United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 84

SEQ ID NO: 3549487 - DNA, 20 bp, Homo sapiens
cggagcgccctgcagggccg

SEQ ID NO: 3549488 - DNA, 13 bp, Homo sapiens
cggagggatggag

SEQ ID NO: 3549489 - DNA, 15 bp, Homo sapiens
cggagggcaggaccc

SEQ ID NO: 3549490 - DNA, 19 bp, Homo sapiens
cggagggctggggatgcgc

SEQ ID NO: 3549491 - DNA, 19 bp, Homo sapiens
cggaggggatccagccact

SEQ ID NO: 3549492 - DNA, 16 bp, Homo sapiens
cggaggggcctggcag

SEQ ID NO: 3549493 - DNA, 18 bp, Homo sapiens
cggaggggcctggcagcc

SEQ ID NO: 3549494 - DNA, 17 bp, Homo sapiens
cggaggtctctgggagc

SEQ ID NO: 3549495 - DNA, 15 bp, Homo sapiens
cggagtcagtgccag

SEQ ID NO: 3549496 - DNA, 16 bp, Homo sapiens
cggagtccactcccag

SEQ ID NO: 3549497 - DNA, 20 bp, Homo sapiens
cggagtccactcccagtgct

SEQ ID NO: 3549498 - DNA, 16 bp, Homo sapiens
cggagtgcctggagtc

SEQ ID NO: 3549499 - DNA, 18 bp, Homo sapiens
cggagtgcctggagtcag

SEQ ID NO: 3549500 - DNA, 14 bp, Homo sapiens
cggatccccttcct

SEQ ID NO: 3549501 - DNA, 19 bp, Homo sapiens
cggatctcacaggctgaga

SEQ ID NO: 3549502 - DNA, 16 bp, Homo sapiens
cggatctgctgggctc

SEQ ID NO: 3549503 - DNA, 17 bp, Homo sapiens
cggatgacaccctggcc

SEQ ID NO: 3549504 - DNA, 20 bp, Homo sapiens
cggatgctactactgcagtc

SEQ ID NO: 3549505 - DNA, 19 bp, Homo sapiens
cggattattttttcagacc

SEQ ID NO: 3549506 - DNA, 17 bp, Homo sapiens
cggcaacgtagcctggg

SEQ ID NO: 3549507 - DNA, 18 bp, Homo sapiens
cggcaacgtagcctgggc

SEQ ID NO: 3549508 - DNA, 16 bp, Homo sapiens
cggcacacactgtgcc

SEQ ID NO: 3549509 - DNA, 14 bp, Homo sapiens
cggcaccctggtct

SEQ ID NO: 3549510 - DNA, 15 bp, Homo sapiens
cggcaccctggtctg

SEQ ID NO: 3549511 - DNA, 13 bp, Homo sapiens
cggcatttgtttc

SEQ ID NO: 3549512 - DNA, 14 bp, Homo sapiens
cggccaaggtgcca

SEQ ID NO: 3549513 - DNA, 17 bp, Homo sapiens
cggccaaggtgccacca

SEQ ID NO: 3549514 - DNA, 20 bp, Homo sapiens
cggccaaggtgccaccaccc

SEQ ID NO: 3549515 - DNA, 16 bp, Homo sapiens
cggccagggagaagct

SEQ ID NO: 3549516 - DNA, 20 bp, Homo sapiens
cggcccatccccaggcacct

SEQ ID NO: 3549517 - DNA, 21 bp, Homo sapiens
cggccccccgcgctcgcccag

SEQ ID NO: 3549518 - DNA, 23 bp, Homo sapiens
cggccccccgcgctcgcccagca

SEQ ID NO: 3549519 - DNA, 18 bp, Homo sapiens
cggcccgcgcagctgcct

SEQ ID NO: 3549520 - DNA, 15 bp, Homo sapiens
cggcccggccggagg

SEQ ID NO: 3549521 - DNA, 20 bp, Homo sapiens
cggccgccccgccccagagc

SEQ ID NO: 3549522 - DNA, 23 bp, Homo sapiens
cggccgccccgccccagagctcc

SEQ ID NO: 3549523 - DNA, 14 bp, Homo sapiens
cggccgcccggcag

SEQ ID NO: 3549524 - DNA, 23 bp, Homo sapiens
cggccgcctttgcgctctcgggt

SEQ ID NO: 3549525 - DNA, 16 bp, Homo sapiens
cggcctccacacctga

SEQ ID NO: 3549526 - DNA, 13 bp, Homo sapiens
cggcctcccagag

SEQ ID NO: 3549527 - DNA, 21 bp, Homo sapiens
cggcctcccagagtgctggga

SEQ ID NO: 3549528 - DNA, 21 bp, Homo sapiens
cggcctccgtccaggagcctg

SEQ ID NO: 3549529 - DNA, 23 bp, Homo sapiens
cggcgggatcctccacagagagg

SEQ ID NO: 3549530 - DNA, 18 bp, Homo sapiens
cggcgggtgacagctccg

SEQ ID NO: 3549531 - DNA, 16 bp, Homo sapiens
cggcggtcccagctcc

SEQ ID NO: 3549532 - DNA, 23 bp, Homo sapiens
cggcgtggtgtgtccctggacac

SEQ ID NO: 3549533 - DNA, 23 bp, Homo sapiens
cggctactggttacctggagaag

SEQ ID NO: 3549534 - DNA, 16 bp, Homo sapiens
cggctcgtgtatttat

SEQ ID NO: 3549535 - DNA, 21 bp, Homo sapiens
cggctcgtgtatttattaccg

SEQ ID NO: 3549536 - DNA, 18 bp, Homo sapiens
cggctgagtggcagcagc

SEQ ID NO: 3549537 - DNA, 15 bp, Homo sapiens
cggctgcacaacagc

SEQ ID NO: 3549538 - DNA, 14 bp, Homo sapiens
cggctgccaggggc

SEQ ID NO: 3549539 - DNA, 23 bp, Homo sapiens
cggctgccaggggctctgtggca

SEQ ID NO: 3549540 - DNA, 17 bp, Homo sapiens
cggcttcgcgctggaat

SEQ ID NO: 3549541 - DNA, 18 bp, Homo sapiens
cgggagacagcttctctg

SEQ ID NO: 3549542 - DNA, 22 bp, Homo sapiens
cgggagacagcttctctgcagt

SEQ ID NO: 3549543 - DNA, 16 bp, Homo sapiens
cgggagcacccagagc

SEQ ID NO: 3549544 - DNA, 17 bp, Homo sapiens
cgggagcacccagagca

SEQ ID NO: 3549545 - DNA, 14 bp, Homo sapiens
cgggagccctagcc

SEQ ID NO: 3549546 - DNA, 15 bp, Homo sapiens
cgggagccctagccc

SEQ ID NO: 3549547 - DNA, 19 bp, Homo sapiens
cgggagccctagccctgct

SEQ ID NO: 3549548 - DNA, 15 bp, Homo sapiens
cgggagccttgtcag

SEQ ID NO: 3549549 - DNA, 17 bp, Homo sapiens
cgggagccttgtcagtg

SEQ ID NO: 3549550 - DNA, 21 bp, Homo sapiens
cgggaggaaaaggcccctgca

SEQ ID NO: 3549551 - DNA, 18 bp, Homo sapiens
cgggatcctccacagaga

SEQ ID NO: 3549552 - DNA, 11 bp, Homo sapiens
cgggcagcccc

SEQ ID NO: 3549553 - DNA, 12 bp, Homo sapiens
cgggcagccccg

SEQ ID NO: 3549554 - DNA, 18 bp, Homo sapiens
cgggcagggggacagcag

SEQ ID NO: 3549555 - DNA, 20 bp, Homo sapiens
cgggcatggtggctcatgcc

SEQ ID NO: 3549556 - DNA, 20 bp, Homo sapiens
cgggccacacgtggctggcg

SEQ ID NO: 3549557 - DNA, 19 bp, Homo sapiens
cgggccccatcctcatccc

SEQ ID NO: 3549558 - DNA, 21 bp, Homo sapiens
cgggccccatcctcatccctg

SEQ ID NO: 3549559 - DNA, 22 bp, Homo sapiens
cgggccccatcctcatccctga

SEQ ID NO: 3549560 - DNA, 22 bp, Homo sapiens
cgggccgtaggggctcctgagt

SEQ ID NO: 3549561 - DNA, 16 bp, Homo sapiens
cgggcctggagaacta

SEQ ID NO: 3549562 - DNA, 14 bp, Homo sapiens
cgggcgcagccctc

SEQ ID NO: 3549563 - DNA, 23 bp, Homo sapiens
cgggcggaggggatccagccact

SEQ ID NO: 3549564 - DNA, 11 bp, Homo sapiens
cgggctcagca

SEQ ID NO: 3549565 - DNA, 18 bp, Homo sapiens
cggggactcggagggtgc

SEQ ID NO: 3549566 - DNA, 23 bp, Homo sapiens
cggggactcggagggtgccgtgc

SEQ ID NO: 3549567 - DNA, 18 bp, Homo sapiens
cggggagaaacccagaga

SEQ ID NO: 3549568 - DNA, 15 bp, Homo sapiens
cggggagggtgacag

SEQ ID NO: 3549569 - DNA, 14 bp, Homo sapiens
cgggggagcccagt

SEQ ID NO: 3549570 - DNA, 15 bp, Homo sapiens
cgggggagcccagtg

SEQ ID NO: 3549571 - DNA, 19 bp, Homo sapiens
cgggggccccacctcggca

SEQ ID NO: 3549572 - DNA, 18 bp, Homo sapiens
cggggtgtaacttcctgc

SEQ ID NO: 3549573 - DNA, 20 bp, Homo sapiens
cggggtgtaacttcctgctg

SEQ ID NO: 3549574 - DNA, 23 bp, Homo sapiens
cggggtgtaacttcctgctgcac

SEQ ID NO: 3549575 - DNA, 23 bp, Homo sapiens
cgggtacttatttctcagctgtg

SEQ ID NO: 3549576 - DNA, 15 bp, Homo sapiens
cgggtcatctgtacc

SEQ ID NO: 3549577 - DNA, 14 bp, Homo sapiens
cgggtgggggaggg

SEQ ID NO: 3549578 - DNA, 20 bp, Homo sapiens
cgggtgggggagggaaaggg

SEQ ID NO: 3549579 - DNA, 18 bp, Homo sapiens
cgggtgtggagaccaggc

SEQ ID NO: 3549580 - DNA, 17 bp, Homo sapiens
cgggttgtgtgtctgtt

SEQ ID NO: 3549581 - DNA, 14 bp, Homo sapiens
cggtaactgtcctg

SEQ ID NO: 3549582 - DNA, 17 bp, Homo sapiens
cggtaactgtcctgtcc

SEQ ID NO: 3549583 - DNA, 18 bp, Homo sapiens
cggtaactgtcctgtcct

SEQ ID NO: 3549584 - DNA, 13 bp, Homo sapiens
cggtacccaccac

SEQ ID NO: 3549585 - DNA, 15 bp, Homo sapiens
cggtatctggcttcc

SEQ ID NO: 3549586 - DNA, 20 bp, Homo sapiens
cggtatctggcttccctgga

SEQ ID NO: 3549587 - DNA, 12 bp, Homo sapiens
cggtctgtgtgc

SEQ ID NO: 3549588 - DNA, 14 bp, Homo sapiens
cggtgctgcaggag

SEQ ID NO: 3549589 - DNA, 17 bp, Homo sapiens
cggtggctgccccggcc

SEQ ID NO: 3549590 - DNA, 14 bp, Homo sapiens
cggtgggcagtggg

SEQ ID NO: 3549591 - DNA, 17 bp, Homo sapiens
cggtgtatcctggccct

SEQ ID NO: 3549592 - DNA, 19 bp, Homo sapiens
cggtgtccccaccatctgc

SEQ ID NO: 3549593 - DNA, 17 bp, Homo sapiens
cggttcctggtgactcc

SEQ ID NO: 3549594 - DNA, 19 bp, Homo sapiens
cggttcctggtgactcctg

SEQ ID NO: 3549595 - DNA, 14 bp, Homo sapiens
cggttgttctttcc

SEQ ID NO: 3549596 - DNA, 21 bp, Homo sapiens
cggtttttttctttggctgca

SEQ ID NO: 3549597 - DNA, 23 bp, Homo sapiens
cggtttttttctttggctgcagg

SEQ ID NO: 3549598 - DNA, 12 bp, Homo sapiens
cgtaaggctgta

SEQ ID NO: 3549599 - DNA, 17 bp, Homo sapiens
cgtaaggctgtacatag

SEQ ID NO: 3549600 - DNA, 23 bp, Homo sapiens
cgtacaaccccctccacccccca

SEQ ID NO: 3549601 - DNA, 15 bp, Homo sapiens
cgtacataataagtt

SEQ ID NO: 3549602 - DNA, 15 bp, Homo sapiens
cgtagcctgggctca

SEQ ID NO: 3549603 - DNA, 17 bp, Homo sapiens
cgtagctctgctgctga

SEQ ID NO: 3549604 - DNA, 16 bp, Homo sapiens
cgtaggggctcctgag

SEQ ID NO: 3549605 - DNA, 17 bp, Homo sapiens
cgtaggggctcctgagt

SEQ ID NO: 3549606 - DNA, 15 bp, Homo sapiens
cgtccagctcagccc

SEQ ID NO: 3549607 - DNA, 22 bp, Homo sapiens
cgtccagctcagccctggcctg

SEQ ID NO: 3549608 - DNA, 12 bp, Homo sapiens
cgtccaggcccc

SEQ ID NO: 3549609 - DNA, 19 bp, Homo sapiens
cgtcccagctgaaggcagt

SEQ ID NO: 3549610 - DNA, 22 bp, Homo sapiens
cgtccggcggccccgccgcaga

SEQ ID NO: 3549611 - DNA, 22 bp, Homo sapiens
cgtcctctcggctgccaggggc

SEQ ID NO: 3549612 - DNA, 17 bp, Homo sapiens
cgtcggactgcccccag

SEQ ID NO: 3549613 - DNA, 19 bp, Homo sapiens
cgtcggactgcccccagaa

SEQ ID NO: 3549614 - DNA, 15 bp, Homo sapiens
cgtcggtcctggtgc

SEQ ID NO: 3549615 - DNA, 19 bp, Homo sapiens
cgtctctaatgtctgcagc

SEQ ID NO: 3549616 - DNA, 20 bp, Homo sapiens
cgtctctaatgtctgcagct

SEQ ID NO: 3549617 - DNA, 19 bp, Homo sapiens
cgtctctactaaaaatgca

SEQ ID NO: 3549618 - DNA, 13 bp, Homo sapiens
cgtctctgccctg

SEQ ID NO: 3549619 - DNA, 14 bp, Homo sapiens
cgtctctgccctgg

SEQ ID NO: 3549620 - DNA, 14 bp, Homo sapiens
cgtctgaggcctgc

SEQ ID NO: 3549621 - DNA, 17 bp, Homo sapiens
cgtctggcccaccaggg

SEQ ID NO: 3549622 - DNA, 20 bp, Homo sapiens
cgtgagagaaagagagaagc

SEQ ID NO: 3549623 - DNA, 18 bp, Homo sapiens
cgtgagctggggactcag

SEQ ID NO: 3549624 - DNA, 23 bp, Homo sapiens
cgtgagctggggactcagggacc

SEQ ID NO: 3549625 - DNA, 20 bp, Homo sapiens
cgtgaggggcaagctaggcc

SEQ ID NO: 3549626 - DNA, 18 bp, Homo sapiens
cgtgatcaaagccacact

SEQ ID NO: 3549627 - DNA, 15 bp, Homo sapiens
cgtgatgggctaggc

SEQ ID NO: 3549628 - DNA, 17 bp, Homo sapiens
cgtgcaaagccaaggca

SEQ ID NO: 3549629 - DNA, 20 bp, Homo sapiens
cgtgcattaaaatttcttat

SEQ ID NO: 3549630 - DNA, 22 bp, Homo sapiens
cgtgccaccccgagggctgagc

SEQ ID NO: 3549631 - DNA, 16 bp, Homo sapiens
cgtgccccttccctgg

SEQ ID NO: 3549632 - DNA, 19 bp, Homo sapiens
cgtgccccttccctgggtt

SEQ ID NO: 3549633 - DNA, 15 bp, Homo sapiens
cgtgccttcagctct

SEQ ID NO: 3549634 - DNA, 19 bp, Homo sapiens
cgtgctccgtagctctgct

SEQ ID NO: 3549635 - DNA, 20 bp, Homo sapiens
cgtgctccgtagctctgctg

SEQ ID NO: 3549636 - DNA, 21 bp, Homo sapiens
cgtgctccgtagctctgctgc

SEQ ID NO: 3549637 - DNA, 18 bp, Homo sapiens
cgtggcacagctgggagc

SEQ ID NO: 3549638 - DNA, 22 bp, Homo sapiens
ttttggtttgccttttatgtaa

SEQ ID NO: 3549639 - DNA, 21 bp, Homo sapiens
ttttgtaaatgaaacttaaga

SEQ ID NO: 3549640 - DNA, 13 bp, Homo sapiens
ttttgtaataaac

SEQ ID NO: 3549641 - DNA, 14 bp, Homo sapiens
ttttgtaataaact

SEQ ID NO: 3549642 - DNA, 18 bp, Homo sapiens
ttttgtagttttatttgt

SEQ ID NO: 3549643 - DNA, 20 bp, Homo sapiens
ttttgtagttttatttgtat

SEQ ID NO: 3549644 - DNA, 21 bp, Homo sapiens
ttttgtagttttatttgtatt

SEQ ID NO: 3549645 - DNA, 23 bp, Homo sapiens
ttttgtataattggatttcctaa

SEQ ID NO: 3549646 - DNA, 24 bp, Homo sapiens
ttttgtataattggatttcctaat

SEQ ID NO: 3549647 - DNA, 18 bp, Homo sapiens
ttttgtcactttttctga

SEQ ID NO: 3549648 - DNA, 15 bp, Homo sapiens
ttttgttagcaaaga

SEQ ID NO: 3549649 - DNA, 21 bp, Homo sapiens
ttttgttggcatagctctggg

SEQ ID NO: 3549650 - DNA, 14 bp, Homo sapiens
tttttaaaaaaact

SEQ ID NO: 3549651 - DNA, 19 bp, Homo sapiens
tttttaaaaaggtaaatgg

SEQ ID NO: 3549652 - DNA, 17 bp, Homo sapiens
tttttaaagacagggtc

SEQ ID NO: 3549653 - DNA, 15 bp, Homo sapiens
tttttaaatgtatac

SEQ ID NO: 3549654 - DNA, 23 bp, Homo sapiens
tttttaaatgtatactatagtac

SEQ ID NO: 3549655 - DNA, 12 bp, Homo sapiens
tttttaactttt

SEQ ID NO: 3549656 - DNA, 20 bp, Homo sapiens
tttttaagaaagtaatttaa

SEQ ID NO: 3549657 - DNA, 21 bp, Homo sapiens
tttttaaggtctaatcagtga

SEQ ID NO: 3549658 - DNA, 20 bp, Homo sapiens
tttttaagtgaaaatatagc

SEQ ID NO: 3549659 - DNA, 17 bp, Homo sapiens
tttttaataaagacagg

SEQ ID NO: 3549660 - DNA, 16 bp, Homo sapiens
tttttacatccttgat

SEQ ID NO: 3549661 - DNA, 11 bp, Homo sapiens
tttttacattt

SEQ ID NO: 3549662 - DNA, 13 bp, Homo sapiens
tttttacatttca

SEQ ID NO: 3549663 - DNA, 12 bp, Homo sapiens
tttttacatttt

SEQ ID NO: 3549664 - DNA, 17 bp, Homo sapiens
tttttagaaatgtgaag

SEQ ID NO: 3549665 - DNA, 16 bp, Homo sapiens
tttttaggcaaagata

SEQ ID NO: 3549666 - DNA, 15 bp, Homo sapiens
tttttatacactgta

SEQ ID NO: 3549667 - DNA, 19 bp, Homo sapiens
tttttatacactgtaagct

SEQ ID NO: 3549668 - DNA, 13 bp, Homo sapiens
tttttatatatta

SEQ ID NO: 3549669 - DNA, 22 bp, Homo sapiens
tttttatctggttctatatgaa

SEQ ID NO: 3549670 - DNA, 10 bp, Homo sapiens
tttttcagac

SEQ ID NO: 3549671 - DNA, 12 bp, Homo sapiens
tttttcagaccg

SEQ ID NO: 3549672 - DNA, 13 bp, Homo sapiens
tttttcatgtttt

SEQ ID NO: 3549673 - DNA, 19 bp, Homo sapiens
tttttcccagctacacctt

SEQ ID NO: 3549674 - DNA, 13 bp, Homo sapiens
tttttcccatgag

SEQ ID NO: 3549675 - DNA, 11 bp, Homo sapiens
tttttcctttt

SEQ ID NO: 3549676 - DNA, 17 bp, Homo sapiens
tttttctgataaaagat

SEQ ID NO: 3549677 - DNA, 14 bp, Homo sapiens
tttttctgtaccag

SEQ ID NO: 3549678 - DNA, 13 bp, Homo sapiens
tttttgaggcaaa

SEQ ID NO: 3549679 - DNA, 12 bp, Homo sapiens
tttttggtcaaa

SEQ ID NO: 3549680 - DNA, 11 bp, Homo sapiens
tttttgtcatg

SEQ ID NO: 3549681 - DNA, 13 bp, Homo sapiens
ttttttactcttt

SEQ ID NO: 3549682 - DNA, 17 bp, Homo sapiens
ttttttactctttgaaa

SEQ ID NO: 3549683 - DNA, 13 bp, Homo sapiens
ttttttccactta

SEQ ID NO: 3549684 - DNA, 13 bp, Homo sapiens
ttttttgaaacac

SEQ ID NO: 3549685 - DNA, 16 bp, Homo sapiens
ttttttgggcagcaat

SEQ ID NO: 3549686 - DNA, 21 bp, Homo sapiens
tttgtatcttttatcctggga

SEQ ID NO: 3549687 - DNA, 13 bp, Homo sapiens
tttgtattcaaaa

SEQ ID NO: 3549688 - DNA, 14 bp, Homo sapiens
tttgtattgtatat

SEQ ID NO: 3549689 - DNA, 14 bp, Homo sapiens
tttgtcatggtgaa

SEQ ID NO: 3549690 - DNA, 16 bp, Homo sapiens
tttgtcatggtgaaat

SEQ ID NO: 3549691 - DNA, 14 bp, Homo sapiens
tttgtcattcagtt

SEQ ID NO: 3549692 - DNA, 12 bp, Homo sapiens
tttgtcccaggt

SEQ ID NO: 3549693 - DNA, 19 bp, Homo sapiens
tttgtcctgatgcttttgt

SEQ ID NO: 3549694 - DNA, 12 bp, Homo sapiens
tttgtcttaaaa

SEQ ID NO: 3549695 - DNA, 17 bp, Homo sapiens
tttgtctttctttgtca

SEQ ID NO: 3549696 - DNA, 20 bp, Homo sapiens
tttgtgaaacagacttgtat

SEQ ID NO: 3549697 - DNA, 22 bp, Homo sapiens
tttgtgaaatgatggtgaaagt

SEQ ID NO: 3549698 - DNA, 22 bp, Homo sapiens
tttgtgaattaggctgtaacta

SEQ ID NO: 3549699 - DNA, 18 bp, Homo sapiens
tttgtgaccagaaagctt

SEQ ID NO: 3549700 - DNA, 12 bp, Homo sapiens
tttgtgcctttg

SEQ ID NO: 3549701 - DNA, 17 bp, Homo sapiens
tttgtgcctttggcctg

SEQ ID NO: 3549702 - DNA, 19 bp, Homo sapiens
tttgtgctttttgtcatgt

SEQ ID NO: 3549703 - DNA, 20 bp, Homo sapiens
tttgtggaaagtcacaggtc

SEQ ID NO: 3549704 - DNA, 20 bp, Homo sapiens
tttgtggccaaggagctgct

SEQ ID NO: 3549705 - DNA, 21 bp, Homo sapiens
tttgtggccaaggagctgcta

SEQ ID NO: 3549706 - DNA, 11 bp, Homo sapiens
tttgtggggag

SEQ ID NO: 3549707 - DNA, 16 bp, Homo sapiens
tttgtgtcgtcttgaa

SEQ ID NO: 3549708 - DNA, 16 bp, Homo sapiens
tttgttaatatttctt

SEQ ID NO: 3549709 - DNA, 15 bp, Homo sapiens
tttgttagcaaagat

SEQ ID NO: 3549710 - DNA, 20 bp, Homo sapiens
tttgttagcaaagattaaat

SEQ ID NO: 3549711 - DNA, 14 bp, Homo sapiens
tttgttaggttttc

SEQ ID NO: 3549712 - DNA, 16 bp, Homo sapiens
tttgttgaaagaaagt

SEQ ID NO: 3549713 - DNA, 18 bp, Homo sapiens
tttgttgctttcttacct

SEQ ID NO: 3549714 - DNA, 15 bp, Homo sapiens
tttgtttcctttgtt

SEQ ID NO: 3549715 - DNA, 16 bp, Homo sapiens
ttttaaaaaatggtca

SEQ ID NO: 3549716 - DNA, 19 bp, Homo sapiens
ttttaaaaattgttattta

SEQ ID NO: 3549717 - DNA, 16 bp, Homo sapiens
ttttaaaacacttcca

SEQ ID NO: 3549718 - DNA, 21 bp, Homo sapiens
ttttaaaaggatgtataaatt

SEQ ID NO: 3549719 - DNA, 19 bp, Homo sapiens
ttttaaacagtgagcctga

SEQ ID NO: 3549720 - DNA, 14 bp, Homo sapiens
ttttaaatcttgac

SEQ ID NO: 3549721 - DNA, 12 bp, Homo sapiens
ttttaaattgtt

SEQ ID NO: 3549722 - DNA, 18 bp, Homo sapiens
ttttaagaaagtaattta

SEQ ID NO: 3549723 - DNA, 23 bp, Homo sapiens
ttttaagggtttgtggaaaatga

SEQ ID NO: 3549724 - DNA, 15 bp, Homo sapiens
ttttaagtatttagg

SEQ ID NO: 3549725 - DNA, 12 bp, Homo sapiens
ttttaataaact

SEQ ID NO: 3549726 - DNA, 15 bp, Homo sapiens
ttttaataaactact

SEQ ID NO: 3549727 - DNA, 21 bp, Homo sapiens
ttttaataaactactctttga

SEQ ID NO: 3549728 - DNA, 19 bp, Homo sapiens
ttttaataccacagctatt

SEQ ID NO: 3549729 - DNA, 23 bp, Homo sapiens
ttttaatcctgtaccaaatctga

SEQ ID NO: 3549730 - DNA, 14 bp, Homo sapiens
ttttaatttaaaaa

SEQ ID NO: 3549731 - DNA, 16 bp, Homo sapiens
ttttaattttcagttc

SEQ ID NO: 3549732 - DNA, 19 bp, Homo sapiens
ttttacaaaaaagaaaaga

SEQ ID NO: 3549733 - DNA, 21 bp, Homo sapiens
ttttacatccttgattacttc

SEQ ID NO: 3549734 - DNA, 15 bp, Homo sapiens
ttttacatctaaact

SEQ ID NO: 3549735 - DNA, 17 bp, Homo sapiens
ttttacatgacagatat

SEQ ID NO: 3549736 - DNA, 15 bp, Homo sapiens
ttttaccaaagcatc

SEQ ID NO: 3549737 - DNA, 16 bp, Homo sapiens
ttttacctattctgaa

SEQ ID NO: 3549738 - DNA, 23 bp, Homo sapiens
ttttacgtagctatttttataca

SEQ ID NO: 3549739 - DNA, 23 bp, Homo sapiens
ttttactgccctttcaaagcact

SEQ ID NO: 3549740 - DNA, 21 bp, Homo sapiens
ttttagaagattctatgttaa

SEQ ID NO: 3549741 - DNA, 19 bp, Homo sapiens
ttttagaatgtcaataaat

SEQ ID NO: 3549742 - DNA, 18 bp, Homo sapiens
ttttagaattttgtgaaa

SEQ ID NO: 3549743 - DNA, 13 bp, Homo sapiens
ttttaggcaaaga

SEQ ID NO: 3549744 - DNA, 20 bp, Homo sapiens
ttttaggccaaaaaaatgta

SEQ ID NO: 3549745 - DNA, 16 bp, Homo sapiens
ttttagtgtaaaattg

SEQ ID NO: 3549746 - DNA, 14 bp, Homo sapiens
ttttataaattaaa

SEQ ID NO: 3549747 - DNA, 21 bp, Homo sapiens
ttttatactgctctataaata

SEQ ID NO: 3549748 - DNA, 19 bp, Homo sapiens
ttttatcccatttagtgtg

SEQ ID NO: 3549749 - DNA, 16 bp, Homo sapiens
ttttatcgcagatttt

SEQ ID NO: 3549750 - DNA, 21 bp, Homo sapiens
ttttatctggttctatatgaa

SEQ ID NO: 3549751 - DNA, 14 bp, Homo sapiens
ttttatctgtttaa

SEQ ID NO: 3549752 - DNA, 18 bp, Homo sapiens
ttttatgccagttgttaa

SEQ ID NO: 3549753 - DNA, 23 bp, Homo sapiens
ttttatggaggctttgcatagat

SEQ ID NO: 3549754 - DNA, 13 bp, Homo sapiens
ttttatgtaaatt

SEQ ID NO: 3549755 - DNA, 16 bp, Homo sapiens
ttttatgtattttcca

SEQ ID NO: 3549756 - DNA, 13 bp, Homo sapiens
ttttatgtctttc

SEQ ID NO: 3549757 - DNA, 20 bp, Homo sapiens
ttttattgtattttgatgag

SEQ ID NO: 3549758 - DNA, 19 bp, Homo sapiens
ttttatttaacagtgcaaa

SEQ ID NO: 3549759 - DNA, 15 bp, Homo sapiens
ttttatttgtaaagt

SEQ ID NO: 3549760 - DNA, 17 bp, Homo sapiens
ttttatttgtaaagtga

SEQ ID NO: 3549761 - DNA, 13 bp, Homo sapiens
ttttatttgtatt

SEQ ID NO: 3549762 - DNA, 21 bp, Homo sapiens
ttttatttttctcatgatgag

SEQ ID NO: 3549763 - DNA, 15 bp, Homo sapiens
ttttcaaatgttctc

SEQ ID NO: 3549764 - DNA, 12 bp, Homo sapiens
ttttcaaattaa

SEQ ID NO: 3549765 - DNA, 21 bp, Homo sapiens
ttttcaacgcagccctgcttt

SEQ ID NO: 3549766 - DNA, 13 bp, Homo sapiens
ttttcaactgcca

SEQ ID NO: 3549767 - DNA, 23 bp, Homo sapiens
ttttcaactgccaaaatgctcta

SEQ ID NO: 3549768 - DNA, 15 bp, Homo sapiens
ttttcaagaaactga

SEQ ID NO: 3549769 - DNA, 13 bp, Homo sapiens
ttttcaatatgca

SEQ ID NO: 3549770 - DNA, 10 bp, Homo sapiens
ttttcaatta

SEQ ID NO: 3549771 - DNA, 22 bp, Homo sapiens
ttttcaattaaacggattattt

SEQ ID NO: 3549772 - DNA, 19 bp, Homo sapiens
ttttcactgctggctgcct

SEQ ID NO: 3549773 - DNA, 13 bp, Homo sapiens
ttttcacttctgt

SEQ ID NO: 3549774 - DNA, 11 bp, Homo sapiens
ttttcagaccg

SEQ ID NO: 3549775 - DNA, 14 bp, Homo sapiens
ttttcagttctatt

SEQ ID NO: 3549776 - DNA, 16 bp, Homo sapiens
ttttcataagatattt

SEQ ID NO: 3549777 - DNA, 16 bp, Homo sapiens
ttttcatcatttcagc

SEQ ID NO: 3549778 - DNA, 11 bp, Homo sapiens
ttttcatgttt

SEQ ID NO: 3549779 - DNA, 20 bp, Homo sapiens
ttttccagctccgtgtttct

SEQ ID NO: 3549780 - DNA, 21 bp, Homo sapiens
ttttccagggtgtagcctaca

SEQ ID NO: 3549781 - DNA, 19 bp, Homo sapiens
ttttcccagctacaccttt

SEQ ID NO: 3549782 - DNA, 12 bp, Homo sapiens
ttttcccccttc

SEQ ID NO: 3549783 - DNA, 18 bp, Homo sapiens
ttttccctggaactcctg

SEQ ID NO: 3549784 - DNA, 18 bp, Homo sapiens
ttttccgcattctttgta

SEQ ID NO: 3549785 - DNA, 15 bp, Homo sapiens
ttttccgtaaatgtc

SEQ ID NO: 3549786 - DNA, 19 bp, Homo sapiens
ttttccgtcacttaaattt

SEQ ID NO: 3549787 - DNA, 21 bp, Homo sapiens
ttttcctctcgagatagtttt

SEQ ID NO: 3549788 - DNA, 20 bp, Homo sapiens
ttttcctggcagctgctgtg

SEQ ID NO: 3549789 - DNA, 14 bp, Homo sapiens
ttttcctgttcata

SEQ ID NO: 3549790 - DNA, 14 bp, Homo sapiens
ttttcggcagcctt

SEQ ID NO: 3549791 - DNA, 17 bp, Homo sapiens
ttttctatttatgcctt

SEQ ID NO: 3549792 - DNA, 20 bp, Homo sapiens
ttttctctgcatttaaaaaa

SEQ ID NO: 3549793 - DNA, 21 bp, Homo sapiens
ttttctctggtaatattgact

SEQ ID NO: 3549794 - DNA, 13 bp, Homo sapiens
ttttctcttcata

SEQ ID NO: 3549795 - DNA, 21 bp, Homo sapiens
ttttctgtaccagttaatttt

SEQ ID NO: 3549796 - DNA, 14 bp, Homo sapiens
ttttcttaagaaat

SEQ ID NO: 3549797 - DNA, 13 bp, Homo sapiens
ttttcttatttca

SEQ ID NO: 3549798 - DNA, 16 bp, Homo sapiens
ttttcttcaaatgttt

SEQ ID NO: 3549799 - DNA, 15 bp, Homo sapiens
ttttcttcactgtcc

SEQ ID NO: 3549800 - DNA, 13 bp, Homo sapiens
ttttcttctttct

SEQ ID NO: 3549801 - DNA, 19 bp, Homo sapiens
ttttcttgataattttcct

SEQ ID NO: 3549802 - DNA, 15 bp, Homo sapiens
ttttctttgaataaa

SEQ ID NO: 3549803 - DNA, 20 bp, Homo sapiens
ttttctttgaataaatgtca

SEQ ID NO: 3549804 - DNA, 15 bp, Homo sapiens
ttttctttggctgca

SEQ ID NO: 3549805 - DNA, 11 bp, Homo sapiens
ttttcttttct

SEQ ID NO: 3549806 - DNA, 17 bp, Homo sapiens
ttttctttttcttaaga

SEQ ID NO: 3549807 - DNA, 13 bp, Homo sapiens
ttttgaaatacct

SEQ ID NO: 3549808 - DNA, 19 bp, Homo sapiens
ttttgaaatacctttgtag

SEQ ID NO: 3549809 - DNA, 13 bp, Homo sapiens
ttttgaatacatt

SEQ ID NO: 3549810 - DNA, 20 bp, Homo sapiens
ttttgatcttgtgctatgaa

SEQ ID NO: 3549811 - DNA, 22 bp, Homo sapiens
ttttgatgagatattaaattct

SEQ ID NO: 3549812 - DNA, 20 bp, Homo sapiens
ttttgattaaccttttcaaa

SEQ ID NO: 3549813 - DNA, 19 bp, Homo sapiens
ttttgccgtggcttgggga

SEQ ID NO: 3549814 - DNA, 14 bp, Homo sapiens
ttttgctaactggg

SEQ ID NO: 3549815 - DNA, 15 bp, Homo sapiens
ttttgctaactggtt

SEQ ID NO: 3549816 - DNA, 17 bp, Homo sapiens
ttttgctaactggttaa

SEQ ID NO: 3549817 - DNA, 18 bp, Homo sapiens
ttttgctaactggttaaa

SEQ ID NO: 3549818 - DNA, 20 bp, Homo sapiens
ttttgctgaattcctttaca

SEQ ID NO: 3549819 - DNA, 17 bp, Homo sapiens
ttttggatgttgctata

SEQ ID NO: 3549820 - DNA, 21 bp, Homo sapiens
ttttgggggtcagcatccagt

SEQ ID NO: 3549821 - DNA, 19 bp, Homo sapiens
ttttgggtactttctatct

SEQ ID NO: 3549822 - DNA, 20 bp, Homo sapiens
ttttggtccttctttcctct

SEQ ID NO: 3549823 - DNA, 20 bp, Homo sapiens
tttctagtacctgtgactct

SEQ ID NO: 3549824 - DNA, 23 bp, Homo sapiens
tttctagtacctgtgactcttag

SEQ ID NO: 3549825 - DNA, 15 bp, Homo sapiens
tttctatataaaatg

SEQ ID NO: 3549826 - DNA, 15 bp, Homo sapiens
tttctatattcctcc

SEQ ID NO: 3549827 - DNA, 12 bp, Homo sapiens
tttctatgaaag

SEQ ID NO: 3549828 - DNA, 15 bp, Homo sapiens
tttctcaatgcttag

SEQ ID NO: 3549829 - DNA, 12 bp, Homo sapiens
tttctcatgttg

SEQ ID NO: 3549830 - DNA, 15 bp, Homo sapiens
tttctcatgttgaaa

SEQ ID NO: 3549831 - DNA, 16 bp, Homo sapiens
tttctccatcccctcc

SEQ ID NO: 3549832 - DNA, 13 bp, Homo sapiens
tttctcccaagaa

SEQ ID NO: 3549833 - DNA, 16 bp, Homo sapiens
tttctcccaagaaacc

SEQ ID NO: 3549834 - DNA, 19 bp, Homo sapiens
tttctcccaagaaacctga

SEQ ID NO: 3549835 - DNA, 17 bp, Homo sapiens
tttctcccagtcattta

SEQ ID NO: 3549836 - DNA, 15 bp, Homo sapiens
tttctcctcccagga

SEQ ID NO: 3549837 - DNA, 14 bp, Homo sapiens
tttctccttttcct

SEQ ID NO: 3549838 - DNA, 16 bp, Homo sapiens
tttctccttttcctat

SEQ ID NO: 3549839 - DNA, 15 bp, Homo sapiens
tttctctaatgcttg

SEQ ID NO: 3549840 - DNA, 14 bp, Homo sapiens
tttctctacactaa

SEQ ID NO: 3549841 - DNA, 15 bp, Homo sapiens
tttctctacactaag

SEQ ID NO: 3549842 - DNA, 16 bp, Homo sapiens
tttctctattatgtta

SEQ ID NO: 3549843 - DNA, 14 bp, Homo sapiens
tttctctcagtgaa

SEQ ID NO: 3549844 - DNA, 18 bp, Homo sapiens
tttctctctcctctctgc

SEQ ID NO: 3549845 - DNA, 14 bp, Homo sapiens
tttctctcttttgt

SEQ ID NO: 3549846 - DNA, 18 bp, Homo sapiens
tttctcttccccttagaa

SEQ ID NO: 3549847 - DNA, 20 bp, Homo sapiens
tttctcttccccttagaaac

SEQ ID NO: 3549848 - DNA, 18 bp, Homo sapiens
tttctcttccccttcctg

SEQ ID NO: 3549849 - DNA, 13 bp, Homo sapiens
tttctcttttctt

SEQ ID NO: 3549850 - DNA, 16 bp, Homo sapiens
tttctctttttgatct

SEQ ID NO: 3549851 - DNA, 13 bp, Homo sapiens
tttctgagaaaga

SEQ ID NO: 3549852 - DNA, 15 bp, Homo sapiens
tttctgagaaagact

SEQ ID NO: 3549853 - DNA, 16 bp, Homo sapiens
tttctgaggtccttat

SEQ ID NO: 3549854 - DNA, 21 bp, Homo sapiens
tttctgattctgattgctatc

SEQ ID NO: 3549855 - DNA, 20 bp, Homo sapiens
tttctgccaataaattctaa

SEQ ID NO: 3549856 - DNA, 15 bp, Homo sapiens
tttctgctctggaat

SEQ ID NO: 3549857 - DNA, 18 bp, Homo sapiens
tttctgctttaaaaatgt

SEQ ID NO: 3549858 - DNA, 21 bp, Homo sapiens
tttctggaatacatgaaatat

SEQ ID NO: 3549859 - DNA, 13 bp, Homo sapiens
tttcttaaaatgt

SEQ ID NO: 3549860 - DNA, 23 bp, Homo sapiens
tttcttaagcaacaatggatatt

SEQ ID NO: 3549861 - DNA, 17 bp, Homo sapiens
tttcttatttcatttct

SEQ ID NO: 3549862 - DNA, 14 bp, Homo sapiens
tttcttcaaatgtt

SEQ ID NO: 3549863 - DNA, 15 bp, Homo sapiens
tttcttcactctggc

SEQ ID NO: 3549864 - DNA, 20 bp, Homo sapiens
tttcttcacttacaagaaag

SEQ ID NO: 3549865 - DNA, 14 bp, Homo sapiens
tttcttcgctggac

SEQ ID NO: 3549866 - DNA, 13 bp, Homo sapiens
tttcttctttcct

SEQ ID NO: 3549867 - DNA, 15 bp, Homo sapiens
tttcttctttccttt

SEQ ID NO: 3549868 - DNA, 14 bp, Homo sapiens
tttcttcttttcct

SEQ ID NO: 3549869 - DNA, 14 bp, Homo sapiens
tttcttgataattt

SEQ ID NO: 3549870 - DNA, 18 bp, Homo sapiens
tttctttgcaccaaagac

SEQ ID NO: 3549871 - DNA, 15 bp, Homo sapiens
tttctttgtgtagct

SEQ ID NO: 3549872 - DNA, 14 bp, Homo sapiens
tttcttttctttat

SEQ ID NO: 3549873 - DNA, 20 bp, Homo sapiens
tttcttttgcaggagtttgt

SEQ ID NO: 3549874 - DNA, 16 bp, Homo sapiens
tttgaaaaaaacttca

SEQ ID NO: 3549875 - DNA, 18 bp, Homo sapiens
tttgaaaagcagacattt

SEQ ID NO: 3549876 - DNA, 23 bp, Homo sapiens
tttgaaaattacatgttttttca

SEQ ID NO: 3549877 - DNA, 17 bp, Homo sapiens
tttgaaacacaatacct

SEQ ID NO: 3549878 - DNA, 18 bp, Homo sapiens
tttgaaagaagcaagaca

SEQ ID NO: 3549879 - DNA, 20 bp, Homo sapiens
tttgaaagacagagtcttca

SEQ ID NO: 3549880 - DNA, 19 bp, Homo sapiens
tttgaaatacctttgtagt

SEQ ID NO: 3549881 - DNA, 22 bp, Homo sapiens
tttgaaatacctttgtagttac

SEQ ID NO: 3549882 - DNA, 20 bp, Homo sapiens
tttgaaatccagaagtttta

SEQ ID NO: 3549883 - DNA, 13 bp, Homo sapiens
tttgaaatggaaa

SEQ ID NO: 3549884 - DNA, 15 bp, Homo sapiens
tttgaaattatgtga

SEQ ID NO: 3549885 - DNA, 14 bp, Homo sapiens
tttgaactcttcaa

SEQ ID NO: 3549886 - DNA, 18 bp, Homo sapiens
tttgaagaccaatcaaat

SEQ ID NO: 3549887 - DNA, 12 bp, Homo sapiens
tttgaagcaact

SEQ ID NO: 3549888 - DNA, 14 bp, Homo sapiens
tttgaaggagaatg

SEQ ID NO: 3549889 - DNA, 15 bp, Homo sapiens
tttgaagtgctgttt

SEQ ID NO: 3549890 - DNA, 14 bp, Homo sapiens
tttgaatatgtagt

SEQ ID NO: 3549891 - DNA, 19 bp, Homo sapiens
tttgaatatgtagtatcta

SEQ ID NO: 3549892 - DNA, 18 bp, Homo sapiens
tttgacagtgttgaaaat

SEQ ID NO: 3549893 - DNA, 15 bp, Homo sapiens
tttgacatttttgcc

SEQ ID NO: 3549894 - DNA, 21 bp, Homo sapiens
tttgaccagaactttttcctc

SEQ ID NO: 3549895 - DNA, 20 bp, Homo sapiens
tttgaccagtttaagccgca

SEQ ID NO: 3549896 - DNA, 20 bp, Homo sapiens
tttgagatggagtttctctc

SEQ ID NO: 3549897 - DNA, 22 bp, Homo sapiens
tttgaggaagtggctgtccctg

SEQ ID NO: 3549898 - DNA, 14 bp, Homo sapiens
tttgaggcaaaaga

SEQ ID NO: 3549899 - DNA, 15 bp, Homo sapiens
tttgaggcaaaagaa

SEQ ID NO: 3549900 - DNA, 19 bp, Homo sapiens
tttgaggtctagagagaac

SEQ ID NO: 3549901 - DNA, 13 bp, Homo sapiens
tttgatatttgca

SEQ ID NO: 3549902 - DNA, 20 bp, Homo sapiens
tttgatgtaaagatgttctg

SEQ ID NO: 3549903 - DNA, 18 bp, Homo sapiens
tttgattaaccttttcaa

SEQ ID NO: 3549904 - DNA, 20 bp, Homo sapiens
tttgattaaccttttcaaat

SEQ ID NO: 3549905 - DNA, 18 bp, Homo sapiens
tttgcactgatatatcat

SEQ ID NO: 3549906 - DNA, 16 bp, Homo sapiens
tttgcaggagtttgtg

SEQ ID NO: 3549907 - DNA, 21 bp, Homo sapiens
tttgcatagattccctgagca

SEQ ID NO: 3549908 - DNA, 21 bp, Homo sapiens
tttgcatattttgagaaactg

SEQ ID NO: 3549909 - DNA, 22 bp, Homo sapiens
tttgcatattttgagaaactgc

SEQ ID NO: 3549910 - DNA, 13 bp, Homo sapiens
tttgcatctttgt

SEQ ID NO: 3549911 - DNA, 18 bp, Homo sapiens
tttgccaaggctctcccc

SEQ ID NO: 3549912 - DNA, 13 bp, Homo sapiens
tttgccaataaag

SEQ ID NO: 3549913 - DNA, 17 bp, Homo sapiens
tttgccaataaagcttt

SEQ ID NO: 3549914 - DNA, 20 bp, Homo sapiens
tttgccagaggaccaatgct

SEQ ID NO: 3549915 - DNA, 20 bp, Homo sapiens
tttgccagttttccctggaa

SEQ ID NO: 3549916 - DNA, 22 bp, Homo sapiens
tttgccatatggaggactgtga

SEQ ID NO: 3549917 - DNA, 20 bp, Homo sapiens
tttgcctcttctttgtgcct

SEQ ID NO: 3549918 - DNA, 22 bp, Homo sapiens
tttgcctcttctttgtgccttt

SEQ ID NO: 3549919 - DNA, 16 bp, Homo sapiens
tttgcctgaggctgta

SEQ ID NO: 3549920 - DNA, 22 bp, Homo sapiens
tttgcgaatattttgtaaatta

SEQ ID NO: 3549921 - DNA, 17 bp, Homo sapiens
tttgctaactgggttaa

SEQ ID NO: 3549922 - DNA, 19 bp, Homo sapiens
tttgctcaaaattgcttct

SEQ ID NO: 3549923 - DNA, 12 bp, Homo sapiens
tttgctcaacag

SEQ ID NO: 3549924 - DNA, 20 bp, Homo sapiens
tttgctctaccaaatagtga

SEQ ID NO: 3549925 - DNA, 22 bp, Homo sapiens
tttgctctctgtgaccctaaga

SEQ ID NO: 3549926 - DNA, 17 bp, Homo sapiens
tttgctgaattccttta

SEQ ID NO: 3549927 - DNA, 18 bp, Homo sapiens
tttgctgaattcctttac

SEQ ID NO: 3549928 - DNA, 18 bp, Homo sapiens
tttgctgcccctgtctgg

SEQ ID NO: 3549929 - DNA, 13 bp, Homo sapiens
tttgctgtgcttt

SEQ ID NO: 3549930 - DNA, 16 bp, Homo sapiens
tttggaaagactggac

SEQ ID NO: 3549931 - DNA, 20 bp, Homo sapiens
tttggacacatttaaggtgt

SEQ ID NO: 3549932 - DNA, 23 bp, Homo sapiens
tttggacagctgataaatttaat

SEQ ID NO: 3549933 - DNA, 19 bp, Homo sapiens
tttggagaaggtctgtggt

SEQ ID NO: 3549934 - DNA, 18 bp, Homo sapiens
tttggagagtttcctgaa

SEQ ID NO: 3549935 - DNA, 14 bp, Homo sapiens
tttggatggtttgt

SEQ ID NO: 3549936 - DNA, 21 bp, Homo sapiens
tttggatgttgctatagtgac

SEQ ID NO: 3549937 - DNA, 18 bp, Homo sapiens
tttggcagccatgataat

SEQ ID NO: 3549938 - DNA, 16 bp, Homo sapiens
tttgggagacatgtga

SEQ ID NO: 3549939 - DNA, 18 bp, Homo sapiens
tttgggagacatgtgaca

SEQ ID NO: 3549940 - DNA, 22 bp, Homo sapiens
tttgggggaaaatttagaaata

SEQ ID NO: 3549941 - DNA, 20 bp, Homo sapiens
tttgggtgtttttcatgttt

SEQ ID NO: 3549942 - DNA, 21 bp, Homo sapiens
tttgggtgtttttcatgtttt

SEQ ID NO: 3549943 - DNA, 14 bp, Homo sapiens
tttgggttctgcct

SEQ ID NO: 3549944 - DNA, 12 bp, Homo sapiens
tttggtcaaatt

SEQ ID NO: 3549945 - DNA, 21 bp, Homo sapiens
tttggtgcttctcagatttct

SEQ ID NO: 3549946 - DNA, 13 bp, Homo sapiens
tttggttcaattt

SEQ ID NO: 3549947 - DNA, 20 bp, Homo sapiens
tttggttccttctctgggtc

SEQ ID NO: 3549948 - DNA, 21 bp, Homo sapiens
tttgtaaaaatgagtcatttg

SEQ ID NO: 3549949 - DNA, 22 bp, Homo sapiens
tttgtaaatgaaacttaagaat

SEQ ID NO: 3549950 - DNA, 23 bp, Homo sapiens
tttgtaactgtaaagatgaatgt

SEQ ID NO: 3549951 - DNA, 12 bp, Homo sapiens
tttgtaataaac

SEQ ID NO: 3549952 - DNA, 14 bp, Homo sapiens
tttgtaataaactc

SEQ ID NO: 3549953 - DNA, 15 bp, Homo sapiens
tttgtaataaactct

SEQ ID NO: 3549954 - DNA, 21 bp, Homo sapiens
tttgtaataataaagaatagc

SEQ ID NO: 3549955 - DNA, 21 bp, Homo sapiens
tttgtacacccatgaaagaaa

SEQ ID NO: 3549956 - DNA, 23 bp, Homo sapiens
tttgtacttgctccttttgctct

SEQ ID NO: 3549957 - DNA, 18 bp, Homo sapiens
tttgtagttactcaagca

SEQ ID NO: 3549958 - DNA, 17 bp, Homo sapiens
tttgtagttttatttgt

SEQ ID NO: 3549959 - DNA, 18 bp, Homo sapiens
tttgtatagaccaaagca

SEQ ID NO: 3549960 - DNA, 14 bp, Homo sapiens
tttagcttttttat

SEQ ID NO: 3549961 - DNA, 15 bp, Homo sapiens
tttagtcaacatata

SEQ ID NO: 3549962 - DNA, 15 bp, Homo sapiens
tttagtcatgtgacc

SEQ ID NO: 3549963 - DNA, 16 bp, Homo sapiens
tttagtgtaataagac

SEQ ID NO: 3549964 - DNA, 22 bp, Homo sapiens
tttagtgtgaatattcctttat

SEQ ID NO: 3549965 - DNA, 13 bp, Homo sapiens
tttataaattaaa

SEQ ID NO: 3549966 - DNA, 21 bp, Homo sapiens
tttataagcatttgtattatt

SEQ ID NO: 3549967 - DNA, 12 bp, Homo sapiens
tttataatgtat

SEQ ID NO: 3549968 - DNA, 21 bp, Homo sapiens
tttataatgtatttgaaaatt

SEQ ID NO: 3549969 - DNA, 12 bp, Homo sapiens
tttatacactgt

SEQ ID NO: 3549970 - DNA, 18 bp, Homo sapiens
tttatacactgtaagctt

SEQ ID NO: 3549971 - DNA, 10 bp, Homo sapiens
tttatacctc

SEQ ID NO: 3549972 - DNA, 22 bp, Homo sapiens
tttatactgctctataaatagt

SEQ ID NO: 3549973 - DNA, 23 bp, Homo sapiens
tttatactgctctataaatagta

SEQ ID NO: 3549974 - DNA, 17 bp, Homo sapiens
tttatatactgctattt

SEQ ID NO: 3549975 - DNA, 22 bp, Homo sapiens
tttatatatataaagtcagtga

SEQ ID NO: 3549976 - DNA, 23 bp, Homo sapiens
tttatatattataagttgacctt

SEQ ID NO: 3549977 - DNA, 17 bp, Homo sapiens
tttatattgtttttata

SEQ ID NO: 3549978 - DNA, 23 bp, Homo sapiens
tttatcagactcggaatctattt

SEQ ID NO: 3549979 - DNA, 16 bp, Homo sapiens
tttatccctcacctgt

SEQ ID NO: 3549980 - DNA, 23 bp, Homo sapiens
tttatcctagtcattcttcccta

SEQ ID NO: 3549981 - DNA, 14 bp, Homo sapiens
tttatctataattt

SEQ ID NO: 3549982 - DNA, 23 bp, Homo sapiens
tttatgacatgaaaagttattta

SEQ ID NO: 3549983 - DNA, 14 bp, Homo sapiens
tttatgcaaataca

SEQ ID NO: 3549984 - DNA, 15 bp, Homo sapiens
tttatgcaaatacaa

SEQ ID NO: 3549985 - DNA, 21 bp, Homo sapiens
tttatgctataaattttttga

SEQ ID NO: 3549986 - DNA, 17 bp, Homo sapiens
tttatgtaacttcctgt

SEQ ID NO: 3549987 - DNA, 13 bp, Homo sapiens
tttatgtctttct

SEQ ID NO: 3549988 - DNA, 13 bp, Homo sapiens
tttatgtgtgtgt

SEQ ID NO: 3549989 - DNA, 14 bp, Homo sapiens
tttatgttctttca

SEQ ID NO: 3549990 - DNA, 19 bp, Homo sapiens
tttatgttctttcacccat

SEQ ID NO: 3549991 - DNA, 18 bp, Homo sapiens
tttattaaacttcagcaa

SEQ ID NO: 3549992 - DNA, 15 bp, Homo sapiens
tttattaatttgaaa

SEQ ID NO: 3549993 - DNA, 14 bp, Homo sapiens
tttattaccagtgg

SEQ ID NO: 3549994 - DNA, 14 bp, Homo sapiens
tttattataaattc

SEQ ID NO: 3549995 - DNA, 14 bp, Homo sapiens
tttattattttctt

SEQ ID NO: 3549996 - DNA, 18 bp, Homo sapiens
tttattccccagtgactc

SEQ ID NO: 3549997 - DNA, 14 bp, Homo sapiens
tttattccctgccc

SEQ ID NO: 3549998 - DNA, 21 bp, Homo sapiens
tttattccctgcccaaaccct

SEQ ID NO: 3549999 - DNA, 17 bp, Homo sapiens
tttattctttgcaaata

SEQ ID NO: 3550000 - DNA, 16 bp, Homo sapiens
tttatttatttattca

SEQ ID NO: 3550001 - DNA, 16 bp, Homo sapiens
tttatttatttatttg

SEQ ID NO: 3550002 - DNA, 13 bp, Homo sapiens
tttatttcaattg

SEQ ID NO: 3550003 - DNA, 20 bp, Homo sapiens
tttatttctaagtatttaaa

SEQ ID NO: 3550004 - DNA, 17 bp, Homo sapiens
tttatttgtattactag

SEQ ID NO: 3550005 - DNA, 18 bp, Homo sapiens
tttatttttaaattatgt

SEQ ID NO: 3550006 - DNA, 16 bp, Homo sapiens
tttatttttaagaaag

SEQ ID NO: 3550007 - DNA, 17 bp, Homo sapiens
tttatttttaagaaaga

SEQ ID NO: 3550008 - DNA, 23 bp, Homo sapiens
tttatttttagaattttgtgaaa

SEQ ID NO: 3550009 - DNA, 17 bp, Homo sapiens
tttattttttcttctgt

SEQ ID NO: 3550010 - DNA, 13 bp, Homo sapiens
tttattttttggt

SEQ ID NO: 3550011 - DNA, 21 bp, Homo sapiens
tttcaaattaatgttccagtt

SEQ ID NO: 3550012 - DNA, 15 bp, Homo sapiens
tttcaacgcagccct

SEQ ID NO: 3550013 - DNA, 16 bp, Homo sapiens
tttcaacgcagccctg

SEQ ID NO: 3550014 - DNA, 20 bp, Homo sapiens
tttcaacgcagccctgcttt

SEQ ID NO: 3550015 - DNA, 19 bp, Homo sapiens
tttcaataaatctttcaaa

SEQ ID NO: 3550016 - DNA, 15 bp, Homo sapiens
tttcaatccattttt

SEQ ID NO: 3550017 - DNA, 14 bp, Homo sapiens
tttcaattaaacgg

SEQ ID NO: 3550018 - DNA, 15 bp, Homo sapiens
tttcaattaaacgga

SEQ ID NO: 3550019 - DNA, 16 bp, Homo sapiens
tttcaattaaacggat

SEQ ID NO: 3550020 - DNA, 18 bp, Homo sapiens
tttcaattaaacggatta

SEQ ID NO: 3550021 - DNA, 14 bp, Homo sapiens
tttcaattgtttat

SEQ ID NO: 3550022 - DNA, 16 bp, Homo sapiens
tttcacaaccttctgt

SEQ ID NO: 3550023 - DNA, 22 bp, Homo sapiens
tttcacagtgtgtggtcaacat

SEQ ID NO: 3550024 - DNA, 18 bp, Homo sapiens
tttcacatttaaatggtt

SEQ ID NO: 3550025 - DNA, 22 bp, Homo sapiens
tttcactgataccacgaggaaa

SEQ ID NO: 3550026 - DNA, 20 bp, Homo sapiens
tttcactgctggctgcctta

SEQ ID NO: 3550027 - DNA, 23 bp, Homo sapiens
tttcactgctgttatatttcatc

SEQ ID NO: 3550028 - DNA, 24 bp, Homo sapiens
tttcactgtagaatgatttcatgc

SEQ ID NO: 3550029 - DNA, 17 bp, Homo sapiens
tttcactgtagctctaa

SEQ ID NO: 3550030 - DNA, 15 bp, Homo sapiens
tttcacttatacctg

SEQ ID NO: 3550031 - DNA, 18 bp, Homo sapiens
tttcagagccagcctggc

SEQ ID NO: 3550032 - DNA, 22 bp, Homo sapiens
tttcagagccagcctggctctg

SEQ ID NO: 3550033 - DNA, 22 bp, Homo sapiens
tttcagatgaaaagaaaactta

SEQ ID NO: 3550034 - DNA, 15 bp, Homo sapiens
tttcagcagtctaaa

SEQ ID NO: 3550035 - DNA, 16 bp, Homo sapiens
tttcagccaaagtcct

SEQ ID NO: 3550036 - DNA, 23 bp, Homo sapiens
tttcaggattaactaaagaagag

SEQ ID NO: 3550037 - DNA, 17 bp, Homo sapiens
tttcaggttaaattaaa

SEQ ID NO: 3550038 - DNA, 11 bp, Homo sapiens
tttcagtgagg

SEQ ID NO: 3550039 - DNA, 13 bp, Homo sapiens
tttcagttctatt

SEQ ID NO: 3550040 - DNA, 12 bp, Homo sapiens
tttcataatctt

SEQ ID NO: 3550041 - DNA, 13 bp, Homo sapiens
tttcatcatttca

SEQ ID NO: 3550042 - DNA, 12 bp, Homo sapiens
tttcatgaaaaa

SEQ ID NO: 3550043 - DNA, 16 bp, Homo sapiens
tttcatgctttatcaa

SEQ ID NO: 3550044 - DNA, 17 bp, Homo sapiens
tttcatgtcttgtcata

SEQ ID NO: 3550045 - DNA, 17 bp, Homo sapiens
tttcatttgtaaaaatg

SEQ ID NO: 3550046 - DNA, 13 bp, Homo sapiens
tttccaaatgaac

SEQ ID NO: 3550047 - DNA, 12 bp, Homo sapiens
tttccaactact

SEQ ID NO: 3550048 - DNA, 15 bp, Homo sapiens
tttccagcttgcatt

SEQ ID NO: 3550049 - DNA, 22 bp, Homo sapiens
tttccaggactgtttcaaacat

SEQ ID NO: 3550050 - DNA, 14 bp, Homo sapiens
tttccagtattgaa

SEQ ID NO: 3550051 - DNA, 17 bp, Homo sapiens
tttccatatttttacaa

SEQ ID NO: 3550052 - DNA, 17 bp, Homo sapiens
tttccatcaactcccaa

SEQ ID NO: 3550053 - DNA, 23 bp, Homo sapiens
tttccatcaactcccaacttctt

SEQ ID NO: 3550054 - DNA, 13 bp, Homo sapiens
tttccatgttttt

SEQ ID NO: 3550055 - DNA, 18 bp, Homo sapiens
tttccattttataaatgt

SEQ ID NO: 3550056 - DNA, 12 bp, Homo sapiens
tttcccaactct

SEQ ID NO: 3550057 - DNA, 21 bp, Homo sapiens
tttcccaccattcctgccttt

SEQ ID NO: 3550058 - DNA, 20 bp, Homo sapiens
tttcccagctacacctttct

SEQ ID NO: 3550059 - DNA, 22 bp, Homo sapiens
tttcccccagcaacgcccctcc

SEQ ID NO: 3550060 - DNA, 23 bp, Homo sapiens
tttcccccagcaacgcccctcca

SEQ ID NO: 3550061 - DNA, 17 bp, Homo sapiens
tttcccccttcatccat

SEQ ID NO: 3550062 - DNA, 22 bp, Homo sapiens
tttcccccttcatccatcctga

SEQ ID NO: 3550063 - DNA, 21 bp, Homo sapiens
tttccctggaactcctggcct

SEQ ID NO: 3550064 - DNA, 16 bp, Homo sapiens
tttcccttctcttcta

SEQ ID NO: 3550065 - DNA, 15 bp, Homo sapiens
tttccgtaaatgtct

SEQ ID NO: 3550066 - DNA, 20 bp, Homo sapiens
tttccgtaaatgtctgcact

SEQ ID NO: 3550067 - DNA, 19 bp, Homo sapiens
tttccgtgaactctggtgc

SEQ ID NO: 3550068 - DNA, 12 bp, Homo sapiens
tttcctaatact

SEQ ID NO: 3550069 - DNA, 17 bp, Homo sapiens
tttcctagccctctcac

SEQ ID NO: 3550070 - DNA, 23 bp, Homo sapiens
tttcctagccctctcacatttat

SEQ ID NO: 3550071 - DNA, 22 bp, Homo sapiens
tttcctagctaggagcaggctt

SEQ ID NO: 3550072 - DNA, 15 bp, Homo sapiens
tttcctccccctgca

SEQ ID NO: 3550073 - DNA, 14 bp, Homo sapiens
tttcctcccttctg

SEQ ID NO: 3550074 - DNA, 20 bp, Homo sapiens
tttcctcccttctgctactg

SEQ ID NO: 3550075 - DNA, 16 bp, Homo sapiens
tttcctcttaacgtaa

SEQ ID NO: 3550076 - DNA, 15 bp, Homo sapiens
tttcctggcagctgc

SEQ ID NO: 3550077 - DNA, 18 bp, Homo sapiens
tttcctggcagctgctgt

SEQ ID NO: 3550078 - DNA, 19 bp, Homo sapiens
tttccttaaattatctaaa

SEQ ID NO: 3550079 - DNA, 16 bp, Homo sapiens
tttccttatttgcctt

SEQ ID NO: 3550080 - DNA, 22 bp, Homo sapiens
tttccttcaggcagctgaaatt

SEQ ID NO: 3550081 - DNA, 14 bp, Homo sapiens
tttccttgtcccgt

SEQ ID NO: 3550082 - DNA, 15 bp, Homo sapiens
tttcctttactcctg

SEQ ID NO: 3550083 - DNA, 22 bp, Homo sapiens
tttccttttgggggtaaagttt

SEQ ID NO: 3550084 - DNA, 15 bp, Homo sapiens
tttcctttttcttcg

SEQ ID NO: 3550085 - DNA, 14 bp, Homo sapiens
tttcgactggtcca

SEQ ID NO: 3550086 - DNA, 17 bp, Homo sapiens
tttcgactggtccagct

SEQ ID NO: 3550087 - DNA, 20 bp, Homo sapiens
tttcgataaacaacaaggtg

SEQ ID NO: 3550088 - DNA, 19 bp, Homo sapiens
tttcgggagccttgtcagt

SEQ ID NO: 3550089 - DNA, 15 bp, Homo sapiens
tttcgtctactgcaa

SEQ ID NO: 3550090 - DNA, 12 bp, Homo sapiens
tttctaaaatct

SEQ ID NO: 3550091 - DNA, 16 bp, Homo sapiens
tttctaaaatctaaaa

SEQ ID NO: 3550092 - DNA, 17 bp, Homo sapiens
tttctaaaatctaaaat

SEQ ID NO: 3550093 - DNA, 19 bp, Homo sapiens
tttctaattggctttacta

SEQ ID NO: 3550094 - DNA, 12 bp, Homo sapiens
tttctacagaga

SEQ ID NO: 3550095 - DNA, 22 bp, Homo sapiens
tttctactatgatcagaagaac

SEQ ID NO: 3550096 - DNA, 17 bp, Homo sapiens
tttctagaaagaataaa

SEQ ID NO: 3550097 - DNA, 22 bp, Homo sapiens
ttgtcacacagtagctccaaca

SEQ ID NO: 3550098 - DNA, 17 bp, Homo sapiens
ttgtcaccgcaggtgct

SEQ ID NO: 3550099 - DNA, 16 bp, Homo sapiens
ttgtcaggtgggagat

SEQ ID NO: 3550100 - DNA, 19 bp, Homo sapiens
ttgtcagtgtgtcagtttt

SEQ ID NO: 3550101 - DNA, 21 bp, Homo sapiens
ttgtcatataagattcatatt

SEQ ID NO: 3550102 - DNA, 16 bp, Homo sapiens
ttgtcatgttatgcag

SEQ ID NO: 3550103 - DNA, 18 bp, Homo sapiens
ttgtcatgttatgcagtg

SEQ ID NO: 3550104 - DNA, 15 bp, Homo sapiens
ttgtcattcagttct

SEQ ID NO: 3550105 - DNA, 21 bp, Homo sapiens
ttgtcattcagttctaggcct

SEQ ID NO: 3550106 - DNA, 13 bp, Homo sapiens
ttgtccagagata

SEQ ID NO: 3550107 - DNA, 21 bp, Homo sapiens
ttgtccagagataaaaatcat

SEQ ID NO: 3550108 - DNA, 16 bp, Homo sapiens
ttgtccctctgcccca

SEQ ID NO: 3550109 - DNA, 21 bp, Homo sapiens
ttgtctgaagtcactgcacag

SEQ ID NO: 3550110 - DNA, 19 bp, Homo sapiens
ttgtctgtgcatccggggg

SEQ ID NO: 3550111 - DNA, 21 bp, Homo sapiens
ttgtctgttttccttcttccc

SEQ ID NO: 3550112 - DNA, 18 bp, Homo sapiens
ttgtcttaaaaaatgtga

SEQ ID NO: 3550113 - DNA, 13 bp, Homo sapiens
ttgtcttaaaaat

SEQ ID NO: 3550114 - DNA, 11 bp, Homo sapiens
ttgtctttctt

SEQ ID NO: 3550115 - DNA, 14 bp, Homo sapiens
ttgtgaagctaatg

SEQ ID NO: 3550116 - DNA, 19 bp, Homo sapiens
ttgtgaattaggctgtaac

SEQ ID NO: 3550117 - DNA, 23 bp, Homo sapiens
ttgtgaattaggctgtaactact

SEQ ID NO: 3550118 - DNA, 19 bp, Homo sapiens
ttgtgagaatggcctggag

SEQ ID NO: 3550119 - DNA, 20 bp, Homo sapiens
ttgtgagaatggcctggagc

SEQ ID NO: 3550120 - DNA, 21 bp, Homo sapiens
ttgtgcatgctagtgttgtat

SEQ ID NO: 3550121 - DNA, 15 bp, Homo sapiens
ttgtgcctaatgtgt

SEQ ID NO: 3550122 - DNA, 16 bp, Homo sapiens
ttgtgctttttgtcat

SEQ ID NO: 3550123 - DNA, 21 bp, Homo sapiens
ttgtggaagcatgtagactgt

SEQ ID NO: 3550124 - DNA, 21 bp, Homo sapiens
ttgtggaattgggagcttggg

SEQ ID NO: 3550125 - DNA, 19 bp, Homo sapiens
ttgtggccaaggagctgct

SEQ ID NO: 3550126 - DNA, 18 bp, Homo sapiens
ttgtgtgtatatgtattt

SEQ ID NO: 3550127 - DNA, 10 bp, Homo sapiens
ttgtgtgtgg

SEQ ID NO: 3550128 - DNA, 16 bp, Homo sapiens
ttgtgttcatttcatt

SEQ ID NO: 3550129 - DNA, 18 bp, Homo sapiens
ttgtgttgcactgaacag

SEQ ID NO: 3550130 - DNA, 13 bp, Homo sapiens
ttgttacaatttt

SEQ ID NO: 3550131 - DNA, 20 bp, Homo sapiens
ttgttagcttccttaagtat

SEQ ID NO: 3550132 - DNA, 12 bp, Homo sapiens
ttgttataaata

SEQ ID NO: 3550133 - DNA, 18 bp, Homo sapiens
ttgttatattacttgcct

SEQ ID NO: 3550134 - DNA, 19 bp, Homo sapiens
ttgttcttataagaagaag

SEQ ID NO: 3550135 - DNA, 14 bp, Homo sapiens
ttgttctttgtttc

SEQ ID NO: 3550136 - DNA, 17 bp, Homo sapiens
ttgttctttgtttccag

SEQ ID NO: 3550137 - DNA, 17 bp, Homo sapiens
ttgttgcatgtttgaaa

SEQ ID NO: 3550138 - DNA, 14 bp, Homo sapiens
ttgttgctatacat

SEQ ID NO: 3550139 - DNA, 15 bp, Homo sapiens
ttgttgtgagaatgg

SEQ ID NO: 3550140 - DNA, 13 bp, Homo sapiens
ttgttgtgtgtat

SEQ ID NO: 3550141 - DNA, 14 bp, Homo sapiens
ttgttgtgtgtata

SEQ ID NO: 3550142 - DNA, 18 bp, Homo sapiens
ttgttgtgtgtatatgta

SEQ ID NO: 3550143 - DNA, 15 bp, Homo sapiens
ttgtttaaacaatct

SEQ ID NO: 3550144 - DNA, 23 bp, Homo sapiens
ttgtttaatggtagttttacagt

SEQ ID NO: 3550145 - DNA, 12 bp, Homo sapiens
ttgtttaatgtt

SEQ ID NO: 3550146 - DNA, 15 bp, Homo sapiens
ttgtttcatgagttt

SEQ ID NO: 3550147 - DNA, 22 bp, Homo sapiens
ttgtttccccacaaaacaaagc

SEQ ID NO: 3550148 - DNA, 13 bp, Homo sapiens
ttgtttcttttaa

SEQ ID NO: 3550149 - DNA, 16 bp, Homo sapiens
ttgtttgctgaaattt

SEQ ID NO: 3550150 - DNA, 22 bp, Homo sapiens
ttgtttgggctttaacatcctt

SEQ ID NO: 3550151 - DNA, 15 bp, Homo sapiens
ttgttttcggcagcc

SEQ ID NO: 3550152 - DNA, 17 bp, Homo sapiens
tttaaaaaaaagaaact

SEQ ID NO: 3550153 - DNA, 14 bp, Homo sapiens
tttaaaaaatgaat

SEQ ID NO: 3550154 - DNA, 11 bp, Homo sapiens
tttaaaaatat

SEQ ID NO: 3550155 - DNA, 21 bp, Homo sapiens
tttaaaacgcgtctgcctggg

SEQ ID NO: 3550156 - DNA, 14 bp, Homo sapiens
tttaaaagaagctt

SEQ ID NO: 3550157 - DNA, 16 bp, Homo sapiens
tttaaaatcatttctg

SEQ ID NO: 3550158 - DNA, 21 bp, Homo sapiens
tttaaaatgctcaatttcagc

SEQ ID NO: 3550159 - DNA, 16 bp, Homo sapiens
tttaaaattgtgatgt

SEQ ID NO: 3550160 - DNA, 17 bp, Homo sapiens
tttaaacaatctttcat

SEQ ID NO: 3550161 - DNA, 13 bp, Homo sapiens
tttaaactgtgtt

SEQ ID NO: 3550162 - DNA, 21 bp, Homo sapiens
tttaaagacagggtcttgcta

SEQ ID NO: 3550163 - DNA, 24 bp, Homo sapiens
tttaaagcttattaaaactcattt

SEQ ID NO: 3550164 - DNA, 16 bp, Homo sapiens
tttaaataaaagcaca

SEQ ID NO: 3550165 - DNA, 17 bp, Homo sapiens
tttaaataaaagcacaa

SEQ ID NO: 3550166 - DNA, 21 bp, Homo sapiens
tttaaatagcattatcttatc

SEQ ID NO: 3550167 - DNA, 19 bp, Homo sapiens
tttaaatcaagtattttgt

SEQ ID NO: 3550168 - DNA, 12 bp, Homo sapiens
tttaaatgaaag

SEQ ID NO: 3550169 - DNA, 12 bp, Homo sapiens
tttaaatgtata

SEQ ID NO: 3550170 - DNA, 13 bp, Homo sapiens
tttaaatgtatac

SEQ ID NO: 3550171 - DNA, 13 bp, Homo sapiens
tttaaatgtcaaa

SEQ ID NO: 3550172 - DNA, 17 bp, Homo sapiens
tttaaatgtgtacaatg

SEQ ID NO: 3550173 - DNA, 17 bp, Homo sapiens
tttaaatgttctaacag

SEQ ID NO: 3550174 - DNA, 14 bp, Homo sapiens
tttaaattatatga

SEQ ID NO: 3550175 - DNA, 19 bp, Homo sapiens
tttaacatccttattcagc

SEQ ID NO: 3550176 - DNA, 13 bp, Homo sapiens
tttaacgctgcct

SEQ ID NO: 3550177 - DNA, 14 bp, Homo sapiens
tttaactgagaaat

SEQ ID NO: 3550178 - DNA, 12 bp, Homo sapiens
tttaacttttaa

SEQ ID NO: 3550179 - DNA, 18 bp, Homo sapiens
tttaagaaaaaataaaag

SEQ ID NO: 3550180 - DNA, 12 bp, Homo sapiens
tttaagacataa

SEQ ID NO: 3550181 - DNA, 13 bp, Homo sapiens
tttaagacataaa

SEQ ID NO: 3550182 - DNA, 15 bp, Homo sapiens
tttaagacataaaca

SEQ ID NO: 3550183 - DNA, 17 bp, Homo sapiens
tttaagatgtacattta

SEQ ID NO: 3550184 - DNA, 18 bp, Homo sapiens
tttaagccaaagaaacaa

SEQ ID NO: 3550185 - DNA, 21 bp, Homo sapiens
tttaagccaaagaaacaagct

SEQ ID NO: 3550186 - DNA, 19 bp, Homo sapiens
tttaagccttacaaaggga

SEQ ID NO: 3550187 - DNA, 19 bp, Homo sapiens
tttaaggtctaatcagtga

SEQ ID NO: 3550188 - DNA, 20 bp, Homo sapiens
tttaagtgaatacattaacg

SEQ ID NO: 3550189 - DNA, 14 bp, Homo sapiens
tttaagtgtgctgg

SEQ ID NO: 3550190 - DNA, 20 bp, Homo sapiens
tttaataaattgcttactga

SEQ ID NO: 3550191 - DNA, 23 bp, Homo sapiens
tttaataaattgcttactgatat

SEQ ID NO: 3550192 - DNA, 16 bp, Homo sapiens
tttaatatgaaatttt

SEQ ID NO: 3550193 - DNA, 17 bp, Homo sapiens
tttaatccatttcagga

SEQ ID NO: 3550194 - DNA, 15 bp, Homo sapiens
tttaatcctgtacca

SEQ ID NO: 3550195 - DNA, 18 bp, Homo sapiens
tttaatcctgtaccaaat

SEQ ID NO: 3550196 - DNA, 20 bp, Homo sapiens
tttaatcctgtaccaaatct

SEQ ID NO: 3550197 - DNA, 16 bp, Homo sapiens
tttaatccttctttgt

SEQ ID NO: 3550198 - DNA, 12 bp, Homo sapiens
tttaatgctgcc

SEQ ID NO: 3550199 - DNA, 17 bp, Homo sapiens
tttaattaaaattggta

SEQ ID NO: 3550200 - DNA, 17 bp, Homo sapiens
tttaattacaaacaata

SEQ ID NO: 3550201 - DNA, 18 bp, Homo sapiens
tttaattacaaacaataa

SEQ ID NO: 3550202 - DNA, 18 bp, Homo sapiens
tttaattcacgtgctttg

SEQ ID NO: 3550203 - DNA, 14 bp, Homo sapiens
tttaattcagcaga

SEQ ID NO: 3550204 - DNA, 22 bp, Homo sapiens
tttaatttaaactgtgttttag

SEQ ID NO: 3550205 - DNA, 15 bp, Homo sapiens
tttaatttttccttt

SEQ ID NO: 3550206 - DNA, 19 bp, Homo sapiens
tttacactattatttccta

SEQ ID NO: 3550207 - DNA, 20 bp, Homo sapiens
tttacagaggacagtatttg

SEQ ID NO: 3550208 - DNA, 23 bp, Homo sapiens
tttacagatttattcctttgtta

SEQ ID NO: 3550209 - DNA, 13 bp, Homo sapiens
tttacagctgcct

SEQ ID NO: 3550210 - DNA, 12 bp, Homo sapiens
tttacagtattt

SEQ ID NO: 3550211 - DNA, 19 bp, Homo sapiens
tttacagtgtttctggctt

SEQ ID NO: 3550212 - DNA, 20 bp, Homo sapiens
tttaccaaagagatattgat

SEQ ID NO: 3550213 - DNA, 12 bp, Homo sapiens
tttaccaaagca

SEQ ID NO: 3550214 - DNA, 23 bp, Homo sapiens
tttaccagcatacccacacaaat

SEQ ID NO: 3550215 - DNA, 13 bp, Homo sapiens
tttaccatcatct

SEQ ID NO: 3550216 - DNA, 16 bp, Homo sapiens
tttaccatcatctctg

SEQ ID NO: 3550217 - DNA, 23 bp, Homo sapiens
tttacccagcatgactttcctta

SEQ ID NO: 3550218 - DNA, 21 bp, Homo sapiens
tttaccctgaggtcactgcta

SEQ ID NO: 3550219 - DNA, 22 bp, Homo sapiens
tttacccttttcccccttccca

SEQ ID NO: 3550220 - DNA, 15 bp, Homo sapiens
tttacctaagattac

SEQ ID NO: 3550221 - DNA, 23 bp, Homo sapiens
tttacctattctgaaaaagacat

SEQ ID NO: 3550222 - DNA, 13 bp, Homo sapiens
tttacgtagctat

SEQ ID NO: 3550223 - DNA, 17 bp, Homo sapiens
tttacgtagctattttt

SEQ ID NO: 3550224 - DNA, 17 bp, Homo sapiens
tttactaatgatactta

SEQ ID NO: 3550225 - DNA, 13 bp, Homo sapiens
tttactctttgaa

SEQ ID NO: 3550226 - DNA, 22 bp, Homo sapiens
tttacttcttatacatttgata

SEQ ID NO: 3550227 - DNA, 22 bp, Homo sapiens
tttagaaatgtgaagaggtctg

SEQ ID NO: 3550228 - DNA, 19 bp, Homo sapiens
tttagaagatattatttgt

SEQ ID NO: 3550229 - DNA, 18 bp, Homo sapiens
tttagagataattgcttg

SEQ ID NO: 3550230 - DNA, 18 bp, Homo sapiens
tttagatgaatgtcagtt

SEQ ID NO: 3550231 - DNA, 21 bp, Homo sapiens
tttagccttccaacatttctt

SEQ ID NO: 3550232 - DNA, 12 bp, Homo sapiens
tttagcttacct

SEQ ID NO: 3550233 - DNA, 16 bp, Homo sapiens
tttagcttacctgggc

SEQ ID NO: 3550234 - DNA, 12 bp, Homo sapiens
tgttacaaaaga

SEQ ID NO: 3550235 - DNA, 18 bp, Homo sapiens
tgttacaaaagaaaaaag

SEQ ID NO: 3550236 - DNA, 23 bp, Homo sapiens
tgttacagccaagtgccaaatgc

SEQ ID NO: 3550237 - DNA, 17 bp, Homo sapiens
tgttacttatgtagaaa

SEQ ID NO: 3550238 - DNA, 15 bp, Homo sapiens
tgttacttccttatg

SEQ ID NO: 3550239 - DNA, 14 bp, Homo sapiens
tgttacttctctaa

SEQ ID NO: 3550240 - DNA, 17 bp, Homo sapiens
tgttagaaaatgactta

SEQ ID NO: 3550241 - DNA, 17 bp, Homo sapiens
tgttagccccataattt

SEQ ID NO: 3550242 - DNA, 19 bp, Homo sapiens
tgttagcttaatcttaatg

SEQ ID NO: 3550243 - DNA, 21 bp, Homo sapiens
tgttaggttttctatgtgact

SEQ ID NO: 3550244 - DNA, 14 bp, Homo sapiens
tgttagttttcctt

SEQ ID NO: 3550245 - DNA, 18 bp, Homo sapiens
tgttatattcattcttta

SEQ ID NO: 3550246 - DNA, 20 bp, Homo sapiens
tgttatgactatgtaaacta

SEQ ID NO: 3550247 - DNA, 15 bp, Homo sapiens
tgttatgctgtttcc

SEQ ID NO: 3550248 - DNA, 14 bp, Homo sapiens
tgttattaaacaaa

SEQ ID NO: 3550249 - DNA, 15 bp, Homo sapiens
tgttattattcatta

SEQ ID NO: 3550250 - DNA, 13 bp, Homo sapiens
tgttatttattga

SEQ ID NO: 3550251 - DNA, 19 bp, Homo sapiens
tgttatttattgaaatgat

SEQ ID NO: 3550252 - DNA, 15 bp, Homo sapiens
tgttatttcttccct

SEQ ID NO: 3550253 - DNA, 17 bp, Homo sapiens
tgttattttccttctga

SEQ ID NO: 3550254 - DNA, 18 bp, Homo sapiens
tgttcagaaggttgctct

SEQ ID NO: 3550255 - DNA, 18 bp, Homo sapiens
tgttcagttgcacttcta

SEQ ID NO: 3550256 - DNA, 19 bp, Homo sapiens
tgttccacaagttaaataa

SEQ ID NO: 3550257 - DNA, 20 bp, Homo sapiens
tgttccattacaccacagca

SEQ ID NO: 3550258 - DNA, 23 bp, Homo sapiens
tgttccattacaccacagcattg

SEQ ID NO: 3550259 - DNA, 18 bp, Homo sapiens
tgttcctagtgaaagagg

SEQ ID NO: 3550260 - DNA, 14 bp, Homo sapiens
tgttcctgaaatgt

SEQ ID NO: 3550261 - DNA, 15 bp, Homo sapiens
tgttcctgaagctgc

SEQ ID NO: 3550262 - DNA, 16 bp, Homo sapiens
tgttcctgaagctgct

SEQ ID NO: 3550263 - DNA, 18 bp, Homo sapiens
tgttcctgaagctgctgt

SEQ ID NO: 3550264 - DNA, 20 bp, Homo sapiens
tgttcctgaaggaggccctg

SEQ ID NO: 3550265 - DNA, 17 bp, Homo sapiens
tgttcctttctctgggc

SEQ ID NO: 3550266 - DNA, 19 bp, Homo sapiens
tgttcctttctctgggctt

SEQ ID NO: 3550267 - DNA, 21 bp, Homo sapiens
tgttctaccgtggatttgtac

SEQ ID NO: 3550268 - DNA, 17 bp, Homo sapiens
tgttctccctttctctc

SEQ ID NO: 3550269 - DNA, 20 bp, Homo sapiens
tgttctccctttctctctcc

SEQ ID NO: 3550270 - DNA, 22 bp, Homo sapiens
tgttctccctttctctctcctc

SEQ ID NO: 3550271 - DNA, 20 bp, Homo sapiens
tgttctgcctctccctgggt

SEQ ID NO: 3550272 - DNA, 20 bp, Homo sapiens
tgttctgcgctgtgtacaat

SEQ ID NO: 3550273 - DNA, 22 bp, Homo sapiens
tgttctgctccataccttttct

SEQ ID NO: 3550274 - DNA, 20 bp, Homo sapiens
tgttctgggagttgctgtta

SEQ ID NO: 3550275 - DNA, 16 bp, Homo sapiens
tgttctgtttgaaact

SEQ ID NO: 3550276 - DNA, 16 bp, Homo sapiens
tgttcttagcaataaa

SEQ ID NO: 3550277 - DNA, 18 bp, Homo sapiens
tgttcttagcaataaatg

SEQ ID NO: 3550278 - DNA, 21 bp, Homo sapiens
tgttcttgcataggctcttaa

SEQ ID NO: 3550279 - DNA, 19 bp, Homo sapiens
tgttctttcacccatccta

SEQ ID NO: 3550280 - DNA, 15 bp, Homo sapiens
tgttctttcctcaca

SEQ ID NO: 3550281 - DNA, 15 bp, Homo sapiens
tgttctttctgctct

SEQ ID NO: 3550282 - DNA, 16 bp, Homo sapiens
tgttcttttgtcccag

SEQ ID NO: 3550283 - DNA, 14 bp, Homo sapiens
tgttgaaacagaaa

SEQ ID NO: 3550284 - DNA, 18 bp, Homo sapiens
tgttgactggactgcttg

SEQ ID NO: 3550285 - DNA, 13 bp, Homo sapiens
tgttgcactaaaa

SEQ ID NO: 3550286 - DNA, 19 bp, Homo sapiens
tgttgcactaaaatgagga

SEQ ID NO: 3550287 - DNA, 15 bp, Homo sapiens
tgttgcactgaacag

SEQ ID NO: 3550288 - DNA, 15 bp, Homo sapiens
tgttgcagccgcaga

SEQ ID NO: 3550289 - DNA, 15 bp, Homo sapiens
tgttgctatagtgac

SEQ ID NO: 3550290 - DNA, 14 bp, Homo sapiens
tgttgctgtggctc

SEQ ID NO: 3550291 - DNA, 16 bp, Homo sapiens
tgttgcttctcaggct

SEQ ID NO: 3550292 - DNA, 18 bp, Homo sapiens
tgttgctttcttacctac

SEQ ID NO: 3550293 - DNA, 17 bp, Homo sapiens
tgttggagcagcaggcc

SEQ ID NO: 3550294 - DNA, 22 bp, Homo sapiens
tgttggagcagcaggcctctgg

SEQ ID NO: 3550295 - DNA, 15 bp, Homo sapiens
tgttggtaaagcaca

SEQ ID NO: 3550296 - DNA, 19 bp, Homo sapiens
tgttggtctgccttctgct

SEQ ID NO: 3550297 - DNA, 15 bp, Homo sapiens
tgttggtttttaaag

SEQ ID NO: 3550298 - DNA, 13 bp, Homo sapiens
tgttgtaatgctg

SEQ ID NO: 3550299 - DNA, 13 bp, Homo sapiens
tgttgtatttcta

SEQ ID NO: 3550300 - DNA, 11 bp, Homo sapiens
tgttgtcaaga

SEQ ID NO: 3550301 - DNA, 12 bp, Homo sapiens
tgttgtcccttc

SEQ ID NO: 3550302 - DNA, 16 bp, Homo sapiens
tgttgtggaagcatgt

SEQ ID NO: 3550303 - DNA, 14 bp, Homo sapiens
tgttgtgtgtggga

SEQ ID NO: 3550304 - DNA, 16 bp, Homo sapiens
tgttgtgtgtgggagt

SEQ ID NO: 3550305 - DNA, 13 bp, Homo sapiens
tgtttaaagtggc

SEQ ID NO: 3550306 - DNA, 13 bp, Homo sapiens
tgtttaatctttt

SEQ ID NO: 3550307 - DNA, 14 bp, Homo sapiens
tgtttaatgttaat

SEQ ID NO: 3550308 - DNA, 20 bp, Homo sapiens
tgtttagatgaatgtcagtt

SEQ ID NO: 3550309 - DNA, 13 bp, Homo sapiens
tgtcacctcaata

SEQ ID NO: 3550310 - DNA, 19 bp, Homo sapiens
tgtcacgatcacaggcctt

SEQ ID NO: 3550311 - DNA, 15 bp, Homo sapiens
tgtcactagaatgga

SEQ ID NO: 3550312 - DNA, 23 bp, Homo sapiens
tgtcactggtagaccaaaataaa

SEQ ID NO: 3550313 - DNA, 14 bp, Homo sapiens
tgtcacttgtcggg

SEQ ID NO: 3550314 - DNA, 12 bp, Homo sapiens
tgtcactttttg

SEQ ID NO: 3550315 - DNA, 15 bp, Homo sapiens
tgtcagccactgtga

SEQ ID NO: 3550316 - DNA, 17 bp, Homo sapiens
tgtcagctgttgtcaca

SEQ ID NO: 3550317 - DNA, 22 bp, Homo sapiens
tgtcaggggcggggagggtgac

SEQ ID NO: 3550318 - DNA, 22 bp, Homo sapiens
tgtcagtatgtggaagtgtggg

SEQ ID NO: 3550319 - DNA, 15 bp, Homo sapiens
tgtcagtatttcaac

SEQ ID NO: 3550320 - DNA, 19 bp, Homo sapiens
tgtcagtggggcagcctct

SEQ ID NO: 3550321 - DNA, 18 bp, Homo sapiens
tgtcagttgttatttatt

SEQ ID NO: 3550322 - DNA, 13 bp, Homo sapiens
tgtcagtttttcc

SEQ ID NO: 3550323 - DNA, 16 bp, Homo sapiens
tgtcataaggttttta

SEQ ID NO: 3550324 - DNA, 15 bp, Homo sapiens
tgtcatacaaattta

SEQ ID NO: 3550325 - DNA, 16 bp, Homo sapiens
tgtcatagaaattaca

SEQ ID NO: 3550326 - DNA, 22 bp, Homo sapiens
tgtcatcactctaggttttaca

SEQ ID NO: 3550327 - DNA, 21 bp, Homo sapiens
tgtcatcctcaaagaaagtgt

SEQ ID NO: 3550328 - DNA, 17 bp, Homo sapiens
tgtcatggtgaaattat

SEQ ID NO: 3550329 - DNA, 21 bp, Homo sapiens
tgtcattcagttctaggcctt

SEQ ID NO: 3550330 - DNA, 22 bp, Homo sapiens
tgtcattcagttctaggccttt

SEQ ID NO: 3550331 - DNA, 17 bp, Homo sapiens
tgtcattggaagccatc

SEQ ID NO: 3550332 - DNA, 22 bp, Homo sapiens
tgtcatttctatattcctccag

SEQ ID NO: 3550333 - DNA, 16 bp, Homo sapiens
tgtcatttgttaaaat

SEQ ID NO: 3550334 - DNA, 15 bp, Homo sapiens
tgtccaaaactgcct

SEQ ID NO: 3550335 - DNA, 22 bp, Homo sapiens
tgtccaatttcgggagccttgt

SEQ ID NO: 3550336 - DNA, 15 bp, Homo sapiens
tgtccacttaaaata

SEQ ID NO: 3550337 - DNA, 20 bp, Homo sapiens
tgtccagagataaaaatcat

SEQ ID NO: 3550338 - DNA, 16 bp, Homo sapiens
tgtccagctccaacct

SEQ ID NO: 3550339 - DNA, 23 bp, Homo sapiens
tgtccagctccaacctgcaaaga

SEQ ID NO: 3550340 - DNA, 21 bp, Homo sapiens
tgtccaggagccccgccaggt

SEQ ID NO: 3550341 - DNA, 16 bp, Homo sapiens
tgtcccaacttgtaaa

SEQ ID NO: 3550342 - DNA, 17 bp, Homo sapiens
tgtcccacatggccatc

SEQ ID NO: 3550343 - DNA, 22 bp, Homo sapiens
tgtcccacatggccatcttctt

SEQ ID NO: 3550344 - DNA, 12 bp, Homo sapiens
tgtcccacccac

SEQ ID NO: 3550345 - DNA, 14 bp, Homo sapiens
tgtcccacccacac

SEQ ID NO: 3550346 - DNA, 20 bp, Homo sapiens
tgtcccacccacacagctgc

SEQ ID NO: 3550347 - DNA, 21 bp, Homo sapiens
tgtcccacccacacagctgcc

SEQ ID NO: 3550348 - DNA, 23 bp, Homo sapiens
tgtcccacccacacagctgccct

SEQ ID NO: 3550349 - DNA, 18 bp, Homo sapiens
tgtcccactacatctggg

SEQ ID NO: 3550350 - DNA, 16 bp, Homo sapiens
tgtcccaggcactgta

SEQ ID NO: 3550351 - DNA, 11 bp, Homo sapiens
tgtccccacca

SEQ ID NO: 3550352 - DNA, 15 bp, Homo sapiens
tgtcccctgacaggg

SEQ ID NO: 3550353 - DNA, 21 bp, Homo sapiens
tgtccctagtaaaaatacaaa

SEQ ID NO: 3550354 - DNA, 12 bp, Homo sapiens
tgtccctgcagg

SEQ ID NO: 3550355 - DNA, 13 bp, Homo sapiens
tgtccctgcaggg

SEQ ID NO: 3550356 - DNA, 16 bp, Homo sapiens
tgtccctgcagggcca

SEQ ID NO: 3550357 - DNA, 12 bp, Homo sapiens
tgtccctggaca

SEQ ID NO: 3550358 - DNA, 13 bp, Homo sapiens
tgtccctggacac

SEQ ID NO: 3550359 - DNA, 15 bp, Homo sapiens
tgtccctggacacag

SEQ ID NO: 3550360 - DNA, 17 bp, Homo sapiens
tgtccctgtccttccct

SEQ ID NO: 3550361 - DNA, 12 bp, Homo sapiens
tgtcccttgcct

SEQ ID NO: 3550362 - DNA, 14 bp, Homo sapiens
tgtccctttcccta

SEQ ID NO: 3550363 - DNA, 15 bp, Homo sapiens
tgtccctttccctac

SEQ ID NO: 3550364 - DNA, 12 bp, Homo sapiens
tgtcccttttcc

SEQ ID NO: 3550365 - DNA, 13 bp, Homo sapiens
tgtccgtgcccct

SEQ ID NO: 3550366 - DNA, 14 bp, Homo sapiens
tgtcctacagtgac

SEQ ID NO: 3550367 - DNA, 20 bp, Homo sapiens
tgtcctcagccttgccagag

SEQ ID NO: 3550368 - DNA, 22 bp, Homo sapiens
tgtcctcagccttgccagagat

SEQ ID NO: 3550369 - DNA, 15 bp, Homo sapiens
tgtcctctgcctggg

SEQ ID NO: 3550370 - DNA, 17 bp, Homo sapiens
tgtcctctgcctgggct

SEQ ID NO: 3550371 - DNA, 21 bp, Homo sapiens
tgtcctcttctgctcttttcc

SEQ ID NO: 3550372 - DNA, 23 bp, Homo sapiens
tgtcctcttctgctcttttcctg

SEQ ID NO: 3550373 - DNA, 18 bp, Homo sapiens
tgtcctcttggccatcct

SEQ ID NO: 3550374 - DNA, 18 bp, Homo sapiens
tgtcctgatgcttttgtc

SEQ ID NO: 3550375 - DNA, 20 bp, Homo sapiens
tgtcctgatttctacaactg

SEQ ID NO: 3550376 - DNA, 10 bp, Homo sapiens
tgtcctgggc

SEQ ID NO: 3550377 - DNA, 11 bp, Homo sapiens
tgtcctgtcct

SEQ ID NO: 3550378 - DNA, 15 bp, Homo sapiens
tgtcctgtcctgctc

SEQ ID NO: 3550379 - DNA, 13 bp, Homo sapiens
tgtcctttctctc

SEQ ID NO: 3550380 - DNA, 17 bp, Homo sapiens
tgtcgaaggggaggcac

SEQ ID NO: 3550381 - DNA, 20 bp, Homo sapiens
tgtcgaaggggaggcacact

SEQ ID NO: 3550382 - DNA, 20 bp, Homo sapiens
tgtcgaggccacattgctgg

SEQ ID NO: 3550383 - DNA, 23 bp, Homo sapiens
tgtcgaggccacattgctggctg

SEQ ID NO: 3550384 - DNA, 14 bp, Homo sapiens
tgtcgcctctgcat

SEQ ID NO: 3550385 - DNA, 17 bp, Homo sapiens
tgtctccaaagaagata

SEQ ID NO: 3550386 - DNA, 11 bp, Homo sapiens
tgtctccagct

SEQ ID NO: 3550387 - DNA, 12 bp, Homo sapiens
tgtctccagctg

SEQ ID NO: 3550388 - DNA, 14 bp, Homo sapiens
tgtctccagctgcc

SEQ ID NO: 3550389 - DNA, 17 bp, Homo sapiens
tgtctccagctgcctgg

SEQ ID NO: 3550390 - DNA, 21 bp, Homo sapiens
tgtctccagctgcctgggccc

SEQ ID NO: 3550391 - DNA, 15 bp, Homo sapiens
tgtctcggctctgca

SEQ ID NO: 3550392 - DNA, 18 bp, Homo sapiens
tgtctcggctctgcatgt

SEQ ID NO: 3550393 - DNA, 21 bp, Homo sapiens
tgtctctagtagtgtggcctg

SEQ ID NO: 3550394 - DNA, 15 bp, Homo sapiens
tgtctcttctaacat

SEQ ID NO: 3550395 - DNA, 20 bp, Homo sapiens
tgtctgaagtcactgcacag

SEQ ID NO: 3550396 - DNA, 18 bp, Homo sapiens
tgtctgagacaggtgcct

SEQ ID NO: 3550397 - DNA, 18 bp, Homo sapiens
tgtctgaggtgacttaaa

SEQ ID NO: 3550398 - DNA, 20 bp, Homo sapiens
tgtctgaggtgacttaaaaa

SEQ ID NO: 3550399 - DNA, 23 bp, Homo sapiens
tgtctgcagctcaagggctggca

SEQ ID NO: 3550400 - DNA, 23 bp, Homo sapiens
tgtctgctgagttggcctggcca

SEQ ID NO: 3550401 - DNA, 18 bp, Homo sapiens
tgtctgctgccagcacag

SEQ ID NO: 3550402 - DNA, 17 bp, Homo sapiens
tgtctggaagacgtggc

SEQ ID NO: 3550403 - DNA, 20 bp, Homo sapiens
tgtctggaagacgtggctct

SEQ ID NO: 3550404 - DNA, 21 bp, Homo sapiens
tgtctggtggtggcaccatct

SEQ ID NO: 3550405 - DNA, 23 bp, Homo sapiens
tgtctggtgtttgtcatggtgaa

SEQ ID NO: 3550406 - DNA, 15 bp, Homo sapiens
tgtctgttttccttc

SEQ ID NO: 3550407 - DNA, 15 bp, Homo sapiens
tgtcttaaaaaatgt

SEQ ID NO: 3550408 - DNA, 12 bp, Homo sapiens
tgtcttaattaa

SEQ ID NO: 3550409 - DNA, 14 bp, Homo sapiens
tgtcttcacaacag

SEQ ID NO: 3550410 - DNA, 12 bp, Homo sapiens
tgtcttctttct

SEQ ID NO: 3550411 - DNA, 13 bp, Homo sapiens
tgtcttctttctc

SEQ ID NO: 3550412 - DNA, 14 bp, Homo sapiens
tgtcttctttctcc

SEQ ID NO: 3550413 - DNA, 19 bp, Homo sapiens
tgtcttctttctccatgga

SEQ ID NO: 3550414 - DNA, 22 bp, Homo sapiens
tgtcttctttctccatggagcc

SEQ ID NO: 3550415 - DNA, 15 bp, Homo sapiens
tgtctttcttgtaag

SEQ ID NO: 3550416 - DNA, 12 bp, Homo sapiens
tgtctttctttg

SEQ ID NO: 3550417 - DNA, 20 bp, Homo sapiens
tgtgaaataaaactggcttt

SEQ ID NO: 3550418 - DNA, 12 bp, Homo sapiens
tgtgaaatgctt

SEQ ID NO: 3550419 - DNA, 17 bp, Homo sapiens
tgtgaaatgctttctgt

SEQ ID NO: 3550420 - DNA, 22 bp, Homo sapiens
tgtgaaatgcttttatattcta

SEQ ID NO: 3550421 - DNA, 17 bp, Homo sapiens
tgtgaacctacctgcct

SEQ ID NO: 3550422 - DNA, 20 bp, Homo sapiens
tgtgaactagggaagctcag

SEQ ID NO: 3550423 - DNA, 22 bp, Homo sapiens
tgtgaactcaccctgggagcca

SEQ ID NO: 3550424 - DNA, 18 bp, Homo sapiens
tgtgaagacccaaaacag

SEQ ID NO: 3550425 - DNA, 23 bp, Homo sapiens
tgtgaagacccaaaacagctttg

SEQ ID NO: 3550426 - DNA, 14 bp, Homo sapiens
tgtgaagaggtctg

SEQ ID NO: 3550427 - DNA, 23 bp, Homo sapiens
tgtgaaggcaggggaatgtatgt

SEQ ID NO: 3550428 - DNA, 14 bp, Homo sapiens
tgtgaagttcatct

SEQ ID NO: 3550429 - DNA, 20 bp, Homo sapiens
tgtgaagtttaattgtctca

SEQ ID NO: 3550430 - DNA, 14 bp, Homo sapiens
tgtgaatattcctt

SEQ ID NO: 3550431 - DNA, 14 bp, Homo sapiens
tgtgaatttgccag

SEQ ID NO: 3550432 - DNA, 15 bp, Homo sapiens
tgtgaatttgccaga

SEQ ID NO: 3550433 - DNA, 16 bp, Homo sapiens
tgtgaatttgccagag

SEQ ID NO: 3550434 - DNA, 18 bp, Homo sapiens
tgtgaatttgccagagga

SEQ ID NO: 3550435 - DNA, 17 bp, Homo sapiens
tgtgacattttacatta

SEQ ID NO: 3550436 - DNA, 18 bp, Homo sapiens
tgtgacttcagctctgtt

SEQ ID NO: 3550437 - DNA, 18 bp, Homo sapiens
tgtgacttccttggaaat

SEQ ID NO: 3550438 - DNA, 14 bp, Homo sapiens
tgtgagatactgtg

SEQ ID NO: 3550439 - DNA, 15 bp, Homo sapiens
tgtgagatactgtgt

SEQ ID NO: 3550440 - DNA, 17 bp, Homo sapiens
tgtgagctgtaaaaatg

SEQ ID NO: 3550441 - DNA, 23 bp, Homo sapiens
tgtgagggccaccggtgggcagt

SEQ ID NO: 3550442 - DNA, 17 bp, Homo sapiens
tgtgagggtcctgcagc

SEQ ID NO: 3550443 - DNA, 13 bp, Homo sapiens
tgtgagtctggga

SEQ ID NO: 3550444 - DNA, 23 bp, Homo sapiens
tgtgagtttaccttgtatactgt

SEQ ID NO: 3550445 - DNA, 13 bp, Homo sapiens
tgtgatatataag

SEQ ID NO: 3550446 - DNA, 14 bp, Homo sapiens
tgtgatatataagt

SEQ ID NO: 3550447 - DNA, 21 bp, Homo sapiens
tgtgatcttaatatatttgaa

SEQ ID NO: 3550448 - DNA, 11 bp, Homo sapiens
tgtgatgtgtc

SEQ ID NO: 3550449 - DNA, 15 bp, Homo sapiens
tgtgattggctgcag

SEQ ID NO: 3550450 - DNA, 14 bp, Homo sapiens
tgtgattggctggt

SEQ ID NO: 3550451 - DNA, 15 bp, Homo sapiens
tgtgatttgaattct

SEQ ID NO: 3550452 - DNA, 16 bp, Homo sapiens
tgtgatttgaattctg

SEQ ID NO: 3550453 - DNA, 12 bp, Homo sapiens
tgtgatttttgt

SEQ ID NO: 3550454 - DNA, 17 bp, Homo sapiens
tgtgatttttgtttgca

SEQ ID NO: 3550455 - DNA, 17 bp, Homo sapiens
tgtgcacatctgttttg

SEQ ID NO: 3550456 - DNA, 12 bp, Homo sapiens
tgtgcactaagg

SEQ ID NO: 3550457 - DNA, 16 bp, Homo sapiens
tgtgcactaaggggcc

SEQ ID NO: 3550458 - DNA, 17 bp, Homo sapiens
tgtgcactaaggggccc

SEQ ID NO: 3550459 - DNA, 18 bp, Homo sapiens
tgtgcactgcctgcatga

SEQ ID NO: 3550460 - DNA, 19 bp, Homo sapiens
tgtgcactgcctgcatgag

SEQ ID NO: 3550461 - DNA, 21 bp, Homo sapiens
tgtgcactgcctgcatgagct

SEQ ID NO: 3550462 - DNA, 16 bp, Homo sapiens
tgtgcagcatttcact

SEQ ID NO: 3550463 - DNA, 22 bp, Homo sapiens
tgtgcagcctgtcctgggctgg

SEQ ID NO: 3550464 - DNA, 15 bp, Homo sapiens
tgtgcagtttggaat

SEQ ID NO: 3550465 - DNA, 22 bp, Homo sapiens
tgtgcatgctagtgttgtattt

SEQ ID NO: 3550466 - DNA, 14 bp, Homo sapiens
tgtgccaacctgtt

SEQ ID NO: 3550467 - DNA, 22 bp, Homo sapiens
tgtgccaactgccaggctgcct

SEQ ID NO: 3550468 - DNA, 12 bp, Homo sapiens
tgtgccacaggc

SEQ ID NO: 3550469 - DNA, 16 bp, Homo sapiens
tgtgccacaggcttag

SEQ ID NO: 3550470 - DNA, 15 bp, Homo sapiens
tgtgccagcaccaca

SEQ ID NO: 3550471 - DNA, 18 bp, Homo sapiens
tgtgccagcaccacagcc

SEQ ID NO: 3550472 - DNA, 18 bp, Homo sapiens
tgtgcccctaaagagcat

SEQ ID NO: 3550473 - DNA, 19 bp, Homo sapiens
tgtgcccctaaagagcatc

SEQ ID NO: 3550474 - DNA, 22 bp, Homo sapiens
tgtgcccctaaagagcatcctg

SEQ ID NO: 3550475 - DNA, 19 bp, Homo sapiens
tgtgcccgcatgtgtgcct

SEQ ID NO: 3550476 - DNA, 12 bp, Homo sapiens
tgtgcctctgcc

SEQ ID NO: 3550477 - DNA, 13 bp, Homo sapiens
tgtgcctctgcct

SEQ ID NO: 3550478 - DNA, 13 bp, Homo sapiens
tgtgcctctggga

SEQ ID NO: 3550479 - DNA, 17 bp, Homo sapiens
tgtgcctctgggactgg

SEQ ID NO: 3550480 - DNA, 15 bp, Homo sapiens
tgtgccttccctttc

SEQ ID NO: 3550481 - DNA, 15 bp, Homo sapiens
tgtgccttctttgta

SEQ ID NO: 3550482 - DNA, 14 bp, Homo sapiens
tgtgcctttcctat

SEQ ID NO: 3550483 - DNA, 16 bp, Homo sapiens
tgtgcctttctttgcc

SEQ ID NO: 3550484 - DNA, 17 bp, Homo sapiens
tgtgcctttctttgcct

SEQ ID NO: 3550485 - DNA, 15 bp, Homo sapiens
tgtgcctttggcctg

SEQ ID NO: 3550486 - DNA, 16 bp, Homo sapiens
tgtgcctttggcctgg

SEQ ID NO: 3550487 - DNA, 23 bp, Homo sapiens
tgtgcgtcccagctgaaggcagt

SEQ ID NO: 3550488 - DNA, 18 bp, Homo sapiens
tgtgctgtttcaaagttc

SEQ ID NO: 3550489 - DNA, 21 bp, Homo sapiens
tgtgctttggaacaatcacag

SEQ ID NO: 3550490 - DNA, 16 bp, Homo sapiens
tgtgctttttgtcatg

SEQ ID NO: 3550491 - DNA, 21 bp, Homo sapiens
tgtggaaagtcacaggtcaca

SEQ ID NO: 3550492 - DNA, 15 bp, Homo sapiens
tgtggaagtgtgggt

SEQ ID NO: 3550493 - DNA, 15 bp, Homo sapiens
tgtggagatggactc

SEQ ID NO: 3550494 - DNA, 23 bp, Homo sapiens
tgtggcaaaaagagtcagacatt

SEQ ID NO: 3550495 - DNA, 15 bp, Homo sapiens
tgtggcagagttaca

SEQ ID NO: 3550496 - DNA, 21 bp, Homo sapiens
tgtggcagagttacagttctg

SEQ ID NO: 3550497 - DNA, 17 bp, Homo sapiens
tgtggccaaggagctgc

SEQ ID NO: 3550498 - DNA, 21 bp, Homo sapiens
tgtggccaaggagctgctata

SEQ ID NO: 3550499 - DNA, 22 bp, Homo sapiens
tgtggcccctgaacaagaattg

SEQ ID NO: 3550500 - DNA, 12 bp, Homo sapiens
tgtggccctggc

SEQ ID NO: 3550501 - DNA, 16 bp, Homo sapiens
tgtggccctggccact

SEQ ID NO: 3550502 - DNA, 16 bp, Homo sapiens
tgtggcctgcaggagg

SEQ ID NO: 3550503 - DNA, 17 bp, Homo sapiens
tggtttattctttgcaa

SEQ ID NO: 3550504 - DNA, 12 bp, Homo sapiens
tggtttcttcat

SEQ ID NO: 3550505 - DNA, 18 bp, Homo sapiens
tggtttcttcattcttta

SEQ ID NO: 3550506 - DNA, 22 bp, Homo sapiens
tgtaaaaacccaagtccctgtc

SEQ ID NO: 3550507 - DNA, 11 bp, Homo sapiens
tgtaaaaatga

SEQ ID NO: 3550508 - DNA, 17 bp, Homo sapiens
tgtaaaaatgaaggaat

SEQ ID NO: 3550509 - DNA, 14 bp, Homo sapiens
tgtaaaatgtatat

SEQ ID NO: 3550510 - DNA, 22 bp, Homo sapiens
tgtaaaattgttaaccttgtaa

SEQ ID NO: 3550511 - DNA, 22 bp, Homo sapiens
tgtaaactgtttctttaaaatt

SEQ ID NO: 3550512 - DNA, 15 bp, Homo sapiens
tgtaaagatgaatgt

SEQ ID NO: 3550513 - DNA, 18 bp, Homo sapiens
tgtaaatcctagacttga

SEQ ID NO: 3550514 - DNA, 14 bp, Homo sapiens
tgtaaatgaaactt

SEQ ID NO: 3550515 - DNA, 14 bp, Homo sapiens
tgtaacaagaaaat

SEQ ID NO: 3550516 - DNA, 19 bp, Homo sapiens
tgtaacaggatacaggtga

SEQ ID NO: 3550517 - DNA, 23 bp, Homo sapiens
tgtaactaaaataattttgtaat

SEQ ID NO: 3550518 - DNA, 17 bp, Homo sapiens
tgtaacttcctgctgca

SEQ ID NO: 3550519 - DNA, 16 bp, Homo sapiens
tgtaacttttgtaaga

SEQ ID NO: 3550520 - DNA, 15 bp, Homo sapiens
tgtaagaaatacaga

SEQ ID NO: 3550521 - DNA, 20 bp, Homo sapiens
tgtaagacaaaggttttcct

SEQ ID NO: 3550522 - DNA, 20 bp, Homo sapiens
tgtaagatcgttctctgcct

SEQ ID NO: 3550523 - DNA, 19 bp, Homo sapiens
tgtaagcaggagagaaatt

SEQ ID NO: 3550524 - DNA, 14 bp, Homo sapiens
tgtaagctttgttc

SEQ ID NO: 3550525 - DNA, 13 bp, Homo sapiens
tgtaagggcagtg

SEQ ID NO: 3550526 - DNA, 15 bp, Homo sapiens
tgtaagggcagtgcc

SEQ ID NO: 3550527 - DNA, 12 bp, Homo sapiens
tgtaataaactc

SEQ ID NO: 3550528 - DNA, 19 bp, Homo sapiens
tgtaataataaagaatagc

SEQ ID NO: 3550529 - DNA, 15 bp, Homo sapiens
tgtaatgacaaaaga

SEQ ID NO: 3550530 - DNA, 13 bp, Homo sapiens
tgtaatgctgcac

SEQ ID NO: 3550531 - DNA, 14 bp, Homo sapiens
tgtaatgctgcact

SEQ ID NO: 3550532 - DNA, 15 bp, Homo sapiens
tgtaatgctgcctca

SEQ ID NO: 3550533 - DNA, 16 bp, Homo sapiens
tgtaatgctgcctcag

SEQ ID NO: 3550534 - DNA, 19 bp, Homo sapiens
tgtaatgtttttatttcaa

SEQ ID NO: 3550535 - DNA, 20 bp, Homo sapiens
tgtaatgtttttatttcaat

SEQ ID NO: 3550536 - DNA, 23 bp, Homo sapiens
tgtaatgtttttatttcaattgt

SEQ ID NO: 3550537 - DNA, 21 bp, Homo sapiens
tgtaattagtgccacttaatg

SEQ ID NO: 3550538 - DNA, 23 bp, Homo sapiens
tgtaattagtgccacttaatgta

SEQ ID NO: 3550539 - DNA, 21 bp, Homo sapiens
tgtaattatatctaaaatatt

SEQ ID NO: 3550540 - DNA, 20 bp, Homo sapiens
tgtaattgtaattccaaaat

SEQ ID NO: 3550541 - DNA, 17 bp, Homo sapiens
tgtaatttaaaattgtg

SEQ ID NO: 3550542 - DNA, 18 bp, Homo sapiens
tgtaatttaaaattgtga

SEQ ID NO: 3550543 - DNA, 20 bp, Homo sapiens
tgtaatttaaaattgtgatg

SEQ ID NO: 3550544 - DNA, 16 bp, Homo sapiens
tgtaattttgtgtaag

SEQ ID NO: 3550545 - DNA, 13 bp, Homo sapiens
tgtacaataaatt

SEQ ID NO: 3550546 - DNA, 18 bp, Homo sapiens
tgtacaatgtacacactg

SEQ ID NO: 3550547 - DNA, 16 bp, Homo sapiens
tgtacagtctgctcct

SEQ ID NO: 3550548 - DNA, 20 bp, Homo sapiens
tgtacataactcctgtccct

SEQ ID NO: 3550549 - DNA, 14 bp, Homo sapiens
tgtacatagtcctt

SEQ ID NO: 3550550 - DNA, 17 bp, Homo sapiens
tgtacatatgtgctgga

SEQ ID NO: 3550551 - DNA, 16 bp, Homo sapiens
tgtacattctgcctag

SEQ ID NO: 3550552 - DNA, 13 bp, Homo sapiens
tggcagctgctgt

SEQ ID NO: 3550553 - DNA, 17 bp, Homo sapiens
tggcagcttgctgggct

SEQ ID NO: 3550554 - DNA, 20 bp, Homo sapiens
tggcagcttgctgggctttg

SEQ ID NO: 3550555 - DNA, 22 bp, Homo sapiens
tggcagcttgctgggctttggg

SEQ ID NO: 3550556 - DNA, 14 bp, Homo sapiens
tggcaggactcctg

SEQ ID NO: 3550557 - DNA, 16 bp, Homo sapiens
tggcaggactcctggc

SEQ ID NO: 3550558 - DNA, 23 bp, Homo sapiens
tggcaggactcctggcagggcca

SEQ ID NO: 3550559 - DNA, 18 bp, Homo sapiens
tggcaggagtctctgcca

SEQ ID NO: 3550560 - DNA, 13 bp, Homo sapiens
tggcaggcccact

SEQ ID NO: 3550561 - DNA, 19 bp, Homo sapiens
tggcaggcccactccccag

SEQ ID NO: 3550562 - DNA, 22 bp, Homo sapiens
tggcaggcccactccccagccc

SEQ ID NO: 3550563 - DNA, 16 bp, Homo sapiens
tggcagggacctgaga

SEQ ID NO: 3550564 - DNA, 19 bp, Homo sapiens
tggcagggccacctgcagg

SEQ ID NO: 3550565 - DNA, 24 bp, Homo sapiens
tggcagggccacctgcaggaccct

SEQ ID NO: 3550566 - DNA, 14 bp, Homo sapiens
tggcaggggagcag

SEQ ID NO: 3550567 - DNA, 14 bp, Homo sapiens
tggcaggtgtggga

SEQ ID NO: 3550568 - DNA, 22 bp, Homo sapiens
tggcagtgggaatgttctttct

SEQ ID NO: 3550569 - DNA, 15 bp, Homo sapiens
tggcatagccccggc

SEQ ID NO: 3550570 - DNA, 16 bp, Homo sapiens
tggcatagccccggcc

SEQ ID NO: 3550571 - DNA, 13 bp, Homo sapiens
tggcatcaaggga

SEQ ID NO: 3550572 - DNA, 22 bp, Homo sapiens
tggcatcaagggagacaccagt

SEQ ID NO: 3550573 - DNA, 22 bp, Homo sapiens
tggcatctgaatgaaaataact

SEQ ID NO: 3550574 - DNA, 14 bp, Homo sapiens
tggcatggcaggag

SEQ ID NO: 3550575 - DNA, 18 bp, Homo sapiens
tggccaaggagctgctat

SEQ ID NO: 3550576 - DNA, 17 bp, Homo sapiens
tggccacaaacctgccc

SEQ ID NO: 3550577 - DNA, 13 bp, Homo sapiens
tggccacagactg

SEQ ID NO: 3550578 - DNA, 18 bp, Homo sapiens
tggccactaaagcttcag

SEQ ID NO: 3550579 - DNA, 18 bp, Homo sapiens
tggccactaagcagagga

SEQ ID NO: 3550580 - DNA, 19 bp, Homo sapiens
tggccactaagcagaggag

SEQ ID NO: 3550581 - DNA, 16 bp, Homo sapiens
tggccaggcagggaga

SEQ ID NO: 3550582 - DNA, 23 bp, Homo sapiens
tggccaggccttacatctggctg

SEQ ID NO: 3550583 - DNA, 15 bp, Homo sapiens
tggccaggtggccac

SEQ ID NO: 3550584 - DNA, 19 bp, Homo sapiens
tggccaggtggccactcca

SEQ ID NO: 3550585 - DNA, 14 bp, Homo sapiens
tggccagtggctgg

SEQ ID NO: 3550586 - DNA, 20 bp, Homo sapiens
tggccatcttctttcttcca

SEQ ID NO: 3550587 - DNA, 22 bp, Homo sapiens
tggccatgatgtccttggactc

SEQ ID NO: 3550588 - DNA, 16 bp, Homo sapiens
tggccatttctgtgga

SEQ ID NO: 3550589 - DNA, 14 bp, Homo sapiens
tggccatttgcttt

SEQ ID NO: 3550590 - DNA, 17 bp, Homo sapiens
tggcccaggaccatcat

SEQ ID NO: 3550591 - DNA, 15 bp, Homo sapiens
tggcccagggcccag

SEQ ID NO: 3550592 - DNA, 23 bp, Homo sapiens
tggcccagggcccagagcccagc

SEQ ID NO: 3550593 - DNA, 18 bp, Homo sapiens
tggcccagtgccagcaag

SEQ ID NO: 3550594 - DNA, 21 bp, Homo sapiens
tggccccagtgcggttcctca

SEQ ID NO: 3550595 - DNA, 14 bp, Homo sapiens
tggccccctgtcct

SEQ ID NO: 3550596 - DNA, 20 bp, Homo sapiens
tggcccccttcaggagcctg

SEQ ID NO: 3550597 - DNA, 16 bp, Homo sapiens
tggccccgccctcagg

SEQ ID NO: 3550598 - DNA, 17 bp, Homo sapiens
tggccccgccctcaggc

SEQ ID NO: 3550599 - DNA, 18 bp, Homo sapiens
tggcccgacagcctggca

SEQ ID NO: 3550600 - DNA, 13 bp, Homo sapiens
tggccctcctcag

SEQ ID NO: 3550601 - DNA, 14 bp, Homo sapiens
tggccctcctcagc

SEQ ID NO: 3550602 - DNA, 13 bp, Homo sapiens
tggcccttaagcc

SEQ ID NO: 3550603 - DNA, 13 bp, Homo sapiens
tggcccttgggga

SEQ ID NO: 3550604 - DNA, 15 bp, Homo sapiens
tggccgactcaggga

SEQ ID NO: 3550605 - DNA, 18 bp, Homo sapiens
tggccgactcagggacct

SEQ ID NO: 3550606 - DNA, 12 bp, Homo sapiens
tggccgggcagg

SEQ ID NO: 3550607 - DNA, 20 bp, Homo sapiens
tggcctatgaaactggttta

SEQ ID NO: 3550608 - DNA, 13 bp, Homo sapiens
tggcctcatttca

SEQ ID NO: 3550609 - DNA, 21 bp, Homo sapiens
tggcctcccaaagtgctggga

SEQ ID NO: 3550610 - DNA, 15 bp, Homo sapiens
tggcctccctgctgt

SEQ ID NO: 3550611 - DNA, 18 bp, Homo sapiens
tggcctcgtgaggggcaa

SEQ ID NO: 3550612 - DNA, 23 bp, Homo sapiens
tggcctcttgagttcctctgcag

SEQ ID NO: 3550613 - DNA, 18 bp, Homo sapiens
tggcctgaactgaggaga

SEQ ID NO: 3550614 - DNA, 14 bp, Homo sapiens
tggcctgcaggagg

SEQ ID NO: 3550615 - DNA, 15 bp, Homo sapiens
tggcctgccatgcca

SEQ ID NO: 3550616 - DNA, 13 bp, Homo sapiens
tggcctggagcag

SEQ ID NO: 3550617 - DNA, 18 bp, Homo sapiens
tggcctggagcaggccca

SEQ ID NO: 3550618 - DNA, 16 bp, Homo sapiens
tggcctgtctgcgtgg

SEQ ID NO: 3550619 - DNA, 17 bp, Homo sapiens
tggccttaaagagggac

SEQ ID NO: 3550620 - DNA, 21 bp, Homo sapiens
tggccttgggatccaggcccc

SEQ ID NO: 3550621 - DNA, 21 bp, Homo sapiens
tggcctttatgttctttcacc

SEQ ID NO: 3550622 - DNA, 16 bp, Homo sapiens
tggcctttttcattta

SEQ ID NO: 3550623 - DNA, 19 bp, Homo sapiens
tggcctttttcatttatct

SEQ ID NO: 3550624 - DNA, 16 bp, Homo sapiens
tggcggaggtctctgg

SEQ ID NO: 3550625 - DNA, 15 bp, Homo sapiens
tggcggcccggccgg

SEQ ID NO: 3550626 - DNA, 18 bp, Homo sapiens
tggcgtctggactgttct

SEQ ID NO: 3550627 - DNA, 17 bp, Homo sapiens
tggctaatgtactgcat

SEQ ID NO: 3550628 - DNA, 15 bp, Homo sapiens
tggctagtcaagctc

SEQ ID NO: 3550629 - DNA, 17 bp, Homo sapiens
tggctagtcaagctcct

SEQ ID NO: 3550630 - DNA, 18 bp, Homo sapiens
tggctagtcaagctcctc

SEQ ID NO: 3550631 - DNA, 20 bp, Homo sapiens
tggctagtcaagctcctcct

SEQ ID NO: 3550632 - DNA, 22 bp, Homo sapiens
tggctagtcaagctcctcctcc

SEQ ID NO: 3550633 - DNA, 23 bp, Homo sapiens
tggctataggtgctacaaaaaca

SEQ ID NO: 3550634 - DNA, 18 bp, Homo sapiens
tggctcacaaggcccagg

SEQ ID NO: 3550635 - DNA, 16 bp, Homo sapiens
tggctcacacctgtaa

SEQ ID NO: 3550636 - DNA, 19 bp, Homo sapiens
tggctcacatggtttacat

SEQ ID NO: 3550637 - DNA, 19 bp, Homo sapiens
tggctccactcttgatctc

SEQ ID NO: 3550638 - DNA, 14 bp, Homo sapiens
tggctccccaaggc

SEQ ID NO: 3550639 - DNA, 14 bp, Homo sapiens
tggctcctcccggt

SEQ ID NO: 3550640 - DNA, 14 bp, Homo sapiens
tggctcctctcagt

SEQ ID NO: 3550641 - DNA, 19 bp, Homo sapiens
tggctctaattcacagtgc

SEQ ID NO: 3550642 - DNA, 13 bp, Homo sapiens
tggctctgccccc

SEQ ID NO: 3550643 - DNA, 18 bp, Homo sapiens
tggctctgccccctcccc

SEQ ID NO: 3550644 - DNA, 12 bp, Homo sapiens
tggctctgctgg

SEQ ID NO: 3550645 - DNA, 20 bp, Homo sapiens
tggctctgggtgaggtaggc

SEQ ID NO: 3550646 - DNA, 14 bp, Homo sapiens
tggctgacccctct

SEQ ID NO: 3550647 - DNA, 16 bp, Homo sapiens
tggctgacccctctgg

SEQ ID NO: 3550648 - DNA, 15 bp, Homo sapiens
tggctgagcccctgg

SEQ ID NO: 3550649 - DNA, 16 bp, Homo sapiens
tggctgagcccctggg

SEQ ID NO: 3550650 - DNA, 17 bp, Homo sapiens
tggctgagcccctgtct

SEQ ID NO: 3550651 - DNA, 19 bp, Homo sapiens
tggctgcaggaagaaactt

SEQ ID NO: 3550652 - DNA, 13 bp, Homo sapiens
tggctgcccagga

SEQ ID NO: 3550653 - DNA, 14 bp, Homo sapiens
tggctgcccaggag

SEQ ID NO: 3550654 - DNA, 18 bp, Homo sapiens
tggctgccccggcctcct

SEQ ID NO: 3550655 - DNA, 16 bp, Homo sapiens
tggctgccttctttcc

SEQ ID NO: 3550656 - DNA, 22 bp, Homo sapiens
tggctgcggggcgggcacacct

SEQ ID NO: 3550657 - DNA, 15 bp, Homo sapiens
tggggcctcaggctc

SEQ ID NO: 3550658 - DNA, 19 bp, Homo sapiens
tggggcgggtggggccata

SEQ ID NO: 3550659 - DNA, 22 bp, Homo sapiens
tggggcgtttcctactgcgcct

SEQ ID NO: 3550660 - DNA, 20 bp, Homo sapiens
tggggctgtgttatgaaaat

SEQ ID NO: 3550661 - DNA, 22 bp, Homo sapiens
tgggggaacactgagaaagagg

SEQ ID NO: 3550662 - DNA, 20 bp, Homo sapiens
tgggggaactcagatccagg

SEQ ID NO: 3550663 - DNA, 19 bp, Homo sapiens
tgggggaggagcctctggc

SEQ ID NO: 3550664 - DNA, 11 bp, Homo sapiens
tgggggatgta

SEQ ID NO: 3550665 - DNA, 22 bp, Homo sapiens
tgggggcaggaaagccacatct

SEQ ID NO: 3550666 - DNA, 20 bp, Homo sapiens
tgggggcccgacaggtgggc

SEQ ID NO: 3550667 - DNA, 22 bp, Homo sapiens
tgggggcccgacaggtgggcct

SEQ ID NO: 3550668 - DNA, 23 bp, Homo sapiens
tgggggcccgacaggtgggcctg

SEQ ID NO: 3550669 - DNA, 17 bp, Homo sapiens
tgggggctgaggagcag

SEQ ID NO: 3550670 - DNA, 22 bp, Homo sapiens
tgggggtcagcatccagtgtga

SEQ ID NO: 3550671 - DNA, 21 bp, Homo sapiens
tgggggtgccgctttctctga

SEQ ID NO: 3550672 - DNA, 16 bp, Homo sapiens
tgggggtgctgctctc

SEQ ID NO: 3550673 - DNA, 16 bp, Homo sapiens
tgggggtgggccaggc

SEQ ID NO: 3550674 - DNA, 12 bp, Homo sapiens
tgggggtggggg

SEQ ID NO: 3550675 - DNA, 19 bp, Homo sapiens
tgggggttctttcttcctc

SEQ ID NO: 3550676 - DNA, 13 bp, Homo sapiens
tggggtccctcta

SEQ ID NO: 3550677 - DNA, 14 bp, Homo sapiens
tggggtcggagagg

SEQ ID NO: 3550678 - DNA, 22 bp, Homo sapiens
tggggtctcctcaggaccaggg

SEQ ID NO: 3550679 - DNA, 21 bp, Homo sapiens
tggggtctggagttgatctgg

SEQ ID NO: 3550680 - DNA, 19 bp, Homo sapiens
tggggtggcacctgtttcc

SEQ ID NO: 3550681 - DNA, 18 bp, Homo sapiens
tggggttgcgtctgaggc

SEQ ID NO: 3550682 - DNA, 20 bp, Homo sapiens
tggggttgctgaagatgcct

SEQ ID NO: 3550683 - DNA, 21 bp, Homo sapiens
tggggtttgtgtttgattggc

SEQ ID NO: 3550684 - DNA, 17 bp, Homo sapiens
tgggtaattgtacaata

SEQ ID NO: 3550685 - DNA, 20 bp, Homo sapiens
tgggtaattgtacaataaat

SEQ ID NO: 3550686 - DNA, 22 bp, Homo sapiens
tgggtagggtagtggctggggt

SEQ ID NO: 3550687 - DNA, 20 bp, Homo sapiens
tgggtcaccagacggggctg

SEQ ID NO: 3550688 - DNA, 21 bp, Homo sapiens
tgggtcaccagacggggctgg

SEQ ID NO: 3550689 - DNA, 12 bp, Homo sapiens
tgggtccaggga

SEQ ID NO: 3550690 - DNA, 13 bp, Homo sapiens
tgggtccagggag

SEQ ID NO: 3550691 - DNA, 13 bp, Homo sapiens
tgggtccagggcc

SEQ ID NO: 3550692 - DNA, 15 bp, Homo sapiens
tgggtcccagagacc

SEQ ID NO: 3550693 - DNA, 12 bp, Homo sapiens
tgggtgagagag

SEQ ID NO: 3550694 - DNA, 23 bp, Homo sapiens
tgggtggaagtgtgtgccaagag

SEQ ID NO: 3550695 - DNA, 16 bp, Homo sapiens
tgggtgggattttgca

SEQ ID NO: 3550696 - DNA, 18 bp, Homo sapiens
tgggtgggattttgcaaa

SEQ ID NO: 3550697 - DNA, 15 bp, Homo sapiens
tgggtgttattttta

SEQ ID NO: 3550698 - DNA, 20 bp, Homo sapiens
tggaacataaaaaggacatc

SEQ ID NO: 3550699 - DNA, 20 bp, Homo sapiens
tggaacataaaatacaatgt

SEQ ID NO: 3550700 - DNA, 12 bp, Homo sapiens
tggaacccagac

SEQ ID NO: 3550701 - DNA, 14 bp, Homo sapiens
tggaacccagactc

SEQ ID NO: 3550702 - DNA, 15 bp, Homo sapiens
tggaacccagactca

SEQ ID NO: 3550703 - DNA, 17 bp, Homo sapiens
tggaacctcagcctggc

SEQ ID NO: 3550704 - DNA, 19 bp, Homo sapiens
tggaacctcagcctggcca

SEQ ID NO: 3550705 - DNA, 17 bp, Homo sapiens
tggaacgctaatgaaac

SEQ ID NO: 3550706 - DNA, 18 bp, Homo sapiens
tggaacgctaatgaaaca

SEQ ID NO: 3550707 - DNA, 23 bp, Homo sapiens
tggaagcatgtagactgtgccag

SEQ ID NO: 3550708 - DNA, 12 bp, Homo sapiens
tggaagccaggt

SEQ ID NO: 3550709 - DNA, 15 bp, Homo sapiens
tggaagccgcgcggc

SEQ ID NO: 3550710 - DNA, 13 bp, Homo sapiens
tggaaggagaggg

SEQ ID NO: 3550711 - DNA, 23 bp, Homo sapiens
tggaaggggccacgtggatgggc

SEQ ID NO: 3550712 - DNA, 16 bp, Homo sapiens
tggaagtacttggccc

SEQ ID NO: 3550713 - DNA, 23 bp, Homo sapiens
tggaagtacttggcccccttcag

SEQ ID NO: 3550714 - DNA, 18 bp, Homo sapiens
tggaagtgaaaactttgt

SEQ ID NO: 3550715 - DNA, 17 bp, Homo sapiens
tggaataaagttgcaga

SEQ ID NO: 3550716 - DNA, 18 bp, Homo sapiens
tggaataaagttgcagat

SEQ ID NO: 3550717 - DNA, 15 bp, Homo sapiens
tggaatacacatgca

SEQ ID NO: 3550718 - DNA, 15 bp, Homo sapiens
tggaatacatgaaat

SEQ ID NO: 3550719 - DNA, 15 bp, Homo sapiens
tggaatagcagcctc

SEQ ID NO: 3550720 - DNA, 19 bp, Homo sapiens
tggaatagtatcctccagg

SEQ ID NO: 3550721 - DNA, 21 bp, Homo sapiens
tggaatagtatcctccaggtt

SEQ ID NO: 3550722 - DNA, 15 bp, Homo sapiens
tggaatccagaagga

SEQ ID NO: 3550723 - DNA, 16 bp, Homo sapiens
tggaatccagaaggaa

SEQ ID NO: 3550724 - DNA, 18 bp, Homo sapiens
tggaatccagaaggaagc

SEQ ID NO: 3550725 - DNA, 19 bp, Homo sapiens
tggaatgccgctgtctctg

SEQ ID NO: 3550726 - DNA, 20 bp, Homo sapiens
tggaatgccgctgtctctga

SEQ ID NO: 3550727 - DNA, 21 bp, Homo sapiens
tggaatggctgagcaaatatt

SEQ ID NO: 3550728 - DNA, 20 bp, Homo sapiens
tggacacaacagcagtctcc

SEQ ID NO: 3550729 - DNA, 23 bp, Homo sapiens
tggacacaataggtctttctctc

SEQ ID NO: 3550730 - DNA, 15 bp, Homo sapiens
tggacacagctcttc

SEQ ID NO: 3550731 - DNA, 12 bp, Homo sapiens
tggacagacaga

SEQ ID NO: 3550732 - DNA, 12 bp, Homo sapiens
tggacagcccca

SEQ ID NO: 3550733 - DNA, 12 bp, Homo sapiens
tggacagctgat

SEQ ID NO: 3550734 - DNA, 20 bp, Homo sapiens
tggacagctgataaatttaa

SEQ ID NO: 3550735 - DNA, 16 bp, Homo sapiens
tggacatactgctgga

SEQ ID NO: 3550736 - DNA, 17 bp, Homo sapiens
tggacatactgctggag

SEQ ID NO: 3550737 - DNA, 13 bp, Homo sapiens
tggacattttatg

SEQ ID NO: 3550738 - DNA, 19 bp, Homo sapiens
tggaccactgggcaatgat

SEQ ID NO: 3550739 - DNA, 22 bp, Homo sapiens
tggaccgaggttcccactctgg

SEQ ID NO: 3550740 - DNA, 19 bp, Homo sapiens
tggacgggatgacctccag

SEQ ID NO: 3550741 - DNA, 21 bp, Homo sapiens
tggacgggatgacctccagaa

SEQ ID NO: 3550742 - DNA, 22 bp, Homo sapiens
tggacgggatgacctccagaag

SEQ ID NO: 3550743 - DNA, 19 bp, Homo sapiens
tggacgttaggccaggcct

SEQ ID NO: 3550744 - DNA, 19 bp, Homo sapiens
tggactcctgccaccagca

SEQ ID NO: 3550745 - DNA, 14 bp, Homo sapiens
tggactctaaagtc

SEQ ID NO: 3550746 - DNA, 17 bp, Homo sapiens
tggactgtgctggtgca

SEQ ID NO: 3550747 - DNA, 16 bp, Homo sapiens
tggactgttctgtaga

SEQ ID NO: 3550748 - DNA, 19 bp, Homo sapiens
tggacttgtgattggctgc

SEQ ID NO: 3550749 - DNA, 15 bp, Homo sapiens
tggagaaagaagtgg

SEQ ID NO: 3550750 - DNA, 19 bp, Homo sapiens
tggagaaagaagtggagac

SEQ ID NO: 3550751 - DNA, 23 bp, Homo sapiens
tggagaaagagctgcctggatga

SEQ ID NO: 3550752 - DNA, 15 bp, Homo sapiens
tggagaacagtggtt

SEQ ID NO: 3550753 - DNA, 20 bp, Homo sapiens
tggagaacagtggttgcctg

SEQ ID NO: 3550754 - DNA, 17 bp, Homo sapiens
tggagaaggtctgtggt

SEQ ID NO: 3550755 - DNA, 17 bp, Homo sapiens
tggagacaaggtgctaa

SEQ ID NO: 3550756 - DNA, 18 bp, Homo sapiens
tggagacaaggtgctaac

SEQ ID NO: 3550757 - DNA, 20 bp, Homo sapiens
tggagacaaggtgctaacat

SEQ ID NO: 3550758 - DNA, 13 bp, Homo sapiens
tggagacagcagt

SEQ ID NO: 3550759 - DNA, 22 bp, Homo sapiens
tggagacagtcctttcccacca

SEQ ID NO: 3550760 - DNA, 16 bp, Homo sapiens
tggagaccaggctcct

SEQ ID NO: 3550761 - DNA, 22 bp, Homo sapiens
tggagactactggccccgcccg

SEQ ID NO: 3550762 - DNA, 14 bp, Homo sapiens
tggagactgtctca

SEQ ID NO: 3550763 - DNA, 14 bp, Homo sapiens
tggagagagcaggg

SEQ ID NO: 3550764 - DNA, 15 bp, Homo sapiens
tggagagagcagggc

SEQ ID NO: 3550765 - DNA, 17 bp, Homo sapiens
tggagagagcagggcta

SEQ ID NO: 3550766 - DNA, 16 bp, Homo sapiens
tggagaggccctctgg

SEQ ID NO: 3550767 - DNA, 15 bp, Homo sapiens
tggagagtttcctga

SEQ ID NO: 3550768 - DNA, 18 bp, Homo sapiens
tggagatggaagcttgtt

SEQ ID NO: 3550769 - DNA, 12 bp, Homo sapiens
tggagcagcagg

SEQ ID NO: 3550770 - DNA, 17 bp, Homo sapiens
tggagcagcaggcctct

SEQ ID NO: 3550771 - DNA, 19 bp, Homo sapiens
tggagcctacctctgtctg

SEQ ID NO: 3550772 - DNA, 20 bp, Homo sapiens
tggagcctacctctgtctga

SEQ ID NO: 3550773 - DNA, 19 bp, Homo sapiens
tggagctgccacagagaag

SEQ ID NO: 3550774 - DNA, 17 bp, Homo sapiens
tggaggactgtgacaga

SEQ ID NO: 3550775 - DNA, 14 bp, Homo sapiens
tggaggagagagac

SEQ ID NO: 3550776 - DNA, 16 bp, Homo sapiens
tggaggagagagaccc

SEQ ID NO: 3550777 - DNA, 12 bp, Homo sapiens
tggaggaggcct

SEQ ID NO: 3550778 - DNA, 14 bp, Homo sapiens
tggaggctcctcta

SEQ ID NO: 3550779 - DNA, 13 bp, Homo sapiens
tggagggcttggc

SEQ ID NO: 3550780 - DNA, 18 bp, Homo sapiens
tggaggtcatctggcgga

SEQ ID NO: 3550781 - DNA, 15 bp, Homo sapiens
tggaggtctccaggg

SEQ ID NO: 3550782 - DNA, 17 bp, Homo sapiens
tggaggtctccaggggc

SEQ ID NO: 3550783 - DNA, 16 bp, Homo sapiens
tggaggtctggctgag

SEQ ID NO: 3550784 - DNA, 17 bp, Homo sapiens
tggaggtctggctgagc

SEQ ID NO: 3550785 - DNA, 19 bp, Homo sapiens
tggaggtctggctgagccc

SEQ ID NO: 3550786 - DNA, 23 bp, Homo sapiens
tggagtcaggtgtcgaggccaca

SEQ ID NO: 3550787 - DNA, 20 bp, Homo sapiens
tggagtgagtcacctgctcc

SEQ ID NO: 3550788 - DNA, 22 bp, Homo sapiens
tggagtgagtcacctgctccag

SEQ ID NO: 3550789 - DNA, 23 bp, Homo sapiens
tggagtgagtcacctgctccaga

SEQ ID NO: 3550790 - DNA, 16 bp, Homo sapiens
tggagtgctcttccca

SEQ ID NO: 3550791 - DNA, 15 bp, Homo sapiens
tggagttgatctgga

SEQ ID NO: 3550792 - DNA, 16 bp, Homo sapiens
tggagttggtggtgct

SEQ ID NO: 3550793 - DNA, 19 bp, Homo sapiens
tggagttttataaattaaa

SEQ ID NO: 3550794 - DNA, 13 bp, Homo sapiens
tggataagtttct

SEQ ID NO: 3550795 - DNA, 18 bp, Homo sapiens
tggatacatacaccagca

SEQ ID NO: 3550796 - DNA, 19 bp, Homo sapiens
tggatatttcaatctttta

SEQ ID NO: 3550797 - DNA, 23 bp, Homo sapiens
tggatccatcttgagccacagtc

SEQ ID NO: 3550798 - DNA, 15 bp, Homo sapiens
tggatctgtgagggg

SEQ ID NO: 3550799 - DNA, 19 bp, Homo sapiens
tggatcttcagaactgccc

SEQ ID NO: 3550800 - DNA, 20 bp, Homo sapiens
tggatcttcagaactgccct

SEQ ID NO: 3550801 - DNA, 14 bp, Homo sapiens
tggatggcagactc

SEQ ID NO: 3550802 - DNA, 18 bp, Homo sapiens
tggatgggcaaagcttgt

SEQ ID NO: 3550803 - DNA, 18 bp, Homo sapiens
tggatgggggaactcaga

SEQ ID NO: 3550804 - DNA, 19 bp, Homo sapiens
tggatgttgctatagtgac

SEQ ID NO: 3550805 - DNA, 23 bp, Homo sapiens
tggattcacccccctctgctgcc

SEQ ID NO: 3550806 - DNA, 20 bp, Homo sapiens
tggattgcgcctaatgtgtt

SEQ ID NO: 3550807 - DNA, 14 bp, Homo sapiens
tggattggggtccc

SEQ ID NO: 3550808 - DNA, 19 bp, Homo sapiens
tggattgtatttaagacat

SEQ ID NO: 3550809 - DNA, 20 bp, Homo sapiens
tggatttcctagtggagttt

SEQ ID NO: 3550810 - DNA, 18 bp, Homo sapiens
tgcatgctagtgttgtat

SEQ ID NO: 3550811 - DNA, 22 bp, Homo sapiens
tgcatgctagtgttgtatttct

SEQ ID NO: 3550812 - DNA, 13 bp, Homo sapiens
tgcatggagaatg

SEQ ID NO: 3550813 - DNA, 17 bp, Homo sapiens
tgcatggtgccccagga

SEQ ID NO: 3550814 - DNA, 16 bp, Homo sapiens
tgctcgtggactgtgc

SEQ ID NO: 3550815 - DNA, 19 bp, Homo sapiens
tgctcgtttacactgcaca

SEQ ID NO: 3550816 - DNA, 16 bp, Homo sapiens
tgctctaacagccctc

SEQ ID NO: 3550817 - DNA, 13 bp, Homo sapiens
tgctctagtgcct

SEQ ID NO: 3550818 - DNA, 16 bp, Homo sapiens
tgctctagtgccttct

SEQ ID NO: 3550819 - DNA, 21 bp, Homo sapiens
tgctctatactgtggcctgca

SEQ ID NO: 3550820 - DNA, 14 bp, Homo sapiens
tgctctcctcttgc

SEQ ID NO: 3550821 - DNA, 16 bp, Homo sapiens
tgctctcctcttgcca

SEQ ID NO: 3550822 - DNA, 20 bp, Homo sapiens
tgctctctcaaattgtcagc

SEQ ID NO: 3550823 - DNA, 17 bp, Homo sapiens
tgctctgccccagcttg

SEQ ID NO: 3550824 - DNA, 22 bp, Homo sapiens
tgctctggaataaagttgcaga

SEQ ID NO: 3550825 - DNA, 23 bp, Homo sapiens
tgctctggaataaagttgcagat

SEQ ID NO: 3550826 - DNA, 15 bp, Homo sapiens
tgctctggcaccatc

SEQ ID NO: 3550827 - DNA, 21 bp, Homo sapiens
tgctctggcaccatcagcctg

SEQ ID NO: 3550828 - DNA, 21 bp, Homo sapiens
tgctctggtctgaccgatgtg

SEQ ID NO: 3550829 - DNA, 18 bp, Homo sapiens
tgctcttagctgtctgct

SEQ ID NO: 3550830 - DNA, 14 bp, Homo sapiens
tgctcttttttctc

SEQ ID NO: 3550831 - DNA, 17 bp, Homo sapiens
tgctgaaacaacaaata

SEQ ID NO: 3550832 - DNA, 19 bp, Homo sapiens
tgctgaacaggaaagagct

SEQ ID NO: 3550833 - DNA, 22 bp, Homo sapiens
tgctgaacaggaaagagctagg

SEQ ID NO: 3550834 - DNA, 13 bp, Homo sapiens
tgctgaattcctt

SEQ ID NO: 3550835 - DNA, 13 bp, Homo sapiens
tgctgacagctct

SEQ ID NO: 3550836 - DNA, 20 bp, Homo sapiens
tgctgacggccagggagaag

SEQ ID NO: 3550837 - DNA, 19 bp, Homo sapiens
tgctgactgtactcctccc

SEQ ID NO: 3550838 - DNA, 17 bp, Homo sapiens
tgctgagctggcccttg

SEQ ID NO: 3550839 - DNA, 15 bp, Homo sapiens
tgctgagctgtttat

SEQ ID NO: 3550840 - DNA, 13 bp, Homo sapiens
tgctgaggcaccg

SEQ ID NO: 3550841 - DNA, 22 bp, Homo sapiens
tgctgaggcaccgtccaggccc

SEQ ID NO: 3550842 - DNA, 14 bp, Homo sapiens
tgctgagttggcct

SEQ ID NO: 3550843 - DNA, 22 bp, Homo sapiens
tgctgcaccctgcgcctccaga

SEQ ID NO: 3550844 - DNA, 15 bp, Homo sapiens
tgctgcacttcctgt

SEQ ID NO: 3550845 - DNA, 23 bp, Homo sapiens
tgctgcagattagttctttttgc

SEQ ID NO: 3550846 - DNA, 19 bp, Homo sapiens
tgctgcagctccctcctca

SEQ ID NO: 3550847 - DNA, 22 bp, Homo sapiens
tgctgccacacttcaggctctt

SEQ ID NO: 3550848 - DNA, 17 bp, Homo sapiens
tgctgccagtgcagcca

SEQ ID NO: 3550849 - DNA, 16 bp, Homo sapiens
tgctgccatgatgtat

SEQ ID NO: 3550850 - DNA, 16 bp, Homo sapiens
tgctgcccagcctcca

SEQ ID NO: 3550851 - DNA, 20 bp, Homo sapiens
tgctgcccctgtctggaaga

SEQ ID NO: 3550852 - DNA, 20 bp, Homo sapiens
tgctgcccgcgggagacagc

SEQ ID NO: 3550853 - DNA, 14 bp, Homo sapiens
tgctgccgccgccg

SEQ ID NO: 3550854 - DNA, 17 bp, Homo sapiens
tgctgcctcaggaccca

SEQ ID NO: 3550855 - DNA, 22 bp, Homo sapiens
tgctgcctcaggacccatccct

SEQ ID NO: 3550856 - DNA, 24 bp, Homo sapiens
tgctgcctcaggacccatccctgc

SEQ ID NO: 3550857 - DNA, 14 bp, Homo sapiens
tgctgcctccagaa

SEQ ID NO: 3550858 - DNA, 22 bp, Homo sapiens
tgctgcctcggatccccttcct

SEQ ID NO: 3550859 - DNA, 13 bp, Homo sapiens
tgctgcctggcac

SEQ ID NO: 3550860 - DNA, 12 bp, Homo sapiens
tgctgccttcag

SEQ ID NO: 3550861 - DNA, 14 bp, Homo sapiens
tgctgccttcaggg

SEQ ID NO: 3550862 - DNA, 22 bp, Homo sapiens
tgctgccttcagggagacaggc

SEQ ID NO: 3550863 - DNA, 21 bp, Homo sapiens
tgctgccttttctttaacttt

SEQ ID NO: 3550864 - DNA, 13 bp, Homo sapiens
tgctgcgctgctt

SEQ ID NO: 3550865 - DNA, 21 bp, Homo sapiens
tgctgctcccctaaagccagg

SEQ ID NO: 3550866 - DNA, 13 bp, Homo sapiens
tgctgctcctctc

SEQ ID NO: 3550867 - DNA, 19 bp, Homo sapiens
tgctgctcctctcttgggt

SEQ ID NO: 3550868 - DNA, 10 bp, Homo sapiens
tgctgctctc

SEQ ID NO: 3550869 - DNA, 15 bp, Homo sapiens
tgctgctgccttcac

SEQ ID NO: 3550870 - DNA, 20 bp, Homo sapiens
tgctgctggggaagacagtg

SEQ ID NO: 3550871 - DNA, 24 bp, Homo sapiens
tgctgctggggaagacagtggccc

SEQ ID NO: 3550872 - DNA, 13 bp, Homo sapiens
tgctgctgtggag

SEQ ID NO: 3550873 - DNA, 22 bp, Homo sapiens
tgctgcttttgggggtcagcat

SEQ ID NO: 3550874 - DNA, 16 bp, Homo sapiens
tgctggaattctaaca

SEQ ID NO: 3550875 - DNA, 14 bp, Homo sapiens
tgctggactgtcat

SEQ ID NO: 3550876 - DNA, 19 bp, Homo sapiens
tgctggactgtcatagaaa

SEQ ID NO: 3550877 - DNA, 12 bp, Homo sapiens
tgctggagtcca

SEQ ID NO: 3550878 - DNA, 18 bp, Homo sapiens
tgctggcaaatccaggct

SEQ ID NO: 3550879 - DNA, 16 bp, Homo sapiens
tgctggcccagggccc

SEQ ID NO: 3550880 - DNA, 19 bp, Homo sapiens
tgctgggaacctagcacac

SEQ ID NO: 3550881 - DNA, 23 bp, Homo sapiens
tgctgggaggtataggggtcctg

SEQ ID NO: 3550882 - DNA, 17 bp, Homo sapiens
tgctgggcagagggagg

SEQ ID NO: 3550883 - DNA, 20 bp, Homo sapiens
tgctgggccactggggactt

SEQ ID NO: 3550884 - DNA, 13 bp, Homo sapiens
tgctgggctgggc

SEQ ID NO: 3550885 - DNA, 22 bp, Homo sapiens
tgctggggccgccacggcctgg

SEQ ID NO: 3550886 - DNA, 23 bp, Homo sapiens
tgctggggccgccacggcctggc

SEQ ID NO: 3550887 - DNA, 21 bp, Homo sapiens
tgctgggtggcaggggggctg

SEQ ID NO: 3550888 - DNA, 13 bp, Homo sapiens
tgctggtacctgc

SEQ ID NO: 3550889 - DNA, 13 bp, Homo sapiens
tgctggtcctgca

SEQ ID NO: 3550890 - DNA, 16 bp, Homo sapiens
tgctggtcctgcacat

SEQ ID NO: 3550891 - DNA, 14 bp, Homo sapiens
tgctgtacaaaagc

SEQ ID NO: 3550892 - DNA, 17 bp, Homo sapiens
tgctgtctaacctgtga

SEQ ID NO: 3550893 - DNA, 22 bp, Homo sapiens
tgctgtcttttctttgccatct

SEQ ID NO: 3550894 - DNA, 19 bp, Homo sapiens
tgctgtgccatgctgggcc

SEQ ID NO: 3550895 - DNA, 12 bp, Homo sapiens
tgctgtgcccct

SEQ ID NO: 3550896 - DNA, 15 bp, Homo sapiens
tgctgtgcccctggc

SEQ ID NO: 3550897 - DNA, 16 bp, Homo sapiens
tgctgtgcccctggcc

SEQ ID NO: 3550898 - DNA, 14 bp, Homo sapiens
tgctgtgctgctca

SEQ ID NO: 3550899 - DNA, 12 bp, Homo sapiens
tgctgtggctcc

SEQ ID NO: 3550900 - DNA, 15 bp, Homo sapiens
tgctgttatatttca

SEQ ID NO: 3550901 - DNA, 14 bp, Homo sapiens
tgctgttcttcagt

SEQ ID NO: 3550902 - DNA, 15 bp, Homo sapiens
tgctgtttcctagct

SEQ ID NO: 3550903 - DNA, 15 bp, Homo sapiens
tgctgtttgaaaata

SEQ ID NO: 3550904 - DNA, 14 bp, Homo sapiens
tgctgttttcctcc

SEQ ID NO: 3550905 - DNA, 15 bp, Homo sapiens
tgctgttttcctccc

SEQ ID NO: 3550906 - DNA, 18 bp, Homo sapiens
tgctgttttgatttgtac

SEQ ID NO: 3550907 - DNA, 16 bp, Homo sapiens
tgctgttttgccagcc

SEQ ID NO: 3550908 - DNA, 18 bp, Homo sapiens
tgcttaatttaaatagca

SEQ ID NO: 3550909 - DNA, 16 bp, Homo sapiens
tgcttatcagtgtgca

SEQ ID NO: 3550910 - DNA, 19 bp, Homo sapiens
tgcttatcagtgtgcaata

SEQ ID NO: 3550911 - DNA, 21 bp, Homo sapiens
tgcttatgacatcacttgtac

SEQ ID NO: 3550912 - DNA, 21 bp, Homo sapiens
tgcttcaaaaacattcttaca

SEQ ID NO: 3550913 - DNA, 17 bp, Homo sapiens
tgcttcatccaatgtga

SEQ ID NO: 3550914 - DNA, 18 bp, Homo sapiens
tgcttcatccaatgtgaa

SEQ ID NO: 3550915 - DNA, 15 bp, Homo sapiens
tgcttccaattttct

SEQ ID NO: 3550916 - DNA, 13 bp, Homo sapiens
tgcttcctttctt

SEQ ID NO: 3550917 - DNA, 18 bp, Homo sapiens
tgcttctaaaacaataaa

SEQ ID NO: 3550918 - DNA, 21 bp, Homo sapiens
tgcttctcagatttctgagga

SEQ ID NO: 3550919 - DNA, 15 bp, Homo sapiens
tgcttctcaggctat

SEQ ID NO: 3550920 - DNA, 17 bp, Homo sapiens
tgcttcttctctccaca

SEQ ID NO: 3550921 - DNA, 18 bp, Homo sapiens
tgcttgactttccagaat

SEQ ID NO: 3550922 - DNA, 13 bp, Homo sapiens
tgcttgcccgctc

SEQ ID NO: 3550923 - DNA, 15 bp, Homo sapiens
tgcttgcccgctccc

SEQ ID NO: 3550924 - DNA, 15 bp, Homo sapiens
tgcttgcctgaagct

SEQ ID NO: 3550925 - DNA, 15 bp, Homo sapiens
tgcttggaagccagg

SEQ ID NO: 3550926 - DNA, 16 bp, Homo sapiens
tgcttggaagccaggt

SEQ ID NO: 3550927 - DNA, 16 bp, Homo sapiens
tgcttggccaggattt

SEQ ID NO: 3550928 - DNA, 23 bp, Homo sapiens
tgcttggcccttcaagggtcagg

SEQ ID NO: 3550929 - DNA, 15 bp, Homo sapiens
tgcttgtaactaaaa

SEQ ID NO: 3550930 - DNA, 16 bp, Homo sapiens
tgcttgtcctgggcct

SEQ ID NO: 3550931 - DNA, 15 bp, Homo sapiens
tgctttcctgcagca

SEQ ID NO: 3550932 - DNA, 17 bp, Homo sapiens
tgctttcctgcatctct

SEQ ID NO: 3550933 - DNA, 13 bp, Homo sapiens
tgctttctgctca

SEQ ID NO: 3550934 - DNA, 16 bp, Homo sapiens
tgctttcttacctact

SEQ ID NO: 3550935 - DNA, 15 bp, Homo sapiens
tgctttcttctttcc

SEQ ID NO: 3550936 - DNA, 22 bp, Homo sapiens
tgctttctttccgtcaccctgg

SEQ ID NO: 3550937 - DNA, 16 bp, Homo sapiens
tgctttgcatctttgt

SEQ ID NO: 3550938 - DNA, 19 bp, Homo sapiens
tgctttgctttctgctcag

SEQ ID NO: 3550939 - DNA, 19 bp, Homo sapiens
tgctttggaacaatcacag

SEQ ID NO: 3550940 - DNA, 18 bp, Homo sapiens
tgctttgggctgccctgg

SEQ ID NO: 3550941 - DNA, 19 bp, Homo sapiens
tgctttgtaggtgtctcat

SEQ ID NO: 3550942 - DNA, 21 bp, Homo sapiens
tgattggctgcttaaactgga

SEQ ID NO: 3550943 - DNA, 11 bp, Homo sapiens
tgattggcttt

SEQ ID NO: 3550944 - DNA, 16 bp, Homo sapiens
tgatttactggaatta

SEQ ID NO: 3550945 - DNA, 22 bp, Homo sapiens
tgatttaggagaagccaggaat

SEQ ID NO: 3550946 - DNA, 22 bp, Homo sapiens
tgatttccatttctgatgtctc

SEQ ID NO: 3550947 - DNA, 13 bp, Homo sapiens
tgatttgaattct

SEQ ID NO: 3550948 - DNA, 18 bp, Homo sapiens
tgatttgtagtggaaaca

SEQ ID NO: 3550949 - DNA, 14 bp, Homo sapiens
tgatttttatcaca

SEQ ID NO: 3550950 - DNA, 16 bp, Homo sapiens
tgatttttttttttca

SEQ ID NO: 3550951 - DNA, 17 bp, Homo sapiens
tgcaaaaaaagcctcca

SEQ ID NO: 3550952 - DNA, 22 bp, Homo sapiens
tgcaaaaaaagcctccaagggt

SEQ ID NO: 3550953 - DNA, 15 bp, Homo sapiens
tgcaaaaggaggtga

SEQ ID NO: 3550954 - DNA, 12 bp, Homo sapiens
tgcaaaatggaa

SEQ ID NO: 3550955 - DNA, 16 bp, Homo sapiens
tgcaaacacaccttgg

SEQ ID NO: 3550956 - DNA, 12 bp, Homo sapiens
tgcaaagatctg

SEQ ID NO: 3550957 - DNA, 13 bp, Homo sapiens
tgcaaagccaagg

SEQ ID NO: 3550958 - DNA, 21 bp, Homo sapiens
tgcaaataaaacgctttcccc

SEQ ID NO: 3550959 - DNA, 21 bp, Homo sapiens
tgcaaatagattcagagaaat

SEQ ID NO: 3550960 - DNA, 22 bp, Homo sapiens
tgcaaatagattcagagaaatt

SEQ ID NO: 3550961 - DNA, 13 bp, Homo sapiens
tgcaacctccgcc

SEQ ID NO: 3550962 - DNA, 19 bp, Homo sapiens
tgcaactggagttccttat

SEQ ID NO: 3550963 - DNA, 21 bp, Homo sapiens
tgcaacttccgctgaggggtc

SEQ ID NO: 3550964 - DNA, 14 bp, Homo sapiens
tgcaagagccaagt

SEQ ID NO: 3550965 - DNA, 19 bp, Homo sapiens
tgcaagatgcttggttgtg

SEQ ID NO: 3550966 - DNA, 23 bp, Homo sapiens
tgcaagcccctgctccagaagat

SEQ ID NO: 3550967 - DNA, 17 bp, Homo sapiens
tgcaaggattacagaaa

SEQ ID NO: 3550968 - DNA, 19 bp, Homo sapiens
tgcaaggattacagaaact

SEQ ID NO: 3550969 - DNA, 16 bp, Homo sapiens
tgcaaggtctttggtt

SEQ ID NO: 3550970 - DNA, 18 bp, Homo sapiens
tgcaataatccaccccca

SEQ ID NO: 3550971 - DNA, 16 bp, Homo sapiens
tgcaatctaatctgaa

SEQ ID NO: 3550972 - DNA, 19 bp, Homo sapiens
tgcaatctaatctgaactg

SEQ ID NO: 3550973 - DNA, 16 bp, Homo sapiens
tgcaatgactcaggac

SEQ ID NO: 3550974 - DNA, 23 bp, Homo sapiens
tgcacaaaactacttttctaaaa

SEQ ID NO: 3550975 - DNA, 13 bp, Homo sapiens
tgcacaacagccc

SEQ ID NO: 3550976 - DNA, 16 bp, Homo sapiens
tgcacaacagccctgc

SEQ ID NO: 3550977 - DNA, 15 bp, Homo sapiens
tgcacacagggcagt

SEQ ID NO: 3550978 - DNA, 16 bp, Homo sapiens
tgcacaccattttgta

SEQ ID NO: 3550979 - DNA, 21 bp, Homo sapiens
tgcacactgtcctattatatt

SEQ ID NO: 3550980 - DNA, 22 bp, Homo sapiens
tgcacaggtggctgtttcttgt

SEQ ID NO: 3550981 - DNA, 23 bp, Homo sapiens
tgcacagtatctgctgttcttca

SEQ ID NO: 3550982 - DNA, 17 bp, Homo sapiens
tgcacagtgcatctcag

SEQ ID NO: 3550983 - DNA, 19 bp, Homo sapiens
tgcacagttgccacattta

SEQ ID NO: 3550984 - DNA, 16 bp, Homo sapiens
tgcacatgctgtctgg

SEQ ID NO: 3550985 - DNA, 22 bp, Homo sapiens
tgcacatgctgtctggccctgg

SEQ ID NO: 3550986 - DNA, 11 bp, Homo sapiens
tgcaccaaaga

SEQ ID NO: 3550987 - DNA, 12 bp, Homo sapiens
tgcaccaaagac

SEQ ID NO: 3550988 - DNA, 14 bp, Homo sapiens
tgcaccaaagacat

SEQ ID NO: 3550989 - DNA, 14 bp, Homo sapiens
tgcaccaccatgcc

SEQ ID NO: 3550990 - DNA, 22 bp, Homo sapiens
tgcaccatgctgctggggaaga

SEQ ID NO: 3550991 - DNA, 18 bp, Homo sapiens
tgcacccctgagccagca

SEQ ID NO: 3550992 - DNA, 18 bp, Homo sapiens
tgcaccccttcctgggca

SEQ ID NO: 3550993 - DNA, 17 bp, Homo sapiens
tgcacccgcctcgacct

SEQ ID NO: 3550994 - DNA, 14 bp, Homo sapiens
tgcacctatctcag

SEQ ID NO: 3550995 - DNA, 16 bp, Homo sapiens
tgcaccttccagcccg

SEQ ID NO: 3550996 - DNA, 19 bp, Homo sapiens
tgcacgctcaatgcccagt

SEQ ID NO: 3550997 - DNA, 15 bp, Homo sapiens
tgcacgtggggccca

SEQ ID NO: 3550998 - DNA, 22 bp, Homo sapiens
tgcactaaaatgaggatccagg

SEQ ID NO: 3550999 - DNA, 15 bp, Homo sapiens
tgcactaaggggccc

SEQ ID NO: 3551000 - DNA, 12 bp, Homo sapiens
tgcactccagac

SEQ ID NO: 3551001 - DNA, 14 bp, Homo sapiens
tgcactcccacctg

SEQ ID NO: 3551002 - DNA, 17 bp, Homo sapiens
tgcactcccacctgaca

SEQ ID NO: 3551003 - DNA, 19 bp, Homo sapiens
tgcactcccacctgacaca

SEQ ID NO: 3551004 - DNA, 21 bp, Homo sapiens
tgcactcctttatctgtaatt

SEQ ID NO: 3551005 - DNA, 13 bp, Homo sapiens
tgcactgaacagg

SEQ ID NO: 3551006 - DNA, 13 bp, Homo sapiens
tgcactgaagttt

SEQ ID NO: 3551007 - DNA, 18 bp, Homo sapiens
tgcactgaagtttttgaa

SEQ ID NO: 3551008 - DNA, 23 bp, Homo sapiens
tgcactgaagtttttgaaatacc

SEQ ID NO: 3551009 - DNA, 21 bp, Homo sapiens
tgcactgatgctgcccctcat

SEQ ID NO: 3551010 - DNA, 14 bp, Homo sapiens
tgcactgcctgcat

SEQ ID NO: 3551011 - DNA, 18 bp, Homo sapiens
tgcactgcctgcatgagc

SEQ ID NO: 3551012 - DNA, 13 bp, Homo sapiens
tgcagaaagcatc

SEQ ID NO: 3551013 - DNA, 10 bp, Homo sapiens
tgcagaggct

SEQ ID NO: 3551014 - DNA, 21 bp, Homo sapiens
tgcagaggcttattcagttct

SEQ ID NO: 3551015 - DNA, 14 bp, Homo sapiens
tgcagcagggatgc

SEQ ID NO: 3551016 - DNA, 22 bp, Homo sapiens
tgcagcagggatgccctggagg

SEQ ID NO: 3551017 - DNA, 15 bp, Homo sapiens
tgcagcatttactat

SEQ ID NO: 3551018 - DNA, 16 bp, Homo sapiens
tgcagccgcagagaaa

SEQ ID NO: 3551019 - DNA, 21 bp, Homo sapiens
tgcagcctaagaagaaggcca

SEQ ID NO: 3551020 - DNA, 20 bp, Homo sapiens
tgcagcctcaacctcctggg

SEQ ID NO: 3551021 - DNA, 14 bp, Homo sapiens
tgcagcctctctgg

SEQ ID NO: 3551022 - DNA, 17 bp, Homo sapiens
tgcagccttcatcagaa

SEQ ID NO: 3551023 - DNA, 13 bp, Homo sapiens
tgcagccttcccc

SEQ ID NO: 3551024 - DNA, 17 bp, Homo sapiens
tgcagccttcccctccc

SEQ ID NO: 3551025 - DNA, 14 bp, Homo sapiens
tgcagcgccacctg

SEQ ID NO: 3551026 - DNA, 20 bp, Homo sapiens
tgcagctcaagggctggcac

SEQ ID NO: 3551027 - DNA, 14 bp, Homo sapiens
tgcagctcatgttt

SEQ ID NO: 3551028 - DNA, 18 bp, Homo sapiens
tgcagctccctcctcagg

SEQ ID NO: 3551029 - DNA, 14 bp, Homo sapiens
tgcagctcctcagc

SEQ ID NO: 3551030 - DNA, 22 bp, Homo sapiens
tgcagctgtggcagagttacag

SEQ ID NO: 3551031 - DNA, 17 bp, Homo sapiens
tgcaggaaggaaaacta

SEQ ID NO: 3551032 - DNA, 20 bp, Homo sapiens
tgcaggaaggaaaactatgt

SEQ ID NO: 3551033 - DNA, 22 bp, Homo sapiens
tgcaggagggttggagtgctct

SEQ ID NO: 3551034 - DNA, 19 bp, Homo sapiens
tgcaggagtgtcctgccca

SEQ ID NO: 3551035 - DNA, 14 bp, Homo sapiens
tgcaggagtttgtg

SEQ ID NO: 3551036 - DNA, 18 bp, Homo sapiens
tgcaggagtttgtggtaa

SEQ ID NO: 3551037 - DNA, 21 bp, Homo sapiens
tgcaggcgatggggcaagaca

SEQ ID NO: 3551038 - DNA, 23 bp, Homo sapiens
tgcagggccatctgactgccaag

SEQ ID NO: 3551039 - DNA, 13 bp, Homo sapiens
tgcagggccgggc

SEQ ID NO: 3551040 - DNA, 17 bp, Homo sapiens
tgcagggccgggcaggg

SEQ ID NO: 3551041 - DNA, 18 bp, Homo sapiens
tgcagggccgggcagggg

SEQ ID NO: 3551042 - DNA, 20 bp, Homo sapiens
tgcagggtctttttctaggg

SEQ ID NO: 3551043 - DNA, 19 bp, Homo sapiens
tgcaggtgttctgctgata

SEQ ID NO: 3551044 - DNA, 16 bp, Homo sapiens
tgcagtactaaaatta

SEQ ID NO: 3551045 - DNA, 18 bp, Homo sapiens
tgcagtactttacctcct

SEQ ID NO: 3551046 - DNA, 14 bp, Homo sapiens
tgcagtcagcagat

SEQ ID NO: 3551047 - DNA, 23 bp, Homo sapiens
tgcagtcagcagatgctgttgtg

SEQ ID NO: 3551048 - DNA, 16 bp, Homo sapiens
tgcagtcctcaggaag

SEQ ID NO: 3551049 - DNA, 19 bp, Homo sapiens
tgcagtctggctgagccct

SEQ ID NO: 3551050 - DNA, 20 bp, Homo sapiens
tgcagtctggctgagccctg

SEQ ID NO: 3551051 - DNA, 22 bp, Homo sapiens
tgcagtctttatttttttccca

SEQ ID NO: 3551052 - DNA, 13 bp, Homo sapiens
tgcagtgaactat

SEQ ID NO: 3551053 - DNA, 14 bp, Homo sapiens
tgcagtgaactatt

SEQ ID NO: 3551054 - DNA, 15 bp, Homo sapiens
tgcagtgaactattt

SEQ ID NO: 3551055 - DNA, 14 bp, Homo sapiens
tgcagttaccacag

SEQ ID NO: 3551056 - DNA, 16 bp, Homo sapiens
tgcagttaccacagca

SEQ ID NO: 3551057 - DNA, 22 bp, Homo sapiens
tgcagttcaaaaacaagacaga

SEQ ID NO: 3551058 - DNA, 16 bp, Homo sapiens
tgcagtttacagtatt

SEQ ID NO: 3551059 - DNA, 17 bp, Homo sapiens
tgcagtttacagtattt

SEQ ID NO: 3551060 - DNA, 19 bp, Homo sapiens
tgcagtttacagtatttct

SEQ ID NO: 3551061 - DNA, 22 bp, Homo sapiens
tgcagtttacagtatttctaca

SEQ ID NO: 3551062 - DNA, 17 bp, Homo sapiens
tgcagtttcttttcaca

SEQ ID NO: 3551063 - DNA, 13 bp, Homo sapiens
tgcagtttggaat

SEQ ID NO: 3551064 - DNA, 18 bp, Homo sapiens
tgcagttttggtgtgtaa

SEQ ID NO: 3551065 - DNA, 20 bp, Homo sapiens
tgcataaaaattaaatggat

SEQ ID NO: 3551066 - DNA, 17 bp, Homo sapiens
tgcataagttaacttcc

SEQ ID NO: 3551067 - DNA, 18 bp, Homo sapiens
tgcataccaacctgggca

SEQ ID NO: 3551068 - DNA, 20 bp, Homo sapiens
tgcatagattccctgagcag

SEQ ID NO: 3551069 - DNA, 17 bp, Homo sapiens
tgcatataatgaataaa

SEQ ID NO: 3551070 - DNA, 18 bp, Homo sapiens
tgcatatagacacacata

SEQ ID NO: 3551071 - DNA, 19 bp, Homo sapiens
tgcatatagacacacatac

SEQ ID NO: 3551072 - DNA, 16 bp, Homo sapiens
tgcatattataaagga

SEQ ID NO: 3551073 - DNA, 20 bp, Homo sapiens
tgcatattataaaggataaa

SEQ ID NO: 3551074 - DNA, 15 bp, Homo sapiens
tgcatattttgagaa

SEQ ID NO: 3551075 - DNA, 20 bp, Homo sapiens
tgcatattttgagaaactgc

SEQ ID NO: 3551076 - DNA, 12 bp, Homo sapiens
tgcatctcctcc

SEQ ID NO: 3551077 - DNA, 12 bp, Homo sapiens
tgcatcttaaaa

SEQ ID NO: 3551078 - DNA, 16 bp, Homo sapiens
tgcatctttgttactt

SEQ ID NO: 3551079 - DNA, 19 bp, Homo sapiens
tgagctggggactcaggga

SEQ ID NO: 3551080 - DNA, 19 bp, Homo sapiens
tgagctgtaaaaatgttac

SEQ ID NO: 3551081 - DNA, 23 bp, Homo sapiens
tgagcttacaattaggaactgag

SEQ ID NO: 3551082 - DNA, 15 bp, Homo sapiens
tgaggaaaaactgac

SEQ ID NO: 3551083 - DNA, 16 bp, Homo sapiens
tgaggaaacaacagct

SEQ ID NO: 3551084 - DNA, 12 bp, Homo sapiens
tgaggaaatatt

SEQ ID NO: 3551085 - DNA, 13 bp, Homo sapiens
tgaggacaagaga

SEQ ID NO: 3551086 - DNA, 17 bp, Homo sapiens
tgaggagagaggaggaa

SEQ ID NO: 3551087 - DNA, 12 bp, Homo sapiens
tgaggagctggg

SEQ ID NO: 3551088 - DNA, 15 bp, Homo sapiens
tgaggataggacaga

SEQ ID NO: 3551089 - DNA, 18 bp, Homo sapiens
tgaggatattcagatgta

SEQ ID NO: 3551090 - DNA, 20 bp, Homo sapiens
tgaggatccagggcagcagg

SEQ ID NO: 3551091 - DNA, 22 bp, Homo sapiens
tgaggatccagggcagcaggcc

SEQ ID NO: 3551092 - DNA, 18 bp, Homo sapiens
tgaggcaccgtccaggcc

SEQ ID NO: 3551093 - DNA, 14 bp, Homo sapiens
tgaggccagaaagg

SEQ ID NO: 3551094 - DNA, 13 bp, Homo sapiens
tgaggcccagaga

SEQ ID NO: 3551095 - DNA, 16 bp, Homo sapiens
tgaggcctgccccctg

SEQ ID NO: 3551096 - DNA, 23 bp, Homo sapiens
tgaggctgacatgctcacacatt

SEQ ID NO: 3551097 - DNA, 22 bp, Homo sapiens
tgaggctgtaactgagagaaag

SEQ ID NO: 3551098 - DNA, 19 bp, Homo sapiens
tgaggcttctccttctcct

SEQ ID NO: 3551099 - DNA, 21 bp, Homo sapiens
tgagggaagcaataggtagct

SEQ ID NO: 3551100 - DNA, 17 bp, Homo sapiens
tgagggagaacaagacc

SEQ ID NO: 3551101 - DNA, 18 bp, Homo sapiens
tgaggggccctggccagg

SEQ ID NO: 3551102 - DNA, 14 bp, Homo sapiens
tgaggggctttctc

SEQ ID NO: 3551103 - DNA, 17 bp, Homo sapiens
tgagggtccacctggag

SEQ ID NO: 3551104 - DNA, 14 bp, Homo sapiens
tgagggtcctgcag

SEQ ID NO: 3551105 - DNA, 21 bp, Homo sapiens
tgagggtcctgcagcctgcag

SEQ ID NO: 3551106 - DNA, 23 bp, Homo sapiens
tgagggtcctgcagcctgcagga

SEQ ID NO: 3551107 - DNA, 14 bp, Homo sapiens
tgagggtcgtggga

SEQ ID NO: 3551108 - DNA, 22 bp, Homo sapiens
tgaggtaccagttgtatttaat

SEQ ID NO: 3551109 - DNA, 21 bp, Homo sapiens
tgaggtaggcacaaatacatt

SEQ ID NO: 3551110 - DNA, 16 bp, Homo sapiens
tgaggtcaccagggga

SEQ ID NO: 3551111 - DNA, 13 bp, Homo sapiens
tgaggtcactgct

SEQ ID NO: 3551112 - DNA, 16 bp, Homo sapiens
tgaggtgaactccagg

SEQ ID NO: 3551113 - DNA, 21 bp, Homo sapiens
tgaggtgaactccaggcatgt

SEQ ID NO: 3551114 - DNA, 23 bp, Homo sapiens
tgaggtgtattggtgttgcagcc

SEQ ID NO: 3551115 - DNA, 21 bp, Homo sapiens
tgagtacaaatgccttaaaat

SEQ ID NO: 3551116 - DNA, 19 bp, Homo sapiens
tgagtagcttatacaatta

SEQ ID NO: 3551117 - DNA, 16 bp, Homo sapiens
tgagtatgtgaagata

SEQ ID NO: 3551118 - DNA, 19 bp, Homo sapiens
tgagtatgtgaagatataa

SEQ ID NO: 3551119 - DNA, 23 bp, Homo sapiens
tgagtatgtgaagatataagtaa

SEQ ID NO: 3551120 - DNA, 17 bp, Homo sapiens
tgagtcaaatccagtgg

SEQ ID NO: 3551121 - DNA, 21 bp, Homo sapiens
tgagtcaaatccagtggtggg

SEQ ID NO: 3551122 - DNA, 14 bp, Homo sapiens
tgagtcacctgctc

SEQ ID NO: 3551123 - DNA, 18 bp, Homo sapiens
tgagtcacctgctccaga

SEQ ID NO: 3551124 - DNA, 16 bp, Homo sapiens
tgagtcatttaaatgt

SEQ ID NO: 3551125 - DNA, 18 bp, Homo sapiens
tgagtgcacctgcctcca

SEQ ID NO: 3551126 - DNA, 20 bp, Homo sapiens
tgagtgccccacttctggcc

SEQ ID NO: 3551127 - DNA, 22 bp, Homo sapiens
tgagtgccccacttctggccac

SEQ ID NO: 3551128 - DNA, 16 bp, Homo sapiens
tgagtggcagcagccc

SEQ ID NO: 3551129 - DNA, 13 bp, Homo sapiens
tgagtgtgaagct

SEQ ID NO: 3551130 - DNA, 14 bp, Homo sapiens
tgagtgtgaagctt

SEQ ID NO: 3551131 - DNA, 19 bp, Homo sapiens
tgagttacattaaaataaa

SEQ ID NO: 3551132 - DNA, 16 bp, Homo sapiens
tgagttatattggaat

SEQ ID NO: 3551133 - DNA, 21 bp, Homo sapiens
tgagttattaactgtattttc

SEQ ID NO: 3551134 - DNA, 14 bp, Homo sapiens
tgagttcctctgca

SEQ ID NO: 3551135 - DNA, 15 bp, Homo sapiens
tgagttcctctgcag

SEQ ID NO: 3551136 - DNA, 17 bp, Homo sapiens
tgagttctttcatctcc

SEQ ID NO: 3551137 - DNA, 14 bp, Homo sapiens
tgagttggctggga

SEQ ID NO: 3551138 - DNA, 16 bp, Homo sapiens
tgagttggctgggaat

SEQ ID NO: 3551139 - DNA, 23 bp, Homo sapiens
tgagtttaccttgtatactgtag

SEQ ID NO: 3551140 - DNA, 13 bp, Homo sapiens
tgataaaaactca

SEQ ID NO: 3551141 - DNA, 13 bp, Homo sapiens
tgataaaggaaat

SEQ ID NO: 3551142 - DNA, 15 bp, Homo sapiens
tgataaatttaatcc

SEQ ID NO: 3551143 - DNA, 20 bp, Homo sapiens
tgataacaatgttttaacaa

SEQ ID NO: 3551144 - DNA, 21 bp, Homo sapiens
tgataacaatgttttaacaag

SEQ ID NO: 3551145 - DNA, 19 bp, Homo sapiens
tgatacaatattgtgcatg

SEQ ID NO: 3551146 - DNA, 13 bp, Homo sapiens
tgatacattccca

SEQ ID NO: 3551147 - DNA, 21 bp, Homo sapiens
tgatagacacatatgaggggg

SEQ ID NO: 3551148 - DNA, 13 bp, Homo sapiens
tgatagacaccat

SEQ ID NO: 3551149 - DNA, 13 bp, Homo sapiens
tgatagtaaatgt

SEQ ID NO: 3551150 - DNA, 13 bp, Homo sapiens
tgatatcaacagc

SEQ ID NO: 3551151 - DNA, 20 bp, Homo sapiens
tgatatcaacagcttcccta

SEQ ID NO: 3551152 - DNA, 13 bp, Homo sapiens
tgatattcaataa

SEQ ID NO: 3551153 - DNA, 19 bp, Homo sapiens
tgatattgttatatacata

SEQ ID NO: 3551154 - DNA, 15 bp, Homo sapiens
tgatattgttctcca

SEQ ID NO: 3551155 - DNA, 20 bp, Homo sapiens
tgatcataaactgactatca

SEQ ID NO: 3551156 - DNA, 13 bp, Homo sapiens
tgatcccaccccc

SEQ ID NO: 3551157 - DNA, 14 bp, Homo sapiens
tgatcccaccccct

SEQ ID NO: 3551158 - DNA, 17 bp, Homo sapiens
tgatcccaccccctcct

SEQ ID NO: 3551159 - DNA, 19 bp, Homo sapiens
tgatccccgtctctgccct

SEQ ID NO: 3551160 - DNA, 22 bp, Homo sapiens
tgatccccgtctctgccctggg

SEQ ID NO: 3551161 - DNA, 17 bp, Homo sapiens
tgatcctcacgccttgg

SEQ ID NO: 3551162 - DNA, 11 bp, Homo sapiens
tgatcctgcca

SEQ ID NO: 3551163 - DNA, 20 bp, Homo sapiens
tgatcctggaggcccagttc

SEQ ID NO: 3551164 - DNA, 13 bp, Homo sapiens
tgatcctgttctg

SEQ ID NO: 3551165 - DNA, 16 bp, Homo sapiens
tgatcggtctcctagg

SEQ ID NO: 3551166 - DNA, 15 bp, Homo sapiens
tgatctaatatccca

SEQ ID NO: 3551167 - DNA, 15 bp, Homo sapiens
tgatctctcttgtcc

SEQ ID NO: 3551168 - DNA, 21 bp, Homo sapiens
tgatctctgttacaaaagaaa

SEQ ID NO: 3551169 - DNA, 23 bp, Homo sapiens
tgatctctgttacaaaagaaaaa

SEQ ID NO: 3551170 - DNA, 20 bp, Homo sapiens
tgatctcttctggtgttgac

SEQ ID NO: 3551171 - DNA, 21 bp, Homo sapiens
tgatctcttctggtgttgact

SEQ ID NO: 3551172 - DNA, 13 bp, Homo sapiens
tgatctggaaccc

SEQ ID NO: 3551173 - DNA, 17 bp, Homo sapiens
tgatctggaacccagac

SEQ ID NO: 3551174 - DNA, 22 bp, Homo sapiens
tgatcttgagaaccttttcaaa

SEQ ID NO: 3551175 - DNA, 14 bp, Homo sapiens
tgatctttaaaata

SEQ ID NO: 3551176 - DNA, 19 bp, Homo sapiens
tgatgaaaactaaggattt

SEQ ID NO: 3551177 - DNA, 19 bp, Homo sapiens
tgatgagagaatgtggaaa

SEQ ID NO: 3551178 - DNA, 21 bp, Homo sapiens
tgatgagatattaaattctca

SEQ ID NO: 3551179 - DNA, 13 bp, Homo sapiens
tgatgattttcct

SEQ ID NO: 3551180 - DNA, 22 bp, Homo sapiens
tgatgcaaggattacagaaact

SEQ ID NO: 3551181 - DNA, 18 bp, Homo sapiens
tgatgcacagtatctgct

SEQ ID NO: 3551182 - DNA, 20 bp, Homo sapiens
tgatgctaaaacctgaaatt

SEQ ID NO: 3551183 - DNA, 15 bp, Homo sapiens
tgatggcaattttgt

SEQ ID NO: 3551184 - DNA, 17 bp, Homo sapiens
tgatggcaattttgtaa

SEQ ID NO: 3551185 - DNA, 19 bp, Homo sapiens
tgatggctaacttacaaag

SEQ ID NO: 3551186 - DNA, 17 bp, Homo sapiens
tgatggcttatgatagc

SEQ ID NO: 3551187 - DNA, 12 bp, Homo sapiens
tgatggtggccc

SEQ ID NO: 3551188 - DNA, 14 bp, Homo sapiens
tgatggttcccctg

SEQ ID NO: 3551189 - DNA, 22 bp, Homo sapiens
tgatgtacataactcctgtccc

SEQ ID NO: 3551190 - DNA, 24 bp, Homo sapiens
tgatgtacataactcctgtccctt

SEQ ID NO: 3551191 - DNA, 19 bp, Homo sapiens
tgatgtcccaacttgtaaa

SEQ ID NO: 3551192 - DNA, 17 bp, Homo sapiens
tgatgtctttttattaa

SEQ ID NO: 3551193 - DNA, 18 bp, Homo sapiens
tgatgtgaagagtttcac

SEQ ID NO: 3551194 - DNA, 16 bp, Homo sapiens
tgatgtgttatctctt

SEQ ID NO: 3551195 - DNA, 13 bp, Homo sapiens
tgatgttttcaca

SEQ ID NO: 3551196 - DNA, 18 bp, Homo sapiens
tgatgtttttaaaggttt

SEQ ID NO: 3551197 - DNA, 19 bp, Homo sapiens
tgattaaaaataccttcta

SEQ ID NO: 3551198 - DNA, 15 bp, Homo sapiens
tgattaaagatgagc

SEQ ID NO: 3551199 - DNA, 16 bp, Homo sapiens
tgattaacttatactg

SEQ ID NO: 3551200 - DNA, 23 bp, Homo sapiens
tgattactggcctttttcattta

SEQ ID NO: 3551201 - DNA, 19 bp, Homo sapiens
tgattagttgacagtatta

SEQ ID NO: 3551202 - DNA, 22 bp, Homo sapiens
tgattagttgacagtattaaca

SEQ ID NO: 3551203 - DNA, 22 bp, Homo sapiens
tgattatttaagactaaaagtt

SEQ ID NO: 3551204 - DNA, 15 bp, Homo sapiens
tgattatttttccag

SEQ ID NO: 3551205 - DNA, 15 bp, Homo sapiens
tgattcaaatgtttt

SEQ ID NO: 3551206 - DNA, 20 bp, Homo sapiens
tgattcatagtaaaatacct

SEQ ID NO: 3551207 - DNA, 12 bp, Homo sapiens
tgattcatattt

SEQ ID NO: 3551208 - DNA, 19 bp, Homo sapiens
tgattcatgccaattagca

SEQ ID NO: 3551209 - DNA, 18 bp, Homo sapiens
tgattcggggctgacctt

SEQ ID NO: 3551210 - DNA, 23 bp, Homo sapiens
tgattcggggctgacctttcaaa

SEQ ID NO: 3551211 - DNA, 19 bp, Homo sapiens
tgattgacagctttgctgc

SEQ ID NO: 3551212 - DNA, 11 bp, Homo sapiens
tgattgctatc

SEQ ID NO: 3551213 - DNA, 12 bp, Homo sapiens
tgattggctgca

SEQ ID NO: 3551214 - DNA, 13 bp, Homo sapiens
tgattggctgcag

SEQ ID NO: 3551215 - DNA, 22 bp, Homo sapiens
tgacattgtagagcttctggca

SEQ ID NO: 3551216 - DNA, 15 bp, Homo sapiens
tgacatttatatatt

SEQ ID NO: 3551217 - DNA, 22 bp, Homo sapiens
tgacatttgggagacatgtgac

SEQ ID NO: 3551218 - DNA, 23 bp, Homo sapiens
tgacatttgggagacatgtgaca

SEQ ID NO: 3551219 - DNA, 16 bp, Homo sapiens
tgacatttttgccaaa

SEQ ID NO: 3551220 - DNA, 11 bp, Homo sapiens
tgaccaacaga

SEQ ID NO: 3551221 - DNA, 19 bp, Homo sapiens
tgaccaacagaaacctttt

SEQ ID NO: 3551222 - DNA, 15 bp, Homo sapiens
tgaccaacatggaga

SEQ ID NO: 3551223 - DNA, 23 bp, Homo sapiens
tgaccagaaagcttcatccacag

SEQ ID NO: 3551224 - DNA, 19 bp, Homo sapiens
tgaccagaactttttcctc

SEQ ID NO: 3551225 - DNA, 20 bp, Homo sapiens
tgaccagaactttttcctct

SEQ ID NO: 3551226 - DNA, 21 bp, Homo sapiens
tgaccagcctccatgctgcct

SEQ ID NO: 3551227 - DNA, 23 bp, Homo sapiens
tgaccagcctccatgctgcctcc

SEQ ID NO: 3551228 - DNA, 16 bp, Homo sapiens
tgaccagggatgctgg

SEQ ID NO: 3551229 - DNA, 18 bp, Homo sapiens
tgaccagggatgctgggc

SEQ ID NO: 3551230 - DNA, 23 bp, Homo sapiens
tgaccagggatgctgggctgggc

SEQ ID NO: 3551231 - DNA, 16 bp, Homo sapiens
tgaccagtctgaccct

SEQ ID NO: 3551232 - DNA, 14 bp, Homo sapiens
tgaccagtgcctgt

SEQ ID NO: 3551233 - DNA, 18 bp, Homo sapiens
tgaccagtgcctgtgagc

SEQ ID NO: 3551234 - DNA, 14 bp, Homo sapiens
tgaccatcatgccc

SEQ ID NO: 3551235 - DNA, 19 bp, Homo sapiens
tgaccattgagtccctgct

SEQ ID NO: 3551236 - DNA, 17 bp, Homo sapiens
tgacccagaggacagca

SEQ ID NO: 3551237 - DNA, 18 bp, Homo sapiens
tgacccagcatctcccag

SEQ ID NO: 3551238 - DNA, 16 bp, Homo sapiens
tgacccagtgccccca

SEQ ID NO: 3551239 - DNA, 23 bp, Homo sapiens
tgaccccaagggggctgctgctc

SEQ ID NO: 3551240 - DNA, 22 bp, Homo sapiens
tgacccccaaccaagtggctcc

SEQ ID NO: 3551241 - DNA, 18 bp, Homo sapiens
tgacccccatctgagctg

SEQ ID NO: 3551242 - DNA, 21 bp, Homo sapiens
tgacccccttgattcccaccg

SEQ ID NO: 3551243 - DNA, 23 bp, Homo sapiens
tgaaccaaattgcactgaagttt

SEQ ID NO: 3551244 - DNA, 22 bp, Homo sapiens
tgaaccatccacttacatatat

SEQ ID NO: 3551245 - DNA, 13 bp, Homo sapiens
tgaaccctccaaa

SEQ ID NO: 3551246 - DNA, 17 bp, Homo sapiens
tgaacctacctgccttg

SEQ ID NO: 3551247 - DNA, 13 bp, Homo sapiens
tgaacctggatcc

SEQ ID NO: 3551248 - DNA, 16 bp, Homo sapiens
tgaacgagcagcccag

SEQ ID NO: 3551249 - DNA, 18 bp, Homo sapiens
tgaacgagcagcccaggg

SEQ ID NO: 3551250 - DNA, 21 bp, Homo sapiens
tgaacgagcagcccagggcct

SEQ ID NO: 3551251 - DNA, 16 bp, Homo sapiens
tgaacgtggattgtat

SEQ ID NO: 3551252 - DNA, 13 bp, Homo sapiens
tgaacgttttaat

SEQ ID NO: 3551253 - DNA, 22 bp, Homo sapiens
tgaactccaccgaccaactgcc

SEQ ID NO: 3551254 - DNA, 20 bp, Homo sapiens
tgaactccaggcatgtgtct

SEQ ID NO: 3551255 - DNA, 14 bp, Homo sapiens
tgaactcgcaggga

SEQ ID NO: 3551256 - DNA, 12 bp, Homo sapiens
tgaactgggctc

SEQ ID NO: 3551257 - DNA, 20 bp, Homo sapiens
tgaacttccaggaaagtgtg

SEQ ID NO: 3551258 - DNA, 14 bp, Homo sapiens
tgaactttctccct

SEQ ID NO: 3551259 - DNA, 19 bp, Homo sapiens
tgaagaaccagtcccccca

SEQ ID NO: 3551260 - DNA, 20 bp, Homo sapiens
tgaagaaccagtccccccac

SEQ ID NO: 3551261 - DNA, 13 bp, Homo sapiens
tgaagaaggaagc

SEQ ID NO: 3551262 - DNA, 19 bp, Homo sapiens
tgaagaaggaagctgtgtt

SEQ ID NO: 3551263 - DNA, 15 bp, Homo sapiens
tgaagaaggcaaggc

SEQ ID NO: 3551264 - DNA, 21 bp, Homo sapiens
tgaagacccaaaacagctttg

SEQ ID NO: 3551265 - DNA, 22 bp, Homo sapiens
tgaagagaagggcagggctgag

SEQ ID NO: 3551266 - DNA, 23 bp, Homo sapiens
tgaagagtcctctgaatgaacct

SEQ ID NO: 3551267 - DNA, 15 bp, Homo sapiens
tgaagagtttcacaa

SEQ ID NO: 3551268 - DNA, 17 bp, Homo sapiens
tgaagatctttgacata

SEQ ID NO: 3551269 - DNA, 20 bp, Homo sapiens
tgaagatctttggcatgatt

SEQ ID NO: 3551270 - DNA, 13 bp, Homo sapiens
tgaagatggcttt

SEQ ID NO: 3551271 - DNA, 18 bp, Homo sapiens
tgaagattatatgaagtt

SEQ ID NO: 3551272 - DNA, 19 bp, Homo sapiens
tgaagatttaatattacag

SEQ ID NO: 3551273 - DNA, 17 bp, Homo sapiens
tgaagcaattagtctga

SEQ ID NO: 3551274 - DNA, 13 bp, Homo sapiens
tgaagcagaacct

SEQ ID NO: 3551275 - DNA, 18 bp, Homo sapiens
tgaagccaccctgggcta

SEQ ID NO: 3551276 - DNA, 15 bp, Homo sapiens
tgaagctaatgtcac

SEQ ID NO: 3551277 - DNA, 17 bp, Homo sapiens
tgaagctgctgcagctc

SEQ ID NO: 3551278 - DNA, 13 bp, Homo sapiens
tgaagctgctgtg

SEQ ID NO: 3551279 - DNA, 16 bp, Homo sapiens
tgaagctgctgtgtcc

SEQ ID NO: 3551280 - DNA, 18 bp, Homo sapiens
tgaagctgctgtgtcctc

SEQ ID NO: 3551281 - DNA, 14 bp, Homo sapiens
tcttgctaccagta

SEQ ID NO: 3551282 - DNA, 16 bp, Homo sapiens
tcttggccctcctcag

SEQ ID NO: 3551283 - DNA, 17 bp, Homo sapiens
tcttggccgactcaggg

SEQ ID NO: 3551284 - DNA, 17 bp, Homo sapiens
tcttgggaccccagaga

SEQ ID NO: 3551285 - DNA, 20 bp, Homo sapiens
tcttgggcctcaggctctgc

SEQ ID NO: 3551286 - DNA, 18 bp, Homo sapiens
tcttgggggaggccaccc

SEQ ID NO: 3551287 - DNA, 21 bp, Homo sapiens
tcttggttcgatacctggagc

SEQ ID NO: 3551288 - DNA, 16 bp, Homo sapiens
tcttgtcctcttctgc

SEQ ID NO: 3551289 - DNA, 16 bp, Homo sapiens
tcttgttcctgaaatg

SEQ ID NO: 3551290 - DNA, 15 bp, Homo sapiens
tctttactgcactca

SEQ ID NO: 3551291 - DNA, 19 bp, Homo sapiens
tctttactgcactcagatt

SEQ ID NO: 3551292 - DNA, 12 bp, Homo sapiens
tctttactttta

SEQ ID NO: 3551293 - DNA, 15 bp, Homo sapiens
tctttagaccctcgg

SEQ ID NO: 3551294 - DNA, 14 bp, Homo sapiens
tctttagatatttg

SEQ ID NO: 3551295 - DNA, 18 bp, Homo sapiens
tctttagcagtttcctca

SEQ ID NO: 3551296 - DNA, 21 bp, Homo sapiens
tctttagcagtttcctcagtg

SEQ ID NO: 3551297 - DNA, 22 bp, Homo sapiens
tctttagcagtttcctcagtga

SEQ ID NO: 3551298 - DNA, 20 bp, Homo sapiens
tctttataacaaaacaggga

SEQ ID NO: 3551299 - DNA, 16 bp, Homo sapiens
tctttatttttttccc

SEQ ID NO: 3551300 - DNA, 17 bp, Homo sapiens
tctttatttttttccca

SEQ ID NO: 3551301 - DNA, 15 bp, Homo sapiens
tctttcacccatcct

SEQ ID NO: 3551302 - DNA, 23 bp, Homo sapiens
tctttcacccatcctaggaacca

SEQ ID NO: 3551303 - DNA, 22 bp, Homo sapiens
tctttcagattttttgaaccat

SEQ ID NO: 3551304 - DNA, 12 bp, Homo sapiens
tctttcatgagt

SEQ ID NO: 3551305 - DNA, 14 bp, Homo sapiens
tctttcatgagttt

SEQ ID NO: 3551306 - DNA, 18 bp, Homo sapiens
tctttccaaaacatttct

SEQ ID NO: 3551307 - DNA, 21 bp, Homo sapiens
tctttccaccataccttagag

SEQ ID NO: 3551308 - DNA, 21 bp, Homo sapiens
tctttccgtcaccctggggat

SEQ ID NO: 3551309 - DNA, 17 bp, Homo sapiens
tctttcctaaggctgca

SEQ ID NO: 3551310 - DNA, 23 bp, Homo sapiens
tctttcctaaggctgcaaggttt

SEQ ID NO: 3551311 - DNA, 20 bp, Homo sapiens
tctttcctttactcctggct

SEQ ID NO: 3551312 - DNA, 14 bp, Homo sapiens
tctttctaatgctg

SEQ ID NO: 3551313 - DNA, 17 bp, Homo sapiens
tctttctatataaaatg

SEQ ID NO: 3551314 - DNA, 24 bp, Homo sapiens
tctttctccttgaatatctttcga

SEQ ID NO: 3551315 - DNA, 16 bp, Homo sapiens
tctttctctcagtgaa

SEQ ID NO: 3551316 - DNA, 15 bp, Homo sapiens
tctttctctgaggac

SEQ ID NO: 3551317 - DNA, 22 bp, Homo sapiens
tctttctgcagaaacagaaagg

SEQ ID NO: 3551318 - DNA, 24 bp, Homo sapiens
tctttctgctctatactgtggcct

SEQ ID NO: 3551319 - DNA, 18 bp, Homo sapiens
tctttcttattttgtaat

SEQ ID NO: 3551320 - DNA, 21 bp, Homo sapiens
tctttcttattttgtaataaa

SEQ ID NO: 3551321 - DNA, 14 bp, Homo sapiens
tctttcttcactct

SEQ ID NO: 3551322 - DNA, 15 bp, Homo sapiens
tctttcttcactctg

SEQ ID NO: 3551323 - DNA, 15 bp, Homo sapiens
tctttcttcctctgc

SEQ ID NO: 3551324 - DNA, 17 bp, Homo sapiens
tctttcttcctctgctg

SEQ ID NO: 3551325 - DNA, 18 bp, Homo sapiens
tctttctttgcaccaaag

SEQ ID NO: 3551326 - DNA, 12 bp, Homo sapiens
tctttgaataaa

SEQ ID NO: 3551327 - DNA, 16 bp, Homo sapiens
tctttgaataaatgtc

SEQ ID NO: 3551328 - DNA, 22 bp, Homo sapiens
tcacttaagttagttccactga

SEQ ID NO: 3551329 - DNA, 17 bp, Homo sapiens
tcacttagtcctttatc

SEQ ID NO: 3551330 - DNA, 14 bp, Homo sapiens
tcacttgtacaaaa

SEQ ID NO: 3551331 - DNA, 16 bp, Homo sapiens
tcacttgtcgggggcc

SEQ ID NO: 3551332 - DNA, 13 bp, Homo sapiens
tcactttgtgtat

SEQ ID NO: 3551333 - DNA, 13 bp, Homo sapiens
tcacttttcctcc

SEQ ID NO: 3551334 - DNA, 17 bp, Homo sapiens
tcactttttctgataaa

SEQ ID NO: 3551335 - DNA, 17 bp, Homo sapiens
tcagaaaaaaataaatg

SEQ ID NO: 3551336 - DNA, 19 bp, Homo sapiens
tcagaaaggggctcttctg

SEQ ID NO: 3551337 - DNA, 20 bp, Homo sapiens
tcagaaaggggctcttctga

SEQ ID NO: 3551338 - DNA, 17 bp, Homo sapiens
tcagaacaaaacttcta

SEQ ID NO: 3551339 - DNA, 19 bp, Homo sapiens
tcagaacattcagctctgg

SEQ ID NO: 3551340 - DNA, 20 bp, Homo sapiens
tcagaacattcagctctgga

SEQ ID NO: 3551341 - DNA, 21 bp, Homo sapiens
tcagaacattcagctctggag

SEQ ID NO: 3551342 - DNA, 23 bp, Homo sapiens
tcagaacattcagctctggagaa

SEQ ID NO: 3551343 - DNA, 18 bp, Homo sapiens
tcagaactcttcctcctc

SEQ ID NO: 3551344 - DNA, 16 bp, Homo sapiens
tcagaactgcccttgc

SEQ ID NO: 3551345 - DNA, 18 bp, Homo sapiens
tcagaagaacatgatttt

SEQ ID NO: 3551346 - DNA, 16 bp, Homo sapiens
tcagaagaatcttcct

SEQ ID NO: 3551347 - DNA, 22 bp, Homo sapiens
tcagaagaatcttcctggcaca

SEQ ID NO: 3551348 - DNA, 22 bp, Homo sapiens
tcagaagtcatcttgctaccag

SEQ ID NO: 3551349 - DNA, 13 bp, Homo sapiens
tcagaatcttttc

SEQ ID NO: 3551350 - DNA, 12 bp, Homo sapiens
tcagacacagct

SEQ ID NO: 3551351 - DNA, 13 bp, Homo sapiens
tcagacacagctc

SEQ ID NO: 3551352 - DNA, 15 bp, Homo sapiens
tcagacccccccatt

SEQ ID NO: 3551353 - DNA, 22 bp, Homo sapiens
tcagacgccaggcaccacagcc

SEQ ID NO: 3551354 - DNA, 19 bp, Homo sapiens
tcagactcaagtacccatt

SEQ ID NO: 3551355 - DNA, 13 bp, Homo sapiens
tcagactgataga

SEQ ID NO: 3551356 - DNA, 20 bp, Homo sapiens
tcagactgatagacaccata

SEQ ID NO: 3551357 - DNA, 12 bp, Homo sapiens
tcagactggccc

SEQ ID NO: 3551358 - DNA, 12 bp, Homo sapiens
tcagagaatttc

SEQ ID NO: 3551359 - DNA, 12 bp, Homo sapiens
tcagagacactg

SEQ ID NO: 3551360 - DNA, 21 bp, Homo sapiens
tcagagaggccttttggaatg

SEQ ID NO: 3551361 - DNA, 19 bp, Homo sapiens
tcagagcccccagccctgg

SEQ ID NO: 3551362 - DNA, 13 bp, Homo sapiens
tcagaggcctgct

SEQ ID NO: 3551363 - DNA, 23 bp, Homo sapiens
tcagagtgcaagcccctgctcca

SEQ ID NO: 3551364 - DNA, 20 bp, Homo sapiens
tcagatcattatcagcctgt

SEQ ID NO: 3551365 - DNA, 16 bp, Homo sapiens
tcagatctttctcctt

SEQ ID NO: 3551366 - DNA, 19 bp, Homo sapiens
tcagatggaaaattcattt

SEQ ID NO: 3551367 - DNA, 22 bp, Homo sapiens
tcagattcccagagcaaaataa

SEQ ID NO: 3551368 - DNA, 21 bp, Homo sapiens
tcagatttaagccttacaaag

SEQ ID NO: 3551369 - DNA, 17 bp, Homo sapiens
tcagatttgccttattg

SEQ ID NO: 3551370 - DNA, 22 bp, Homo sapiens
tcagatttgccttattggcagc

SEQ ID NO: 3551371 - DNA, 18 bp, Homo sapiens
tcagcaaccctacagtat

SEQ ID NO: 3551372 - DNA, 20 bp, Homo sapiens
tcagcaaccctacagtatat

SEQ ID NO: 3551373 - DNA, 18 bp, Homo sapiens
tcagcaagataaacatta

SEQ ID NO: 3551374 - DNA, 19 bp, Homo sapiens
tcagcaatgccccaaactt

SEQ ID NO: 3551375 - DNA, 13 bp, Homo sapiens
tcagcaccccagt

SEQ ID NO: 3551376 - DNA, 23 bp, Homo sapiens
tcagcactttgggaggctgaggc

SEQ ID NO: 3551377 - DNA, 14 bp, Homo sapiens
tcagcagagtgagg

SEQ ID NO: 3551378 - DNA, 19 bp, Homo sapiens
tcagcagtctaaattttct

SEQ ID NO: 3551379 - DNA, 22 bp, Homo sapiens
tcagcagtctaaattttctaaa

SEQ ID NO: 3551380 - DNA, 23 bp, Homo sapiens
tcagcattctcactcctacctgg

SEQ ID NO: 3551381 - DNA, 13 bp, Homo sapiens
tcagcattttaga

SEQ ID NO: 3551382 - DNA, 14 bp, Homo sapiens
tcagccagagaagc

SEQ ID NO: 3551383 - DNA, 16 bp, Homo sapiens
tcagccaggtctgact

SEQ ID NO: 3551384 - DNA, 19 bp, Homo sapiens
tcagccaggtctgactcca

SEQ ID NO: 3551385 - DNA, 12 bp, Homo sapiens
tcagcctcctgt

SEQ ID NO: 3551386 - DNA, 21 bp, Homo sapiens
tcagcctgctttcctgcagca

SEQ ID NO: 3551387 - DNA, 18 bp, Homo sapiens
tcagcctggccagacaca

SEQ ID NO: 3551388 - DNA, 12 bp, Homo sapiens
tcagcctggttt

SEQ ID NO: 3551389 - DNA, 20 bp, Homo sapiens
tcagccttttatgtattttc

SEQ ID NO: 3551390 - DNA, 15 bp, Homo sapiens
tcagcgtaaaatggt

SEQ ID NO: 3551391 - DNA, 16 bp, Homo sapiens
tcagcgtaaaatggtg

SEQ ID NO: 3551392 - DNA, 21 bp, Homo sapiens
tcagctcccctcggagaagag

SEQ ID NO: 3551393 - DNA, 18 bp, Homo sapiens
tcagctccctgcctgttt

SEQ ID NO: 3551394 - DNA, 16 bp, Homo sapiens
tcagctctggagaaca

SEQ ID NO: 3551395 - DNA, 19 bp, Homo sapiens
tcagctcttggctccactg

SEQ ID NO: 3551396 - DNA, 20 bp, Homo sapiens
tcagctgcaaggtactctgg

SEQ ID NO: 3551397 - DNA, 21 bp, Homo sapiens
tcagctgcctcctgcgccctg

SEQ ID NO: 3551398 - DNA, 15 bp, Homo sapiens
tcagctgtgccttcc

SEQ ID NO: 3551399 - DNA, 22 bp, Homo sapiens
tcagctgtgccttccctttcta

SEQ ID NO: 3551400 - DNA, 22 bp, Homo sapiens
tcagctgtggggaacacagcta

SEQ ID NO: 3551401 - DNA, 9 bp, Homo sapiens
tcaggaaac

SEQ ID NO: 3551402 - DNA, 23 bp, Homo sapiens
tcaggaaatcaaatatgcaaagc

SEQ ID NO: 3551403 - DNA, 23 bp, Homo sapiens
tcaggaagggggccgccaccctc

SEQ ID NO: 3551404 - DNA, 15 bp, Homo sapiens
tcaggaattcagtgc

SEQ ID NO: 3551405 - DNA, 18 bp, Homo sapiens
tcaggaattcagtgcctt

SEQ ID NO: 3551406 - DNA, 14 bp, Homo sapiens
tcaggacagatgcc

SEQ ID NO: 3551407 - DNA, 16 bp, Homo sapiens
tcaggactctctccag

SEQ ID NO: 3551408 - DNA, 21 bp, Homo sapiens
tcaggactctctccaggaggg

SEQ ID NO: 3551409 - DNA, 23 bp, Homo sapiens
tcaggagccgaagcccaggggcc

SEQ ID NO: 3551410 - DNA, 12 bp, Homo sapiens
tcaggagcctgg

SEQ ID NO: 3551411 - DNA, 16 bp, Homo sapiens
tcaggagcctggccag

SEQ ID NO: 3551412 - DNA, 20 bp, Homo sapiens
tcaggagcctggccaggcag

SEQ ID NO: 3551413 - DNA, 17 bp, Homo sapiens
tcaggaggcaggacctt

SEQ ID NO: 3551414 - DNA, 20 bp, Homo sapiens
tcaggatcaaaccccgacca

SEQ ID NO: 3551415 - DNA, 13 bp, Homo sapiens
tcaggatccagtg

SEQ ID NO: 3551416 - DNA, 15 bp, Homo sapiens
tcaggccaccctcca

SEQ ID NO: 3551417 - DNA, 16 bp, Homo sapiens
tcaggccaccctccac

SEQ ID NO: 3551418 - DNA, 13 bp, Homo sapiens
tcaggccacttga

SEQ ID NO: 3551419 - DNA, 12 bp, Homo sapiens
tcaggccagccc

SEQ ID NO: 3551420 - DNA, 15 bp, Homo sapiens
tcaggccagcccagc

SEQ ID NO: 3551421 - DNA, 17 bp, Homo sapiens
tcaggccagcccagcca

SEQ ID NO: 3551422 - DNA, 15 bp, Homo sapiens
tcaggccgaaggagg

SEQ ID NO: 3551423 - DNA, 23 bp, Homo sapiens
tcaggcgtagatcaccagaataa

SEQ ID NO: 3551424 - DNA, 18 bp, Homo sapiens
tcaggctaagaccctgtg

SEQ ID NO: 3551425 - DNA, 18 bp, Homo sapiens
tcaggctatatgcagtcc

SEQ ID NO: 3551426 - DNA, 11 bp, Homo sapiens
tcaggctctgc

SEQ ID NO: 3551427 - DNA, 13 bp, Homo sapiens
tcaggctctgcac

SEQ ID NO: 3551428 - DNA, 16 bp, Homo sapiens
tcagggaaaagcagct

SEQ ID NO: 3551429 - DNA, 23 bp, Homo sapiens
tcagggaaaagcagctctcccct

SEQ ID NO: 3551430 - DNA, 17 bp, Homo sapiens
tcagggaccgtccaggg

SEQ ID NO: 3551431 - DNA, 18 bp, Homo sapiens
tcagggagacaggcaggg

SEQ ID NO: 3551432 - DNA, 21 bp, Homo sapiens
tcagggatggagggaagacct

SEQ ID NO: 3551433 - DNA, 18 bp, Homo sapiens
tcaggggaccccactccc

SEQ ID NO: 3551434 - DNA, 20 bp, Homo sapiens
tcaggggctctagggactgc

SEQ ID NO: 3551435 - DNA, 16 bp, Homo sapiens
tcaggtcaggagttcg

SEQ ID NO: 3551436 - DNA, 12 bp, Homo sapiens
tcaggtccctgc

SEQ ID NO: 3551437 - DNA, 21 bp, Homo sapiens
tcaggtgaaactccagatgcc

SEQ ID NO: 3551438 - DNA, 22 bp, Homo sapiens
tcaggttgtctgaagtcactgc

SEQ ID NO: 3551439 - DNA, 18 bp, Homo sapiens
tcagtaatttgaggacaa

SEQ ID NO: 3551440 - DNA, 14 bp, Homo sapiens
tcagtatgtggaag

SEQ ID NO: 3551441 - DNA, 16 bp, Homo sapiens
tcagtatgtggaagtg

SEQ ID NO: 3551442 - DNA, 12 bp, Homo sapiens
tcagtccaggat

SEQ ID NO: 3551443 - DNA, 14 bp, Homo sapiens
tcagtcctttgtct

SEQ ID NO: 3551444 - DNA, 15 bp, Homo sapiens
tcagtcctttgtctt

SEQ ID NO: 3551445 - DNA, 19 bp, Homo sapiens
tcagtgaatatttttgtat

SEQ ID NO: 3551446 - DNA, 21 bp, Homo sapiens
tcagtgaatatttttgtattt

SEQ ID NO: 3551447 - DNA, 15 bp, Homo sapiens
tcagtgactcctgct

SEQ ID NO: 3551448 - DNA, 13 bp, Homo sapiens
tcagtgcagtttc

SEQ ID NO: 3551449 - DNA, 14 bp, Homo sapiens
tcagtgcagtttct

SEQ ID NO: 3551450 - DNA, 14 bp, Homo sapiens
tcagtgcctccaca

SEQ ID NO: 3551451 - DNA, 15 bp, Homo sapiens
tcagtggggctggca

SEQ ID NO: 3551452 - DNA, 19 bp, Homo sapiens
tcagtggggctggcatcaa

SEQ ID NO: 3551453 - DNA, 14 bp, Homo sapiens
tcagtggtgggaga

SEQ ID NO: 3551454 - DNA, 19 bp, Homo sapiens
tcagtgttttcattttaga

SEQ ID NO: 3551455 - DNA, 16 bp, Homo sapiens
tcagttaactattgca

SEQ ID NO: 3551456 - DNA, 21 bp, Homo sapiens
tcagttctaggcctttcctct

SEQ ID NO: 3551457 - DNA, 21 bp, Homo sapiens
tcagtttatgttgtacaatgt

SEQ ID NO: 3551458 - DNA, 21 bp, Homo sapiens
tcagtttattttttcttctgt

SEQ ID NO: 3551459 - DNA, 14 bp, Homo sapiens
tcagtttttcctcc

SEQ ID NO: 3551460 - DNA, 16 bp, Homo sapiens
tataaatgtaaaaatg

SEQ ID NO: 3551461 - DNA, 19 bp, Homo sapiens
tataaatgtaaaaatgaag

SEQ ID NO: 3551462 - DNA, 12 bp, Homo sapiens
tataaatgtaca

SEQ ID NO: 3551463 - DNA, 17 bp, Homo sapiens
tataaatgtttatattg

SEQ ID NO: 3551464 - DNA, 19 bp, Homo sapiens
tataaatgtttatattgtt

SEQ ID NO: 3551465 - DNA, 20 bp, Homo sapiens
tataaatgtttatattgttt

SEQ ID NO: 3551466 - DNA, 15 bp, Homo sapiens
tataaattattactt

SEQ ID NO: 3551467 - DNA, 21 bp, Homo sapiens
tataaattcctctttgctttg

SEQ ID NO: 3551468 - DNA, 16 bp, Homo sapiens
tataaattctactaag

SEQ ID NO: 3551469 - DNA, 22 bp, Homo sapiens
tataaattctactaagttattt

SEQ ID NO: 3551470 - DNA, 14 bp, Homo sapiens
tataagactattcc

SEQ ID NO: 3551471 - DNA, 16 bp, Homo sapiens
tataagagcatgaaat

SEQ ID NO: 3551472 - DNA, 22 bp, Homo sapiens
tataagagcttccaattttcct

SEQ ID NO: 3551473 - DNA, 16 bp, Homo sapiens
tataagtagcaggcca

SEQ ID NO: 3551474 - DNA, 18 bp, Homo sapiens
tataagtgtacatatgtg

SEQ ID NO: 3551475 - DNA, 23 bp, Homo sapiens
tataagttctattttactgtctt

SEQ ID NO: 3551476 - DNA, 18 bp, Homo sapiens
tataataaaaatatattt

SEQ ID NO: 3551477 - DNA, 14 bp, Homo sapiens
tataataaacataa

SEQ ID NO: 3551478 - DNA, 14 bp, Homo sapiens
tataataaaggact

SEQ ID NO: 3551479 - DNA, 22 bp, Homo sapiens
tataataaaggactgtaatctt

SEQ ID NO: 3551480 - DNA, 19 bp, Homo sapiens
tataatagattgagttatt

SEQ ID NO: 3551481 - DNA, 13 bp, Homo sapiens
tataatattttaa

SEQ ID NO: 3551482 - DNA, 11 bp, Homo sapiens
tataatgaacc

SEQ ID NO: 3551483 - DNA, 15 bp, Homo sapiens
tataatgaataaatc

SEQ ID NO: 3551484 - DNA, 15 bp, Homo sapiens
tataatgtatttgaa

SEQ ID NO: 3551485 - DNA, 16 bp, Homo sapiens
tataatgtatttgaaa

SEQ ID NO: 3551486 - DNA, 14 bp, Homo sapiens
tataattggaagtg

SEQ ID NO: 3551487 - DNA, 20 bp, Homo sapiens
tataattggatttcctaata

SEQ ID NO: 3551488 - DNA, 12 bp, Homo sapiens
tataattggctt

SEQ ID NO: 3551489 - DNA, 13 bp, Homo sapiens
tataattggctta

SEQ ID NO: 3551490 - DNA, 16 bp, Homo sapiens
tataatttacctaaga

SEQ ID NO: 3551491 - DNA, 20 bp, Homo sapiens
tataatttacctaagattac

SEQ ID NO: 3551492 - DNA, 13 bp, Homo sapiens
tataattttcact

SEQ ID NO: 3551493 - DNA, 21 bp, Homo sapiens
tatacaccatatactgttctt

SEQ ID NO: 3551494 - DNA, 19 bp, Homo sapiens
tatacacccagttctgaat

SEQ ID NO: 3551495 - DNA, 20 bp, Homo sapiens
tatacagaggaaatctgtaa

SEQ ID NO: 3551496 - DNA, 20 bp, Homo sapiens
tatacagtagcttgaaattg

SEQ ID NO: 3551497 - DNA, 17 bp, Homo sapiens
tatactatttagtctca

SEQ ID NO: 3551498 - DNA, 16 bp, Homo sapiens
tatactgctatttaca

SEQ ID NO: 3551499 - DNA, 18 bp, Homo sapiens
tatactgtggcctgcagg

SEQ ID NO: 3551500 - DNA, 21 bp, Homo sapiens
tatactgtggcctgcaggagg

SEQ ID NO: 3551501 - DNA, 14 bp, Homo sapiens
tatagacacacata

SEQ ID NO: 3551502 - DNA, 14 bp, Homo sapiens
tatagaccaaagca

SEQ ID NO: 3551503 - DNA, 18 bp, Homo sapiens
tatagaccaattgaagca

SEQ ID NO: 3551504 - DNA, 21 bp, Homo sapiens
tatagaccaattgaagcatga

SEQ ID NO: 3551505 - DNA, 14 bp, Homo sapiens
tatagccatgattt

SEQ ID NO: 3551506 - DNA, 14 bp, Homo sapiens
tatagctaagtaca

SEQ ID NO: 3551507 - DNA, 23 bp, Homo sapiens
tataggagaaagcaaaatacatc

SEQ ID NO: 3551508 - DNA, 24 bp, Homo sapiens
tataggagaaagcaaaatacatca

SEQ ID NO: 3551509 - DNA, 21 bp, Homo sapiens
tataggcctgtcccttgcctc

SEQ ID NO: 3551510 - DNA, 13 bp, Homo sapiens
tataggctatttt

SEQ ID NO: 3551511 - DNA, 21 bp, Homo sapiens
tataggctattttctaaagac

SEQ ID NO: 3551512 - DNA, 12 bp, Homo sapiens
tatagtgacatg

SEQ ID NO: 3551513 - DNA, 20 bp, Homo sapiens
tatagttactgtgtaattag

SEQ ID NO: 3551514 - DNA, 11 bp, Homo sapiens
tatagttatat

SEQ ID NO: 3551515 - DNA, 18 bp, Homo sapiens
tatataaaatgtattcaa

SEQ ID NO: 3551516 - DNA, 19 bp, Homo sapiens
tatataagtgtacatatgt

SEQ ID NO: 3551517 - DNA, 23 bp, Homo sapiens
tatatacagaggaaatctgtaac

SEQ ID NO: 3551518 - DNA, 20 bp, Homo sapiens
tatatactgctatttacact

SEQ ID NO: 3551519 - DNA, 13 bp, Homo sapiens
tatatagaatgct

SEQ ID NO: 3551520 - DNA, 17 bp, Homo sapiens
tatataggcagttgcat

SEQ ID NO: 3551521 - DNA, 19 bp, Homo sapiens
tatatatgcacacatatat

SEQ ID NO: 3551522 - DNA, 10 bp, Homo sapiens
tatatattat

SEQ ID NO: 3551523 - DNA, 20 bp, Homo sapiens
tatatattcttataaaaatg

SEQ ID NO: 3551524 - DNA, 15 bp, Homo sapiens
tatatgaatgctatt

SEQ ID NO: 3551525 - DNA, 15 bp, Homo sapiens
tatatgcaatgtcca

SEQ ID NO: 3551526 - DNA, 21 bp, Homo sapiens
tatatgtacagtttattgata

SEQ ID NO: 3551527 - DNA, 18 bp, Homo sapiens
tatattaaaaaagagaca

SEQ ID NO: 3551528 - DNA, 12 bp, Homo sapiens
tatattacaatg

SEQ ID NO: 3551529 - DNA, 13 bp, Homo sapiens
tatattataagtt

SEQ ID NO: 3551530 - DNA, 19 bp, Homo sapiens
tatattcattctttttgaa

SEQ ID NO: 3551531 - DNA, 20 bp, Homo sapiens
tatattggaattataaatat

SEQ ID NO: 3551532 - DNA, 20 bp, Homo sapiens
tatatttaagcaacatcttt

SEQ ID NO: 3551533 - DNA, 20 bp, Homo sapiens
tatatttcaaacattttgta

SEQ ID NO: 3551534 - DNA, 13 bp, Homo sapiens
tatattttaagaa

SEQ ID NO: 3551535 - DNA, 14 bp, Homo sapiens
tatattttgctagc

SEQ ID NO: 3551536 - DNA, 18 bp, Homo sapiens
tatattttgtactttgtg

SEQ ID NO: 3551537 - DNA, 18 bp, Homo sapiens
tatatttttaaaaaatga

SEQ ID NO: 3551538 - DNA, 18 bp, Homo sapiens
tatatttttgtctgcagc

SEQ ID NO: 3551539 - DNA, 19 bp, Homo sapiens
tatatttttgtctgcagct

SEQ ID NO: 3551540 - DNA, 21 bp, Homo sapiens
tatcaaagagaagatgcctgt

SEQ ID NO: 3551541 - DNA, 18 bp, Homo sapiens
tatcaaagtcattaaaga

SEQ ID NO: 3551542 - DNA, 14 bp, Homo sapiens
tatcaacagcttcc

SEQ ID NO: 3551543 - DNA, 14 bp, Homo sapiens
tatcaagcaacatt

SEQ ID NO: 3551544 - DNA, 16 bp, Homo sapiens
tatcaagcaacattct

SEQ ID NO: 3551545 - DNA, 20 bp, Homo sapiens
tatcacaaatcttaacttga

SEQ ID NO: 3551546 - DNA, 17 bp, Homo sapiens
tatcagagtatgtcagt

SEQ ID NO: 3551547 - DNA, 15 bp, Homo sapiens
tatcagcacgtgtgg

SEQ ID NO: 3551548 - DNA, 15 bp, Homo sapiens
tatcaggtgtataaa

SEQ ID NO: 3551549 - DNA, 13 bp, Homo sapiens
tatcagtgtcctt

SEQ ID NO: 3551550 - DNA, 17 bp, Homo sapiens
tatcagtgtcctttcca

SEQ ID NO: 3551551 - DNA, 18 bp, Homo sapiens
tatcagttttatagcttt

SEQ ID NO: 3551552 - DNA, 18 bp, Homo sapiens
tatcatagaaatgtaact

SEQ ID NO: 3551553 - DNA, 23 bp, Homo sapiens
tatcatagaaatgtaacttttgt

SEQ ID NO: 3551554 - DNA, 16 bp, Homo sapiens
tatcatgagtgaataa

SEQ ID NO: 3551555 - DNA, 16 bp, Homo sapiens
tatcatgtaaagaaat

SEQ ID NO: 3551556 - DNA, 21 bp, Homo sapiens
tatcatgtaaagaaatgtctt

SEQ ID NO: 3551557 - DNA, 22 bp, Homo sapiens
tatcatgtaaagaaatgtctta

SEQ ID NO: 3551558 - DNA, 19 bp, Homo sapiens
tatccaacatcaacatctt

SEQ ID NO: 3551559 - DNA, 21 bp, Homo sapiens
tatccacaattattggcaaag

SEQ ID NO: 3551560 - DNA, 22 bp, Homo sapiens
tatccacaattattggcaaagt

SEQ ID NO: 3551561 - DNA, 22 bp, Homo sapiens
ctgtcagtgttaaagattttgt

SEQ ID NO: 3551562 - DNA, 16 bp, Homo sapiens
ctgtcatagaaattac

SEQ ID NO: 3551563 - DNA, 22 bp, Homo sapiens
ctgtcatcctcaaagaaagtgt

SEQ ID NO: 3551564 - DNA, 15 bp, Homo sapiens
ctgtcattatttcct

SEQ ID NO: 3551565 - DNA, 15 bp, Homo sapiens
ctgtcatttgaacct

SEQ ID NO: 3551566 - DNA, 18 bp, Homo sapiens
ctgtccaggcactgctgc

SEQ ID NO: 3551567 - DNA, 21 bp, Homo sapiens
ctgtccaggcactgctgccca

SEQ ID NO: 3551568 - DNA, 17 bp, Homo sapiens
ctgtccatttttattca

SEQ ID NO: 3551569 - DNA, 20 bp, Homo sapiens
ctgtcccaattctgcccgct

SEQ ID NO: 3551570 - DNA, 23 bp, Homo sapiens
ctgtcccacccacacagctgccc

SEQ ID NO: 3551571 - DNA, 12 bp, Homo sapiens
ctgtccctgcag

SEQ ID NO: 3551572 - DNA, 14 bp, Homo sapiens
ctgtccctgcaggg

SEQ ID NO: 3551573 - DNA, 15 bp, Homo sapiens
ctgtcccttgcctct

SEQ ID NO: 3551574 - DNA, 22 bp, Homo sapiens
ctgtcccttgcctctgccctgg

SEQ ID NO: 3551575 - DNA, 17 bp, Homo sapiens
ctgtcccttttccctta

SEQ ID NO: 3551576 - DNA, 15 bp, Homo sapiens
ctgtcctattatatt

SEQ ID NO: 3551577 - DNA, 20 bp, Homo sapiens
ctgtcctctctggctgggga

SEQ ID NO: 3551578 - DNA, 17 bp, Homo sapiens
ctgtcctgcagtcccac

SEQ ID NO: 3551579 - DNA, 22 bp, Homo sapiens
ctgtcctgcagtcccacactgt

SEQ ID NO: 3551580 - DNA, 22 bp, Homo sapiens
ctgtcctgctcattatgccact

SEQ ID NO: 3551581 - DNA, 14 bp, Homo sapiens
ctgtcctgggcatg

SEQ ID NO: 3551582 - DNA, 20 bp, Homo sapiens
ctgtcctgggcatgggtcca

SEQ ID NO: 3551583 - DNA, 14 bp, Homo sapiens
ctgtcctgtcctgc

SEQ ID NO: 3551584 - DNA, 16 bp, Homo sapiens
ctgtcctgtcctgctc

SEQ ID NO: 3551585 - DNA, 13 bp, Homo sapiens
ctgtcctgtcttt

SEQ ID NO: 3551586 - DNA, 14 bp, Homo sapiens
ctgtcctgtctttg

SEQ ID NO: 3551587 - DNA, 11 bp, Homo sapiens
ctgtccttaac

SEQ ID NO: 3551588 - DNA, 20 bp, Homo sapiens
ctgtccttaacccacctctc

SEQ ID NO: 3551589 - DNA, 15 bp, Homo sapiens
ctgtctaacctgtga

SEQ ID NO: 3551590 - DNA, 13 bp, Homo sapiens
ctgtctagagagg

SEQ ID NO: 3551591 - DNA, 18 bp, Homo sapiens
ctgtctcaagagggcact

SEQ ID NO: 3551592 - DNA, 19 bp, Homo sapiens
ctgtctcaagagggcactg

SEQ ID NO: 3551593 - DNA, 21 bp, Homo sapiens
ctgtctcaagagggcactggt

SEQ ID NO: 3551594 - DNA, 22 bp, Homo sapiens
ctgtctcaagagggcactggtg

SEQ ID NO: 3551595 - DNA, 12 bp, Homo sapiens
ctgtctcacctg

SEQ ID NO: 3551596 - DNA, 14 bp, Homo sapiens
ctgtctcacctgga

SEQ ID NO: 3551597 - DNA, 13 bp, Homo sapiens
ctgtctccagctg

SEQ ID NO: 3551598 - DNA, 18 bp, Homo sapiens
ctgtctccagctgcctgg

SEQ ID NO: 3551599 - DNA, 21 bp, Homo sapiens
ctgtctccagctgcctgggcc

SEQ ID NO: 3551600 - DNA, 21 bp, Homo sapiens
ctgtctccagggcccccaccg

SEQ ID NO: 3551601 - DNA, 14 bp, Homo sapiens
ctgtctctccagtg

SEQ ID NO: 3551602 - DNA, 14 bp, Homo sapiens
ctgtctgagacagg

SEQ ID NO: 3551603 - DNA, 14 bp, Homo sapiens
ctgtctgccagggc

SEQ ID NO: 3551604 - DNA, 16 bp, Homo sapiens
ctgtctgctgccagca

SEQ ID NO: 3551605 - DNA, 17 bp, Homo sapiens
ctgtctgggctcagaca

SEQ ID NO: 3551606 - DNA, 15 bp, Homo sapiens
ctgtctgtctctaat

SEQ ID NO: 3551607 - DNA, 14 bp, Homo sapiens
ctgtcttaattttc

SEQ ID NO: 3551608 - DNA, 19 bp, Homo sapiens
ctgtcttctttctccatgg

SEQ ID NO: 3551609 - DNA, 18 bp, Homo sapiens
ctgtcttgttaatgcttt

SEQ ID NO: 3551610 - DNA, 19 bp, Homo sapiens
ctgtcttgttaatgctttt

SEQ ID NO: 3551611 - DNA, 20 bp, Homo sapiens
ctgtgaattcattctggagg

SEQ ID NO: 3551612 - DNA, 14 bp, Homo sapiens
ctgtgacagacttt

SEQ ID NO: 3551613 - DNA, 22 bp, Homo sapiens
ctgtgagcacaaagaagaaagc

SEQ ID NO: 3551614 - DNA, 17 bp, Homo sapiens
ctgtgagcatggggcca

SEQ ID NO: 3551615 - DNA, 21 bp, Homo sapiens
ctgtgagcatggggccaggaa

SEQ ID NO: 3551616 - DNA, 16 bp, Homo sapiens
ctgtgatatgtctgct

SEQ ID NO: 3551617 - DNA, 12 bp, Homo sapiens
ctgtgattggct

SEQ ID NO: 3551618 - DNA, 16 bp, Homo sapiens
ctgtgattgtgcctac

SEQ ID NO: 3551619 - DNA, 15 bp, Homo sapiens
ctgtgatttttatca

SEQ ID NO: 3551620 - DNA, 23 bp, Homo sapiens
ctgtgcagcctgtcctgggctgg

SEQ ID NO: 3551621 - DNA, 14 bp, Homo sapiens
ctgtgccagaggcc

SEQ ID NO: 3551622 - DNA, 15 bp, Homo sapiens
ctgtgccatgctggg

SEQ ID NO: 3551623 - DNA, 16 bp, Homo sapiens
ctgtgccatgctgggc

SEQ ID NO: 3551624 - DNA, 17 bp, Homo sapiens
ctgtgcccgcatgtgtg

SEQ ID NO: 3551625 - DNA, 18 bp, Homo sapiens
ctgtgcccgcatgtgtgc

SEQ ID NO: 3551626 - DNA, 18 bp, Homo sapiens
ctgtgccttccctttcta

SEQ ID NO: 3551627 - DNA, 23 bp, Homo sapiens
ctgtgccttgccacattaaattg

SEQ ID NO: 3551628 - DNA, 17 bp, Homo sapiens
ctgtgcctttcctatca

SEQ ID NO: 3551629 - DNA, 14 bp, Homo sapiens
ctgtgcgtcccagc

SEQ ID NO: 3551630 - DNA, 16 bp, Homo sapiens
ctgtgcgtcccagctg

SEQ ID NO: 3551631 - DNA, 17 bp, Homo sapiens
ctgtgcgtcccagctga

SEQ ID NO: 3551632 - DNA, 18 bp, Homo sapiens
ctgtgctaatcaaaactt

SEQ ID NO: 3551633 - DNA, 19 bp, Homo sapiens
ctgtgctccacactcagaa

SEQ ID NO: 3551634 - DNA, 20 bp, Homo sapiens
ctgtgctccacactcagaaa

SEQ ID NO: 3551635 - DNA, 15 bp, Homo sapiens
ctgtgctctggcacc

SEQ ID NO: 3551636 - DNA, 12 bp, Homo sapiens
ctgtgctgctca

SEQ ID NO: 3551637 - DNA, 19 bp, Homo sapiens
ctgtgctggtattggaata

SEQ ID NO: 3551638 - DNA, 14 bp, Homo sapiens
ctgtgctgtttcaa

SEQ ID NO: 3551639 - DNA, 19 bp, Homo sapiens
ctgtgctgtttcaaagttc

SEQ ID NO: 3551640 - DNA, 17 bp, Homo sapiens
ctgtgcttttaaatgca

SEQ ID NO: 3551641 - DNA, 16 bp, Homo sapiens
ctgtggagctgccaca

SEQ ID NO: 3551642 - DNA, 17 bp, Homo sapiens
ctgtggagctgccacag

SEQ ID NO: 3551643 - DNA, 19 bp, Homo sapiens
ctgtggagctgccacagag

SEQ ID NO: 3551644 - DNA, 20 bp, Homo sapiens
ctgtggagctgccacagaga

SEQ ID NO: 3551645 - DNA, 22 bp, Homo sapiens
ctgtggagctgccacagagaag

SEQ ID NO: 3551646 - DNA, 22 bp, Homo sapiens
ctgtggagggagggcagctggc

SEQ ID NO: 3551647 - DNA, 23 bp, Homo sapiens
ctgtggagggagggcagctggcc

SEQ ID NO: 3551648 - DNA, 18 bp, Homo sapiens
ctgtggcagagttacagt

SEQ ID NO: 3551649 - DNA, 15 bp, Homo sapiens
ctgtggcctgcagga

SEQ ID NO: 3551650 - DNA, 16 bp, Homo sapiens
ctgtggcctgcaggag

SEQ ID NO: 3551651 - DNA, 17 bp, Homo sapiens
ctgtggcctgcaggagg

SEQ ID NO: 3551652 - DNA, 13 bp, Homo sapiens
ctgtgggcaaagt

SEQ ID NO: 3551653 - DNA, 17 bp, Homo sapiens
ctgtgggcactggtggg

SEQ ID NO: 3551654 - DNA, 18 bp, Homo sapiens
ctgtggggaacacagcta

SEQ ID NO: 3551655 - DNA, 18 bp, Homo sapiens
ctgtggggtcgggctcac

SEQ ID NO: 3551656 - DNA, 14 bp, Homo sapiens
ctgtggtcatgtga

SEQ ID NO: 3551657 - DNA, 16 bp, Homo sapiens
ctgtggttccagtaag

SEQ ID NO: 3551658 - DNA, 14 bp, Homo sapiens
ctgtgtcatttctt

SEQ ID NO: 3551659 - DNA, 15 bp, Homo sapiens
ctgtgtcatttcttc

SEQ ID NO: 3551660 - DNA, 21 bp, Homo sapiens
ctgtgtcctccaccatgcact

SEQ ID NO: 3551661 - DNA, 17 bp, Homo sapiens
ctgtgtcctctagttga

SEQ ID NO: 3551662 - DNA, 14 bp, Homo sapiens
ctgtgtcctctgcc

SEQ ID NO: 3551663 - DNA, 15 bp, Homo sapiens
ctgtgtcctctgcct

SEQ ID NO: 3551664 - DNA, 17 bp, Homo sapiens
ctgtgtgaccctgggca

SEQ ID NO: 3551665 - DNA, 18 bp, Homo sapiens
ctgtgtgaccctgggcag

SEQ ID NO: 3551666 - DNA, 23 bp, Homo sapiens
ctgtgtgagtgagcacacccgtg

SEQ ID NO: 3551667 - DNA, 12 bp, Homo sapiens
ctgtgtggctcc

SEQ ID NO: 3551668 - DNA, 18 bp, Homo sapiens
ctgtgtggctcctgggcc

SEQ ID NO: 3551669 - DNA, 21 bp, Homo sapiens
ctgtgtgtccaaaactgcctc

SEQ ID NO: 3551670 - DNA, 12 bp, Homo sapiens
ctgtgtgtctgt

SEQ ID NO: 3551671 - DNA, 15 bp, Homo sapiens
ctgtgtgtctgtcct

SEQ ID NO: 3551672 - DNA, 15 bp, Homo sapiens
ctgtgtgtgtgtatg

SEQ ID NO: 3551673 - DNA, 16 bp, Homo sapiens
ctgtgttatgaaaata

SEQ ID NO: 3551674 - DNA, 22 bp, Homo sapiens
ctgtgttcgactcagcctcagg

SEQ ID NO: 3551675 - DNA, 17 bp, Homo sapiens
ctgtgttgaaacagaaa

SEQ ID NO: 3551676 - DNA, 16 bp, Homo sapiens
ctgttaaaagatgaaa

SEQ ID NO: 3551677 - DNA, 13 bp, Homo sapiens
ctgttaactgtta

SEQ ID NO: 3551678 - DNA, 17 bp, Homo sapiens
ctgttaatatttctaaa

SEQ ID NO: 3551679 - DNA, 15 bp, Homo sapiens
ctgttaatctgatgt

SEQ ID NO: 3551680 - DNA, 19 bp, Homo sapiens
ctgttaatctgatgtataa

SEQ ID NO: 3551681 - DNA, 22 bp, Homo sapiens
ctgttaatctgatgtataatgt

SEQ ID NO: 3551682 - DNA, 23 bp, Homo sapiens
ctgttacttatgtagaaactgag

SEQ ID NO: 3551683 - DNA, 12 bp, Homo sapiens
ctgttagtaaat

SEQ ID NO: 3551684 - DNA, 14 bp, Homo sapiens
ctgttatatttcat

SEQ ID NO: 3551685 - DNA, 21 bp, Homo sapiens
ctgttatttcttccctgcttt

SEQ ID NO: 3551686 - DNA, 22 bp, Homo sapiens
ctgttatttcttccctgctttg

SEQ ID NO: 3551687 - DNA, 19 bp, Homo sapiens
ctgttcacagccagactgg

SEQ ID NO: 3551688 - DNA, 22 bp, Homo sapiens
ctgttcacagccagactggcac

SEQ ID NO: 3551689 - DNA, 13 bp, Homo sapiens
ctgttcactctac

SEQ ID NO: 3551690 - DNA, 20 bp, Homo sapiens
ctgttctgcgctgtgtacaa

SEQ ID NO: 3551691 - DNA, 16 bp, Homo sapiens
ctgttcttagagtgta

SEQ ID NO: 3551692 - DNA, 21 bp, Homo sapiens
ctgttcttagagtgtagctgt

SEQ ID NO: 3551693 - DNA, 21 bp, Homo sapiens
ctgttcttcagtcctttgtct

SEQ ID NO: 3551694 - DNA, 18 bp, Homo sapiens
ctgttcttgggcctcagg

SEQ ID NO: 3551695 - DNA, 21 bp, Homo sapiens
ctgttgacacaggtctttcct

SEQ ID NO: 3551696 - DNA, 11 bp, Homo sapiens
ctgttgaggca

SEQ ID NO: 3551697 - DNA, 14 bp, Homo sapiens
ctgttgataaaaac

SEQ ID NO: 3551698 - DNA, 18 bp, Homo sapiens
ctgttgataaaaactcag

SEQ ID NO: 3551699 - DNA, 14 bp, Homo sapiens
ctgttgccatggat

SEQ ID NO: 3551700 - DNA, 22 bp, Homo sapiens
ctgttgccatggattcaccccc

SEQ ID NO: 3551701 - DNA, 15 bp, Homo sapiens
ctgttggagaaagaa

SEQ ID NO: 3551702 - DNA, 17 bp, Homo sapiens
ctgttggcaggcccact

SEQ ID NO: 3551703 - DNA, 23 bp, Homo sapiens
ctgttggcaggcccactccccag

SEQ ID NO: 3551704 - DNA, 16 bp, Homo sapiens
ctgttggtctgccttc

SEQ ID NO: 3551705 - DNA, 15 bp, Homo sapiens
ctgttggttcaaact

SEQ ID NO: 3551706 - DNA, 12 bp, Homo sapiens
ctgtttcaaagt

SEQ ID NO: 3551707 - DNA, 14 bp, Homo sapiens
ctgtttcaaagttc

SEQ ID NO: 3551708 - DNA, 16 bp, Homo sapiens
ctgtttccctgctgaa

SEQ ID NO: 3551709 - DNA, 17 bp, Homo sapiens
ctgtttccctgctgaat

SEQ ID NO: 3551710 - DNA, 20 bp, Homo sapiens
ctgtttccctgctgaatgcc

SEQ ID NO: 3551711 - DNA, 23 bp, Homo sapiens
ctgtttgctcaaaattgcttcta

SEQ ID NO: 3551712 - DNA, 16 bp, Homo sapiens
ctgtttggtggggtgg

SEQ ID NO: 3551713 - DNA, 21 bp, Homo sapiens
ctgtttggtggggtggcacct

SEQ ID NO: 3551714 - DNA, 17 bp, Homo sapiens
ctgtttgtagtgaaata

SEQ ID NO: 3551715 - DNA, 17 bp, Homo sapiens
ctgttttcccccagcaa

SEQ ID NO: 3551716 - DNA, 16 bp, Homo sapiens
ctgttttcctcccttc

SEQ ID NO: 3551717 - DNA, 20 bp, Homo sapiens
ctgttttcctcccttctgct

SEQ ID NO: 3551718 - DNA, 12 bp, Homo sapiens
ctgttttcttct

SEQ ID NO: 3551719 - DNA, 18 bp, Homo sapiens
ctgttttggatgttgcta

SEQ ID NO: 3551720 - DNA, 20 bp, Homo sapiens
ctgttttggatgttgctata

SEQ ID NO: 3551721 - DNA, 21 bp, Homo sapiens
ctgtttttctctaatgcttga

SEQ ID NO: 3551722 - DNA, 20 bp, Homo sapiens
cttaaaagtaataaagagaa

SEQ ID NO: 3551723 - DNA, 22 bp, Homo sapiens
cttaaaagtaataaagagaaat

SEQ ID NO: 3551724 - DNA, 12 bp, Homo sapiens
cttaaaagtatt

SEQ ID NO: 3551725 - DNA, 18 bp, Homo sapiens
cttaaaatattcctgcat

SEQ ID NO: 3551726 - DNA, 20 bp, Homo sapiens
cttaaaatattcctgcattt

SEQ ID NO: 3551727 - DNA, 14 bp, Homo sapiens
cttaaaatggaatt

SEQ ID NO: 3551728 - DNA, 13 bp, Homo sapiens
cttaaacaaaaaa

SEQ ID NO: 3551729 - DNA, 22 bp, Homo sapiens
cttaaatgcaaccatttgaaac

SEQ ID NO: 3551730 - DNA, 21 bp, Homo sapiens
cttaaatttgatttacatata

SEQ ID NO: 3551731 - DNA, 22 bp, Homo sapiens
cttaacccacctctcctgccct

SEQ ID NO: 3551732 - DNA, 23 bp, Homo sapiens
cttaactattaaggccttttcca

SEQ ID NO: 3551733 - DNA, 18 bp, Homo sapiens
cttaacttcttgcttctt

SEQ ID NO: 3551734 - DNA, 16 bp, Homo sapiens
cttaagcagcatggaa

SEQ ID NO: 3551735 - DNA, 18 bp, Homo sapiens
cttaagcagcatggaaaa

SEQ ID NO: 3551736 - DNA, 19 bp, Homo sapiens
cttaagcagcatggaaaaa

SEQ ID NO: 3551737 - DNA, 18 bp, Homo sapiens
cttaagcatctggctcta

SEQ ID NO: 3551738 - DNA, 15 bp, Homo sapiens
cttaaggccctcatt

SEQ ID NO: 3551739 - DNA, 14 bp, Homo sapiens
cttaatagcaacag

SEQ ID NO: 3551740 - DNA, 17 bp, Homo sapiens
cttaatccattaaaaag

SEQ ID NO: 3551741 - DNA, 14 bp, Homo sapiens
cttaatgtatgtta

SEQ ID NO: 3551742 - DNA, 13 bp, Homo sapiens
cttaatgtctggt

SEQ ID NO: 3551743 - DNA, 16 bp, Homo sapiens
cttaatgtctggtgtt

SEQ ID NO: 3551744 - DNA, 17 bp, Homo sapiens
cttaattaaaagaatat

SEQ ID NO: 3551745 - DNA, 17 bp, Homo sapiens
cttaatttaaatagcat

SEQ ID NO: 3551746 - DNA, 22 bp, Homo sapiens
cttacaaagggaaagcctctgg

SEQ ID NO: 3551747 - DNA, 23 bp, Homo sapiens
cttacaaagggaaagcctctggc

SEQ ID NO: 3551748 - DNA, 18 bp, Homo sapiens
cttacaagcctaagaatc

SEQ ID NO: 3551749 - DNA, 14 bp, Homo sapiens
cttacacttataaa

SEQ ID NO: 3551750 - DNA, 15 bp, Homo sapiens
cttacacttataaaa

SEQ ID NO: 3551751 - DNA, 12 bp, Homo sapiens
cttacaggagcc

SEQ ID NO: 3551752 - DNA, 16 bp, Homo sapiens
cttacaggagccagcc

SEQ ID NO: 3551753 - DNA, 19 bp, Homo sapiens
cttacaggagccagcctgc

SEQ ID NO: 3551754 - DNA, 20 bp, Homo sapiens
cttacattagcagtttgctt

SEQ ID NO: 3551755 - DNA, 22 bp, Homo sapiens
cttacattagcagtttgctttg

SEQ ID NO: 3551756 - DNA, 12 bp, Homo sapiens
cttacatttcac

SEQ ID NO: 3551757 - DNA, 20 bp, Homo sapiens
cttacattttactttttcct

SEQ ID NO: 3551758 - DNA, 15 bp, Homo sapiens
cttaccagtctcctc

SEQ ID NO: 3551759 - DNA, 17 bp, Homo sapiens
cttaccagtctcctccc

SEQ ID NO: 3551760 - DNA, 14 bp, Homo sapiens
cttaccctcctctg

SEQ ID NO: 3551761 - DNA, 16 bp, Homo sapiens
cttaccctcctctgct

SEQ ID NO: 3551762 - DNA, 18 bp, Homo sapiens
cttaccctcctctgctgg

SEQ ID NO: 3551763 - DNA, 20 bp, Homo sapiens
cttaccctcctctgctggga

SEQ ID NO: 3551764 - DNA, 13 bp, Homo sapiens
cttacctgggcac

SEQ ID NO: 3551765 - DNA, 20 bp, Homo sapiens
cttacctgtatgtctccagt

SEQ ID NO: 3551766 - DNA, 13 bp, Homo sapiens
cttactaaaaagt

SEQ ID NO: 3551767 - DNA, 15 bp, Homo sapiens
cttactaaaaagtat

SEQ ID NO: 3551768 - DNA, 17 bp, Homo sapiens
cttactaaaaagtataa

SEQ ID NO: 3551769 - DNA, 15 bp, Homo sapiens
cttactaatgtaaaa

SEQ ID NO: 3551770 - DNA, 21 bp, Homo sapiens
cttactcccccaccactcagg

SEQ ID NO: 3551771 - DNA, 17 bp, Homo sapiens
cttactgcgactaaact

SEQ ID NO: 3551772 - DNA, 21 bp, Homo sapiens
cttacttcaaagtgcctgggc

SEQ ID NO: 3551773 - DNA, 23 bp, Homo sapiens
cttacttcaaagtgcctgggctc

SEQ ID NO: 3551774 - DNA, 21 bp, Homo sapiens
cttactttaattactggaatt

SEQ ID NO: 3551775 - DNA, 17 bp, Homo sapiens
cttagaaattgcatttc

SEQ ID NO: 3551776 - DNA, 14 bp, Homo sapiens
cttagagctcttgt

SEQ ID NO: 3551777 - DNA, 14 bp, Homo sapiens
cttagagtgtagct

SEQ ID NO: 3551778 - DNA, 18 bp, Homo sapiens
cttagagtgtagctgtaa

SEQ ID NO: 3551779 - DNA, 18 bp, Homo sapiens
cttagagtttctgtttga

SEQ ID NO: 3551780 - DNA, 17 bp, Homo sapiens
cttagccctcaccacag

SEQ ID NO: 3551781 - DNA, 17 bp, Homo sapiens
cttagctgtctgctcag

SEQ ID NO: 3551782 - DNA, 22 bp, Homo sapiens
cttaggagacagatcactcctg

SEQ ID NO: 3551783 - DNA, 18 bp, Homo sapiens
cttagggacaggacccca

SEQ ID NO: 3551784 - DNA, 20 bp, Homo sapiens
cttaggtggctctgggaatg

SEQ ID NO: 3551785 - DNA, 21 bp, Homo sapiens
cttagtgttcaaaacaaaatg

SEQ ID NO: 3551786 - DNA, 16 bp, Homo sapiens
cttataaaccaatctt

SEQ ID NO: 3551787 - DNA, 18 bp, Homo sapiens
cttataaagtggaagtat

SEQ ID NO: 3551788 - DNA, 24 bp, Homo sapiens
cttataaagtggaagtatgtatat

SEQ ID NO: 3551789 - DNA, 16 bp, Homo sapiens
cttataataaaggact

SEQ ID NO: 3551790 - DNA, 15 bp, Homo sapiens
cttatacatttgata

SEQ ID NO: 3551791 - DNA, 21 bp, Homo sapiens
cttatactgtaggtgttatgt

SEQ ID NO: 3551792 - DNA, 16 bp, Homo sapiens
cttataggcctgtccc

SEQ ID NO: 3551793 - DNA, 17 bp, Homo sapiens
cttataggcctgtccct

SEQ ID NO: 3551794 - DNA, 17 bp, Homo sapiens
cttatagtacatgataa

SEQ ID NO: 3551795 - DNA, 19 bp, Homo sapiens
cttatagtacatgataaat

SEQ ID NO: 3551796 - DNA, 20 bp, Homo sapiens
cttatagtacctcactgcac

SEQ ID NO: 3551797 - DNA, 15 bp, Homo sapiens
cttatagttactgtg

SEQ ID NO: 3551798 - DNA, 18 bp, Homo sapiens
cttatagttactgtgtaa

SEQ ID NO: 3551799 - DNA, 20 bp, Homo sapiens
cttatcacccccttgttgta

SEQ ID NO: 3551800 - DNA, 21 bp, Homo sapiens
cttatcacccccttgttgtaa

SEQ ID NO: 3551801 - DNA, 14 bp, Homo sapiens
cttatccctctctt

SEQ ID NO: 3551802 - DNA, 13 bp, Homo sapiens
cttatctccaaga

SEQ ID NO: 3551803 - DNA, 14 bp, Homo sapiens
cttatctccaagac

SEQ ID NO: 3551804 - DNA, 14 bp, Homo sapiens
cttatctctttcca

SEQ ID NO: 3551805 - DNA, 15 bp, Homo sapiens
cttatctctttccac

SEQ ID NO: 3551806 - DNA, 22 bp, Homo sapiens
cttatctctttccaccatacct

SEQ ID NO: 3551807 - DNA, 24 bp, Homo sapiens
cttatctgaaaggccagcagctga

SEQ ID NO: 3551808 - DNA, 15 bp, Homo sapiens
cttatgaatatattt

SEQ ID NO: 3551809 - DNA, 21 bp, Homo sapiens
cttcaacagccaagctggcac

SEQ ID NO: 3551810 - DNA, 22 bp, Homo sapiens
cttcaacagccaagctggcaca

SEQ ID NO: 3551811 - DNA, 16 bp, Homo sapiens
cttcaaccattcccca

SEQ ID NO: 3551812 - DNA, 20 bp, Homo sapiens
cttcaaccattccccatggg

SEQ ID NO: 3551813 - DNA, 15 bp, Homo sapiens
cttcaacccagtggg

SEQ ID NO: 3551814 - DNA, 23 bp, Homo sapiens
cttcaactgaccagcctccatgc

SEQ ID NO: 3551815 - DNA, 23 bp, Homo sapiens
cttcaagctgttatttcttccct

SEQ ID NO: 3551816 - DNA, 18 bp, Homo sapiens
cttcaagggtcagggtga

SEQ ID NO: 3551817 - DNA, 17 bp, Homo sapiens
cttcacaaagcccaagg

SEQ ID NO: 3551818 - DNA, 18 bp, Homo sapiens
cttcaccccaatcccagc

SEQ ID NO: 3551819 - DNA, 17 bp, Homo sapiens
cttcacgcccttggcca

SEQ ID NO: 3551820 - DNA, 13 bp, Homo sapiens
cttcactctggct

SEQ ID NO: 3551821 - DNA, 16 bp, Homo sapiens
cttcactctggcttca

SEQ ID NO: 3551822 - DNA, 21 bp, Homo sapiens
cttcactctggcttcaaaaag

SEQ ID NO: 3551823 - DNA, 17 bp, Homo sapiens
cttcactgtcctccaag

SEQ ID NO: 3551824 - DNA, 18 bp, Homo sapiens
cttcactgtcctccaagc

SEQ ID NO: 3551825 - DNA, 21 bp, Homo sapiens
cttcactgtcctccaagccag

SEQ ID NO: 3551826 - DNA, 15 bp, Homo sapiens
cttcactttcctcag

SEQ ID NO: 3551827 - DNA, 16 bp, Homo sapiens
cttcactttcctcagt

SEQ ID NO: 3551828 - DNA, 18 bp, Homo sapiens
cttcactttcttaagcaa

SEQ ID NO: 3551829 - DNA, 18 bp, Homo sapiens
cttcagaactgcccttgc

SEQ ID NO: 3551830 - DNA, 19 bp, Homo sapiens
cttcagaactgcccttgct

SEQ ID NO: 3551831 - DNA, 20 bp, Homo sapiens
cttcagcaaccctacagtat

SEQ ID NO: 3551832 - DNA, 18 bp, Homo sapiens
cttcagccaggtctgact

SEQ ID NO: 3551833 - DNA, 21 bp, Homo sapiens
cttcagccaggtctgactcca

SEQ ID NO: 3551834 - DNA, 16 bp, Homo sapiens
cttcaggagcctggcc

SEQ ID NO: 3551835 - DNA, 20 bp, Homo sapiens
cttcaggagcctggccaggc

SEQ ID NO: 3551836 - DNA, 22 bp, Homo sapiens
cttcaggagcctggccaggcag

SEQ ID NO: 3551837 - DNA, 16 bp, Homo sapiens
cttcaggctcttctcc

SEQ ID NO: 3551838 - DNA, 19 bp, Homo sapiens
cttcaggctcttctccttt

SEQ ID NO: 3551839 - DNA, 22 bp, Homo sapiens
cttcaggctcttctcctttcac

SEQ ID NO: 3551840 - DNA, 19 bp, Homo sapiens
cttcaggtcaggtggctgt

SEQ ID NO: 3551841 - DNA, 12 bp, Homo sapiens
cttcagtccttt

SEQ ID NO: 3551842 - DNA, 21 bp, Homo sapiens
cttcagtgaatatttttgtat

SEQ ID NO: 3551843 - DNA, 15 bp, Homo sapiens
cttcagtgactcctg

SEQ ID NO: 3551844 - DNA, 18 bp, Homo sapiens
cttcagtgactcctgctg

SEQ ID NO: 3551845 - DNA, 15 bp, Homo sapiens
cttcagtgagcccct

SEQ ID NO: 3551846 - DNA, 18 bp, Homo sapiens
cttcagtgagcccctccc

SEQ ID NO: 3551847 - DNA, 17 bp, Homo sapiens
cttcagtgtatggaaat

SEQ ID NO: 3551848 - DNA, 20 bp, Homo sapiens
cttcagtgtatggaaataaa

SEQ ID NO: 3551849 - DNA, 19 bp, Homo sapiens
cttcagttcagctttaaag

SEQ ID NO: 3551850 - DNA, 19 bp, Homo sapiens
cttcatcagaactcttcct

SEQ ID NO: 3551851 - DNA, 16 bp, Homo sapiens
cttcatccaatgtgaa

SEQ ID NO: 3551852 - DNA, 19 bp, Homo sapiens
cttcatccatcctgagcca

SEQ ID NO: 3551853 - DNA, 15 bp, Homo sapiens
cttcatgtccagtga

SEQ ID NO: 3551854 - DNA, 23 bp, Homo sapiens
cttcatgtccagtgagcagtgtt

SEQ ID NO: 3551855 - DNA, 15 bp, Homo sapiens
cttcatgtttggaaa

SEQ ID NO: 3551856 - DNA, 14 bp, Homo sapiens
cttcattctcgtga

SEQ ID NO: 3551857 - DNA, 15 bp, Homo sapiens
cttcattctttactg

SEQ ID NO: 3551858 - DNA, 17 bp, Homo sapiens
cttcattctttactgca

SEQ ID NO: 3551859 - DNA, 20 bp, Homo sapiens
cttcattctttactgcactc

SEQ ID NO: 3551860 - DNA, 21 bp, Homo sapiens
cttcattctttactgcactca

SEQ ID NO: 3551861 - DNA, 13 bp, Homo sapiens
cttcatttggaga

SEQ ID NO: 3551862 - DNA, 13 bp, Homo sapiens
cttcatttttccc

SEQ ID NO: 3551863 - DNA, 15 bp, Homo sapiens
cttccacccacaaac

SEQ ID NO: 3551864 - DNA, 16 bp, Homo sapiens
cttccacccacaaact

SEQ ID NO: 3551865 - DNA, 17 bp, Homo sapiens
cttccacccacaaactc

SEQ ID NO: 3551866 - DNA, 21 bp, Homo sapiens
cttccacccacaaactccagg

SEQ ID NO: 3551867 - DNA, 22 bp, Homo sapiens
cttccacccacaaactccaggc

SEQ ID NO: 3551868 - DNA, 14 bp, Homo sapiens
cttccacccagtgc

SEQ ID NO: 3551869 - DNA, 23 bp, Homo sapiens
cttccacctcacctctttgttct

SEQ ID NO: 3551870 - DNA, 20 bp, Homo sapiens
cttccactgaggtgggagca

SEQ ID NO: 3551871 - DNA, 16 bp, Homo sapiens
cttccacttgagtgtc

SEQ ID NO: 3551872 - DNA, 20 bp, Homo sapiens
cttccaggaaagtgtgaaga

SEQ ID NO: 3551873 - DNA, 22 bp, Homo sapiens
cttccagtggctggtttctgag

SEQ ID NO: 3551874 - DNA, 21 bp, Homo sapiens
cttccatgatgcacagtatct

SEQ ID NO: 3551875 - DNA, 16 bp, Homo sapiens
cttccatgtcgcctct

SEQ ID NO: 3551876 - DNA, 18 bp, Homo sapiens
cttccatgtcgcctctgc

SEQ ID NO: 3551877 - DNA, 17 bp, Homo sapiens
cttccattccttcatgt

SEQ ID NO: 3551878 - DNA, 12 bp, Homo sapiens
cttcccacagga

SEQ ID NO: 3551879 - DNA, 14 bp, Homo sapiens
cttcccacaggagg

SEQ ID NO: 3551880 - DNA, 22 bp, Homo sapiens
cttcccacaggagggccagcgc

SEQ ID NO: 3551881 - DNA, 13 bp, Homo sapiens
cttcccactccag

SEQ ID NO: 3551882 - DNA, 17 bp, Homo sapiens
cttcccactccagctga

SEQ ID NO: 3551883 - DNA, 20 bp, Homo sapiens
cttcccatggccatttctgt

SEQ ID NO: 3551884 - DNA, 12 bp, Homo sapiens
cttcccatttct

SEQ ID NO: 3551885 - DNA, 16 bp, Homo sapiens
cttcccatttcttccc

SEQ ID NO: 3551886 - DNA, 19 bp, Homo sapiens
cttcccatttcttcccact

SEQ ID NO: 3551887 - DNA, 20 bp, Homo sapiens
cttcccatttcttcccactt

SEQ ID NO: 3551888 - DNA, 15 bp, Homo sapiens
cttccccctccaatc

SEQ ID NO: 3551889 - DNA, 13 bp, Homo sapiens
cttccccttccct

SEQ ID NO: 3551890 - DNA, 15 bp, Homo sapiens
cttccccttccctta

SEQ ID NO: 3551891 - DNA, 17 bp, Homo sapiens
cttccccttcctgtttc

SEQ ID NO: 3551892 - DNA, 23 bp, Homo sapiens
cttcccgctcagccctccctgcc

SEQ ID NO: 3551893 - DNA, 15 bp, Homo sapiens
cttccctaaactgca

SEQ ID NO: 3551894 - DNA, 17 bp, Homo sapiens
cttccctccgccttctc

SEQ ID NO: 3551895 - DNA, 21 bp, Homo sapiens
cttccctgctttgcatctttg

SEQ ID NO: 3551896 - DNA, 13 bp, Homo sapiens
cttccctggaagc

SEQ ID NO: 3551897 - DNA, 18 bp, Homo sapiens
cttccctgggagggaggt

SEQ ID NO: 3551898 - DNA, 21 bp, Homo sapiens
cttccctgggtttgggagcca

SEQ ID NO: 3551899 - DNA, 22 bp, Homo sapiens
cttccctgggtttgggagccag

SEQ ID NO: 3551900 - DNA, 23 bp, Homo sapiens
cttccctgggtttgggagccagg

SEQ ID NO: 3551901 - DNA, 12 bp, Homo sapiens
cttccgctgagg

SEQ ID NO: 3551902 - DNA, 21 bp, Homo sapiens
cttccgctgaggggtctcgga

SEQ ID NO: 3551903 - DNA, 23 bp, Homo sapiens
cttccgctttgaaagaagcaaga

SEQ ID NO: 3551904 - DNA, 23 bp, Homo sapiens
cttcctaccacccggtccccact

SEQ ID NO: 3551905 - DNA, 22 bp, Homo sapiens
cttcctagttttctcctcccag

SEQ ID NO: 3551906 - DNA, 23 bp, Homo sapiens
cttcctagttttctcctcccagg

SEQ ID NO: 3551907 - DNA, 14 bp, Homo sapiens
cttcctcacacccc

SEQ ID NO: 3551908 - DNA, 15 bp, Homo sapiens
cttcctcacacccct

SEQ ID NO: 3551909 - DNA, 18 bp, Homo sapiens
cttcctcagctgcctcct

SEQ ID NO: 3551910 - DNA, 15 bp, Homo sapiens
cttcctccacttcat

SEQ ID NO: 3551911 - DNA, 15 bp, Homo sapiens
cttcctcgtgggtcc

SEQ ID NO: 3551912 - DNA, 19 bp, Homo sapiens
cttcctcgtgggtcccaga

SEQ ID NO: 3551913 - DNA, 13 bp, Homo sapiens
cttcctctcaggc

SEQ ID NO: 3551914 - DNA, 14 bp, Homo sapiens
cttcctctccactg

SEQ ID NO: 3551915 - DNA, 11 bp, Homo sapiens
cttcctctgct

SEQ ID NO: 3551916 - DNA, 12 bp, Homo sapiens
cttcctctgctg

SEQ ID NO: 3551917 - DNA, 14 bp, Homo sapiens
cttcctctggctcc

SEQ ID NO: 3551918 - DNA, 23 bp, Homo sapiens
agcccatttgggcagagaggctg

SEQ ID NO: 3551919 - DNA, 19 bp, Homo sapiens
agccccaactccaggggca

SEQ ID NO: 3551920 - DNA, 21 bp, Homo sapiens
agccccaactccaggggcacc

SEQ ID NO: 3551921 - DNA, 13 bp, Homo sapiens
agccccagccagg

SEQ ID NO: 3551922 - DNA, 15 bp, Homo sapiens
agccccagggcctgc

SEQ ID NO: 3551923 - DNA, 23 bp, Homo sapiens
agccccagggtttacatgaagca

SEQ ID NO: 3551924 - DNA, 13 bp, Homo sapiens
agcccccagccct

SEQ ID NO: 3551925 - DNA, 22 bp, Homo sapiens
agcccccagccctgggaaccac

SEQ ID NO: 3551926 - DNA, 18 bp, Homo sapiens
agcccccagggcctccag

SEQ ID NO: 3551927 - DNA, 18 bp, Homo sapiens
agccccccttgccccacc

SEQ ID NO: 3551928 - DNA, 15 bp, Homo sapiens
agcccctcacactgc

SEQ ID NO: 3551929 - DNA, 11 bp, Homo sapiens
agcccctgggg

SEQ ID NO: 3551930 - DNA, 15 bp, Homo sapiens
agcccgacagtgcca

SEQ ID NO: 3551931 - DNA, 17 bp, Homo sapiens
agcccgacagtgccatc

SEQ ID NO: 3551932 - DNA, 15 bp, Homo sapiens
agcccgcgtctgtgc

SEQ ID NO: 3551933 - DNA, 22 bp, Homo sapiens
agccctaagtggctgccttctt

SEQ ID NO: 3551934 - DNA, 17 bp, Homo sapiens
agccctagactggtgct

SEQ ID NO: 3551935 - DNA, 18 bp, Homo sapiens
agccctagccctgctcca

SEQ ID NO: 3551936 - DNA, 15 bp, Homo sapiens
agccctattgctgct

SEQ ID NO: 3551937 - DNA, 16 bp, Homo sapiens
agccctattgctgcta

SEQ ID NO: 3551938 - DNA, 13 bp, Homo sapiens
agccctccctgcc

SEQ ID NO: 3551939 - DNA, 15 bp, Homo sapiens
agccctccctgcccc

SEQ ID NO: 3551940 - DNA, 17 bp, Homo sapiens
agccctcctctgcactc

SEQ ID NO: 3551941 - DNA, 16 bp, Homo sapiens
agccctgaatttcttc

SEQ ID NO: 3551942 - DNA, 17 bp, Homo sapiens
agccctgaatttcttct

SEQ ID NO: 3551943 - DNA, 18 bp, Homo sapiens
agccctgaatttcttctt

SEQ ID NO: 3551944 - DNA, 12 bp, Homo sapiens
agccctgcacca

SEQ ID NO: 3551945 - DNA, 20 bp, Homo sapiens
agccctgcaccatgctgctg

SEQ ID NO: 3551946 - DNA, 23 bp, Homo sapiens
agccctgctttgggctgccctgg

SEQ ID NO: 3551947 - DNA, 17 bp, Homo sapiens
agccctggagagcccca

SEQ ID NO: 3551948 - DNA, 18 bp, Homo sapiens
agccctggagagccccat

SEQ ID NO: 3551949 - DNA, 18 bp, Homo sapiens
agccctggcctggctggg

SEQ ID NO: 3551950 - DNA, 22 bp, Homo sapiens
agccctgggggattcctgagct

SEQ ID NO: 3551951 - DNA, 13 bp, Homo sapiens
agcccttcatttg

SEQ ID NO: 3551952 - DNA, 22 bp, Homo sapiens
agcccttctatacccacccaga

SEQ ID NO: 3551953 - DNA, 18 bp, Homo sapiens
agcccttggaacaccctg

SEQ ID NO: 3551954 - DNA, 19 bp, Homo sapiens
agcccttggaacaccctgg

SEQ ID NO: 3551955 - DNA, 17 bp, Homo sapiens
agccgactctttgatat

SEQ ID NO: 3551956 - DNA, 19 bp, Homo sapiens
agccgagattgcgccattg

SEQ ID NO: 3551957 - DNA, 13 bp, Homo sapiens
agccgcagacctg

SEQ ID NO: 3551958 - DNA, 19 bp, Homo sapiens
agccgcagacctggagctt

SEQ ID NO: 3551959 - DNA, 13 bp, Homo sapiens
agccgcagagaaa

SEQ ID NO: 3551960 - DNA, 14 bp, Homo sapiens
agccgcagagaaat

SEQ ID NO: 3551961 - DNA, 15 bp, Homo sapiens
agccgccagctggga

SEQ ID NO: 3551962 - DNA, 19 bp, Homo sapiens
agccggggtgtaacttcct

SEQ ID NO: 3551963 - DNA, 22 bp, Homo sapiens
agccggggtgtaacttcctgct

SEQ ID NO: 3551964 - DNA, 20 bp, Homo sapiens
agccggtaactgtcctgtcc

SEQ ID NO: 3551965 - DNA, 21 bp, Homo sapiens
agccggtaactgtcctgtcct

SEQ ID NO: 3551966 - DNA, 14 bp, Homo sapiens
agccgtggcttccc

SEQ ID NO: 3551967 - DNA, 14 bp, Homo sapiens
agcctaaagggcag

SEQ ID NO: 3551968 - DNA, 16 bp, Homo sapiens
agcctaaagggcaggg

SEQ ID NO: 3551969 - DNA, 17 bp, Homo sapiens
agcctaaagggcagggc

SEQ ID NO: 3551970 - DNA, 14 bp, Homo sapiens
agcctaagaagaag

SEQ ID NO: 3551971 - DNA, 17 bp, Homo sapiens
agcctaagaagaaggcc

SEQ ID NO: 3551972 - DNA, 16 bp, Homo sapiens
agcctaccatgtgaaa

SEQ ID NO: 3551973 - DNA, 19 bp, Homo sapiens
agcctacctctgtctgaga

SEQ ID NO: 3551974 - DNA, 17 bp, Homo sapiens
agcctagctcctgccac

SEQ ID NO: 3551975 - DNA, 18 bp, Homo sapiens
agcctcaaaacaaaggcc

SEQ ID NO: 3551976 - DNA, 20 bp, Homo sapiens
agcctcaaaacaaaggccta

SEQ ID NO: 3551977 - DNA, 22 bp, Homo sapiens
agcctcaaaacgggtcagtatt

SEQ ID NO: 3551978 - DNA, 15 bp, Homo sapiens
agcctcaacctcctg

SEQ ID NO: 3551979 - DNA, 19 bp, Homo sapiens
agcctcaacctcctgggtt

SEQ ID NO: 3551980 - DNA, 16 bp, Homo sapiens
agcctcacactggcgt

SEQ ID NO: 3551981 - DNA, 15 bp, Homo sapiens
agcctcagaaggccc

SEQ ID NO: 3551982 - DNA, 23 bp, Homo sapiens
ttacatccttgattacttccact

SEQ ID NO: 3551983 - DNA, 12 bp, Homo sapiens
ttacatgtttcc

SEQ ID NO: 3551984 - DNA, 14 bp, Homo sapiens
ttacatgttttttc

SEQ ID NO: 3551985 - DNA, 22 bp, Homo sapiens
ttacatgttttttcatttgtaa

SEQ ID NO: 3551986 - DNA, 23 bp, Homo sapiens
ttacatttcacctactaatgtct

SEQ ID NO: 3551987 - DNA, 18 bp, Homo sapiens
ttaccagtgccttaaact

SEQ ID NO: 3551988 - DNA, 23 bp, Homo sapiens
ttaccagtggcgttgttgcatgt

SEQ ID NO: 3551989 - DNA, 16 bp, Homo sapiens
ttaccatcatctctga

SEQ ID NO: 3551990 - DNA, 20 bp, Homo sapiens
ttaccattttaacgctgcct

SEQ ID NO: 3551991 - DNA, 16 bp, Homo sapiens
ttacccacacacagat

SEQ ID NO: 3551992 - DNA, 13 bp, Homo sapiens
ttaccctacagac

SEQ ID NO: 3551993 - DNA, 17 bp, Homo sapiens
ttaccctcctctgctgg

SEQ ID NO: 3551994 - DNA, 18 bp, Homo sapiens
ttaccctcctctgctggg

SEQ ID NO: 3551995 - DNA, 19 bp, Homo sapiens
ttaccctgaggtcactgct

SEQ ID NO: 3551996 - DNA, 14 bp, Homo sapiens
ttacctattctgaa

SEQ ID NO: 3551997 - DNA, 19 bp, Homo sapiens
ttaccttctttctaataca

SEQ ID NO: 3551998 - DNA, 15 bp, Homo sapiens
ttaccttgaaatgct

SEQ ID NO: 3551999 - DNA, 22 bp, Homo sapiens
ttacgtagctatttttatacac

SEQ ID NO: 3552000 - DNA, 18 bp, Homo sapiens
ttacgtgaagaaataaat

SEQ ID NO: 3552001 - DNA, 21 bp, Homo sapiens
ttacgtgaagaaataaatgaa

SEQ ID NO: 3552002 - DNA, 20 bp, Homo sapiens
ttacgtgtaaaggaaaataa

SEQ ID NO: 3552003 - DNA, 20 bp, Homo sapiens
ttactcccccaccactcagg

SEQ ID NO: 3552004 - DNA, 23 bp, Homo sapiens
ttactcccccaccactcaggcca

SEQ ID NO: 3552005 - DNA, 12 bp, Homo sapiens
ttactcctccat

SEQ ID NO: 3552006 - DNA, 11 bp, Homo sapiens
ttactcctggc

SEQ ID NO: 3552007 - DNA, 16 bp, Homo sapiens
ttactgaagcctttct

SEQ ID NO: 3552008 - DNA, 18 bp, Homo sapiens
ttactggaattcttctgc

SEQ ID NO: 3552009 - DNA, 16 bp, Homo sapiens
ttactggcctttttca

SEQ ID NO: 3552010 - DNA, 16 bp, Homo sapiens
ttactggcttctcttg

SEQ ID NO: 3552011 - DNA, 15 bp, Homo sapiens
ttactgtcttgaatt

SEQ ID NO: 3552012 - DNA, 23 bp, Homo sapiens
ttactgttcatttgatttgtaca

SEQ ID NO: 3552013 - DNA, 23 bp, Homo sapiens
ttacttatgtagaaactgaggcc

SEQ ID NO: 3552014 - DNA, 11 bp, Homo sapiens
ttacttctctt

SEQ ID NO: 3552015 - DNA, 18 bp, Homo sapiens
ttacttgcctatctgact

SEQ ID NO: 3552016 - DNA, 15 bp, Homo sapiens
ttactttaaattata

SEQ ID NO: 3552017 - DNA, 19 bp, Homo sapiens
ttactttaattactggaat

SEQ ID NO: 3552018 - DNA, 11 bp, Homo sapiens
ttactttcagc

SEQ ID NO: 3552019 - DNA, 21 bp, Homo sapiens
ttagaaaatgacttatttctg

SEQ ID NO: 3552020 - DNA, 16 bp, Homo sapiens
ttagaaatgcagaatc

SEQ ID NO: 3552021 - DNA, 13 bp, Homo sapiens
ttagaaatgtgaa

SEQ ID NO: 3552022 - DNA, 17 bp, Homo sapiens
ttagaaattgcatttcc

SEQ ID NO: 3552023 - DNA, 18 bp, Homo sapiens
ttagaaccgtaggttttt

SEQ ID NO: 3552024 - DNA, 14 bp, Homo sapiens
ttagaagaagtgtg

SEQ ID NO: 3552025 - DNA, 13 bp, Homo sapiens
ttagaataaattc

SEQ ID NO: 3552026 - DNA, 16 bp, Homo sapiens
ttagaataaattccca

SEQ ID NO: 3552027 - DNA, 13 bp, Homo sapiens
ttagaatgtcaat

SEQ ID NO: 3552028 - DNA, 22 bp, Homo sapiens
ttagactgttgggacagccatt

SEQ ID NO: 3552029 - DNA, 18 bp, Homo sapiens
ttagagaaaaccttaaaa

SEQ ID NO: 3552030 - DNA, 20 bp, Homo sapiens
ttagagaaaaccttaaaagt

SEQ ID NO: 3552031 - DNA, 22 bp, Homo sapiens
ttagagaagctacccctcaaac

SEQ ID NO: 3552032 - DNA, 15 bp, Homo sapiens
ttagagataattgct

SEQ ID NO: 3552033 - DNA, 17 bp, Homo sapiens
ttagagataattgcttg

SEQ ID NO: 3552034 - DNA, 22 bp, Homo sapiens
ttagagggtgatggaacaagag

SEQ ID NO: 3552035 - DNA, 22 bp, Homo sapiens
ttagatatttgcctgtctgttt

SEQ ID NO: 3552036 - DNA, 16 bp, Homo sapiens
ttagatgtaattttgt

SEQ ID NO: 3552037 - DNA, 19 bp, Homo sapiens
ttagattaagaaatagaca

SEQ ID NO: 3552038 - DNA, 15 bp, Homo sapiens
ttagcaaggcagagc

SEQ ID NO: 3552039 - DNA, 17 bp, Homo sapiens
ttagcaataaatgcttt

SEQ ID NO: 3552040 - DNA, 19 bp, Homo sapiens
ttagcagtttcctcagtga

SEQ ID NO: 3552041 - DNA, 23 bp, Homo sapiens
ttagcagtttcctcagtgatgga

SEQ ID NO: 3552042 - DNA, 16 bp, Homo sapiens
ttagcagtttgctttg

SEQ ID NO: 3552043 - DNA, 16 bp, Homo sapiens
ttagcattgaaataat

SEQ ID NO: 3552044 - DNA, 21 bp, Homo sapiens
ttagccaactgtttccctgct

SEQ ID NO: 3552045 - DNA, 23 bp, Homo sapiens
ttagctactttggcattgctgca

SEQ ID NO: 3552046 - DNA, 15 bp, Homo sapiens
ttagctgtctgctca

SEQ ID NO: 3552047 - DNA, 19 bp, Homo sapiens
ttaggcaaagataatttat

SEQ ID NO: 3552048 - DNA, 15 bp, Homo sapiens
ttaggctgttggttc

SEQ ID NO: 3552049 - DNA, 21 bp, Homo sapiens
ttagggacaggaccccagctc

SEQ ID NO: 3552050 - DNA, 14 bp, Homo sapiens
ttagggagagaaga

SEQ ID NO: 3552051 - DNA, 19 bp, Homo sapiens
ttagtactttgtgctcata

SEQ ID NO: 3552052 - DNA, 20 bp, Homo sapiens
ttagtatttcagtgttttca

SEQ ID NO: 3552053 - DNA, 22 bp, Homo sapiens
ttagtatttcagtgttttcatt

SEQ ID NO: 3552054 - DNA, 16 bp, Homo sapiens
ttagtctcaggttcaa

SEQ ID NO: 3552055 - DNA, 18 bp, Homo sapiens
ttagtctgaaactggctt

SEQ ID NO: 3552056 - DNA, 19 bp, Homo sapiens
ttagtctgaaactggcttc

SEQ ID NO: 3552057 - DNA, 13 bp, Homo sapiens
ttagttaatggat

SEQ ID NO: 3552058 - DNA, 16 bp, Homo sapiens
ttagttaccttatagt

SEQ ID NO: 3552059 - DNA, 18 bp, Homo sapiens
ttagttaccttatagtta

SEQ ID NO: 3552060 - DNA, 21 bp, Homo sapiens
ttagttaccttatagttactg

SEQ ID NO: 3552061 - DNA, 15 bp, Homo sapiens
ttagttccactgaga

SEQ ID NO: 3552062 - DNA, 19 bp, Homo sapiens
ttagttctttttgccagtt

SEQ ID NO: 3552063 - DNA, 14 bp, Homo sapiens
ttataaaccaatct

SEQ ID NO: 3552064 - DNA, 23 bp, Homo sapiens
ttataaagaccgtacaaactcag

SEQ ID NO: 3552065 - DNA, 11 bp, Homo sapiens
ttataaataaa

SEQ ID NO: 3552066 - DNA, 19 bp, Homo sapiens
ttataactaacatgtcctg

SEQ ID NO: 3552067 - DNA, 15 bp, Homo sapiens
ttataagttctattt

SEQ ID NO: 3552068 - DNA, 17 bp, Homo sapiens
ttataagttgaccttta

SEQ ID NO: 3552069 - DNA, 15 bp, Homo sapiens
ttataatgaatgaaa

SEQ ID NO: 3552070 - DNA, 14 bp, Homo sapiens
ttataatgtatttg

SEQ ID NO: 3552071 - DNA, 15 bp, Homo sapiens
ttatacaccagcaat

SEQ ID NO: 3552072 - DNA, 14 bp, Homo sapiens
ttatacactgtaag

SEQ ID NO: 3552073 - DNA, 16 bp, Homo sapiens
ttatacctgctatcag

SEQ ID NO: 3552074 - DNA, 13 bp, Homo sapiens
agccttttgctct

SEQ ID NO: 3552075 - DNA, 14 bp, Homo sapiens
agccttttgctctc

SEQ ID NO: 3552076 - DNA, 16 bp, Homo sapiens
agccttttgctctctg

SEQ ID NO: 3552077 - DNA, 18 bp, Homo sapiens
agcctttttacctggcct

SEQ ID NO: 3552078 - DNA, 16 bp, Homo sapiens
agcgaacagccttaga

SEQ ID NO: 3552079 - DNA, 17 bp, Homo sapiens
agcgacacttgaatgta

SEQ ID NO: 3552080 - DNA, 14 bp, Homo sapiens
agcgaccccaggac

SEQ ID NO: 3552081 - DNA, 21 bp, Homo sapiens
agcgcaggcagcgcagggctg

SEQ ID NO: 3552082 - DNA, 12 bp, Homo sapiens
agcgcagggctg

SEQ ID NO: 3552083 - DNA, 13 bp, Homo sapiens
agcgcagggctgg

SEQ ID NO: 3552084 - DNA, 17 bp, Homo sapiens
agcgcagggctggcacg

SEQ ID NO: 3552085 - DNA, 18 bp, Homo sapiens
agcgcagggctggcacgt

SEQ ID NO: 3552086 - DNA, 14 bp, Homo sapiens
agcgcatgtgtgca

SEQ ID NO: 3552087 - DNA, 12 bp, Homo sapiens
agcgccctgcag

SEQ ID NO: 3552088 - DNA, 14 bp, Homo sapiens
agcgccctgcaggg

SEQ ID NO: 3552089 - DNA, 18 bp, Homo sapiens
agcggagcccagcctggg

SEQ ID NO: 3552090 - DNA, 14 bp, Homo sapiens
agcggcaccctggt

SEQ ID NO: 3552091 - DNA, 17 bp, Homo sapiens
agcggcaccctggtctg

SEQ ID NO: 3552092 - DNA, 18 bp, Homo sapiens
agcggcaccctggtctgt

SEQ ID NO: 3552093 - DNA, 13 bp, Homo sapiens
agcggctggagaa

SEQ ID NO: 3552094 - DNA, 11 bp, Homo sapiens
agcgggcagcc

SEQ ID NO: 3552095 - DNA, 12 bp, Homo sapiens
agcgggcagccc

SEQ ID NO: 3552096 - DNA, 14 bp, Homo sapiens
agcgggcagccccg

SEQ ID NO: 3552097 - DNA, 22 bp, Homo sapiens
agcgggcggaggggatccagcc

SEQ ID NO: 3552098 - DNA, 16 bp, Homo sapiens
agcgtaaaatggtgaa

SEQ ID NO: 3552099 - DNA, 17 bp, Homo sapiens
agctaagaacctggaac

SEQ ID NO: 3552100 - DNA, 18 bp, Homo sapiens
agctaagctaggaatgaa

SEQ ID NO: 3552101 - DNA, 19 bp, Homo sapiens
agctaattctttgacctgt

SEQ ID NO: 3552102 - DNA, 21 bp, Homo sapiens
agctacacctttctcctttgt

SEQ ID NO: 3552103 - DNA, 15 bp, Homo sapiens
agctacatgttcttt

SEQ ID NO: 3552104 - DNA, 21 bp, Homo sapiens
agctacatgttctttgtacct

SEQ ID NO: 3552105 - DNA, 16 bp, Homo sapiens
agctacccctcaaact

SEQ ID NO: 3552106 - DNA, 19 bp, Homo sapiens
agctacccctcaaactgca

SEQ ID NO: 3552107 - DNA, 23 bp, Homo sapiens
agctacctcaaccaatgccaaaa

SEQ ID NO: 3552108 - DNA, 16 bp, Homo sapiens
agctactcagtggggc

SEQ ID NO: 3552109 - DNA, 17 bp, Homo sapiens
agctagaaaacattttt

SEQ ID NO: 3552110 - DNA, 22 bp, Homo sapiens
agctagaacattccatttgctt

SEQ ID NO: 3552111 - DNA, 16 bp, Homo sapiens
agctaggaaccctgga

SEQ ID NO: 3552112 - DNA, 17 bp, Homo sapiens
agctaggaaccctggag

SEQ ID NO: 3552113 - DNA, 18 bp, Homo sapiens
agctaggaaccctggagg

SEQ ID NO: 3552114 - DNA, 13 bp, Homo sapiens
agctaggaatgaa

SEQ ID NO: 3552115 - DNA, 23 bp, Homo sapiens
agctataaattcctctttgcttt

SEQ ID NO: 3552116 - DNA, 16 bp, Homo sapiens
agctatttcagcctcc

SEQ ID NO: 3552117 - DNA, 16 bp, Homo sapiens
agctatttttatacac

SEQ ID NO: 3552118 - DNA, 17 bp, Homo sapiens
agctatttttatacact

SEQ ID NO: 3552119 - DNA, 23 bp, Homo sapiens
agctcacgtaatgcattgcctgt

SEQ ID NO: 3552120 - DNA, 19 bp, Homo sapiens
agctcagccctggcctggc

SEQ ID NO: 3552121 - DNA, 22 bp, Homo sapiens
agctcagccctggcctggctgg

SEQ ID NO: 3552122 - DNA, 22 bp, Homo sapiens
agctccaacactttgagcattt

SEQ ID NO: 3552123 - DNA, 23 bp, Homo sapiens
agctccatacacacgctgccttc

SEQ ID NO: 3552124 - DNA, 22 bp, Homo sapiens
agctcccctcggagaagagctg

SEQ ID NO: 3552125 - DNA, 18 bp, Homo sapiens
agctccctgcctgtttcc

SEQ ID NO: 3552126 - DNA, 20 bp, Homo sapiens
agctccctgcctgtttcccg

SEQ ID NO: 3552127 - DNA, 15 bp, Homo sapiens
agctccgggatcagc

SEQ ID NO: 3552128 - DNA, 17 bp, Homo sapiens
agctccgtgtttctcta

SEQ ID NO: 3552129 - DNA, 18 bp, Homo sapiens
agctcctctccccagccc

SEQ ID NO: 3552130 - DNA, 19 bp, Homo sapiens
agctcctctccccagccca

SEQ ID NO: 3552131 - DNA, 24 bp, Homo sapiens
agctcctctccccagcccagagac

SEQ ID NO: 3552132 - DNA, 12 bp, Homo sapiens
agctcctgacct

SEQ ID NO: 3552133 - DNA, 17 bp, Homo sapiens
agctcctgaccttgggt

SEQ ID NO: 3552134 - DNA, 21 bp, Homo sapiens
agctcctgccacatggagccc

SEQ ID NO: 3552135 - DNA, 13 bp, Homo sapiens
agctctagcctct

SEQ ID NO: 3552136 - DNA, 16 bp, Homo sapiens
agctctagcctctgga

SEQ ID NO: 3552137 - DNA, 18 bp, Homo sapiens
agctctagcctctggact

SEQ ID NO: 3552138 - DNA, 18 bp, Homo sapiens
agctctattgatactctt

SEQ ID NO: 3552139 - DNA, 14 bp, Homo sapiens
agctctccgagctc

SEQ ID NO: 3552140 - DNA, 18 bp, Homo sapiens
agctctccgagctctggt

SEQ ID NO: 3552141 - DNA, 18 bp, Homo sapiens
agctctccggtctctctc

SEQ ID NO: 3552142 - DNA, 21 bp, Homo sapiens
agctctgacatcccttcctgg

SEQ ID NO: 3552143 - DNA, 22 bp, Homo sapiens
agctctgacatcccttcctgga

SEQ ID NO: 3552144 - DNA, 12 bp, Homo sapiens
agctctggagaa

SEQ ID NO: 3552145 - DNA, 18 bp, Homo sapiens
ttcaggactctctccagg

SEQ ID NO: 3552146 - DNA, 19 bp, Homo sapiens
ttcaggactctctccagga

SEQ ID NO: 3552147 - DNA, 17 bp, Homo sapiens
ttcaggagatggggaat

SEQ ID NO: 3552148 - DNA, 21 bp, Homo sapiens
ttcaggagcctggccaggcag

SEQ ID NO: 3552149 - DNA, 21 bp, Homo sapiens
ttcaggattaactaaagaaga

SEQ ID NO: 3552150 - DNA, 14 bp, Homo sapiens
ttcaggcagctgaa

SEQ ID NO: 3552151 - DNA, 13 bp, Homo sapiens
ttcagggtcatag

SEQ ID NO: 3552152 - DNA, 18 bp, Homo sapiens
ttcaggtcaggtggctgt

SEQ ID NO: 3552153 - DNA, 15 bp, Homo sapiens
ttcaggtctgtatgt

SEQ ID NO: 3552154 - DNA, 16 bp, Homo sapiens
ttcaggtctgtatgtc

SEQ ID NO: 3552155 - DNA, 20 bp, Homo sapiens
ttcagtcctttgtctttctt

SEQ ID NO: 3552156 - DNA, 17 bp, Homo sapiens
ttcagtgactcctgctg

SEQ ID NO: 3552157 - DNA, 16 bp, Homo sapiens
ttcagtgagcccctcc

SEQ ID NO: 3552158 - DNA, 17 bp, Homo sapiens
ttcagtgagcccctccc

SEQ ID NO: 3552159 - DNA, 23 bp, Homo sapiens
ttcagtgcattatctacttgtgt

SEQ ID NO: 3552160 - DNA, 20 bp, Homo sapiens
ttcagttctaggcctttcct

SEQ ID NO: 3552161 - DNA, 21 bp, Homo sapiens
ttcagttctaggcctttcctc

SEQ ID NO: 3552162 - DNA, 23 bp, Homo sapiens
ttcagttctaggcctttcctctg

SEQ ID NO: 3552163 - DNA, 15 bp, Homo sapiens
ttcagttctatttaa

SEQ ID NO: 3552164 - DNA, 20 bp, Homo sapiens
ttcataaattatttgattat

SEQ ID NO: 3552165 - DNA, 14 bp, Homo sapiens
ttcataagatattt

SEQ ID NO: 3552166 - DNA, 15 bp, Homo sapiens
ttcataattctgaaa

SEQ ID NO: 3552167 - DNA, 20 bp, Homo sapiens
ttcatacactaaccaaatct

SEQ ID NO: 3552168 - DNA, 21 bp, Homo sapiens
ttcatatatgaggacttgtgt

SEQ ID NO: 3552169 - DNA, 20 bp, Homo sapiens
ttcatatctatttattaaat

SEQ ID NO: 3552170 - DNA, 15 bp, Homo sapiens
ttcatatttaatttg

SEQ ID NO: 3552171 - DNA, 20 bp, Homo sapiens
ttcatatttaatttgaaggt

SEQ ID NO: 3552172 - DNA, 21 bp, Homo sapiens
ttcatatttacttcttataca

SEQ ID NO: 3552173 - DNA, 17 bp, Homo sapiens
ttcatattttaaacaga

SEQ ID NO: 3552174 - DNA, 22 bp, Homo sapiens
ttcatattttaaacagaggata

SEQ ID NO: 3552175 - DNA, 13 bp, Homo sapiens
ttcatcagaactc

SEQ ID NO: 3552176 - DNA, 19 bp, Homo sapiens
ttcatcagaactcttcctc

SEQ ID NO: 3552177 - DNA, 15 bp, Homo sapiens
ttcatcatttcagcc

SEQ ID NO: 3552178 - DNA, 18 bp, Homo sapiens
ttcatcatttcagccaaa

SEQ ID NO: 3552179 - DNA, 16 bp, Homo sapiens
ttcatctaccttttct

SEQ ID NO: 3552180 - DNA, 20 bp, Homo sapiens
ttcatcttgcagcatttact

SEQ ID NO: 3552181 - DNA, 21 bp, Homo sapiens
ttcatcttgcagcatttacta

SEQ ID NO: 3552182 - DNA, 16 bp, Homo sapiens
ttcatcttttgaagag

SEQ ID NO: 3552183 - DNA, 22 bp, Homo sapiens
ttcatgaaaaagctgcttctta

SEQ ID NO: 3552184 - DNA, 16 bp, Homo sapiens
ttcatgagtttttccc

SEQ ID NO: 3552185 - DNA, 14 bp, Homo sapiens
ttcatgctttatca

SEQ ID NO: 3552186 - DNA, 19 bp, Homo sapiens
ttcatggatatttgtcaac

SEQ ID NO: 3552187 - DNA, 14 bp, Homo sapiens
ttcatggttcaagt

SEQ ID NO: 3552188 - DNA, 15 bp, Homo sapiens
ttcatggttcaagta

SEQ ID NO: 3552189 - DNA, 17 bp, Homo sapiens
ttcatggttcaagtatt

SEQ ID NO: 3552190 - DNA, 16 bp, Homo sapiens
ttcatgttagttacct

SEQ ID NO: 3552191 - DNA, 18 bp, Homo sapiens
ttcatgttagttacctta

SEQ ID NO: 3552192 - DNA, 14 bp, Homo sapiens
ttcattcattcact

SEQ ID NO: 3552193 - DNA, 15 bp, Homo sapiens
ttcattcattggtga

SEQ ID NO: 3552194 - DNA, 18 bp, Homo sapiens
ttcattctaccaagctgt

SEQ ID NO: 3552195 - DNA, 20 bp, Homo sapiens
ttcattctaccaagctgtca

SEQ ID NO: 3552196 - DNA, 21 bp, Homo sapiens
ttcattctaccaagctgtcac

SEQ ID NO: 3552197 - DNA, 15 bp, Homo sapiens
ttcattctgaaccct

SEQ ID NO: 3552198 - DNA, 14 bp, Homo sapiens
ttcattctttactg

SEQ ID NO: 3552199 - DNA, 18 bp, Homo sapiens
ttcatttcagggtcttgg

SEQ ID NO: 3552200 - DNA, 15 bp, Homo sapiens
ttcatttcatttcag

SEQ ID NO: 3552201 - DNA, 15 bp, Homo sapiens
ttcatttctttcctt

SEQ ID NO: 3552202 - DNA, 12 bp, Homo sapiens
ttcatttgcttt

SEQ ID NO: 3552203 - DNA, 16 bp, Homo sapiens
ttcatttgctttggaa

SEQ ID NO: 3552204 - DNA, 22 bp, Homo sapiens
ttccaaaacatttctggacagt

SEQ ID NO: 3552205 - DNA, 18 bp, Homo sapiens
ttccaaaatattgacatt

SEQ ID NO: 3552206 - DNA, 22 bp, Homo sapiens
ttccaaagctttattaccagtg

SEQ ID NO: 3552207 - DNA, 16 bp, Homo sapiens
ttccaaataaataatt

SEQ ID NO: 3552208 - DNA, 12 bp, Homo sapiens
ttccaaatgaac

SEQ ID NO: 3552209 - DNA, 14 bp, Homo sapiens
ttccaacatttctt

SEQ ID NO: 3552210 - DNA, 14 bp, Homo sapiens
ttccaagaggctgt

SEQ ID NO: 3552211 - DNA, 20 bp, Homo sapiens
ttccaagctgtgttaactgt

SEQ ID NO: 3552212 - DNA, 21 bp, Homo sapiens
ttccaattttctggaatacat

SEQ ID NO: 3552213 - DNA, 19 bp, Homo sapiens
ttccacccacaaactccag

SEQ ID NO: 3552214 - DNA, 19 bp, Homo sapiens
ttccactatttgcagaggc

SEQ ID NO: 3552215 - DNA, 19 bp, Homo sapiens
ttccactcgtgtgtttcta

SEQ ID NO: 3552216 - DNA, 14 bp, Homo sapiens
ttccactgaaaatt

SEQ ID NO: 3552217 - DNA, 18 bp, Homo sapiens
ttccactgaaaatttaac

SEQ ID NO: 3552218 - DNA, 21 bp, Homo sapiens
ttccactgaaaatttaacagt

SEQ ID NO: 3552219 - DNA, 20 bp, Homo sapiens
ttccactgaggtgggagcat

SEQ ID NO: 3552220 - DNA, 21 bp, Homo sapiens
ttccacttagaaattgcattt

SEQ ID NO: 3552221 - DNA, 23 bp, Homo sapiens
ttccagactgcttccaattttct

SEQ ID NO: 3552222 - DNA, 18 bp, Homo sapiens
ttccagagagtggctcct

SEQ ID NO: 3552223 - DNA, 21 bp, Homo sapiens
ttccagagagtggctcctccc

SEQ ID NO: 3552224 - DNA, 19 bp, Homo sapiens
ttccagaggctattatttt

SEQ ID NO: 3552225 - DNA, 19 bp, Homo sapiens
ttccagtattgaaaacttc

SEQ ID NO: 3552226 - DNA, 15 bp, Homo sapiens
ttccagtgtctgtct

SEQ ID NO: 3552227 - DNA, 15 bp, Homo sapiens
ttccatcatttctgt

SEQ ID NO: 3552228 - DNA, 15 bp, Homo sapiens
ttccatgatgcacag

SEQ ID NO: 3552229 - DNA, 22 bp, Homo sapiens
ttccatgcaactggagttcctt

SEQ ID NO: 3552230 - DNA, 18 bp, Homo sapiens
ttccatgtcgcctctgca

SEQ ID NO: 3552231 - DNA, 19 bp, Homo sapiens
ttccatgtcgcctctgcat

SEQ ID NO: 3552232 - DNA, 15 bp, Homo sapiens
ttccatgtgcctttc

SEQ ID NO: 3552233 - DNA, 20 bp, Homo sapiens
ttccatgtgcctttctttgc

SEQ ID NO: 3552234 - DNA, 23 bp, Homo sapiens
ttccatgtgcctttctttgcctc

SEQ ID NO: 3552235 - DNA, 20 bp, Homo sapiens
ttccatgttttttcttcaaa

SEQ ID NO: 3552236 - DNA, 13 bp, Homo sapiens
ttccattccttca

SEQ ID NO: 3552237 - DNA, 12 bp, Homo sapiens
ttcccaaatttc

SEQ ID NO: 3552238 - DNA, 15 bp, Homo sapiens
ttcccaacacaaaga

SEQ ID NO: 3552239 - DNA, 17 bp, Homo sapiens
ttcccaactctagctgg

SEQ ID NO: 3552240 - DNA, 18 bp, Homo sapiens
ttcccaactctagctggg

SEQ ID NO: 3552241 - DNA, 13 bp, Homo sapiens
ttcccacatttgt

SEQ ID NO: 3552242 - DNA, 16 bp, Homo sapiens
ttcccacatttgtctt

SEQ ID NO: 3552243 - DNA, 18 bp, Homo sapiens
ttcccagagcaaaataat

SEQ ID NO: 3552244 - DNA, 20 bp, Homo sapiens
ttcccagcctgactagaact

SEQ ID NO: 3552245 - DNA, 13 bp, Homo sapiens
ttcccaggaccct

SEQ ID NO: 3552246 - DNA, 22 bp, Homo sapiens
ttcccagggagaaacccacgac

SEQ ID NO: 3552247 - DNA, 14 bp, Homo sapiens
ttcccattcttgca

SEQ ID NO: 3552248 - DNA, 14 bp, Homo sapiens
ttcccatttcttcc

SEQ ID NO: 3552249 - DNA, 15 bp, Homo sapiens
ttcccatttcttccc

SEQ ID NO: 3552250 - DNA, 17 bp, Homo sapiens
ttccccaagggccctgg

SEQ ID NO: 3552251 - DNA, 11 bp, Homo sapiens
ttccccagaga

SEQ ID NO: 3552252 - DNA, 22 bp, Homo sapiens
ttccccagcatgcaccacgggc

SEQ ID NO: 3552253 - DNA, 16 bp, Homo sapiens
aaacctaagtccttcc

SEQ ID NO: 3552254 - DNA, 17 bp, Homo sapiens
aaacctatttttccttt

SEQ ID NO: 3552255 - DNA, 19 bp, Homo sapiens
aaacctatttttcctttaa

SEQ ID NO: 3552256 - DNA, 18 bp, Homo sapiens
aaacctccagcctccctg

SEQ ID NO: 3552257 - DNA, 11 bp, Homo sapiens
aaacctctcct

SEQ ID NO: 3552258 - DNA, 22 bp, Homo sapiens
aaacctgactcaattatttgca

SEQ ID NO: 3552259 - DNA, 18 bp, Homo sapiens
aaacctggggtgaatact

SEQ ID NO: 3552260 - DNA, 17 bp, Homo sapiens
aaaccttaaaagtaata

SEQ ID NO: 3552261 - DNA, 21 bp, Homo sapiens
aaaccttaaaagtaataaaga

SEQ ID NO: 3552262 - DNA, 16 bp, Homo sapiens
aaaccttccacccagt

SEQ ID NO: 3552263 - DNA, 23 bp, Homo sapiens
aaaccttccacccagtgctgaat

SEQ ID NO: 3552264 - DNA, 13 bp, Homo sapiens
aaaccttttattt

SEQ ID NO: 3552265 - DNA, 17 bp, Homo sapiens
aaaccttttatttttat

SEQ ID NO: 3552266 - DNA, 15 bp, Homo sapiens
aaacggttcctggtg

SEQ ID NO: 3552267 - DNA, 22 bp, Homo sapiens
aaacggttcctggtgactcctg

SEQ ID NO: 3552268 - DNA, 19 bp, Homo sapiens
aaacgtgaaacgccacaaa

SEQ ID NO: 3552269 - DNA, 21 bp, Homo sapiens
aaacgtttctcaaatctgctt

SEQ ID NO: 3552270 - DNA, 12 bp, Homo sapiens
aaactacaaata

SEQ ID NO: 3552271 - DNA, 13 bp, Homo sapiens
aaactcaaaatat

SEQ ID NO: 3552272 - DNA, 17 bp, Homo sapiens
aaactcagatccttggt

SEQ ID NO: 3552273 - DNA, 14 bp, Homo sapiens
aaactcaggcccag

SEQ ID NO: 3552274 - DNA, 22 bp, Homo sapiens
aaactccagatgccacaatgga

SEQ ID NO: 3552275 - DNA, 16 bp, Homo sapiens
aaactccatgatattt

SEQ ID NO: 3552276 - DNA, 16 bp, Homo sapiens
aaactctgggtcttgg

SEQ ID NO: 3552277 - DNA, 21 bp, Homo sapiens
aaactctgggtcttggccatg

SEQ ID NO: 3552278 - DNA, 22 bp, Homo sapiens
aaactctgttacactttttgga

SEQ ID NO: 3552279 - DNA, 15 bp, Homo sapiens
aaactgacagatgct

SEQ ID NO: 3552280 - DNA, 13 bp, Homo sapiens
aaactgactatca

SEQ ID NO: 3552281 - DNA, 22 bp, Homo sapiens
aaactgaggcccagagagggaa

SEQ ID NO: 3552282 - DNA, 21 bp, Homo sapiens
aaactgagtttaagggggact

SEQ ID NO: 3552283 - DNA, 12 bp, Homo sapiens
aaactgcacatc

SEQ ID NO: 3552284 - DNA, 15 bp, Homo sapiens
aaactgcactgtcaa

SEQ ID NO: 3552285 - DNA, 10 bp, Homo sapiens
aaactgcagc

SEQ ID NO: 3552286 - DNA, 19 bp, Homo sapiens
aaactgccagcaacgcagg

SEQ ID NO: 3552287 - DNA, 16 bp, Homo sapiens
aaactgctcatttcat

SEQ ID NO: 3552288 - DNA, 19 bp, Homo sapiens
aaactgcttcctttcttga

SEQ ID NO: 3552289 - DNA, 20 bp, Homo sapiens
aaactgcttcctttcttgat

SEQ ID NO: 3552290 - DNA, 14 bp, Homo sapiens
aaactggcttcccc

SEQ ID NO: 3552291 - DNA, 14 bp, Homo sapiens
aaactggctttggc

SEQ ID NO: 3552292 - DNA, 18 bp, Homo sapiens
aaactggtatgaataatt

SEQ ID NO: 3552293 - DNA, 20 bp, Homo sapiens
aaactggtttataataaact

SEQ ID NO: 3552294 - DNA, 16 bp, Homo sapiens
aaactgttatttttac

SEQ ID NO: 3552295 - DNA, 20 bp, Homo sapiens
aaactgttcccacctgctgg

SEQ ID NO: 3552296 - DNA, 18 bp, Homo sapiens
aaactgtttctttaaaat

SEQ ID NO: 3552297 - DNA, 14 bp, Homo sapiens
aaacttaaacaaaa

SEQ ID NO: 3552298 - DNA, 15 bp, Homo sapiens
aaacttaagaattga

SEQ ID NO: 3552299 - DNA, 17 bp, Homo sapiens
aaacttaatttaatatt

SEQ ID NO: 3552300 - DNA, 23 bp, Homo sapiens
aaacttcaaagctgaatattttt

SEQ ID NO: 3552301 - DNA, 12 bp, Homo sapiens
aaacttctgctc

SEQ ID NO: 3552302 - DNA, 22 bp, Homo sapiens
aaacttgatgtgttatctctta

SEQ ID NO: 3552303 - DNA, 15 bp, Homo sapiens
aaacttgttgaattt

SEQ ID NO: 3552304 - DNA, 22 bp, Homo sapiens
aaactttggagagggaaaatct

SEQ ID NO: 3552305 - DNA, 13 bp, Homo sapiens
aaacttttaactg

SEQ ID NO: 3552306 - DNA, 22 bp, Homo sapiens
aaagaaaaaaaaaaagaaagaa

SEQ ID NO: 3552307 - DNA, 13 bp, Homo sapiens
aaagaaacaagct

SEQ ID NO: 3552308 - DNA, 14 bp, Homo sapiens
aaagaaacaagctg

SEQ ID NO: 3552309 - DNA, 17 bp, Homo sapiens
aaagaaatgtcttaatt

SEQ ID NO: 3552310 - DNA, 14 bp, Homo sapiens
aaagaacaaacaaa

SEQ ID NO: 3552311 - DNA, 16 bp, Homo sapiens
aaagaaccatgcagga

SEQ ID NO: 3552312 - DNA, 15 bp, Homo sapiens
aaagaacgctgattt

SEQ ID NO: 3552313 - DNA, 18 bp, Homo sapiens
aaagaacgctgatttaaa

SEQ ID NO: 3552314 - DNA, 20 bp, Homo sapiens
aaagaacgctgatttaaaga

SEQ ID NO: 3552315 - DNA, 19 bp, Homo sapiens
aaagaacttgctgctgcct

SEQ ID NO: 3552316 - DNA, 11 bp, Homo sapiens
aaagaagaaaa

SEQ ID NO: 3552317 - DNA, 12 bp, Homo sapiens
aaagaagaaaag

SEQ ID NO: 3552318 - DNA, 19 bp, Homo sapiens
aaagaagagttttagagaa

SEQ ID NO: 3552319 - DNA, 12 bp, Homo sapiens
aaagaagcaaga

SEQ ID NO: 3552320 - DNA, 14 bp, Homo sapiens
aaagaagcaagaca

SEQ ID NO: 3552321 - DNA, 16 bp, Homo sapiens
aaagaagcccccagct

SEQ ID NO: 3552322 - DNA, 23 bp, Homo sapiens
aaagaagggggccctgctacctg

SEQ ID NO: 3552323 - DNA, 16 bp, Homo sapiens
aaagaatagaagctaa

SEQ ID NO: 3552324 - DNA, 12 bp, Homo sapiens
aaagaatgttag

SEQ ID NO: 3552325 - DNA, 17 bp, Homo sapiens
aaagacataaaacagaa

SEQ ID NO: 3552326 - DNA, 18 bp, Homo sapiens
aaagacataaaacagaat

SEQ ID NO: 3552327 - DNA, 21 bp, Homo sapiens
aaagacatcagtctccaacat

SEQ ID NO: 3552328 - DNA, 17 bp, Homo sapiens
aaagacattgacagcaa

SEQ ID NO: 3552329 - DNA, 18 bp, Homo sapiens
aaagacattgacagcaat

SEQ ID NO: 3552330 - DNA, 19 bp, Homo sapiens
aaagacattgacagcaatt

SEQ ID NO: 3552331 - DNA, 17 bp, Homo sapiens
aaagactattcaaacag

SEQ ID NO: 3552332 - DNA, 15 bp, Homo sapiens
aaagactctggaggt

SEQ ID NO: 3552333 - DNA, 23 bp, Homo sapiens
aaagacttctcaaagagaattgt

SEQ ID NO: 3552334 - DNA, 13 bp, Homo sapiens
aaagagaaatata

SEQ ID NO: 3552335 - DNA, 23 bp, Homo sapiens
aaagagaaatatatttgtcactt

SEQ ID NO: 3552336 - DNA, 12 bp, Homo sapiens
aaagagaattgt

SEQ ID NO: 3552337 - DNA, 19 bp, Homo sapiens
aaagagagaagccagccac

SEQ ID NO: 3552338 - DNA, 22 bp, Homo sapiens
aaagagctaggaaccctggagg

SEQ ID NO: 3552339 - DNA, 16 bp, Homo sapiens
aaagagctgcctggat

SEQ ID NO: 3552340 - DNA, 15 bp, Homo sapiens
aaagaggcagcttga

SEQ ID NO: 3552341 - DNA, 12 bp, Homo sapiens
aaagagggacag

SEQ ID NO: 3552342 - DNA, 17 bp, Homo sapiens
aaagaggtgaaaatgaa

SEQ ID NO: 3552343 - DNA, 15 bp, Homo sapiens
aaagagtttaaacaa

SEQ ID NO: 3552344 - DNA, 21 bp, Homo sapiens
aaagagtttaaacaaaaaacc

SEQ ID NO: 3552345 - DNA, 13 bp, Homo sapiens
aaagatgaaaata

SEQ ID NO: 3552346 - DNA, 21 bp, Homo sapiens
aaagattaggtcgttttccaa

SEQ ID NO: 3552347 - DNA, 19 bp, Homo sapiens
aaagattctggggctgtgt

SEQ ID NO: 3552348 - DNA, 13 bp, Homo sapiens
aaagcaaaataca

SEQ ID NO: 3552349 - DNA, 15 bp, Homo sapiens
aaagcaaagaaaata

SEQ ID NO: 3552350 - DNA, 17 bp, Homo sapiens
aaagcaaaggtgcactc

SEQ ID NO: 3552351 - DNA, 20 bp, Homo sapiens
aaagcacactcatcccctca

SEQ ID NO: 3552352 - DNA, 18 bp, Homo sapiens
aaagcacatggttcaaat

SEQ ID NO: 3552353 - DNA, 17 bp, Homo sapiens
aaagcactgacttctaa

SEQ ID NO: 3552354 - DNA, 21 bp, Homo sapiens
aaagcactgacttctaagtaa

SEQ ID NO: 3552355 - DNA, 16 bp, Homo sapiens
aaagcagagcctcctg

SEQ ID NO: 3552356 - DNA, 17 bp, Homo sapiens
aaagcagagcctcctgg

SEQ ID NO: 3552357 - DNA, 19 bp, Homo sapiens
aaagcagctttaaaaaaat

SEQ ID NO: 3552358 - DNA, 12 bp, Homo sapiens
aaagcagttcct

SEQ ID NO: 3552359 - DNA, 17 bp, Homo sapiens
aaagcatccctcaccca

SEQ ID NO: 3552360 - DNA, 24 bp, Homo sapiens
aaagcatccctcacccatcctaga

SEQ ID NO: 3552361 - DNA, 20 bp, Homo sapiens
aaagcattgtaaatgtgctt

SEQ ID NO: 3552362 - DNA, 20 bp, Homo sapiens
aaagcatttgagctgtggtt

SEQ ID NO: 3552363 - DNA, 13 bp, Homo sapiens
aaagcattttgta

SEQ ID NO: 3552364 - DNA, 14 bp, Homo sapiens
aaagcattttgtaa

SEQ ID NO: 3552365 - DNA, 15 bp, Homo sapiens
aaagccaaggcagcg

SEQ ID NO: 3552366 - DNA, 18 bp, Homo sapiens
aaagccacatcttgctct

SEQ ID NO: 3552367 - DNA, 14 bp, Homo sapiens
aaagccaggctcag

SEQ ID NO: 3552368 - DNA, 23 bp, Homo sapiens
aaagcccaagggatctggtccta

SEQ ID NO: 3552369 - DNA, 20 bp, Homo sapiens
aaagcccctcacactgcaag

SEQ ID NO: 3552370 - DNA, 22 bp, Homo sapiens
aaagcccttccatgtcgcctct

SEQ ID NO: 3552371 - DNA, 18 bp, Homo sapiens
aaagccttaaaatgcatt

SEQ ID NO: 3552372 - DNA, 19 bp, Homo sapiens
aaagcgacttcaggtcagg

SEQ ID NO: 3552373 - DNA, 14 bp, Homo sapiens
aaagcggtccctgt

SEQ ID NO: 3552374 - DNA, 13 bp, Homo sapiens
aaagctctgaaaa

SEQ ID NO: 3552375 - DNA, 17 bp, Homo sapiens
aaagctgccatttccct

SEQ ID NO: 3552376 - DNA, 18 bp, Homo sapiens
aaagctttattaccagtg

SEQ ID NO: 3552377 - DNA, 15 bp, Homo sapiens
aaagctttgttttgt

SEQ ID NO: 3552378 - DNA, 13 bp, Homo sapiens
aaaggaaaataat

SEQ ID NO: 3552379 - DNA, 16 bp, Homo sapiens
aaaggacatcagcaaa

SEQ ID NO: 3552380 - DNA, 22 bp, Homo sapiens
aaaggacccttgagtaagtgaa

SEQ ID NO: 3552381 - DNA, 19 bp, Homo sapiens
aaaggacctcctaaataaa

SEQ ID NO: 3552382 - DNA, 19 bp, Homo sapiens
aaaggagccttttgctctc

SEQ ID NO: 3552383 - DNA, 13 bp, Homo sapiens
aaaggaggtgaaa

SEQ ID NO: 3552384 - DNA, 20 bp, Homo sapiens
aaaggatctgtgattggctg

SEQ ID NO: 3552385 - DNA, 22 bp, Homo sapiens
aaaggatctgtgattggctggt

SEQ ID NO: 3552386 - DNA, 16 bp, Homo sapiens
aaatggcgaacatgtg

SEQ ID NO: 3552387 - DNA, 16 bp, Homo sapiens
aaatggggccagatcc

SEQ ID NO: 3552388 - DNA, 17 bp, Homo sapiens
aaatggggccagatcca

SEQ ID NO: 3552389 - DNA, 21 bp, Homo sapiens
aaatgggggcaggaaagccac

SEQ ID NO: 3552390 - DNA, 15 bp, Homo sapiens
aaatgggtgttattt

SEQ ID NO: 3552391 - DNA, 19 bp, Homo sapiens
aaatggtgctgcagatttg

SEQ ID NO: 3552392 - DNA, 17 bp, Homo sapiens
aaatggttaaattttac

SEQ ID NO: 3552393 - DNA, 20 bp, Homo sapiens
aaatggttgatggaaaataa

SEQ ID NO: 3552394 - DNA, 16 bp, Homo sapiens
aaatgtaaaaatgaag

SEQ ID NO: 3552395 - DNA, 17 bp, Homo sapiens
aaatgtaaaaatgaagg

SEQ ID NO: 3552396 - DNA, 18 bp, Homo sapiens
aaatgtaaaaatgaagga

SEQ ID NO: 3552397 - DNA, 17 bp, Homo sapiens
aaatgtaacttttgtaa

SEQ ID NO: 3552398 - DNA, 18 bp, Homo sapiens
aaatgtaacttttgtaag

SEQ ID NO: 3552399 - DNA, 16 bp, Homo sapiens
aaatgtaagggaaact

SEQ ID NO: 3552400 - DNA, 12 bp, Homo sapiens
aaatgtacattt

SEQ ID NO: 3552401 - DNA, 19 bp, Homo sapiens
aaatgtaggatcaaaaggc

SEQ ID NO: 3552402 - DNA, 20 bp, Homo sapiens
aaatgtagttttgtatacag

SEQ ID NO: 3552403 - DNA, 21 bp, Homo sapiens
aaatgtatgtgtgtctatttt

SEQ ID NO: 3552404 - DNA, 15 bp, Homo sapiens
aaatgtattcaagca

SEQ ID NO: 3552405 - DNA, 15 bp, Homo sapiens
aaatgtcaaatgtga

SEQ ID NO: 3552406 - DNA, 14 bp, Homo sapiens
aaatgtgaaatgct

SEQ ID NO: 3552407 - DNA, 16 bp, Homo sapiens
aaatgtgaaatgcttt

SEQ ID NO: 3552408 - DNA, 24 bp, Homo sapiens
aaatgtgactcagcatcacccacc

SEQ ID NO: 3552409 - DNA, 15 bp, Homo sapiens
aaatgtggctcctgg

SEQ ID NO: 3552410 - DNA, 16 bp, Homo sapiens
aaatgtggctgtatcc

SEQ ID NO: 3552411 - DNA, 22 bp, Homo sapiens
aaatgttacgtgaagaaataaa

SEQ ID NO: 3552412 - DNA, 15 bp, Homo sapiens
aaatgttcagaaggt

SEQ ID NO: 3552413 - DNA, 20 bp, Homo sapiens
aaatgttttaaagtttaatg

SEQ ID NO: 3552414 - DNA, 23 bp, Homo sapiens
aaatgttttaaagtttaatgcct

SEQ ID NO: 3552415 - DNA, 12 bp, Homo sapiens
aaattaaatgga

SEQ ID NO: 3552416 - DNA, 15 bp, Homo sapiens
aaattaaatggattt

SEQ ID NO: 3552417 - DNA, 17 bp, Homo sapiens
aaattaacaataaagaa

SEQ ID NO: 3552418 - DNA, 16 bp, Homo sapiens
aaattacacccaaaga

SEQ ID NO: 3552419 - DNA, 13 bp, Homo sapiens
aaattacatgttt

SEQ ID NO: 3552420 - DNA, 22 bp, Homo sapiens
aaattacatgttttttcatttg

SEQ ID NO: 3552421 - DNA, 19 bp, Homo sapiens
aaattataactattacagt

SEQ ID NO: 3552422 - DNA, 17 bp, Homo sapiens
aaattatatgatatgca

SEQ ID NO: 3552423 - DNA, 18 bp, Homo sapiens
aaattatatgatatgcat

SEQ ID NO: 3552424 - DNA, 22 bp, Homo sapiens
aaattatgtgacattttacatt

SEQ ID NO: 3552425 - DNA, 18 bp, Homo sapiens
aaattattactttaaatt

SEQ ID NO: 3552426 - DNA, 22 bp, Homo sapiens
aaattccactgaaaatttaaca

SEQ ID NO: 3552427 - DNA, 17 bp, Homo sapiens
aaattcccgttttgtca

SEQ ID NO: 3552428 - DNA, 18 bp, Homo sapiens
aaattcctctttgctttg

SEQ ID NO: 3552429 - DNA, 19 bp, Homo sapiens
aaattcctctttgctttgc

SEQ ID NO: 3552430 - DNA, 16 bp, Homo sapiens
aaattctcaaagtttt

SEQ ID NO: 3552431 - DNA, 19 bp, Homo sapiens
aaattgaaataaagataaa

SEQ ID NO: 3552432 - DNA, 19 bp, Homo sapiens
aaattgataacatggaaat

SEQ ID NO: 3552433 - DNA, 12 bp, Homo sapiens
aaattgcactga

SEQ ID NO: 3552434 - DNA, 17 bp, Homo sapiens
aaattgcactgaagttt

SEQ ID NO: 3552435 - DNA, 17 bp, Homo sapiens
aaattgcagtttacagt

SEQ ID NO: 3552436 - DNA, 18 bp, Homo sapiens
aaattgcttctaaaacaa

SEQ ID NO: 3552437 - DNA, 23 bp, Homo sapiens
aaattgggcttgtgatttccatt

SEQ ID NO: 3552438 - DNA, 23 bp, Homo sapiens
aaattgtctgggttccaaaatat

SEQ ID NO: 3552439 - DNA, 19 bp, Homo sapiens
aaattgttatcaaaatagt

SEQ ID NO: 3552440 - DNA, 15 bp, Homo sapiens
aaatttaatgctgcc

SEQ ID NO: 3552441 - DNA, 15 bp, Homo sapiens
aaatttaattacaaa

SEQ ID NO: 3552442 - DNA, 12 bp, Homo sapiens
aaatttaattct

SEQ ID NO: 3552443 - DNA, 12 bp, Homo sapiens
aaatttatgtga

SEQ ID NO: 3552444 - DNA, 15 bp, Homo sapiens
aaatttatgtgatgg

SEQ ID NO: 3552445 - DNA, 19 bp, Homo sapiens
aaatttcataattctgaaa

SEQ ID NO: 3552446 - DNA, 13 bp, Homo sapiens
aaatttgataaac

SEQ ID NO: 3552447 - DNA, 20 bp, Homo sapiens
aaatttgataaactgaattt

SEQ ID NO: 3552448 - DNA, 22 bp, Homo sapiens
aaatttgttctttgtttagcct

SEQ ID NO: 3552449 - DNA, 18 bp, Homo sapiens
aaatttttacctgtttaa

SEQ ID NO: 3552450 - DNA, 22 bp, Homo sapiens
aaattttttacgtagctatttt

SEQ ID NO: 3552451 - DNA, 12 bp, Homo sapiens
aaattttttgaa

SEQ ID NO: 3552452 - DNA, 16 bp, Homo sapiens
aaattttttttacatt

SEQ ID NO: 3552453 - DNA, 17 bp, Homo sapiens
aaattttttttacattt

SEQ ID NO: 3552454 - DNA, 18 bp, Homo sapiens
aaattttttttacatttt

SEQ ID NO: 3552455 - DNA, 12 bp, Homo sapiens
aacaaaacaaaa

SEQ ID NO: 3552456 - DNA, 9 bp, Homo sapiens
aacaaaact

SEQ ID NO: 3552457 - DNA, 17 bp, Homo sapiens
aacaaacgagcaggcat

SEQ ID NO: 3552458 - DNA, 18 bp, Homo sapiens
aacaaagcagctttaaaa

SEQ ID NO: 3552459 - DNA, 16 bp, Homo sapiens
aacaaatatgttctct

SEQ ID NO: 3552460 - DNA, 15 bp, Homo sapiens
aacaaatgaaattta

SEQ ID NO: 3552461 - DNA, 22 bp, Homo sapiens
aacaaatgaaatttaattacaa

SEQ ID NO: 3552462 - DNA, 23 bp, Homo sapiens
aacaacgtgagagaaagagagaa

SEQ ID NO: 3552463 - DNA, 21 bp, Homo sapiens
aacaagcatttcccccaggga

SEQ ID NO: 3552464 - DNA, 17 bp, Homo sapiens
aacaagtttagaaagct

SEQ ID NO: 3552465 - DNA, 20 bp, Homo sapiens
aacaatcccaatctttctat

SEQ ID NO: 3552466 - DNA, 19 bp, Homo sapiens
aacacaaaaaaaattttag

SEQ ID NO: 3552467 - DNA, 18 bp, Homo sapiens
aacacagcaagggtgatg

SEQ ID NO: 3552468 - DNA, 12 bp, Homo sapiens
aacacatcagct

SEQ ID NO: 3552469 - DNA, 18 bp, Homo sapiens
aacacatctggctgcaca

SEQ ID NO: 3552470 - DNA, 22 bp, Homo sapiens
aacacatctggctgcacaggct

SEQ ID NO: 3552471 - DNA, 22 bp, Homo sapiens
aacacatttgggatgttccttt

SEQ ID NO: 3552472 - DNA, 13 bp, Homo sapiens
aacaccaacccct

SEQ ID NO: 3552473 - DNA, 17 bp, Homo sapiens
aacaccaacccctgacc

SEQ ID NO: 3552474 - DNA, 11 bp, Homo sapiens
aacaccagtgt

SEQ ID NO: 3552475 - DNA, 23 bp, Homo sapiens
aacacctcccaggagacagttca

SEQ ID NO: 3552476 - DNA, 15 bp, Homo sapiens
aacacgagcaggcta

SEQ ID NO: 3552477 - DNA, 13 bp, Homo sapiens
aacactaaacatt

SEQ ID NO: 3552478 - DNA, 16 bp, Homo sapiens
aacactgaaatgaaat

SEQ ID NO: 3552479 - DNA, 19 bp, Homo sapiens
aacactgagaaagaggcag

SEQ ID NO: 3552480 - DNA, 14 bp, Homo sapiens
aacacttaatagca

SEQ ID NO: 3552481 - DNA, 23 bp, Homo sapiens
aacactttgagcatttttaaggg

SEQ ID NO: 3552482 - DNA, 13 bp, Homo sapiens
aacagaaacaaaa

SEQ ID NO: 3552483 - DNA, 20 bp, Homo sapiens
aacagaaactacatttctac

SEQ ID NO: 3552484 - DNA, 12 bp, Homo sapiens
aacagaggatat

SEQ ID NO: 3552485 - DNA, 18 bp, Homo sapiens
aacagagtggcctccctg

SEQ ID NO: 3552486 - DNA, 20 bp, Homo sapiens
aacagattcaggccagccca

SEQ ID NO: 3552487 - DNA, 14 bp, Homo sapiens
aacagatttaaaga

SEQ ID NO: 3552488 - DNA, 18 bp, Homo sapiens
aacagcatgaataaaaca

SEQ ID NO: 3552489 - DNA, 20 bp, Homo sapiens
aacagccttagagctcttgt

SEQ ID NO: 3552490 - DNA, 11 bp, Homo sapiens
aacagctcagc

SEQ ID NO: 3552491 - DNA, 12 bp, Homo sapiens
aacagcttccct

SEQ ID NO: 3552492 - DNA, 13 bp, Homo sapiens
aacagctttgtct

SEQ ID NO: 3552493 - DNA, 15 bp, Homo sapiens
aacagctttgtctcc

SEQ ID NO: 3552494 - DNA, 17 bp, Homo sapiens
aacagtctcaggaaatc

SEQ ID NO: 3552495 - DNA, 19 bp, Homo sapiens
aacagtctcaggaaatcaa

SEQ ID NO: 3552496 - DNA, 17 bp, Homo sapiens
aacagtggttgcctggg

SEQ ID NO: 3552497 - DNA, 19 bp, Homo sapiens
aacagtggttgcctggggg

SEQ ID NO: 3552498 - DNA, 16 bp, Homo sapiens
aacagtttcttgcttg

SEQ ID NO: 3552499 - DNA, 17 bp, Homo sapiens
aacagtttcttgcttgg

SEQ ID NO: 3552500 - DNA, 15 bp, Homo sapiens
aacataaaaaggaca

SEQ ID NO: 3552501 - DNA, 22 bp, Homo sapiens
aacataaaaaggacatcagcaa

SEQ ID NO: 3552502 - DNA, 18 bp, Homo sapiens
aacataaacacatttcca

SEQ ID NO: 3552503 - DNA, 15 bp, Homo sapiens
aacatattcaaggag

SEQ ID NO: 3552504 - DNA, 13 bp, Homo sapiens
aacatcaaataaa

SEQ ID NO: 3552505 - DNA, 15 bp, Homo sapiens
aacatcaaataaatt

SEQ ID NO: 3552506 - DNA, 16 bp, Homo sapiens
aacatcaaataaattt

SEQ ID NO: 3552507 - DNA, 17 bp, Homo sapiens
aacatcaaataaatttc

SEQ ID NO: 3552508 - DNA, 20 bp, Homo sapiens
aacatcaaataaatttctgg

SEQ ID NO: 3552509 - DNA, 14 bp, Homo sapiens
aacatcaacatctt

SEQ ID NO: 3552510 - DNA, 16 bp, Homo sapiens
aacatccaagtggcct

SEQ ID NO: 3552511 - DNA, 17 bp, Homo sapiens
aacatcgcacagtttac

SEQ ID NO: 3552512 - DNA, 20 bp, Homo sapiens
aacatctacaaaacattaaa

SEQ ID NO: 3552513 - DNA, 21 bp, Homo sapiens
aacatctttttaacctgcaaa

SEQ ID NO: 3552514 - DNA, 22 bp, Homo sapiens
aacatgatccccgtctctgccc

SEQ ID NO: 3552515 - DNA, 22 bp, Homo sapiens
aacatggtaaacgctgtcccta

SEQ ID NO: 3552516 - DNA, 19 bp, Homo sapiens
aacatgtcctgcctattat

SEQ ID NO: 3552517 - DNA, 20 bp, Homo sapiens
aacatgtcctgcctattatc

SEQ ID NO: 3552518 - DNA, 17 bp, Homo sapiens
aactgaaccaaattgca

SEQ ID NO: 3552519 - DNA, 15 bp, Homo sapiens
aactgaacttcagag

SEQ ID NO: 3552520 - DNA, 12 bp, Homo sapiens
aactgaagcttt

SEQ ID NO: 3552521 - DNA, 19 bp, Homo sapiens
aactgaattttttttaaaa

SEQ ID NO: 3552522 - DNA, 14 bp, Homo sapiens
aactgaccagcctc

SEQ ID NO: 3552523 - DNA, 15 bp, Homo sapiens
aactgactatcataa

SEQ ID NO: 3552524 - DNA, 22 bp, Homo sapiens
aactgactatcataaaatcaaa

SEQ ID NO: 3552525 - DNA, 15 bp, Homo sapiens
aactgagagaaagat

SEQ ID NO: 3552526 - DNA, 23 bp, Homo sapiens
aactgagatgtgaacacatcagc

SEQ ID NO: 3552527 - DNA, 12 bp, Homo sapiens
aactgagctggg

SEQ ID NO: 3552528 - DNA, 13 bp, Homo sapiens
aactgaggaattt

SEQ ID NO: 3552529 - DNA, 18 bp, Homo sapiens
aactgaggaattttcttt

SEQ ID NO: 3552530 - DNA, 20 bp, Homo sapiens
aactgaggaattttctttgt

SEQ ID NO: 3552531 - DNA, 21 bp, Homo sapiens
aactgaggcccagagagggaa

SEQ ID NO: 3552532 - DNA, 12 bp, Homo sapiens
aactgcaaaaaa

SEQ ID NO: 3552533 - DNA, 21 bp, Homo sapiens
aactgcaaaaaaagcctccaa

SEQ ID NO: 3552534 - DNA, 22 bp, Homo sapiens
aactgcaaaaaaagcctccaag

SEQ ID NO: 3552535 - DNA, 11 bp, Homo sapiens
aactgcacatc

SEQ ID NO: 3552536 - DNA, 13 bp, Homo sapiens
aactgcacatcta

SEQ ID NO: 3552537 - DNA, 12 bp, Homo sapiens
aactgcagcctc

SEQ ID NO: 3552538 - DNA, 16 bp, Homo sapiens
aactgcagcctctctg

SEQ ID NO: 3552539 - DNA, 20 bp, Homo sapiens
aactgccaggctgcctcctg

SEQ ID NO: 3552540 - DNA, 18 bp, Homo sapiens
aactgcccattgtaactt

SEQ ID NO: 3552541 - DNA, 16 bp, Homo sapiens
aactgcccttgctgcc

SEQ ID NO: 3552542 - DNA, 17 bp, Homo sapiens
aactgctgaattcacct

SEQ ID NO: 3552543 - DNA, 13 bp, Homo sapiens
aactgctgcagat

SEQ ID NO: 3552544 - DNA, 13 bp, Homo sapiens
aactgctgcaggg

SEQ ID NO: 3552545 - DNA, 18 bp, Homo sapiens
aactggaaaatcttctag

SEQ ID NO: 3552546 - DNA, 11 bp, Homo sapiens
aactggaagct

SEQ ID NO: 3552547 - DNA, 12 bp, Homo sapiens
aactggaagctt

SEQ ID NO: 3552548 - DNA, 16 bp, Homo sapiens
aactggaagctttgta

SEQ ID NO: 3552549 - DNA, 21 bp, Homo sapiens
aactggacacaataggtcttt

SEQ ID NO: 3552550 - DNA, 23 bp, Homo sapiens
aactggagttccttatccctctc

SEQ ID NO: 3552551 - DNA, 16 bp, Homo sapiens
aactggatatttcaat

SEQ ID NO: 3552552 - DNA, 17 bp, Homo sapiens
aactgggcatttcaatc

SEQ ID NO: 3552553 - DNA, 18 bp, Homo sapiens
aactgggcatttcaatcc

SEQ ID NO: 3552554 - DNA, 22 bp, Homo sapiens
aactgggttaaatattttgcta

SEQ ID NO: 3552555 - DNA, 22 bp, Homo sapiens
aactggttaaacattaatattt

SEQ ID NO: 3552556 - DNA, 20 bp, Homo sapiens
aactgtattttctttcactt

SEQ ID NO: 3552557 - DNA, 17 bp, Homo sapiens
aactgtcctgtcctgct

SEQ ID NO: 3552558 - DNA, 22 bp, Homo sapiens
aactgtgaattcattctggagg

SEQ ID NO: 3552559 - DNA, 13 bp, Homo sapiens
aactgtgattttt

SEQ ID NO: 3552560 - DNA, 13 bp, Homo sapiens
aactgttcccacc

SEQ ID NO: 3552561 - DNA, 16 bp, Homo sapiens
aactgtttccctgctg

SEQ ID NO: 3552562 - DNA, 17 bp, Homo sapiens
aactgtttccctgctga

SEQ ID NO: 3552563 - DNA, 19 bp, Homo sapiens
aactgtttccctgctgaat

SEQ ID NO: 3552564 - DNA, 15 bp, Homo sapiens
aacttaagaattgaa

SEQ ID NO: 3552565 - DNA, 23 bp, Homo sapiens
aacttaaggtatatttagttgca

SEQ ID NO: 3552566 - DNA, 22 bp, Homo sapiens
aacttaatgttcttatgcaaaa

SEQ ID NO: 3552567 - DNA, 21 bp, Homo sapiens
aacttacaaagattctctatg

SEQ ID NO: 3552568 - DNA, 21 bp, Homo sapiens
aacttagcttatgagtagctt

SEQ ID NO: 3552569 - DNA, 14 bp, Homo sapiens
aacttattgctaga

SEQ ID NO: 3552570 - DNA, 15 bp, Homo sapiens
aacttcagcaaccct

SEQ ID NO: 3552571 - DNA, 13 bp, Homo sapiens
aacttccaattta

SEQ ID NO: 3552572 - DNA, 12 bp, Homo sapiens
aacttccaggaa

SEQ ID NO: 3552573 - DNA, 15 bp, Homo sapiens
aacttccaggaaagt

SEQ ID NO: 3552574 - DNA, 12 bp, Homo sapiens
aacttcctgctg

SEQ ID NO: 3552575 - DNA, 13 bp, Homo sapiens
aacttcctgctgc

SEQ ID NO: 3552576 - DNA, 17 bp, Homo sapiens
aacttcctgtgcctttc

SEQ ID NO: 3552577 - DNA, 11 bp, Homo sapiens
aacttctgctc

SEQ ID NO: 3552578 - DNA, 13 bp, Homo sapiens
aacttctgtttta

SEQ ID NO: 3552579 - DNA, 12 bp, Homo sapiens
aacttcttcctg

SEQ ID NO: 3552580 - DNA, 24 bp, Homo sapiens
aacttgaaacagattcaggccagc

SEQ ID NO: 3552581 - DNA, 14 bp, Homo sapiens
aacttgactgggtg

SEQ ID NO: 3552582 - DNA, 22 bp, Homo sapiens
aacttgcatctaggctgggcgt

SEQ ID NO: 3552583 - DNA, 17 bp, Homo sapiens
aacttgtattttgtcac

SEQ ID NO: 3552584 - DNA, 22 bp, Homo sapiens
aactttaaccacagtgaaagtt

SEQ ID NO: 3552585 - DNA, 13 bp, Homo sapiens
aacttttctcttt

SEQ ID NO: 3552586 - DNA, 13 bp, Homo sapiens
aacttttgggagc

SEQ ID NO: 3552587 - DNA, 21 bp, Homo sapiens
aactttttttctgtaccagtt

SEQ ID NO: 3552588 - DNA, 19 bp, Homo sapiens
aacttttttttctctcttt

SEQ ID NO: 3552589 - DNA, 20 bp, Homo sapiens
aagaaaaaaaaaaagaaaga

SEQ ID NO: 3552590 - DNA, 17 bp, Homo sapiens
aagaaaagattcttctt

SEQ ID NO: 3552591 - DNA, 14 bp, Homo sapiens
aagaaaagccgaaa

SEQ ID NO: 3552592 - DNA, 14 bp, Homo sapiens
aagaaaatgtcttt

SEQ ID NO: 3552593 - DNA, 19 bp, Homo sapiens
aagaaaatttttgtagtag

SEQ ID NO: 3552594 - DNA, 17 bp, Homo sapiens
aagaaacaagctgtgca

SEQ ID NO: 3552595 - DNA, 16 bp, Homo sapiens
aagaaacaccagtgtt

SEQ ID NO: 3552596 - DNA, 17 bp, Homo sapiens
aagaaacaccagtgtta

SEQ ID NO: 3552597 - DNA, 21 bp, Homo sapiens
aagaaaccaagtgcgctttgc

SEQ ID NO: 3552598 - DNA, 21 bp, Homo sapiens
aagaaactgaggaattttctt

SEQ ID NO: 3552599 - DNA, 15 bp, Homo sapiens
aagaaacttttctga

SEQ ID NO: 3552600 - DNA, 23 bp, Homo sapiens
aagaaacttttttattttttaaa

SEQ ID NO: 3552601 - DNA, 12 bp, Homo sapiens
aagaaagaaaga

SEQ ID NO: 3552602 - DNA, 12 bp, Homo sapiens
aagaaagaggaa

SEQ ID NO: 3552603 - DNA, 19 bp, Homo sapiens
aagaaagtaatttaatttg

SEQ ID NO: 3552604 - DNA, 23 bp, Homo sapiens
aagaaagtgggaggtcaggaaac

SEQ ID NO: 3552605 - DNA, 12 bp, Homo sapiens
aagaaagtgtat

SEQ ID NO: 3552606 - DNA, 15 bp, Homo sapiens
aagaaagtgtatttg

SEQ ID NO: 3552607 - DNA, 20 bp, Homo sapiens
aagaaatgcatatgtcacta

SEQ ID NO: 3552608 - DNA, 17 bp, Homo sapiens
aagaaatggctatgaac

SEQ ID NO: 3552609 - DNA, 20 bp, Homo sapiens
aagaaatggctatgaacaga

SEQ ID NO: 3552610 - DNA, 16 bp, Homo sapiens
aagaaattaacaataa

SEQ ID NO: 3552611 - DNA, 15 bp, Homo sapiens
aagaacaatattgac

SEQ ID NO: 3552612 - DNA, 22 bp, Homo sapiens
aagaacaggcttggcaaagaag

SEQ ID NO: 3552613 - DNA, 24 bp, Homo sapiens
aagaaccatgcaggaaggaaaact

SEQ ID NO: 3552614 - DNA, 23 bp, Homo sapiens
aagaacctacagactccatctct

SEQ ID NO: 3552615 - DNA, 12 bp, Homo sapiens
aagaagaaaaga

SEQ ID NO: 3552616 - DNA, 15 bp, Homo sapiens
aagaagaaggccaga

SEQ ID NO: 3552617 - DNA, 20 bp, Homo sapiens
aagaagagctatcaggagaa

SEQ ID NO: 3552618 - DNA, 14 bp, Homo sapiens
aagaaggaagctgt

SEQ ID NO: 3552619 - DNA, 14 bp, Homo sapiens
aagaaggatgatgt

SEQ ID NO: 3552620 - DNA, 12 bp, Homo sapiens
aagaaggccaga

SEQ ID NO: 3552621 - DNA, 13 bp, Homo sapiens
aagaaggccagag

SEQ ID NO: 3552622 - DNA, 14 bp, Homo sapiens
aagaaggccagaga

SEQ ID NO: 3552623 - DNA, 20 bp, Homo sapiens
aagaaggccagagagggaaa

SEQ ID NO: 3552624 - DNA, 15 bp, Homo sapiens
aagaagggggccctg

SEQ ID NO: 3552625 - DNA, 19 bp, Homo sapiens
aagaagggggccctgctac

SEQ ID NO: 3552626 - DNA, 20 bp, Homo sapiens
aagaataaaaacttttgagg

SEQ ID NO: 3552627 - DNA, 14 bp, Homo sapiens
aagaataaacattt

SEQ ID NO: 3552628 - DNA, 12 bp, Homo sapiens
aagaataaattc

SEQ ID NO: 3552629 - DNA, 18 bp, Homo sapiens
aagaatagcattgtaaaa

SEQ ID NO: 3552630 - DNA, 23 bp, Homo sapiens
aagaatagcattgtaaaagcatt

SEQ ID NO: 3552631 - DNA, 13 bp, Homo sapiens
aagaatattttaa

SEQ ID NO: 3552632 - DNA, 12 bp, Homo sapiens
aagaatgtaaag

SEQ ID NO: 3552633 - DNA, 13 bp, Homo sapiens
aagaatgtaaagc

SEQ ID NO: 3552634 - DNA, 11 bp, Homo sapiens
aagaatgttag

SEQ ID NO: 3552635 - DNA, 15 bp, Homo sapiens
aagaatgttagagta

SEQ ID NO: 3552636 - DNA, 16 bp, Homo sapiens
aagaatgttagagtaa

SEQ ID NO: 3552637 - DNA, 21 bp, Homo sapiens
aagaatgttagagtaatgaaa

SEQ ID NO: 3552638 - DNA, 21 bp, Homo sapiens
aagaattgaattggaaagact

SEQ ID NO: 3552639 - DNA, 18 bp, Homo sapiens
aagacaccgttcattcag

SEQ ID NO: 3552640 - DNA, 16 bp, Homo sapiens
aagacagaaaagtgcc

SEQ ID NO: 3552641 - DNA, 12 bp, Homo sapiens
aagacagaggca

SEQ ID NO: 3552642 - DNA, 15 bp, Homo sapiens
aagacagcagaactg

SEQ ID NO: 3552643 - DNA, 22 bp, Homo sapiens
aagacagctggcggaggctgct

SEQ ID NO: 3552644 - DNA, 13 bp, Homo sapiens
aagacataaacaa

SEQ ID NO: 3552645 - DNA, 14 bp, Homo sapiens
aagacataaacaaa

SEQ ID NO: 3552646 - DNA, 17 bp, Homo sapiens
aagacataaacaaagac

SEQ ID NO: 3552647 - DNA, 22 bp, Homo sapiens
aagacataaacaaagacattga

SEQ ID NO: 3552648 - DNA, 14 bp, Homo sapiens
aagacattagagaa

SEQ ID NO: 3552649 - DNA, 19 bp, Homo sapiens
aagacattagagaaaacct

SEQ ID NO: 3552650 - DNA, 22 bp, Homo sapiens
aagacattagagaaaaccttaa

SEQ ID NO: 3552651 - DNA, 21 bp, Homo sapiens
aagacattgacagcaattcat

SEQ ID NO: 3552652 - DNA, 19 bp, Homo sapiens
aatactttctatgtgacat

SEQ ID NO: 3552653 - DNA, 23 bp, Homo sapiens
aatactttgcagcacagctgaga

SEQ ID NO: 3552654 - DNA, 17 bp, Homo sapiens
aatagagaaaattcagg

SEQ ID NO: 3552655 - DNA, 16 bp, Homo sapiens
aatagattcagagaaa

SEQ ID NO: 3552656 - DNA, 21 bp, Homo sapiens
aatagcattatcttatcattt

SEQ ID NO: 3552657 - DNA, 16 bp, Homo sapiens
aatagctttaatgata

SEQ ID NO: 3552658 - DNA, 16 bp, Homo sapiens
aataggaattggtttc

SEQ ID NO: 3552659 - DNA, 16 bp, Homo sapiens
aataggatcctggagg

SEQ ID NO: 3552660 - DNA, 15 bp, Homo sapiens
aataggcattttaag

SEQ ID NO: 3552661 - DNA, 17 bp, Homo sapiens
aataggtcatatgttgt

SEQ ID NO: 3552662 - DNA, 13 bp, Homo sapiens
aatagtagatgtg

SEQ ID NO: 3552663 - DNA, 21 bp, Homo sapiens
aatagtatcctccaggttttt

SEQ ID NO: 3552664 - DNA, 23 bp, Homo sapiens
aatagtatcctccaggtttttca

SEQ ID NO: 3552665 - DNA, 14 bp, Homo sapiens
aatagtatgaaaat

SEQ ID NO: 3552666 - DNA, 18 bp, Homo sapiens
aatagtatgaaaatggaa

SEQ ID NO: 3552667 - DNA, 18 bp, Homo sapiens
aatagttgccaatctaaa

SEQ ID NO: 3552668 - DNA, 13 bp, Homo sapiens
aatataaaaataa

SEQ ID NO: 3552669 - DNA, 18 bp, Homo sapiens
aatatagacattctcaca

SEQ ID NO: 3552670 - DNA, 19 bp, Homo sapiens
aatatagacattctcacat

SEQ ID NO: 3552671 - DNA, 20 bp, Homo sapiens
aatatagacattctcacata

SEQ ID NO: 3552672 - DNA, 22 bp, Homo sapiens
aatatagatgtaatttttcaaa

SEQ ID NO: 3552673 - DNA, 20 bp, Homo sapiens
aatatataaagtatatgttc

SEQ ID NO: 3552674 - DNA, 20 bp, Homo sapiens
aatatatctaccccagacta

SEQ ID NO: 3552675 - DNA, 21 bp, Homo sapiens
aatatatttataaggaaattt

SEQ ID NO: 3552676 - DNA, 15 bp, Homo sapiens
aatatatttgtcact

SEQ ID NO: 3552677 - DNA, 18 bp, Homo sapiens
aatatcaccaaaaaccta

SEQ ID NO: 3552678 - DNA, 16 bp, Homo sapiens
aatatcgttagggtga

SEQ ID NO: 3552679 - DNA, 23 bp, Homo sapiens
aatatgaaattttttttcatgct

SEQ ID NO: 3552680 - DNA, 19 bp, Homo sapiens
aatatgagtacaaatgcct

SEQ ID NO: 3552681 - DNA, 13 bp, Homo sapiens
aatatgcaagcag

SEQ ID NO: 3552682 - DNA, 17 bp, Homo sapiens
aatatgcaagcagcttt

SEQ ID NO: 3552683 - DNA, 21 bp, Homo sapiens
aatatgcaagcagctttttat

SEQ ID NO: 3552684 - DNA, 14 bp, Homo sapiens
aatatggatttgtt

SEQ ID NO: 3552685 - DNA, 20 bp, Homo sapiens
aatatgtttggaatattcca

SEQ ID NO: 3552686 - DNA, 20 bp, Homo sapiens
aatattacagataaaatgta

SEQ ID NO: 3552687 - DNA, 18 bp, Homo sapiens
aatattatacttctttat

SEQ ID NO: 3552688 - DNA, 15 bp, Homo sapiens
aatattcctgcattt

SEQ ID NO: 3552689 - DNA, 17 bp, Homo sapiens
aatattgacttgtatat

SEQ ID NO: 3552690 - DNA, 14 bp, Homo sapiens
aatattgactttgt

SEQ ID NO: 3552691 - DNA, 15 bp, Homo sapiens
aatattgactttgtc

SEQ ID NO: 3552692 - DNA, 16 bp, Homo sapiens
aatattgactttgtct

SEQ ID NO: 3552693 - DNA, 22 bp, Homo sapiens
aatattgctccatgatgactta

SEQ ID NO: 3552694 - DNA, 17 bp, Homo sapiens
aatattgttttacaata

SEQ ID NO: 3552695 - DNA, 18 bp, Homo sapiens
aatattgttttacaatag

SEQ ID NO: 3552696 - DNA, 20 bp, Homo sapiens
aatatttcaggttcttcaga

SEQ ID NO: 3552697 - DNA, 14 bp, Homo sapiens
aatatttgttttaa

SEQ ID NO: 3552698 - DNA, 15 bp, Homo sapiens
aatattttaattaaa

SEQ ID NO: 3552699 - DNA, 12 bp, Homo sapiens
aatattttgcta

SEQ ID NO: 3552700 - DNA, 23 bp, Homo sapiens
aatatttttatatacagaggaaa

SEQ ID NO: 3552701 - DNA, 16 bp, Homo sapiens
aatatttttgtatttt

SEQ ID NO: 3552702 - DNA, 15 bp, Homo sapiens
aatcaaatatgcaaa

SEQ ID NO: 3552703 - DNA, 22 bp, Homo sapiens
aatcaaatatgcaaagcactga

SEQ ID NO: 3552704 - DNA, 15 bp, Homo sapiens
aatcaaatgtaaagt

SEQ ID NO: 3552705 - DNA, 20 bp, Homo sapiens
aatcaaatgtggctgtatcc

SEQ ID NO: 3552706 - DNA, 15 bp, Homo sapiens
aatcaagaaacttaa

SEQ ID NO: 3552707 - DNA, 10 bp, Homo sapiens
aatcaagaga

SEQ ID NO: 3552708 - DNA, 13 bp, Homo sapiens
aatcaagagaaac

SEQ ID NO: 3552709 - DNA, 14 bp, Homo sapiens
aatcaagagaaact

SEQ ID NO: 3552710 - DNA, 22 bp, Homo sapiens
aatcaagccatgtataaatgtg

SEQ ID NO: 3552711 - DNA, 15 bp, Homo sapiens
aatcaaggataaata

SEQ ID NO: 3552712 - DNA, 15 bp, Homo sapiens
aatcaagtattttgt

SEQ ID NO: 3552713 - DNA, 13 bp, Homo sapiens
aatcacagggaat

SEQ ID NO: 3552714 - DNA, 17 bp, Homo sapiens
aatcaccatctttgtca

SEQ ID NO: 3552715 - DNA, 16 bp, Homo sapiens
aatcactggattataa

SEQ ID NO: 3552716 - DNA, 17 bp, Homo sapiens
aatcactgtgcttaatt

SEQ ID NO: 3552717 - DNA, 14 bp, Homo sapiens
aatcagaaaaccca

SEQ ID NO: 3552718 - DNA, 15 bp, Homo sapiens
aatcagaaaacccac

SEQ ID NO: 3552719 - DNA, 17 bp, Homo sapiens
aatcagaacaaaacttc

SEQ ID NO: 3552720 - DNA, 18 bp, Homo sapiens
aatcagaacaaaacttct

SEQ ID NO: 3552721 - DNA, 19 bp, Homo sapiens
aatcagaacaaaacttcta

SEQ ID NO: 3552722 - DNA, 12 bp, Homo sapiens
aatcagaactca

SEQ ID NO: 3552723 - DNA, 11 bp, Homo sapiens
aatcagctgga

SEQ ID NO: 3552724 - DNA, 21 bp, Homo sapiens
aatcaggcatgtgtcccttcc

SEQ ID NO: 3552725 - DNA, 20 bp, Homo sapiens
aatcatacaaactctcacca

SEQ ID NO: 3552726 - DNA, 21 bp, Homo sapiens
aatcatacaaactctcaccat

SEQ ID NO: 3552727 - DNA, 15 bp, Homo sapiens
aatcatatagaccaa

SEQ ID NO: 3552728 - DNA, 13 bp, Homo sapiens
aatcatatttgaa

SEQ ID NO: 3552729 - DNA, 17 bp, Homo sapiens
aatcattcttactaaaa

SEQ ID NO: 3552730 - DNA, 20 bp, Homo sapiens
aatccaaaaagctctgaaaa

SEQ ID NO: 3552731 - DNA, 12 bp, Homo sapiens
aatccaccccca

SEQ ID NO: 3552732 - DNA, 14 bp, Homo sapiens
aatccacccccagg

SEQ ID NO: 3552733 - DNA, 15 bp, Homo sapiens
aatccagaaggaagc

SEQ ID NO: 3552734 - DNA, 18 bp, Homo sapiens
aatccagaaggaagctcg

SEQ ID NO: 3552735 - DNA, 17 bp, Homo sapiens
aatccagtggtgggtaa

SEQ ID NO: 3552736 - DNA, 18 bp, Homo sapiens
aatccagtggtgggtaat

SEQ ID NO: 3552737 - DNA, 18 bp, Homo sapiens
aatccatttcaggactct

SEQ ID NO: 3552738 - DNA, 15 bp, Homo sapiens
aatcccaatctttct

SEQ ID NO: 3552739 - DNA, 14 bp, Homo sapiens
aatcctagactgct

SEQ ID NO: 3552740 - DNA, 19 bp, Homo sapiens
aatcctcctacctcagcct

SEQ ID NO: 3552741 - DNA, 18 bp, Homo sapiens
aatcctcttgagagaaac

SEQ ID NO: 3552742 - DNA, 20 bp, Homo sapiens
aatcctgaactttctccctc

SEQ ID NO: 3552743 - DNA, 18 bp, Homo sapiens
aatcctgtatataaaata

SEQ ID NO: 3552744 - DNA, 20 bp, Homo sapiens
aatccttcaaaataaaaagt

SEQ ID NO: 3552745 - DNA, 17 bp, Homo sapiens
aatccttgcttatgaca

SEQ ID NO: 3552746 - DNA, 13 bp, Homo sapiens
aatccttttcctt

SEQ ID NO: 3552747 - DNA, 14 bp, Homo sapiens
aatcgtttttaatt

SEQ ID NO: 3552748 - DNA, 20 bp, Homo sapiens
aatctaaaagctctgttcca

SEQ ID NO: 3552749 - DNA, 16 bp, Homo sapiens
aatctaatctgaactg

SEQ ID NO: 3552750 - DNA, 22 bp, Homo sapiens
aatctaatgtgagtgtgaagct

SEQ ID NO: 3552751 - DNA, 21 bp, Homo sapiens
aatctagttgtcaataaatgg

SEQ ID NO: 3552752 - DNA, 15 bp, Homo sapiens
aatctctacaaaccc

SEQ ID NO: 3552753 - DNA, 19 bp, Homo sapiens
aatctctcaaatctgttat

SEQ ID NO: 3552754 - DNA, 17 bp, Homo sapiens
aatctcttcaaattctt

SEQ ID NO: 3552755 - DNA, 13 bp, Homo sapiens
aatctgacatatt

SEQ ID NO: 3552756 - DNA, 14 bp, Homo sapiens
aatctgacatatta

SEQ ID NO: 3552757 - DNA, 17 bp, Homo sapiens
aatctgacccagtgccc

SEQ ID NO: 3552758 - DNA, 21 bp, Homo sapiens
aatctgcttcatccaatgtga

SEQ ID NO: 3552759 - DNA, 19 bp, Homo sapiens
aatctgcttgtattccaag

SEQ ID NO: 3552760 - DNA, 16 bp, Homo sapiens
aatctggattcatatt

SEQ ID NO: 3552761 - DNA, 18 bp, Homo sapiens
aatctggattcatattta

SEQ ID NO: 3552762 - DNA, 19 bp, Homo sapiens
aatctggattcatatttaa

SEQ ID NO: 3552763 - DNA, 19 bp, Homo sapiens
aatctgtgctgtttcaaag

SEQ ID NO: 3552764 - DNA, 22 bp, Homo sapiens
aatctgtgctgtttcaaagttc

SEQ ID NO: 3552765 - DNA, 15 bp, Homo sapiens
aatcttaaacataat

SEQ ID NO: 3552766 - DNA, 20 bp, Homo sapiens
aatcttaaacataataaatc

SEQ ID NO: 3552767 - DNA, 21 bp, Homo sapiens
aatcttagtgtatgattactg

SEQ ID NO: 3552768 - DNA, 14 bp, Homo sapiens
aatcttattgttta

SEQ ID NO: 3552769 - DNA, 21 bp, Homo sapiens
aatcttcactttcttaagcaa

SEQ ID NO: 3552770 - DNA, 12 bp, Homo sapiens
aatcttccaaag

SEQ ID NO: 3552771 - DNA, 13 bp, Homo sapiens
aatcttccaaaga

SEQ ID NO: 3552772 - DNA, 10 bp, Homo sapiens
aatcttcctg

SEQ ID NO: 3552773 - DNA, 17 bp, Homo sapiens
aatcttcctggcacaat

SEQ ID NO: 3552774 - DNA, 16 bp, Homo sapiens
aatcttgaatttctgc

SEQ ID NO: 3552775 - DNA, 19 bp, Homo sapiens
aatcttgtaggtcattgca

SEQ ID NO: 3552776 - DNA, 12 bp, Homo sapiens
aatctttcaaaa

SEQ ID NO: 3552777 - DNA, 15 bp, Homo sapiens
aatctttcatgtctt

SEQ ID NO: 3552778 - DNA, 17 bp, Homo sapiens
aatctttttatcccatt

SEQ ID NO: 3552779 - DNA, 13 bp, Homo sapiens
aatgaaaaaagca

SEQ ID NO: 3552780 - DNA, 21 bp, Homo sapiens
aatgaaacaaaaaaaaaatga

SEQ ID NO: 3552781 - DNA, 15 bp, Homo sapiens
aatgaaagtattggc

SEQ ID NO: 3552782 - DNA, 12 bp, Homo sapiens
aatgaaatcttc

SEQ ID NO: 3552783 - DNA, 18 bp, Homo sapiens
aatgaaatttaattacaa

SEQ ID NO: 3552784 - DNA, 16 bp, Homo sapiens
aatgacaaaagataca

SEQ ID NO: 3552785 - DNA, 23 bp, Homo sapiens
acaaaagctttttaaaatttaga

SEQ ID NO: 3552786 - DNA, 22 bp, Homo sapiens
acaaaaggaaaataaatgaaca

SEQ ID NO: 3552787 - DNA, 14 bp, Homo sapiens
acaaaatgaaagaa

SEQ ID NO: 3552788 - DNA, 20 bp, Homo sapiens
acaaaatgtagggttataat

SEQ ID NO: 3552789 - DNA, 10 bp, Homo sapiens
acaaacaaaa

SEQ ID NO: 3552790 - DNA, 12 bp, Homo sapiens
acaaacaaaact

SEQ ID NO: 3552791 - DNA, 13 bp, Homo sapiens
acaaacaaatttt

SEQ ID NO: 3552792 - DNA, 12 bp, Homo sapiens
acaaactccagg

SEQ ID NO: 3552793 - DNA, 13 bp, Homo sapiens
acaaactccaggc

SEQ ID NO: 3552794 - DNA, 15 bp, Homo sapiens
acaaactccaggctg

SEQ ID NO: 3552795 - DNA, 19 bp, Homo sapiens
acaaactggcttaataata

SEQ ID NO: 3552796 - DNA, 19 bp, Homo sapiens
acaaagaaccatgcaggaa

SEQ ID NO: 3552797 - DNA, 15 bp, Homo sapiens
acaaagaacttgctg

SEQ ID NO: 3552798 - DNA, 20 bp, Homo sapiens
acaaagaacttgctgctgcc

SEQ ID NO: 3552799 - DNA, 15 bp, Homo sapiens
acaaagaagaaagct

SEQ ID NO: 3552800 - DNA, 13 bp, Homo sapiens
acaaagacattga

SEQ ID NO: 3552801 - DNA, 15 bp, Homo sapiens
acaaagacattgaca

SEQ ID NO: 3552802 - DNA, 17 bp, Homo sapiens
acaaagacattgacagc

SEQ ID NO: 3552803 - DNA, 22 bp, Homo sapiens
acaaagcagctttaaaaaaata

SEQ ID NO: 3552804 - DNA, 18 bp, Homo sapiens
acaaagcccttccatgtc

SEQ ID NO: 3552805 - DNA, 12 bp, Homo sapiens
acaaagggaaaa

SEQ ID NO: 3552806 - DNA, 15 bp, Homo sapiens
acaaagggaaaaaag

SEQ ID NO: 3552807 - DNA, 22 bp, Homo sapiens
acaaagggaaaaaagagtttaa

SEQ ID NO: 3552808 - DNA, 19 bp, Homo sapiens
acaaagggaaagcctctgg

SEQ ID NO: 3552809 - DNA, 21 bp, Homo sapiens
acaaagggaaagcctctggcc

SEQ ID NO: 3552810 - DNA, 15 bp, Homo sapiens
acaaagggccatcgt

SEQ ID NO: 3552811 - DNA, 17 bp, Homo sapiens
acaaaggggcttaatta

SEQ ID NO: 3552812 - DNA, 16 bp, Homo sapiens
acaaagtccaagtctg

SEQ ID NO: 3552813 - DNA, 16 bp, Homo sapiens
acaaataacaagaata

SEQ ID NO: 3552814 - DNA, 14 bp, Homo sapiens
acaaataatttaga

SEQ ID NO: 3552815 - DNA, 19 bp, Homo sapiens
acaaatacaatacatagga

SEQ ID NO: 3552816 - DNA, 16 bp, Homo sapiens
acaaatcagaagtcat

SEQ ID NO: 3552817 - DNA, 17 bp, Homo sapiens
acaaatgactgtctctt

SEQ ID NO: 3552818 - DNA, 13 bp, Homo sapiens
acaaatttataaa

SEQ ID NO: 3552819 - DNA, 18 bp, Homo sapiens
acaaatttttctgcttta

SEQ ID NO: 3552820 - DNA, 14 bp, Homo sapiens
acaacagcagtctc

SEQ ID NO: 3552821 - DNA, 17 bp, Homo sapiens
acaacagccctgcctga

SEQ ID NO: 3552822 - DNA, 16 bp, Homo sapiens
acaacatccaagtggc

SEQ ID NO: 3552823 - DNA, 23 bp, Homo sapiens
acaacatccaagtggcctccgtc

SEQ ID NO: 3552824 - DNA, 13 bp, Homo sapiens
acaacatgttcta

SEQ ID NO: 3552825 - DNA, 16 bp, Homo sapiens
acaaccccctccaccc

SEQ ID NO: 3552826 - DNA, 17 bp, Homo sapiens
acaacccttctctgttg

SEQ ID NO: 3552827 - DNA, 23 bp, Homo sapiens
acaacctgtgtgagagaatttat

SEQ ID NO: 3552828 - DNA, 18 bp, Homo sapiens
acaaccttctgtggctca

SEQ ID NO: 3552829 - DNA, 20 bp, Homo sapiens
acaactactagtgtgactcc

SEQ ID NO: 3552830 - DNA, 16 bp, Homo sapiens
acaactggaagctttg

SEQ ID NO: 3552831 - DNA, 14 bp, Homo sapiens
acaactgtgaagcc

SEQ ID NO: 3552832 - DNA, 13 bp, Homo sapiens
acaacttagtgta

SEQ ID NO: 3552833 - DNA, 17 bp, Homo sapiens
acaactttaagaggaca

SEQ ID NO: 3552834 - DNA, 10 bp, Homo sapiens
acaagaaaat

SEQ ID NO: 3552835 - DNA, 21 bp, Homo sapiens
acaagaaggtggaaggcagtg

SEQ ID NO: 3552836 - DNA, 15 bp, Homo sapiens
acaagagctgttatg

SEQ ID NO: 3552837 - DNA, 15 bp, Homo sapiens
acaagatgtgggcct

SEQ ID NO: 3552838 - DNA, 14 bp, Homo sapiens
acaagcagcccttg

SEQ ID NO: 3552839 - DNA, 17 bp, Homo sapiens
acaagcagcccttgctt

SEQ ID NO: 3552840 - DNA, 14 bp, Homo sapiens
acaagccaaagagc

SEQ ID NO: 3552841 - DNA, 23 bp, Homo sapiens
acaagccaaagagcctcccacca

SEQ ID NO: 3552842 - DNA, 16 bp, Homo sapiens
acaagctgtccctgca

SEQ ID NO: 3552843 - DNA, 18 bp, Homo sapiens
acaagctgtgcaggcatg

SEQ ID NO: 3552844 - DNA, 15 bp, Homo sapiens
acaaggaaccctcag

SEQ ID NO: 3552845 - DNA, 19 bp, Homo sapiens
acaaggaaccctcaggcca

SEQ ID NO: 3552846 - DNA, 15 bp, Homo sapiens
acaaggacttcctgt

SEQ ID NO: 3552847 - DNA, 13 bp, Homo sapiens
acaaggcccagga

SEQ ID NO: 3552848 - DNA, 21 bp, Homo sapiens
acaaggtggggattgcccctg

SEQ ID NO: 3552849 - DNA, 16 bp, Homo sapiens
acaagtaatattatta

SEQ ID NO: 3552850 - DNA, 23 bp, Homo sapiens
acaagtgaaataacaaaatggac

SEQ ID NO: 3552851 - DNA, 13 bp, Homo sapiens
acaagtggtggta

SEQ ID NO: 3552852 - DNA, 17 bp, Homo sapiens
acaagttccaacatgca

SEQ ID NO: 3552853 - DNA, 16 bp, Homo sapiens
acaagttttggcagcc

SEQ ID NO: 3552854 - DNA, 18 bp, Homo sapiens
acaagttttggcagccat

SEQ ID NO: 3552855 - DNA, 20 bp, Homo sapiens
acaagttttggcagccatga

SEQ ID NO: 3552856 - DNA, 19 bp, Homo sapiens
acaatacctacaataaact

SEQ ID NO: 3552857 - DNA, 21 bp, Homo sapiens
acaatacctacaataaactgg

SEQ ID NO: 3552858 - DNA, 21 bp, Homo sapiens
acaatataagagcttccaatt

SEQ ID NO: 3552859 - DNA, 15 bp, Homo sapiens
acaatattgtgcatg

SEQ ID NO: 3552860 - DNA, 16 bp, Homo sapiens
acaatcagaaactctt

SEQ ID NO: 3552861 - DNA, 17 bp, Homo sapiens
acaatcccaatctttct

SEQ ID NO: 3552862 - DNA, 16 bp, Homo sapiens
acaatctttcatgtct

SEQ ID NO: 3552863 - DNA, 17 bp, Homo sapiens
acaatgagtttgggcat

SEQ ID NO: 3552864 - DNA, 20 bp, Homo sapiens
acaatgatatccaatattaa

SEQ ID NO: 3552865 - DNA, 23 bp, Homo sapiens
acaatgtagatggcctcttacta

SEQ ID NO: 3552866 - DNA, 15 bp, Homo sapiens
acaatgttggagcag

SEQ ID NO: 3552867 - DNA, 16 bp, Homo sapiens
acaatgttggagcagc

SEQ ID NO: 3552868 - DNA, 22 bp, Homo sapiens
acaatgttggagcagcaggcct

SEQ ID NO: 3552869 - DNA, 16 bp, Homo sapiens
acaatgttttaacaag

SEQ ID NO: 3552870 - DNA, 13 bp, Homo sapiens
acaattattggca

SEQ ID NO: 3552871 - DNA, 17 bp, Homo sapiens
acaattattggcaaagt

SEQ ID NO: 3552872 - DNA, 22 bp, Homo sapiens
acaattttacctattctgaaaa

SEQ ID NO: 3552873 - DNA, 18 bp, Homo sapiens
acacaataggtctttctc

SEQ ID NO: 3552874 - DNA, 13 bp, Homo sapiens
acacaccttggag

SEQ ID NO: 3552875 - DNA, 13 bp, Homo sapiens
acacacgctgcct

SEQ ID NO: 3552876 - DNA, 13 bp, Homo sapiens
acacacggggctc

SEQ ID NO: 3552877 - DNA, 17 bp, Homo sapiens
acacactggtacttaga

SEQ ID NO: 3552878 - DNA, 23 bp, Homo sapiens
acacagactgcgatttgtcccag

SEQ ID NO: 3552879 - DNA, 20 bp, Homo sapiens
acacagaggaatttatacct

SEQ ID NO: 3552880 - DNA, 13 bp, Homo sapiens
acacagctcttca

SEQ ID NO: 3552881 - DNA, 13 bp, Homo sapiens
acacagctgccct

SEQ ID NO: 3552882 - DNA, 14 bp, Homo sapiens
acacagctgcccta

SEQ ID NO: 3552883 - DNA, 16 bp, Homo sapiens
acacagctgccctagc

SEQ ID NO: 3552884 - DNA, 13 bp, Homo sapiens
acacaggccctcc

SEQ ID NO: 3552885 - DNA, 16 bp, Homo sapiens
acacaggctgtcctta

SEQ ID NO: 3552886 - DNA, 21 bp, Homo sapiens
acacagtagctccaacacttt

SEQ ID NO: 3552887 - DNA, 18 bp, Homo sapiens
acacagttctgggcaaag

SEQ ID NO: 3552888 - DNA, 17 bp, Homo sapiens
acacatatgagggggaa

SEQ ID NO: 3552889 - DNA, 15 bp, Homo sapiens
acacatcagcttgcc

SEQ ID NO: 3552890 - DNA, 23 bp, Homo sapiens
acacattatattctcttatgata

SEQ ID NO: 3552891 - DNA, 22 bp, Homo sapiens
acacatttgggatgttcctttt

SEQ ID NO: 3552892 - DNA, 19 bp, Homo sapiens
acacatttttaaattgtta

SEQ ID NO: 3552893 - DNA, 18 bp, Homo sapiens
acaccacacttgttttct

SEQ ID NO: 3552894 - DNA, 22 bp, Homo sapiens
acaccacgtccttattggaata

SEQ ID NO: 3552895 - DNA, 14 bp, Homo sapiens
acaccagacagaca

SEQ ID NO: 3552896 - DNA, 19 bp, Homo sapiens
acaccagcattccttttga

SEQ ID NO: 3552897 - DNA, 15 bp, Homo sapiens
acaccattttgtaaa

SEQ ID NO: 3552898 - DNA, 13 bp, Homo sapiens
acacccaccccct

SEQ ID NO: 3552899 - DNA, 14 bp, Homo sapiens
acacccaccccctc

SEQ ID NO: 3552900 - DNA, 14 bp, Homo sapiens
acacccatgaaaga

SEQ ID NO: 3552901 - DNA, 12 bp, Homo sapiens
acaccccctccc

SEQ ID NO: 3552902 - DNA, 21 bp, Homo sapiens
acaccccctccccgcccctgt

SEQ ID NO: 3552903 - DNA, 19 bp, Homo sapiens
acaccccctttccatctgt

SEQ ID NO: 3552904 - DNA, 13 bp, Homo sapiens
acaccctctgggg

SEQ ID NO: 3552905 - DNA, 22 bp, Homo sapiens
acaccctctgggggtcctctct

SEQ ID NO: 3552906 - DNA, 23 bp, Homo sapiens
acaccctctgggggtcctctctg

SEQ ID NO: 3552907 - DNA, 11 bp, Homo sapiens
acaccctggat

SEQ ID NO: 3552908 - DNA, 14 bp, Homo sapiens
acaccctggcctga

SEQ ID NO: 3552909 - DNA, 23 bp, Homo sapiens
acaccgtggcagcttgctgggct

SEQ ID NO: 3552910 - DNA, 18 bp, Homo sapiens
acaccgttcattcaggca

SEQ ID NO: 3552911 - DNA, 16 bp, Homo sapiens
acaccgtttagaaaaa

SEQ ID NO: 3552912 - DNA, 21 bp, Homo sapiens
acacctactagtcaccagaga

SEQ ID NO: 3552913 - DNA, 19 bp, Homo sapiens
acacctcccaggagacagt

SEQ ID NO: 3552914 - DNA, 13 bp, Homo sapiens
acacctccccctt

SEQ ID NO: 3552915 - DNA, 23 bp, Homo sapiens
acacctcgctgttgtcacatctc

SEQ ID NO: 3552916 - DNA, 21 bp, Homo sapiens
acacctcgtcaagagcatgca

SEQ ID NO: 3552917 - DNA, 21 bp, Homo sapiens
acacctgaatcagctggacat

SEQ ID NO: 3552918 - DNA, 17 bp, Homo sapiens
acatgagtcaaaacaaa

SEQ ID NO: 3552919 - DNA, 22 bp, Homo sapiens
acatgatccccgtctctgccct

SEQ ID NO: 3552920 - DNA, 17 bp, Homo sapiens
acatgatcttctttata

SEQ ID NO: 3552921 - DNA, 19 bp, Homo sapiens
acatgatcttctttataat

SEQ ID NO: 3552922 - DNA, 21 bp, Homo sapiens
acatgcagaaattgacctgat

SEQ ID NO: 3552923 - DNA, 17 bp, Homo sapiens
acatgcagttatatatt

SEQ ID NO: 3552924 - DNA, 13 bp, Homo sapiens
acatgcatataat

SEQ ID NO: 3552925 - DNA, 18 bp, Homo sapiens
acatgcattcacatatct

SEQ ID NO: 3552926 - DNA, 14 bp, Homo sapiens
acatgccacaagga

SEQ ID NO: 3552927 - DNA, 23 bp, Homo sapiens
acatgctgcctggcacagaccag

SEQ ID NO: 3552928 - DNA, 14 bp, Homo sapiens
acatgctgtctggc

SEQ ID NO: 3552929 - DNA, 17 bp, Homo sapiens
acatgctgtctggccct

SEQ ID NO: 3552930 - DNA, 15 bp, Homo sapiens
acatggaacagtgta

SEQ ID NO: 3552931 - DNA, 16 bp, Homo sapiens
acatggaacagtgtaa

SEQ ID NO: 3552932 - DNA, 19 bp, Homo sapiens
acatggccatcttctttct

SEQ ID NO: 3552933 - DNA, 21 bp, Homo sapiens
acatggggaggttgtggggcc

SEQ ID NO: 3552934 - DNA, 13 bp, Homo sapiens
acatgggttcaat

SEQ ID NO: 3552935 - DNA, 20 bp, Homo sapiens
acatgtcagccactgtgata

SEQ ID NO: 3552936 - DNA, 14 bp, Homo sapiens
acatgtgacattta

SEQ ID NO: 3552937 - DNA, 15 bp, Homo sapiens
acatgtgacatttat

SEQ ID NO: 3552938 - DNA, 22 bp, Homo sapiens
acatgtgttttcatcatttcag

SEQ ID NO: 3552939 - DNA, 19 bp, Homo sapiens
acatgttggaaatgtgttt

SEQ ID NO: 3552940 - DNA, 14 bp, Homo sapiens
acatgttttttcat

SEQ ID NO: 3552941 - DNA, 22 bp, Homo sapiens
acatgttttttcatttgtaaaa

SEQ ID NO: 3552942 - DNA, 13 bp, Homo sapiens
acattaaaataaa

SEQ ID NO: 3552943 - DNA, 16 bp, Homo sapiens
acattaaaataaacca

SEQ ID NO: 3552944 - DNA, 17 bp, Homo sapiens
acattaaaataaaccaa

SEQ ID NO: 3552945 - DNA, 21 bp, Homo sapiens
acattaaatgtggaaggaaaa

SEQ ID NO: 3552946 - DNA, 14 bp, Homo sapiens
acattaacggtgct

SEQ ID NO: 3552947 - DNA, 18 bp, Homo sapiens
acattaacggtgctaaaa

SEQ ID NO: 3552948 - DNA, 16 bp, Homo sapiens
acattaatatttacca

SEQ ID NO: 3552949 - DNA, 17 bp, Homo sapiens
acattaatatttaccaa

SEQ ID NO: 3552950 - DNA, 19 bp, Homo sapiens
acattaatatttaccaaag

SEQ ID NO: 3552951 - DNA, 20 bp, Homo sapiens
acattaatatttaccaaagt

SEQ ID NO: 3552952 - DNA, 13 bp, Homo sapiens
acattactaaata

SEQ ID NO: 3552953 - DNA, 14 bp, Homo sapiens
acattacttattta

SEQ ID NO: 3552954 - DNA, 18 bp, Homo sapiens
acattagagaaaacctta

SEQ ID NO: 3552955 - DNA, 18 bp, Homo sapiens
acattagcagtttgcttt

SEQ ID NO: 3552956 - DNA, 22 bp, Homo sapiens
acattattaagtaacttattta

SEQ ID NO: 3552957 - DNA, 20 bp, Homo sapiens
acattcagactaaaaataca

SEQ ID NO: 3552958 - DNA, 16 bp, Homo sapiens
acattcagctctggag

SEQ ID NO: 3552959 - DNA, 17 bp, Homo sapiens
acattcctccagcctcc

SEQ ID NO: 3552960 - DNA, 18 bp, Homo sapiens
acattctcacataagccc

SEQ ID NO: 3552961 - DNA, 19 bp, Homo sapiens
acattctgcctagagtgta

SEQ ID NO: 3552962 - DNA, 22 bp, Homo sapiens
acattctgcctagagtgtagcc

SEQ ID NO: 3552963 - DNA, 23 bp, Homo sapiens
acattctgcctagagtgtagcct

SEQ ID NO: 3552964 - DNA, 13 bp, Homo sapiens
acattgacagcaa

SEQ ID NO: 3552965 - DNA, 15 bp, Homo sapiens
acattgacagcaatt

SEQ ID NO: 3552966 - DNA, 13 bp, Homo sapiens
acattgctggctg

SEQ ID NO: 3552967 - DNA, 15 bp, Homo sapiens
acattgctggctgcc

SEQ ID NO: 3552968 - DNA, 16 bp, Homo sapiens
acattggagcctgggc

SEQ ID NO: 3552969 - DNA, 21 bp, Homo sapiens
acattggcacctaatccaggc

SEQ ID NO: 3552970 - DNA, 22 bp, Homo sapiens
acattggttctttcatttgctt

SEQ ID NO: 3552971 - DNA, 18 bp, Homo sapiens
acatttaaaacattaaaa

SEQ ID NO: 3552972 - DNA, 16 bp, Homo sapiens
acatttaggattttgt

SEQ ID NO: 3552973 - DNA, 15 bp, Homo sapiens
acatttagtcctgta

SEQ ID NO: 3552974 - DNA, 16 bp, Homo sapiens
acatttcatacaacag

SEQ ID NO: 3552975 - DNA, 16 bp, Homo sapiens
acatttctcatgttga

SEQ ID NO: 3552976 - DNA, 14 bp, Homo sapiens
acatttctggacag

SEQ ID NO: 3552977 - DNA, 15 bp, Homo sapiens
acatttctggacagt

SEQ ID NO: 3552978 - DNA, 13 bp, Homo sapiens
acatttctttgga

SEQ ID NO: 3552979 - DNA, 21 bp, Homo sapiens
acatttgctttaatgagtgca

SEQ ID NO: 3552980 - DNA, 17 bp, Homo sapiens
acatttgggagacatgt

SEQ ID NO: 3552981 - DNA, 20 bp, Homo sapiens
acatttgggagacatgtgac

SEQ ID NO: 3552982 - DNA, 18 bp, Homo sapiens
acattttactttttcctg

SEQ ID NO: 3552983 - DNA, 21 bp, Homo sapiens
acattttccgcccactcctgg

SEQ ID NO: 3552984 - DNA, 20 bp, Homo sapiens
acatttttaaattgttagct

SEQ ID NO: 3552985 - DNA, 11 bp, Homo sapiens
acatttttgcc

SEQ ID NO: 3552986 - DNA, 14 bp, Homo sapiens
acattttttcttct

SEQ ID NO: 3552987 - DNA, 21 bp, Homo sapiens
acattttttcttctgaagatt

SEQ ID NO: 3552988 - DNA, 13 bp, Homo sapiens
accaaaagacatt

SEQ ID NO: 3552989 - DNA, 17 bp, Homo sapiens
accaaaagacattagag

SEQ ID NO: 3552990 - DNA, 21 bp, Homo sapiens
accaaacaatattgctccatg

SEQ ID NO: 3552991 - DNA, 17 bp, Homo sapiens
accaaagacatcagtct

SEQ ID NO: 3552992 - DNA, 20 bp, Homo sapiens
accaaagcaccttagctggc

SEQ ID NO: 3552993 - DNA, 13 bp, Homo sapiens
accaaagcatcaa

SEQ ID NO: 3552994 - DNA, 19 bp, Homo sapiens
accaaaggaaaatgtctgt

SEQ ID NO: 3552995 - DNA, 16 bp, Homo sapiens
accaaatatgttaaag

SEQ ID NO: 3552996 - DNA, 13 bp, Homo sapiens
accaaatgtagtt

SEQ ID NO: 3552997 - DNA, 17 bp, Homo sapiens
accaacagaaacctttt

SEQ ID NO: 3552998 - DNA, 21 bp, Homo sapiens
accaacagaaaccttttattt

SEQ ID NO: 3552999 - DNA, 13 bp, Homo sapiens
accaaccacagca

SEQ ID NO: 3553000 - DNA, 18 bp, Homo sapiens
accaacctccagactcag

SEQ ID NO: 3553001 - DNA, 14 bp, Homo sapiens
accaagccgtggct

SEQ ID NO: 3553002 - DNA, 15 bp, Homo sapiens
accaagctcaccctt

SEQ ID NO: 3553003 - DNA, 19 bp, Homo sapiens
accaaggaatttaaaactg

SEQ ID NO: 3553004 - DNA, 13 bp, Homo sapiens
accaatcccaact

SEQ ID NO: 3553005 - DNA, 17 bp, Homo sapiens
accaattgaagcatgaa

SEQ ID NO: 3553006 - DNA, 23 bp, Homo sapiens
accacagactttagctttctgag

SEQ ID NO: 3553007 - DNA, 15 bp, Homo sapiens
accacagcaactgac

SEQ ID NO: 3553008 - DNA, 23 bp, Homo sapiens
accacagcatcgggagcacccag

SEQ ID NO: 3553009 - DNA, 16 bp, Homo sapiens
accacatctaagcctg

SEQ ID NO: 3553010 - DNA, 15 bp, Homo sapiens
accacattgaagaat

SEQ ID NO: 3553011 - DNA, 16 bp, Homo sapiens
accacccggtccccac

SEQ ID NO: 3553012 - DNA, 19 bp, Homo sapiens
accaccgttcagtcatttt

SEQ ID NO: 3553013 - DNA, 12 bp, Homo sapiens
accactcaggcc

SEQ ID NO: 3553014 - DNA, 14 bp, Homo sapiens
accactcaggccac

SEQ ID NO: 3553015 - DNA, 13 bp, Homo sapiens
accactccccaac

SEQ ID NO: 3553016 - DNA, 22 bp, Homo sapiens
accactccccaacccctctcca

SEQ ID NO: 3553017 - DNA, 21 bp, Homo sapiens
accactccttcatgtttggaa

SEQ ID NO: 3553018 - DNA, 23 bp, Homo sapiens
accactgggccataatgttgctt

SEQ ID NO: 3553019 - DNA, 20 bp, Homo sapiens
accactgtacacacccgcct

SEQ ID NO: 3553020 - DNA, 16 bp, Homo sapiens
accagaacgcacccca

SEQ ID NO: 3553021 - DNA, 16 bp, Homo sapiens
accagaactttttcct

SEQ ID NO: 3553022 - DNA, 17 bp, Homo sapiens
accagacacccaggact

SEQ ID NO: 3553023 - DNA, 15 bp, Homo sapiens
accagacggggctgg

SEQ ID NO: 3553024 - DNA, 14 bp, Homo sapiens
accagagccgggag

SEQ ID NO: 3553025 - DNA, 13 bp, Homo sapiens
accagcacatcca

SEQ ID NO: 3553026 - DNA, 21 bp, Homo sapiens
accagcatccacactgccggc

SEQ ID NO: 3553027 - DNA, 21 bp, Homo sapiens
accagccagcgtcccttggtg

SEQ ID NO: 3553028 - DNA, 18 bp, Homo sapiens
accagcccgacagtgcca

SEQ ID NO: 3553029 - DNA, 22 bp, Homo sapiens
accagcccgacagtgccatccc

SEQ ID NO: 3553030 - DNA, 21 bp, Homo sapiens
accagcctagcctggctctgc

SEQ ID NO: 3553031 - DNA, 14 bp, Homo sapiens
accagcctgaccaa

SEQ ID NO: 3553032 - DNA, 18 bp, Homo sapiens
accagcctggccaacatg

SEQ ID NO: 3553033 - DNA, 20 bp, Homo sapiens
accagcctggccaacatggt

SEQ ID NO: 3553034 - DNA, 13 bp, Homo sapiens
accagctcaggac

SEQ ID NO: 3553035 - DNA, 14 bp, Homo sapiens
accagctcaggaca

SEQ ID NO: 3553036 - DNA, 21 bp, Homo sapiens
accagcttgtatgcaatggat

SEQ ID NO: 3553037 - DNA, 14 bp, Homo sapiens
accaggcagtgtgc

SEQ ID NO: 3553038 - DNA, 15 bp, Homo sapiens
accagggatgctggg

SEQ ID NO: 3553039 - DNA, 20 bp, Homo sapiens
accagggatgctgggctggg

SEQ ID NO: 3553040 - DNA, 13 bp, Homo sapiens
accaggggccaac

SEQ ID NO: 3553041 - DNA, 23 bp, Homo sapiens
accaggggccaacctcaggctcc

SEQ ID NO: 3553042 - DNA, 18 bp, Homo sapiens
accagtatttagaagcca

SEQ ID NO: 3553043 - DNA, 23 bp, Homo sapiens
accagtctcctcactctgtccct

SEQ ID NO: 3553044 - DNA, 15 bp, Homo sapiens
accagtgacgctgct

SEQ ID NO: 3553045 - DNA, 14 bp, Homo sapiens
accagttaaaagca

SEQ ID NO: 3553046 - DNA, 12 bp, Homo sapiens
accagttaattt

SEQ ID NO: 3553047 - DNA, 13 bp, Homo sapiens
accagttaatttt

SEQ ID NO: 3553048 - DNA, 22 bp, Homo sapiens
accagtttaagccgcagacctg

SEQ ID NO: 3553049 - DNA, 23 bp, Homo sapiens
accagtttaagccgcagacctgg

SEQ ID NO: 3553050 - DNA, 16 bp, Homo sapiens
actatatataatgtat

SEQ ID NO: 3553051 - DNA, 12 bp, Homo sapiens
actatatgtgaa

SEQ ID NO: 3553052 - DNA, 22 bp, Homo sapiens
actatatttgggcctgctccag

SEQ ID NO: 3553053 - DNA, 14 bp, Homo sapiens
actatcataaaatc

SEQ ID NO: 3553054 - DNA, 19 bp, Homo sapiens
actatctccgttccatctg

SEQ ID NO: 3553055 - DNA, 22 bp, Homo sapiens
actatgatcagaagaacatgat

SEQ ID NO: 3553056 - DNA, 16 bp, Homo sapiens
actatgtaaactactt

SEQ ID NO: 3553057 - DNA, 23 bp, Homo sapiens
actattctgggggcccgacaggt

SEQ ID NO: 3553058 - DNA, 15 bp, Homo sapiens
actattgcatttata

SEQ ID NO: 3553059 - DNA, 21 bp, Homo sapiens
actatttttatttttaaatta

SEQ ID NO: 3553060 - DNA, 15 bp, Homo sapiens
actcaaaatatttgt

SEQ ID NO: 3553061 - DNA, 20 bp, Homo sapiens
actcaaaatatttgtacata

SEQ ID NO: 3553062 - DNA, 22 bp, Homo sapiens
actcaaagacttcctctggctc

SEQ ID NO: 3553063 - DNA, 21 bp, Homo sapiens
actcaaatatgagtacaaatg

SEQ ID NO: 3553064 - DNA, 14 bp, Homo sapiens
actcaaatcaagaa

SEQ ID NO: 3553065 - DNA, 20 bp, Homo sapiens
actcaaatggggccagatcc

SEQ ID NO: 3553066 - DNA, 22 bp, Homo sapiens
actcaaatggggccagatccag

SEQ ID NO: 3553067 - DNA, 23 bp, Homo sapiens
actcaaatggggccagatccagc

SEQ ID NO: 3553068 - DNA, 17 bp, Homo sapiens
actcaattatttgcata

SEQ ID NO: 3553069 - DNA, 18 bp, Homo sapiens
actcacccctagccctgg

SEQ ID NO: 3553070 - DNA, 19 bp, Homo sapiens
actcacccctagccctggt

SEQ ID NO: 3553071 - DNA, 15 bp, Homo sapiens
actcaccctgggagc

SEQ ID NO: 3553072 - DNA, 18 bp, Homo sapiens
actcaccctgggagccag

SEQ ID NO: 3553073 - DNA, 20 bp, Homo sapiens
actcactgggaagctcccac

SEQ ID NO: 3553074 - DNA, 19 bp, Homo sapiens
actcactggtggttttccg

SEQ ID NO: 3553075 - DNA, 18 bp, Homo sapiens
actcagacattggcacct

SEQ ID NO: 3553076 - DNA, 16 bp, Homo sapiens
actcagatccagggac

SEQ ID NO: 3553077 - DNA, 19 bp, Homo sapiens
actcagatccagggacaga

SEQ ID NO: 3553078 - DNA, 18 bp, Homo sapiens
actcagatttaagcctta

SEQ ID NO: 3553079 - DNA, 22 bp, Homo sapiens
actcagatttaagccttacaaa

SEQ ID NO: 3553080 - DNA, 19 bp, Homo sapiens
actcaggaggctgaggcag

SEQ ID NO: 3553081 - DNA, 21 bp, Homo sapiens
actcaggaggctgaggcagga

SEQ ID NO: 3553082 - DNA, 24 bp, Homo sapiens
actcaggccacagtggggctgcag

SEQ ID NO: 3553083 - DNA, 21 bp, Homo sapiens
actcaggggaccccactcccc

SEQ ID NO: 3553084 - DNA, 24 bp, Homo sapiens
actcagtgaccagtgcctgtgagc

SEQ ID NO: 3553085 - DNA, 16 bp, Homo sapiens
actcatggggaagctt

SEQ ID NO: 3553086 - DNA, 20 bp, Homo sapiens
actcatggggaagcttccat

SEQ ID NO: 3553087 - DNA, 15 bp, Homo sapiens
actccaaagaaatgt

SEQ ID NO: 3553088 - DNA, 18 bp, Homo sapiens
actccaaagaaatgtaag

SEQ ID NO: 3553089 - DNA, 22 bp, Homo sapiens
actccaccgaccaactgcccta

SEQ ID NO: 3553090 - DNA, 12 bp, Homo sapiens
actccactccaa

SEQ ID NO: 3553091 - DNA, 18 bp, Homo sapiens
actccagacccctggctt

SEQ ID NO: 3553092 - DNA, 16 bp, Homo sapiens
actccagcctgggcaa

SEQ ID NO: 3553093 - DNA, 20 bp, Homo sapiens
actccaggcatgtgtctggc

SEQ ID NO: 3553094 - DNA, 23 bp, Homo sapiens
actccaggcatgtgtctggccct

SEQ ID NO: 3553095 - DNA, 14 bp, Homo sapiens
actccaggggcacc

SEQ ID NO: 3553096 - DNA, 16 bp, Homo sapiens
actccaggttcctgaa

SEQ ID NO: 3553097 - DNA, 20 bp, Homo sapiens
actccatctcaaaacaaaac

SEQ ID NO: 3553098 - DNA, 17 bp, Homo sapiens
actcccaaactgacaat

SEQ ID NO: 3553099 - DNA, 15 bp, Homo sapiens
actcccaacttcttc

SEQ ID NO: 3553100 - DNA, 16 bp, Homo sapiens
actcccacagcagccc

SEQ ID NO: 3553101 - DNA, 16 bp, Homo sapiens
actcccacctgacaca

SEQ ID NO: 3553102 - DNA, 12 bp, Homo sapiens
actcccagaacc

SEQ ID NO: 3553103 - DNA, 14 bp, Homo sapiens
actcccagaacctc

SEQ ID NO: 3553104 - DNA, 13 bp, Homo sapiens
actcccattcctg

SEQ ID NO: 3553105 - DNA, 17 bp, Homo sapiens
actccccaacccctctc

SEQ ID NO: 3553106 - DNA, 20 bp, Homo sapiens
actccccagagctgtgccag

SEQ ID NO: 3553107 - DNA, 17 bp, Homo sapiens
actccccagccagcctg

SEQ ID NO: 3553108 - DNA, 19 bp, Homo sapiens
actccccagcccagcaccc

SEQ ID NO: 3553109 - DNA, 22 bp, Homo sapiens
actcccctcacacacacccccc

SEQ ID NO: 3553110 - DNA, 17 bp, Homo sapiens
actccctacactgatgc

SEQ ID NO: 3553111 - DNA, 18 bp, Homo sapiens
actccctacactgatgca

SEQ ID NO: 3553112 - DNA, 21 bp, Homo sapiens
actcctacatgatgttatgta

SEQ ID NO: 3553113 - DNA, 21 bp, Homo sapiens
actcctataaagtgcctcgga

SEQ ID NO: 3553114 - DNA, 16 bp, Homo sapiens
actcctcagcacccct

SEQ ID NO: 3553115 - DNA, 18 bp, Homo sapiens
actcctcagcacccctcc

SEQ ID NO: 3553116 - DNA, 12 bp, Homo sapiens
actcctcccagg

SEQ ID NO: 3553117 - DNA, 15 bp, Homo sapiens
actcctgacctcaag

SEQ ID NO: 3553118 - DNA, 20 bp, Homo sapiens
actcctgccaccagcatcca

SEQ ID NO: 3553119 - DNA, 15 bp, Homo sapiens
actcctgctggtacc

SEQ ID NO: 3553120 - DNA, 16 bp, Homo sapiens
actcctgctggtacct

SEQ ID NO: 3553121 - DNA, 22 bp, Homo sapiens
actcctgctggtacctgccctc

SEQ ID NO: 3553122 - DNA, 20 bp, Homo sapiens
actcctggcagggccacctg

SEQ ID NO: 3553123 - DNA, 13 bp, Homo sapiens
actcctggccttt

SEQ ID NO: 3553124 - DNA, 14 bp, Homo sapiens
actcctgtcttctt

SEQ ID NO: 3553125 - DNA, 23 bp, Homo sapiens
actcctgtcttctttctccatgg

SEQ ID NO: 3553126 - DNA, 24 bp, Homo sapiens
actcctgtcttctttctccatgga

SEQ ID NO: 3553127 - DNA, 18 bp, Homo sapiens
actcctgttgccatggat

SEQ ID NO: 3553128 - DNA, 16 bp, Homo sapiens
actccttatcccttgg

SEQ ID NO: 3553129 - DNA, 21 bp, Homo sapiens
actccttatctctttccacca

SEQ ID NO: 3553130 - DNA, 14 bp, Homo sapiens
actcctttatctgt

SEQ ID NO: 3553131 - DNA, 22 bp, Homo sapiens
actcggtgtccccaccatctgc

SEQ ID NO: 3553132 - DNA, 15 bp, Homo sapiens
actcgtgtgtttcta

SEQ ID NO: 3553133 - DNA, 14 bp, Homo sapiens
actctaaagtctgt

SEQ ID NO: 3553134 - DNA, 12 bp, Homo sapiens
actctagagggc

SEQ ID NO: 3553135 - DNA, 20 bp, Homo sapiens
actctcccattatatttatt

SEQ ID NO: 3553136 - DNA, 19 bp, Homo sapiens
actctccccgctcaggggc

SEQ ID NO: 3553137 - DNA, 13 bp, Homo sapiens
actctctccagga

SEQ ID NO: 3553138 - DNA, 19 bp, Homo sapiens
actctctgaacccctccct

SEQ ID NO: 3553139 - DNA, 21 bp, Homo sapiens
actctctgaacccctccctcc

SEQ ID NO: 3553140 - DNA, 13 bp, Homo sapiens
actctcttcctcc

SEQ ID NO: 3553141 - DNA, 15 bp, Homo sapiens
actctcttcctccac

SEQ ID NO: 3553142 - DNA, 17 bp, Homo sapiens
actctcttcctccactt

SEQ ID NO: 3553143 - DNA, 14 bp, Homo sapiens
actctgagagctgt

SEQ ID NO: 3553144 - DNA, 15 bp, Homo sapiens
actctgagagctgtt

SEQ ID NO: 3553145 - DNA, 12 bp, Homo sapiens
actctgcctcct

SEQ ID NO: 3553146 - DNA, 16 bp, Homo sapiens
actctgcctcctcttc

SEQ ID NO: 3553147 - DNA, 14 bp, Homo sapiens
actctggaggtcat

SEQ ID NO: 3553148 - DNA, 21 bp, Homo sapiens
actctggaggtttgtttagaa

SEQ ID NO: 3553149 - DNA, 15 bp, Homo sapiens
actctggcagcaccg

SEQ ID NO: 3553150 - DNA, 19 bp, Homo sapiens
actctggcttcaaaaagcc

SEQ ID NO: 3553151 - DNA, 20 bp, Homo sapiens
actctgggtcttggccatga

SEQ ID NO: 3553152 - DNA, 15 bp, Homo sapiens
actctggtgctcctg

SEQ ID NO: 3553153 - DNA, 19 bp, Homo sapiens
actctgtccctgtccttcc

SEQ ID NO: 3553154 - DNA, 21 bp, Homo sapiens
actctgtccctgtccttccct

SEQ ID NO: 3553155 - DNA, 14 bp, Homo sapiens
actctgtgaaagaa

SEQ ID NO: 3553156 - DNA, 21 bp, Homo sapiens
actcttagccctcaccacagc

SEQ ID NO: 3553157 - DNA, 16 bp, Homo sapiens
actcttattttttaaa

SEQ ID NO: 3553158 - DNA, 22 bp, Homo sapiens
actcttcagtgactcctgctgg

SEQ ID NO: 3553159 - DNA, 13 bp, Homo sapiens
actcttgatctct

SEQ ID NO: 3553160 - DNA, 16 bp, Homo sapiens
actcttgatctctctt

SEQ ID NO: 3553161 - DNA, 23 bp, Homo sapiens
actcttggttcgatacctggagc

SEQ ID NO: 3553162 - DNA, 16 bp, Homo sapiens
actctttgatatgcca

SEQ ID NO: 3553163 - DNA, 16 bp, Homo sapiens
actgaaaacctctcct

SEQ ID NO: 3553164 - DNA, 17 bp, Homo sapiens
actgaaaacctctcctc

SEQ ID NO: 3553165 - DNA, 20 bp, Homo sapiens
actgaaaaggaggggtctgg

SEQ ID NO: 3553166 - DNA, 22 bp, Homo sapiens
actgaaccaaattgcactgaag

SEQ ID NO: 3553167 - DNA, 24 bp, Homo sapiens
actgaaccaaattgcactgaagtt

SEQ ID NO: 3553168 - DNA, 18 bp, Homo sapiens
actgaagctttttattta

SEQ ID NO: 3553169 - DNA, 20 bp, Homo sapiens
actgaaggaaaagcaagaaa

SEQ ID NO: 3553170 - DNA, 23 bp, Homo sapiens
actgaaggaaaagcaagaaacag

SEQ ID NO: 3553171 - DNA, 21 bp, Homo sapiens
actgaagtttttgaaatacct

SEQ ID NO: 3553172 - DNA, 19 bp, Homo sapiens
actgaattttttttaaaaa

SEQ ID NO: 3553173 - DNA, 12 bp, Homo sapiens
actgacaatttt

SEQ ID NO: 3553174 - DNA, 15 bp, Homo sapiens
actgacagacttaga

SEQ ID NO: 3553175 - DNA, 13 bp, Homo sapiens
actgacagggagc

SEQ ID NO: 3553176 - DNA, 23 bp, Homo sapiens
actgacatcaattttaccctgag

SEQ ID NO: 3553177 - DNA, 12 bp, Homo sapiens
actgaccactgg

SEQ ID NO: 3553178 - DNA, 20 bp, Homo sapiens
actgaccatcatgccctctc

SEQ ID NO: 3553179 - DNA, 20 bp, Homo sapiens
actgacccccatctgagctg

SEQ ID NO: 3553180 - DNA, 14 bp, Homo sapiens
actgaccctcaggc

SEQ ID NO: 3553181 - DNA, 16 bp, Homo sapiens
agaattatctcaagta

SEQ ID NO: 3553182 - DNA, 21 bp, Homo sapiens
agaattatctcaagtaaaaca

SEQ ID NO: 3553183 - DNA, 23 bp, Homo sapiens
agaattatctcaagtaaaacaaa

SEQ ID NO: 3553184 - DNA, 18 bp, Homo sapiens
agaattctgtattggata

SEQ ID NO: 3553185 - DNA, 15 bp, Homo sapiens
agaattgaattggaa

SEQ ID NO: 3553186 - DNA, 21 bp, Homo sapiens
agaattgaattggaaagactt

SEQ ID NO: 3553187 - DNA, 16 bp, Homo sapiens
agaatttggggcagga

SEQ ID NO: 3553188 - DNA, 17 bp, Homo sapiens
agaattttccatttatt

SEQ ID NO: 3553189 - DNA, 14 bp, Homo sapiens
agaattttgtgaaa

SEQ ID NO: 3553190 - DNA, 22 bp, Homo sapiens
agaattttgtgaaacagacttg

SEQ ID NO: 3553191 - DNA, 19 bp, Homo sapiens
agacaaacacctcccagga

SEQ ID NO: 3553192 - DNA, 20 bp, Homo sapiens
agacaaagccttaagcaaat

SEQ ID NO: 3553193 - DNA, 18 bp, Homo sapiens
agacaaaggttttcctct

SEQ ID NO: 3553194 - DNA, 23 bp, Homo sapiens
agacaaatctttaagaatagttc

SEQ ID NO: 3553195 - DNA, 16 bp, Homo sapiens
agacaagagctgttat

SEQ ID NO: 3553196 - DNA, 20 bp, Homo sapiens
agacaagagctgttatgctg

SEQ ID NO: 3553197 - DNA, 22 bp, Homo sapiens
agacaagagctgttatgctgtt

SEQ ID NO: 3553198 - DNA, 15 bp, Homo sapiens
agacaagcagccctt

SEQ ID NO: 3553199 - DNA, 12 bp, Homo sapiens
agacaaggtgct

SEQ ID NO: 3553200 - DNA, 15 bp, Homo sapiens
agacaaggtgctaac

SEQ ID NO: 3553201 - DNA, 14 bp, Homo sapiens
agacaatcactgcc

SEQ ID NO: 3553202 - DNA, 23 bp, Homo sapiens
agacaattgaggtaagttttttg

SEQ ID NO: 3553203 - DNA, 12 bp, Homo sapiens
agacacagactg

SEQ ID NO: 3553204 - DNA, 14 bp, Homo sapiens
agacacagataata

SEQ ID NO: 3553205 - DNA, 14 bp, Homo sapiens
agacacatatgagg

SEQ ID NO: 3553206 - DNA, 16 bp, Homo sapiens
agacacatatgagggg

SEQ ID NO: 3553207 - DNA, 14 bp, Homo sapiens
agacaccctctggg

SEQ ID NO: 3553208 - DNA, 21 bp, Homo sapiens
agacacgctggcgacacactc

SEQ ID NO: 3553209 - DNA, 17 bp, Homo sapiens
agacacgtggcctcgtg

SEQ ID NO: 3553210 - DNA, 19 bp, Homo sapiens
agacacgtggcctcgtgag

SEQ ID NO: 3553211 - DNA, 20 bp, Homo sapiens
agacactaacgaaatatcaa

SEQ ID NO: 3553212 - DNA, 19 bp, Homo sapiens
agacactgttgataaaaac

SEQ ID NO: 3553213 - DNA, 18 bp, Homo sapiens
agacagaaaagtgcctga

SEQ ID NO: 3553214 - DNA, 22 bp, Homo sapiens
agacagaaaagtgcctgagctg

SEQ ID NO: 3553215 - DNA, 15 bp, Homo sapiens
agacagaggcagaga

SEQ ID NO: 3553216 - DNA, 21 bp, Homo sapiens
agacagctggcggaggctgct

SEQ ID NO: 3553217 - DNA, 17 bp, Homo sapiens
agacagcttacaggagc

SEQ ID NO: 3553218 - DNA, 21 bp, Homo sapiens
agacaggaatttagaaaaagt

SEQ ID NO: 3553219 - DNA, 15 bp, Homo sapiens
agacaggagacaaaa

SEQ ID NO: 3553220 - DNA, 12 bp, Homo sapiens
agacaggccctc

SEQ ID NO: 3553221 - DNA, 18 bp, Homo sapiens
agacaggccctccctgtc

SEQ ID NO: 3553222 - DNA, 14 bp, Homo sapiens
agacagttcaagaa

SEQ ID NO: 3553223 - DNA, 15 bp, Homo sapiens
agacagttcaagaaa

SEQ ID NO: 3553224 - DNA, 15 bp, Homo sapiens
agacataaaacagaa

SEQ ID NO: 3553225 - DNA, 16 bp, Homo sapiens
agacatacttgaaggg

SEQ ID NO: 3553226 - DNA, 21 bp, Homo sapiens
agacatacttgaagggccaga

SEQ ID NO: 3553227 - DNA, 23 bp, Homo sapiens
agacatacttgaagggccagagc

SEQ ID NO: 3553228 - DNA, 14 bp, Homo sapiens
agacatcagtctcc

SEQ ID NO: 3553229 - DNA, 22 bp, Homo sapiens
agacatccaaatttttttttaa

SEQ ID NO: 3553230 - DNA, 21 bp, Homo sapiens
agacatggaggggatgataaa

SEQ ID NO: 3553231 - DNA, 13 bp, Homo sapiens
agacatgtgacat

SEQ ID NO: 3553232 - DNA, 20 bp, Homo sapiens
agacattagagaaaacctta

SEQ ID NO: 3553233 - DNA, 15 bp, Homo sapiens
agacattcagactaa

SEQ ID NO: 3553234 - DNA, 14 bp, Homo sapiens
agacattgacagca

SEQ ID NO: 3553235 - DNA, 20 bp, Homo sapiens
agacattgacagcaattcat

SEQ ID NO: 3553236 - DNA, 15 bp, Homo sapiens
agacattggcaccta

SEQ ID NO: 3553237 - DNA, 21 bp, Homo sapiens
agacatttgctatgagctggg

SEQ ID NO: 3553238 - DNA, 14 bp, Homo sapiens
agaccaaatgtagt

SEQ ID NO: 3553239 - DNA, 13 bp, Homo sapiens
agaccaattgaag

SEQ ID NO: 3553240 - DNA, 17 bp, Homo sapiens
agaccaattgaagcatg

SEQ ID NO: 3553241 - DNA, 19 bp, Homo sapiens
agaccaattgaagcatgaa

SEQ ID NO: 3553242 - DNA, 12 bp, Homo sapiens
agaccagctctt

SEQ ID NO: 3553243 - DNA, 13 bp, Homo sapiens
agaccagctcttc

SEQ ID NO: 3553244 - DNA, 17 bp, Homo sapiens
agaccataagagaaacc

SEQ ID NO: 3553245 - DNA, 18 bp, Homo sapiens
agaccataagagaaacct

SEQ ID NO: 3553246 - DNA, 16 bp, Homo sapiens
agaccatattacctgg

SEQ ID NO: 3553247 - DNA, 19 bp, Homo sapiens
agaccatattacctggatt

SEQ ID NO: 3553248 - DNA, 14 bp, Homo sapiens
agacccaaaacagc

SEQ ID NO: 3553249 - DNA, 15 bp, Homo sapiens
agacccaaaccccca

SEQ ID NO: 3553250 - DNA, 21 bp, Homo sapiens
agacccaacagcaaaggaact

SEQ ID NO: 3553251 - DNA, 17 bp, Homo sapiens
agacccagtcccacact

SEQ ID NO: 3553252 - DNA, 18 bp, Homo sapiens
agacccagtcccacactg

SEQ ID NO: 3553253 - DNA, 13 bp, Homo sapiens
agacccccccatt

SEQ ID NO: 3553254 - DNA, 22 bp, Homo sapiens
agacccccccatttcccgcaca

SEQ ID NO: 3553255 - DNA, 15 bp, Homo sapiens
agaccccctcagcct

SEQ ID NO: 3553256 - DNA, 15 bp, Homo sapiens
agacccctggctttt

SEQ ID NO: 3553257 - DNA, 12 bp, Homo sapiens
agaccctcgggc

SEQ ID NO: 3553258 - DNA, 13 bp, Homo sapiens
agaccctggcctc

SEQ ID NO: 3553259 - DNA, 15 bp, Homo sapiens
agaccgatcggcggc

SEQ ID NO: 3553260 - DNA, 15 bp, Homo sapiens
agaccgtacaaactc

SEQ ID NO: 3553261 - DNA, 21 bp, Homo sapiens
agacctcatctgtggagctgc

SEQ ID NO: 3553262 - DNA, 18 bp, Homo sapiens
agacctctgtgcacttat

SEQ ID NO: 3553263 - DNA, 20 bp, Homo sapiens
agacctgaaagagaggactg

SEQ ID NO: 3553264 - DNA, 13 bp, Homo sapiens
agacctgacaatt

SEQ ID NO: 3553265 - DNA, 18 bp, Homo sapiens
agacctgatcctggaggc

SEQ ID NO: 3553266 - DNA, 21 bp, Homo sapiens
agacctgatcctggaggccca

SEQ ID NO: 3553267 - DNA, 23 bp, Homo sapiens
agacctgatcctggaggcccagt

SEQ ID NO: 3553268 - DNA, 13 bp, Homo sapiens
agacctggagctt

SEQ ID NO: 3553269 - DNA, 21 bp, Homo sapiens
agacctggagcttcagccagg

SEQ ID NO: 3553270 - DNA, 14 bp, Homo sapiens
agacctggcagctc

SEQ ID NO: 3553271 - DNA, 15 bp, Homo sapiens
agacctggcagctct

SEQ ID NO: 3553272 - DNA, 23 bp, Homo sapiens
agacctggcagctctggacagcc

SEQ ID NO: 3553273 - DNA, 14 bp, Homo sapiens
agacgaacatgtag

SEQ ID NO: 3553274 - DNA, 12 bp, Homo sapiens
agacgaggggca

SEQ ID NO: 3553275 - DNA, 21 bp, Homo sapiens
agacgaggggcagggaaggac

SEQ ID NO: 3553276 - DNA, 13 bp, Homo sapiens
agacggtctgtgt

SEQ ID NO: 3553277 - DNA, 19 bp, Homo sapiens
agacgtctccccttctctg

SEQ ID NO: 3553278 - DNA, 23 bp, Homo sapiens
agacgtctccccttctctgcctc

SEQ ID NO: 3553279 - DNA, 16 bp, Homo sapiens
agactaaaagttgcat

SEQ ID NO: 3553280 - DNA, 18 bp, Homo sapiens
agactactattttctttt

SEQ ID NO: 3553281 - DNA, 19 bp, Homo sapiens
agactactattttcttttt

SEQ ID NO: 3553282 - DNA, 13 bp, Homo sapiens
agactactcaata

SEQ ID NO: 3553283 - DNA, 21 bp, Homo sapiens
agactagagtctgagatgccc

SEQ ID NO: 3553284 - DNA, 14 bp, Homo sapiens
agactagatgtagt

SEQ ID NO: 3553285 - DNA, 16 bp, Homo sapiens
agactagatgtagtat

SEQ ID NO: 3553286 - DNA, 19 bp, Homo sapiens
agactagatgtagtatttt

SEQ ID NO: 3553287 - DNA, 15 bp, Homo sapiens
agactattcaaacag

SEQ ID NO: 3553288 - DNA, 13 bp, Homo sapiens
agactcaaatgct

SEQ ID NO: 3553289 - DNA, 23 bp, Homo sapiens
agactcaagtacccattctgttt

SEQ ID NO: 3553290 - DNA, 20 bp, Homo sapiens
agactcactgggaagctccc

SEQ ID NO: 3553291 - DNA, 13 bp, Homo sapiens
agactcagcagag

SEQ ID NO: 3553292 - DNA, 17 bp, Homo sapiens
agactcccattcctgaa

SEQ ID NO: 3553293 - DNA, 19 bp, Homo sapiens
agactcctcagcacccctc

SEQ ID NO: 3553294 - DNA, 13 bp, Homo sapiens
agactctggaggt

SEQ ID NO: 3553295 - DNA, 14 bp, Homo sapiens
agactgctcctggg

SEQ ID NO: 3553296 - DNA, 20 bp, Homo sapiens
agactggcacagttttctga

SEQ ID NO: 3553297 - DNA, 21 bp, Homo sapiens
agactgtgaacttgactgggt

SEQ ID NO: 3553298 - DNA, 20 bp, Homo sapiens
agactgtgccagaggccaga

SEQ ID NO: 3553299 - DNA, 15 bp, Homo sapiens
agacttactattaca

SEQ ID NO: 3553300 - DNA, 20 bp, Homo sapiens
agacttcctctggctcccca

SEQ ID NO: 3553301 - DNA, 17 bp, Homo sapiens
agacttctctttcttat

SEQ ID NO: 3553302 - DNA, 16 bp, Homo sapiens
agacttgtatattcta

SEQ ID NO: 3553303 - DNA, 18 bp, Homo sapiens
agacttgtatattctatt

SEQ ID NO: 3553304 - DNA, 18 bp, Homo sapiens
agacttgtatgaaagatg

SEQ ID NO: 3553305 - DNA, 17 bp, Homo sapiens
agactttagctttctga

SEQ ID NO: 3553306 - DNA, 17 bp, Homo sapiens
agactttggacagtggc

SEQ ID NO: 3553307 - DNA, 21 bp, Homo sapiens
agactttgtgttcatttcatt

SEQ ID NO: 3553308 - DNA, 18 bp, Homo sapiens
agactttgtttttaaaat

SEQ ID NO: 3553309 - DNA, 17 bp, Homo sapiens
agagaaaaccttaaaag

SEQ ID NO: 3553310 - DNA, 23 bp, Homo sapiens
agagaaaataaatttaactttaa

SEQ ID NO: 3553311 - DNA, 13 bp, Homo sapiens
agagaaacagttg

SEQ ID NO: 3553312 - DNA, 21 bp, Homo sapiens
agagaaacctgccaaggagca

SEQ ID NO: 3553313 - DNA, 19 bp, Homo sapiens
agcacaaagaagaaagctg

SEQ ID NO: 3553314 - DNA, 17 bp, Homo sapiens
agcacaagactggccca

SEQ ID NO: 3553315 - DNA, 18 bp, Homo sapiens
agcacaagactggcccag

SEQ ID NO: 3553316 - DNA, 13 bp, Homo sapiens
agcacacccgtgt

SEQ ID NO: 3553317 - DNA, 14 bp, Homo sapiens
agcacactcatccc

SEQ ID NO: 3553318 - DNA, 19 bp, Homo sapiens
agcaccaacctccagactc

SEQ ID NO: 3553319 - DNA, 17 bp, Homo sapiens
agcaccagggctcacgt

SEQ ID NO: 3553320 - DNA, 13 bp, Homo sapiens
agcaccccctgct

SEQ ID NO: 3553321 - DNA, 14 bp, Homo sapiens
agcaccccctgctc

SEQ ID NO: 3553322 - DNA, 21 bp, Homo sapiens
agcaccccctgctccaccagc

SEQ ID NO: 3553323 - DNA, 18 bp, Homo sapiens
agcaccgcctcttcccgc

SEQ ID NO: 3553324 - DNA, 17 bp, Homo sapiens
agcacggactgtcagtt

SEQ ID NO: 3553325 - DNA, 18 bp, Homo sapiens
agcacgggacggaagtgc

SEQ ID NO: 3553326 - DNA, 20 bp, Homo sapiens
agcactccccagagctgtgc

SEQ ID NO: 3553327 - DNA, 11 bp, Homo sapiens
agcactctcag

SEQ ID NO: 3553328 - DNA, 20 bp, Homo sapiens
agcactgaaccacattcagg

SEQ ID NO: 3553329 - DNA, 21 bp, Homo sapiens
agcactgaaccacattcaggg

SEQ ID NO: 3553330 - DNA, 23 bp, Homo sapiens
agcactgaaccacattcagggaa

SEQ ID NO: 3553331 - DNA, 19 bp, Homo sapiens
agcactgacttctaagtaa

SEQ ID NO: 3553332 - DNA, 20 bp, Homo sapiens
agcactggtgtgaactcacc

SEQ ID NO: 3553333 - DNA, 13 bp, Homo sapiens
agcagaaagaaga

SEQ ID NO: 3553334 - DNA, 23 bp, Homo sapiens
agcagaactgctatttttcatcc

SEQ ID NO: 3553335 - DNA, 18 bp, Homo sapiens
agcagactggtttgcagt

SEQ ID NO: 3553336 - DNA, 23 bp, Homo sapiens
agcagagaggtttcgatatttat

SEQ ID NO: 3553337 - DNA, 14 bp, Homo sapiens
agcagagcctcctg

SEQ ID NO: 3553338 - DNA, 15 bp, Homo sapiens
agcagagcctcctgg

SEQ ID NO: 3553339 - DNA, 21 bp, Homo sapiens
agcagaggaggggccgctgcc

SEQ ID NO: 3553340 - DNA, 19 bp, Homo sapiens
agcagagggggagtagcca

SEQ ID NO: 3553341 - DNA, 19 bp, Homo sapiens
agcagatgcaatgactcag

SEQ ID NO: 3553342 - DNA, 15 bp, Homo sapiens
agcagcaggaggggg

SEQ ID NO: 3553343 - DNA, 18 bp, Homo sapiens
agcagcaggaggggggag

SEQ ID NO: 3553344 - DNA, 21 bp, Homo sapiens
agcagcaggaggggggaggga

SEQ ID NO: 3553345 - DNA, 11 bp, Homo sapiens
agcagcaggcc

SEQ ID NO: 3553346 - DNA, 17 bp, Homo sapiens
agcagcaggcctctggg

SEQ ID NO: 3553347 - DNA, 19 bp, Homo sapiens
agcagcaggcctctgggac

SEQ ID NO: 3553348 - DNA, 22 bp, Homo sapiens
agcagcaggcctctgggaccca

SEQ ID NO: 3553349 - DNA, 15 bp, Homo sapiens
agcagcaggctcagg

SEQ ID NO: 3553350 - DNA, 17 bp, Homo sapiens
agcagcatggaaaaatg

SEQ ID NO: 3553351 - DNA, 17 bp, Homo sapiens
agcagcatggcatagcc

SEQ ID NO: 3553352 - DNA, 14 bp, Homo sapiens
agcagccccaggag

SEQ ID NO: 3553353 - DNA, 15 bp, Homo sapiens
agcagccccaggaga

SEQ ID NO: 3553354 - DNA, 12 bp, Homo sapiens
agcagccgccag

SEQ ID NO: 3553355 - DNA, 22 bp, Homo sapiens
agcagcctcacactggcgtctg

SEQ ID NO: 3553356 - DNA, 17 bp, Homo sapiens
agcagctaaattttctg

SEQ ID NO: 3553357 - DNA, 18 bp, Homo sapiens
agcagctaaattttctga

SEQ ID NO: 3553358 - DNA, 22 bp, Homo sapiens
agcagctgaaatatgctggctg

SEQ ID NO: 3553359 - DNA, 19 bp, Homo sapiens
agcagctgcaggggcctct

SEQ ID NO: 3553360 - DNA, 13 bp, Homo sapiens
agcagctttaaaa

SEQ ID NO: 3553361 - DNA, 15 bp, Homo sapiens
agcaggagagaaatt

SEQ ID NO: 3553362 - DNA, 19 bp, Homo sapiens
agcaggagccccgccacag

SEQ ID NO: 3553363 - DNA, 16 bp, Homo sapiens
agcaggcccaatgctg

SEQ ID NO: 3553364 - DNA, 14 bp, Homo sapiens
agcaggcctctggg

SEQ ID NO: 3553365 - DNA, 17 bp, Homo sapiens
agcaggctactgtcagc

SEQ ID NO: 3553366 - DNA, 19 bp, Homo sapiens
agcaggctactgtcagctc

SEQ ID NO: 3553367 - DNA, 16 bp, Homo sapiens
agcaggctcaggcaca

SEQ ID NO: 3553368 - DNA, 15 bp, Homo sapiens
agcaggcttgtggca

SEQ ID NO: 3553369 - DNA, 16 bp, Homo sapiens
agcagggaccgggcgc

SEQ ID NO: 3553370 - DNA, 22 bp, Homo sapiens
agcagggtccacagctggaaag

SEQ ID NO: 3553371 - DNA, 15 bp, Homo sapiens
agcaggttccccaag

SEQ ID NO: 3553372 - DNA, 22 bp, Homo sapiens
agcaggttccccaagggccctg

SEQ ID NO: 3553373 - DNA, 16 bp, Homo sapiens
agcaggttgttattta

SEQ ID NO: 3553374 - DNA, 17 bp, Homo sapiens
agcagtcgcctgcctgc

SEQ ID NO: 3553375 - DNA, 12 bp, Homo sapiens
agcagtctaaat

SEQ ID NO: 3553376 - DNA, 14 bp, Homo sapiens
agcagtctaaattt

SEQ ID NO: 3553377 - DNA, 18 bp, Homo sapiens
agcagtctccttcagcac

SEQ ID NO: 3553378 - DNA, 17 bp, Homo sapiens
agcagtctgataaactg

SEQ ID NO: 3553379 - DNA, 20 bp, Homo sapiens
agcagtgttgcgtttttcct

SEQ ID NO: 3553380 - DNA, 22 bp, Homo sapiens
agcagtgttgcgtttttccttg

SEQ ID NO: 3553381 - DNA, 17 bp, Homo sapiens
agcagttaatttatata

SEQ ID NO: 3553382 - DNA, 22 bp, Homo sapiens
agcagttcaataatccatgaaa

SEQ ID NO: 3553383 - DNA, 14 bp, Homo sapiens
agcagttcattcta

SEQ ID NO: 3553384 - DNA, 18 bp, Homo sapiens
agcagttcattctaccaa

SEQ ID NO: 3553385 - DNA, 16 bp, Homo sapiens
agcagttcctgtccca

SEQ ID NO: 3553386 - DNA, 23 bp, Homo sapiens
agcagttcctgtcccacatggcc

SEQ ID NO: 3553387 - DNA, 13 bp, Homo sapiens
agcagttgaaaag

SEQ ID NO: 3553388 - DNA, 16 bp, Homo sapiens
agcagttgaaaagact

SEQ ID NO: 3553389 - DNA, 22 bp, Homo sapiens
agcagttgttatattcattctt

SEQ ID NO: 3553390 - DNA, 16 bp, Homo sapiens
agcataatttaaaaat

SEQ ID NO: 3553391 - DNA, 17 bp, Homo sapiens
agcataatttaaaaata

SEQ ID NO: 3553392 - DNA, 18 bp, Homo sapiens
agcataatttaaaaatat

SEQ ID NO: 3553393 - DNA, 20 bp, Homo sapiens
agcataatttaaaaatatat

SEQ ID NO: 3553394 - DNA, 22 bp, Homo sapiens
agcataatttaaaaatatattt

SEQ ID NO: 3553395 - DNA, 13 bp, Homo sapiens
agcataccaacac

SEQ ID NO: 3553396 - DNA, 22 bp, Homo sapiens
agcataccaacacgagcaggct

SEQ ID NO: 3553397 - DNA, 21 bp, Homo sapiens
agcataggaattggagattgg

SEQ ID NO: 3553398 - DNA, 12 bp, Homo sapiens
agcatataaatg

SEQ ID NO: 3553399 - DNA, 15 bp, Homo sapiens
agcatataaatgttt

SEQ ID NO: 3553400 - DNA, 23 bp, Homo sapiens
agcatcaggctaagaccctgtgt

SEQ ID NO: 3553401 - DNA, 15 bp, Homo sapiens
agcatccaccccacc

SEQ ID NO: 3553402 - DNA, 14 bp, Homo sapiens
agcatccctggagc

SEQ ID NO: 3553403 - DNA, 20 bp, Homo sapiens
agcatccctggagcaggagc

SEQ ID NO: 3553404 - DNA, 13 bp, Homo sapiens
agcatccttggca

SEQ ID NO: 3553405 - DNA, 12 bp, Homo sapiens
agcatcgggagc

SEQ ID NO: 3553406 - DNA, 20 bp, Homo sapiens
agcatcgggagcacccagag

SEQ ID NO: 3553407 - DNA, 21 bp, Homo sapiens
agcatctgcagtacagtctta

SEQ ID NO: 3553408 - DNA, 14 bp, Homo sapiens
agcatgcttgggct

SEQ ID NO: 3553409 - DNA, 17 bp, Homo sapiens
agcatgcttgggctgac

SEQ ID NO: 3553410 - DNA, 18 bp, Homo sapiens
agcatgcttgggctgacc

SEQ ID NO: 3553411 - DNA, 19 bp, Homo sapiens
agcatggaaaaatggttga

SEQ ID NO: 3553412 - DNA, 20 bp, Homo sapiens
agcatggaaaaatggttgat

SEQ ID NO: 3553413 - DNA, 16 bp, Homo sapiens
agcatggagacagcag

SEQ ID NO: 3553414 - DNA, 19 bp, Homo sapiens
agcatggcatagccccggc

SEQ ID NO: 3553415 - DNA, 19 bp, Homo sapiens
agcatgtaagaaataagtt

SEQ ID NO: 3553416 - DNA, 13 bp, Homo sapiens
agcatgtggtctt

SEQ ID NO: 3553417 - DNA, 22 bp, Homo sapiens
agcatgttcctccttttcttca

SEQ ID NO: 3553418 - DNA, 20 bp, Homo sapiens
agcattctcactcctacctg

SEQ ID NO: 3553419 - DNA, 19 bp, Homo sapiens
agcattgcagcctaagaag

SEQ ID NO: 3553420 - DNA, 18 bp, Homo sapiens
agcattgtaaatgtgctt

SEQ ID NO: 3553421 - DNA, 15 bp, Homo sapiens
agcattgtctatttt

SEQ ID NO: 3553422 - DNA, 20 bp, Homo sapiens
agcatttaatggcagctagt

SEQ ID NO: 3553423 - DNA, 14 bp, Homo sapiens
agcatttcatgaaa

SEQ ID NO: 3553424 - DNA, 23 bp, Homo sapiens
agcatttgtataaagaaactggt

SEQ ID NO: 3553425 - DNA, 15 bp, Homo sapiens
agcatttgtattatt

SEQ ID NO: 3553426 - DNA, 16 bp, Homo sapiens
agcattttagaaacta

SEQ ID NO: 3553427 - DNA, 20 bp, Homo sapiens
agcattttagaaactacaaa

SEQ ID NO: 3553428 - DNA, 12 bp, Homo sapiens
agcattttcctc

SEQ ID NO: 3553429 - DNA, 19 bp, Homo sapiens
agcatttttttaaaagaag

SEQ ID NO: 3553430 - DNA, 23 bp, Homo sapiens
agcatttttttaaaagaagcttt

SEQ ID NO: 3553431 - DNA, 15 bp, Homo sapiens
agccaaagaaacaag

SEQ ID NO: 3553432 - DNA, 18 bp, Homo sapiens
agccaaagaaacaagctg

SEQ ID NO: 3553433 - DNA, 13 bp, Homo sapiens
agccaaatttctt

SEQ ID NO: 3553434 - DNA, 15 bp, Homo sapiens
agccaaatttctttt

SEQ ID NO: 3553435 - DNA, 19 bp, Homo sapiens
agccaactgtttccctgct

SEQ ID NO: 3553436 - DNA, 15 bp, Homo sapiens
agccaagctggcaca

SEQ ID NO: 3553437 - DNA, 21 bp, Homo sapiens
agccaagctggcacaaaagac

SEQ ID NO: 3553438 - DNA, 15 bp, Homo sapiens
agccaaggcagcgac

SEQ ID NO: 3553439 - DNA, 19 bp, Homo sapiens
agccacaccgtggcagctt

SEQ ID NO: 3553440 - DNA, 21 bp, Homo sapiens
agccacactctgggctccaga

SEQ ID NO: 3553441 - DNA, 16 bp, Homo sapiens
agccacagacccctgg

SEQ ID NO: 3553442 - DNA, 18 bp, Homo sapiens
agccacagacccctggga

SEQ ID NO: 3553443 - DNA, 19 bp, Homo sapiens
agccacagacccctgggag

SEQ ID NO: 3553444 - DNA, 12 bp, Homo sapiens
agccacagcaga

SEQ ID NO: 3553445 - DNA, 17 bp, Homo sapiens
agctctcctgactttta

SEQ ID NO: 3553446 - DNA, 17 bp, Homo sapiens
agctctctgactgcttt

SEQ ID NO: 3553447 - DNA, 14 bp, Homo sapiens
agctctgaaaacaa

SEQ ID NO: 3553448 - DNA, 21 bp, Homo sapiens
agctctgcagagcaggaaaca

SEQ ID NO: 3553449 - DNA, 23 bp, Homo sapiens
agctctgcgtcggtcctggtgcc

SEQ ID NO: 3553450 - DNA, 11 bp, Homo sapiens
agctctggaga

SEQ ID NO: 3553451 - DNA, 13 bp, Homo sapiens
agctctggagaac

SEQ ID NO: 3553452 - DNA, 10 bp, Homo sapiens
agctcttcat

SEQ ID NO: 3553453 - DNA, 20 bp, Homo sapiens
agctcttcattccattgact

SEQ ID NO: 3553454 - DNA, 16 bp, Homo sapiens
agctcttccagggcag

SEQ ID NO: 3553455 - DNA, 13 bp, Homo sapiens
agctcttccctta

SEQ ID NO: 3553456 - DNA, 19 bp, Homo sapiens
agctcttgtgttcagaaga

SEQ ID NO: 3553457 - DNA, 11 bp, Homo sapiens
agctctttctc

SEQ ID NO: 3553458 - DNA, 15 bp, Homo sapiens
agctcttttcctaga

SEQ ID NO: 3553459 - DNA, 17 bp, Homo sapiens
agctgaaattcaccaag

SEQ ID NO: 3553460 - DNA, 14 bp, Homo sapiens
agctgacagccaca

SEQ ID NO: 3553461 - DNA, 17 bp, Homo sapiens
agctgacagccacaccg

SEQ ID NO: 3553462 - DNA, 15 bp, Homo sapiens
agctgacagtcagct

SEQ ID NO: 3553463 - DNA, 17 bp, Homo sapiens
agctgacagtcagctgt

SEQ ID NO: 3553464 - DNA, 18 bp, Homo sapiens
agctgagagaccctggcc

SEQ ID NO: 3553465 - DNA, 22 bp, Homo sapiens
agctgagagaccctggcctcaa

SEQ ID NO: 3553466 - DNA, 14 bp, Homo sapiens
agctgagcaggtgt

SEQ ID NO: 3553467 - DNA, 23 bp, Homo sapiens
agctgatttaacttgtattttgt

SEQ ID NO: 3553468 - DNA, 21 bp, Homo sapiens
agctgattttgagggttttta

SEQ ID NO: 3553469 - DNA, 15 bp, Homo sapiens
agctgcaccccttcc

SEQ ID NO: 3553470 - DNA, 19 bp, Homo sapiens
agctgcactgatgctgccc

SEQ ID NO: 3553471 - DNA, 11 bp, Homo sapiens
agctgcagcct

SEQ ID NO: 3553472 - DNA, 18 bp, Homo sapiens
agctgccctagctgaccc

SEQ ID NO: 3553473 - DNA, 19 bp, Homo sapiens
agctgccctagctgacccc

SEQ ID NO: 3553474 - DNA, 19 bp, Homo sapiens
agctgcctcctgcgccctg

SEQ ID NO: 3553475 - DNA, 16 bp, Homo sapiens
agctgctcagggaaaa

SEQ ID NO: 3553476 - DNA, 18 bp, Homo sapiens
agctgctcctagagggag

SEQ ID NO: 3553477 - DNA, 22 bp, Homo sapiens
agctgctcctagagggaggggc

SEQ ID NO: 3553478 - DNA, 17 bp, Homo sapiens
agctgctgggtggcagg

SEQ ID NO: 3553479 - DNA, 20 bp, Homo sapiens
agctgctttgagctacagga

SEQ ID NO: 3553480 - DNA, 23 bp, Homo sapiens
agctggacatactgctggagtcc

SEQ ID NO: 3553481 - DNA, 20 bp, Homo sapiens
agctggcacaaaagacagct

SEQ ID NO: 3553482 - DNA, 15 bp, Homo sapiens
agctggcattacagc

SEQ ID NO: 3553483 - DNA, 21 bp, Homo sapiens
agctggcattacagctggaga

SEQ ID NO: 3553484 - DNA, 21 bp, Homo sapiens
agctggctgtacctgttcctc

SEQ ID NO: 3553485 - DNA, 22 bp, Homo sapiens
agctggctgtacctgttcctcc

SEQ ID NO: 3553486 - DNA, 23 bp, Homo sapiens
agctgggcaggtctcctctggga

SEQ ID NO: 3553487 - DNA, 15 bp, Homo sapiens
agctggggactcagg

SEQ ID NO: 3553488 - DNA, 18 bp, Homo sapiens
agctggggactcagggac

SEQ ID NO: 3553489 - DNA, 14 bp, Homo sapiens
agctggggagccct

SEQ ID NO: 3553490 - DNA, 15 bp, Homo sapiens
agctggggatccctc

SEQ ID NO: 3553491 - DNA, 19 bp, Homo sapiens
agctgggggtgggccaggc

SEQ ID NO: 3553492 - DNA, 21 bp, Homo sapiens
agctgggggtgggccaggctg

SEQ ID NO: 3553493 - DNA, 15 bp, Homo sapiens
agctggttagaaatg

SEQ ID NO: 3553494 - DNA, 13 bp, Homo sapiens
agctgtaaaaatg

SEQ ID NO: 3553495 - DNA, 18 bp, Homo sapiens
agctgtaagggcagtgcc

SEQ ID NO: 3553496 - DNA, 22 bp, Homo sapiens
agctgtcacaggttttcagaga

SEQ ID NO: 3553497 - DNA, 15 bp, Homo sapiens
agctgtccctgcagg

SEQ ID NO: 3553498 - DNA, 19 bp, Homo sapiens
agctgtccctgcagggcca

SEQ ID NO: 3553499 - DNA, 20 bp, Homo sapiens
agctgtccctgcagggccat

SEQ ID NO: 3553500 - DNA, 15 bp, Homo sapiens
agctgtcctggaggt

SEQ ID NO: 3553501 - DNA, 14 bp, Homo sapiens
agctgtgccagcag

SEQ ID NO: 3553502 - DNA, 21 bp, Homo sapiens
agctgtggcagagttacagtt

SEQ ID NO: 3553503 - DNA, 18 bp, Homo sapiens
agctgtgttgaaacagaa

SEQ ID NO: 3553504 - DNA, 20 bp, Homo sapiens
agctgttatgctgtttccta

SEQ ID NO: 3553505 - DNA, 20 bp, Homo sapiens
agctgtttggatacagctgc

SEQ ID NO: 3553506 - DNA, 15 bp, Homo sapiens
agcttaatcttaatg

SEQ ID NO: 3553507 - DNA, 15 bp, Homo sapiens
agcttacaagccagc

SEQ ID NO: 3553508 - DNA, 17 bp, Homo sapiens
agcttacaagccagctg

SEQ ID NO: 3553509 - DNA, 14 bp, Homo sapiens
agcttacctgggca

SEQ ID NO: 3553510 - DNA, 16 bp, Homo sapiens
agcttacctgggcaca

SEQ ID NO: 3553511 - DNA, 18 bp, Homo sapiens
agcttacctgggcacaaa

SEQ ID NO: 3553512 - DNA, 15 bp, Homo sapiens
agcttattaaaactc

SEQ ID NO: 3553513 - DNA, 15 bp, Homo sapiens
agcttcaacttttct

SEQ ID NO: 3553514 - DNA, 20 bp, Homo sapiens
agcttcaccccaatcccagc

SEQ ID NO: 3553515 - DNA, 21 bp, Homo sapiens
agcttcagactcaagtaccca

SEQ ID NO: 3553516 - DNA, 15 bp, Homo sapiens
agcttcatccacagc

SEQ ID NO: 3553517 - DNA, 18 bp, Homo sapiens
agcttccaattttccttc

SEQ ID NO: 3553518 - DNA, 20 bp, Homo sapiens
agcttccatgatgcacagta

SEQ ID NO: 3553519 - DNA, 10 bp, Homo sapiens
agcttcccaa

SEQ ID NO: 3553520 - DNA, 16 bp, Homo sapiens
agcttccctattttga

SEQ ID NO: 3553521 - DNA, 20 bp, Homo sapiens
agcttccgctttgaaagaag

SEQ ID NO: 3553522 - DNA, 15 bp, Homo sapiens
agcttcctcacaccc

SEQ ID NO: 3553523 - DNA, 23 bp, Homo sapiens
agcttcctcacacccctgtccca

SEQ ID NO: 3553524 - DNA, 20 bp, Homo sapiens
agcttctaaatggtgctgca

SEQ ID NO: 3553525 - DNA, 15 bp, Homo sapiens
agcttctcccagtgt

SEQ ID NO: 3553526 - DNA, 12 bp, Homo sapiens
agcttctcctgt

SEQ ID NO: 3553527 - DNA, 16 bp, Homo sapiens
agcttctcctgtgtga

SEQ ID NO: 3553528 - DNA, 21 bp, Homo sapiens
agcttctcctgtgtgattgac

SEQ ID NO: 3553529 - DNA, 17 bp, Homo sapiens
agcttctctctccaggg

SEQ ID NO: 3553530 - DNA, 13 bp, Homo sapiens
agcttcttcacag

SEQ ID NO: 3553531 - DNA, 16 bp, Homo sapiens
agcttgccctgttaaa

SEQ ID NO: 3553532 - DNA, 18 bp, Homo sapiens
agcttgccctgttaaaag

SEQ ID NO: 3553533 - DNA, 19 bp, Homo sapiens
agcttgccctgttaaaaga

SEQ ID NO: 3553534 - DNA, 18 bp, Homo sapiens
agcttgctgggctttggg

SEQ ID NO: 3553535 - DNA, 23 bp, Homo sapiens
agcttgcttgctttcttttttaa

SEQ ID NO: 3553536 - DNA, 12 bp, Homo sapiens
agcttggctcac

SEQ ID NO: 3553537 - DNA, 20 bp, Homo sapiens
agcttggctcacaaggccca

SEQ ID NO: 3553538 - DNA, 19 bp, Homo sapiens
agcttggtgacaaaattca

SEQ ID NO: 3553539 - DNA, 15 bp, Homo sapiens
agcttgtcaaagatg

SEQ ID NO: 3553540 - DNA, 11 bp, Homo sapiens
agcttgttgaa

SEQ ID NO: 3553541 - DNA, 20 bp, Homo sapiens
agcttgttgaaaacccagac

SEQ ID NO: 3553542 - DNA, 13 bp, Homo sapiens
agctttaaaaaaa

SEQ ID NO: 3553543 - DNA, 20 bp, Homo sapiens
agctttaaaaaaataattgg

SEQ ID NO: 3553544 - DNA, 13 bp, Homo sapiens
agctttaaaagaa

SEQ ID NO: 3553545 - DNA, 16 bp, Homo sapiens
agctttaaaggccagg

SEQ ID NO: 3553546 - DNA, 21 bp, Homo sapiens
agctttaatgatatgcttgta

SEQ ID NO: 3553547 - DNA, 16 bp, Homo sapiens
agctttccctgccagg

SEQ ID NO: 3553548 - DNA, 18 bp, Homo sapiens
agctttctgccttagcct

SEQ ID NO: 3553549 - DNA, 21 bp, Homo sapiens
agctttgctaccaaagcacct

SEQ ID NO: 3553550 - DNA, 18 bp, Homo sapiens
agctttgctctttggtag

SEQ ID NO: 3553551 - DNA, 13 bp, Homo sapiens
agctttgctgctg

SEQ ID NO: 3553552 - DNA, 16 bp, Homo sapiens
agctttggctctggct

SEQ ID NO: 3553553 - DNA, 22 bp, Homo sapiens
agctttgtctccaaagaagata

SEQ ID NO: 3553554 - DNA, 15 bp, Homo sapiens
agctttgttctggga

SEQ ID NO: 3553555 - DNA, 21 bp, Homo sapiens
aggaaaaaaatcgtccaggga

SEQ ID NO: 3553556 - DNA, 21 bp, Homo sapiens
aggaaaaccaagccgtggctt

SEQ ID NO: 3553557 - DNA, 22 bp, Homo sapiens
aggaaaaccaagccgtggcttc

SEQ ID NO: 3553558 - DNA, 23 bp, Homo sapiens
aggaaaaccaagccgtggcttcc

SEQ ID NO: 3553559 - DNA, 20 bp, Homo sapiens
aggaaaagcggacatcagct

SEQ ID NO: 3553560 - DNA, 17 bp, Homo sapiens
aggaaaaggcccctgca

SEQ ID NO: 3553561 - DNA, 16 bp, Homo sapiens
aggaaaatatttcatt

SEQ ID NO: 3553562 - DNA, 23 bp, Homo sapiens
aggaaaatgtctgtaataataga

SEQ ID NO: 3553563 - DNA, 15 bp, Homo sapiens
aggaaactgaagcat

SEQ ID NO: 3553564 - DNA, 15 bp, Homo sapiens
aggaaacttttaact

SEQ ID NO: 3553565 - DNA, 18 bp, Homo sapiens
aggaaagaagggggccct

SEQ ID NO: 3553566 - DNA, 22 bp, Homo sapiens
aggaaagaagggggccctgcta

SEQ ID NO: 3553567 - DNA, 14 bp, Homo sapiens
aggaaagagctagg

SEQ ID NO: 3553568 - DNA, 19 bp, Homo sapiens
aggaaagagctaggaaccc

SEQ ID NO: 3553569 - DNA, 23 bp, Homo sapiens
aggaaagagctaggaaccctgga

SEQ ID NO: 3553570 - DNA, 16 bp, Homo sapiens
aggaaagccacatctt

SEQ ID NO: 3553571 - DNA, 12 bp, Homo sapiens
aggaaaggattt

SEQ ID NO: 3553572 - DNA, 17 bp, Homo sapiens
aggaaagtgtgaagacc

SEQ ID NO: 3553573 - DNA, 14 bp, Homo sapiens
aggaaatattaatt

SEQ ID NO: 3553574 - DNA, 20 bp, Homo sapiens
aggaaatcaaatatgcaaag

SEQ ID NO: 3553575 - DNA, 15 bp, Homo sapiens
aggaacaagaaggtg

SEQ ID NO: 3553576 - DNA, 13 bp, Homo sapiens
aggaacccaagat

SEQ ID NO: 3553577 - DNA, 21 bp, Homo sapiens
aggggcgttctcccaaagatt

SEQ ID NO: 3553578 - DNA, 13 bp, Homo sapiens
aggggctcctgag

SEQ ID NO: 3553579 - DNA, 13 bp, Homo sapiens
aggggctctgtgg

SEQ ID NO: 3553580 - DNA, 13 bp, Homo sapiens
aggggctttctct

SEQ ID NO: 3553581 - DNA, 23 bp, Homo sapiens
aggggctttctcttccccttcct

SEQ ID NO: 3553582 - DNA, 19 bp, Homo sapiens
agggggccccgccagggct

SEQ ID NO: 3553583 - DNA, 14 bp, Homo sapiens
agggggccctgcta

SEQ ID NO: 3553584 - DNA, 23 bp, Homo sapiens
agggggtgattagagggaggaga

SEQ ID NO: 3553585 - DNA, 20 bp, Homo sapiens
agggggtgtctcaggccaca

SEQ ID NO: 3553586 - DNA, 18 bp, Homo sapiens
aggggtaggatgtacagg

SEQ ID NO: 3553587 - DNA, 16 bp, Homo sapiens
aggggtcctgggggca

SEQ ID NO: 3553588 - DNA, 21 bp, Homo sapiens
aggggtgcggcggtcccagct

SEQ ID NO: 3553589 - DNA, 20 bp, Homo sapiens
aggggtgggggtgccgctct

SEQ ID NO: 3553590 - DNA, 12 bp, Homo sapiens
agggtaagtatt

SEQ ID NO: 3553591 - DNA, 14 bp, Homo sapiens
agggtccacctgga

SEQ ID NO: 3553592 - DNA, 22 bp, Homo sapiens
agggtccaggagagcctggggg

SEQ ID NO: 3553593 - DNA, 15 bp, Homo sapiens
agggtcctcttttcc

SEQ ID NO: 3553594 - DNA, 19 bp, Homo sapiens
agggtcctgcagcctgcag

SEQ ID NO: 3553595 - DNA, 22 bp, Homo sapiens
agggtcgtgggaaaggggagta

SEQ ID NO: 3553596 - DNA, 18 bp, Homo sapiens
agggtctcccctcctgca

SEQ ID NO: 3553597 - DNA, 23 bp, Homo sapiens
agggtctcccctcctgcacacag

SEQ ID NO: 3553598 - DNA, 12 bp, Homo sapiens
agggtctgggac

SEQ ID NO: 3553599 - DNA, 17 bp, Homo sapiens
agggtgagggccacctc

SEQ ID NO: 3553600 - DNA, 22 bp, Homo sapiens
agggtgatgggaaagcattgta

SEQ ID NO: 3553601 - DNA, 24 bp, Homo sapiens
agggtgccgtgtcccctgacaggg

SEQ ID NO: 3553602 - DNA, 21 bp, Homo sapiens
agggtgggggtgctctctctg

SEQ ID NO: 3553603 - DNA, 22 bp, Homo sapiens
agggtgtggggccatgcctcct

SEQ ID NO: 3553604 - DNA, 18 bp, Homo sapiens
agggttattgcatttgga

SEQ ID NO: 3553605 - DNA, 14 bp, Homo sapiens
agggttgctggtcc

SEQ ID NO: 3553606 - DNA, 17 bp, Homo sapiens
agggttggagtgctctt

SEQ ID NO: 3553607 - DNA, 21 bp, Homo sapiens
agggttggagtgctcttccca

SEQ ID NO: 3553608 - DNA, 17 bp, Homo sapiens
agggttggcaccttccc

SEQ ID NO: 3553609 - DNA, 20 bp, Homo sapiens
agggttggcaccttccccct

SEQ ID NO: 3553610 - DNA, 18 bp, Homo sapiens
agggtttcgactggtcca

SEQ ID NO: 3553611 - DNA, 20 bp, Homo sapiens
agggtttcgactggtccagc

SEQ ID NO: 3553612 - DNA, 21 bp, Homo sapiens
agggtttcgactggtccagct

SEQ ID NO: 3553613 - DNA, 23 bp, Homo sapiens
agggtttcgactggtccagctct

SEQ ID NO: 3553614 - DNA, 19 bp, Homo sapiens
aggtaaatggttaaatttt

SEQ ID NO: 3553615 - DNA, 21 bp, Homo sapiens
aggtaaatggttaaattttac

SEQ ID NO: 3553616 - DNA, 17 bp, Homo sapiens
aggtaatttttttcacc

SEQ ID NO: 3553617 - DNA, 16 bp, Homo sapiens
aggtacacagctctag

SEQ ID NO: 3553618 - DNA, 16 bp, Homo sapiens
aggtacaggagaggca

SEQ ID NO: 3553619 - DNA, 17 bp, Homo sapiens
aggtacaggagaggcag

SEQ ID NO: 3553620 - DNA, 22 bp, Homo sapiens
aggtacaggagaggcagcatgc

SEQ ID NO: 3553621 - DNA, 14 bp, Homo sapiens
aggtactattctga

SEQ ID NO: 3553622 - DNA, 16 bp, Homo sapiens
aggtagcactctcaga

SEQ ID NO: 3553623 - DNA, 17 bp, Homo sapiens
aggtagctggggagccc

SEQ ID NO: 3553624 - DNA, 15 bp, Homo sapiens
aggtattattatctt

SEQ ID NO: 3553625 - DNA, 18 bp, Homo sapiens
aggtattattatctttaa

SEQ ID NO: 3553626 - DNA, 14 bp, Homo sapiens
aggtatttatcttt

SEQ ID NO: 3553627 - DNA, 21 bp, Homo sapiens
aggtcaaacccaagttagttc

SEQ ID NO: 3553628 - DNA, 20 bp, Homo sapiens
aggtcacaacccttctctgt

SEQ ID NO: 3553629 - DNA, 21 bp, Homo sapiens
aggtcactcgtggtgaggctg

SEQ ID NO: 3553630 - DNA, 12 bp, Homo sapiens
aggtcagcctgg

SEQ ID NO: 3553631 - DNA, 14 bp, Homo sapiens
aggtcagcctggaa

SEQ ID NO: 3553632 - DNA, 15 bp, Homo sapiens
aggtcagcctggaag

SEQ ID NO: 3553633 - DNA, 16 bp, Homo sapiens
aggtcagcctggaagg

SEQ ID NO: 3553634 - DNA, 12 bp, Homo sapiens
aggtcaggaaac

SEQ ID NO: 3553635 - DNA, 22 bp, Homo sapiens
aggtcatatgttgtgtttggtt

SEQ ID NO: 3553636 - DNA, 18 bp, Homo sapiens
aggtcccggccagctctg

SEQ ID NO: 3553637 - DNA, 22 bp, Homo sapiens
aggtcccggccagctctggagt

SEQ ID NO: 3553638 - DNA, 20 bp, Homo sapiens
aggtccctggtcggagaggg

SEQ ID NO: 3553639 - DNA, 22 bp, Homo sapiens
aggtcctccgtagggtctttct

SEQ ID NO: 3553640 - DNA, 16 bp, Homo sapiens
aggtcggagtgcctgg

SEQ ID NO: 3553641 - DNA, 19 bp, Homo sapiens
aggtcggagtgcctggagt

SEQ ID NO: 3553642 - DNA, 19 bp, Homo sapiens
aggtcgttttccaaagagc

SEQ ID NO: 3553643 - DNA, 18 bp, Homo sapiens
aggtctaaataggatcct

SEQ ID NO: 3553644 - DNA, 13 bp, Homo sapiens
aggtctcattcat

SEQ ID NO: 3553645 - DNA, 18 bp, Homo sapiens
aggtctcattgcttctga

SEQ ID NO: 3553646 - DNA, 17 bp, Homo sapiens
aggtctccaggggcctg

SEQ ID NO: 3553647 - DNA, 18 bp, Homo sapiens
aggtctccaggggcctgc

SEQ ID NO: 3553648 - DNA, 19 bp, Homo sapiens
aggtctgactccaaagctg

SEQ ID NO: 3553649 - DNA, 16 bp, Homo sapiens
aggtctgattggctgc

SEQ ID NO: 3553650 - DNA, 17 bp, Homo sapiens
aggtctgattggctgct

SEQ ID NO: 3553651 - DNA, 15 bp, Homo sapiens
aggtctggctgagcc

SEQ ID NO: 3553652 - DNA, 16 bp, Homo sapiens
aggtctggctgagccc

SEQ ID NO: 3553653 - DNA, 20 bp, Homo sapiens
aggtctggctgagcccctgg

SEQ ID NO: 3553654 - DNA, 23 bp, Homo sapiens
aggtctggctgagcccctgggga

SEQ ID NO: 3553655 - DNA, 23 bp, Homo sapiens
aggtctgtcataggactctggac

SEQ ID NO: 3553656 - DNA, 19 bp, Homo sapiens
aggtctgtggtgcagtgtg

SEQ ID NO: 3553657 - DNA, 14 bp, Homo sapiens
aggtctttctctca

SEQ ID NO: 3553658 - DNA, 18 bp, Homo sapiens
aggtctttggttcagcta

SEQ ID NO: 3553659 - DNA, 15 bp, Homo sapiens
aggtgaaaatgaaga

SEQ ID NO: 3553660 - DNA, 19 bp, Homo sapiens
aggtgaaaatgaagaagga

SEQ ID NO: 3553661 - DNA, 19 bp, Homo sapiens
aggtgaaactccagatgcc

SEQ ID NO: 3553662 - DNA, 21 bp, Homo sapiens
aggtgaaactccagatgccac

SEQ ID NO: 3553663 - DNA, 22 bp, Homo sapiens
aggtgaggtgaactccaggcat

SEQ ID NO: 3553664 - DNA, 21 bp, Homo sapiens
aggtgcaaggagtgtaaaatg

SEQ ID NO: 3553665 - DNA, 20 bp, Homo sapiens
aggtgctacaaaaacacagc

SEQ ID NO: 3553666 - DNA, 24 bp, Homo sapiens
aggtgctacaaaaacacagcaagg

SEQ ID NO: 3553667 - DNA, 23 bp, Homo sapiens
aggtgctttagagataattgctt

SEQ ID NO: 3553668 - DNA, 12 bp, Homo sapiens
aggtggccgcca

SEQ ID NO: 3553669 - DNA, 19 bp, Homo sapiens
aggtgggcaaagggaagta

SEQ ID NO: 3553670 - DNA, 21 bp, Homo sapiens
aggtgggggaacactgagaaa

SEQ ID NO: 3553671 - DNA, 22 bp, Homo sapiens
aggtggtcataagtgaatattt

SEQ ID NO: 3553672 - DNA, 22 bp, Homo sapiens
aggtggtcctcctatctccctg

SEQ ID NO: 3553673 - DNA, 18 bp, Homo sapiens
aggtggttcgtgctgtgc

SEQ ID NO: 3553674 - DNA, 19 bp, Homo sapiens
aggtggttcgtgctgtgct

SEQ ID NO: 3553675 - DNA, 14 bp, Homo sapiens
aggtgtataaatgt

SEQ ID NO: 3553676 - DNA, 12 bp, Homo sapiens
aggtgtgaggag

SEQ ID NO: 3553677 - DNA, 14 bp, Homo sapiens
aggtgtgaggagag

SEQ ID NO: 3553678 - DNA, 19 bp, Homo sapiens
aggtgtgcttcctgctgta

SEQ ID NO: 3553679 - DNA, 15 bp, Homo sapiens
aggtgttatgtattc

SEQ ID NO: 3553680 - DNA, 19 bp, Homo sapiens
aggtgttatgtattcctat

SEQ ID NO: 3553681 - DNA, 14 bp, Homo sapiens
aggtgttctgctga

SEQ ID NO: 3553682 - DNA, 16 bp, Homo sapiens
aggtgttgtcccttct

SEQ ID NO: 3553683 - DNA, 13 bp, Homo sapiens
aggttaatattta

SEQ ID NO: 3553684 - DNA, 18 bp, Homo sapiens
aggttccacagaggacac

SEQ ID NO: 3553685 - DNA, 18 bp, Homo sapiens
aggttccccaagggccct

SEQ ID NO: 3553686 - DNA, 22 bp, Homo sapiens
aggttcctgaaatatccaggaa

SEQ ID NO: 3553687 - DNA, 23 bp, Homo sapiens
aggttgggagaatgtcagtatgt

SEQ ID NO: 3553688 - DNA, 18 bp, Homo sapiens
aggttggttttgctgttg

SEQ ID NO: 3553689 - DNA, 15 bp, Homo sapiens
aggttgttatttagg

SEQ ID NO: 3553690 - DNA, 13 bp, Homo sapiens
aggtttaaagttt

SEQ ID NO: 3553691 - DNA, 21 bp, Homo sapiens
aggtttaggctggtggcccag

SEQ ID NO: 3553692 - DNA, 17 bp, Homo sapiens
aggtttcgatatttatt

SEQ ID NO: 3553693 - DNA, 18 bp, Homo sapiens
aggtttcgatatttattg

SEQ ID NO: 3553694 - DNA, 16 bp, Homo sapiens
aggtttgaaggagaat

SEQ ID NO: 3553695 - DNA, 15 bp, Homo sapiens
aggtttgcagatatt

SEQ ID NO: 3553696 - DNA, 15 bp, Homo sapiens
aggttttcagagaat

SEQ ID NO: 3553697 - DNA, 16 bp, Homo sapiens
aggttttcagagaatt

SEQ ID NO: 3553698 - DNA, 22 bp, Homo sapiens
aggttttcctcttctattttgt

SEQ ID NO: 3553699 - DNA, 18 bp, Homo sapiens
aggttttctatgtgactc

SEQ ID NO: 3553700 - DNA, 16 bp, Homo sapiens
aggtttttcaattaaa

SEQ ID NO: 3553701 - DNA, 21 bp, Homo sapiens
aggtttttcaattaaacggat

SEQ ID NO: 3553702 - DNA, 22 bp, Homo sapiens
aggttttttttttttaatttaa

SEQ ID NO: 3553703 - DNA, 15 bp, Homo sapiens
agtaaaaccacagca

SEQ ID NO: 3553704 - DNA, 14 bp, Homo sapiens
agtaactgtgactg

SEQ ID NO: 3553705 - DNA, 19 bp, Homo sapiens
agtaacttttaaaatttgt

SEQ ID NO: 3553706 - DNA, 21 bp, Homo sapiens
agtaaggatttttatgtacat

SEQ ID NO: 3553707 - DNA, 16 bp, Homo sapiens
agtaagttatctttga

SEQ ID NO: 3553708 - DNA, 17 bp, Homo sapiens
agtgttttcattttaga

SEQ ID NO: 3553709 - DNA, 13 bp, Homo sapiens
agttaaaagcatt

SEQ ID NO: 3553710 - DNA, 20 bp, Homo sapiens
agttaaaattgttatcaaaa

SEQ ID NO: 3553711 - DNA, 19 bp, Homo sapiens
agttaactattgcatttat

SEQ ID NO: 3553712 - DNA, 17 bp, Homo sapiens
agttaagacctggcagc

SEQ ID NO: 3553713 - DNA, 12 bp, Homo sapiens
agttaagtgaag

SEQ ID NO: 3553714 - DNA, 18 bp, Homo sapiens
agttaagtgaagcctacc

SEQ ID NO: 3553715 - DNA, 23 bp, Homo sapiens
agttaatttttccaactactaat

SEQ ID NO: 3553716 - DNA, 13 bp, Homo sapiens
agttacagttctg

SEQ ID NO: 3553717 - DNA, 18 bp, Homo sapiens
agttacattaaaataaac

SEQ ID NO: 3553718 - DNA, 16 bp, Homo sapiens
agttaccagtgcctta

SEQ ID NO: 3553719 - DNA, 16 bp, Homo sapiens
agttaccttatagtta

SEQ ID NO: 3553720 - DNA, 21 bp, Homo sapiens
agttaccttatagttactgtg

SEQ ID NO: 3553721 - DNA, 22 bp, Homo sapiens
agttaccttatagttactgtgt

SEQ ID NO: 3553722 - DNA, 16 bp, Homo sapiens
agttactcaagcagtt

SEQ ID NO: 3553723 - DNA, 17 bp, Homo sapiens
agttactccctacactg

SEQ ID NO: 3553724 - DNA, 16 bp, Homo sapiens
agttactgtgtaatta

SEQ ID NO: 3553725 - DNA, 18 bp, Homo sapiens
agttactgtgtaattagt

SEQ ID NO: 3553726 - DNA, 19 bp, Homo sapiens
agttactgtgtaattagtg

SEQ ID NO: 3553727 - DNA, 19 bp, Homo sapiens
agttacttaattgccagca

SEQ ID NO: 3553728 - DNA, 22 bp, Homo sapiens
agttacttaattgccagcaaat

SEQ ID NO: 3553729 - DNA, 13 bp, Homo sapiens
agttataaaccaa

SEQ ID NO: 3553730 - DNA, 17 bp, Homo sapiens
agttataaaccaatgaa

SEQ ID NO: 3553731 - DNA, 16 bp, Homo sapiens
agttatatgtacagtt

SEQ ID NO: 3553732 - DNA, 18 bp, Homo sapiens
agttatctttgaatatgt

SEQ ID NO: 3553733 - DNA, 14 bp, Homo sapiens
agttatgaaatatt

SEQ ID NO: 3553734 - DNA, 23 bp, Homo sapiens
agttattaactgtattttctttc

SEQ ID NO: 3553735 - DNA, 13 bp, Homo sapiens
agttatttatgct

SEQ ID NO: 3553736 - DNA, 21 bp, Homo sapiens
agttattttatgacatgaaaa

SEQ ID NO: 3553737 - DNA, 14 bp, Homo sapiens
agttcaaactcaca

SEQ ID NO: 3553738 - DNA, 18 bp, Homo sapiens
agttcaatcctgattcat

SEQ ID NO: 3553739 - DNA, 10 bp, Homo sapiens
agttcaatgc

SEQ ID NO: 3553740 - DNA, 12 bp, Homo sapiens
agttcagggacc

SEQ ID NO: 3553741 - DNA, 19 bp, Homo sapiens
agttcatcaccatttcctc

SEQ ID NO: 3553742 - DNA, 13 bp, Homo sapiens
agttcatcttgca

SEQ ID NO: 3553743 - DNA, 22 bp, Homo sapiens
agttcatcttgcagcatttact

SEQ ID NO: 3553744 - DNA, 21 bp, Homo sapiens
agttcatgagaatctatattt

SEQ ID NO: 3553745 - DNA, 13 bp, Homo sapiens
agttccactgaga

SEQ ID NO: 3553746 - DNA, 18 bp, Homo sapiens
agttccggggagaaaccc

SEQ ID NO: 3553747 - DNA, 15 bp, Homo sapiens
agttcctctgcagtt

SEQ ID NO: 3553748 - DNA, 17 bp, Homo sapiens
agttcgagaccagcctg

SEQ ID NO: 3553749 - DNA, 21 bp, Homo sapiens
agttctaggcatacttttcaa

SEQ ID NO: 3553750 - DNA, 16 bp, Homo sapiens
agttctaggcctttcc

SEQ ID NO: 3553751 - DNA, 22 bp, Homo sapiens
agttctaggcctttcctctgca

SEQ ID NO: 3553752 - DNA, 23 bp, Homo sapiens
agttctatttatttgtgagactg

SEQ ID NO: 3553753 - DNA, 16 bp, Homo sapiens
agttctctgggaagtg

SEQ ID NO: 3553754 - DNA, 18 bp, Homo sapiens
agttctgacgctgacaat

SEQ ID NO: 3553755 - DNA, 19 bp, Homo sapiens
agttctgacgctgacaata

SEQ ID NO: 3553756 - DNA, 22 bp, Homo sapiens
agttctgtggtttcatgttagt

SEQ ID NO: 3553757 - DNA, 20 bp, Homo sapiens
agttctttcctccccctgca

SEQ ID NO: 3553758 - DNA, 18 bp, Homo sapiens
agttctttgggccagaca

SEQ ID NO: 3553759 - DNA, 21 bp, Homo sapiens
agttgaaaagactccaaagaa

SEQ ID NO: 3553760 - DNA, 11 bp, Homo sapiens
agttgaccttt

SEQ ID NO: 3553761 - DNA, 17 bp, Homo sapiens
agttgacttatagtaca

SEQ ID NO: 3553762 - DNA, 23 bp, Homo sapiens
agttgatataaaactctgggtct

SEQ ID NO: 3553763 - DNA, 13 bp, Homo sapiens
agttgatctggaa

SEQ ID NO: 3553764 - DNA, 19 bp, Homo sapiens
agttgatctggaacccaga

SEQ ID NO: 3553765 - DNA, 23 bp, Homo sapiens
agttgatctggaacccagactca

SEQ ID NO: 3553766 - DNA, 14 bp, Homo sapiens
agttgatggagccc

SEQ ID NO: 3553767 - DNA, 22 bp, Homo sapiens
agttgcccccattcccagcctg

SEQ ID NO: 3553768 - DNA, 21 bp, Homo sapiens
agttgcctttatttgctgtta

SEQ ID NO: 3553769 - DNA, 21 bp, Homo sapiens
agttgctgttaatctgatgta

SEQ ID NO: 3553770 - DNA, 22 bp, Homo sapiens
agttgctgttaatctgatgtat

SEQ ID NO: 3553771 - DNA, 16 bp, Homo sapiens
agttggctttgcccac

SEQ ID NO: 3553772 - DNA, 17 bp, Homo sapiens
agttggtgtaatcattt

SEQ ID NO: 3553773 - DNA, 14 bp, Homo sapiens
agttgtccagagat

SEQ ID NO: 3553774 - DNA, 22 bp, Homo sapiens
agttgtgagtttaccttgtata

SEQ ID NO: 3553775 - DNA, 22 bp, Homo sapiens
agtttaaaaagatgaaaaagaa

SEQ ID NO: 3553776 - DNA, 19 bp, Homo sapiens
agtttaaacaaaaaaccca

SEQ ID NO: 3553777 - DNA, 16 bp, Homo sapiens
agtttacccagcatga

SEQ ID NO: 3553778 - DNA, 20 bp, Homo sapiens
agtttaccttgtatactgta

SEQ ID NO: 3553779 - DNA, 13 bp, Homo sapiens
agtttatccaaat

SEQ ID NO: 3553780 - DNA, 16 bp, Homo sapiens
agtttatccaaatctt

SEQ ID NO: 3553781 - DNA, 20 bp, Homo sapiens
agtttcacaaatccttcaaa

SEQ ID NO: 3553782 - DNA, 14 bp, Homo sapiens
agtttctacattca

SEQ ID NO: 3553783 - DNA, 15 bp, Homo sapiens
agtttctcagctccc

SEQ ID NO: 3553784 - DNA, 20 bp, Homo sapiens
agtttctctcttgttgtcca

SEQ ID NO: 3553785 - DNA, 19 bp, Homo sapiens
agtttgaagaccaatcaaa

SEQ ID NO: 3553786 - DNA, 22 bp, Homo sapiens
agtttgacaccttagagaagct

SEQ ID NO: 3553787 - DNA, 17 bp, Homo sapiens
agtttgctctaccaaat

SEQ ID NO: 3553788 - DNA, 12 bp, Homo sapiens
agtttgctgtgc

SEQ ID NO: 3553789 - DNA, 15 bp, Homo sapiens
agtttgtagccaggt

SEQ ID NO: 3553790 - DNA, 16 bp, Homo sapiens
agttttaacttccagt

SEQ ID NO: 3553791 - DNA, 13 bp, Homo sapiens
agttttatttgta

SEQ ID NO: 3553792 - DNA, 14 bp, Homo sapiens
agttttatttgtat

SEQ ID NO: 3553793 - DNA, 12 bp, Homo sapiens
agttttccctgg

SEQ ID NO: 3553794 - DNA, 20 bp, Homo sapiens
agttttccgaagtctctgat

SEQ ID NO: 3553795 - DNA, 14 bp, Homo sapiens
agtttttgaaatac

SEQ ID NO: 3553796 - DNA, 22 bp, Homo sapiens
agttttttgaaaatgggctcaa

SEQ ID NO: 3553797 - DNA, 21 bp, Homo sapiens
agttttttgaaattatgtgac

SEQ ID NO: 3553798 - DNA, 14 bp, Homo sapiens
ataaaaaatgacaa

SEQ ID NO: 3553799 - DNA, 12 bp, Homo sapiens
ataaaaatcata

SEQ ID NO: 3553800 - DNA, 14 bp, Homo sapiens
ataaaaatcatata

SEQ ID NO: 3553801 - DNA, 18 bp, Homo sapiens
ataaaaatcatatagacc

SEQ ID NO: 3553802 - DNA, 14 bp, Homo sapiens
ataaaaatgtcttg

SEQ ID NO: 3553803 - DNA, 18 bp, Homo sapiens
ataaaataacttgcatct

SEQ ID NO: 3553804 - DNA, 16 bp, Homo sapiens
ataaaatcaaaacaag

SEQ ID NO: 3553805 - DNA, 21 bp, Homo sapiens
ataaaatcaaaacaagtgaaa

SEQ ID NO: 3553806 - DNA, 17 bp, Homo sapiens
ataaaatgatcctgcca

SEQ ID NO: 3553807 - DNA, 13 bp, Homo sapiens
ataaaatttaatt

SEQ ID NO: 3553808 - DNA, 13 bp, Homo sapiens
ataaaccaaatat

SEQ ID NO: 3553809 - DNA, 22 bp, Homo sapiens
ataaaccaaatatgttaaagtt

SEQ ID NO: 3553810 - DNA, 12 bp, Homo sapiens
ataaaccaatct

SEQ ID NO: 3553811 - DNA, 18 bp, Homo sapiens
ataaaccgtgtatttatt

SEQ ID NO: 3553812 - DNA, 19 bp, Homo sapiens
ataaactactctttgattt

SEQ ID NO: 3553813 - DNA, 23 bp, Homo sapiens
ataaactggtatgaataattgca

SEQ ID NO: 3553814 - DNA, 18 bp, Homo sapiens
ataaagacaatcactgcc

SEQ ID NO: 3553815 - DNA, 21 bp, Homo sapiens
ataaagaccgtacaaactcag

SEQ ID NO: 3553816 - DNA, 18 bp, Homo sapiens
ataaagatcgcccccacc

SEQ ID NO: 3553817 - DNA, 14 bp, Homo sapiens
ataaagcaataaga

SEQ ID NO: 3553818 - DNA, 16 bp, Homo sapiens
ataaagcaatgtgttt

SEQ ID NO: 3553819 - DNA, 17 bp, Homo sapiens
ataaaggcagttttcta

SEQ ID NO: 3553820 - DNA, 18 bp, Homo sapiens
ataaaggcagttttctaa

SEQ ID NO: 3553821 - DNA, 16 bp, Homo sapiens
ataaagtaaatacatg

SEQ ID NO: 3553822 - DNA, 13 bp, Homo sapiens
ataaagtcagtga

SEQ ID NO: 3553823 - DNA, 19 bp, Homo sapiens
ataaagtgcctcggacagt

SEQ ID NO: 3553824 - DNA, 22 bp, Homo sapiens
ataaatagggaagatggagaca

SEQ ID NO: 3553825 - DNA, 16 bp, Homo sapiens
ataaatagtattccaa

SEQ ID NO: 3553826 - DNA, 13 bp, Homo sapiens
ataaatatatcta

SEQ ID NO: 3553827 - DNA, 15 bp, Homo sapiens
ataaatcacacattc

SEQ ID NO: 3553828 - DNA, 15 bp, Homo sapiens
ataaatcacagatgc

SEQ ID NO: 3553829 - DNA, 16 bp, Homo sapiens
ataaatcacagatgca

SEQ ID NO: 3553830 - DNA, 18 bp, Homo sapiens
ataaatcacagatgcata

SEQ ID NO: 3553831 - DNA, 15 bp, Homo sapiens
ataaatcatgttgtt

SEQ ID NO: 3553832 - DNA, 21 bp, Homo sapiens
ataaatcatgttgttgtgtgt

SEQ ID NO: 3553833 - DNA, 19 bp, Homo sapiens
ataaatcattcttactaaa

SEQ ID NO: 3553834 - DNA, 21 bp, Homo sapiens
ataaatcattcttactaaaaa

SEQ ID NO: 3553835 - DNA, 15 bp, Homo sapiens
ataaatctgacccag

SEQ ID NO: 3553836 - DNA, 23 bp, Homo sapiens
ataaatggcccggacatgtcttg

SEQ ID NO: 3553837 - DNA, 12 bp, Homo sapiens
ataaatgtacat

SEQ ID NO: 3553838 - DNA, 15 bp, Homo sapiens
ataaatgtattgatt

SEQ ID NO: 3553839 - DNA, 12 bp, Homo sapiens
ataaatgtcact

SEQ ID NO: 3553840 - DNA, 20 bp, Homo sapiens
atccttctcactgccatgga

SEQ ID NO: 3553841 - DNA, 20 bp, Homo sapiens
atccttctttgtaatacttt

SEQ ID NO: 3553842 - DNA, 19 bp, Homo sapiens
atccttgattacttccact

SEQ ID NO: 3553843 - DNA, 19 bp, Homo sapiens
atccttggctttcagagcc

SEQ ID NO: 3553844 - DNA, 22 bp, Homo sapiens
atcctttcaaaagaagagtttt

SEQ ID NO: 3553845 - DNA, 14 bp, Homo sapiens
atccttttccttat

SEQ ID NO: 3553846 - DNA, 20 bp, Homo sapiens
atccttttccttatttgcct

SEQ ID NO: 3553847 - DNA, 17 bp, Homo sapiens
atcgacttgttcttgat

SEQ ID NO: 3553848 - DNA, 23 bp, Homo sapiens
atcgattgtgtacttttcctttg

SEQ ID NO: 3553849 - DNA, 22 bp, Homo sapiens
atcgctaaagggaccatctgct

SEQ ID NO: 3553850 - DNA, 18 bp, Homo sapiens
atcgggagcacccagagc

SEQ ID NO: 3553851 - DNA, 19 bp, Homo sapiens
atcgggagcacccagagca

SEQ ID NO: 3553852 - DNA, 23 bp, Homo sapiens
atctaaaaatagacttaaatctc

SEQ ID NO: 3553853 - DNA, 18 bp, Homo sapiens
atctaaaagctctgttcc

SEQ ID NO: 3553854 - DNA, 21 bp, Homo sapiens
atctaacgtgttccagtgtct

SEQ ID NO: 3553855 - DNA, 15 bp, Homo sapiens
atctaagtgatataa

SEQ ID NO: 3553856 - DNA, 14 bp, Homo sapiens
atctaatctaaaag

SEQ ID NO: 3553857 - DNA, 15 bp, Homo sapiens
atctagctagtaata

SEQ ID NO: 3553858 - DNA, 18 bp, Homo sapiens
atctagtgacagaggaga

SEQ ID NO: 3553859 - DNA, 18 bp, Homo sapiens
atctagttgtcaataaat

SEQ ID NO: 3553860 - DNA, 13 bp, Homo sapiens
atctataatttac

SEQ ID NO: 3553861 - DNA, 19 bp, Homo sapiens
atctattgtttgttgcact

SEQ ID NO: 3553862 - DNA, 16 bp, Homo sapiens
atctcaagtaaaacaa

SEQ ID NO: 3553863 - DNA, 17 bp, Homo sapiens
atctcacaggctgagaa

SEQ ID NO: 3553864 - DNA, 16 bp, Homo sapiens
atctcacatatacaag

SEQ ID NO: 3553865 - DNA, 14 bp, Homo sapiens
atctcagccatagg

SEQ ID NO: 3553866 - DNA, 11 bp, Homo sapiens
atctcagccca

SEQ ID NO: 3553867 - DNA, 21 bp, Homo sapiens
atctcaggagatggagggctt

SEQ ID NO: 3553868 - DNA, 19 bp, Homo sapiens
atctcagggaactgaccct

SEQ ID NO: 3553869 - DNA, 15 bp, Homo sapiens
atctcatctgtctcg

SEQ ID NO: 3553870 - DNA, 18 bp, Homo sapiens
atctccaaggcagggacc

SEQ ID NO: 3553871 - DNA, 15 bp, Homo sapiens
atctccactccagat

SEQ ID NO: 3553872 - DNA, 16 bp, Homo sapiens
atctccactggaccct

SEQ ID NO: 3553873 - DNA, 16 bp, Homo sapiens
atctcccccactccac

SEQ ID NO: 3553874 - DNA, 19 bp, Homo sapiens
atctccctcctccaggtcg

SEQ ID NO: 3553875 - DNA, 16 bp, Homo sapiens
atctccttgtggccta

SEQ ID NO: 3553876 - DNA, 16 bp, Homo sapiens
atctcctttgaagaag

SEQ ID NO: 3553877 - DNA, 20 bp, Homo sapiens
atctcctttgaagaaggcaa

SEQ ID NO: 3553878 - DNA, 19 bp, Homo sapiens
atctctcaaatctgttatc

SEQ ID NO: 3553879 - DNA, 18 bp, Homo sapiens
atctctccccatatataa

SEQ ID NO: 3553880 - DNA, 17 bp, Homo sapiens
atctctcttgtcctctt

SEQ ID NO: 3553881 - DNA, 17 bp, Homo sapiens
atctctgtgtgcacaaa

SEQ ID NO: 3553882 - DNA, 19 bp, Homo sapiens
atctctgtgtgcacaaata

SEQ ID NO: 3553883 - DNA, 13 bp, Homo sapiens
atctcttctgcaa

SEQ ID NO: 3553884 - DNA, 14 bp, Homo sapiens
atctcttctgcaag

SEQ ID NO: 3553885 - DNA, 13 bp, Homo sapiens
atctcttctggtg

SEQ ID NO: 3553886 - DNA, 15 bp, Homo sapiens
atctcttgcccttcc

SEQ ID NO: 3553887 - DNA, 19 bp, Homo sapiens
atctctttccaccatacct

SEQ ID NO: 3553888 - DNA, 22 bp, Homo sapiens
atctctttgttctaaagatgga

SEQ ID NO: 3553889 - DNA, 17 bp, Homo sapiens
atctgaaaggccagcag

SEQ ID NO: 3553890 - DNA, 23 bp, Homo sapiens
atctgaactgaccttgaatcttt

SEQ ID NO: 3553891 - DNA, 22 bp, Homo sapiens
atctgaatgaaaataactgaac

SEQ ID NO: 3553892 - DNA, 13 bp, Homo sapiens
atctgacatatta

SEQ ID NO: 3553893 - DNA, 14 bp, Homo sapiens
atctgaccagcagc

SEQ ID NO: 3553894 - DNA, 13 bp, Homo sapiens
atctgacccagtg

SEQ ID NO: 3553895 - DNA, 20 bp, Homo sapiens
atctgcagggggtgtgtctg

SEQ ID NO: 3553896 - DNA, 19 bp, Homo sapiens
atctgcagtacagtcttat

SEQ ID NO: 3553897 - DNA, 23 bp, Homo sapiens
atctgccccctagttcaggtcca

SEQ ID NO: 3553898 - DNA, 12 bp, Homo sapiens
atctgcctggag

SEQ ID NO: 3553899 - DNA, 16 bp, Homo sapiens
atctgcctggaggcaa

SEQ ID NO: 3553900 - DNA, 16 bp, Homo sapiens
atctgctaagtaattt

SEQ ID NO: 3553901 - DNA, 12 bp, Homo sapiens
atctgctgcagt

SEQ ID NO: 3553902 - DNA, 12 bp, Homo sapiens
atctgctgtctt

SEQ ID NO: 3553903 - DNA, 21 bp, Homo sapiens
atctgctgtcttttctttgcc

SEQ ID NO: 3553904 - DNA, 15 bp, Homo sapiens
atctggaacccagac

SEQ ID NO: 3553905 - DNA, 16 bp, Homo sapiens
atctggaacccagact

SEQ ID NO: 3553906 - DNA, 17 bp, Homo sapiens
atctggaacctcagcct

SEQ ID NO: 3553907 - DNA, 15 bp, Homo sapiens
atctggactcctctg

SEQ ID NO: 3553908 - DNA, 16 bp, Homo sapiens
atctggactcctctgt

SEQ ID NO: 3553909 - DNA, 18 bp, Homo sapiens
atctggactcctctgtcc

SEQ ID NO: 3553910 - DNA, 16 bp, Homo sapiens
atctggcggaggtctc

SEQ ID NO: 3553911 - DNA, 19 bp, Homo sapiens
atctggcggaggtctctgg

SEQ ID NO: 3553912 - DNA, 15 bp, Homo sapiens
atctggctgcacagg

SEQ ID NO: 3553913 - DNA, 17 bp, Homo sapiens
atctggcttccctggaa

SEQ ID NO: 3553914 - DNA, 23 bp, Homo sapiens
atctggggagagcggctggagaa

SEQ ID NO: 3553915 - DNA, 17 bp, Homo sapiens
atctgggggagtggaat

SEQ ID NO: 3553916 - DNA, 15 bp, Homo sapiens
atctgggtctctaat

SEQ ID NO: 3553917 - DNA, 18 bp, Homo sapiens
atctgggtctctaatctg

SEQ ID NO: 3553918 - DNA, 18 bp, Homo sapiens
atctggtcctacccatcc

SEQ ID NO: 3553919 - DNA, 20 bp, Homo sapiens
atctgtaacaggtattttgt

SEQ ID NO: 3553920 - DNA, 20 bp, Homo sapiens
atctgtaattgtaattccaa

SEQ ID NO: 3553921 - DNA, 22 bp, Homo sapiens
atctgtatataagttgctgtgt

SEQ ID NO: 3553922 - DNA, 19 bp, Homo sapiens
atctgtctcggctctgcat

SEQ ID NO: 3553923 - DNA, 18 bp, Homo sapiens
atctgtgacctctgacaa

SEQ ID NO: 3553924 - DNA, 14 bp, Homo sapiens
atctgtgcaaacag

SEQ ID NO: 3553925 - DNA, 16 bp, Homo sapiens
atctgtgcttctaata

SEQ ID NO: 3553926 - DNA, 21 bp, Homo sapiens
atctgtgcttctaatattagt

SEQ ID NO: 3553927 - DNA, 14 bp, Homo sapiens
atctgtggagctgc

SEQ ID NO: 3553928 - DNA, 19 bp, Homo sapiens
atctgtggagctgccacag

SEQ ID NO: 3553929 - DNA, 21 bp, Homo sapiens
atctgtggagctgccacagag

SEQ ID NO: 3553930 - DNA, 19 bp, Homo sapiens
atctgtgtggctcctgggc

SEQ ID NO: 3553931 - DNA, 17 bp, Homo sapiens
atctgtttaaagcatat

SEQ ID NO: 3553932 - DNA, 22 bp, Homo sapiens
atctgtttaaagcatatagaga

SEQ ID NO: 3553933 - DNA, 18 bp, Homo sapiens
atcttaatgtatcaaact

SEQ ID NO: 3553934 - DNA, 14 bp, Homo sapiens
atcttaatgtctgg

SEQ ID NO: 3553935 - DNA, 19 bp, Homo sapiens
atcttaatgtctggtgttt

SEQ ID NO: 3553936 - DNA, 16 bp, Homo sapiens
atcttagtgtatgatt

SEQ ID NO: 3553937 - DNA, 16 bp, Homo sapiens
atcttatcatttatca

SEQ ID NO: 3553938 - DNA, 21 bp, Homo sapiens
atcttattgtttaatcttttt

SEQ ID NO: 3553939 - DNA, 13 bp, Homo sapiens
atcttatttagga

SEQ ID NO: 3553940 - DNA, 11 bp, Homo sapiens
atcttcacttt

SEQ ID NO: 3553941 - DNA, 17 bp, Homo sapiens
atcttcagaactgccct

SEQ ID NO: 3553942 - DNA, 18 bp, Homo sapiens
atcttcagaactgccctt

SEQ ID NO: 3553943 - DNA, 19 bp, Homo sapiens
atcttcagaactgcccttg

SEQ ID NO: 3553944 - DNA, 21 bp, Homo sapiens
atcttcagaactgcccttgct

SEQ ID NO: 3553945 - DNA, 15 bp, Homo sapiens
atcttcccagtatta

SEQ ID NO: 3553946 - DNA, 17 bp, Homo sapiens
atcttctacatgcaatt

SEQ ID NO: 3553947 - DNA, 18 bp, Homo sapiens
atcttctgaagaggaaaa

SEQ ID NO: 3553948 - DNA, 17 bp, Homo sapiens
atcttcttatgcaattt

SEQ ID NO: 3553949 - DNA, 20 bp, Homo sapiens
atcttcttatgcaatttcct

SEQ ID NO: 3553950 - DNA, 14 bp, Homo sapiens
atcttctttataat

SEQ ID NO: 3553951 - DNA, 15 bp, Homo sapiens
atcttctttcttcca

SEQ ID NO: 3553952 - DNA, 16 bp, Homo sapiens
atcttctttcttccac

SEQ ID NO: 3553953 - DNA, 18 bp, Homo sapiens
atcttggccctcctcagc

SEQ ID NO: 3553954 - DNA, 22 bp, Homo sapiens
atcttggccctcctcagctccc

SEQ ID NO: 3553955 - DNA, 23 bp, Homo sapiens
atcttggccctcctcagctccct

SEQ ID NO: 3553956 - DNA, 17 bp, Homo sapiens
atcttgtgctatgaaac

SEQ ID NO: 3553957 - DNA, 19 bp, Homo sapiens
atcttgtgctatgaaacaa

SEQ ID NO: 3553958 - DNA, 20 bp, Homo sapiens
atcttgtgctatgaaacaat

SEQ ID NO: 3553959 - DNA, 23 bp, Homo sapiens
atcttgtgctatgaaacaatctt

SEQ ID NO: 3553960 - DNA, 12 bp, Homo sapiens
atctttaaaata

SEQ ID NO: 3553961 - DNA, 21 bp, Homo sapiens
atctttagcagtttcctcagt

SEQ ID NO: 3553962 - DNA, 23 bp, Homo sapiens
atctttagcagtttcctcagtga

SEQ ID NO: 3553963 - DNA, 14 bp, Homo sapiens
atctttagcctggg

SEQ ID NO: 3553964 - DNA, 13 bp, Homo sapiens
atctttcaccttt

SEQ ID NO: 3553965 - DNA, 15 bp, Homo sapiens
atctttcatgtcttg

SEQ ID NO: 3553966 - DNA, 17 bp, Homo sapiens
atctttcgataaacaac

SEQ ID NO: 3553967 - DNA, 23 bp, Homo sapiens
atctttctatataaaatgtattc

SEQ ID NO: 3553968 - DNA, 20 bp, Homo sapiens
atctttctttccaaaacatt

SEQ ID NO: 3553969 - DNA, 15 bp, Homo sapiens
atctttgaatatgta

SEQ ID NO: 3553970 - DNA, 17 bp, Homo sapiens
atctttggcatgattta

SEQ ID NO: 3553971 - DNA, 13 bp, Homo sapiens
atctttgtggcca

SEQ ID NO: 3553972 - DNA, 19 bp, Homo sapiens
atgttggagcagcaggcct

SEQ ID NO: 3553973 - DNA, 23 bp, Homo sapiens
atgttgggaggatacagaggaga

SEQ ID NO: 3553974 - DNA, 23 bp, Homo sapiens
atgttggggtaaaagtgttgctg

SEQ ID NO: 3553975 - DNA, 20 bp, Homo sapiens
atgttgggttgttacagagt

SEQ ID NO: 3553976 - DNA, 14 bp, Homo sapiens
atgttgtaatgctg

SEQ ID NO: 3553977 - DNA, 17 bp, Homo sapiens
atgttgtttataataaa

SEQ ID NO: 3553978 - DNA, 15 bp, Homo sapiens
atgtttacagaggac

SEQ ID NO: 3553979 - DNA, 14 bp, Homo sapiens
atgtttatattgtt

SEQ ID NO: 3553980 - DNA, 18 bp, Homo sapiens
atgtttatattgttttta

SEQ ID NO: 3553981 - DNA, 17 bp, Homo sapiens
atgtttgccatttgctg

SEQ ID NO: 3553982 - DNA, 14 bp, Homo sapiens
atgtttggatggtt

SEQ ID NO: 3553983 - DNA, 18 bp, Homo sapiens
atgttttagcatttgtat

SEQ ID NO: 3553984 - DNA, 24 bp, Homo sapiens
atgttttagcatttgtataaagaa

SEQ ID NO: 3553985 - DNA, 12 bp, Homo sapiens
atgttttcaaat

SEQ ID NO: 3553986 - DNA, 16 bp, Homo sapiens
atgttttgaaagacag

SEQ ID NO: 3553987 - DNA, 15 bp, Homo sapiens
atgtttttatttcaa

SEQ ID NO: 3553988 - DNA, 16 bp, Homo sapiens
atgtttttatttcaat

SEQ ID NO: 3553989 - DNA, 23 bp, Homo sapiens
atgttttttcttcaaatgtttaa

SEQ ID NO: 3553990 - DNA, 22 bp, Homo sapiens
attaaaaaagagacatccaaat

SEQ ID NO: 3553991 - DNA, 20 bp, Homo sapiens
attaaaaagttgttctttgt

SEQ ID NO: 3553992 - DNA, 21 bp, Homo sapiens
attaaaaataccttctatgta

SEQ ID NO: 3553993 - DNA, 23 bp, Homo sapiens
attaaaaataccttctatgtatt

SEQ ID NO: 3553994 - DNA, 16 bp, Homo sapiens
attaaaagaatatttt

SEQ ID NO: 3553995 - DNA, 17 bp, Homo sapiens
attaaaataaaccaaat

SEQ ID NO: 3553996 - DNA, 18 bp, Homo sapiens
attaaaataaaccaaata

SEQ ID NO: 3553997 - DNA, 13 bp, Homo sapiens
attaaaatataat

SEQ ID NO: 3553998 - DNA, 18 bp, Homo sapiens
attaaaatataatctcta

SEQ ID NO: 3553999 - DNA, 14 bp, Homo sapiens
attaaaatatttca

SEQ ID NO: 3554000 - DNA, 21 bp, Homo sapiens
attaaaatgcttacatttgaa

SEQ ID NO: 3554001 - DNA, 14 bp, Homo sapiens
attaaaatttctta

SEQ ID NO: 3554002 - DNA, 15 bp, Homo sapiens
attaaacggattatt

SEQ ID NO: 3554003 - DNA, 20 bp, Homo sapiens
attaaacggattattttttc

SEQ ID NO: 3554004 - DNA, 23 bp, Homo sapiens
attaaacggattattttttcaga

SEQ ID NO: 3554005 - DNA, 13 bp, Homo sapiens
attaaacttcagc

SEQ ID NO: 3554006 - DNA, 19 bp, Homo sapiens
attaaatgtggaaggaaaa

SEQ ID NO: 3554007 - DNA, 17 bp, Homo sapiens
attaacatattatttca

SEQ ID NO: 3554008 - DNA, 14 bp, Homo sapiens
attaacggtgctaa

SEQ ID NO: 3554009 - DNA, 15 bp, Homo sapiens
attaactaaagaaga

SEQ ID NO: 3554010 - DNA, 22 bp, Homo sapiens
attaactgagtagctctcctga

SEQ ID NO: 3554011 - DNA, 11 bp, Homo sapiens
attaagaaata

SEQ ID NO: 3554012 - DNA, 12 bp, Homo sapiens
attaaggttttc

SEQ ID NO: 3554013 - DNA, 15 bp, Homo sapiens
attaagtaacttatt

SEQ ID NO: 3554014 - DNA, 18 bp, Homo sapiens
attaatatccctacatgt

SEQ ID NO: 3554015 - DNA, 15 bp, Homo sapiens
attaatatttaccaa

SEQ ID NO: 3554016 - DNA, 22 bp, Homo sapiens
attaatatttaccaaagtagga

SEQ ID NO: 3554017 - DNA, 11 bp, Homo sapiens
attaatcaaga

SEQ ID NO: 3554018 - DNA, 17 bp, Homo sapiens
attaatcaagagaaact

SEQ ID NO: 3554019 - DNA, 20 bp, Homo sapiens
attaatcatacaaactctca

SEQ ID NO: 3554020 - DNA, 21 bp, Homo sapiens
attaatcatacaaactctcac

SEQ ID NO: 3554021 - DNA, 20 bp, Homo sapiens
attaatcctcttgagagaaa

SEQ ID NO: 3554022 - DNA, 16 bp, Homo sapiens
attaatcttagtgtat

SEQ ID NO: 3554023 - DNA, 14 bp, Homo sapiens
attaatcttattgt

SEQ ID NO: 3554024 - DNA, 21 bp, Homo sapiens
attaatggtttattctttgca

SEQ ID NO: 3554025 - DNA, 21 bp, Homo sapiens
attaatgtatccaatgaaata

SEQ ID NO: 3554026 - DNA, 23 bp, Homo sapiens
attaatgttccagtttgaagacc

SEQ ID NO: 3554027 - DNA, 15 bp, Homo sapiens
attaattatgtgtag

SEQ ID NO: 3554028 - DNA, 12 bp, Homo sapiens
attaattgcttt

SEQ ID NO: 3554029 - DNA, 14 bp, Homo sapiens
attaattgtcatta

SEQ ID NO: 3554030 - DNA, 12 bp, Homo sapiens
attaatttgaaa

SEQ ID NO: 3554031 - DNA, 10 bp, Homo sapiens
attacaaaga

SEQ ID NO: 3554032 - DNA, 15 bp, Homo sapiens
attacaaagttaaaa

SEQ ID NO: 3554033 - DNA, 14 bp, Homo sapiens
attacaaatcagaa

SEQ ID NO: 3554034 - DNA, 18 bp, Homo sapiens
attacaaatcagaagtca

SEQ ID NO: 3554035 - DNA, 13 bp, Homo sapiens
attacacaaagaa

SEQ ID NO: 3554036 - DNA, 21 bp, Homo sapiens
attacacaaagaacttgctgc

SEQ ID NO: 3554037 - DNA, 15 bp, Homo sapiens
attacagaaactgat

SEQ ID NO: 3554038 - DNA, 21 bp, Homo sapiens
attacagatctgcaccaccat

SEQ ID NO: 3554039 - DNA, 15 bp, Homo sapiens
attacagctggagaa

SEQ ID NO: 3554040 - DNA, 22 bp, Homo sapiens
attacatgttttttcatttgta

SEQ ID NO: 3554041 - DNA, 18 bp, Homo sapiens
attacattttatatgtga

SEQ ID NO: 3554042 - DNA, 20 bp, Homo sapiens
attaccttaaacttgcagta

SEQ ID NO: 3554043 - DNA, 13 bp, Homo sapiens
attaccttctttc

SEQ ID NO: 3554044 - DNA, 14 bp, Homo sapiens
attaccttctttct

SEQ ID NO: 3554045 - DNA, 13 bp, Homo sapiens
attacgtgctctg

SEQ ID NO: 3554046 - DNA, 14 bp, Homo sapiens
attactgttccaga

SEQ ID NO: 3554047 - DNA, 14 bp, Homo sapiens
attacttatttaac

SEQ ID NO: 3554048 - DNA, 15 bp, Homo sapiens
attacttatttttga

SEQ ID NO: 3554049 - DNA, 16 bp, Homo sapiens
attacttatttttgac

SEQ ID NO: 3554050 - DNA, 18 bp, Homo sapiens
attacttatttttgacag

SEQ ID NO: 3554051 - DNA, 19 bp, Homo sapiens
attacttatttttgacagt

SEQ ID NO: 3554052 - DNA, 16 bp, Homo sapiens
attactttaaattata

SEQ ID NO: 3554053 - DNA, 18 bp, Homo sapiens
attagacactttggaaga

SEQ ID NO: 3554054 - DNA, 22 bp, Homo sapiens
attagagaaaaccttaaaagta

SEQ ID NO: 3554055 - DNA, 13 bp, Homo sapiens
attagcaaggcag

SEQ ID NO: 3554056 - DNA, 14 bp, Homo sapiens
attagcaaggcaga

SEQ ID NO: 3554057 - DNA, 22 bp, Homo sapiens
attagcaattgactgtcactgt

SEQ ID NO: 3554058 - DNA, 14 bp, Homo sapiens
attaggatttcatg

SEQ ID NO: 3554059 - DNA, 11 bp, Homo sapiens
attaggctgtt

SEQ ID NO: 3554060 - DNA, 21 bp, Homo sapiens
attaggtcgttttccaaagag

SEQ ID NO: 3554061 - DNA, 19 bp, Homo sapiens
attagtatcacaaaaccac

SEQ ID NO: 3554062 - DNA, 16 bp, Homo sapiens
attagtgccacttaat

SEQ ID NO: 3554063 - DNA, 21 bp, Homo sapiens
attagtgccacttaatgtatg

SEQ ID NO: 3554064 - DNA, 18 bp, Homo sapiens
attagttggctttcataa

SEQ ID NO: 3554065 - DNA, 16 bp, Homo sapiens
attagttttaaaatga

SEQ ID NO: 3554066 - DNA, 16 bp, Homo sapiens
attataaatattttcc

SEQ ID NO: 3554067 - DNA, 16 bp, Homo sapiens
attataagttctattt

SEQ ID NO: 3554068 - DNA, 22 bp, Homo sapiens
attataagttctattttactgt

SEQ ID NO: 3554069 - DNA, 11 bp, Homo sapiens
attataagttg

SEQ ID NO: 3554070 - DNA, 15 bp, Homo sapiens
attatacttctttat

SEQ ID NO: 3554071 - DNA, 17 bp, Homo sapiens
attataggatcatttgt

SEQ ID NO: 3554072 - DNA, 13 bp, Homo sapiens
attatatgaagtt

SEQ ID NO: 3554073 - DNA, 13 bp, Homo sapiens
attatatgatatg

SEQ ID NO: 3554074 - DNA, 14 bp, Homo sapiens
attatatgatatgc

SEQ ID NO: 3554075 - DNA, 16 bp, Homo sapiens
attatatgcctgattc

SEQ ID NO: 3554076 - DNA, 21 bp, Homo sapiens
attatatgcctgattcatagt

SEQ ID NO: 3554077 - DNA, 16 bp, Homo sapiens
attatattcattcttt

SEQ ID NO: 3554078 - DNA, 14 bp, Homo sapiens
attatattctctta

SEQ ID NO: 3554079 - DNA, 18 bp, Homo sapiens
attatctcaaaactgcac

SEQ ID NO: 3554080 - DNA, 23 bp, Homo sapiens
attatctcaaaactgcactgtca

SEQ ID NO: 3554081 - DNA, 13 bp, Homo sapiens
attatctcaagta

SEQ ID NO: 3554082 - DNA, 14 bp, Homo sapiens
attatctcaagtaa

SEQ ID NO: 3554083 - DNA, 20 bp, Homo sapiens
attatctcctttgaagaagg

SEQ ID NO: 3554084 - DNA, 16 bp, Homo sapiens
attatcttatcattta

SEQ ID NO: 3554085 - DNA, 22 bp, Homo sapiens
attatgccacttccttttaact

SEQ ID NO: 3554086 - DNA, 13 bp, Homo sapiens
attatgtgacatt

SEQ ID NO: 3554087 - DNA, 14 bp, Homo sapiens
attattaagtaact

SEQ ID NO: 3554088 - DNA, 16 bp, Homo sapiens
attattaataatgaag

SEQ ID NO: 3554089 - DNA, 18 bp, Homo sapiens
attattaatcctcttgag

SEQ ID NO: 3554090 - DNA, 20 bp, Homo sapiens
attattaccttacagaagtt

SEQ ID NO: 3554091 - DNA, 21 bp, Homo sapiens
attattacttatttttgacag

SEQ ID NO: 3554092 - DNA, 14 bp, Homo sapiens
attattactttaaa

SEQ ID NO: 3554093 - DNA, 20 bp, Homo sapiens
attattactttatgaacaat

SEQ ID NO: 3554094 - DNA, 16 bp, Homo sapiens
attattatcgctttat

SEQ ID NO: 3554095 - DNA, 13 bp, Homo sapiens
attattatgttct

SEQ ID NO: 3554096 - DNA, 15 bp, Homo sapiens
attattatgttctta

SEQ ID NO: 3554097 - DNA, 12 bp, Homo sapiens
attattctcttt

SEQ ID NO: 3554098 - DNA, 18 bp, Homo sapiens
attattctcttttatctg

SEQ ID NO: 3554099 - DNA, 21 bp, Homo sapiens
attattctcttttatctgttt

SEQ ID NO: 3554100 - DNA, 19 bp, Homo sapiens
attattgtctgttttcctt

SEQ ID NO: 3554101 - DNA, 14 bp, Homo sapiens
attatttaagacta

SEQ ID NO: 3554102 - DNA, 19 bp, Homo sapiens
attatttctaatccttttc

SEQ ID NO: 3554103 - DNA, 21 bp, Homo sapiens
attatttgggggaactggaca

SEQ ID NO: 3554104 - DNA, 16 bp, Homo sapiens
attattttttaataaa

SEQ ID NO: 3554105 - DNA, 22 bp, Homo sapiens
attgcactgaagtttttgaaat

SEQ ID NO: 3554106 - DNA, 23 bp, Homo sapiens
attgcactgaagtttttgaaata

SEQ ID NO: 3554107 - DNA, 13 bp, Homo sapiens
attgccagcaaat

SEQ ID NO: 3554108 - DNA, 22 bp, Homo sapiens
attgccccatccagacctggct

SEQ ID NO: 3554109 - DNA, 13 bp, Homo sapiens
attgcccctggct

SEQ ID NO: 3554110 - DNA, 17 bp, Homo sapiens
attgcccctggctttgc

SEQ ID NO: 3554111 - DNA, 19 bp, Homo sapiens
attgcccctggctttgcct

SEQ ID NO: 3554112 - DNA, 20 bp, Homo sapiens
attgcccctggctttgcctc

SEQ ID NO: 3554113 - DNA, 21 bp, Homo sapiens
attgcctaagaataaacattt

SEQ ID NO: 3554114 - DNA, 17 bp, Homo sapiens
attgcgcctaatgtgtt

SEQ ID NO: 3554115 - DNA, 21 bp, Homo sapiens
attgctgaggcaccgtccagg

SEQ ID NO: 3554116 - DNA, 13 bp, Homo sapiens
attgctgctgccc

SEQ ID NO: 3554117 - DNA, 14 bp, Homo sapiens
attgcttactgata

SEQ ID NO: 3554118 - DNA, 23 bp, Homo sapiens
attgcttctaaaacaataaagat

SEQ ID NO: 3554119 - DNA, 12 bp, Homo sapiens
attgctttgagc

SEQ ID NO: 3554120 - DNA, 16 bp, Homo sapiens
attgcttttttaaata

SEQ ID NO: 3554121 - DNA, 14 bp, Homo sapiens
attggaaagacttc

SEQ ID NO: 3554122 - DNA, 19 bp, Homo sapiens
attggaatagcagcctcac

SEQ ID NO: 3554123 - DNA, 14 bp, Homo sapiens
attggatttcctaa

SEQ ID NO: 3554124 - DNA, 15 bp, Homo sapiens
attggatttcctaat

SEQ ID NO: 3554125 - DNA, 19 bp, Homo sapiens
attggcaaagtttaaatgt

SEQ ID NO: 3554126 - DNA, 20 bp, Homo sapiens
attggcacctaatccaggca

SEQ ID NO: 3554127 - DNA, 14 bp, Homo sapiens
attggcctctgtat

SEQ ID NO: 3554128 - DNA, 21 bp, Homo sapiens
attggctccatatcatttgag

SEQ ID NO: 3554129 - DNA, 22 bp, Homo sapiens
attggctgcttaaactggaaag

SEQ ID NO: 3554130 - DNA, 19 bp, Homo sapiens
attggctggttaatgggaa

SEQ ID NO: 3554131 - DNA, 19 bp, Homo sapiens
attggtatagccatgattt

SEQ ID NO: 3554132 - DNA, 23 bp, Homo sapiens
attgtaaaaccccatctctacta

SEQ ID NO: 3554133 - DNA, 19 bp, Homo sapiens
attgtaaaagcattttgta

SEQ ID NO: 3554134 - DNA, 16 bp, Homo sapiens
attgtaacttatttca

SEQ ID NO: 3554135 - DNA, 19 bp, Homo sapiens
attgtatattacaatgatc

SEQ ID NO: 3554136 - DNA, 18 bp, Homo sapiens
attgtatttaagacataa

SEQ ID NO: 3554137 - DNA, 19 bp, Homo sapiens
attgtatttaagacataaa

SEQ ID NO: 3554138 - DNA, 21 bp, Homo sapiens
attgtatttaagacataaaca

SEQ ID NO: 3554139 - DNA, 22 bp, Homo sapiens
attgtatttaagacataaacaa

SEQ ID NO: 3554140 - DNA, 16 bp, Homo sapiens
attgtattttgatgag

SEQ ID NO: 3554141 - DNA, 19 bp, Homo sapiens
attgtcaacacaaactggc

SEQ ID NO: 3554142 - DNA, 23 bp, Homo sapiens
attgtccctctgccccatcctcc

SEQ ID NO: 3554143 - DNA, 13 bp, Homo sapiens
attgtgatgtgtc

SEQ ID NO: 3554144 - DNA, 21 bp, Homo sapiens
attgtgtatctgtgcttctaa

SEQ ID NO: 3554145 - DNA, 21 bp, Homo sapiens
attgtgtatttaaaaaaaaga

SEQ ID NO: 3554146 - DNA, 20 bp, Homo sapiens
attgttagaaaatgacttat

SEQ ID NO: 3554147 - DNA, 21 bp, Homo sapiens
attgttctcacttattattaa

SEQ ID NO: 3554148 - DNA, 14 bp, Homo sapiens
attgtttattttag

SEQ ID NO: 3554149 - DNA, 17 bp, Homo sapiens
attgtttctcaaatctt

SEQ ID NO: 3554150 - DNA, 15 bp, Homo sapiens
attgtttgatgtttt

SEQ ID NO: 3554151 - DNA, 21 bp, Homo sapiens
attgttttctatttatgcctt

SEQ ID NO: 3554152 - DNA, 15 bp, Homo sapiens
attgtttttatatat

SEQ ID NO: 3554153 - DNA, 19 bp, Homo sapiens
attgtttttatatattata

SEQ ID NO: 3554154 - DNA, 16 bp, Homo sapiens
atttaaaaaaaagaaa

SEQ ID NO: 3554155 - DNA, 22 bp, Homo sapiens
atttaaaaaaaagaaacttttc

SEQ ID NO: 3554156 - DNA, 22 bp, Homo sapiens
atttaaaaaatcccttcctgag

SEQ ID NO: 3554157 - DNA, 19 bp, Homo sapiens
atttaaaacattaaaatat

SEQ ID NO: 3554158 - DNA, 13 bp, Homo sapiens
atttaaaactgtt

SEQ ID NO: 3554159 - DNA, 17 bp, Homo sapiens
atttaaaactgttattt

SEQ ID NO: 3554160 - DNA, 17 bp, Homo sapiens
atttaaaagacagcttt

SEQ ID NO: 3554161 - DNA, 15 bp, Homo sapiens
atttaaactgtgttt

SEQ ID NO: 3554162 - DNA, 20 bp, Homo sapiens
atttaaagaaaaccacagtt

SEQ ID NO: 3554163 - DNA, 23 bp, Homo sapiens
atttaaagaaatatgtattctgt

SEQ ID NO: 3554164 - DNA, 20 bp, Homo sapiens
atttaaatagcattatctta

SEQ ID NO: 3554165 - DNA, 15 bp, Homo sapiens
atttaaatgtgtaca

SEQ ID NO: 3554166 - DNA, 13 bp, Homo sapiens
atttaacaagatc

SEQ ID NO: 3554167 - DNA, 11 bp, Homo sapiens
atttaacttct

SEQ ID NO: 3554168 - DNA, 16 bp, Homo sapiens
atttaagacactgaaa

SEQ ID NO: 3554169 - DNA, 17 bp, Homo sapiens
atttaagacataaacaa

SEQ ID NO: 3554170 - DNA, 20 bp, Homo sapiens
atttaagacataaacaaaga

SEQ ID NO: 3554171 - DNA, 21 bp, Homo sapiens
atttaagacataaacaaagac

SEQ ID NO: 3554172 - DNA, 16 bp, Homo sapiens
atttaagatgtacatt

SEQ ID NO: 3554173 - DNA, 18 bp, Homo sapiens
atttaagatgtacattta

SEQ ID NO: 3554174 - DNA, 20 bp, Homo sapiens
atttaagatgtacatttaat

SEQ ID NO: 3554175 - DNA, 22 bp, Homo sapiens
atttaagccttataaaccaatc

SEQ ID NO: 3554176 - DNA, 21 bp, Homo sapiens
atttaaggatagtgtgaagat

SEQ ID NO: 3554177 - DNA, 15 bp, Homo sapiens
atttaatatttactc

SEQ ID NO: 3554178 - DNA, 16 bp, Homo sapiens
atttaatatttactct

SEQ ID NO: 3554179 - DNA, 18 bp, Homo sapiens
atttaatttgaaatatgg

SEQ ID NO: 3554180 - DNA, 15 bp, Homo sapiens
atttaatttgaagat

SEQ ID NO: 3554181 - DNA, 20 bp, Homo sapiens
atttaatttgtaaaacttct

SEQ ID NO: 3554182 - DNA, 16 bp, Homo sapiens
atttaatttttccttt

SEQ ID NO: 3554183 - DNA, 19 bp, Homo sapiens
atttacactattatttcct

SEQ ID NO: 3554184 - DNA, 20 bp, Homo sapiens
atttaccaaagagatattga

SEQ ID NO: 3554185 - DNA, 18 bp, Homo sapiens
atttaccatcatctctga

SEQ ID NO: 3554186 - DNA, 23 bp, Homo sapiens
atttacccttttcccccttccca

SEQ ID NO: 3554187 - DNA, 15 bp, Homo sapiens
atttacctaagatta

SEQ ID NO: 3554188 - DNA, 17 bp, Homo sapiens
atttacctaagattaca

SEQ ID NO: 3554189 - DNA, 18 bp, Homo sapiens
atttactaccttatcact

SEQ ID NO: 3554190 - DNA, 19 bp, Homo sapiens
atttactgatgagagaatg

SEQ ID NO: 3554191 - DNA, 20 bp, Homo sapiens
atttactggacataacattt

SEQ ID NO: 3554192 - DNA, 19 bp, Homo sapiens
atttacttcttatacattt

SEQ ID NO: 3554193 - DNA, 15 bp, Homo sapiens
atttagaaaaagtca

SEQ ID NO: 3554194 - DNA, 20 bp, Homo sapiens
atttagaaaaagtcaatgta

SEQ ID NO: 3554195 - DNA, 12 bp, Homo sapiens
atttagaagata

SEQ ID NO: 3554196 - DNA, 12 bp, Homo sapiens
atttagaagcca

SEQ ID NO: 3554197 - DNA, 13 bp, Homo sapiens
atttagaagccaa

SEQ ID NO: 3554198 - DNA, 23 bp, Homo sapiens
atttagaagccaactatgattat

SEQ ID NO: 3554199 - DNA, 22 bp, Homo sapiens
atttaggcttttccaaatcaag

SEQ ID NO: 3554200 - DNA, 14 bp, Homo sapiens
atttagtcaacata

SEQ ID NO: 3554201 - DNA, 14 bp, Homo sapiens
atttagtgtgaata

SEQ ID NO: 3554202 - DNA, 23 bp, Homo sapiens
atttagttgcagtccagctcttt

SEQ ID NO: 3554203 - DNA, 15 bp, Homo sapiens
atttatacaccagca

SEQ ID NO: 3554204 - DNA, 22 bp, Homo sapiens
atttatacaccagcaatttaga

SEQ ID NO: 3554205 - DNA, 18 bp, Homo sapiens
atttatacctcaaactat

SEQ ID NO: 3554206 - DNA, 14 bp, Homo sapiens
atttatatattgaa

SEQ ID NO: 3554207 - DNA, 18 bp, Homo sapiens
atttatcctgaaatttca

SEQ ID NO: 3554208 - DNA, 15 bp, Homo sapiens
atttatctataattt

SEQ ID NO: 3554209 - DNA, 21 bp, Homo sapiens
atttatgaaagtattaaaatg

SEQ ID NO: 3554210 - DNA, 23 bp, Homo sapiens
atttatgctataaattttttgaa

SEQ ID NO: 3554211 - DNA, 12 bp, Homo sapiens
atttatgtgcac

SEQ ID NO: 3554212 - DNA, 17 bp, Homo sapiens
atttattaattgctttg

SEQ ID NO: 3554213 - DNA, 14 bp, Homo sapiens
atttattaatttga

SEQ ID NO: 3554214 - DNA, 16 bp, Homo sapiens
atttattaatttgaaa

SEQ ID NO: 3554215 - DNA, 18 bp, Homo sapiens
atttattaatttgaaacc

SEQ ID NO: 3554216 - DNA, 15 bp, Homo sapiens
atttattacacaaag

SEQ ID NO: 3554217 - DNA, 18 bp, Homo sapiens
atttattgaaatgatttc

SEQ ID NO: 3554218 - DNA, 21 bp, Homo sapiens
atttattgaaatgatttcaca

SEQ ID NO: 3554219 - DNA, 22 bp, Homo sapiens
atttattgaaatgatttcacag

SEQ ID NO: 3554220 - DNA, 17 bp, Homo sapiens
atttattgatgttttca

SEQ ID NO: 3554221 - DNA, 23 bp, Homo sapiens
atttattgttagaaaatgactta

SEQ ID NO: 3554222 - DNA, 14 bp, Homo sapiens
atttatttattcat

SEQ ID NO: 3554223 - DNA, 15 bp, Homo sapiens
atttatttatttgtt

SEQ ID NO: 3554224 - DNA, 22 bp, Homo sapiens
atttatttctagttctttcctc

SEQ ID NO: 3554225 - DNA, 13 bp, Homo sapiens
atttatttgaggt

SEQ ID NO: 3554226 - DNA, 19 bp, Homo sapiens
atttatttgaggtcagtgt

SEQ ID NO: 3554227 - DNA, 21 bp, Homo sapiens
atttatttgaggtcagtgttt

SEQ ID NO: 3554228 - DNA, 16 bp, Homo sapiens
atttattttcttttga

SEQ ID NO: 3554229 - DNA, 18 bp, Homo sapiens
atttcaaacattttgtat

SEQ ID NO: 3554230 - DNA, 16 bp, Homo sapiens
atttcaattgtttata

SEQ ID NO: 3554231 - DNA, 17 bp, Homo sapiens
atttcacagtgtgtggt

SEQ ID NO: 3554232 - DNA, 23 bp, Homo sapiens
atttcacctactaatgtctcttc

SEQ ID NO: 3554233 - DNA, 17 bp, Homo sapiens
atttcactagagacaaa

SEQ ID NO: 3554234 - DNA, 22 bp, Homo sapiens
atttcactagagacaaatcttt

SEQ ID NO: 3554235 - DNA, 16 bp, Homo sapiens
atttcacttatttaga

SEQ ID NO: 3554236 - DNA, 22 bp, Homo sapiens
caagacctcatctgtggagctg

SEQ ID NO: 3554237 - DNA, 23 bp, Homo sapiens
caagacctcatctgtggagctgc

SEQ ID NO: 3554238 - DNA, 13 bp, Homo sapiens
caagacgaggggc

SEQ ID NO: 3554239 - DNA, 17 bp, Homo sapiens
caagacgaggggcaggg

SEQ ID NO: 3554240 - DNA, 22 bp, Homo sapiens
caagactagactactcaatatt

SEQ ID NO: 3554241 - DNA, 17 bp, Homo sapiens
caagactgaagatggct

SEQ ID NO: 3554242 - DNA, 19 bp, Homo sapiens
caagactggcccagtgcca

SEQ ID NO: 3554243 - DNA, 12 bp, Homo sapiens
caagagaaactt

SEQ ID NO: 3554244 - DNA, 19 bp, Homo sapiens
caagagatctgtgtggctc

SEQ ID NO: 3554245 - DNA, 21 bp, Homo sapiens
caagagctactcccacagcag

SEQ ID NO: 3554246 - DNA, 15 bp, Homo sapiens
caagagctgttatgc

SEQ ID NO: 3554247 - DNA, 21 bp, Homo sapiens
caagagctgttatgctgtttc

SEQ ID NO: 3554248 - DNA, 22 bp, Homo sapiens
caagagtcgctgtgccacaggc

SEQ ID NO: 3554249 - DNA, 13 bp, Homo sapiens
caagatgcttggt

SEQ ID NO: 3554250 - DNA, 16 bp, Homo sapiens
caagatttttttcctg

SEQ ID NO: 3554251 - DNA, 23 bp, Homo sapiens
caagcaaacatcaaataaatttc

SEQ ID NO: 3554252 - DNA, 15 bp, Homo sapiens
caagcagacagccct

SEQ ID NO: 3554253 - DNA, 15 bp, Homo sapiens
caagcagatgacaga

SEQ ID NO: 3554254 - DNA, 17 bp, Homo sapiens
caagcagctttttattc

SEQ ID NO: 3554255 - DNA, 23 bp, Homo sapiens
caagcagctttttattccctgcc

SEQ ID NO: 3554256 - DNA, 21 bp, Homo sapiens
caagcaggagtgtgcggtcaa

SEQ ID NO: 3554257 - DNA, 20 bp, Homo sapiens
caagccaaagagcctcccac

SEQ ID NO: 3554258 - DNA, 21 bp, Homo sapiens
caagccaaagagcctcccacc

SEQ ID NO: 3554259 - DNA, 19 bp, Homo sapiens
caagccatgtataaatgtg

SEQ ID NO: 3554260 - DNA, 16 bp, Homo sapiens
caagccgaccttccct

SEQ ID NO: 3554261 - DNA, 22 bp, Homo sapiens
caagcctcatgccaaccctggg

SEQ ID NO: 3554262 - DNA, 14 bp, Homo sapiens
caagcctcctgtac

SEQ ID NO: 3554263 - DNA, 14 bp, Homo sapiens
caagcgagcacagt

SEQ ID NO: 3554264 - DNA, 20 bp, Homo sapiens
caagctaggccccagaggcc

SEQ ID NO: 3554265 - DNA, 12 bp, Homo sapiens
caagctcaccct

SEQ ID NO: 3554266 - DNA, 15 bp, Homo sapiens
caagctcctcctccc

SEQ ID NO: 3554267 - DNA, 17 bp, Homo sapiens
caagctcctcctccctg

SEQ ID NO: 3554268 - DNA, 15 bp, Homo sapiens
caagctggcacaaaa

SEQ ID NO: 3554269 - DNA, 22 bp, Homo sapiens
caagctggcacaaaagacagct

SEQ ID NO: 3554270 - DNA, 13 bp, Homo sapiens
caagctgtccctg

SEQ ID NO: 3554271 - DNA, 14 bp, Homo sapiens
caagctgtccctgc

SEQ ID NO: 3554272 - DNA, 17 bp, Homo sapiens
caagctgtccctgcagg

SEQ ID NO: 3554273 - DNA, 12 bp, Homo sapiens
caagctgtgcag

SEQ ID NO: 3554274 - DNA, 19 bp, Homo sapiens
caagctgtgcaggcatggt

SEQ ID NO: 3554275 - DNA, 13 bp, Homo sapiens
caagcttcccaac

SEQ ID NO: 3554276 - DNA, 22 bp, Homo sapiens
caaggaaccctcaggccaccct

SEQ ID NO: 3554277 - DNA, 21 bp, Homo sapiens
caaggaatttcttaacttctt

SEQ ID NO: 3554278 - DNA, 14 bp, Homo sapiens
caaggacttcctgt

SEQ ID NO: 3554279 - DNA, 23 bp, Homo sapiens
caaggacttcctgtccagctcca

SEQ ID NO: 3554280 - DNA, 17 bp, Homo sapiens
caaggagcatccttggc

SEQ ID NO: 3554281 - DNA, 13 bp, Homo sapiens
caaggagctgcta

SEQ ID NO: 3554282 - DNA, 19 bp, Homo sapiens
caaggagggtgagtgcaag

SEQ ID NO: 3554283 - DNA, 16 bp, Homo sapiens
caaggagtgtaaaatg

SEQ ID NO: 3554284 - DNA, 17 bp, Homo sapiens
caaggagtgtaaaatgt

SEQ ID NO: 3554285 - DNA, 24 bp, Homo sapiens
caaggagtttgagaccagcttagc

SEQ ID NO: 3554286 - DNA, 15 bp, Homo sapiens
caaggatagatgctg

SEQ ID NO: 3554287 - DNA, 20 bp, Homo sapiens
caaggatagatgctggccca

SEQ ID NO: 3554288 - DNA, 23 bp, Homo sapiens
caaggatagatgctggcccaggg

SEQ ID NO: 3554289 - DNA, 18 bp, Homo sapiens
caaggattacagaaactg

SEQ ID NO: 3554290 - DNA, 19 bp, Homo sapiens
caaggattacagaaactga

SEQ ID NO: 3554291 - DNA, 13 bp, Homo sapiens
caaggcagggacc

SEQ ID NO: 3554292 - DNA, 15 bp, Homo sapiens
caaggccatccttcc

SEQ ID NO: 3554293 - DNA, 23 bp, Homo sapiens
caaggccatccttccctgtctgc

SEQ ID NO: 3554294 - DNA, 13 bp, Homo sapiens
caaggcccaggag

SEQ ID NO: 3554295 - DNA, 18 bp, Homo sapiens
caaggctttaaagctgag

SEQ ID NO: 3554296 - DNA, 20 bp, Homo sapiens
caagggatctggtcctaccc

SEQ ID NO: 3554297 - DNA, 14 bp, Homo sapiens
caagggccctggca

SEQ ID NO: 3554298 - DNA, 13 bp, Homo sapiens
caagggctggcac

SEQ ID NO: 3554299 - DNA, 16 bp, Homo sapiens
caaggggaccccgaga

SEQ ID NO: 3554300 - DNA, 14 bp, Homo sapiens
caagggggctgctg

SEQ ID NO: 3554301 - DNA, 20 bp, Homo sapiens
caagggggctgctgctcctc

SEQ ID NO: 3554302 - DNA, 14 bp, Homo sapiens
caagggtcagggtg

SEQ ID NO: 3554303 - DNA, 20 bp, Homo sapiens
caagggtttcgactggtcca

SEQ ID NO: 3554304 - DNA, 21 bp, Homo sapiens
caagggtttcgactggtccag

SEQ ID NO: 3554305 - DNA, 14 bp, Homo sapiens
caaggtactctggt

SEQ ID NO: 3554306 - DNA, 19 bp, Homo sapiens
caaggtgaggtgaactcca

SEQ ID NO: 3554307 - DNA, 22 bp, Homo sapiens
caaggtgaggtgaactccaggc

SEQ ID NO: 3554308 - DNA, 20 bp, Homo sapiens
caaggtgccaccaccctgcc

SEQ ID NO: 3554309 - DNA, 20 bp, Homo sapiens
caaggtggggattgcccctg

SEQ ID NO: 3554310 - DNA, 22 bp, Homo sapiens
caaggtttaggctggtggccca

SEQ ID NO: 3554311 - DNA, 14 bp, Homo sapiens
caagtaaaacaaat

SEQ ID NO: 3554312 - DNA, 14 bp, Homo sapiens
caagtaatattatt

SEQ ID NO: 3554313 - DNA, 22 bp, Homo sapiens
caagtaatccacctgcctcggc

SEQ ID NO: 3554314 - DNA, 16 bp, Homo sapiens
caagtatgaataaaga

SEQ ID NO: 3554315 - DNA, 16 bp, Homo sapiens
caagtattaagcagtt

SEQ ID NO: 3554316 - DNA, 22 bp, Homo sapiens
caagtattaagcagttcattct

SEQ ID NO: 3554317 - DNA, 14 bp, Homo sapiens
caagtcactcccaa

SEQ ID NO: 3554318 - DNA, 19 bp, Homo sapiens
caagtcaggcccttatttt

SEQ ID NO: 3554319 - DNA, 14 bp, Homo sapiens
caagtccaagcata

SEQ ID NO: 3554320 - DNA, 14 bp, Homo sapiens
caagtccagctggg

SEQ ID NO: 3554321 - DNA, 21 bp, Homo sapiens
caagtccagctgggaagccct

SEQ ID NO: 3554322 - DNA, 18 bp, Homo sapiens
caagtgactctcctgcct

SEQ ID NO: 3554323 - DNA, 19 bp, Homo sapiens
caagtgactctcctgcctc

SEQ ID NO: 3554324 - DNA, 22 bp, Homo sapiens
caagtgattctcctgcctcagc

SEQ ID NO: 3554325 - DNA, 19 bp, Homo sapiens
caagtggacgttaggccag

SEQ ID NO: 3554326 - DNA, 17 bp, Homo sapiens
caagtggcataaagcat

SEQ ID NO: 3554327 - DNA, 19 bp, Homo sapiens
caagtggctcccacaccct

SEQ ID NO: 3554328 - DNA, 12 bp, Homo sapiens
caagtggggtgc

SEQ ID NO: 3554329 - DNA, 17 bp, Homo sapiens
caagtggtgagcaagca

SEQ ID NO: 3554330 - DNA, 18 bp, Homo sapiens
caagtggtggtaaccctg

SEQ ID NO: 3554331 - DNA, 19 bp, Homo sapiens
caagtggtggtaaccctgg

SEQ ID NO: 3554332 - DNA, 17 bp, Homo sapiens
caagttagttcaatcct

SEQ ID NO: 3554333 - DNA, 16 bp, Homo sapiens
caagttctatttcttg

SEQ ID NO: 3554334 - DNA, 21 bp, Homo sapiens
caagtttgctgcaacccaagt

SEQ ID NO: 3554335 - DNA, 21 bp, Homo sapiens
caagttttggcagccatgata

SEQ ID NO: 3554336 - DNA, 20 bp, Homo sapiens
caataaaatcttgaaaatgc

SEQ ID NO: 3554337 - DNA, 16 bp, Homo sapiens
caataaagcttttgga

SEQ ID NO: 3554338 - DNA, 17 bp, Homo sapiens
caataaatctgacccag

SEQ ID NO: 3554339 - DNA, 18 bp, Homo sapiens
caataaatctgacccagt

SEQ ID NO: 3554340 - DNA, 20 bp, Homo sapiens
caataaatctgacccagtgc

SEQ ID NO: 3554341 - DNA, 16 bp, Homo sapiens
caataaattctaaatt

SEQ ID NO: 3554342 - DNA, 13 bp, Homo sapiens
caataaatttgct

SEQ ID NO: 3554343 - DNA, 22 bp, Homo sapiens
caataaattttttttggtcaaa

SEQ ID NO: 3554344 - DNA, 21 bp, Homo sapiens
caataagaacaagttttggca

SEQ ID NO: 3554345 - DNA, 17 bp, Homo sapiens
caataatccacccccag

SEQ ID NO: 3554346 - DNA, 21 bp, Homo sapiens
caatacctacaataaactggt

SEQ ID NO: 3554347 - DNA, 21 bp, Homo sapiens
caatacttacatatctgactt

SEQ ID NO: 3554348 - DNA, 21 bp, Homo sapiens
caatagcccaggatatatttt

SEQ ID NO: 3554349 - DNA, 18 bp, Homo sapiens
caataggtctttctctca

SEQ ID NO: 3554350 - DNA, 21 bp, Homo sapiens
caatagttttttacttctctt

SEQ ID NO: 3554351 - DNA, 13 bp, Homo sapiens
caatatcctttgc

SEQ ID NO: 3554352 - DNA, 15 bp, Homo sapiens
caatatcctttgcct

SEQ ID NO: 3554353 - DNA, 14 bp, Homo sapiens
caatatgcaagcag

SEQ ID NO: 3554354 - DNA, 18 bp, Homo sapiens
caatatgcaagcagcttt

SEQ ID NO: 3554355 - DNA, 21 bp, Homo sapiens
caatattaaagggtctggaaa

SEQ ID NO: 3554356 - DNA, 14 bp, Homo sapiens
caatattgactttg

SEQ ID NO: 3554357 - DNA, 12 bp, Homo sapiens
caatcactgcca

SEQ ID NO: 3554358 - DNA, 22 bp, Homo sapiens
caatcactgtgcttaatttaaa

SEQ ID NO: 3554359 - DNA, 19 bp, Homo sapiens
caatcagcccagtgcaaac

SEQ ID NO: 3554360 - DNA, 17 bp, Homo sapiens
caatcccaccaaccctc

SEQ ID NO: 3554361 - DNA, 23 bp, Homo sapiens
caatcccaccaaccctcagagcc

SEQ ID NO: 3554362 - DNA, 13 bp, Homo sapiens
caatcgcaaatca

SEQ ID NO: 3554363 - DNA, 16 bp, Homo sapiens
caatctggattcatat

SEQ ID NO: 3554364 - DNA, 18 bp, Homo sapiens
caatctttcatgtcttgt

SEQ ID NO: 3554365 - DNA, 21 bp, Homo sapiens
caatctttctatataaaatgt

SEQ ID NO: 3554366 - DNA, 12 bp, Homo sapiens
caatcttttaaa

SEQ ID NO: 3554367 - DNA, 20 bp, Homo sapiens
cacttaagttagttccactg

SEQ ID NO: 3554368 - DNA, 22 bp, Homo sapiens
cacttaagttagttccactgag

SEQ ID NO: 3554369 - DNA, 12 bp, Homo sapiens
cacttaatagca

SEQ ID NO: 3554370 - DNA, 15 bp, Homo sapiens
cacttaatgtatgtt

SEQ ID NO: 3554371 - DNA, 13 bp, Homo sapiens
cacttacatatat

SEQ ID NO: 3554372 - DNA, 19 bp, Homo sapiens
cacttacatatatttttaa

SEQ ID NO: 3554373 - DNA, 23 bp, Homo sapiens
cacttagcaggcaccgccacgtc

SEQ ID NO: 3554374 - DNA, 18 bp, Homo sapiens
cacttaggagaagtcttc

SEQ ID NO: 3554375 - DNA, 12 bp, Homo sapiens
cacttagtcctt

SEQ ID NO: 3554376 - DNA, 16 bp, Homo sapiens
cacttattgaatatat

SEQ ID NO: 3554377 - DNA, 16 bp, Homo sapiens
cacttcaggctcttct

SEQ ID NO: 3554378 - DNA, 19 bp, Homo sapiens
cacttcagggctttactcc

SEQ ID NO: 3554379 - DNA, 18 bp, Homo sapiens
cacttcaggtcaggagtt

SEQ ID NO: 3554380 - DNA, 17 bp, Homo sapiens
cacttcctgttttataa

SEQ ID NO: 3554381 - DNA, 20 bp, Homo sapiens
cacttctggccacatcagcc

SEQ ID NO: 3554382 - DNA, 22 bp, Homo sapiens
cacttctggccacatcagcccc

SEQ ID NO: 3554383 - DNA, 20 bp, Homo sapiens
cacttgagaaccagtctcct

SEQ ID NO: 3554384 - DNA, 21 bp, Homo sapiens
cacttgagaaccagtctcctc

SEQ ID NO: 3554385 - DNA, 14 bp, Homo sapiens
cacttgcccacacc

SEQ ID NO: 3554386 - DNA, 17 bp, Homo sapiens
cacttgtacaaaataaa

SEQ ID NO: 3554387 - DNA, 15 bp, Homo sapiens
cacttgttttctttg

SEQ ID NO: 3554388 - DNA, 20 bp, Homo sapiens
cacttgttttctttgtttct

SEQ ID NO: 3554389 - DNA, 15 bp, Homo sapiens
cactttattaccttc

SEQ ID NO: 3554390 - DNA, 13 bp, Homo sapiens
cactttcctcagt

SEQ ID NO: 3554391 - DNA, 21 bp, Homo sapiens
cactttgagcatttttaaggg

SEQ ID NO: 3554392 - DNA, 17 bp, Homo sapiens
cactttgcacagctctc

SEQ ID NO: 3554393 - DNA, 18 bp, Homo sapiens
cacttttttataaaagtt

SEQ ID NO: 3554394 - DNA, 22 bp, Homo sapiens
cagaaaaataagtcaaaaggaa

SEQ ID NO: 3554395 - DNA, 10 bp, Homo sapiens
cagaaaagtg

SEQ ID NO: 3554396 - DNA, 16 bp, Homo sapiens
cagaaaagtgcctgag

SEQ ID NO: 3554397 - DNA, 18 bp, Homo sapiens
cagaaaccagaaaagcaa

SEQ ID NO: 3554398 - DNA, 21 bp, Homo sapiens
cagaaagcctcctgccccctg

SEQ ID NO: 3554399 - DNA, 22 bp, Homo sapiens
cagaaagcctgggtgacatttg

SEQ ID NO: 3554400 - DNA, 13 bp, Homo sapiens
cagaaagcttcat

SEQ ID NO: 3554401 - DNA, 20 bp, Homo sapiens
cagaaagcttcatccacagc

SEQ ID NO: 3554402 - DNA, 13 bp, Homo sapiens
cagaaaggtgtga

SEQ ID NO: 3554403 - DNA, 17 bp, Homo sapiens
cagaaaggtgtgaggag

SEQ ID NO: 3554404 - DNA, 13 bp, Homo sapiens
cagaaataaatca

SEQ ID NO: 3554405 - DNA, 16 bp, Homo sapiens
cagaaataaatcacag

SEQ ID NO: 3554406 - DNA, 15 bp, Homo sapiens
cagaaatacaaaaaa

SEQ ID NO: 3554407 - DNA, 14 bp, Homo sapiens
cagaacaaaacttc

SEQ ID NO: 3554408 - DNA, 17 bp, Homo sapiens
cagaacattcagctctg

SEQ ID NO: 3554409 - DNA, 21 bp, Homo sapiens
cagaacattcagctctggaga

SEQ ID NO: 3554410 - DNA, 14 bp, Homo sapiens
cagaaccaaatctt

SEQ ID NO: 3554411 - DNA, 15 bp, Homo sapiens
cagaaccaaatcttt

SEQ ID NO: 3554412 - DNA, 22 bp, Homo sapiens
cagaacccacataaaagcccca

SEQ ID NO: 3554413 - DNA, 23 bp, Homo sapiens
cagaacccacataaaagccccag

SEQ ID NO: 3554414 - DNA, 22 bp, Homo sapiens
cagaacccttggagccaatgga

SEQ ID NO: 3554415 - DNA, 19 bp, Homo sapiens
cagaacctctaagtgctgc

SEQ ID NO: 3554416 - DNA, 20 bp, Homo sapiens
cagaacctctaagtgctgct

SEQ ID NO: 3554417 - DNA, 21 bp, Homo sapiens
cagaacctctaagtgctgctg

SEQ ID NO: 3554418 - DNA, 22 bp, Homo sapiens
cagaacctctaagtgctgctgt

SEQ ID NO: 3554419 - DNA, 24 bp, Homo sapiens
cagaacctctaagtgctgctgtgg

SEQ ID NO: 3554420 - DNA, 20 bp, Homo sapiens
cagaaccttcaacccagtgg

SEQ ID NO: 3554421 - DNA, 21 bp, Homo sapiens
cagaaccttcaacccagtggg

SEQ ID NO: 3554422 - DNA, 18 bp, Homo sapiens
cagaacgcaccccactgg

SEQ ID NO: 3554423 - DNA, 13 bp, Homo sapiens
cagaacgtggctc

SEQ ID NO: 3554424 - DNA, 18 bp, Homo sapiens
cagaactcggtgtcccca

SEQ ID NO: 3554425 - DNA, 20 bp, Homo sapiens
cagaactcttcctcctccca

SEQ ID NO: 3554426 - DNA, 22 bp, Homo sapiens
cagaactcttcctcctcccaag

SEQ ID NO: 3554427 - DNA, 17 bp, Homo sapiens
cagaagaatcttcctgg

SEQ ID NO: 3554428 - DNA, 23 bp, Homo sapiens
cagaagaatcttcctggcacaat

SEQ ID NO: 3554429 - DNA, 20 bp, Homo sapiens
cagaagatgccagcttctct

SEQ ID NO: 3554430 - DNA, 18 bp, Homo sapiens
cagaagcctccccagctc

SEQ ID NO: 3554431 - DNA, 19 bp, Homo sapiens
cagaaggcaaggccctgcc

SEQ ID NO: 3554432 - DNA, 21 bp, Homo sapiens
cagaaggcaaggccctgccct

SEQ ID NO: 3554433 - DNA, 17 bp, Homo sapiens
cagaaggccccagagag

SEQ ID NO: 3554434 - DNA, 22 bp, Homo sapiens
cagaagtcacacattacaaagt

SEQ ID NO: 3554435 - DNA, 16 bp, Homo sapiens
cagaagtcatcttgct

SEQ ID NO: 3554436 - DNA, 17 bp, Homo sapiens
cagaagtcatcttgcta

SEQ ID NO: 3554437 - DNA, 22 bp, Homo sapiens
cagaagtcatcttgctaccagt

SEQ ID NO: 3554438 - DNA, 17 bp, Homo sapiens
cagaagtctttcagcaa

SEQ ID NO: 3554439 - DNA, 15 bp, Homo sapiens
cagaagtttctcagc

SEQ ID NO: 3554440 - DNA, 18 bp, Homo sapiens
cagaatggcagtcctgga

SEQ ID NO: 3554441 - DNA, 15 bp, Homo sapiens
cagacaaaatgaaag

SEQ ID NO: 3554442 - DNA, 12 bp, Homo sapiens
cagacaagcagc

SEQ ID NO: 3554443 - DNA, 19 bp, Homo sapiens
cagacaagcagcccttgct

SEQ ID NO: 3554444 - DNA, 21 bp, Homo sapiens
cagacacaaagagacaaagct

SEQ ID NO: 3554445 - DNA, 14 bp, Homo sapiens
cagacacccaggac

SEQ ID NO: 3554446 - DNA, 15 bp, Homo sapiens
cagacacccaggact

SEQ ID NO: 3554447 - DNA, 17 bp, Homo sapiens
cagacacccaggactta

SEQ ID NO: 3554448 - DNA, 16 bp, Homo sapiens
cagacagcttacagga

SEQ ID NO: 3554449 - DNA, 13 bp, Homo sapiens
cagacaggccctc

SEQ ID NO: 3554450 - DNA, 18 bp, Homo sapiens
cagacatgccacaaggac

SEQ ID NO: 3554451 - DNA, 20 bp, Homo sapiens
cagacatttctttggaaaac

SEQ ID NO: 3554452 - DNA, 13 bp, Homo sapiens
cagacattttaaa

SEQ ID NO: 3554453 - DNA, 17 bp, Homo sapiens
cagaccacttgccacgc

SEQ ID NO: 3554454 - DNA, 13 bp, Homo sapiens
cagaccagctctt

SEQ ID NO: 3554455 - DNA, 20 bp, Homo sapiens
cagacccacgggctcatgca

SEQ ID NO: 3554456 - DNA, 17 bp, Homo sapiens
cagacccagtcccacac

SEQ ID NO: 3554457 - DNA, 22 bp, Homo sapiens
cagacccctggcttttcactgc

SEQ ID NO: 3554458 - DNA, 12 bp, Homo sapiens
cagacccctggg

SEQ ID NO: 3554459 - DNA, 14 bp, Homo sapiens
cagacccctgggag

SEQ ID NO: 3554460 - DNA, 17 bp, Homo sapiens
cagacccctgggagctt

SEQ ID NO: 3554461 - DNA, 19 bp, Homo sapiens
cagacccctgggagcttcc

SEQ ID NO: 3554462 - DNA, 13 bp, Homo sapiens
cagacctgatcct

SEQ ID NO: 3554463 - DNA, 14 bp, Homo sapiens
cagacctgatcctg

SEQ ID NO: 3554464 - DNA, 17 bp, Homo sapiens
cagacctgatcctggag

SEQ ID NO: 3554465 - DNA, 20 bp, Homo sapiens
cagacctgatcctggaggcc

SEQ ID NO: 3554466 - DNA, 14 bp, Homo sapiens
cagacgccaggcac

SEQ ID NO: 3554467 - DNA, 13 bp, Homo sapiens
cagacggggctgg

SEQ ID NO: 3554468 - DNA, 19 bp, Homo sapiens
cagacggggctggagtgtg

SEQ ID NO: 3554469 - DNA, 14 bp, Homo sapiens
cagacggtctgtgt

SEQ ID NO: 3554470 - DNA, 20 bp, Homo sapiens
cagacggtctgtgtgctgtt

SEQ ID NO: 3554471 - DNA, 21 bp, Homo sapiens
cagacggtctgtgtgctgttt

SEQ ID NO: 3554472 - DNA, 16 bp, Homo sapiens
cagactactattttct

SEQ ID NO: 3554473 - DNA, 19 bp, Homo sapiens
cagactagatgtagtattt

SEQ ID NO: 3554474 - DNA, 21 bp, Homo sapiens
cagactagatgtagtattttt

SEQ ID NO: 3554475 - DNA, 22 bp, Homo sapiens
cagactcaaatgctcagaccag

SEQ ID NO: 3554476 - DNA, 23 bp, Homo sapiens
cagactcaaatgctcagaccagc

SEQ ID NO: 3554477 - DNA, 20 bp, Homo sapiens
cagactcaagtacccattct

SEQ ID NO: 3554478 - DNA, 18 bp, Homo sapiens
cagactcaatgtgctctg

SEQ ID NO: 3554479 - DNA, 19 bp, Homo sapiens
cagactcaatgtgctctgt

SEQ ID NO: 3554480 - DNA, 13 bp, Homo sapiens
cagactcactggg

SEQ ID NO: 3554481 - DNA, 18 bp, Homo sapiens
cagactcactgggaagct

SEQ ID NO: 3554482 - DNA, 12 bp, Homo sapiens
cagactcagcag

SEQ ID NO: 3554483 - DNA, 17 bp, Homo sapiens
cagactcagcagagtga

SEQ ID NO: 3554484 - DNA, 14 bp, Homo sapiens
cagactcccattcc

SEQ ID NO: 3554485 - DNA, 17 bp, Homo sapiens
cagactcccattcctga

SEQ ID NO: 3554486 - DNA, 14 bp, Homo sapiens
cagactgatagaca

SEQ ID NO: 3554487 - DNA, 20 bp, Homo sapiens
cagactgcttccaattttct

SEQ ID NO: 3554488 - DNA, 22 bp, Homo sapiens
cagactggcacagttttctgag

SEQ ID NO: 3554489 - DNA, 18 bp, Homo sapiens
cagactgggcactggggc

SEQ ID NO: 3554490 - DNA, 17 bp, Homo sapiens
cagactgtctccacggc

SEQ ID NO: 3554491 - DNA, 21 bp, Homo sapiens
cagactgtgaacttgactggg

SEQ ID NO: 3554492 - DNA, 23 bp, Homo sapiens
cagactgtgtttaactgctgcag

SEQ ID NO: 3554493 - DNA, 14 bp, Homo sapiens
cagacttagaacct

SEQ ID NO: 3554494 - DNA, 15 bp, Homo sapiens
cagacttgtatattc

SEQ ID NO: 3554495 - DNA, 16 bp, Homo sapiens
cagacttgtatattct

SEQ ID NO: 3554496 - DNA, 23 bp, Homo sapiens
cagacttgtatattctattttac

SEQ ID NO: 3554497 - DNA, 21 bp, Homo sapiens
cagactttggacagtggcctc

SEQ ID NO: 3554498 - DNA, 11 bp, Homo sapiens
cagagaaagca

SEQ ID NO: 3554499 - DNA, 15 bp, Homo sapiens
cagctctgacatccc

SEQ ID NO: 3554500 - DNA, 19 bp, Homo sapiens
cagctctgacatcccttcc

SEQ ID NO: 3554501 - DNA, 20 bp, Homo sapiens
cagctctgacatcccttcct

SEQ ID NO: 3554502 - DNA, 18 bp, Homo sapiens
cagctctggacagcccca

SEQ ID NO: 3554503 - DNA, 16 bp, Homo sapiens
cagctctggagaacag

SEQ ID NO: 3554504 - DNA, 17 bp, Homo sapiens
cagctctggagaacagt

SEQ ID NO: 3554505 - DNA, 12 bp, Homo sapiens
cagctctggagt

SEQ ID NO: 3554506 - DNA, 12 bp, Homo sapiens
cagctcttcatt

SEQ ID NO: 3554507 - DNA, 18 bp, Homo sapiens
cagctcttccagggcagc

SEQ ID NO: 3554508 - DNA, 18 bp, Homo sapiens
cagctcttggctccactg

SEQ ID NO: 3554509 - DNA, 19 bp, Homo sapiens
cagctgaaatatgctggct

SEQ ID NO: 3554510 - DNA, 11 bp, Homo sapiens
cagctgaaatt

SEQ ID NO: 3554511 - DNA, 20 bp, Homo sapiens
cagctgaaattcaccaagaa

SEQ ID NO: 3554512 - DNA, 15 bp, Homo sapiens
cagctgacagccaca

SEQ ID NO: 3554513 - DNA, 20 bp, Homo sapiens
cagctgagcatggagacagc

SEQ ID NO: 3554514 - DNA, 14 bp, Homo sapiens
cagctgcacccctt

SEQ ID NO: 3554515 - DNA, 22 bp, Homo sapiens
cagctgcaggggcctctgttcc

SEQ ID NO: 3554516 - DNA, 11 bp, Homo sapiens
cagctgcccta

SEQ ID NO: 3554517 - DNA, 21 bp, Homo sapiens
cagctgcctcctgcgccctgt

SEQ ID NO: 3554518 - DNA, 11 bp, Homo sapiens
cagctgcctgg

SEQ ID NO: 3554519 - DNA, 23 bp, Homo sapiens
cagctgctcctagagggaggggc

SEQ ID NO: 3554520 - DNA, 12 bp, Homo sapiens
cagctgctgtgg

SEQ ID NO: 3554521 - DNA, 14 bp, Homo sapiens
cagctgctttgagc

SEQ ID NO: 3554522 - DNA, 20 bp, Homo sapiens
cagctggacatactgctgga

SEQ ID NO: 3554523 - DNA, 15 bp, Homo sapiens
cagctggcccccagc

SEQ ID NO: 3554524 - DNA, 18 bp, Homo sapiens
cagctggcccccagccct

SEQ ID NO: 3554525 - DNA, 20 bp, Homo sapiens
cagctggcccccagccctgg

SEQ ID NO: 3554526 - DNA, 22 bp, Homo sapiens
cagctggcccccagccctgggg

SEQ ID NO: 3554527 - DNA, 16 bp, Homo sapiens
cagctggcggaggctg

SEQ ID NO: 3554528 - DNA, 21 bp, Homo sapiens
cagctggctgggccttcacca

SEQ ID NO: 3554529 - DNA, 12 bp, Homo sapiens
cagctgggctgt

SEQ ID NO: 3554530 - DNA, 12 bp, Homo sapiens
cagctgtgctcc

SEQ ID NO: 3554531 - DNA, 13 bp, Homo sapiens
cagctgtgctcca

SEQ ID NO: 3554532 - DNA, 16 bp, Homo sapiens
cagctgtgctccacac

SEQ ID NO: 3554533 - DNA, 18 bp, Homo sapiens
cagctgtgctccacactc

SEQ ID NO: 3554534 - DNA, 20 bp, Homo sapiens
cagctgtgctccacactcag

SEQ ID NO: 3554535 - DNA, 19 bp, Homo sapiens
cagctgtggcagagttaca

SEQ ID NO: 3554536 - DNA, 13 bp, Homo sapiens
cagcttacaggag

SEQ ID NO: 3554537 - DNA, 13 bp, Homo sapiens
cagcttcctcaca

SEQ ID NO: 3554538 - DNA, 19 bp, Homo sapiens
cagcttcctcacacccctg

SEQ ID NO: 3554539 - DNA, 20 bp, Homo sapiens
cagcttcctcacacccctgt

SEQ ID NO: 3554540 - DNA, 18 bp, Homo sapiens
cagcttctactcctgcct

SEQ ID NO: 3554541 - DNA, 21 bp, Homo sapiens
cagcttctactcctgcctcat

SEQ ID NO: 3554542 - DNA, 16 bp, Homo sapiens
cagcttctcctgtgtg

SEQ ID NO: 3554543 - DNA, 18 bp, Homo sapiens
cagcttctctctccaggg

SEQ ID NO: 3554544 - DNA, 15 bp, Homo sapiens
cagcttctctgcagt

SEQ ID NO: 3554545 - DNA, 18 bp, Homo sapiens
cagcttgaaactgagatg

SEQ ID NO: 3554546 - DNA, 12 bp, Homo sapiens
cagcttgagttt

SEQ ID NO: 3554547 - DNA, 22 bp, Homo sapiens
cagcttgcattgattgctacaa

SEQ ID NO: 3554548 - DNA, 13 bp, Homo sapiens
cagcttgctgggc

SEQ ID NO: 3554549 - DNA, 21 bp, Homo sapiens
cagcttggctcacaaggccca

SEQ ID NO: 3554550 - DNA, 17 bp, Homo sapiens
cagcttgggcagatctc

SEQ ID NO: 3554551 - DNA, 22 bp, Homo sapiens
cagctttgctaccaaagcacct

SEQ ID NO: 3554552 - DNA, 13 bp, Homo sapiens
cagctttgctgct

SEQ ID NO: 3554553 - DNA, 14 bp, Homo sapiens
cagctttggctctg

SEQ ID NO: 3554554 - DNA, 11 bp, Homo sapiens
cagctttgtct

SEQ ID NO: 3554555 - DNA, 16 bp, Homo sapiens
cagctttttattccct

SEQ ID NO: 3554556 - DNA, 15 bp, Homo sapiens
caggaaagagctagg

SEQ ID NO: 3554557 - DNA, 18 bp, Homo sapiens
caggaaagccacatcttg

SEQ ID NO: 3554558 - DNA, 23 bp, Homo sapiens
caggaaagccacatcttgctctg

SEQ ID NO: 3554559 - DNA, 12 bp, Homo sapiens
caggaaagtgtg

SEQ ID NO: 3554560 - DNA, 19 bp, Homo sapiens
caggaaccacaccacatct

SEQ ID NO: 3554561 - DNA, 12 bp, Homo sapiens
caggaactgggc

SEQ ID NO: 3554562 - DNA, 13 bp, Homo sapiens
caggaactgggcc

SEQ ID NO: 3554563 - DNA, 14 bp, Homo sapiens
caggaagaaacttt

SEQ ID NO: 3554564 - DNA, 20 bp, Homo sapiens
caggaagaaacttttttatt

SEQ ID NO: 3554565 - DNA, 13 bp, Homo sapiens
caggaaggaaaac

SEQ ID NO: 3554566 - DNA, 15 bp, Homo sapiens
caggaaggaaaacta

SEQ ID NO: 3554567 - DNA, 22 bp, Homo sapiens
caggaaggccaaaatcaagagt

SEQ ID NO: 3554568 - DNA, 19 bp, Homo sapiens
caggaatctgtatatattt

SEQ ID NO: 3554569 - DNA, 16 bp, Homo sapiens
caggaatttcccagga

SEQ ID NO: 3554570 - DNA, 18 bp, Homo sapiens
caggacaaaggctgacag

SEQ ID NO: 3554571 - DNA, 17 bp, Homo sapiens
caggacagatgccacac

SEQ ID NO: 3554572 - DNA, 20 bp, Homo sapiens
caggacagttgatggagccc

SEQ ID NO: 3554573 - DNA, 19 bp, Homo sapiens
caggaccagctcaggacag

SEQ ID NO: 3554574 - DNA, 20 bp, Homo sapiens
caggaccagctcaggacaga

SEQ ID NO: 3554575 - DNA, 22 bp, Homo sapiens
caggaccagggttggcaccttc

SEQ ID NO: 3554576 - DNA, 16 bp, Homo sapiens
caggacccatccctgc

SEQ ID NO: 3554577 - DNA, 23 bp, Homo sapiens
caggacccatccctgcctggagg

SEQ ID NO: 3554578 - DNA, 16 bp, Homo sapiens
caggaccccagctctg

SEQ ID NO: 3554579 - DNA, 18 bp, Homo sapiens
caggaccccagctctgcg

SEQ ID NO: 3554580 - DNA, 17 bp, Homo sapiens
caggaccctcacctctc

SEQ ID NO: 3554581 - DNA, 15 bp, Homo sapiens
caggaccctcaggaa

SEQ ID NO: 3554582 - DNA, 18 bp, Homo sapiens
caggaccctgaaggggcc

SEQ ID NO: 3554583 - DNA, 18 bp, Homo sapiens
caggaccctgtcctgcag

SEQ ID NO: 3554584 - DNA, 17 bp, Homo sapiens
caggacctcgtgccacc

SEQ ID NO: 3554585 - DNA, 17 bp, Homo sapiens
caggacgttagactgtt

SEQ ID NO: 3554586 - DNA, 12 bp, Homo sapiens
caggactcccag

SEQ ID NO: 3554587 - DNA, 14 bp, Homo sapiens
caggactcccagaa

SEQ ID NO: 3554588 - DNA, 18 bp, Homo sapiens
caggactcccagaacctc

SEQ ID NO: 3554589 - DNA, 19 bp, Homo sapiens
caggactcccagaacctct

SEQ ID NO: 3554590 - DNA, 18 bp, Homo sapiens
caggactcctggcagggc

SEQ ID NO: 3554591 - DNA, 14 bp, Homo sapiens
caggactctctcca

SEQ ID NO: 3554592 - DNA, 17 bp, Homo sapiens
caggactctctccagga

SEQ ID NO: 3554593 - DNA, 15 bp, Homo sapiens
caggactctgcctcc

SEQ ID NO: 3554594 - DNA, 15 bp, Homo sapiens
caggactgtttcaaa

SEQ ID NO: 3554595 - DNA, 18 bp, Homo sapiens
caggagagactgagcagc

SEQ ID NO: 3554596 - DNA, 21 bp, Homo sapiens
caggagagactgagcagccgc

SEQ ID NO: 3554597 - DNA, 11 bp, Homo sapiens
caggagagagc

SEQ ID NO: 3554598 - DNA, 21 bp, Homo sapiens
caggagagagccaggatgccc

SEQ ID NO: 3554599 - DNA, 16 bp, Homo sapiens
caggagagcctggggg

SEQ ID NO: 3554600 - DNA, 23 bp, Homo sapiens
caggagaggcagcatgcttgggc

SEQ ID NO: 3554601 - DNA, 17 bp, Homo sapiens
caggagatgctgtgccc

SEQ ID NO: 3554602 - DNA, 14 bp, Homo sapiens
caggagatggaggg

SEQ ID NO: 3554603 - DNA, 17 bp, Homo sapiens
caggagatggagggctt

SEQ ID NO: 3554604 - DNA, 23 bp, Homo sapiens
caggagatggggaataatttcct

SEQ ID NO: 3554605 - DNA, 11 bp, Homo sapiens
caggagccagc

SEQ ID NO: 3554606 - DNA, 22 bp, Homo sapiens
caggagccagcctgcttcccac

SEQ ID NO: 3554607 - DNA, 13 bp, Homo sapiens
caggagcccccct

SEQ ID NO: 3554608 - DNA, 17 bp, Homo sapiens
caggagccgaagcccag

SEQ ID NO: 3554609 - DNA, 16 bp, Homo sapiens
caggagcctagcggag

SEQ ID NO: 3554610 - DNA, 14 bp, Homo sapiens
caggagcctggcca

SEQ ID NO: 3554611 - DNA, 18 bp, Homo sapiens
caggagcctggccaggca

SEQ ID NO: 3554612 - DNA, 19 bp, Homo sapiens
caggagcctggccaggcag

SEQ ID NO: 3554613 - DNA, 15 bp, Homo sapiens
caggaggcaggacct

SEQ ID NO: 3554614 - DNA, 18 bp, Homo sapiens
caggaggcaggaccttcg

SEQ ID NO: 3554615 - DNA, 18 bp, Homo sapiens
caggagggccagcgctgt

SEQ ID NO: 3554616 - DNA, 23 bp, Homo sapiens
caggaggggggagggaagggagc

SEQ ID NO: 3554617 - DNA, 15 bp, Homo sapiens
caggagtctctgcca

SEQ ID NO: 3554618 - DNA, 17 bp, Homo sapiens
caggagtgtcctgccca

SEQ ID NO: 3554619 - DNA, 14 bp, Homo sapiens
caggagtttgtggt

SEQ ID NO: 3554620 - DNA, 16 bp, Homo sapiens
caggagtttgtggtaa

SEQ ID NO: 3554621 - DNA, 21 bp, Homo sapiens
caggagtttgtggtaacttga

SEQ ID NO: 3554622 - DNA, 22 bp, Homo sapiens
caggagtttgtggtaacttgag

SEQ ID NO: 3554623 - DNA, 17 bp, Homo sapiens
caggatcagttaactat

SEQ ID NO: 3554624 - DNA, 14 bp, Homo sapiens
caggatccagtgac

SEQ ID NO: 3554625 - DNA, 17 bp, Homo sapiens
caggatgcccagatgaa

SEQ ID NO: 3554626 - DNA, 22 bp, Homo sapiens
caggatgcccagatgaactgac

SEQ ID NO: 3554627 - DNA, 18 bp, Homo sapiens
caggattaactaaagaag

SEQ ID NO: 3554628 - DNA, 20 bp, Homo sapiens
caggattaactaaagaagag

SEQ ID NO: 3554629 - DNA, 18 bp, Homo sapiens
caggattctctgcagccc

SEQ ID NO: 3554630 - DNA, 17 bp, Homo sapiens
caggcaaagaaaatgaa

SEQ ID NO: 3554631 - DNA, 12 bp, Homo sapiens
caggcacacctt

SEQ ID NO: 3554632 - DNA, 23 bp, Homo sapiens
cagtgcccccactgaccagaact

SEQ ID NO: 3554633 - DNA, 17 bp, Homo sapiens
cagtgccctcattttat

SEQ ID NO: 3554634 - DNA, 13 bp, Homo sapiens
cagtgcctgtgag

SEQ ID NO: 3554635 - DNA, 21 bp, Homo sapiens
cagtgcctgtgagcatggggc

SEQ ID NO: 3554636 - DNA, 19 bp, Homo sapiens
cagtgctaaagcctgtggg

SEQ ID NO: 3554637 - DNA, 14 bp, Homo sapiens
cagtgctcttttct

SEQ ID NO: 3554638 - DNA, 23 bp, Homo sapiens
cagtgctcttttctcctcactgt

SEQ ID NO: 3554639 - DNA, 23 bp, Homo sapiens
cagtgctgaccagacagcctccc

SEQ ID NO: 3554640 - DNA, 19 bp, Homo sapiens
cagtggatcttcagaactg

SEQ ID NO: 3554641 - DNA, 15 bp, Homo sapiens
cagtggcctcttgag

SEQ ID NO: 3554642 - DNA, 19 bp, Homo sapiens
cagtggccttccccagcat

SEQ ID NO: 3554643 - DNA, 19 bp, Homo sapiens
cagtggcgttgttgcatgt

SEQ ID NO: 3554644 - DNA, 20 bp, Homo sapiens
cagtggctggatctgtgagg

SEQ ID NO: 3554645 - DNA, 17 bp, Homo sapiens
cagtgggaatgttcttt

SEQ ID NO: 3554646 - DNA, 13 bp, Homo sapiens
cagtgggagctga

SEQ ID NO: 3554647 - DNA, 22 bp, Homo sapiens
cagtgggcgttgggagcctagc

SEQ ID NO: 3554648 - DNA, 23 bp, Homo sapiens
cagtgggcgttgggagcctagct

SEQ ID NO: 3554649 - DNA, 14 bp, Homo sapiens
cagtggggcagcct

SEQ ID NO: 3554650 - DNA, 16 bp, Homo sapiens
cagtggggctgcaggc

SEQ ID NO: 3554651 - DNA, 16 bp, Homo sapiens
cagtggggctggcatc

SEQ ID NO: 3554652 - DNA, 17 bp, Homo sapiens
cagtggggctggcatca

SEQ ID NO: 3554653 - DNA, 12 bp, Homo sapiens
cagtggtgggta

SEQ ID NO: 3554654 - DNA, 15 bp, Homo sapiens
cagtggtgggtaatt

SEQ ID NO: 3554655 - DNA, 19 bp, Homo sapiens
cagtggtgggtaattgtac

SEQ ID NO: 3554656 - DNA, 15 bp, Homo sapiens
cagtggttgcctggg

SEQ ID NO: 3554657 - DNA, 17 bp, Homo sapiens
cagtggttgcctggggg

SEQ ID NO: 3554658 - DNA, 17 bp, Homo sapiens
cagtgtatggaaataaa

SEQ ID NO: 3554659 - DNA, 14 bp, Homo sapiens
cagtgtcctttcca

SEQ ID NO: 3554660 - DNA, 21 bp, Homo sapiens
cagtgtctaggcactgagcag

SEQ ID NO: 3554661 - DNA, 22 bp, Homo sapiens
cagtgtctaggcactgagcagg

SEQ ID NO: 3554662 - DNA, 14 bp, Homo sapiens
cagtgtctgtctga

SEQ ID NO: 3554663 - DNA, 17 bp, Homo sapiens
cagtgtctgtctgaggt

SEQ ID NO: 3554664 - DNA, 17 bp, Homo sapiens
cagtgtgagatactgtg

SEQ ID NO: 3554665 - DNA, 19 bp, Homo sapiens
cagtgtgcactaaggggcc

SEQ ID NO: 3554666 - DNA, 18 bp, Homo sapiens
cagtgtgtcagtttttcc

SEQ ID NO: 3554667 - DNA, 21 bp, Homo sapiens
cagtgtgtggtcaacatttct

SEQ ID NO: 3554668 - DNA, 22 bp, Homo sapiens
cagtgtgtggtcaacatttctc

SEQ ID NO: 3554669 - DNA, 20 bp, Homo sapiens
cagtgttatttattccccag

SEQ ID NO: 3554670 - DNA, 20 bp, Homo sapiens
cagtgttgcgtttttccttg

SEQ ID NO: 3554671 - DNA, 13 bp, Homo sapiens
cagtgttggagaa

SEQ ID NO: 3554672 - DNA, 18 bp, Homo sapiens
cagtgtttccctctgtgt

SEQ ID NO: 3554673 - DNA, 21 bp, Homo sapiens
cagttaactattgcatttata

SEQ ID NO: 3554674 - DNA, 14 bp, Homo sapiens
cagttaatttatat

SEQ ID NO: 3554675 - DNA, 13 bp, Homo sapiens
cagttaatttttc

SEQ ID NO: 3554676 - DNA, 14 bp, Homo sapiens
cagttaatttttcc

SEQ ID NO: 3554677 - DNA, 17 bp, Homo sapiens
cagttaccacagcaact

SEQ ID NO: 3554678 - DNA, 20 bp, Homo sapiens
cagttcattctaccaagctg

SEQ ID NO: 3554679 - DNA, 11 bp, Homo sapiens
cagttctaggc

SEQ ID NO: 3554680 - DNA, 14 bp, Homo sapiens
cagttctaggcctt

SEQ ID NO: 3554681 - DNA, 12 bp, Homo sapiens
cagttctctggg

SEQ ID NO: 3554682 - DNA, 18 bp, Homo sapiens
cagttctgggcaaagagg

SEQ ID NO: 3554683 - DNA, 21 bp, Homo sapiens
cagttctttataacaaaacag

SEQ ID NO: 3554684 - DNA, 16 bp, Homo sapiens
cagttctttgggccag

SEQ ID NO: 3554685 - DNA, 21 bp, Homo sapiens
cagttctttgggccagacatg

SEQ ID NO: 3554686 - DNA, 14 bp, Homo sapiens
cagttgaaaagact

SEQ ID NO: 3554687 - DNA, 18 bp, Homo sapiens
cagttgaaaagactccaa

SEQ ID NO: 3554688 - DNA, 21 bp, Homo sapiens
cagttgaaaagactccaaaga

SEQ ID NO: 3554689 - DNA, 18 bp, Homo sapiens
cagttgaaaatgcaactc

SEQ ID NO: 3554690 - DNA, 16 bp, Homo sapiens
cagttgatggagcccc

SEQ ID NO: 3554691 - DNA, 21 bp, Homo sapiens
cagttgatggagccccagggt

SEQ ID NO: 3554692 - DNA, 15 bp, Homo sapiens
cagttgtagcagaaa

SEQ ID NO: 3554693 - DNA, 19 bp, Homo sapiens
cagttgttatattcattct

SEQ ID NO: 3554694 - DNA, 14 bp, Homo sapiens
cagttgttatttat

SEQ ID NO: 3554695 - DNA, 19 bp, Homo sapiens
cagttgttatttattgaaa

SEQ ID NO: 3554696 - DNA, 18 bp, Homo sapiens
cagtttaaaaagatgaaa

SEQ ID NO: 3554697 - DNA, 13 bp, Homo sapiens
cagtttacagtat

SEQ ID NO: 3554698 - DNA, 20 bp, Homo sapiens
cagtttatatactgctattt

SEQ ID NO: 3554699 - DNA, 14 bp, Homo sapiens
cagtttattgatat

SEQ ID NO: 3554700 - DNA, 14 bp, Homo sapiens
cagtttgctttgta

SEQ ID NO: 3554701 - DNA, 21 bp, Homo sapiens
cagtttgctttgtatgcactt

SEQ ID NO: 3554702 - DNA, 22 bp, Homo sapiens
cagtttggagagtcagatcttt

SEQ ID NO: 3554703 - DNA, 16 bp, Homo sapiens
cagttttatgccccat

SEQ ID NO: 3554704 - DNA, 13 bp, Homo sapiens
cagttttccctgg

SEQ ID NO: 3554705 - DNA, 19 bp, Homo sapiens
cagttttctgagaaagact

SEQ ID NO: 3554706 - DNA, 20 bp, Homo sapiens
cagttttctgagaaagacta

SEQ ID NO: 3554707 - DNA, 12 bp, Homo sapiens
cagtttttcctc

SEQ ID NO: 3554708 - DNA, 20 bp, Homo sapiens
cataaaaaggacatcagcaa

SEQ ID NO: 3554709 - DNA, 21 bp, Homo sapiens
cataaaaaggacatcagcaaa

SEQ ID NO: 3554710 - DNA, 17 bp, Homo sapiens
cataaaaattaaatgga

SEQ ID NO: 3554711 - DNA, 19 bp, Homo sapiens
cataaaagatatgttgaag

SEQ ID NO: 3554712 - DNA, 14 bp, Homo sapiens
cataaaagccccag

SEQ ID NO: 3554713 - DNA, 17 bp, Homo sapiens
cataaaataaataatct

SEQ ID NO: 3554714 - DNA, 14 bp, Homo sapiens
cataaaatcaaaac

SEQ ID NO: 3554715 - DNA, 12 bp, Homo sapiens
cataaacaaaga

SEQ ID NO: 3554716 - DNA, 24 bp, Homo sapiens
cataaacaaagacattgacagcaa

SEQ ID NO: 3554717 - DNA, 19 bp, Homo sapiens
cataaacggttcctggtga

SEQ ID NO: 3554718 - DNA, 17 bp, Homo sapiens
cataaagacaatcactg

SEQ ID NO: 3554719 - DNA, 18 bp, Homo sapiens
cataaagacaatcactgc

SEQ ID NO: 3554720 - DNA, 19 bp, Homo sapiens
cataaagacaatcactgcc

SEQ ID NO: 3554721 - DNA, 15 bp, Homo sapiens
cataaagtaaataca

SEQ ID NO: 3554722 - DNA, 22 bp, Homo sapiens
cataaagtaaatacatgcatat

SEQ ID NO: 3554723 - DNA, 12 bp, Homo sapiens
cataaataaagt

SEQ ID NO: 3554724 - DNA, 15 bp, Homo sapiens
cataaataaagtttc

SEQ ID NO: 3554725 - DNA, 20 bp, Homo sapiens
cataacattttcagaatagt

SEQ ID NO: 3554726 - DNA, 17 bp, Homo sapiens
cataactcctgtccctt

SEQ ID NO: 3554727 - DNA, 12 bp, Homo sapiens
cataacttgaaa

SEQ ID NO: 3554728 - DNA, 17 bp, Homo sapiens
cataagagaaacctgcc

SEQ ID NO: 3554729 - DNA, 18 bp, Homo sapiens
cataagagaaacctgcca

SEQ ID NO: 3554730 - DNA, 19 bp, Homo sapiens
cataagagaaacctgccaa

SEQ ID NO: 3554731 - DNA, 22 bp, Homo sapiens
cataagagaaacctgccaagga

SEQ ID NO: 3554732 - DNA, 15 bp, Homo sapiens
cataagcacctaaaa

SEQ ID NO: 3554733 - DNA, 23 bp, Homo sapiens
cataagtaacttttaaaatttgt

SEQ ID NO: 3554734 - DNA, 18 bp, Homo sapiens
cataagtgctattgcaga

SEQ ID NO: 3554735 - DNA, 22 bp, Homo sapiens
cataagtgctattgcagagccg

SEQ ID NO: 3554736 - DNA, 18 bp, Homo sapiens
cataatcacaacccttca

SEQ ID NO: 3554737 - DNA, 21 bp, Homo sapiens
cataatctggactcctctgtc

SEQ ID NO: 3554738 - DNA, 22 bp, Homo sapiens
cataatgaaaatattttttaca

SEQ ID NO: 3554739 - DNA, 12 bp, Homo sapiens
cataatggtact

SEQ ID NO: 3554740 - DNA, 15 bp, Homo sapiens
cataatgttgcttct

SEQ ID NO: 3554741 - DNA, 16 bp, Homo sapiens
cataattcatagtgat

SEQ ID NO: 3554742 - DNA, 14 bp, Homo sapiens
cataattctgaaac

SEQ ID NO: 3554743 - DNA, 15 bp, Homo sapiens
cataatttaaaaata

SEQ ID NO: 3554744 - DNA, 13 bp, Homo sapiens
cataattttgcaa

SEQ ID NO: 3554745 - DNA, 16 bp, Homo sapiens
catacatccctcagtt

SEQ ID NO: 3554746 - DNA, 15 bp, Homo sapiens
catacctggccctgt

SEQ ID NO: 3554747 - DNA, 18 bp, Homo sapiens
catactatgaaatatgta

SEQ ID NO: 3554748 - DNA, 11 bp, Homo sapiens
catactctgct

SEQ ID NO: 3554749 - DNA, 20 bp, Homo sapiens
catactgccttgtttaatgt

SEQ ID NO: 3554750 - DNA, 14 bp, Homo sapiens
catacttgaagggc

SEQ ID NO: 3554751 - DNA, 17 bp, Homo sapiens
catacttgaagggccag

SEQ ID NO: 3554752 - DNA, 17 bp, Homo sapiens
catagattccctgagca

SEQ ID NO: 3554753 - DNA, 20 bp, Homo sapiens
catagatttaagtgaataca

SEQ ID NO: 3554754 - DNA, 22 bp, Homo sapiens
catagcacctaacaacattgta

SEQ ID NO: 3554755 - DNA, 12 bp, Homo sapiens
catagctctggg

SEQ ID NO: 3554756 - DNA, 22 bp, Homo sapiens
catagcttacaagccagctgga

SEQ ID NO: 3554757 - DNA, 22 bp, Homo sapiens
catagtccttttatctccttgt

SEQ ID NO: 3554758 - DNA, 17 bp, Homo sapiens
catagtttgggtatttt

SEQ ID NO: 3554759 - DNA, 21 bp, Homo sapiens
catagtttgggtatttttggt

SEQ ID NO: 3554760 - DNA, 16 bp, Homo sapiens
catataaatgtttata

SEQ ID NO: 3554761 - DNA, 20 bp, Homo sapiens
catataaatgtttatattgt

SEQ ID NO: 3554762 - DNA, 11 bp, Homo sapiens
catataagaca

SEQ ID NO: 3554763 - DNA, 20 bp, Homo sapiens
catataagacaaatattcct

SEQ ID NO: 3554764 - DNA, 14 bp, Homo sapiens
catttctgggggga

SEQ ID NO: 3554765 - DNA, 15 bp, Homo sapiens
catttcttcacttca

SEQ ID NO: 3554766 - DNA, 19 bp, Homo sapiens
catttgaaacccctgtagg

SEQ ID NO: 3554767 - DNA, 17 bp, Homo sapiens
catttgaacctggatcc

SEQ ID NO: 3554768 - DNA, 16 bp, Homo sapiens
catttgacaaaactaa

SEQ ID NO: 3554769 - DNA, 21 bp, Homo sapiens
catttgacaaaactaaccttg

SEQ ID NO: 3554770 - DNA, 23 bp, Homo sapiens
catttgagtttagggttctggtg

SEQ ID NO: 3554771 - DNA, 18 bp, Homo sapiens
catttgcttgtactggga

SEQ ID NO: 3554772 - DNA, 15 bp, Homo sapiens
catttggaaatgatt

SEQ ID NO: 3554773 - DNA, 12 bp, Homo sapiens
catttggaattg

SEQ ID NO: 3554774 - DNA, 23 bp, Homo sapiens
catttgggatgttccttttttca

SEQ ID NO: 3554775 - DNA, 12 bp, Homo sapiens
catttgggcaga

SEQ ID NO: 3554776 - DNA, 16 bp, Homo sapiens
catttgggcagagagg

SEQ ID NO: 3554777 - DNA, 20 bp, Homo sapiens
catttggggtttgtgtttga

SEQ ID NO: 3554778 - DNA, 14 bp, Homo sapiens
catttgtaaaaatg

SEQ ID NO: 3554779 - DNA, 21 bp, Homo sapiens
catttgtaaaaatgagtcatt

SEQ ID NO: 3554780 - DNA, 22 bp, Homo sapiens
catttgtttctttctctgagga

SEQ ID NO: 3554781 - DNA, 23 bp, Homo sapiens
catttgtttctttctctgaggac

SEQ ID NO: 3554782 - DNA, 18 bp, Homo sapiens
catttgttttcggcagcc

SEQ ID NO: 3554783 - DNA, 21 bp, Homo sapiens
catttgttttcggcagcctta

SEQ ID NO: 3554784 - DNA, 18 bp, Homo sapiens
cattttaaccctatttta

SEQ ID NO: 3554785 - DNA, 14 bp, Homo sapiens
cattttaaggcaat

SEQ ID NO: 3554786 - DNA, 22 bp, Homo sapiens
cattttaatttattaattgctt

SEQ ID NO: 3554787 - DNA, 18 bp, Homo sapiens
cattttacattaaatttt

SEQ ID NO: 3554788 - DNA, 17 bp, Homo sapiens
cattttagaaactacaa

SEQ ID NO: 3554789 - DNA, 14 bp, Homo sapiens
cattttatgtcttt

SEQ ID NO: 3554790 - DNA, 22 bp, Homo sapiens
cattttatgtctttcttgtaag

SEQ ID NO: 3554791 - DNA, 20 bp, Homo sapiens
cattttggagagtttcctga

SEQ ID NO: 3554792 - DNA, 16 bp, Homo sapiens
cattttgtaataataa

SEQ ID NO: 3554793 - DNA, 21 bp, Homo sapiens
catttttaattcacgtgcttt

SEQ ID NO: 3554794 - DNA, 19 bp, Homo sapiens
catttttgccaaaatacca

SEQ ID NO: 3554795 - DNA, 17 bp, Homo sapiens
cattttttcttctgaag

SEQ ID NO: 3554796 - DNA, 19 bp, Homo sapiens
cattttttgggcagcaatt

SEQ ID NO: 3554797 - DNA, 23 bp, Homo sapiens
cattttttttctttgaataaatg

SEQ ID NO: 3554798 - DNA, 18 bp, Homo sapiens
ccaaaacaagccaaagag

SEQ ID NO: 3554799 - DNA, 13 bp, Homo sapiens
ccaaaacagcttt

SEQ ID NO: 3554800 - DNA, 14 bp, Homo sapiens
ccaaaacagctttg

SEQ ID NO: 3554801 - DNA, 23 bp, Homo sapiens
ccaaaacagctttgtctccaaag

SEQ ID NO: 3554802 - DNA, 22 bp, Homo sapiens
ccaaaagaagcccccagctaag

SEQ ID NO: 3554803 - DNA, 12 bp, Homo sapiens
ccaaaagacatt

SEQ ID NO: 3554804 - DNA, 14 bp, Homo sapiens
ccaaaagctgctca

SEQ ID NO: 3554805 - DNA, 18 bp, Homo sapiens
ccaaaatccaaaacttct

SEQ ID NO: 3554806 - DNA, 16 bp, Homo sapiens
ccaaaccccagcccca

SEQ ID NO: 3554807 - DNA, 18 bp, Homo sapiens
ccaaacccttaactgaca

SEQ ID NO: 3554808 - DNA, 23 bp, Homo sapiens
ccaaacccttgctttcctgggcc

SEQ ID NO: 3554809 - DNA, 18 bp, Homo sapiens
ccaaacctccagcctccc

SEQ ID NO: 3554810 - DNA, 14 bp, Homo sapiens
ccaaacctgggaag

SEQ ID NO: 3554811 - DNA, 18 bp, Homo sapiens
ccaaacctgggaaggcca

SEQ ID NO: 3554812 - DNA, 16 bp, Homo sapiens
ccaaactgacaatttt

SEQ ID NO: 3554813 - DNA, 17 bp, Homo sapiens
ccaaactggtgcatgac

SEQ ID NO: 3554814 - DNA, 19 bp, Homo sapiens
ccaaagaaacaagctgtgc

SEQ ID NO: 3554815 - DNA, 20 bp, Homo sapiens
ccaaagaaacaagctgtgca

SEQ ID NO: 3554816 - DNA, 11 bp, Homo sapiens
ccaaagaagat

SEQ ID NO: 3554817 - DNA, 18 bp, Homo sapiens
ccaaagactctggaggtc

SEQ ID NO: 3554818 - DNA, 22 bp, Homo sapiens
ccaaagactctggaggtcatct

SEQ ID NO: 3554819 - DNA, 23 bp, Homo sapiens
ccaaagattaggtcgttttccaa

SEQ ID NO: 3554820 - DNA, 14 bp, Homo sapiens
ccaaagctgttcca

SEQ ID NO: 3554821 - DNA, 14 bp, Homo sapiens
ccaaaggaaaatgt

SEQ ID NO: 3554822 - DNA, 14 bp, Homo sapiens
ccaaaggaacactg

SEQ ID NO: 3554823 - DNA, 16 bp, Homo sapiens
ccaaaggaacactgac

SEQ ID NO: 3554824 - DNA, 17 bp, Homo sapiens
ccaaaggaactctagag

SEQ ID NO: 3554825 - DNA, 16 bp, Homo sapiens
ccaaaggatgtgatat

SEQ ID NO: 3554826 - DNA, 19 bp, Homo sapiens
ccaaaggatgtgatatata

SEQ ID NO: 3554827 - DNA, 14 bp, Homo sapiens
ccaaaggtggcagc

SEQ ID NO: 3554828 - DNA, 15 bp, Homo sapiens
ccaaaggtggcagct

SEQ ID NO: 3554829 - DNA, 14 bp, Homo sapiens
ccaaagtattgtac

SEQ ID NO: 3554830 - DNA, 22 bp, Homo sapiens
ccaaatctgacatattatgcct

SEQ ID NO: 3554831 - DNA, 15 bp, Homo sapiens
ccaaatgaccgagcc

SEQ ID NO: 3554832 - DNA, 22 bp, Homo sapiens
ccaaatgaccgagccctggaga

SEQ ID NO: 3554833 - DNA, 23 bp, Homo sapiens
ccaaatgaccgagccctggagag

SEQ ID NO: 3554834 - DNA, 18 bp, Homo sapiens
ccaaatggccattttaaa

SEQ ID NO: 3554835 - DNA, 16 bp, Homo sapiens
ccaaattgcactgaag

SEQ ID NO: 3554836 - DNA, 22 bp, Homo sapiens
ccaacagaaaccttttattttt

SEQ ID NO: 3554837 - DNA, 17 bp, Homo sapiens
ccaacagcaaaggaact

SEQ ID NO: 3554838 - DNA, 16 bp, Homo sapiens
ccaacatcaacatctt

SEQ ID NO: 3554839 - DNA, 18 bp, Homo sapiens
ccaacatctacaaaacat

SEQ ID NO: 3554840 - DNA, 21 bp, Homo sapiens
ccaacatgtttctgttttgtt

SEQ ID NO: 3554841 - DNA, 22 bp, Homo sapiens
ccaaccagcccgacagtgccat

SEQ ID NO: 3554842 - DNA, 15 bp, Homo sapiens
ccaacccctctccag

SEQ ID NO: 3554843 - DNA, 16 bp, Homo sapiens
ccaacccctctccagg

SEQ ID NO: 3554844 - DNA, 22 bp, Homo sapiens
ccaacccctgacctaccccagc

SEQ ID NO: 3554845 - DNA, 21 bp, Homo sapiens
ccaacctacattccaccctgt

SEQ ID NO: 3554846 - DNA, 16 bp, Homo sapiens
ccaacctcaggctcct

SEQ ID NO: 3554847 - DNA, 11 bp, Homo sapiens
ccaacctccag

SEQ ID NO: 3554848 - DNA, 15 bp, Homo sapiens
ccaacctccagactc

SEQ ID NO: 3554849 - DNA, 12 bp, Homo sapiens
ccaacctccagt

SEQ ID NO: 3554850 - DNA, 21 bp, Homo sapiens
ccaacctgttcttagagtgta

SEQ ID NO: 3554851 - DNA, 15 bp, Homo sapiens
ccaacgcccctgtgg

SEQ ID NO: 3554852 - DNA, 23 bp, Homo sapiens
ccaacgcccctgtggccaactgc

SEQ ID NO: 3554853 - DNA, 17 bp, Homo sapiens
ccaacgtgcaaagccaa

SEQ ID NO: 3554854 - DNA, 20 bp, Homo sapiens
ccaacgtgcaaagccaaggc

SEQ ID NO: 3554855 - DNA, 21 bp, Homo sapiens
ccaacgtgcaaagccaaggca

SEQ ID NO: 3554856 - DNA, 18 bp, Homo sapiens
ccaactccaggggcacct

SEQ ID NO: 3554857 - DNA, 16 bp, Homo sapiens
ccaactgccaggctgc

SEQ ID NO: 3554858 - DNA, 19 bp, Homo sapiens
ccaactgggcatttcaatc

SEQ ID NO: 3554859 - DNA, 17 bp, Homo sapiens
ccaactgtttccctgct

SEQ ID NO: 3554860 - DNA, 20 bp, Homo sapiens
ccaacttctcttgctttcta

SEQ ID NO: 3554861 - DNA, 19 bp, Homo sapiens
ccaagaatagatgctgact

SEQ ID NO: 3554862 - DNA, 15 bp, Homo sapiens
ccaagagatctgtgt

SEQ ID NO: 3554863 - DNA, 22 bp, Homo sapiens
ccaagcatttcatgaaaaagct

SEQ ID NO: 3554864 - DNA, 19 bp, Homo sapiens
ccaagccagattctcttga

SEQ ID NO: 3554865 - DNA, 14 bp, Homo sapiens
ccaagccgtggctt

SEQ ID NO: 3554866 - DNA, 15 bp, Homo sapiens
ccaagccgtggcttc

SEQ ID NO: 3554867 - DNA, 14 bp, Homo sapiens
ccaagctccatctc

SEQ ID NO: 3554868 - DNA, 23 bp, Homo sapiens
ccaagctgcctcccctctccttc

SEQ ID NO: 3554869 - DNA, 23 bp, Homo sapiens
ccaagctggcacaaaagacagct

SEQ ID NO: 3554870 - DNA, 24 bp, Homo sapiens
ccaagctggcacaaaagacagctg

SEQ ID NO: 3554871 - DNA, 13 bp, Homo sapiens
ccaagctgtcaca

SEQ ID NO: 3554872 - DNA, 14 bp, Homo sapiens
ccaagctgttttct

SEQ ID NO: 3554873 - DNA, 17 bp, Homo sapiens
ccaagctgttttcttct

SEQ ID NO: 3554874 - DNA, 18 bp, Homo sapiens
ccaagctgttttcttcta

SEQ ID NO: 3554875 - DNA, 16 bp, Homo sapiens
ccaagcttcccaacag

SEQ ID NO: 3554876 - DNA, 13 bp, Homo sapiens
ccaaggagctgct

SEQ ID NO: 3554877 - DNA, 16 bp, Homo sapiens
ccaaggagctgctata

SEQ ID NO: 3554878 - DNA, 21 bp, Homo sapiens
ccaaggaggtgggccacaccc

SEQ ID NO: 3554879 - DNA, 17 bp, Homo sapiens
ccaaggcattctcccag

SEQ ID NO: 3554880 - DNA, 16 bp, Homo sapiens
ccaaggctctcccctc

SEQ ID NO: 3554881 - DNA, 18 bp, Homo sapiens
ccaaggctctcccctctc

SEQ ID NO: 3554882 - DNA, 17 bp, Homo sapiens
ccaaggctttaaagctg

SEQ ID NO: 3554883 - DNA, 21 bp, Homo sapiens
ccaaggctttaaagctgagag

SEQ ID NO: 3554884 - DNA, 13 bp, Homo sapiens
ccaagggatctgg

SEQ ID NO: 3554885 - DNA, 18 bp, Homo sapiens
ccaagggatggacatctt

SEQ ID NO: 3554886 - DNA, 16 bp, Homo sapiens
ccaagggccctggcac

SEQ ID NO: 3554887 - DNA, 21 bp, Homo sapiens
ccaagggtttcgactggtcca

SEQ ID NO: 3554888 - DNA, 22 bp, Homo sapiens
ccaaggtgaggtgaactccagg

SEQ ID NO: 3554889 - DNA, 24 bp, Homo sapiens
ccaaggtgaggtgaactccaggca

SEQ ID NO: 3554890 - DNA, 20 bp, Homo sapiens
ccaagtgccccaccactccc

SEQ ID NO: 3554891 - DNA, 21 bp, Homo sapiens
ccaagtggacgttaggccagg

SEQ ID NO: 3554892 - DNA, 17 bp, Homo sapiens
ccaagtggtgagcaagc

SEQ ID NO: 3554893 - DNA, 13 bp, Homo sapiens
ccaatcaaatata

SEQ ID NO: 3554894 - DNA, 17 bp, Homo sapiens
ccaatgacacccatgcc

SEQ ID NO: 3554895 - DNA, 13 bp, Homo sapiens
ccaatgctgcttt

SEQ ID NO: 3554896 - DNA, 15 bp, Homo sapiens
ccaattgtcaaatta

SEQ ID NO: 3554897 - DNA, 21 bp, Homo sapiens
ccacaaaacttcagtgtggta

SEQ ID NO: 3554898 - DNA, 13 bp, Homo sapiens
ccacaaactccag

SEQ ID NO: 3554899 - DNA, 15 bp, Homo sapiens
ccacaaactccaggc

SEQ ID NO: 3554900 - DNA, 17 bp, Homo sapiens
ccacaaactccaggctg

SEQ ID NO: 3554901 - DNA, 19 bp, Homo sapiens
ccacaactcctacatgatg

SEQ ID NO: 3554902 - DNA, 17 bp, Homo sapiens
ccacaagctgtccctgc

SEQ ID NO: 3554903 - DNA, 21 bp, Homo sapiens
ccacaagctgtccctgcaggg

SEQ ID NO: 3554904 - DNA, 20 bp, Homo sapiens
ccacaagttaaataaatcat

SEQ ID NO: 3554905 - DNA, 18 bp, Homo sapiens
ccacaattattggcaaag

SEQ ID NO: 3554906 - DNA, 21 bp, Homo sapiens
ccacacaacatccaagtggcc

SEQ ID NO: 3554907 - DNA, 22 bp, Homo sapiens
ccacacaaggatagatgctggc

SEQ ID NO: 3554908 - DNA, 19 bp, Homo sapiens
ccacacacagctgggctgt

SEQ ID NO: 3554909 - DNA, 13 bp, Homo sapiens
ccacacagctgcc

SEQ ID NO: 3554910 - DNA, 13 bp, Homo sapiens
ccacacccaggaa

SEQ ID NO: 3554911 - DNA, 21 bp, Homo sapiens
ccacaccgtggcagcttgctg

SEQ ID NO: 3554912 - DNA, 19 bp, Homo sapiens
ccacacctgaacttgccta

SEQ ID NO: 3554913 - DNA, 22 bp, Homo sapiens
ccacacctggccttaaagaggg

SEQ ID NO: 3554914 - DNA, 21 bp, Homo sapiens
ccacactgcttggcccttcaa

SEQ ID NO: 3554915 - DNA, 19 bp, Homo sapiens
ccacactgtggccaggcct

SEQ ID NO: 3554916 - DNA, 18 bp, Homo sapiens
ccacacttgttttctttg

SEQ ID NO: 3554917 - DNA, 12 bp, Homo sapiens
ccacagaacctt

SEQ ID NO: 3554918 - DNA, 20 bp, Homo sapiens
ccacagaaccttcaacccag

SEQ ID NO: 3554919 - DNA, 16 bp, Homo sapiens
ccacagaacttgtggc

SEQ ID NO: 3554920 - DNA, 14 bp, Homo sapiens
ccacagacccctgg

SEQ ID NO: 3554921 - DNA, 18 bp, Homo sapiens
ccacagacccctgggagc

SEQ ID NO: 3554922 - DNA, 17 bp, Homo sapiens
ccacagactcaatgtgc

SEQ ID NO: 3554923 - DNA, 21 bp, Homo sapiens
ccacagagaagtttgtagcca

SEQ ID NO: 3554924 - DNA, 16 bp, Homo sapiens
ccacagcaactgacct

SEQ ID NO: 3554925 - DNA, 16 bp, Homo sapiens
ccacagcagccccagg

SEQ ID NO: 3554926 - DNA, 17 bp, Homo sapiens
ccacagcagttgaaaag

SEQ ID NO: 3554927 - DNA, 22 bp, Homo sapiens
ccacagcatcgggagcacccag

SEQ ID NO: 3554928 - DNA, 18 bp, Homo sapiens
ccacagccggtcagagga

SEQ ID NO: 3554929 - DNA, 14 bp, Homo sapiens
ccacagcctccaaa

SEQ ID NO: 3554930 - DNA, 15 bp, Homo sapiens
ccacaggcccttcct

SEQ ID NO: 3554931 - DNA, 16 bp, Homo sapiens
ccacaggcccttcctc

SEQ ID NO: 3554932 - DNA, 18 bp, Homo sapiens
ccacaggcttagggacag

SEQ ID NO: 3554933 - DNA, 19 bp, Homo sapiens
ccacaggcttagggacagg

SEQ ID NO: 3554934 - DNA, 14 bp, Homo sapiens
ccacagtgaaagtt

SEQ ID NO: 3554935 - DNA, 18 bp, Homo sapiens
ccacagtggggctgcagg

SEQ ID NO: 3554936 - DNA, 20 bp, Homo sapiens
ccacagtggggctgcaggca

SEQ ID NO: 3554937 - DNA, 23 bp, Homo sapiens
ccacagttctgacgctgacaata

SEQ ID NO: 3554938 - DNA, 16 bp, Homo sapiens
ccacataaaagcccca

SEQ ID NO: 3554939 - DNA, 21 bp, Homo sapiens
ccacataaaagccccagcttg

SEQ ID NO: 3554940 - DNA, 23 bp, Homo sapiens
ccacatagtgatggttcccctgt

SEQ ID NO: 3554941 - DNA, 23 bp, Homo sapiens
ccacatctaagcctgaaggggcg

SEQ ID NO: 3554942 - DNA, 18 bp, Homo sapiens
ccacatcttgctctgcat

SEQ ID NO: 3554943 - DNA, 21 bp, Homo sapiens
ccacatgaggccatctcagga

SEQ ID NO: 3554944 - DNA, 16 bp, Homo sapiens
ccacatgccaggggcc

SEQ ID NO: 3554945 - DNA, 15 bp, Homo sapiens
ccacatgctgcctgg

SEQ ID NO: 3554946 - DNA, 18 bp, Homo sapiens
ccacatgctgcctggcac

SEQ ID NO: 3554947 - DNA, 22 bp, Homo sapiens
ccacatgctgcctggcacagac

SEQ ID NO: 3554948 - DNA, 21 bp, Homo sapiens
ccacatggccatcttctttct

SEQ ID NO: 3554949 - DNA, 13 bp, Homo sapiens
ccacattgctggc

SEQ ID NO: 3554950 - DNA, 16 bp, Homo sapiens
ccacattgctggctgc

SEQ ID NO: 3554951 - DNA, 17 bp, Homo sapiens
ccacattgctggctgcc

SEQ ID NO: 3554952 - DNA, 21 bp, Homo sapiens
ccaccaataaatcagaccatg

SEQ ID NO: 3554953 - DNA, 13 bp, Homo sapiens
ccaccacaggcat

SEQ ID NO: 3554954 - DNA, 14 bp, Homo sapiens
ccaccacccccttt

SEQ ID NO: 3554955 - DNA, 14 bp, Homo sapiens
ccaccaccctgccc

SEQ ID NO: 3554956 - DNA, 21 bp, Homo sapiens
ccaccactccccaacccctct

SEQ ID NO: 3554957 - DNA, 13 bp, Homo sapiens
ccaccagcagcat

SEQ ID NO: 3554958 - DNA, 11 bp, Homo sapiens
ccaccatctgc

SEQ ID NO: 3554959 - DNA, 14 bp, Homo sapiens
ccaccatctgctgt

SEQ ID NO: 3554960 - DNA, 18 bp, Homo sapiens
ccaccatctgctgtcttt

SEQ ID NO: 3554961 - DNA, 21 bp, Homo sapiens
ccaccatgcttgcctgaagct

SEQ ID NO: 3554962 - DNA, 12 bp, Homo sapiens
ccaccattcctg

SEQ ID NO: 3554963 - DNA, 16 bp, Homo sapiens
ccaccattcctgcctt

SEQ ID NO: 3554964 - DNA, 12 bp, Homo sapiens
ccacccacaaac

SEQ ID NO: 3554965 - DNA, 21 bp, Homo sapiens
ccacccacaaactccaggctg

SEQ ID NO: 3554966 - DNA, 23 bp, Homo sapiens
ccacccacaaactccaggctgga

SEQ ID NO: 3554967 - DNA, 14 bp, Homo sapiens
ccacccacacagct

SEQ ID NO: 3554968 - DNA, 21 bp, Homo sapiens
ccacccacacagctgccctag

SEQ ID NO: 3554969 - DNA, 17 bp, Homo sapiens
ccacccacctccctgcc

SEQ ID NO: 3554970 - DNA, 16 bp, Homo sapiens
ccaccccatccagcca

SEQ ID NO: 3554971 - DNA, 15 bp, Homo sapiens
ccacccccaggtgca

SEQ ID NO: 3554972 - DNA, 15 bp, Homo sapiens
ccaccccctcctccc

SEQ ID NO: 3554973 - DNA, 14 bp, Homo sapiens
ccaccccctctgga

SEQ ID NO: 3554974 - DNA, 21 bp, Homo sapiens
ccaccccctctggagaaggcc

SEQ ID NO: 3554975 - DNA, 18 bp, Homo sapiens
ccacccccttccctggga

SEQ ID NO: 3554976 - DNA, 20 bp, Homo sapiens
ccaccccgtagattcccatc

SEQ ID NO: 3554977 - DNA, 20 bp, Homo sapiens
ccacccctgggggctctcat

SEQ ID NO: 3554978 - DNA, 20 bp, Homo sapiens
ccaccccttggaggagagag

SEQ ID NO: 3554979 - DNA, 21 bp, Homo sapiens
ccaccctgccccccctaagag

SEQ ID NO: 3554980 - DNA, 15 bp, Homo sapiens
ccaccgaccaactgc

SEQ ID NO: 3554981 - DNA, 18 bp, Homo sapiens
ccaccgtacaaccccctc

SEQ ID NO: 3554982 - DNA, 14 bp, Homo sapiens
ccacctccacaccc

SEQ ID NO: 3554983 - DNA, 14 bp, Homo sapiens
ccacctccctgcct

SEQ ID NO: 3554984 - DNA, 12 bp, Homo sapiens
ccacctctcctg

SEQ ID NO: 3554985 - DNA, 13 bp, Homo sapiens
ccacctctgtggg

SEQ ID NO: 3554986 - DNA, 14 bp, Homo sapiens
ccacctctgtgggc

SEQ ID NO: 3554987 - DNA, 16 bp, Homo sapiens
ccacctgacacaccag

SEQ ID NO: 3554988 - DNA, 23 bp, Homo sapiens
ccacctgacacaccaggcgctaa

SEQ ID NO: 3554989 - DNA, 21 bp, Homo sapiens
ccacctggaagccgcgcggcc

SEQ ID NO: 3554990 - DNA, 12 bp, Homo sapiens
ccacctggagag

SEQ ID NO: 3554991 - DNA, 22 bp, Homo sapiens
ccacctggcaaaggacccttga

SEQ ID NO: 3554992 - DNA, 13 bp, Homo sapiens
ccacctggctgcc

SEQ ID NO: 3554993 - DNA, 17 bp, Homo sapiens
ccacctgggaacacagt

SEQ ID NO: 3554994 - DNA, 19 bp, Homo sapiens
ccacctggttgaatataat

SEQ ID NO: 3554995 - DNA, 23 bp, Homo sapiens
ccacgagggtctcccctcctgca

SEQ ID NO: 3554996 - DNA, 16 bp, Homo sapiens
ccacgagggtgccgtg

SEQ ID NO: 3554997 - DNA, 12 bp, Homo sapiens
ccacgcctcacc

SEQ ID NO: 3554998 - DNA, 18 bp, Homo sapiens
ccacgcctcaccagcccc

SEQ ID NO: 3554999 - DNA, 21 bp, Homo sapiens
ccacgctgaccatgcgtcagg

SEQ ID NO: 3555000 - DNA, 12 bp, Homo sapiens
ccacggcctggc

SEQ ID NO: 3555001 - DNA, 14 bp, Homo sapiens
ccacggtttttctt

SEQ ID NO: 3555002 - DNA, 22 bp, Homo sapiens
ccacgtggatgggcaaagcttg

SEQ ID NO: 3555003 - DNA, 14 bp, Homo sapiens
ccacgtgtatagta

SEQ ID NO: 3555004 - DNA, 20 bp, Homo sapiens
ccacgtgtatagtatctgta

SEQ ID NO: 3555005 - DNA, 14 bp, Homo sapiens
ccactaaagcttca

SEQ ID NO: 3555006 - DNA, 22 bp, Homo sapiens
ccactaagcagaggaggggccg

SEQ ID NO: 3555007 - DNA, 16 bp, Homo sapiens
ccactaccaaaagaca

SEQ ID NO: 3555008 - DNA, 12 bp, Homo sapiens
ccactaccagcc

SEQ ID NO: 3555009 - DNA, 13 bp, Homo sapiens
ccactaccagcca

SEQ ID NO: 3555010 - DNA, 21 bp, Homo sapiens
ccactactctcttcctccact

SEQ ID NO: 3555011 - DNA, 22 bp, Homo sapiens
ccactatctccgttccatctgg

SEQ ID NO: 3555012 - DNA, 16 bp, Homo sapiens
ccactcaggccacagt

SEQ ID NO: 3555013 - DNA, 16 bp, Homo sapiens
ccactcaggggacccc

SEQ ID NO: 3555014 - DNA, 18 bp, Homo sapiens
ccactcaggggaccccac

SEQ ID NO: 3555015 - DNA, 16 bp, Homo sapiens
ccactcagtgcctcca

SEQ ID NO: 3555016 - DNA, 16 bp, Homo sapiens
ccactccaagtgcccc

SEQ ID NO: 3555017 - DNA, 22 bp, Homo sapiens
ccactccaagtgccccaccact

SEQ ID NO: 3555018 - DNA, 19 bp, Homo sapiens
ccactccagacccctggct

SEQ ID NO: 3555019 - DNA, 15 bp, Homo sapiens
ccactccccaacccc

SEQ ID NO: 3555020 - DNA, 17 bp, Homo sapiens
ccactccccaacccctc

SEQ ID NO: 3555021 - DNA, 19 bp, Homo sapiens
ccactccccagccagcctg

SEQ ID NO: 3555022 - DNA, 22 bp, Homo sapiens
ccactccccagccccagcccct

SEQ ID NO: 3555023 - DNA, 22 bp, Homo sapiens
ccactcccccgtttctcctttt

SEQ ID NO: 3555024 - DNA, 11 bp, Homo sapiens
ccactccttgt

SEQ ID NO: 3555025 - DNA, 13 bp, Homo sapiens
ccactccttgtcc

SEQ ID NO: 3555026 - DNA, 13 bp, Homo sapiens
ccactctgcactg

SEQ ID NO: 3555027 - DNA, 17 bp, Homo sapiens
ccattctacctgtcctc

SEQ ID NO: 3555028 - DNA, 20 bp, Homo sapiens
ccattctattctccagacat

SEQ ID NO: 3555029 - DNA, 12 bp, Homo sapiens
ccattctgtttt

SEQ ID NO: 3555030 - DNA, 20 bp, Homo sapiens
ccattcttcctagttttctc

SEQ ID NO: 3555031 - DNA, 14 bp, Homo sapiens
ccattgagtccctg

SEQ ID NO: 3555032 - DNA, 16 bp, Homo sapiens
ccattgagtccctgct

SEQ ID NO: 3555033 - DNA, 13 bp, Homo sapiens
ccattggtgttga

SEQ ID NO: 3555034 - DNA, 18 bp, Homo sapiens
ccattgtggaattgagca

SEQ ID NO: 3555035 - DNA, 15 bp, Homo sapiens
ccattgtttaaaaat

SEQ ID NO: 3555036 - DNA, 14 bp, Homo sapiens
ccatttcaggactc

SEQ ID NO: 3555037 - DNA, 22 bp, Homo sapiens
ccatttcccttctggacactga

SEQ ID NO: 3555038 - DNA, 18 bp, Homo sapiens
ccatttgcaacaggaaga

SEQ ID NO: 3555039 - DNA, 16 bp, Homo sapiens
ccatttgctttttcac

SEQ ID NO: 3555040 - DNA, 14 bp, Homo sapiens
ccatttttctcttg

SEQ ID NO: 3555041 - DNA, 11 bp, Homo sapiens
cccaaaacagc

SEQ ID NO: 3555042 - DNA, 15 bp, Homo sapiens
cccaaaacagctttg

SEQ ID NO: 3555043 - DNA, 18 bp, Homo sapiens
cccaaaacagctttgtct

SEQ ID NO: 3555044 - DNA, 17 bp, Homo sapiens
cccaaaccccctgcagc

SEQ ID NO: 3555045 - DNA, 18 bp, Homo sapiens
cccaaaccccctgcagcc

SEQ ID NO: 3555046 - DNA, 13 bp, Homo sapiens
cccaaacctggga

SEQ ID NO: 3555047 - DNA, 21 bp, Homo sapiens
cccaaacctgggaaggccagc

SEQ ID NO: 3555048 - DNA, 15 bp, Homo sapiens
cccaaatcctagact

SEQ ID NO: 3555049 - DNA, 18 bp, Homo sapiens
cccaactccaggggcacc

SEQ ID NO: 3555050 - DNA, 21 bp, Homo sapiens
cccaagaatagatgctgactg

SEQ ID NO: 3555051 - DNA, 20 bp, Homo sapiens
cccaagccccctccttgtct

SEQ ID NO: 3555052 - DNA, 12 bp, Homo sapiens
cccaagcttccc

SEQ ID NO: 3555053 - DNA, 14 bp, Homo sapiens
cccaagcttcccaa

SEQ ID NO: 3555054 - DNA, 21 bp, Homo sapiens
cccaaggcattctcccagctc

SEQ ID NO: 3555055 - DNA, 23 bp, Homo sapiens
cccaagggatctggtcctaccca

SEQ ID NO: 3555056 - DNA, 13 bp, Homo sapiens
cccaagggccctg

SEQ ID NO: 3555057 - DNA, 14 bp, Homo sapiens
cccaagggccctgg

SEQ ID NO: 3555058 - DNA, 15 bp, Homo sapiens
cccaagggccctggc

SEQ ID NO: 3555059 - DNA, 16 bp, Homo sapiens
cccaagggccctggca

SEQ ID NO: 3555060 - DNA, 16 bp, Homo sapiens
cccaagggggctgctg

SEQ ID NO: 3555061 - DNA, 19 bp, Homo sapiens
cccaagggggctgctgctc

SEQ ID NO: 3555062 - DNA, 22 bp, Homo sapiens
cccaaggttacttaattcaact

SEQ ID NO: 3555063 - DNA, 18 bp, Homo sapiens
cccaatgacacccatgcc

SEQ ID NO: 3555064 - DNA, 12 bp, Homo sapiens
cccaatgctgct

SEQ ID NO: 3555065 - DNA, 13 bp, Homo sapiens
cccaatgctgctt

SEQ ID NO: 3555066 - DNA, 15 bp, Homo sapiens
cccaatttcagactc

SEQ ID NO: 3555067 - DNA, 14 bp, Homo sapiens
cccacaaactccag

SEQ ID NO: 3555068 - DNA, 15 bp, Homo sapiens
cccacaaactccagg

SEQ ID NO: 3555069 - DNA, 18 bp, Homo sapiens
cccacaagctgtccctgc

SEQ ID NO: 3555070 - DNA, 22 bp, Homo sapiens
cccacaagctgtccctgcaggg

SEQ ID NO: 3555071 - DNA, 19 bp, Homo sapiens
cccacaaggaaccctcagg

SEQ ID NO: 3555072 - DNA, 22 bp, Homo sapiens
cccacaaggaaccctcaggcca

SEQ ID NO: 3555073 - DNA, 13 bp, Homo sapiens
cccacaagtggtg

SEQ ID NO: 3555074 - DNA, 14 bp, Homo sapiens
cccacaagtggtgg

SEQ ID NO: 3555075 - DNA, 22 bp, Homo sapiens
cccacaagtggtggtaaccctg

SEQ ID NO: 3555076 - DNA, 14 bp, Homo sapiens
cccacacagctgcc

SEQ ID NO: 3555077 - DNA, 16 bp, Homo sapiens
cccacacagctgccct

SEQ ID NO: 3555078 - DNA, 21 bp, Homo sapiens
cccacacagctgccctagctg

SEQ ID NO: 3555079 - DNA, 13 bp, Homo sapiens
cccacagaacctt

SEQ ID NO: 3555080 - DNA, 21 bp, Homo sapiens
cccacaggagggccagcgctg

SEQ ID NO: 3555081 - DNA, 22 bp, Homo sapiens
cccacataaaagccccagcttg

SEQ ID NO: 3555082 - DNA, 18 bp, Homo sapiens
cccacatgaggccatctc

SEQ ID NO: 3555083 - DNA, 13 bp, Homo sapiens
cccaccacacaac

SEQ ID NO: 3555084 - DNA, 14 bp, Homo sapiens
cccaccactcaggc

SEQ ID NO: 3555085 - DNA, 13 bp, Homo sapiens
cccaccatctgct

SEQ ID NO: 3555086 - DNA, 15 bp, Homo sapiens
cccaccatctgctgt

SEQ ID NO: 3555087 - DNA, 16 bp, Homo sapiens
cccaccatctgctgtc

SEQ ID NO: 3555088 - DNA, 12 bp, Homo sapiens
cccaccattcct

SEQ ID NO: 3555089 - DNA, 13 bp, Homo sapiens
cccaccattcctg

SEQ ID NO: 3555090 - DNA, 15 bp, Homo sapiens
cccacccctcactcc

SEQ ID NO: 3555091 - DNA, 16 bp, Homo sapiens
cccacccctcactccc

SEQ ID NO: 3555092 - DNA, 21 bp, Homo sapiens
cccacccctcactccccaggg

SEQ ID NO: 3555093 - DNA, 22 bp, Homo sapiens
cccacccctgggggctctcatg

SEQ ID NO: 3555094 - DNA, 23 bp, Homo sapiens
cccaccctccggcgggtgacagc

SEQ ID NO: 3555095 - DNA, 18 bp, Homo sapiens
cccaccctggtgggccaa

SEQ ID NO: 3555096 - DNA, 15 bp, Homo sapiens
cccaccggccaggcc

SEQ ID NO: 3555097 - DNA, 23 bp, Homo sapiens
cccaccgggctgggagctctgca

SEQ ID NO: 3555098 - DNA, 12 bp, Homo sapiens
cccacctccctg

SEQ ID NO: 3555099 - DNA, 14 bp, Homo sapiens
cccacctccctgcc

SEQ ID NO: 3555100 - DNA, 17 bp, Homo sapiens
cccacctccctgcctcc

SEQ ID NO: 3555101 - DNA, 20 bp, Homo sapiens
cccacctcggcacacactgt

SEQ ID NO: 3555102 - DNA, 12 bp, Homo sapiens
cccacctggctg

SEQ ID NO: 3555103 - DNA, 15 bp, Homo sapiens
cccacctggctgcca

SEQ ID NO: 3555104 - DNA, 13 bp, Homo sapiens
cccaccttcccac

SEQ ID NO: 3555105 - DNA, 21 bp, Homo sapiens
cccacgacctgtcctgtcttt

SEQ ID NO: 3555106 - DNA, 23 bp, Homo sapiens
cccacgagggtctcccctcctgc

SEQ ID NO: 3555107 - DNA, 17 bp, Homo sapiens
cccacgcctcaccagcc

SEQ ID NO: 3555108 - DNA, 19 bp, Homo sapiens
cccacgctgaccatgcgtc

SEQ ID NO: 3555109 - DNA, 15 bp, Homo sapiens
cccactcaggggacc

SEQ ID NO: 3555110 - DNA, 14 bp, Homo sapiens
cccactccactact

SEQ ID NO: 3555111 - DNA, 14 bp, Homo sapiens
cccactccagctga

SEQ ID NO: 3555112 - DNA, 14 bp, Homo sapiens
cccactccccagcc

SEQ ID NO: 3555113 - DNA, 13 bp, Homo sapiens
cccactcccctca

SEQ ID NO: 3555114 - DNA, 13 bp, Homo sapiens
cccactcctggga

SEQ ID NO: 3555115 - DNA, 22 bp, Homo sapiens
cccactctgggcaaagcccctc

SEQ ID NO: 3555116 - DNA, 13 bp, Homo sapiens
cccactgctgagc

SEQ ID NO: 3555117 - DNA, 15 bp, Homo sapiens
cccactgtcctgggc

SEQ ID NO: 3555118 - DNA, 18 bp, Homo sapiens
cccactttcatctacctt

SEQ ID NO: 3555119 - DNA, 15 bp, Homo sapiens
cccagaaagcctcct

SEQ ID NO: 3555120 - DNA, 19 bp, Homo sapiens
cccagaacctctaagtgct

SEQ ID NO: 3555121 - DNA, 23 bp, Homo sapiens
cccagaacctctaagtgctgctg

SEQ ID NO: 3555122 - DNA, 18 bp, Homo sapiens
cccagaatggagcctgct

SEQ ID NO: 3555123 - DNA, 22 bp, Homo sapiens
cccagaatttaccatcatctct

SEQ ID NO: 3555124 - DNA, 20 bp, Homo sapiens
cccagactcagacattggca

SEQ ID NO: 3555125 - DNA, 18 bp, Homo sapiens
cccagacttctctttctt

SEQ ID NO: 3555126 - DNA, 22 bp, Homo sapiens
cccagagaaaggggagcccact

SEQ ID NO: 3555127 - DNA, 20 bp, Homo sapiens
cccagagacctcatcagcct

SEQ ID NO: 3555128 - DNA, 15 bp, Homo sapiens
cccagagagaccctg

SEQ ID NO: 3555129 - DNA, 12 bp, Homo sapiens
cccagagaggga

SEQ ID NO: 3555130 - DNA, 15 bp, Homo sapiens
cccagagagggaaga

SEQ ID NO: 3555131 - DNA, 14 bp, Homo sapiens
cccagagcaccccc

SEQ ID NO: 3555132 - DNA, 15 bp, Homo sapiens
cccagagcccagctc

SEQ ID NO: 3555133 - DNA, 17 bp, Homo sapiens
cccagagcccagctcca

SEQ ID NO: 3555134 - DNA, 18 bp, Homo sapiens
cccagagggttgctggtc

SEQ ID NO: 3555135 - DNA, 15 bp, Homo sapiens
cccagcaagcgggag

SEQ ID NO: 3555136 - DNA, 21 bp, Homo sapiens
cccagcaggagagactgagca

SEQ ID NO: 3555137 - DNA, 18 bp, Homo sapiens
cccagcatccctggagca

SEQ ID NO: 3555138 - DNA, 17 bp, Homo sapiens
cccagcatcgcactctg

SEQ ID NO: 3555139 - DNA, 12 bp, Homo sapiens
cccagcatctcc

SEQ ID NO: 3555140 - DNA, 13 bp, Homo sapiens
cccagcatctccc

SEQ ID NO: 3555141 - DNA, 19 bp, Homo sapiens
cccagcatgcaccacgggc

SEQ ID NO: 3555142 - DNA, 15 bp, Homo sapiens
cccagccactcccca

SEQ ID NO: 3555143 - DNA, 16 bp, Homo sapiens
cccagccactccccag

SEQ ID NO: 3555144 - DNA, 12 bp, Homo sapiens
cccagccagccc

SEQ ID NO: 3555145 - DNA, 15 bp, Homo sapiens
cccagccagcccttc

SEQ ID NO: 3555146 - DNA, 18 bp, Homo sapiens
cccagccaggccaacagc

SEQ ID NO: 3555147 - DNA, 16 bp, Homo sapiens
cccagccagggctcaa

SEQ ID NO: 3555148 - DNA, 21 bp, Homo sapiens
cccagccagggctcaatctct

SEQ ID NO: 3555149 - DNA, 22 bp, Homo sapiens
cccagccagggctcaatctctg

SEQ ID NO: 3555150 - DNA, 13 bp, Homo sapiens
cccagccatccag

SEQ ID NO: 3555151 - DNA, 16 bp, Homo sapiens
cccagcccaccccatg

SEQ ID NO: 3555152 - DNA, 14 bp, Homo sapiens
cccagcccagagcc

SEQ ID NO: 3555153 - DNA, 19 bp, Homo sapiens
cccagcccagagccacctg

SEQ ID NO: 3555154 - DNA, 12 bp, Homo sapiens
cccagcccagca

SEQ ID NO: 3555155 - DNA, 15 bp, Homo sapiens
cccagccccagccag

SEQ ID NO: 3555156 - DNA, 17 bp, Homo sapiens
cccagccccagccaggg

SEQ ID NO: 3555157 - DNA, 14 bp, Homo sapiens
cccagccccagccc

SEQ ID NO: 3555158 - DNA, 15 bp, Homo sapiens
cccagccccagcccc

SEQ ID NO: 3555159 - DNA, 11 bp, Homo sapiens
cccagccctgg

SEQ ID NO: 3555160 - DNA, 15 bp, Homo sapiens
cccagccctggggga

SEQ ID NO: 3555161 - DNA, 22 bp, Homo sapiens
ccgggagggtgcggctgtgcag

SEQ ID NO: 3555162 - DNA, 16 bp, Homo sapiens
ccgggatgggagccgg

SEQ ID NO: 3555163 - DNA, 14 bp, Homo sapiens
ccgggcatggtggc

SEQ ID NO: 3555164 - DNA, 12 bp, Homo sapiens
ccgggcgcagcc

SEQ ID NO: 3555165 - DNA, 20 bp, Homo sapiens
ccgggcgtgtgaagaacacc

SEQ ID NO: 3555166 - DNA, 17 bp, Homo sapiens
ccgggctggagaaagag

SEQ ID NO: 3555167 - DNA, 23 bp, Homo sapiens
ccgggctggagaaagagctgcct

SEQ ID NO: 3555168 - DNA, 15 bp, Homo sapiens
ccggggaaaggcaag

SEQ ID NO: 3555169 - DNA, 22 bp, Homo sapiens
ccggggctctgggtgctgccct

SEQ ID NO: 3555170 - DNA, 17 bp, Homo sapiens
ccggggtgtaacttcct

SEQ ID NO: 3555171 - DNA, 18 bp, Homo sapiens
ccggggtgtaacttcctg

SEQ ID NO: 3555172 - DNA, 22 bp, Homo sapiens
ccgggtcatctgtacctctgcc

SEQ ID NO: 3555173 - DNA, 16 bp, Homo sapiens
ccggtcgggcagccag

SEQ ID NO: 3555174 - DNA, 18 bp, Homo sapiens
ccggtcgggcagccagca

SEQ ID NO: 3555175 - DNA, 21 bp, Homo sapiens
ccggtcgggcagccagcagag

SEQ ID NO: 3555176 - DNA, 13 bp, Homo sapiens
ccggtgctgcagg

SEQ ID NO: 3555177 - DNA, 15 bp, Homo sapiens
ccggtgggcagtggg

SEQ ID NO: 3555178 - DNA, 20 bp, Homo sapiens
ccggtgtatcctggccctgg

SEQ ID NO: 3555179 - DNA, 15 bp, Homo sapiens
ccgtagctctgctgc

SEQ ID NO: 3555180 - DNA, 18 bp, Homo sapiens
ccgtatgaagacagaggc

SEQ ID NO: 3555181 - DNA, 17 bp, Homo sapiens
ccgtcacccactctgca

SEQ ID NO: 3555182 - DNA, 17 bp, Homo sapiens
ccgtcactacctggctg

SEQ ID NO: 3555183 - DNA, 15 bp, Homo sapiens
ccgtccaggggagat

SEQ ID NO: 3555184 - DNA, 17 bp, Homo sapiens
ccgtctggcccaccagg

SEQ ID NO: 3555185 - DNA, 16 bp, Homo sapiens
ccgtgccccttccctg

SEQ ID NO: 3555186 - DNA, 20 bp, Homo sapiens
ccgtgccccttccctgggtt

SEQ ID NO: 3555187 - DNA, 16 bp, Homo sapiens
ccgtgccttcagctct

SEQ ID NO: 3555188 - DNA, 18 bp, Homo sapiens
ccgtgcgggcgaggccgc

SEQ ID NO: 3555189 - DNA, 21 bp, Homo sapiens
ccgtgctgacagctgctccta

SEQ ID NO: 3555190 - DNA, 18 bp, Homo sapiens
ccgtggcacagctgggag

SEQ ID NO: 3555191 - DNA, 15 bp, Homo sapiens
ccgtggcagcttgct

SEQ ID NO: 3555192 - DNA, 17 bp, Homo sapiens
ccgtggcagcttgctgg

SEQ ID NO: 3555193 - DNA, 15 bp, Homo sapiens
ccgtggcttcccgct

SEQ ID NO: 3555194 - DNA, 22 bp, Homo sapiens
ccgtggcttggggattgtacac

SEQ ID NO: 3555195 - DNA, 17 bp, Homo sapiens
ccgtgggtcattacaaa

SEQ ID NO: 3555196 - DNA, 15 bp, Homo sapiens
ccgtgtccaggagcc

SEQ ID NO: 3555197 - DNA, 23 bp, Homo sapiens
ccgtgtccaggagccccgccagg

SEQ ID NO: 3555198 - DNA, 17 bp, Homo sapiens
ccgtgtctcagcctctg

SEQ ID NO: 3555199 - DNA, 20 bp, Homo sapiens
ccgtgtctcagcctctgcca

SEQ ID NO: 3555200 - DNA, 14 bp, Homo sapiens
ccgtgtttctctaa

SEQ ID NO: 3555201 - DNA, 15 bp, Homo sapiens
ccgtgtttctctaag

SEQ ID NO: 3555202 - DNA, 18 bp, Homo sapiens
cctaaactgcagcctctc

SEQ ID NO: 3555203 - DNA, 18 bp, Homo sapiens
cctaaagagcatcctgat

SEQ ID NO: 3555204 - DNA, 16 bp, Homo sapiens
cctaaagccaggctca

SEQ ID NO: 3555205 - DNA, 19 bp, Homo sapiens
cctaaatttaatgctgcct

SEQ ID NO: 3555206 - DNA, 20 bp, Homo sapiens
cctaaatttaatgctgcctt

SEQ ID NO: 3555207 - DNA, 21 bp, Homo sapiens
cctaactcctataaagtgcct

SEQ ID NO: 3555208 - DNA, 18 bp, Homo sapiens
cctaagaagaaggccaga

SEQ ID NO: 3555209 - DNA, 20 bp, Homo sapiens
cctaagaagaaggccagaga

SEQ ID NO: 3555210 - DNA, 15 bp, Homo sapiens
cctaagaataaacat

SEQ ID NO: 3555211 - DNA, 17 bp, Homo sapiens
cctaagcccccagggcc

SEQ ID NO: 3555212 - DNA, 18 bp, Homo sapiens
cctaatcaaattctgtct

SEQ ID NO: 3555213 - DNA, 20 bp, Homo sapiens
cctaatcaaattctgtctgg

SEQ ID NO: 3555214 - DNA, 18 bp, Homo sapiens
cctaatccaggcagatcc

SEQ ID NO: 3555215 - DNA, 19 bp, Homo sapiens
cctaatggctatttttgaa

SEQ ID NO: 3555216 - DNA, 21 bp, Homo sapiens
cctaattcttttatctttatt

SEQ ID NO: 3555217 - DNA, 23 bp, Homo sapiens
cctaattttgccaaaatcctgaa

SEQ ID NO: 3555218 - DNA, 16 bp, Homo sapiens
cctacaataaactggt

SEQ ID NO: 3555219 - DNA, 23 bp, Homo sapiens
cctacagacagcttacaggagcc

SEQ ID NO: 3555220 - DNA, 17 bp, Homo sapiens
cctacagactccatctc

SEQ ID NO: 3555221 - DNA, 20 bp, Homo sapiens
cctacagactccatctcttc

SEQ ID NO: 3555222 - DNA, 18 bp, Homo sapiens
cctacagtatataagctt

SEQ ID NO: 3555223 - DNA, 22 bp, Homo sapiens
cctacagtatataagctttttt

SEQ ID NO: 3555224 - DNA, 20 bp, Homo sapiens
cctacagtgactccctggga

SEQ ID NO: 3555225 - DNA, 22 bp, Homo sapiens
cctacagtgactccctgggagc

SEQ ID NO: 3555226 - DNA, 15 bp, Homo sapiens
cctacattccaccct

SEQ ID NO: 3555227 - DNA, 14 bp, Homo sapiens
cctacccatccccg

SEQ ID NO: 3555228 - DNA, 15 bp, Homo sapiens
cctaccctaaccaag

SEQ ID NO: 3555229 - DNA, 16 bp, Homo sapiens
cctaccctaaccaagt

SEQ ID NO: 3555230 - DNA, 18 bp, Homo sapiens
cctaccctaaccaagttc

SEQ ID NO: 3555231 - DNA, 14 bp, Homo sapiens
cctaccctcccacc

SEQ ID NO: 3555232 - DNA, 23 bp, Homo sapiens
cctaccctggcagggacctgaga

SEQ ID NO: 3555233 - DNA, 22 bp, Homo sapiens
cctaccgagtctcttctccact

SEQ ID NO: 3555234 - DNA, 15 bp, Homo sapiens
cctacctctgtctga

SEQ ID NO: 3555235 - DNA, 12 bp, Homo sapiens
cctacctggtaa

SEQ ID NO: 3555236 - DNA, 17 bp, Homo sapiens
cctacctgtctgctgcc

SEQ ID NO: 3555237 - DNA, 18 bp, Homo sapiens
cctacctgtctgctgcca

SEQ ID NO: 3555238 - DNA, 20 bp, Homo sapiens
cctacctgtctgctgccagc

SEQ ID NO: 3555239 - DNA, 21 bp, Homo sapiens
cctacctgtctgctgccagca

SEQ ID NO: 3555240 - DNA, 14 bp, Homo sapiens
cctacctgtgcctg

SEQ ID NO: 3555241 - DNA, 16 bp, Homo sapiens
cctactgcgcctcgtg

SEQ ID NO: 3555242 - DNA, 16 bp, Homo sapiens
cctactgtgggcaaag

SEQ ID NO: 3555243 - DNA, 17 bp, Homo sapiens
cctactgtgggcaaagt

SEQ ID NO: 3555244 - DNA, 23 bp, Homo sapiens
cctagaaagggcaaggggtgagg

SEQ ID NO: 3555245 - DNA, 18 bp, Homo sapiens
cctagactgctcctgggc

SEQ ID NO: 3555246 - DNA, 19 bp, Homo sapiens
cctagactgctcctgggca

SEQ ID NO: 3555247 - DNA, 11 bp, Homo sapiens
cctagagtgta

SEQ ID NO: 3555248 - DNA, 15 bp, Homo sapiens
cctagagtgtagcct

SEQ ID NO: 3555249 - DNA, 16 bp, Homo sapiens
cctagatgcacgtggg

SEQ ID NO: 3555250 - DNA, 23 bp, Homo sapiens
cctagatgcacgtggggcccact

SEQ ID NO: 3555251 - DNA, 13 bp, Homo sapiens
cctagccctctca

SEQ ID NO: 3555252 - DNA, 20 bp, Homo sapiens
cctagccctctcacatttat

SEQ ID NO: 3555253 - DNA, 12 bp, Homo sapiens
cctagccctgct

SEQ ID NO: 3555254 - DNA, 16 bp, Homo sapiens
cctagcctggctctgc

SEQ ID NO: 3555255 - DNA, 20 bp, Homo sapiens
cctagcggagcccagcctgg

SEQ ID NO: 3555256 - DNA, 21 bp, Homo sapiens
cctagctgaccccgagaagtg

SEQ ID NO: 3555257 - DNA, 13 bp, Homo sapiens
cctaggaaccagc

SEQ ID NO: 3555258 - DNA, 14 bp, Homo sapiens
cctaggcctcagcc

SEQ ID NO: 3555259 - DNA, 18 bp, Homo sapiens
cctaggcctcagccagag

SEQ ID NO: 3555260 - DNA, 17 bp, Homo sapiens
cctaggctccaccccat

SEQ ID NO: 3555261 - DNA, 15 bp, Homo sapiens
cctaggtgcagctcc

SEQ ID NO: 3555262 - DNA, 16 bp, Homo sapiens
cctaggtgcagctcct

SEQ ID NO: 3555263 - DNA, 14 bp, Homo sapiens
cctaggtgcccagg

SEQ ID NO: 3555264 - DNA, 16 bp, Homo sapiens
cctaggtgcccagggc

SEQ ID NO: 3555265 - DNA, 15 bp, Homo sapiens
cctagttttctcctc

SEQ ID NO: 3555266 - DNA, 22 bp, Homo sapiens
cctataaagggcccacacctgg

SEQ ID NO: 3555267 - DNA, 14 bp, Homo sapiens
cctataaagtgcct

SEQ ID NO: 3555268 - DNA, 18 bp, Homo sapiens
cctatagctacatgttct

SEQ ID NO: 3555269 - DNA, 20 bp, Homo sapiens
cctatagctacatgttcttt

SEQ ID NO: 3555270 - DNA, 14 bp, Homo sapiens
cctatctccctggc

SEQ ID NO: 3555271 - DNA, 17 bp, Homo sapiens
cctatgagatggccatg

SEQ ID NO: 3555272 - DNA, 21 bp, Homo sapiens
cctatgagatggccatgctca

SEQ ID NO: 3555273 - DNA, 19 bp, Homo sapiens
cctatgatggatggcagac

SEQ ID NO: 3555274 - DNA, 19 bp, Homo sapiens
cctatggaagttgttgcta

SEQ ID NO: 3555275 - DNA, 16 bp, Homo sapiens
cctatgtagtccgtgc

SEQ ID NO: 3555276 - DNA, 22 bp, Homo sapiens
cctatttattaatattttacag

SEQ ID NO: 3555277 - DNA, 22 bp, Homo sapiens
cctattttgaatgcagaaaaca

SEQ ID NO: 3555278 - DNA, 13 bp, Homo sapiens
cctatttttcctt

SEQ ID NO: 3555279 - DNA, 15 bp, Homo sapiens
cctatttttccttta

SEQ ID NO: 3555280 - DNA, 14 bp, Homo sapiens
cctcaaactgcaca

SEQ ID NO: 3555281 - DNA, 16 bp, Homo sapiens
cctcaaactgcacatc

SEQ ID NO: 3555282 - DNA, 14 bp, Homo sapiens
cctcaaagaaagtg

SEQ ID NO: 3555283 - DNA, 16 bp, Homo sapiens
cctcaaagaaagtgta

SEQ ID NO: 3555284 - DNA, 14 bp, Homo sapiens
cctcaaggaagcta

SEQ ID NO: 3555285 - DNA, 18 bp, Homo sapiens
cctcaataaacatttcat

SEQ ID NO: 3555286 - DNA, 17 bp, Homo sapiens
cctcacacacacccccc

SEQ ID NO: 3555287 - DNA, 13 bp, Homo sapiens
cctcacactgcaa

SEQ ID NO: 3555288 - DNA, 15 bp, Homo sapiens
cctcaccacagcctt

SEQ ID NO: 3555289 - DNA, 13 bp, Homo sapiens
cctcacccacctc

SEQ ID NO: 3555290 - DNA, 15 bp, Homo sapiens
cctcacccacctctg

SEQ ID NO: 3555291 - DNA, 16 bp, Homo sapiens
cctcacccacctctgg

SEQ ID NO: 3555292 - DNA, 17 bp, Homo sapiens
cctcacccccagctttg

SEQ ID NO: 3555293 - DNA, 21 bp, Homo sapiens
cctgggagccagtcctccact

SEQ ID NO: 3555294 - DNA, 14 bp, Homo sapiens
cctgggagcccaga

SEQ ID NO: 3555295 - DNA, 13 bp, Homo sapiens
cctgggcacaaac

SEQ ID NO: 3555296 - DNA, 17 bp, Homo sapiens
cctgggcatgggtccag

SEQ ID NO: 3555297 - DNA, 18 bp, Homo sapiens
cctgggcatgggtccagg

SEQ ID NO: 3555298 - DNA, 21 bp, Homo sapiens
cctgggcatgggtccagggcc

SEQ ID NO: 3555299 - DNA, 18 bp, Homo sapiens
cctgggcattagcaaggc

SEQ ID NO: 3555300 - DNA, 19 bp, Homo sapiens
cctgggcattagcaaggca

SEQ ID NO: 3555301 - DNA, 18 bp, Homo sapiens
cctgggccgtggcacagc

SEQ ID NO: 3555302 - DNA, 22 bp, Homo sapiens
cctgggccgtggcacagctggg

SEQ ID NO: 3555303 - DNA, 13 bp, Homo sapiens
cctgggcctgccc

SEQ ID NO: 3555304 - DNA, 14 bp, Homo sapiens
cctgggcctgcccc

SEQ ID NO: 3555305 - DNA, 16 bp, Homo sapiens
cctgggcctgcccctg

SEQ ID NO: 3555306 - DNA, 19 bp, Homo sapiens
cctgggcctttgcaagatg

SEQ ID NO: 3555307 - DNA, 22 bp, Homo sapiens
cctgggcctttgcaagatgctt

SEQ ID NO: 3555308 - DNA, 23 bp, Homo sapiens
cctgggcctttgcaagatgcttg

SEQ ID NO: 3555309 - DNA, 18 bp, Homo sapiens
cctgggctcactgtgctg

SEQ ID NO: 3555310 - DNA, 14 bp, Homo sapiens
cctgggctcagcct

SEQ ID NO: 3555311 - DNA, 16 bp, Homo sapiens
cctgggctcagcctgg

SEQ ID NO: 3555312 - DNA, 14 bp, Homo sapiens
cctgggctcctctt

SEQ ID NO: 3555313 - DNA, 21 bp, Homo sapiens
cctgggctcctcttagctcag

SEQ ID NO: 3555314 - DNA, 22 bp, Homo sapiens
cctgggctggggcctcagaccc

SEQ ID NO: 3555315 - DNA, 21 bp, Homo sapiens
cctggggagtggttaggcagc

SEQ ID NO: 3555316 - DNA, 21 bp, Homo sapiens
cctggggatcttcccacagga

SEQ ID NO: 3555317 - DNA, 15 bp, Homo sapiens
cctggggcagcactc

SEQ ID NO: 3555318 - DNA, 16 bp, Homo sapiens
cctgggggctctcatg

SEQ ID NO: 3555319 - DNA, 22 bp, Homo sapiens
cctgggggttctttcttcctct

SEQ ID NO: 3555320 - DNA, 16 bp, Homo sapiens
cctggggtgcatctcc

SEQ ID NO: 3555321 - DNA, 17 bp, Homo sapiens
cctggggtgcatctcct

SEQ ID NO: 3555322 - DNA, 18 bp, Homo sapiens
cctggggtgcatctcctc

SEQ ID NO: 3555323 - DNA, 23 bp, Homo sapiens
cctgggtagctagcaccatggca

SEQ ID NO: 3555324 - DNA, 19 bp, Homo sapiens
cctggtccccactgctgag

SEQ ID NO: 3555325 - DNA, 20 bp, Homo sapiens
cctggtccccactgctgagc

SEQ ID NO: 3555326 - DNA, 22 bp, Homo sapiens
cctggtgcacgcaggcacagca

SEQ ID NO: 3555327 - DNA, 18 bp, Homo sapiens
cctggtgccctggatgcc

SEQ ID NO: 3555328 - DNA, 21 bp, Homo sapiens
cctggtgctgccacacttcag

SEQ ID NO: 3555329 - DNA, 16 bp, Homo sapiens
cctggttagctgacag

SEQ ID NO: 3555330 - DNA, 20 bp, Homo sapiens
cctggttagctgacagtcag

SEQ ID NO: 3555331 - DNA, 16 bp, Homo sapiens
cctggttcagacacag

SEQ ID NO: 3555332 - DNA, 17 bp, Homo sapiens
cctggttgaatataata

SEQ ID NO: 3555333 - DNA, 19 bp, Homo sapiens
cctggtttcgtgtgctgcc

SEQ ID NO: 3555334 - DNA, 16 bp, Homo sapiens
cctgtaccaaatctga

SEQ ID NO: 3555335 - DNA, 16 bp, Homo sapiens
cctgtacctcagtgga

SEQ ID NO: 3555336 - DNA, 15 bp, Homo sapiens
cctgtataagacact

SEQ ID NO: 3555337 - DNA, 13 bp, Homo sapiens
cctgtcacccaca

SEQ ID NO: 3555338 - DNA, 14 bp, Homo sapiens
cctgtccagctcca

SEQ ID NO: 3555339 - DNA, 19 bp, Homo sapiens
cctgtccagctccaacctg

SEQ ID NO: 3555340 - DNA, 21 bp, Homo sapiens
cctgtcccaattctgcccgct

SEQ ID NO: 3555341 - DNA, 13 bp, Homo sapiens
cctgtcccacatg

SEQ ID NO: 3555342 - DNA, 16 bp, Homo sapiens
cctgtcccacccacac

SEQ ID NO: 3555343 - DNA, 21 bp, Homo sapiens
cctgtcccacccacacagctg

SEQ ID NO: 3555344 - DNA, 15 bp, Homo sapiens
cctgtcccttgcctc

SEQ ID NO: 3555345 - DNA, 18 bp, Homo sapiens
cctgtcccttgcctctgc

SEQ ID NO: 3555346 - DNA, 13 bp, Homo sapiens
cctgtcctgcagt

SEQ ID NO: 3555347 - DNA, 14 bp, Homo sapiens
cctgtcctgcagtc

SEQ ID NO: 3555348 - DNA, 23 bp, Homo sapiens
cctgtcctgcagtcccacactgt

SEQ ID NO: 3555349 - DNA, 14 bp, Homo sapiens
cctgtccttccctg

SEQ ID NO: 3555350 - DNA, 23 bp, Homo sapiens
cctgtccttgtcacgatcacagg

SEQ ID NO: 3555351 - DNA, 14 bp, Homo sapiens
cctgtctagagagg

SEQ ID NO: 3555352 - DNA, 21 bp, Homo sapiens
cctgtctcatcttctgaagag

SEQ ID NO: 3555353 - DNA, 13 bp, Homo sapiens
cctgtctccagct

SEQ ID NO: 3555354 - DNA, 14 bp, Homo sapiens
cctgtctccagctg

SEQ ID NO: 3555355 - DNA, 21 bp, Homo sapiens
cctgtctccagctgcctgggc

SEQ ID NO: 3555356 - DNA, 23 bp, Homo sapiens
cctgtctccagctgcctgggccc

SEQ ID NO: 3555357 - DNA, 13 bp, Homo sapiens
cctgtctccaggg

SEQ ID NO: 3555358 - DNA, 19 bp, Homo sapiens
cctgtctggaagacgtggc

SEQ ID NO: 3555359 - DNA, 18 bp, Homo sapiens
cctgtcttctttctccat

SEQ ID NO: 3555360 - DNA, 21 bp, Homo sapiens
cctgtcttctttctccatgga

SEQ ID NO: 3555361 - DNA, 20 bp, Homo sapiens
cctgtcttggggccactttc

SEQ ID NO: 3555362 - DNA, 19 bp, Homo sapiens
cctgtgaccagtctgaccc

SEQ ID NO: 3555363 - DNA, 21 bp, Homo sapiens
cctgtgagcacaaagaagaaa

SEQ ID NO: 3555364 - DNA, 20 bp, Homo sapiens
cctgtgagcatggggccagg

SEQ ID NO: 3555365 - DNA, 21 bp, Homo sapiens
cctgtgcctcctcacccccag

SEQ ID NO: 3555366 - DNA, 17 bp, Homo sapiens
cctgtgcctctgggact

SEQ ID NO: 3555367 - DNA, 15 bp, Homo sapiens
cctgtgcctgaccct

SEQ ID NO: 3555368 - DNA, 18 bp, Homo sapiens
cctgtgcgtcccagctga

SEQ ID NO: 3555369 - DNA, 24 bp, Homo sapiens
cctgtggaacataaaaaggacatc

SEQ ID NO: 3555370 - DNA, 17 bp, Homo sapiens
cctgtggccctggccac

SEQ ID NO: 3555371 - DNA, 12 bp, Homo sapiens
cctgtgggcttc

SEQ ID NO: 3555372 - DNA, 14 bp, Homo sapiens
cctgtggtcatgtg

SEQ ID NO: 3555373 - DNA, 16 bp, Homo sapiens
cctgtgtcctccacca

SEQ ID NO: 3555374 - DNA, 20 bp, Homo sapiens
cctgtgtgaccctgggcagt

SEQ ID NO: 3555375 - DNA, 14 bp, Homo sapiens
cctgtgtgattgac

SEQ ID NO: 3555376 - DNA, 21 bp, Homo sapiens
cctgtgtgtccaaaactgcct

SEQ ID NO: 3555377 - DNA, 22 bp, Homo sapiens
cctgttacttatgtagaaactg

SEQ ID NO: 3555378 - DNA, 12 bp, Homo sapiens
cctgttcccatt

SEQ ID NO: 3555379 - DNA, 13 bp, Homo sapiens
cctgttccccaga

SEQ ID NO: 3555380 - DNA, 24 bp, Homo sapiens
cctgttctccctttctctctcctc

SEQ ID NO: 3555381 - DNA, 16 bp, Homo sapiens
cctgttcttagagtgt

SEQ ID NO: 3555382 - DNA, 16 bp, Homo sapiens
cctgttggcaggccca

SEQ ID NO: 3555383 - DNA, 19 bp, Homo sapiens
cctgttgtcagatctattg

SEQ ID NO: 3555384 - DNA, 20 bp, Homo sapiens
cctgtttcccgtaaggctgt

SEQ ID NO: 3555385 - DNA, 15 bp, Homo sapiens
ccttaaaagtaataa

SEQ ID NO: 3555386 - DNA, 11 bp, Homo sapiens
ccttaaaatgc

SEQ ID NO: 3555387 - DNA, 12 bp, Homo sapiens
ccttaaaatgga

SEQ ID NO: 3555388 - DNA, 13 bp, Homo sapiens
ccttaaaatggaa

SEQ ID NO: 3555389 - DNA, 22 bp, Homo sapiens
ccttaaagagggacaggctgaa

SEQ ID NO: 3555390 - DNA, 16 bp, Homo sapiens
ccttaactgcatccag

SEQ ID NO: 3555391 - DNA, 13 bp, Homo sapiens
ccttaagcaaatt

SEQ ID NO: 3555392 - DNA, 15 bp, Homo sapiens
ccttaagcaaatttt

SEQ ID NO: 3555393 - DNA, 14 bp, Homo sapiens
ccttaatctaatct

SEQ ID NO: 3555394 - DNA, 23 bp, Homo sapiens
ccttaatctaatctaaaagctct

SEQ ID NO: 3555395 - DNA, 16 bp, Homo sapiens
ccttaatgacaacact

SEQ ID NO: 3555396 - DNA, 17 bp, Homo sapiens
ccttaatgacaacactt

SEQ ID NO: 3555397 - DNA, 18 bp, Homo sapiens
ccttaatgacaacactta

SEQ ID NO: 3555398 - DNA, 12 bp, Homo sapiens
ccttacaaaggg

SEQ ID NO: 3555399 - DNA, 18 bp, Homo sapiens
ccttaccctcctctgctg

SEQ ID NO: 3555400 - DNA, 18 bp, Homo sapiens
ccttacttcaaagtgcct

SEQ ID NO: 3555401 - DNA, 21 bp, Homo sapiens
ccttacttcaaagtgcctggg

SEQ ID NO: 3555402 - DNA, 15 bp, Homo sapiens
ccttagaacctttct

SEQ ID NO: 3555403 - DNA, 14 bp, Homo sapiens
ccttagagaagcta

SEQ ID NO: 3555404 - DNA, 22 bp, Homo sapiens
ccttagctggcattacagctgg

SEQ ID NO: 3555405 - DNA, 20 bp, Homo sapiens
ccttaggtttttttccttct

SEQ ID NO: 3555406 - DNA, 17 bp, Homo sapiens
ccttataaaccaatctt

SEQ ID NO: 3555407 - DNA, 13 bp, Homo sapiens
ccttatccctctc

SEQ ID NO: 3555408 - DNA, 14 bp, Homo sapiens
ccttatccctctct

SEQ ID NO: 3555409 - DNA, 17 bp, Homo sapiens
ccttatccctctcttcc

SEQ ID NO: 3555410 - DNA, 18 bp, Homo sapiens
ccttatctgaaaggccag

SEQ ID NO: 3555411 - DNA, 23 bp, Homo sapiens
ccttatctgaaaggccagcagct

SEQ ID NO: 3555412 - DNA, 14 bp, Homo sapiens
ccttattttcaaga

SEQ ID NO: 3555413 - DNA, 14 bp, Homo sapiens
ccttcacctcggag

SEQ ID NO: 3555414 - DNA, 12 bp, Homo sapiens
ccttcaggagcc

SEQ ID NO: 3555415 - DNA, 16 bp, Homo sapiens
ccttcaggagcctggc

SEQ ID NO: 3555416 - DNA, 18 bp, Homo sapiens
ccttcaggagcctggcca

SEQ ID NO: 3555417 - DNA, 21 bp, Homo sapiens
ccttcagggagacaggcaggg

SEQ ID NO: 3555418 - DNA, 15 bp, Homo sapiens
ccttcagtgagcccc

SEQ ID NO: 3555419 - DNA, 17 bp, Homo sapiens
ccttcagtgagcccctc

SEQ ID NO: 3555420 - DNA, 21 bp, Homo sapiens
ccttcatcagaactcttcctc

SEQ ID NO: 3555421 - DNA, 20 bp, Homo sapiens
ccttccacctgccaccccct

SEQ ID NO: 3555422 - DNA, 19 bp, Homo sapiens
ccttccatgtcgcctctgc

SEQ ID NO: 3555423 - DNA, 15 bp, Homo sapiens
ccttccatgtgcctt

SEQ ID NO: 3555424 - DNA, 19 bp, Homo sapiens
ccttccatgtgcctttctt

SEQ ID NO: 3555425 - DNA, 15 bp, Homo sapiens
cggccagccatgtct

SEQ ID NO: 3555426 - DNA, 13 bp, Homo sapiens
cggccagctctgg

SEQ ID NO: 3555427 - DNA, 16 bp, Homo sapiens
cggccagctctggagt

SEQ ID NO: 3555428 - DNA, 22 bp, Homo sapiens
cggccaggccgcgcccagcaga

SEQ ID NO: 3555429 - DNA, 14 bp, Homo sapiens
cggccccgccgcag

SEQ ID NO: 3555430 - DNA, 21 bp, Homo sapiens
cggcccggccggagggcagga

SEQ ID NO: 3555431 - DNA, 21 bp, Homo sapiens
cggccgccccgccccagagct

SEQ ID NO: 3555432 - DNA, 22 bp, Homo sapiens
cggccgccccgccccagagctc

SEQ ID NO: 3555433 - DNA, 17 bp, Homo sapiens
cggccgcccggcagtgc

SEQ ID NO: 3555434 - DNA, 13 bp, Homo sapiens
cggccgcgccacc

SEQ ID NO: 3555435 - DNA, 22 bp, Homo sapiens
cggccgcgccacccgggcaagg

SEQ ID NO: 3555436 - DNA, 15 bp, Homo sapiens
cggccggagggcagg

SEQ ID NO: 3555437 - DNA, 16 bp, Homo sapiens
cggccggagggcagga

SEQ ID NO: 3555438 - DNA, 13 bp, Homo sapiens
cggcctccatgca

SEQ ID NO: 3555439 - DNA, 22 bp, Homo sapiens
cggcctccgtccaggagcctgg

SEQ ID NO: 3555440 - DNA, 18 bp, Homo sapiens
cggcctcctcggagagca

SEQ ID NO: 3555441 - DNA, 22 bp, Homo sapiens
cggcctcctcggagagcagcag

SEQ ID NO: 3555442 - DNA, 20 bp, Homo sapiens
cggcgggatcctccacagag

SEQ ID NO: 3555443 - DNA, 20 bp, Homo sapiens
cggcgtggtgtgtccctgga

SEQ ID NO: 3555444 - DNA, 22 bp, Homo sapiens
cggcgtggtgtgtccctggaca

SEQ ID NO: 3555445 - DNA, 19 bp, Homo sapiens
cggctactggttacctgga

SEQ ID NO: 3555446 - DNA, 20 bp, Homo sapiens
cggctactggttacctggag

SEQ ID NO: 3555447 - DNA, 14 bp, Homo sapiens
cggctcctcctcac

SEQ ID NO: 3555448 - DNA, 14 bp, Homo sapiens
cggctcgtgtattt

SEQ ID NO: 3555449 - DNA, 11 bp, Homo sapiens
cggctgagtgg

SEQ ID NO: 3555450 - DNA, 13 bp, Homo sapiens
cggctgccagggg

SEQ ID NO: 3555451 - DNA, 18 bp, Homo sapiens
cggctgccaggggctctg

SEQ ID NO: 3555452 - DNA, 22 bp, Homo sapiens
cggctgccaggggctctgtggc

SEQ ID NO: 3555453 - DNA, 15 bp, Homo sapiens
cggctggagaaagat

SEQ ID NO: 3555454 - DNA, 19 bp, Homo sapiens
cggctggagaaagatgcag

SEQ ID NO: 3555455 - DNA, 21 bp, Homo sapiens
cggcttgttgacttcgcagcc

SEQ ID NO: 3555456 - DNA, 17 bp, Homo sapiens
cggctttaagtgtgctg

SEQ ID NO: 3555457 - DNA, 20 bp, Homo sapiens
cgggaaaggatggagtgttt

SEQ ID NO: 3555458 - DNA, 13 bp, Homo sapiens
cgggagcacccag

SEQ ID NO: 3555459 - DNA, 14 bp, Homo sapiens
cgggagcacccaga

SEQ ID NO: 3555460 - DNA, 18 bp, Homo sapiens
cgggagccctagccctgc

SEQ ID NO: 3555461 - DNA, 16 bp, Homo sapiens
cgggagcgagtaaagt

SEQ ID NO: 3555462 - DNA, 22 bp, Homo sapiens
cgggatgggagccgggcaaact

SEQ ID NO: 3555463 - DNA, 15 bp, Homo sapiens
cgggcacacctcctc

SEQ ID NO: 3555464 - DNA, 14 bp, Homo sapiens
cgggcaccaggggc

SEQ ID NO: 3555465 - DNA, 10 bp, Homo sapiens
cgggcagaaa

SEQ ID NO: 3555466 - DNA, 12 bp, Homo sapiens
cgggcagccagc

SEQ ID NO: 3555467 - DNA, 13 bp, Homo sapiens
cgggcagccagca

SEQ ID NO: 3555468 - DNA, 15 bp, Homo sapiens
cgggcagccagcaga

SEQ ID NO: 3555469 - DNA, 21 bp, Homo sapiens
cgggcggaggggatccagcca

SEQ ID NO: 3555470 - DNA, 22 bp, Homo sapiens
cgggcggaggggatccagccac

SEQ ID NO: 3555471 - DNA, 12 bp, Homo sapiens
cgggcgggcgtg

SEQ ID NO: 3555472 - DNA, 21 bp, Homo sapiens
cgggctttcccccaggcgcct

SEQ ID NO: 3555473 - DNA, 17 bp, Homo sapiens
cggggccagcttggcag

SEQ ID NO: 3555474 - DNA, 15 bp, Homo sapiens
cggggcttggggctc

SEQ ID NO: 3555475 - DNA, 16 bp, Homo sapiens
cgggggagcccagtga

SEQ ID NO: 3555476 - DNA, 23 bp, Homo sapiens
cgggggcaggggaggccatctgg

SEQ ID NO: 3555477 - DNA, 18 bp, Homo sapiens
cggggtgtgtcatttcta

SEQ ID NO: 3555478 - DNA, 16 bp, Homo sapiens
cgggtgaatctgtcta

SEQ ID NO: 3555479 - DNA, 12 bp, Homo sapiens
cgggtgtggaga

SEQ ID NO: 3555480 - DNA, 22 bp, Homo sapiens
cgggtgtggagaccaggctcct

SEQ ID NO: 3555481 - DNA, 20 bp, Homo sapiens
cgggttcaagtgactctcct

SEQ ID NO: 3555482 - DNA, 13 bp, Homo sapiens
cggtcccagctcc

SEQ ID NO: 3555483 - DNA, 14 bp, Homo sapiens
cggtccctgtccct

SEQ ID NO: 3555484 - DNA, 19 bp, Homo sapiens
cggtcgggcagccagcaga

SEQ ID NO: 3555485 - DNA, 18 bp, Homo sapiens
cggtgctaaaaatgaaaa

SEQ ID NO: 3555486 - DNA, 19 bp, Homo sapiens
cggtgctaaaaatgaaaat

SEQ ID NO: 3555487 - DNA, 20 bp, Homo sapiens
cggtggcggctgcacaacag

SEQ ID NO: 3555488 - DNA, 20 bp, Homo sapiens
cggtggctagtcaagctcct

SEQ ID NO: 3555489 - DNA, 14 bp, Homo sapiens
cggtggctgccccg

SEQ ID NO: 3555490 - DNA, 16 bp, Homo sapiens
cggtggctgccccggc

SEQ ID NO: 3555491 - DNA, 11 bp, Homo sapiens
cggtgggcagt

SEQ ID NO: 3555492 - DNA, 12 bp, Homo sapiens
cggtgggcagtg

SEQ ID NO: 3555493 - DNA, 14 bp, Homo sapiens
cggtgtccccacca

SEQ ID NO: 3555494 - DNA, 21 bp, Homo sapiens
cggtgttaattttgctaactg

SEQ ID NO: 3555495 - DNA, 11 bp, Homo sapiens
cggttcctggt

SEQ ID NO: 3555496 - DNA, 13 bp, Homo sapiens
cggttcctggtga

SEQ ID NO: 3555497 - DNA, 17 bp, Homo sapiens
cggttctaaggctcaga

SEQ ID NO: 3555498 - DNA, 18 bp, Homo sapiens
cgtaatgcattgcctgta

SEQ ID NO: 3555499 - DNA, 16 bp, Homo sapiens
cgtacaaccccctcca

SEQ ID NO: 3555500 - DNA, 17 bp, Homo sapiens
cgtactacccagctctg

SEQ ID NO: 3555501 - DNA, 11 bp, Homo sapiens
cgtagcctggg

SEQ ID NO: 3555502 - DNA, 20 bp, Homo sapiens
cgtagctatttttatacact

SEQ ID NO: 3555503 - DNA, 15 bp, Homo sapiens
cgtagctctgctgct

SEQ ID NO: 3555504 - DNA, 18 bp, Homo sapiens
cgtagctctgctgctgat

SEQ ID NO: 3555505 - DNA, 18 bp, Homo sapiens
cgtatgaagacagaggca

SEQ ID NO: 3555506 - DNA, 15 bp, Homo sapiens
cgtcacactcttcag

SEQ ID NO: 3555507 - DNA, 11 bp, Homo sapiens
cgtccagggag

SEQ ID NO: 3555508 - DNA, 18 bp, Homo sapiens
cgtccatccgactgcccc

SEQ ID NO: 3555509 - DNA, 16 bp, Homo sapiens
cgtcgccctcccaggc

SEQ ID NO: 3555510 - DNA, 22 bp, Homo sapiens
cgtcggactgcccccagaaagc

SEQ ID NO: 3555511 - DNA, 13 bp, Homo sapiens
cgtctactgcaag

SEQ ID NO: 3555512 - DNA, 17 bp, Homo sapiens
cgtctctgccctgggct

SEQ ID NO: 3555513 - DNA, 20 bp, Homo sapiens
cgtctggactgttctgtaga

SEQ ID NO: 3555514 - DNA, 22 bp, Homo sapiens
cgtgaactctggtgctcctgca

SEQ ID NO: 3555515 - DNA, 16 bp, Homo sapiens
cgtgaagaaataaatg

SEQ ID NO: 3555516 - DNA, 13 bp, Homo sapiens
cgtgacaggctcg

SEQ ID NO: 3555517 - DNA, 22 bp, Homo sapiens
cgtgacaggctcgtcagccacc

SEQ ID NO: 3555518 - DNA, 17 bp, Homo sapiens
cgtgagagaaagagaga

SEQ ID NO: 3555519 - DNA, 18 bp, Homo sapiens
cgtgagagaaagagagaa

SEQ ID NO: 3555520 - DNA, 15 bp, Homo sapiens
cgtgagctggggact

SEQ ID NO: 3555521 - DNA, 22 bp, Homo sapiens
cgtgaggggcaagctaggcccc

SEQ ID NO: 3555522 - DNA, 14 bp, Homo sapiens
cgtgatcaaagcca

SEQ ID NO: 3555523 - DNA, 22 bp, Homo sapiens
cgtgatcaaagccacactctgg

SEQ ID NO: 3555524 - DNA, 15 bp, Homo sapiens
cgtgatctcccctca

SEQ ID NO: 3555525 - DNA, 19 bp, Homo sapiens
cgtgatgggctaggcctcc

SEQ ID NO: 3555526 - DNA, 19 bp, Homo sapiens
cgtgccaccccgagggctg

SEQ ID NO: 3555527 - DNA, 22 bp, Homo sapiens
cgtgctccgtagctctgctgct

SEQ ID NO: 3555528 - DNA, 15 bp, Homo sapiens
cgtgctgacagctgc

SEQ ID NO: 3555529 - DNA, 19 bp, Homo sapiens
cgtggactgtgctggtgca

SEQ ID NO: 3555530 - DNA, 14 bp, Homo sapiens
cgtggcacagctgg

SEQ ID NO: 3555531 - DNA, 15 bp, Homo sapiens
cgtggcacagctggg

SEQ ID NO: 3555532 - DNA, 18 bp, Homo sapiens
cgtggcagcttgctgggc

SEQ ID NO: 3555533 - DNA, 19 bp, Homo sapiens
cgtggcagcttgctgggct

SEQ ID NO: 3555534 - DNA, 19 bp, Homo sapiens
cgtggccccgccctcaggc

SEQ ID NO: 3555535 - DNA, 19 bp, Homo sapiens
cgtggcctcgtgaggggca

SEQ ID NO: 3555536 - DNA, 17 bp, Homo sapiens
cgtggctctgggtgagg

SEQ ID NO: 3555537 - DNA, 20 bp, Homo sapiens
cgtggcttcccgctcagccc

SEQ ID NO: 3555538 - DNA, 22 bp, Homo sapiens
cgtggcttggggattgtacacg

SEQ ID NO: 3555539 - DNA, 15 bp, Homo sapiens
cgtgggaaaggggag

SEQ ID NO: 3555540 - DNA, 22 bp, Homo sapiens
cgtgggaacccccctcccaccc

SEQ ID NO: 3555541 - DNA, 20 bp, Homo sapiens
cgtggggaacggaggaggac

SEQ ID NO: 3555542 - DNA, 21 bp, Homo sapiens
cgtggtgtgtccctggacaca

SEQ ID NO: 3555543 - DNA, 19 bp, Homo sapiens
cgtgtaaaggaaaataatg

SEQ ID NO: 3555544 - DNA, 16 bp, Homo sapiens
cgtgtatagtatctgt

SEQ ID NO: 3555545 - DNA, 17 bp, Homo sapiens
cgtgtatagtatctgta

SEQ ID NO: 3555546 - DNA, 18 bp, Homo sapiens
cgtgtatagtatctgtat

SEQ ID NO: 3555547 - DNA, 18 bp, Homo sapiens
cgtgtcccctgacagggc

SEQ ID NO: 3555548 - DNA, 18 bp, Homo sapiens
cgtgtgaagccacggaag

SEQ ID NO: 3555549 - DNA, 21 bp, Homo sapiens
cgttaaaaacagatttggaaa

SEQ ID NO: 3555550 - DNA, 21 bp, Homo sapiens
cgttaagaatttggggcagga

SEQ ID NO: 3555551 - DNA, 17 bp, Homo sapiens
cgttaggccaggcctta

SEQ ID NO: 3555552 - DNA, 16 bp, Homo sapiens
cgttccatctgggctt

SEQ ID NO: 3555553 - DNA, 13 bp, Homo sapiens
cgttgggagccta

SEQ ID NO: 3555554 - DNA, 17 bp, Homo sapiens
cgttgggagcctagctc

SEQ ID NO: 3555555 - DNA, 15 bp, Homo sapiens
cgtttcctactgcgc

SEQ ID NO: 3555556 - DNA, 16 bp, Homo sapiens
cgtttctccttttcct

SEQ ID NO: 3555557 - DNA, 17 bp, Homo sapiens
cgtttctccttttccta

SEQ ID NO: 3555558 - DNA, 13 bp, Homo sapiens
ctccatggagcct

SEQ ID NO: 3555559 - DNA, 15 bp, Homo sapiens
ctccatggagcctac

SEQ ID NO: 3555560 - DNA, 18 bp, Homo sapiens
ctccatggagcctacctc

SEQ ID NO: 3555561 - DNA, 17 bp, Homo sapiens
ctccattggtgttgaca

SEQ ID NO: 3555562 - DNA, 15 bp, Homo sapiens
ctccatttctttctt

SEQ ID NO: 3555563 - DNA, 17 bp, Homo sapiens
ctccatttctttcttcc

SEQ ID NO: 3555564 - DNA, 18 bp, Homo sapiens
ctccatttctttcttcca

SEQ ID NO: 3555565 - DNA, 22 bp, Homo sapiens
ctcccaaagtgctgggattata

SEQ ID NO: 3555566 - DNA, 17 bp, Homo sapiens
ctcccaacttcttcctg

SEQ ID NO: 3555567 - DNA, 20 bp, Homo sapiens
ctcccaacttcttcctgtga

SEQ ID NO: 3555568 - DNA, 14 bp, Homo sapiens
ctcccaagaaacct

SEQ ID NO: 3555569 - DNA, 22 bp, Homo sapiens
ctcccaaggcattctcccagct

SEQ ID NO: 3555570 - DNA, 13 bp, Homo sapiens
ctcccacacccct

SEQ ID NO: 3555571 - DNA, 13 bp, Homo sapiens
ctcccaccagagc

SEQ ID NO: 3555572 - DNA, 18 bp, Homo sapiens
ctcccaccagagccggga

SEQ ID NO: 3555573 - DNA, 22 bp, Homo sapiens
ctcccaccccactcaggggacc

SEQ ID NO: 3555574 - DNA, 15 bp, Homo sapiens
ctcccactgcccact

SEQ ID NO: 3555575 - DNA, 13 bp, Homo sapiens
ctcccagacaggc

SEQ ID NO: 3555576 - DNA, 22 bp, Homo sapiens
ctcccagagtgctgggattaca

SEQ ID NO: 3555577 - DNA, 17 bp, Homo sapiens
ctcccagcaagacctca

SEQ ID NO: 3555578 - DNA, 23 bp, Homo sapiens
ctcccagcaagacctcatctgtg

SEQ ID NO: 3555579 - DNA, 22 bp, Homo sapiens
ctcccaggatgacgtgctccgt

SEQ ID NO: 3555580 - DNA, 14 bp, Homo sapiens
ctcccaggcgcccc

SEQ ID NO: 3555581 - DNA, 17 bp, Homo sapiens
ctcccaggcgccccttc

SEQ ID NO: 3555582 - DNA, 19 bp, Homo sapiens
ctcccaggcgccccttccc

SEQ ID NO: 3555583 - DNA, 19 bp, Homo sapiens
ctcccaggttcccccagca

SEQ ID NO: 3555584 - DNA, 16 bp, Homo sapiens
ctcccatcctggggca

SEQ ID NO: 3555585 - DNA, 21 bp, Homo sapiens
ctcccatcctggggcagcact

SEQ ID NO: 3555586 - DNA, 15 bp, Homo sapiens
ctcccattcctgaag

SEQ ID NO: 3555587 - DNA, 19 bp, Homo sapiens
ctcccattcctgaagaacc

SEQ ID NO: 3555588 - DNA, 22 bp, Homo sapiens
ctcccattgtccctctgcccca

SEQ ID NO: 3555589 - DNA, 22 bp, Homo sapiens
ctccccaacccctctccaggcc

SEQ ID NO: 3555590 - DNA, 19 bp, Homo sapiens
ctccccaattatatctccc

SEQ ID NO: 3555591 - DNA, 13 bp, Homo sapiens
ctccccacccgct

SEQ ID NO: 3555592 - DNA, 23 bp, Homo sapiens
ctccccagagctgtgccagcagg

SEQ ID NO: 3555593 - DNA, 21 bp, Homo sapiens
ctccccagccagcccttccct

SEQ ID NO: 3555594 - DNA, 17 bp, Homo sapiens
ctccccagcccagagac

SEQ ID NO: 3555595 - DNA, 15 bp, Homo sapiens
ctccccagcccagca

SEQ ID NO: 3555596 - DNA, 17 bp, Homo sapiens
ctccccagcccagcacc

SEQ ID NO: 3555597 - DNA, 15 bp, Homo sapiens
ctccccatatataaa

SEQ ID NO: 3555598 - DNA, 17 bp, Homo sapiens
ctccccatatataaatt

SEQ ID NO: 3555599 - DNA, 20 bp, Homo sapiens
ctccccatatataaattatt

SEQ ID NO: 3555600 - DNA, 19 bp, Homo sapiens
ctcccccaaggccactgcg

SEQ ID NO: 3555601 - DNA, 16 bp, Homo sapiens
ctcccccactccacta

SEQ ID NO: 3555602 - DNA, 17 bp, Homo sapiens
ctcccccactccactac

SEQ ID NO: 3555603 - DNA, 16 bp, Homo sapiens
ctcccccagccactcc

SEQ ID NO: 3555604 - DNA, 15 bp, Homo sapiens
ctcccccccatgcac

SEQ ID NO: 3555605 - DNA, 17 bp, Homo sapiens
ctcccccgtttctcctt

SEQ ID NO: 3555606 - DNA, 16 bp, Homo sapiens
ctccccctccttgtgc

SEQ ID NO: 3555607 - DNA, 20 bp, Homo sapiens
ctccccctttcacactggat

SEQ ID NO: 3555608 - DNA, 22 bp, Homo sapiens
ctccccctttcacactggatcc

SEQ ID NO: 3555609 - DNA, 17 bp, Homo sapiens
ctccccgcccctgtggc

SEQ ID NO: 3555610 - DNA, 14 bp, Homo sapiens
ctccccgctcaggg

SEQ ID NO: 3555611 - DNA, 16 bp, Homo sapiens
ctccccgctcaggggc

SEQ ID NO: 3555612 - DNA, 21 bp, Homo sapiens
ctccccgctcaggggcctgga

SEQ ID NO: 3555613 - DNA, 22 bp, Homo sapiens
ctccccgctcaggggcctggag

SEQ ID NO: 3555614 - DNA, 22 bp, Homo sapiens
ctcccctaaagccaggctcagg

SEQ ID NO: 3555615 - DNA, 13 bp, Homo sapiens
ctcccctatgctg

SEQ ID NO: 3555616 - DNA, 13 bp, Homo sapiens
ctcccctcacaca

SEQ ID NO: 3555617 - DNA, 13 bp, Homo sapiens
ctcccctcccctg

SEQ ID NO: 3555618 - DNA, 15 bp, Homo sapiens
ctcccctcccctggg

SEQ ID NO: 3555619 - DNA, 13 bp, Homo sapiens
ctcccctcctgca

SEQ ID NO: 3555620 - DNA, 16 bp, Homo sapiens
ctcccctctccttcct

SEQ ID NO: 3555621 - DNA, 20 bp, Homo sapiens
ctccccttttttcttctatt

SEQ ID NO: 3555622 - DNA, 14 bp, Homo sapiens
ctcccgaaaaatgt

SEQ ID NO: 3555623 - DNA, 17 bp, Homo sapiens
ctcccgaaaaatgtgtg

SEQ ID NO: 3555624 - DNA, 18 bp, Homo sapiens
ctcccgaaaaatgtgtgg

SEQ ID NO: 3555625 - DNA, 14 bp, Homo sapiens
ctcccgccccgccc

SEQ ID NO: 3555626 - DNA, 18 bp, Homo sapiens
ctcccgccccgcccctcc

SEQ ID NO: 3555627 - DNA, 20 bp, Homo sapiens
ctcccggctatgggggcact

SEQ ID NO: 3555628 - DNA, 21 bp, Homo sapiens
ctcccgggggccccacctcgg

SEQ ID NO: 3555629 - DNA, 21 bp, Homo sapiens
ctcccggtgcccaagaataga

SEQ ID NO: 3555630 - DNA, 13 bp, Homo sapiens
ctccctaccctaa

SEQ ID NO: 3555631 - DNA, 19 bp, Homo sapiens
ctccctcttcctctccata

SEQ ID NO: 3555632 - DNA, 18 bp, Homo sapiens
ctccctgaagcctttgca

SEQ ID NO: 3555633 - DNA, 14 bp, Homo sapiens
ctccctgcccctcc

SEQ ID NO: 3555634 - DNA, 17 bp, Homo sapiens
ctccctgcccctccctt

SEQ ID NO: 3555635 - DNA, 18 bp, Homo sapiens
ctccctgcccctcccttc

SEQ ID NO: 3555636 - DNA, 21 bp, Homo sapiens
ctccctgcccctcccttcaac

SEQ ID NO: 3555637 - DNA, 16 bp, Homo sapiens
ctccctgcctgctcct

SEQ ID NO: 3555638 - DNA, 19 bp, Homo sapiens
ctccctgcctgctccttgg

SEQ ID NO: 3555639 - DNA, 16 bp, Homo sapiens
ctccctgcctgtttcc

SEQ ID NO: 3555640 - DNA, 23 bp, Homo sapiens
ctccctgctgtgccatgctgggc

SEQ ID NO: 3555641 - DNA, 19 bp, Homo sapiens
ctccctggctcactggcag

SEQ ID NO: 3555642 - DNA, 21 bp, Homo sapiens
ctccctgtctccagctgcctg

SEQ ID NO: 3555643 - DNA, 23 bp, Homo sapiens
ctccctgtctccagctgcctggg

SEQ ID NO: 3555644 - DNA, 19 bp, Homo sapiens
ctccctgtctccagggccc

SEQ ID NO: 3555645 - DNA, 16 bp, Homo sapiens
ctccctgttccccaga

SEQ ID NO: 3555646 - DNA, 19 bp, Homo sapiens
ctccctgttccccagagaa

SEQ ID NO: 3555647 - DNA, 21 bp, Homo sapiens
ctcccttaccctcctctgctg

SEQ ID NO: 3555648 - DNA, 21 bp, Homo sapiens
ctcccttcaaccattccccat

SEQ ID NO: 3555649 - DNA, 20 bp, Homo sapiens
ctcccttcaagacgaggggc

SEQ ID NO: 3555650 - DNA, 22 bp, Homo sapiens
ctcccttcaagacgaggggcag

SEQ ID NO: 3555651 - DNA, 16 bp, Homo sapiens
ctcccttctgctactg

SEQ ID NO: 3555652 - DNA, 20 bp, Homo sapiens
ctccctttctctctcctctc

SEQ ID NO: 3555653 - DNA, 18 bp, Homo sapiens
ctccgactctgcacccgc

SEQ ID NO: 3555654 - DNA, 19 bp, Homo sapiens
ctccgactctgcacccgcc

SEQ ID NO: 3555655 - DNA, 15 bp, Homo sapiens
ctccgagctctggtg

SEQ ID NO: 3555656 - DNA, 18 bp, Homo sapiens
ctccgagctctggtgctt

SEQ ID NO: 3555657 - DNA, 13 bp, Homo sapiens
ctccgcccctgcc

SEQ ID NO: 3555658 - DNA, 18 bp, Homo sapiens
ctccggagcgccctgcag

SEQ ID NO: 3555659 - DNA, 22 bp, Homo sapiens
ctccggagcgccctgcagggcc

SEQ ID NO: 3555660 - DNA, 21 bp, Homo sapiens
ctccggcgggtgacagctccg

SEQ ID NO: 3555661 - DNA, 21 bp, Homo sapiens
ctccgtagctctgctgctgat

SEQ ID NO: 3555662 - DNA, 22 bp, Homo sapiens
ctccgtagggtctttcttggga

SEQ ID NO: 3555663 - DNA, 20 bp, Homo sapiens
ctccgtccaggagcctgtgc

SEQ ID NO: 3555664 - DNA, 21 bp, Homo sapiens
ctccgtgtttctctaaggaat

SEQ ID NO: 3555665 - DNA, 19 bp, Homo sapiens
ctccgttccatctgggctt

SEQ ID NO: 3555666 - DNA, 13 bp, Homo sapiens
ctcctaaaactgg

SEQ ID NO: 3555667 - DNA, 19 bp, Homo sapiens
ctcctaccctcccaccaga

SEQ ID NO: 3555668 - DNA, 13 bp, Homo sapiens
ctcctacctcagc

SEQ ID NO: 3555669 - DNA, 15 bp, Homo sapiens
ctcctagagggaggg

SEQ ID NO: 3555670 - DNA, 23 bp, Homo sapiens
ctcctagagggaggggcctaggc

SEQ ID NO: 3555671 - DNA, 22 bp, Homo sapiens
ctcctagcctgtgcctctggga

SEQ ID NO: 3555672 - DNA, 16 bp, Homo sapiens
ctcctataaagtgcct

SEQ ID NO: 3555673 - DNA, 17 bp, Homo sapiens
ctcctataaagtgcctc

SEQ ID NO: 3555674 - DNA, 17 bp, Homo sapiens
ctcctcacccacctctg

SEQ ID NO: 3555675 - DNA, 15 bp, Homo sapiens
ctcctcacccccagc

SEQ ID NO: 3555676 - DNA, 17 bp, Homo sapiens
ctcctcacccccagctt

SEQ ID NO: 3555677 - DNA, 20 bp, Homo sapiens
ctcctcacccccagctttgc

SEQ ID NO: 3555678 - DNA, 21 bp, Homo sapiens
ctcctcacccccagctttgct

SEQ ID NO: 3555679 - DNA, 13 bp, Homo sapiens
ctcctcactctgt

SEQ ID NO: 3555680 - DNA, 14 bp, Homo sapiens
ctcctcactctgtc

SEQ ID NO: 3555681 - DNA, 15 bp, Homo sapiens
ctcctcactctgtcc

SEQ ID NO: 3555682 - DNA, 19 bp, Homo sapiens
ctcctcactgtatccaggt

SEQ ID NO: 3555683 - DNA, 11 bp, Homo sapiens
ctcctcagcac

SEQ ID NO: 3555684 - DNA, 15 bp, Homo sapiens
ctcctcagcacccct

SEQ ID NO: 3555685 - DNA, 13 bp, Homo sapiens
ctcctcagctccc

SEQ ID NO: 3555686 - DNA, 14 bp, Homo sapiens
ctcctcagctccct

SEQ ID NO: 3555687 - DNA, 14 bp, Homo sapiens
ctcctccacctcaa

SEQ ID NO: 3555688 - DNA, 15 bp, Homo sapiens
ctcctccacctcaac

SEQ ID NO: 3555689 - DNA, 13 bp, Homo sapiens
ctcctcccactgc

SEQ ID NO: 3555690 - DNA, 13 bp, Homo sapiens
ctgagaaagacta

SEQ ID NO: 3555691 - DNA, 22 bp, Homo sapiens
ctgagaaagactattcaaacag

SEQ ID NO: 3555692 - DNA, 17 bp, Homo sapiens
ctgagaaagaggcaggg

SEQ ID NO: 3555693 - DNA, 22 bp, Homo sapiens
ctgagacaggtgcctaacctgg

SEQ ID NO: 3555694 - DNA, 23 bp, Homo sapiens
ctgagaccttgctttgagactcc

SEQ ID NO: 3555695 - DNA, 23 bp, Homo sapiens
ctgagacgccacggagggctggg

SEQ ID NO: 3555696 - DNA, 16 bp, Homo sapiens
ctgagagaccctggcc

SEQ ID NO: 3555697 - DNA, 19 bp, Homo sapiens
ctgagagaccctggcctca

SEQ ID NO: 3555698 - DNA, 20 bp, Homo sapiens
ctgagagaccctggcctcaa

SEQ ID NO: 3555699 - DNA, 23 bp, Homo sapiens
ctgagagctgtttttgacagcct

SEQ ID NO: 3555700 - DNA, 21 bp, Homo sapiens
ctgagcaaatgtggctcctgg

SEQ ID NO: 3555701 - DNA, 22 bp, Homo sapiens
ctgagcagcatccaccccaccc

SEQ ID NO: 3555702 - DNA, 11 bp, Homo sapiens
ctgagcagccg

SEQ ID NO: 3555703 - DNA, 22 bp, Homo sapiens
ctgagcagccgccagctgggag

SEQ ID NO: 3555704 - DNA, 16 bp, Homo sapiens
ctgagcaggattttaa

SEQ ID NO: 3555705 - DNA, 14 bp, Homo sapiens
ctgagcagggatct

SEQ ID NO: 3555706 - DNA, 16 bp, Homo sapiens
ctgagcagggtccaca

SEQ ID NO: 3555707 - DNA, 18 bp, Homo sapiens
ctgagcagggtccacagc

SEQ ID NO: 3555708 - DNA, 21 bp, Homo sapiens
ctgagcagggtccacagctgg

SEQ ID NO: 3555709 - DNA, 20 bp, Homo sapiens
ctgagcatactcaacaaaac

SEQ ID NO: 3555710 - DNA, 17 bp, Homo sapiens
ctgagcatggagacagc

SEQ ID NO: 3555711 - DNA, 20 bp, Homo sapiens
ctgagcatggagacagcagt

SEQ ID NO: 3555712 - DNA, 17 bp, Homo sapiens
ctgagcccatttctggg

SEQ ID NO: 3555713 - DNA, 13 bp, Homo sapiens
ctgagcccctggg

SEQ ID NO: 3555714 - DNA, 12 bp, Homo sapiens
ctgagcccctgt

SEQ ID NO: 3555715 - DNA, 15 bp, Homo sapiens
ctgagcccctgtcta

SEQ ID NO: 3555716 - DNA, 18 bp, Homo sapiens
ctgagccctcctgagggc

SEQ ID NO: 3555717 - DNA, 22 bp, Homo sapiens
ctgagcggcaccctggtctgtg

SEQ ID NO: 3555718 - DNA, 17 bp, Homo sapiens
ctgagctggaaggggcc

SEQ ID NO: 3555719 - DNA, 18 bp, Homo sapiens
ctgagctggcctgtctgc

SEQ ID NO: 3555720 - DNA, 17 bp, Homo sapiens
ctgagctgggggaagaa

SEQ ID NO: 3555721 - DNA, 16 bp, Homo sapiens
ctgagctggggggatg

SEQ ID NO: 3555722 - DNA, 23 bp, Homo sapiens
ctgaggaagagggactgttcttt

SEQ ID NO: 3555723 - DNA, 17 bp, Homo sapiens
ctgaggacacagatccc

SEQ ID NO: 3555724 - DNA, 17 bp, Homo sapiens
ctgaggagatgaccagg

SEQ ID NO: 3555725 - DNA, 21 bp, Homo sapiens
ctgaggagcagcaggaggggg

SEQ ID NO: 3555726 - DNA, 22 bp, Homo sapiens
ctgaggatattcagatgtatgt

SEQ ID NO: 3555727 - DNA, 13 bp, Homo sapiens
ctgaggatttctt

SEQ ID NO: 3555728 - DNA, 14 bp, Homo sapiens
ctgaggcaggagaa

SEQ ID NO: 3555729 - DNA, 14 bp, Homo sapiens
ctgaggccagaaag

SEQ ID NO: 3555730 - DNA, 15 bp, Homo sapiens
ctgaggcccagagag

SEQ ID NO: 3555731 - DNA, 20 bp, Homo sapiens
ctgaggcccagagagggaag

SEQ ID NO: 3555732 - DNA, 14 bp, Homo sapiens
ctgaggcccctagg

SEQ ID NO: 3555733 - DNA, 23 bp, Homo sapiens
ctgaggcccctaggtgcccaggg

SEQ ID NO: 3555734 - DNA, 22 bp, Homo sapiens
ctgaggcctcattttgggggtc

SEQ ID NO: 3555735 - DNA, 17 bp, Homo sapiens
ctgaggcctgccccctg

SEQ ID NO: 3555736 - DNA, 18 bp, Homo sapiens
ctgaggcctgccccctgg

SEQ ID NO: 3555737 - DNA, 20 bp, Homo sapiens
ctgaggcctgccccctgggc

SEQ ID NO: 3555738 - DNA, 21 bp, Homo sapiens
ctgaggcctgccccctgggct

SEQ ID NO: 3555739 - DNA, 12 bp, Homo sapiens
ctgaggctgagg

SEQ ID NO: 3555740 - DNA, 18 bp, Homo sapiens
ctgagggattgaggggcc

SEQ ID NO: 3555741 - DNA, 21 bp, Homo sapiens
ctgagggctaattctgggaag

SEQ ID NO: 3555742 - DNA, 21 bp, Homo sapiens
ctgagggggtgggggtgccgc

SEQ ID NO: 3555743 - DNA, 23 bp, Homo sapiens
ctgagggtcgtgggaaaggggag

SEQ ID NO: 3555744 - DNA, 12 bp, Homo sapiens
ctgagtcaaatc

SEQ ID NO: 3555745 - DNA, 13 bp, Homo sapiens
ctgagtcaaatcc

SEQ ID NO: 3555746 - DNA, 19 bp, Homo sapiens
ctgagtcaaatccagtggt

SEQ ID NO: 3555747 - DNA, 23 bp, Homo sapiens
ctgagtcaccctacctgtgcctg

SEQ ID NO: 3555748 - DNA, 18 bp, Homo sapiens
ctgagtcatggccgggtg

SEQ ID NO: 3555749 - DNA, 13 bp, Homo sapiens
ctgagtgccccac

SEQ ID NO: 3555750 - DNA, 13 bp, Homo sapiens
ctgagtggcagca

SEQ ID NO: 3555751 - DNA, 22 bp, Homo sapiens
ctgagtgtcatgaagtgcacag

SEQ ID NO: 3555752 - DNA, 13 bp, Homo sapiens
ctgagttggcctg

SEQ ID NO: 3555753 - DNA, 14 bp, Homo sapiens
ctgagttggcctgg

SEQ ID NO: 3555754 - DNA, 18 bp, Homo sapiens
ctgagttggcctggccat

SEQ ID NO: 3555755 - DNA, 16 bp, Homo sapiens
ctgatactgggtctgc

SEQ ID NO: 3555756 - DNA, 15 bp, Homo sapiens
ctgatagacaccata

SEQ ID NO: 3555757 - DNA, 23 bp, Homo sapiens
ctgatcccaccccctcctccccc

SEQ ID NO: 3555758 - DNA, 18 bp, Homo sapiens
ctgatcctggaggcccag

SEQ ID NO: 3555759 - DNA, 14 bp, Homo sapiens
ctgatgaatctcaa

SEQ ID NO: 3555760 - DNA, 20 bp, Homo sapiens
ctgatgagagaatgtggaaa

SEQ ID NO: 3555761 - DNA, 14 bp, Homo sapiens
ctgatgattttcct

SEQ ID NO: 3555762 - DNA, 19 bp, Homo sapiens
ctgatgattttcctttttc

SEQ ID NO: 3555763 - DNA, 20 bp, Homo sapiens
ctgatgcaaggattacagaa

SEQ ID NO: 3555764 - DNA, 16 bp, Homo sapiens
ctgatgtagcttgaga

SEQ ID NO: 3555765 - DNA, 15 bp, Homo sapiens
ctgatgtataatgta

SEQ ID NO: 3555766 - DNA, 20 bp, Homo sapiens
ctgatgttcctagtgaaaga

SEQ ID NO: 3555767 - DNA, 17 bp, Homo sapiens
ctgattagttgacagta

SEQ ID NO: 3555768 - DNA, 20 bp, Homo sapiens
ctgattagttgacagtatta

SEQ ID NO: 3555769 - DNA, 12 bp, Homo sapiens
ctgattcatatt

SEQ ID NO: 3555770 - DNA, 23 bp, Homo sapiens
ctgattcatatttaatttgaaga

SEQ ID NO: 3555771 - DNA, 14 bp, Homo sapiens
ctgattctgattgc

SEQ ID NO: 3555772 - DNA, 17 bp, Homo sapiens
ctgattgctatcagcaa

SEQ ID NO: 3555773 - DNA, 18 bp, Homo sapiens
ctgattgctatcagcaat

SEQ ID NO: 3555774 - DNA, 16 bp, Homo sapiens
ctgatttaggagaagc

SEQ ID NO: 3555775 - DNA, 20 bp, Homo sapiens
ctgatttaggagaagccagg

SEQ ID NO: 3555776 - DNA, 21 bp, Homo sapiens
ctgatttaggagaagccagga

SEQ ID NO: 3555777 - DNA, 22 bp, Homo sapiens
ctgatttaggagaagccaggaa

SEQ ID NO: 3555778 - DNA, 21 bp, Homo sapiens
ctgattttcaaagctttttcc

SEQ ID NO: 3555779 - DNA, 14 bp, Homo sapiens
ctgattttctcact

SEQ ID NO: 3555780 - DNA, 21 bp, Homo sapiens
ctgcaaaaaaagcctccaagg

SEQ ID NO: 3555781 - DNA, 15 bp, Homo sapiens
ctgcaaaactccagg

SEQ ID NO: 3555782 - DNA, 13 bp, Homo sapiens
ctgcaaaatctgt

SEQ ID NO: 3555783 - DNA, 22 bp, Homo sapiens
ctgcaaagatctgtcctcagcc

SEQ ID NO: 3555784 - DNA, 13 bp, Homo sapiens
ctgcaacccaagt

SEQ ID NO: 3555785 - DNA, 14 bp, Homo sapiens
ctgcaacttctgcc

SEQ ID NO: 3555786 - DNA, 17 bp, Homo sapiens
ctgcaagcacagccctt

SEQ ID NO: 3555787 - DNA, 16 bp, Homo sapiens
ctgcaaggtactctgg

SEQ ID NO: 3555788 - DNA, 19 bp, Homo sapiens
ctgcaaggtactctggtga

SEQ ID NO: 3555789 - DNA, 20 bp, Homo sapiens
ctgcaaggtttaggctggtg

SEQ ID NO: 3555790 - DNA, 18 bp, Homo sapiens
ctgcaagttatgaaatat

SEQ ID NO: 3555791 - DNA, 13 bp, Homo sapiens
ctgcacaaagccc

SEQ ID NO: 3555792 - DNA, 20 bp, Homo sapiens
ctgcacaaagcccttccatg

SEQ ID NO: 3555793 - DNA, 21 bp, Homo sapiens
ctgcacaaagcccttccatgt

SEQ ID NO: 3555794 - DNA, 23 bp, Homo sapiens
ctgcacaacagccctgcctgaga

SEQ ID NO: 3555795 - DNA, 14 bp, Homo sapiens
ctgcacacagggca

SEQ ID NO: 3555796 - DNA, 17 bp, Homo sapiens
ctgcacagacaagcagc

SEQ ID NO: 3555797 - DNA, 18 bp, Homo sapiens
ctgcacagacaagcagcc

SEQ ID NO: 3555798 - DNA, 12 bp, Homo sapiens
ctgcacatgagt

SEQ ID NO: 3555799 - DNA, 14 bp, Homo sapiens
ctgcaccaccatgc

SEQ ID NO: 3555800 - DNA, 23 bp, Homo sapiens
ctgcaccatgctgctggggaaga

SEQ ID NO: 3555801 - DNA, 21 bp, Homo sapiens
ctgcaccccttcctgggcaca

SEQ ID NO: 3555802 - DNA, 17 bp, Homo sapiens
ctgcacccgcctcgacc

SEQ ID NO: 3555803 - DNA, 14 bp, Homo sapiens
ctgcaccctgcgcc

SEQ ID NO: 3555804 - DNA, 15 bp, Homo sapiens
ctgcaccctgcgcct

SEQ ID NO: 3555805 - DNA, 21 bp, Homo sapiens
ctgcaccctgcgcctccagag

SEQ ID NO: 3555806 - DNA, 22 bp, Homo sapiens
ctgcaccctgcgcctccagagg

SEQ ID NO: 3555807 - DNA, 11 bp, Homo sapiens
ctgcacctcct

SEQ ID NO: 3555808 - DNA, 16 bp, Homo sapiens
ctgcacctcctaccct

SEQ ID NO: 3555809 - DNA, 19 bp, Homo sapiens
ctgcacctcctaccctccc

SEQ ID NO: 3555810 - DNA, 20 bp, Homo sapiens
ctgcacgctcaatgcccagt

SEQ ID NO: 3555811 - DNA, 15 bp, Homo sapiens
ctgcactcagattta

SEQ ID NO: 3555812 - DNA, 19 bp, Homo sapiens
ctgcactcccacctgacac

SEQ ID NO: 3555813 - DNA, 21 bp, Homo sapiens
ctgcactgaggatttcttttt

SEQ ID NO: 3555814 - DNA, 18 bp, Homo sapiens
ctgcactgatgctgcccc

SEQ ID NO: 3555815 - DNA, 14 bp, Homo sapiens
ctgcacttcctgtt

SEQ ID NO: 3555816 - DNA, 13 bp, Homo sapiens
ctgcagaaggaaa

SEQ ID NO: 3555817 - DNA, 20 bp, Homo sapiens
ctgcagaaggaaagaagggg

SEQ ID NO: 3555818 - DNA, 23 bp, Homo sapiens
ctgcagaaggaaagaagggggcc

SEQ ID NO: 3555819 - DNA, 22 bp, Homo sapiens
ctgcagaatttgggttctgcct

SEQ ID NO: 3555820 - DNA, 20 bp, Homo sapiens
ctgcagagcaggaaacatga

SEQ ID NO: 3555821 - DNA, 18 bp, Homo sapiens
ctgtggctttcagcctct

SEQ ID NO: 3555822 - DNA, 19 bp, Homo sapiens
ctgtggctttcagcctctg

SEQ ID NO: 3555823 - DNA, 19 bp, Homo sapiens
ctgtgggcaaagtcctcct

SEQ ID NO: 3555824 - DNA, 20 bp, Homo sapiens
ctgtggggcagctgagcagc

SEQ ID NO: 3555825 - DNA, 16 bp, Homo sapiens
ctgtggggtcgggctc

SEQ ID NO: 3555826 - DNA, 20 bp, Homo sapiens
ctgtggtcacccatgcatct

SEQ ID NO: 3555827 - DNA, 22 bp, Homo sapiens
ctgtggtcatgtgagtctggga

SEQ ID NO: 3555828 - DNA, 13 bp, Homo sapiens
ctgtggtgcagtg

SEQ ID NO: 3555829 - DNA, 14 bp, Homo sapiens
ctgtggttccagta

SEQ ID NO: 3555830 - DNA, 18 bp, Homo sapiens
ctgtggtttcatgttagt

SEQ ID NO: 3555831 - DNA, 20 bp, Homo sapiens
ctgtggtttgggggagaaga

SEQ ID NO: 3555832 - DNA, 18 bp, Homo sapiens
ctgtgtaattagtgccac

SEQ ID NO: 3555833 - DNA, 22 bp, Homo sapiens
ctgtgtaccacttcctgaggcc

SEQ ID NO: 3555834 - DNA, 16 bp, Homo sapiens
ctgtgtcatttcttca

SEQ ID NO: 3555835 - DNA, 18 bp, Homo sapiens
ctgtgtcctccaccatgc

SEQ ID NO: 3555836 - DNA, 23 bp, Homo sapiens
ctgtgtcctctgcctgggctctg

SEQ ID NO: 3555837 - DNA, 14 bp, Homo sapiens
ctgtgtgctgtttg

SEQ ID NO: 3555838 - DNA, 13 bp, Homo sapiens
ctgtgtggctcct

SEQ ID NO: 3555839 - DNA, 19 bp, Homo sapiens
ctgtgtggctcctgggccg

SEQ ID NO: 3555840 - DNA, 19 bp, Homo sapiens
ctgtgtgtccaaaactgcc

SEQ ID NO: 3555841 - DNA, 18 bp, Homo sapiens
ctgtgtgtgtgtatgtgg

SEQ ID NO: 3555842 - DNA, 17 bp, Homo sapiens
ctgtgtgtttatgtgtg

SEQ ID NO: 3555843 - DNA, 13 bp, Homo sapiens
ctgtgttgaaaca

SEQ ID NO: 3555844 - DNA, 20 bp, Homo sapiens
ctgtgtttaactgctgcagg

SEQ ID NO: 3555845 - DNA, 17 bp, Homo sapiens
ctgtgtttttttctaaa

SEQ ID NO: 3555846 - DNA, 19 bp, Homo sapiens
ctgttaaaagatgaaaata

SEQ ID NO: 3555847 - DNA, 16 bp, Homo sapiens
ctgttaatctgatgta

SEQ ID NO: 3555848 - DNA, 20 bp, Homo sapiens
ctgttaatttataatgtatt

SEQ ID NO: 3555849 - DNA, 21 bp, Homo sapiens
ctgttaatttataatgtattt

SEQ ID NO: 3555850 - DNA, 17 bp, Homo sapiens
ctgttacaaaagaaaaa

SEQ ID NO: 3555851 - DNA, 20 bp, Homo sapiens
ctgttacttatgtagaaact

SEQ ID NO: 3555852 - DNA, 17 bp, Homo sapiens
ctgttatatttcatcat

SEQ ID NO: 3555853 - DNA, 13 bp, Homo sapiens
ctgttatgctgtt

SEQ ID NO: 3555854 - DNA, 16 bp, Homo sapiens
ctgttatgctgtttcc

SEQ ID NO: 3555855 - DNA, 16 bp, Homo sapiens
ctgttatttcttccct

SEQ ID NO: 3555856 - DNA, 23 bp, Homo sapiens
ctgttatttcttccctgctttgc

SEQ ID NO: 3555857 - DNA, 16 bp, Homo sapiens
ctgttcacttttcctc

SEQ ID NO: 3555858 - DNA, 17 bp, Homo sapiens
ctgttcatacactaacc

SEQ ID NO: 3555859 - DNA, 21 bp, Homo sapiens
ctgttcatacactaaccaaat

SEQ ID NO: 3555860 - DNA, 21 bp, Homo sapiens
ctgttccattacaccacagca

SEQ ID NO: 3555861 - DNA, 16 bp, Homo sapiens
ctgttccccaaatggc

SEQ ID NO: 3555862 - DNA, 14 bp, Homo sapiens
ctgttccccagaga

SEQ ID NO: 3555863 - DNA, 16 bp, Homo sapiens
ctgttccccagagaaa

SEQ ID NO: 3555864 - DNA, 23 bp, Homo sapiens
ctgttcccccttcacaaagccca

SEQ ID NO: 3555865 - DNA, 19 bp, Homo sapiens
ctgttcctttctctgggct

SEQ ID NO: 3555866 - DNA, 15 bp, Homo sapiens
ctgttctaacatgta

SEQ ID NO: 3555867 - DNA, 22 bp, Homo sapiens
ctgttgacacaggtctttccta

SEQ ID NO: 3555868 - DNA, 15 bp, Homo sapiens
ctgttgaggcatcaa

SEQ ID NO: 3555869 - DNA, 17 bp, Homo sapiens
ctgttgccatggattca

SEQ ID NO: 3555870 - DNA, 14 bp, Homo sapiens
ctgttgcccaggct

SEQ ID NO: 3555871 - DNA, 12 bp, Homo sapiens
ctgttggagaaa

SEQ ID NO: 3555872 - DNA, 20 bp, Homo sapiens
ctgttggcaggcccactccc

SEQ ID NO: 3555873 - DNA, 22 bp, Homo sapiens
ctgttggcaggcccactcccca

SEQ ID NO: 3555874 - DNA, 16 bp, Homo sapiens
ctgttggtaaagcaca

SEQ ID NO: 3555875 - DNA, 13 bp, Homo sapiens
ctgttggtctgcc

SEQ ID NO: 3555876 - DNA, 20 bp, Homo sapiens
ctgttggtctgccttctgct

SEQ ID NO: 3555877 - DNA, 23 bp, Homo sapiens
ctgttggtctgccttctgctgaa

SEQ ID NO: 3555878 - DNA, 14 bp, Homo sapiens
ctgttgtcacatct

SEQ ID NO: 3555879 - DNA, 14 bp, Homo sapiens
ctgtttattaatct

SEQ ID NO: 3555880 - DNA, 15 bp, Homo sapiens
ctgtttcaaagttct

SEQ ID NO: 3555881 - DNA, 18 bp, Homo sapiens
ctgtttcagaccccccca

SEQ ID NO: 3555882 - DNA, 19 bp, Homo sapiens
ctgtttcagacccccccat

SEQ ID NO: 3555883 - DNA, 20 bp, Homo sapiens
ctgtttcccgtaaggctgta

SEQ ID NO: 3555884 - DNA, 15 bp, Homo sapiens
ctgtttccctgctga

SEQ ID NO: 3555885 - DNA, 17 bp, Homo sapiens
ctgtttcttgtctgtta

SEQ ID NO: 3555886 - DNA, 12 bp, Homo sapiens
ctgtttgattct

SEQ ID NO: 3555887 - DNA, 14 bp, Homo sapiens
ctgtttgattcttt

SEQ ID NO: 3555888 - DNA, 20 bp, Homo sapiens
ctgtttgctcaaaattgctt

SEQ ID NO: 3555889 - DNA, 18 bp, Homo sapiens
ctgtttggatacagctgc

SEQ ID NO: 3555890 - DNA, 19 bp, Homo sapiens
ctgtttggatacagctgct

SEQ ID NO: 3555891 - DNA, 23 bp, Homo sapiens
ctgtttggtggggtggcacctgt

SEQ ID NO: 3555892 - DNA, 22 bp, Homo sapiens
ctgttttacaaaaaagaaaaga

SEQ ID NO: 3555893 - DNA, 23 bp, Homo sapiens
ctgttttcctcccttctgctact

SEQ ID NO: 3555894 - DNA, 16 bp, Homo sapiens
ctgttttccttcttcc

SEQ ID NO: 3555895 - DNA, 12 bp, Homo sapiens
cttaaaaattta

SEQ ID NO: 3555896 - DNA, 12 bp, Homo sapiens
cttaaaacctgc

SEQ ID NO: 3555897 - DNA, 15 bp, Homo sapiens
cttaaaacctgcttt

SEQ ID NO: 3555898 - DNA, 18 bp, Homo sapiens
cttaaaagtaataaagag

SEQ ID NO: 3555899 - DNA, 16 bp, Homo sapiens
cttaaaatacatgaat

SEQ ID NO: 3555900 - DNA, 14 bp, Homo sapiens
cttaaacaaaaaac

SEQ ID NO: 3555901 - DNA, 16 bp, Homo sapiens
cttaaacaaaaaacta

SEQ ID NO: 3555902 - DNA, 17 bp, Homo sapiens
cttaaacacaggctgtc

SEQ ID NO: 3555903 - DNA, 15 bp, Homo sapiens
cttaaagagggacag

SEQ ID NO: 3555904 - DNA, 22 bp, Homo sapiens
cttaaagagggacaggctgaag

SEQ ID NO: 3555905 - DNA, 15 bp, Homo sapiens
cttaaatatagcagt

SEQ ID NO: 3555906 - DNA, 16 bp, Homo sapiens
cttaaatttgttcttt

SEQ ID NO: 3555907 - DNA, 13 bp, Homo sapiens
cttaacatgggct

SEQ ID NO: 3555908 - DNA, 14 bp, Homo sapiens
cttaacccacctct

SEQ ID NO: 3555909 - DNA, 16 bp, Homo sapiens
cttaacccacctctcc

SEQ ID NO: 3555910 - DNA, 17 bp, Homo sapiens
cttaacccacctctcct

SEQ ID NO: 3555911 - DNA, 12 bp, Homo sapiens
cttaactatttc

SEQ ID NO: 3555912 - DNA, 17 bp, Homo sapiens
cttaactgtatagctct

SEQ ID NO: 3555913 - DNA, 15 bp, Homo sapiens
cttaacttcttgctt

SEQ ID NO: 3555914 - DNA, 22 bp, Homo sapiens
cttaacttcttgcttctttcta

SEQ ID NO: 3555915 - DNA, 20 bp, Homo sapiens
cttaagcagcatggaaaaat

SEQ ID NO: 3555916 - DNA, 21 bp, Homo sapiens
cttaagcagcatggaaaaatg

SEQ ID NO: 3555917 - DNA, 15 bp, Homo sapiens
cttaagcatctggct

SEQ ID NO: 3555918 - DNA, 22 bp, Homo sapiens
cttaagccaaactcaggcccag

SEQ ID NO: 3555919 - DNA, 21 bp, Homo sapiens
cttaaggcacagtgggagctg

SEQ ID NO: 3555920 - DNA, 19 bp, Homo sapiens
cttaagtatatcatgtaaa

SEQ ID NO: 3555921 - DNA, 19 bp, Homo sapiens
cttaataaactgtggtgct

SEQ ID NO: 3555922 - DNA, 12 bp, Homo sapiens
cttaatagcaac

SEQ ID NO: 3555923 - DNA, 13 bp, Homo sapiens
cttaatagcaaca

SEQ ID NO: 3555924 - DNA, 21 bp, Homo sapiens
cttaatcaagatttttttcct

SEQ ID NO: 3555925 - DNA, 22 bp, Homo sapiens
cttaatcaggtcctcagagaat

SEQ ID NO: 3555926 - DNA, 16 bp, Homo sapiens
cttaatcttaatgtct

SEQ ID NO: 3555927 - DNA, 18 bp, Homo sapiens
cttaatgacattcccctc

SEQ ID NO: 3555928 - DNA, 23 bp, Homo sapiens
cttaatgacattcccctcccacc

SEQ ID NO: 3555929 - DNA, 14 bp, Homo sapiens
cttaatgtatcaaa

SEQ ID NO: 3555930 - DNA, 18 bp, Homo sapiens
cttaatgtatcaaactgt

SEQ ID NO: 3555931 - DNA, 23 bp, Homo sapiens
cttaatgtatcaaactgtataac

SEQ ID NO: 3555932 - DNA, 15 bp, Homo sapiens
cttaatgtctggtgt

SEQ ID NO: 3555933 - DNA, 13 bp, Homo sapiens
cttaatgttctta

SEQ ID NO: 3555934 - DNA, 16 bp, Homo sapiens
cttaattaaaagaata

SEQ ID NO: 3555935 - DNA, 19 bp, Homo sapiens
cttaattaaaagaatattt

SEQ ID NO: 3555936 - DNA, 10 bp, Homo sapiens
cttaattatt

SEQ ID NO: 3555937 - DNA, 16 bp, Homo sapiens
cttaattattgatgtt

SEQ ID NO: 3555938 - DNA, 18 bp, Homo sapiens
cttacaagaaaggcctga

SEQ ID NO: 3555939 - DNA, 17 bp, Homo sapiens
cttacaatcgcaaatca

SEQ ID NO: 3555940 - DNA, 13 bp, Homo sapiens
cttacacattcca

SEQ ID NO: 3555941 - DNA, 15 bp, Homo sapiens
cttacagcctctgac

SEQ ID NO: 3555942 - DNA, 16 bp, Homo sapiens
cttacagcctctgact

SEQ ID NO: 3555943 - DNA, 14 bp, Homo sapiens
cttacaggagccag

SEQ ID NO: 3555944 - DNA, 18 bp, Homo sapiens
cttacaggagccagcctg

SEQ ID NO: 3555945 - DNA, 23 bp, Homo sapiens
cttacaggagccagcctgcttcc

SEQ ID NO: 3555946 - DNA, 17 bp, Homo sapiens
cttacatatctgacttc

SEQ ID NO: 3555947 - DNA, 21 bp, Homo sapiens
cttacattagcagtttgcttt

SEQ ID NO: 3555948 - DNA, 18 bp, Homo sapiens
cttaccagggtctttgca

SEQ ID NO: 3555949 - DNA, 19 bp, Homo sapiens
cttaccagtgacgctgctg

SEQ ID NO: 3555950 - DNA, 15 bp, Homo sapiens
cttaccctcctctgc

SEQ ID NO: 3555951 - DNA, 21 bp, Homo sapiens
cttaccctcctctgctgggaa

SEQ ID NO: 3555952 - DNA, 14 bp, Homo sapiens
cttacctgggcaca

SEQ ID NO: 3555953 - DNA, 16 bp, Homo sapiens
ctttcctccccctgca

SEQ ID NO: 3555954 - DNA, 13 bp, Homo sapiens
ctttcctgggcct

SEQ ID NO: 3555955 - DNA, 17 bp, Homo sapiens
ctttcctgggcctttgc

SEQ ID NO: 3555956 - DNA, 17 bp, Homo sapiens
ctttcctttactcctgg

SEQ ID NO: 3555957 - DNA, 15 bp, Homo sapiens
ctttcggagctcctg

SEQ ID NO: 3555958 - DNA, 22 bp, Homo sapiens
ctttcggggagaggctgaggac

SEQ ID NO: 3555959 - DNA, 15 bp, Homo sapiens
ctttcgttgttatta

SEQ ID NO: 3555960 - DNA, 18 bp, Homo sapiens
ctttctaagcaaccacac

SEQ ID NO: 3555961 - DNA, 14 bp, Homo sapiens
ctttctaatgctga

SEQ ID NO: 3555962 - DNA, 18 bp, Homo sapiens
ctttctagggacatgaaa

SEQ ID NO: 3555963 - DNA, 13 bp, Homo sapiens
ctttctagttcaa

SEQ ID NO: 3555964 - DNA, 14 bp, Homo sapiens
ctttctatgtgaca

SEQ ID NO: 3555965 - DNA, 14 bp, Homo sapiens
ctttctccatggag

SEQ ID NO: 3555966 - DNA, 16 bp, Homo sapiens
ctttctccatggagcc

SEQ ID NO: 3555967 - DNA, 21 bp, Homo sapiens
ctttctccatggagcctacct

SEQ ID NO: 3555968 - DNA, 14 bp, Homo sapiens
ctttctctgaggac

SEQ ID NO: 3555969 - DNA, 17 bp, Homo sapiens
ctttctcttccccttcc

SEQ ID NO: 3555970 - DNA, 14 bp, Homo sapiens
ctttctgctcagct

SEQ ID NO: 3555971 - DNA, 11 bp, Homo sapiens
ctttctggcaa

SEQ ID NO: 3555972 - DNA, 15 bp, Homo sapiens
ctttctgtcttgtta

SEQ ID NO: 3555973 - DNA, 18 bp, Homo sapiens
ctttcttattttgtaata

SEQ ID NO: 3555974 - DNA, 23 bp, Homo sapiens
ctttcttattttgtaataaactc

SEQ ID NO: 3555975 - DNA, 16 bp, Homo sapiens
ctttcttcctctgctg

SEQ ID NO: 3555976 - DNA, 15 bp, Homo sapiens
ctttcttctttcctt

SEQ ID NO: 3555977 - DNA, 11 bp, Homo sapiens
ctttcttggga

SEQ ID NO: 3555978 - DNA, 21 bp, Homo sapiens
ctttcttgggatagtgttctg

SEQ ID NO: 3555979 - DNA, 21 bp, Homo sapiens
ctttctttgcaccaaagacat

SEQ ID NO: 3555980 - DNA, 12 bp, Homo sapiens
ctttctttgcct

SEQ ID NO: 3555981 - DNA, 15 bp, Homo sapiens
ctttctttttttccc

SEQ ID NO: 3555982 - DNA, 12 bp, Homo sapiens
ctttgaaagaag

SEQ ID NO: 3555983 - DNA, 17 bp, Homo sapiens
ctttgaaagaagcaaga

SEQ ID NO: 3555984 - DNA, 14 bp, Homo sapiens
ctttgaagaaggca

SEQ ID NO: 3555985 - DNA, 18 bp, Homo sapiens
ctttgaagaaggcaaggc

SEQ ID NO: 3555986 - DNA, 12 bp, Homo sapiens
ctttgaataaat

SEQ ID NO: 3555987 - DNA, 14 bp, Homo sapiens
ctttgaataaatgt

SEQ ID NO: 3555988 - DNA, 14 bp, Homo sapiens
ctttgacctgttgg

SEQ ID NO: 3555989 - DNA, 14 bp, Homo sapiens
ctttgactttcttc

SEQ ID NO: 3555990 - DNA, 21 bp, Homo sapiens
ctttgagactcctcagcaccc

SEQ ID NO: 3555991 - DNA, 19 bp, Homo sapiens
ctttgatactaccagggtc

SEQ ID NO: 3555992 - DNA, 17 bp, Homo sapiens
ctttgcaagatgcttgg

SEQ ID NO: 3555993 - DNA, 15 bp, Homo sapiens
ctttgcaccaaagac

SEQ ID NO: 3555994 - DNA, 13 bp, Homo sapiens
ctttgcatattat

SEQ ID NO: 3555995 - DNA, 18 bp, Homo sapiens
ctttgccatctctgctcc

SEQ ID NO: 3555996 - DNA, 15 bp, Homo sapiens
ctttgcccacccctc

SEQ ID NO: 3555997 - DNA, 17 bp, Homo sapiens
ctttgcccacccctcac

SEQ ID NO: 3555998 - DNA, 19 bp, Homo sapiens
ctttgcccacccctcactc

SEQ ID NO: 3555999 - DNA, 12 bp, Homo sapiens
ctttgcctctgc

SEQ ID NO: 3556000 - DNA, 23 bp, Homo sapiens
ctttgcctctgcagtctcatttc

SEQ ID NO: 3556001 - DNA, 12 bp, Homo sapiens
ctttgcctcttc

SEQ ID NO: 3556002 - DNA, 23 bp, Homo sapiens
ctttgcctcttctttgtgccttt

SEQ ID NO: 3556003 - DNA, 11 bp, Homo sapiens
ctttgctgctg

SEQ ID NO: 3556004 - DNA, 14 bp, Homo sapiens
ctttgctttctgct

SEQ ID NO: 3556005 - DNA, 14 bp, Homo sapiens
ctttggacagtggc

SEQ ID NO: 3556006 - DNA, 15 bp, Homo sapiens
ctttggacagtggcc

SEQ ID NO: 3556007 - DNA, 24 bp, Homo sapiens
ctttggagagggaaaatcttcact

SEQ ID NO: 3556008 - DNA, 11 bp, Homo sapiens
ctttggctgca

SEQ ID NO: 3556009 - DNA, 14 bp, Homo sapiens
ctttggctgcaggt

SEQ ID NO: 3556010 - DNA, 15 bp, Homo sapiens
ctttggctggtagca

SEQ ID NO: 3556011 - DNA, 17 bp, Homo sapiens
ctttgggaggctgaggc

SEQ ID NO: 3556012 - DNA, 19 bp, Homo sapiens
ctttgggctgccctggtgc

SEQ ID NO: 3556013 - DNA, 21 bp, Homo sapiens
ctttgggctgccctggtgctg

SEQ ID NO: 3556014 - DNA, 14 bp, Homo sapiens
ctttggttccatgt

SEQ ID NO: 3556015 - DNA, 19 bp, Homo sapiens
ctttggttccttctctggg

SEQ ID NO: 3556016 - DNA, 20 bp, Homo sapiens
ctttgtacacccatgaaaga

SEQ ID NO: 3556017 - DNA, 14 bp, Homo sapiens
ctttgtagctccta

SEQ ID NO: 3556018 - DNA, 16 bp, Homo sapiens
ctttgtagttactcaa

SEQ ID NO: 3556019 - DNA, 13 bp, Homo sapiens
ctttgtattcaaa

SEQ ID NO: 3556020 - DNA, 21 bp, Homo sapiens
ctttgtcattcagttctaggc

SEQ ID NO: 3556021 - DNA, 20 bp, Homo sapiens
ctttgtctcaaaataaagca

SEQ ID NO: 3556022 - DNA, 14 bp, Homo sapiens
ctttgtgaccagaa

SEQ ID NO: 3556023 - DNA, 17 bp, Homo sapiens
ctttgtgcctttggcct

SEQ ID NO: 3556024 - DNA, 18 bp, Homo sapiens
ctttgtgctttttgtcat

SEQ ID NO: 3556025 - DNA, 17 bp, Homo sapiens
ctttgtgtagctttgct

SEQ ID NO: 3556026 - DNA, 15 bp, Homo sapiens
ctttgtgttcatttc

SEQ ID NO: 3556027 - DNA, 16 bp, Homo sapiens
ctttgtgttcatttca

SEQ ID NO: 3556028 - DNA, 17 bp, Homo sapiens
ctttgtgttcatttcat

SEQ ID NO: 3556029 - DNA, 18 bp, Homo sapiens
ctttgtgttcatttcatt

SEQ ID NO: 3556030 - DNA, 19 bp, Homo sapiens
ctttgttacttctctaatt

SEQ ID NO: 3556031 - DNA, 13 bp, Homo sapiens
ctttgttgaaaga

SEQ ID NO: 3556032 - DNA, 14 bp, Homo sapiens
ctttgtttagcctg

SEQ ID NO: 3556033 - DNA, 18 bp, Homo sapiens
cttttaaaacacttccat

SEQ ID NO: 3556034 - DNA, 14 bp, Homo sapiens
cttttaaactggaa

SEQ ID NO: 3556035 - DNA, 16 bp, Homo sapiens
cttttaatccatttca

SEQ ID NO: 3556036 - DNA, 18 bp, Homo sapiens
cttttaggccaaaaaaat

SEQ ID NO: 3556037 - DNA, 17 bp, Homo sapiens
cttttatctatttgaga

SEQ ID NO: 3556038 - DNA, 15 bp, Homo sapiens
cttttatctccttgt

SEQ ID NO: 3556039 - DNA, 13 bp, Homo sapiens
cttttatgtattt

SEQ ID NO: 3556040 - DNA, 20 bp, Homo sapiens
cttttcacattaggctgttg

SEQ ID NO: 3556041 - DNA, 16 bp, Homo sapiens
cttttcactgctggct

SEQ ID NO: 3556042 - DNA, 23 bp, Homo sapiens
cttttcccccttcccatttcttc

SEQ ID NO: 3556043 - DNA, 12 bp, Homo sapiens
cttttcctatcc

SEQ ID NO: 3556044 - DNA, 18 bp, Homo sapiens
cttttcctggcagctgct

SEQ ID NO: 3556045 - DNA, 18 bp, Homo sapiens
cttttccttatttgcctt

SEQ ID NO: 3556046 - DNA, 20 bp, Homo sapiens
cttttccttatttgccttct

SEQ ID NO: 3556047 - DNA, 17 bp, Homo sapiens
cttttctctggtaatat

SEQ ID NO: 3556048 - DNA, 13 bp, Homo sapiens
cttttctcttttc

SEQ ID NO: 3556049 - DNA, 20 bp, Homo sapiens
cttttctcttttctttctgt

SEQ ID NO: 3556050 - DNA, 16 bp, Homo sapiens
cttttctgccactcca

SEQ ID NO: 3556051 - DNA, 17 bp, Homo sapiens
cttttctgtcctgggca

SEQ ID NO: 3556052 - DNA, 14 bp, Homo sapiens
cttttctttaactt

SEQ ID NO: 3556053 - DNA, 12 bp, Homo sapiens
cttttctttatt

SEQ ID NO: 3556054 - DNA, 17 bp, Homo sapiens
cttttctttgccatctc

SEQ ID NO: 3556055 - DNA, 21 bp, Homo sapiens
cttttctttgccatctctgct

SEQ ID NO: 3556056 - DNA, 20 bp, Homo sapiens
cttttgaacccaggagttca

SEQ ID NO: 3556057 - DNA, 18 bp, Homo sapiens
cttttgaatacatttgta

SEQ ID NO: 3556058 - DNA, 12 bp, Homo sapiens
cttttgaggctt

SEQ ID NO: 3556059 - DNA, 19 bp, Homo sapiens
cttttgctgaacaggaaag

SEQ ID NO: 3556060 - DNA, 22 bp, Homo sapiens
cttttgggggtaaagtttgctc

SEQ ID NO: 3556061 - DNA, 21 bp, Homo sapiens
cttttggttatgaatactttg

SEQ ID NO: 3556062 - DNA, 20 bp, Homo sapiens
cttttgtaagacaaaggttt

SEQ ID NO: 3556063 - DNA, 23 bp, Homo sapiens
cttttgtagttttatttgtatta

SEQ ID NO: 3556064 - DNA, 13 bp, Homo sapiens
cttttgtggagtt

SEQ ID NO: 3556065 - DNA, 18 bp, Homo sapiens
ctttttaaagttcaaact

SEQ ID NO: 3556066 - DNA, 16 bp, Homo sapiens
ctttttaacctgcaaa

SEQ ID NO: 3556067 - DNA, 23 bp, Homo sapiens
ctttttatcccatttagtgtgaa

SEQ ID NO: 3556068 - DNA, 18 bp, Homo sapiens
ctttttattccctgccca

SEQ ID NO: 3556069 - DNA, 12 bp, Homo sapiens
ctttttcattta

SEQ ID NO: 3556070 - DNA, 13 bp, Homo sapiens
ctttttcatttat

SEQ ID NO: 3556071 - DNA, 14 bp, Homo sapiens
ctttttcttaagaa

SEQ ID NO: 3556072 - DNA, 22 bp, Homo sapiens
ctttttcttcacttacaagaaa

SEQ ID NO: 3556073 - DNA, 21 bp, Homo sapiens
ctttttgccagttttccctgg

SEQ ID NO: 3556074 - DNA, 23 bp, Homo sapiens
ctttttgccagttttccctggaa

SEQ ID NO: 3556075 - DNA, 12 bp, Homo sapiens
ctttttgtcatg

SEQ ID NO: 3556076 - DNA, 15 bp, Homo sapiens
ctttttgtcatgtta

SEQ ID NO: 3556077 - DNA, 16 bp, Homo sapiens
cttttttaataaacta

SEQ ID NO: 3556078 - DNA, 19 bp, Homo sapiens
ctttttttctgtaccagtt

SEQ ID NO: 3556079 - DNA, 14 bp, Homo sapiens
ctttttttgcttta

SEQ ID NO: 3556080 - DNA, 22 bp, Homo sapiens
ctttttttttttttaaagacag

SEQ ID NO: 3556081 - DNA, 16 bp, Homo sapiens
gaaaaaaaaagcaaat

SEQ ID NO: 3556082 - DNA, 19 bp, Homo sapiens
gaaaaaagagtttaaacaa

SEQ ID NO: 3556083 - DNA, 15 bp, Homo sapiens
gaaaaagaagaaaag

SEQ ID NO: 3556084 - DNA, 18 bp, Homo sapiens
gaaaaagaataaaaactt

SEQ ID NO: 3556085 - DNA, 11 bp, Homo sapiens
gaaaaagacat

SEQ ID NO: 3556086 - DNA, 17 bp, Homo sapiens
gaaaaagctgcttctta

SEQ ID NO: 3556087 - DNA, 20 bp, Homo sapiens
gacccagaatggagcctgct

SEQ ID NO: 3556088 - DNA, 12 bp, Homo sapiens
gacccagcatct

SEQ ID NO: 3556089 - DNA, 23 bp, Homo sapiens
gacccagtcccacactgtggcca

SEQ ID NO: 3556090 - DNA, 16 bp, Homo sapiens
gacccagtgcccccac

SEQ ID NO: 3556091 - DNA, 22 bp, Homo sapiens
gacccatccctgcctggaggct

SEQ ID NO: 3556092 - DNA, 17 bp, Homo sapiens
gaccccaaagactctgg

SEQ ID NO: 3556093 - DNA, 21 bp, Homo sapiens
gaccccaaaggaacactgaca

SEQ ID NO: 3556094 - DNA, 22 bp, Homo sapiens
gaccccaagggggctgctgctc

SEQ ID NO: 3556095 - DNA, 15 bp, Homo sapiens
gaccccacatccttc

SEQ ID NO: 3556096 - DNA, 18 bp, Homo sapiens
gaccccacatccttctca

SEQ ID NO: 3556097 - DNA, 15 bp, Homo sapiens
gaccccactcccctc

SEQ ID NO: 3556098 - DNA, 16 bp, Homo sapiens
gaccccagagaaaacc

SEQ ID NO: 3556099 - DNA, 12 bp, Homo sapiens
gaccccagctct

SEQ ID NO: 3556100 - DNA, 13 bp, Homo sapiens
gaccccaggacct

SEQ ID NO: 3556101 - DNA, 18 bp, Homo sapiens
gacccccatctgagctgg

SEQ ID NO: 3556102 - DNA, 19 bp, Homo sapiens
gacccccatctgagctggg

SEQ ID NO: 3556103 - DNA, 18 bp, Homo sapiens
gaccccgagaagtgctct

SEQ ID NO: 3556104 - DNA, 15 bp, Homo sapiens
gaccccgcacccggc

SEQ ID NO: 3556105 - DNA, 15 bp, Homo sapiens
gaccctccccgcacc

SEQ ID NO: 3556106 - DNA, 16 bp, Homo sapiens
gaccctgaaggggcca

SEQ ID NO: 3556107 - DNA, 17 bp, Homo sapiens
gaccctgacctccgccc

SEQ ID NO: 3556108 - DNA, 20 bp, Homo sapiens
gaccctgacctccgcccctg

SEQ ID NO: 3556109 - DNA, 21 bp, Homo sapiens
gaccctgcaagaccacggagg

SEQ ID NO: 3556110 - DNA, 18 bp, Homo sapiens
gaccctggcctcaagtta

SEQ ID NO: 3556111 - DNA, 12 bp, Homo sapiens
gaccctgggcag

SEQ ID NO: 3556112 - DNA, 13 bp, Homo sapiens
gaccctttcagaa

SEQ ID NO: 3556113 - DNA, 15 bp, Homo sapiens
gaccgagccctggag

SEQ ID NO: 3556114 - DNA, 20 bp, Homo sapiens
gaccggcggaccccagccat

SEQ ID NO: 3556115 - DNA, 15 bp, Homo sapiens
gaccggtgctgcagg

SEQ ID NO: 3556116 - DNA, 16 bp, Homo sapiens
gaccggtgctgcagga

SEQ ID NO: 3556117 - DNA, 20 bp, Homo sapiens
gacctaccccagccaggctc

SEQ ID NO: 3556118 - DNA, 20 bp, Homo sapiens
gacctcaagtgatctgtcca

SEQ ID NO: 3556119 - DNA, 19 bp, Homo sapiens
gacctcatctgtggagctg

SEQ ID NO: 3556120 - DNA, 11 bp, Homo sapiens
gacctccagaa

SEQ ID NO: 3556121 - DNA, 13 bp, Homo sapiens
gacctccccaccc

SEQ ID NO: 3556122 - DNA, 18 bp, Homo sapiens
gacctcgtgccaccccga

SEQ ID NO: 3556123 - DNA, 18 bp, Homo sapiens
gacctgatcctggaggcc

SEQ ID NO: 3556124 - DNA, 15 bp, Homo sapiens
gacctggcagctctg

SEQ ID NO: 3556125 - DNA, 16 bp, Homo sapiens
gacctggcgtgctcag

SEQ ID NO: 3556126 - DNA, 17 bp, Homo sapiens
gacctggcgtgctcaga

SEQ ID NO: 3556127 - DNA, 18 bp, Homo sapiens
gacctgtcctgtctttga

SEQ ID NO: 3556128 - DNA, 13 bp, Homo sapiens
gaccttcccaggg

SEQ ID NO: 3556129 - DNA, 18 bp, Homo sapiens
gaccttcgggctgtgccc

SEQ ID NO: 3556130 - DNA, 15 bp, Homo sapiens
gaccttgaatctttt

SEQ ID NO: 3556131 - DNA, 16 bp, Homo sapiens
gacgcacacagctgag

SEQ ID NO: 3556132 - DNA, 18 bp, Homo sapiens
gacgccacggagggctgg

SEQ ID NO: 3556133 - DNA, 12 bp, Homo sapiens
gacgccaggcac

SEQ ID NO: 3556134 - DNA, 17 bp, Homo sapiens
gacgccaggcaccacag

SEQ ID NO: 3556135 - DNA, 20 bp, Homo sapiens
gacgccaggcaccacagcct

SEQ ID NO: 3556136 - DNA, 15 bp, Homo sapiens
gacggagccgagcca

SEQ ID NO: 3556137 - DNA, 18 bp, Homo sapiens
gacgggatgacctccaga

SEQ ID NO: 3556138 - DNA, 21 bp, Homo sapiens
gacggtgttaattttgctaac

SEQ ID NO: 3556139 - DNA, 16 bp, Homo sapiens
gacgtctccccttctc

SEQ ID NO: 3556140 - DNA, 21 bp, Homo sapiens
gacgtgatgggctaggcctcc

SEQ ID NO: 3556141 - DNA, 14 bp, Homo sapiens
gactaaaaatacac

SEQ ID NO: 3556142 - DNA, 22 bp, Homo sapiens
gactaaactttttttctgtacc

SEQ ID NO: 3556143 - DNA, 14 bp, Homo sapiens
gactactattttct

SEQ ID NO: 3556144 - DNA, 18 bp, Homo sapiens
gactacttgggagcaccg

SEQ ID NO: 3556145 - DNA, 18 bp, Homo sapiens
gactagactactcaatat

SEQ ID NO: 3556146 - DNA, 23 bp, Homo sapiens
gactagagggacctctcccaggg

SEQ ID NO: 3556147 - DNA, 17 bp, Homo sapiens
gactagatgtagtattt

SEQ ID NO: 3556148 - DNA, 21 bp, Homo sapiens
gactatatttgggcctgctcc

SEQ ID NO: 3556149 - DNA, 13 bp, Homo sapiens
gactatctttgct

SEQ ID NO: 3556150 - DNA, 20 bp, Homo sapiens
gactatgcgtggctggaacc

SEQ ID NO: 3556151 - DNA, 15 bp, Homo sapiens
gactattcaaacagt

SEQ ID NO: 3556152 - DNA, 20 bp, Homo sapiens
gactattgtgccaactgcca

SEQ ID NO: 3556153 - DNA, 14 bp, Homo sapiens
gactcaagagaatt

SEQ ID NO: 3556154 - DNA, 18 bp, Homo sapiens
gactcaagtacccattct

SEQ ID NO: 3556155 - DNA, 19 bp, Homo sapiens
gactcaagtacccattctg

SEQ ID NO: 3556156 - DNA, 21 bp, Homo sapiens
gactcaagtacccattctgtt

SEQ ID NO: 3556157 - DNA, 18 bp, Homo sapiens
gactcagacattggcacc

SEQ ID NO: 3556158 - DNA, 18 bp, Homo sapiens
gactcagggaccggtgct

SEQ ID NO: 3556159 - DNA, 23 bp, Homo sapiens
gactcagggaccggtgctgcagg

SEQ ID NO: 3556160 - DNA, 24 bp, Homo sapiens
gactcagggaccggtgctgcagga

SEQ ID NO: 3556161 - DNA, 13 bp, Homo sapiens
gactcagggacct

SEQ ID NO: 3556162 - DNA, 18 bp, Homo sapiens
gactcagggaggctaaat

SEQ ID NO: 3556163 - DNA, 21 bp, Homo sapiens
gactcattttaaaaaatggaa

SEQ ID NO: 3556164 - DNA, 11 bp, Homo sapiens
gactccaaaga

SEQ ID NO: 3556165 - DNA, 22 bp, Homo sapiens
gactccagggtgacaaggcctg

SEQ ID NO: 3556166 - DNA, 15 bp, Homo sapiens
gactcccagaacctc

SEQ ID NO: 3556167 - DNA, 15 bp, Homo sapiens
gactccccagcccag

SEQ ID NO: 3556168 - DNA, 20 bp, Homo sapiens
gactccccagcccagcaccc

SEQ ID NO: 3556169 - DNA, 23 bp, Homo sapiens
gactccccagcccagcacccctt

SEQ ID NO: 3556170 - DNA, 12 bp, Homo sapiens
gactccctggga

SEQ ID NO: 3556171 - DNA, 14 bp, Homo sapiens
gactccctgggagc

SEQ ID NO: 3556172 - DNA, 12 bp, Homo sapiens
gactcctcagca

SEQ ID NO: 3556173 - DNA, 17 bp, Homo sapiens
gactcctcagcacccct

SEQ ID NO: 3556174 - DNA, 19 bp, Homo sapiens
gactcctcagcacccctcc

SEQ ID NO: 3556175 - DNA, 11 bp, Homo sapiens
gactcctctgt

SEQ ID NO: 3556176 - DNA, 18 bp, Homo sapiens
gactctcctgcctcagcc

SEQ ID NO: 3556177 - DNA, 18 bp, Homo sapiens
gactctggacaatctcac

SEQ ID NO: 3556178 - DNA, 22 bp, Homo sapiens
gactctgggggtggacatctga

SEQ ID NO: 3556179 - DNA, 21 bp, Homo sapiens
gactctttaataaattgctta

SEQ ID NO: 3556180 - DNA, 16 bp, Homo sapiens
gactgaaaacctctcc

SEQ ID NO: 3556181 - DNA, 20 bp, Homo sapiens
gactgaaaacctctcctcat

SEQ ID NO: 3556182 - DNA, 19 bp, Homo sapiens
gactgaaaatattgtttta

SEQ ID NO: 3556183 - DNA, 21 bp, Homo sapiens
gactgacccccatctgagctg

SEQ ID NO: 3556184 - DNA, 15 bp, Homo sapiens
gactgagcagccgcc

SEQ ID NO: 3556185 - DNA, 15 bp, Homo sapiens
gactgcattgccgct

SEQ ID NO: 3556186 - DNA, 14 bp, Homo sapiens
gactgccaagccag

SEQ ID NO: 3556187 - DNA, 15 bp, Homo sapiens
gactgccaagccaga

SEQ ID NO: 3556188 - DNA, 16 bp, Homo sapiens
gactgccaagccagat

SEQ ID NO: 3556189 - DNA, 16 bp, Homo sapiens
gactgccaggctgttt

SEQ ID NO: 3556190 - DNA, 22 bp, Homo sapiens
gactgcccccagaaagcctcct

SEQ ID NO: 3556191 - DNA, 22 bp, Homo sapiens
gactgcccctgctgtgctgctc

SEQ ID NO: 3556192 - DNA, 23 bp, Homo sapiens
gactgcccctgctgtgctgctca

SEQ ID NO: 3556193 - DNA, 14 bp, Homo sapiens
gactgctcctgggc

SEQ ID NO: 3556194 - DNA, 22 bp, Homo sapiens
gactgctcctgggcattagcaa

SEQ ID NO: 3556195 - DNA, 14 bp, Homo sapiens
gactggaggaggcc

SEQ ID NO: 3556196 - DNA, 17 bp, Homo sapiens
gactggatgtaccacca

SEQ ID NO: 3556197 - DNA, 18 bp, Homo sapiens
gactggcacagttttctg

SEQ ID NO: 3556198 - DNA, 16 bp, Homo sapiens
gactgggaacagaact

SEQ ID NO: 3556199 - DNA, 11 bp, Homo sapiens
gactggtccag

SEQ ID NO: 3556200 - DNA, 12 bp, Homo sapiens
gactggtccagc

SEQ ID NO: 3556201 - DNA, 14 bp, Homo sapiens
gactggtccagctc

SEQ ID NO: 3556202 - DNA, 17 bp, Homo sapiens
gactggtccagctctga

SEQ ID NO: 3556203 - DNA, 15 bp, Homo sapiens
gactggttctgaggc

SEQ ID NO: 3556204 - DNA, 18 bp, Homo sapiens
gactggttctgaggccag

SEQ ID NO: 3556205 - DNA, 17 bp, Homo sapiens
gactgtactcctcccag

SEQ ID NO: 3556206 - DNA, 15 bp, Homo sapiens
gactgtcatagaaat

SEQ ID NO: 3556207 - DNA, 21 bp, Homo sapiens
gactgtctcaagagggcactg

SEQ ID NO: 3556208 - DNA, 23 bp, Homo sapiens
gactgtctcaagagggcactggt

SEQ ID NO: 3556209 - DNA, 15 bp, Homo sapiens
gactgtgctggtgca

SEQ ID NO: 3556210 - DNA, 19 bp, Homo sapiens
gacttaaaatattcctgca

SEQ ID NO: 3556211 - DNA, 21 bp, Homo sapiens
gacttactttaattactggaa

SEQ ID NO: 3556212 - DNA, 17 bp, Homo sapiens
gacttatagtacatgat

SEQ ID NO: 3556213 - DNA, 12 bp, Homo sapiens
gacttatttctg

SEQ ID NO: 3556214 - DNA, 13 bp, Homo sapiens
gacttatttctgc

SEQ ID NO: 3556215 - DNA, 15 bp, Homo sapiens
gacttatttctgctc

SEQ ID NO: 3556216 - DNA, 15 bp, Homo sapiens
gacttcaggtcaggt

SEQ ID NO: 3556217 - DNA, 19 bp, Homo sapiens
gacttcctgtccagctcca

SEQ ID NO: 3556218 - DNA, 20 bp, Homo sapiens
gacttcctgtccagctccaa

SEQ ID NO: 3556219 - DNA, 21 bp, Homo sapiens
gacttcctgtccagctccaac

SEQ ID NO: 3556220 - DNA, 18 bp, Homo sapiens
gatgagatattaaattct

SEQ ID NO: 3556221 - DNA, 20 bp, Homo sapiens
gatgataaaggaaataggat

SEQ ID NO: 3556222 - DNA, 16 bp, Homo sapiens
gatgatgaaaactaag

SEQ ID NO: 3556223 - DNA, 19 bp, Homo sapiens
gatgatggcagagccaggc

SEQ ID NO: 3556224 - DNA, 22 bp, Homo sapiens
gatgcaaggattacagaaactg

SEQ ID NO: 3556225 - DNA, 20 bp, Homo sapiens
gatgcacagtatctgctgtt

SEQ ID NO: 3556226 - DNA, 22 bp, Homo sapiens
gatgcacagtatctgctgttct

SEQ ID NO: 3556227 - DNA, 16 bp, Homo sapiens
gatgcacatccctgga

SEQ ID NO: 3556228 - DNA, 21 bp, Homo sapiens
gatgcacgtggggcccactgc

SEQ ID NO: 3556229 - DNA, 22 bp, Homo sapiens
gatgcagcgccgtgtcctctct

SEQ ID NO: 3556230 - DNA, 14 bp, Homo sapiens
gatgccagcttctc

SEQ ID NO: 3556231 - DNA, 16 bp, Homo sapiens
gatgccagcttctctc

SEQ ID NO: 3556232 - DNA, 19 bp, Homo sapiens
gatgccagcttctctctcc

SEQ ID NO: 3556233 - DNA, 16 bp, Homo sapiens
gatgccccctccagga

SEQ ID NO: 3556234 - DNA, 18 bp, Homo sapiens
gatgccccctccaggaga

SEQ ID NO: 3556235 - DNA, 19 bp, Homo sapiens
gatgccctggaggtggctg

SEQ ID NO: 3556236 - DNA, 14 bp, Homo sapiens
gatgccctgggggc

SEQ ID NO: 3556237 - DNA, 20 bp, Homo sapiens
gatgcctgttaatttataat

SEQ ID NO: 3556238 - DNA, 16 bp, Homo sapiens
gatgcggatcctgctg

SEQ ID NO: 3556239 - DNA, 16 bp, Homo sapiens
gatgcgttcagcagac

SEQ ID NO: 3556240 - DNA, 19 bp, Homo sapiens
gatgcgttcagcagactgg

SEQ ID NO: 3556241 - DNA, 12 bp, Homo sapiens
gatgctgagcca

SEQ ID NO: 3556242 - DNA, 13 bp, Homo sapiens
gatgctgagccat

SEQ ID NO: 3556243 - DNA, 12 bp, Homo sapiens
gatgctgcccct

SEQ ID NO: 3556244 - DNA, 13 bp, Homo sapiens
gatgctgcccctc

SEQ ID NO: 3556245 - DNA, 12 bp, Homo sapiens
gatgctggccca

SEQ ID NO: 3556246 - DNA, 14 bp, Homo sapiens
gatgctggcccagg

SEQ ID NO: 3556247 - DNA, 19 bp, Homo sapiens
gatgctggcccagggccca

SEQ ID NO: 3556248 - DNA, 22 bp, Homo sapiens
gatgctggcccagggcccagag

SEQ ID NO: 3556249 - DNA, 12 bp, Homo sapiens
gatgctgggctg

SEQ ID NO: 3556250 - DNA, 14 bp, Homo sapiens
gatgctgggctggg

SEQ ID NO: 3556251 - DNA, 16 bp, Homo sapiens
gatgcttttgtctaat

SEQ ID NO: 3556252 - DNA, 13 bp, Homo sapiens
gatggaaaataaa

SEQ ID NO: 3556253 - DNA, 15 bp, Homo sapiens
gatggaaaataaaca

SEQ ID NO: 3556254 - DNA, 19 bp, Homo sapiens
gatggacttgtgattggct

SEQ ID NO: 3556255 - DNA, 23 bp, Homo sapiens
gatggaggaaaaccaagccgtgg

SEQ ID NO: 3556256 - DNA, 22 bp, Homo sapiens
gatggagggaagacctgaaaga

SEQ ID NO: 3556257 - DNA, 15 bp, Homo sapiens
gatggagggcttggc

SEQ ID NO: 3556258 - DNA, 16 bp, Homo sapiens
gatggatggcagactc

SEQ ID NO: 3556259 - DNA, 17 bp, Homo sapiens
gatggcaacagatctgg

SEQ ID NO: 3556260 - DNA, 18 bp, Homo sapiens
gatggcagactctttaat

SEQ ID NO: 3556261 - DNA, 19 bp, Homo sapiens
gatggcagactctttaata

SEQ ID NO: 3556262 - DNA, 23 bp, Homo sapiens
gatggcagagccaggctgttgga

SEQ ID NO: 3556263 - DNA, 14 bp, Homo sapiens
gatggccatgctca

SEQ ID NO: 3556264 - DNA, 12 bp, Homo sapiens
gatggctcctct

SEQ ID NO: 3556265 - DNA, 13 bp, Homo sapiens
gatggctcctctc

SEQ ID NO: 3556266 - DNA, 16 bp, Homo sapiens
gatgggaaagcattgt

SEQ ID NO: 3556267 - DNA, 18 bp, Homo sapiens
gatggggcaagacagaaa

SEQ ID NO: 3556268 - DNA, 19 bp, Homo sapiens
gatgggggaactcagatcc

SEQ ID NO: 3556269 - DNA, 21 bp, Homo sapiens
gatggtggccacagactgacc

SEQ ID NO: 3556270 - DNA, 13 bp, Homo sapiens
gatgtaaagatgt

SEQ ID NO: 3556271 - DNA, 13 bp, Homo sapiens
gatgtaattttgt

SEQ ID NO: 3556272 - DNA, 22 bp, Homo sapiens
gatgtacataactcctgtccct

SEQ ID NO: 3556273 - DNA, 22 bp, Homo sapiens
gatgtacatttaataatatcaa

SEQ ID NO: 3556274 - DNA, 22 bp, Homo sapiens
gatgtccttggactccatcgct

SEQ ID NO: 3556275 - DNA, 14 bp, Homo sapiens
gatgtctccagatt

SEQ ID NO: 3556276 - DNA, 16 bp, Homo sapiens
gatgtctttttattaa

SEQ ID NO: 3556277 - DNA, 14 bp, Homo sapiens
gatgtgaacacatc

SEQ ID NO: 3556278 - DNA, 16 bp, Homo sapiens
gatgtgaacacatcag

SEQ ID NO: 3556279 - DNA, 18 bp, Homo sapiens
gatgtgcagcatttcact

SEQ ID NO: 3556280 - DNA, 17 bp, Homo sapiens
gatgtgcagtttggaat

SEQ ID NO: 3556281 - DNA, 16 bp, Homo sapiens
gatgttagttttcctt

SEQ ID NO: 3556282 - DNA, 20 bp, Homo sapiens
gatgttctgcctctccctgg

SEQ ID NO: 3556283 - DNA, 22 bp, Homo sapiens
gatgttctgcctctccctgggt

SEQ ID NO: 3556284 - DNA, 22 bp, Homo sapiens
gatgtttacatttttaaaggta

SEQ ID NO: 3556285 - DNA, 16 bp, Homo sapiens
gattacaaatcagaag

SEQ ID NO: 3556286 - DNA, 23 bp, Homo sapiens
gattacaaatcagaagtcatctt

SEQ ID NO: 3556287 - DNA, 18 bp, Homo sapiens
gattacaggcatgtgcca

SEQ ID NO: 3556288 - DNA, 20 bp, Homo sapiens
gattacagggatgagccacc

SEQ ID NO: 3556289 - DNA, 22 bp, Homo sapiens
gattactggcctttttcattta

SEQ ID NO: 3556290 - DNA, 17 bp, Homo sapiens
gattagggagagaagat

SEQ ID NO: 3556291 - DNA, 19 bp, Homo sapiens
gattataaaattaatcaca

SEQ ID NO: 3556292 - DNA, 16 bp, Homo sapiens
gattattttttcagac

SEQ ID NO: 3556293 - DNA, 17 bp, Homo sapiens
gattattttttcagacc

SEQ ID NO: 3556294 - DNA, 15 bp, Homo sapiens
gattcaaatgtttta

SEQ ID NO: 3556295 - DNA, 18 bp, Homo sapiens
gattcaaatgttttaaag

SEQ ID NO: 3556296 - DNA, 17 bp, Homo sapiens
gattcaggccagcccag

SEQ ID NO: 3556297 - DNA, 18 bp, Homo sapiens
gattcaggccagcccagc

SEQ ID NO: 3556298 - DNA, 19 bp, Homo sapiens
gattcaggccagcccagcc

SEQ ID NO: 3556299 - DNA, 17 bp, Homo sapiens
gattcatatttacttct

SEQ ID NO: 3556300 - DNA, 18 bp, Homo sapiens
gattcatatttacttctt

SEQ ID NO: 3556301 - DNA, 19 bp, Homo sapiens
gattcatatttacttctta

SEQ ID NO: 3556302 - DNA, 23 bp, Homo sapiens
gattccaaggctttaaagctgag

SEQ ID NO: 3556303 - DNA, 22 bp, Homo sapiens
gattccagagagtggctcctcc

SEQ ID NO: 3556304 - DNA, 19 bp, Homo sapiens
gattcctgagctggcctgt

SEQ ID NO: 3556305 - DNA, 13 bp, Homo sapiens
gattctatgttaa

SEQ ID NO: 3556306 - DNA, 15 bp, Homo sapiens
gattctcagggctgg

SEQ ID NO: 3556307 - DNA, 18 bp, Homo sapiens
gattctcagggctggagc

SEQ ID NO: 3556308 - DNA, 23 bp, Homo sapiens
gattctcagggctggagcctggg

SEQ ID NO: 3556309 - DNA, 18 bp, Homo sapiens
gattctcctgcctcagcc

SEQ ID NO: 3556310 - DNA, 16 bp, Homo sapiens
gattctctctttaacc

SEQ ID NO: 3556311 - DNA, 14 bp, Homo sapiens
gattctctgcagcc

SEQ ID NO: 3556312 - DNA, 20 bp, Homo sapiens
gattctgaccttaaatgcaa

SEQ ID NO: 3556313 - DNA, 14 bp, Homo sapiens
gattctgattgcta

SEQ ID NO: 3556314 - DNA, 15 bp, Homo sapiens
gattctggggctgtg

SEQ ID NO: 3556315 - DNA, 11 bp, Homo sapiens
gattcttctta

SEQ ID NO: 3556316 - DNA, 18 bp, Homo sapiens
gattcttcttaaaagttt

SEQ ID NO: 3556317 - DNA, 15 bp, Homo sapiens
gattcttgtatttat

SEQ ID NO: 3556318 - DNA, 19 bp, Homo sapiens
gattgacagctttgctgct

SEQ ID NO: 3556319 - DNA, 23 bp, Homo sapiens
gattgcaggagtccctgccatca

SEQ ID NO: 3556320 - DNA, 20 bp, Homo sapiens
gattgcccctggctttgcct

SEQ ID NO: 3556321 - DNA, 22 bp, Homo sapiens
gattgcccctggctttgcctct

SEQ ID NO: 3556322 - DNA, 21 bp, Homo sapiens
gattgcgcctaatgtgtttga

SEQ ID NO: 3556323 - DNA, 13 bp, Homo sapiens
gattgctgaggca

SEQ ID NO: 3556324 - DNA, 11 bp, Homo sapiens
gattggctgca

SEQ ID NO: 3556325 - DNA, 13 bp, Homo sapiens
gattggctgcagg

SEQ ID NO: 3556326 - DNA, 9 bp, Homo sapiens
gattggctt

SEQ ID NO: 3556327 - DNA, 21 bp, Homo sapiens
gattggggggtgggctttgtt

SEQ ID NO: 3556328 - DNA, 23 bp, Homo sapiens
gattgtaatatgtaaatggtatg

SEQ ID NO: 3556329 - DNA, 14 bp, Homo sapiens
gattgtatttaaga

SEQ ID NO: 3556330 - DNA, 16 bp, Homo sapiens
gattgtatttaagaca

SEQ ID NO: 3556331 - DNA, 19 bp, Homo sapiens
gattgtatttaagacataa

SEQ ID NO: 3556332 - DNA, 16 bp, Homo sapiens
gatttaacttgtattt

SEQ ID NO: 3556333 - DNA, 15 bp, Homo sapiens
gatttaagccttaca

SEQ ID NO: 3556334 - DNA, 19 bp, Homo sapiens
gatttaagtgaatacatta

SEQ ID NO: 3556335 - DNA, 16 bp, Homo sapiens
gatttaatttgaaata

SEQ ID NO: 3556336 - DNA, 19 bp, Homo sapiens
gatttatgtgcactgcctg

SEQ ID NO: 3556337 - DNA, 15 bp, Homo sapiens
gatttcaaacttaaa

SEQ ID NO: 3556338 - DNA, 20 bp, Homo sapiens
gatttcatgctatctctgtg

SEQ ID NO: 3556339 - DNA, 14 bp, Homo sapiens
gatttccatttctg

SEQ ID NO: 3556340 - DNA, 16 bp, Homo sapiens
gatttcctagtggagt

SEQ ID NO: 3556341 - DNA, 14 bp, Homo sapiens
gatttctgaggaaa

SEQ ID NO: 3556342 - DNA, 14 bp, Homo sapiens
gatttgaattctgt

SEQ ID NO: 3556343 - DNA, 17 bp, Homo sapiens
gatttgatatttgcatt

SEQ ID NO: 3556344 - DNA, 20 bp, Homo sapiens
gatttggaatacacatgcag

SEQ ID NO: 3556345 - DNA, 20 bp, Homo sapiens
gatttggggctcagagtggg

SEQ ID NO: 3556346 - DNA, 14 bp, Homo sapiens
gatttgtcccaggt

SEQ ID NO: 3556347 - DNA, 14 bp, Homo sapiens
gattttacaagtat

SEQ ID NO: 3556348 - DNA, 18 bp, Homo sapiens
gattttcaaagctttttc

SEQ ID NO: 3556349 - DNA, 22 bp, Homo sapiens
gattttgtgtcttttaaactgg

SEQ ID NO: 3556350 - DNA, 11 bp, Homo sapiens
gatttttaaga

SEQ ID NO: 3556351 - DNA, 21 bp, Homo sapiens
gatttttttcccaattgagaa

SEQ ID NO: 3556352 - DNA, 21 bp, Homo sapiens
gcagggatgatggcagagcca

SEQ ID NO: 3556353 - DNA, 13 bp, Homo sapiens
gcagggatgccct

SEQ ID NO: 3556354 - DNA, 21 bp, Homo sapiens
gcagggatgccctggaggtgg

SEQ ID NO: 3556355 - DNA, 23 bp, Homo sapiens
gcagggatgccctggaggtggct

SEQ ID NO: 3556356 - DNA, 18 bp, Homo sapiens
gcagggccacctgcagga

SEQ ID NO: 3556357 - DNA, 18 bp, Homo sapiens
gcagggccatctgactgc

SEQ ID NO: 3556358 - DNA, 14 bp, Homo sapiens
gcagggcccacgtg

SEQ ID NO: 3556359 - DNA, 17 bp, Homo sapiens
gcagggcgcccagcgcc

SEQ ID NO: 3556360 - DNA, 14 bp, Homo sapiens
gcagggcttctcct

SEQ ID NO: 3556361 - DNA, 22 bp, Homo sapiens
gcaggggagacaggagcctagc

SEQ ID NO: 3556362 - DNA, 15 bp, Homo sapiens
gcaggggaggccatc

SEQ ID NO: 3556363 - DNA, 18 bp, Homo sapiens
gcaggggaggccatctgg

SEQ ID NO: 3556364 - DNA, 18 bp, Homo sapiens
gcagggggccccgccagg

SEQ ID NO: 3556365 - DNA, 21 bp, Homo sapiens
gcagggggccccgccagggct

SEQ ID NO: 3556366 - DNA, 17 bp, Homo sapiens
gcaggggggctgtgcca

SEQ ID NO: 3556367 - DNA, 22 bp, Homo sapiens
gcaggggttgagagctttctgc

SEQ ID NO: 3556368 - DNA, 20 bp, Homo sapiens
gcagggtccacagctggaaa

SEQ ID NO: 3556369 - DNA, 18 bp, Homo sapiens
gcaggtacatttctgatt

SEQ ID NO: 3556370 - DNA, 18 bp, Homo sapiens
gcaggtgctcatgctgct

SEQ ID NO: 3556371 - DNA, 19 bp, Homo sapiens
gcaggtgcttttggcagag

SEQ ID NO: 3556372 - DNA, 15 bp, Homo sapiens
gcagtactaaaatta

SEQ ID NO: 3556373 - DNA, 12 bp, Homo sapiens
gcagtcctggag

SEQ ID NO: 3556374 - DNA, 15 bp, Homo sapiens
gcagtcctggaggca

SEQ ID NO: 3556375 - DNA, 17 bp, Homo sapiens
gcagtcctggaggcagg

SEQ ID NO: 3556376 - DNA, 19 bp, Homo sapiens
gcagtcgcccaagcagaca

SEQ ID NO: 3556377 - DNA, 15 bp, Homo sapiens
gcagtcgcctgcctg

SEQ ID NO: 3556378 - DNA, 20 bp, Homo sapiens
gcagtcgcctgcctgcagca

SEQ ID NO: 3556379 - DNA, 22 bp, Homo sapiens
gcagtcgcctgcctgcagcagg

SEQ ID NO: 3556380 - DNA, 17 bp, Homo sapiens
gcagtctgataaactga

SEQ ID NO: 3556381 - DNA, 14 bp, Homo sapiens
gcagtgaactattt

SEQ ID NO: 3556382 - DNA, 19 bp, Homo sapiens
gcagtgactccccagccca

SEQ ID NO: 3556383 - DNA, 23 bp, Homo sapiens
gcagtgatgtttgccatttgctg

SEQ ID NO: 3556384 - DNA, 16 bp, Homo sapiens
gcagtgattctgtttg

SEQ ID NO: 3556385 - DNA, 21 bp, Homo sapiens
gcagtgggaatgttctttctg

SEQ ID NO: 3556386 - DNA, 21 bp, Homo sapiens
gcagtgtgcactaaggggccc

SEQ ID NO: 3556387 - DNA, 14 bp, Homo sapiens
gcagtgttccttgt

SEQ ID NO: 3556388 - DNA, 15 bp, Homo sapiens
gcagtgttgcgtttt

SEQ ID NO: 3556389 - DNA, 20 bp, Homo sapiens
gcagtgttgcgtttttcctt

SEQ ID NO: 3556390 - DNA, 22 bp, Homo sapiens
gcagttactccctacactgatg

SEQ ID NO: 3556391 - DNA, 20 bp, Homo sapiens
gcagttcagaatggcagtcc

SEQ ID NO: 3556392 - DNA, 13 bp, Homo sapiens
gcagttcattcta

SEQ ID NO: 3556393 - DNA, 14 bp, Homo sapiens
gcagttcattctac

SEQ ID NO: 3556394 - DNA, 20 bp, Homo sapiens
gcagttcattctaccaagct

SEQ ID NO: 3556395 - DNA, 22 bp, Homo sapiens
gcagttcattctaccaagctgt

SEQ ID NO: 3556396 - DNA, 23 bp, Homo sapiens
gcagttcattctaccaagctgtc

SEQ ID NO: 3556397 - DNA, 21 bp, Homo sapiens
gcagttgaaaagactccaaag

SEQ ID NO: 3556398 - DNA, 22 bp, Homo sapiens
gcagttgaaaagactccaaaga

SEQ ID NO: 3556399 - DNA, 21 bp, Homo sapiens
gcagttgttatattcattctt

SEQ ID NO: 3556400 - DNA, 15 bp, Homo sapiens
gcagtttacagtatt

SEQ ID NO: 3556401 - DNA, 16 bp, Homo sapiens
gcagtttacagtattt

SEQ ID NO: 3556402 - DNA, 17 bp, Homo sapiens
gcagtttacagtatttc

SEQ ID NO: 3556403 - DNA, 22 bp, Homo sapiens
gcagtttcctcagtgatggaat

SEQ ID NO: 3556404 - DNA, 23 bp, Homo sapiens
gcatactgccttgtttaatgtta

SEQ ID NO: 3556405 - DNA, 15 bp, Homo sapiens
gcatacttttcaaag

SEQ ID NO: 3556406 - DNA, 18 bp, Homo sapiens
gcatagattccctgagca

SEQ ID NO: 3556407 - DNA, 14 bp, Homo sapiens
gcatagctctgggg

SEQ ID NO: 3556408 - DNA, 11 bp, Homo sapiens
gcatataaatg

SEQ ID NO: 3556409 - DNA, 14 bp, Homo sapiens
gcatataaatgttt

SEQ ID NO: 3556410 - DNA, 19 bp, Homo sapiens
gcatataaatgtttatatt

SEQ ID NO: 3556411 - DNA, 17 bp, Homo sapiens
gcatataatgaataaat

SEQ ID NO: 3556412 - DNA, 20 bp, Homo sapiens
gcatataattttcacttctg

SEQ ID NO: 3556413 - DNA, 18 bp, Homo sapiens
gcatatagacacacatac

SEQ ID NO: 3556414 - DNA, 22 bp, Homo sapiens
gcatatagacacacatacataa

SEQ ID NO: 3556415 - DNA, 23 bp, Homo sapiens
gcatattataaaggataaagaag

SEQ ID NO: 3556416 - DNA, 19 bp, Homo sapiens
gcatatttgccaataaagc

SEQ ID NO: 3556417 - DNA, 20 bp, Homo sapiens
gcatatttgccaataaagct

SEQ ID NO: 3556418 - DNA, 22 bp, Homo sapiens
gcatatttgccaataaagcttt

SEQ ID NO: 3556419 - DNA, 20 bp, Homo sapiens
gcatcaagggagacaccagt

SEQ ID NO: 3556420 - DNA, 13 bp, Homo sapiens
gcatcaatacaac

SEQ ID NO: 3556421 - DNA, 19 bp, Homo sapiens
gcatcaatacaaccagccc

SEQ ID NO: 3556422 - DNA, 23 bp, Homo sapiens
gcatcacggatggtgcatgggct

SEQ ID NO: 3556423 - DNA, 20 bp, Homo sapiens
gcatcaggctaagaccctgt

SEQ ID NO: 3556424 - DNA, 22 bp, Homo sapiens
gcatcaggctaagaccctgtgt

SEQ ID NO: 3556425 - DNA, 22 bp, Homo sapiens
gcatccctttttcataaattat

SEQ ID NO: 3556426 - DNA, 20 bp, Homo sapiens
gcatcgggagcacccagagc

SEQ ID NO: 3556427 - DNA, 13 bp, Homo sapiens
gcatctcagccca

SEQ ID NO: 3556428 - DNA, 19 bp, Homo sapiens
gcatctcaggaggggcagc

SEQ ID NO: 3556429 - DNA, 19 bp, Homo sapiens
gcatctcctcccgcccttc

SEQ ID NO: 3556430 - DNA, 23 bp, Homo sapiens
gcatctcctcccgcccttccatg

SEQ ID NO: 3556431 - DNA, 20 bp, Homo sapiens
gcatctgaatgaaaataact

SEQ ID NO: 3556432 - DNA, 20 bp, Homo sapiens
gcatctgaccagcagcgcct

SEQ ID NO: 3556433 - DNA, 18 bp, Homo sapiens
gcatcttccactggaacg

SEQ ID NO: 3556434 - DNA, 18 bp, Homo sapiens
gcatgaaataaaatatat

SEQ ID NO: 3556435 - DNA, 15 bp, Homo sapiens
gcatgaaatttttaa

SEQ ID NO: 3556436 - DNA, 18 bp, Homo sapiens
gcatgaacgtggattgta

SEQ ID NO: 3556437 - DNA, 21 bp, Homo sapiens
gcatgaataaaacactcatcc

SEQ ID NO: 3556438 - DNA, 21 bp, Homo sapiens
gcatgagctggcaaccagcca

SEQ ID NO: 3556439 - DNA, 22 bp, Homo sapiens
gcatgatattgttctccaagga

SEQ ID NO: 3556440 - DNA, 15 bp, Homo sapiens
gcatgcaccacgggc

SEQ ID NO: 3556441 - DNA, 20 bp, Homo sapiens
gcatgcttgggctgacccag

SEQ ID NO: 3556442 - DNA, 22 bp, Homo sapiens
gcatgcttgggctgacccagca

SEQ ID NO: 3556443 - DNA, 12 bp, Homo sapiens
gcatggaaaaat

SEQ ID NO: 3556444 - DNA, 23 bp, Homo sapiens
gcatggaaaaatggttgatggaa

SEQ ID NO: 3556445 - DNA, 13 bp, Homo sapiens
gcatggagaatgg

SEQ ID NO: 3556446 - DNA, 13 bp, Homo sapiens
gcatggagacagc

SEQ ID NO: 3556447 - DNA, 16 bp, Homo sapiens
gcatggagacagcagt

SEQ ID NO: 3556448 - DNA, 16 bp, Homo sapiens
gcatggcactgactga

SEQ ID NO: 3556449 - DNA, 14 bp, Homo sapiens
gcatggccaggtgg

SEQ ID NO: 3556450 - DNA, 17 bp, Homo sapiens
gcatggccaggtggcca

SEQ ID NO: 3556451 - DNA, 13 bp, Homo sapiens
gcatggggccagg

SEQ ID NO: 3556452 - DNA, 14 bp, Homo sapiens
gcatggggccagga

SEQ ID NO: 3556453 - DNA, 15 bp, Homo sapiens
gcatggggccaggaa

SEQ ID NO: 3556454 - DNA, 15 bp, Homo sapiens
gcatgggtccagggc

SEQ ID NO: 3556455 - DNA, 18 bp, Homo sapiens
gcatgggtccagggcctg

SEQ ID NO: 3556456 - DNA, 15 bp, Homo sapiens
gcatggtgccccagg

SEQ ID NO: 3556457 - DNA, 21 bp, Homo sapiens
gcatggtgccccaggaccagc

SEQ ID NO: 3556458 - DNA, 16 bp, Homo sapiens
gcatggtggctcatgc

SEQ ID NO: 3556459 - DNA, 21 bp, Homo sapiens
gcatggtggctcatgcctgta

SEQ ID NO: 3556460 - DNA, 22 bp, Homo sapiens
gcatgtagactgtgccagaggc

SEQ ID NO: 3556461 - DNA, 16 bp, Homo sapiens
gcatgtgctgtgtgag

SEQ ID NO: 3556462 - DNA, 21 bp, Homo sapiens
gcatgtgctgtgtgagtgagc

SEQ ID NO: 3556463 - DNA, 16 bp, Homo sapiens
gcatgtgtctggccct

SEQ ID NO: 3556464 - DNA, 23 bp, Homo sapiens
gcatgttcctccttttcttcacc

SEQ ID NO: 3556465 - DNA, 11 bp, Homo sapiens
gcatgttttcc

SEQ ID NO: 3556466 - DNA, 19 bp, Homo sapiens
gcattagcaaggcagagcc

SEQ ID NO: 3556467 - DNA, 19 bp, Homo sapiens
gcattatggtctaatgatt

SEQ ID NO: 3556468 - DNA, 21 bp, Homo sapiens
gcattattctcttttatctgt

SEQ ID NO: 3556469 - DNA, 22 bp, Homo sapiens
gcattgactttcagtaaacata

SEQ ID NO: 3556470 - DNA, 16 bp, Homo sapiens
gcattgcagcctaaga

SEQ ID NO: 3556471 - DNA, 20 bp, Homo sapiens
gcattgtcaccgcaggtgct

SEQ ID NO: 3556472 - DNA, 18 bp, Homo sapiens
gcatttaatggcagctag

SEQ ID NO: 3556473 - DNA, 12 bp, Homo sapiens
gcatttcaatcc

SEQ ID NO: 3556474 - DNA, 16 bp, Homo sapiens
gcatttcccccaggga

SEQ ID NO: 3556475 - DNA, 13 bp, Homo sapiens
gcatttctaaaat

SEQ ID NO: 3556476 - DNA, 22 bp, Homo sapiens
gcatttggattggggtccctct

SEQ ID NO: 3556477 - DNA, 23 bp, Homo sapiens
gcatttggattggggtccctcta

SEQ ID NO: 3556478 - DNA, 15 bp, Homo sapiens
gcatttggtgagagt

SEQ ID NO: 3556479 - DNA, 21 bp, Homo sapiens
gcatttggtgagagtcaaagc

SEQ ID NO: 3556480 - DNA, 22 bp, Homo sapiens
gcatttggtgagagtcaaagct

SEQ ID NO: 3556481 - DNA, 12 bp, Homo sapiens
gcatttgtatta

SEQ ID NO: 3556482 - DNA, 18 bp, Homo sapiens
gcatttgttggtttatca

SEQ ID NO: 3556483 - DNA, 17 bp, Homo sapiens
gcctggccccctgtcct

SEQ ID NO: 3556484 - DNA, 15 bp, Homo sapiens
gcctggccgcagggc

SEQ ID NO: 3556485 - DNA, 18 bp, Homo sapiens
gcctggccgcagggcggg

SEQ ID NO: 3556486 - DNA, 16 bp, Homo sapiens
gcctggctccgtccag

SEQ ID NO: 3556487 - DNA, 14 bp, Homo sapiens
gcctggctctgccc

SEQ ID NO: 3556488 - DNA, 22 bp, Homo sapiens
gcctggctctgccccctccccc

SEQ ID NO: 3556489 - DNA, 14 bp, Homo sapiens
gcctgggagcccag

SEQ ID NO: 3556490 - DNA, 16 bp, Homo sapiens
gcctgggccgcccaga

SEQ ID NO: 3556491 - DNA, 19 bp, Homo sapiens
gcctgggccgtggcacagc

SEQ ID NO: 3556492 - DNA, 21 bp, Homo sapiens
gcctgggccgtggcacagctg

SEQ ID NO: 3556493 - DNA, 12 bp, Homo sapiens
gcctgggctcac

SEQ ID NO: 3556494 - DNA, 17 bp, Homo sapiens
gcctgggctcagcctgg

SEQ ID NO: 3556495 - DNA, 22 bp, Homo sapiens
gcctgggggcttttgccactcc

SEQ ID NO: 3556496 - DNA, 23 bp, Homo sapiens
gcctgggggtggggggactgcct

SEQ ID NO: 3556497 - DNA, 23 bp, Homo sapiens
gcctggggtgtcctacagtgact

SEQ ID NO: 3556498 - DNA, 21 bp, Homo sapiens
gcctggtcccacgagggtgcc

SEQ ID NO: 3556499 - DNA, 23 bp, Homo sapiens
gcctggttcagacacagctcttc

SEQ ID NO: 3556500 - DNA, 13 bp, Homo sapiens
gcctggtttctgg

SEQ ID NO: 3556501 - DNA, 17 bp, Homo sapiens
gcctgtcccaattctgc

SEQ ID NO: 3556502 - DNA, 20 bp, Homo sapiens
gcctgtcccaattctgcccg

SEQ ID NO: 3556503 - DNA, 18 bp, Homo sapiens
gcctgtcccttgcctctg

SEQ ID NO: 3556504 - DNA, 16 bp, Homo sapiens
gcctgtcttaattttc

SEQ ID NO: 3556505 - DNA, 18 bp, Homo sapiens
gcctgtgcctctgggact

SEQ ID NO: 3556506 - DNA, 19 bp, Homo sapiens
gcctgtgcctctgggactg

SEQ ID NO: 3556507 - DNA, 19 bp, Homo sapiens
gcctgtgcgtcccagctga

SEQ ID NO: 3556508 - DNA, 21 bp, Homo sapiens
gcctgtgggcgcatactacag

SEQ ID NO: 3556509 - DNA, 19 bp, Homo sapiens
gcctgttaatttataatgt

SEQ ID NO: 3556510 - DNA, 23 bp, Homo sapiens
gcctgttcccattcttgcatggc

SEQ ID NO: 3556511 - DNA, 21 bp, Homo sapiens
gcctgtttcccgtaaggctgt

SEQ ID NO: 3556512 - DNA, 14 bp, Homo sapiens
gccttaaaatgcat

SEQ ID NO: 3556513 - DNA, 19 bp, Homo sapiens
gccttaaagagggacaggc

SEQ ID NO: 3556514 - DNA, 23 bp, Homo sapiens
gccttaaagagggacaggctgaa

SEQ ID NO: 3556515 - DNA, 19 bp, Homo sapiens
gccttaactatttcacatg

SEQ ID NO: 3556516 - DNA, 13 bp, Homo sapiens
gccttaagcaaat

SEQ ID NO: 3556517 - DNA, 22 bp, Homo sapiens
gccttaaggccctcattctcat

SEQ ID NO: 3556518 - DNA, 13 bp, Homo sapiens
gccttacatctgg

SEQ ID NO: 3556519 - DNA, 16 bp, Homo sapiens
gccttacttcaaagtg

SEQ ID NO: 3556520 - DNA, 17 bp, Homo sapiens
gccttagaacctttctt

SEQ ID NO: 3556521 - DNA, 14 bp, Homo sapiens
gccttagagctctt

SEQ ID NO: 3556522 - DNA, 16 bp, Homo sapiens
gccttcagctctacag

SEQ ID NO: 3556523 - DNA, 22 bp, Homo sapiens
gccttcatcagaactcttcctc

SEQ ID NO: 3556524 - DNA, 15 bp, Homo sapiens
gccttccccagctcc

SEQ ID NO: 3556525 - DNA, 14 bp, Homo sapiens
gccttcccctgggc

SEQ ID NO: 3556526 - DNA, 13 bp, Homo sapiens
gccttcctcagct

SEQ ID NO: 3556527 - DNA, 15 bp, Homo sapiens
gccttcctcagctgc

SEQ ID NO: 3556528 - DNA, 20 bp, Homo sapiens
gccttcctcagctgcctcct

SEQ ID NO: 3556529 - DNA, 18 bp, Homo sapiens
gccttcggtacccaccac

SEQ ID NO: 3556530 - DNA, 14 bp, Homo sapiens
gccttctcccacat

SEQ ID NO: 3556531 - DNA, 15 bp, Homo sapiens
gccttctcccacatg

SEQ ID NO: 3556532 - DNA, 10 bp, Homo sapiens
gccttctgct

SEQ ID NO: 3556533 - DNA, 13 bp, Homo sapiens
gccttctgctgaa

SEQ ID NO: 3556534 - DNA, 23 bp, Homo sapiens
gccttctttccatcaactcccaa

SEQ ID NO: 3556535 - DNA, 14 bp, Homo sapiens
gccttgccagagat

SEQ ID NO: 3556536 - DNA, 23 bp, Homo sapiens
gccttgcctaaatttaatgctgc

SEQ ID NO: 3556537 - DNA, 22 bp, Homo sapiens
gccttgggatagcaaactccag

SEQ ID NO: 3556538 - DNA, 20 bp, Homo sapiens
gccttgtacagtctgctcct

SEQ ID NO: 3556539 - DNA, 13 bp, Homo sapiens
gccttgtcagtgt

SEQ ID NO: 3556540 - DNA, 18 bp, Homo sapiens
gccttgtcagtgtgtcag

SEQ ID NO: 3556541 - DNA, 21 bp, Homo sapiens
gccttgtcagtgtgtcagttt

SEQ ID NO: 3556542 - DNA, 23 bp, Homo sapiens
gccttgtttaatggtagttttac

SEQ ID NO: 3556543 - DNA, 15 bp, Homo sapiens
gccttgtttaatgtt

SEQ ID NO: 3556544 - DNA, 18 bp, Homo sapiens
gccttgtttaatgttaat

SEQ ID NO: 3556545 - DNA, 17 bp, Homo sapiens
gcctttaagaaccttaa

SEQ ID NO: 3556546 - DNA, 18 bp, Homo sapiens
gcctttaagaaccttaat

SEQ ID NO: 3556547 - DNA, 12 bp, Homo sapiens
gcctttaagcca

SEQ ID NO: 3556548 - DNA, 21 bp, Homo sapiens
gcctttaagccaaagaaacaa

SEQ ID NO: 3556549 - DNA, 18 bp, Homo sapiens
gcctttcctctgcacgct

SEQ ID NO: 3556550 - DNA, 13 bp, Homo sapiens
gcctttctttgcc

SEQ ID NO: 3556551 - DNA, 18 bp, Homo sapiens
gcctttctttgcctctgc

SEQ ID NO: 3556552 - DNA, 19 bp, Homo sapiens
gcctttgcaagatgcttgg

SEQ ID NO: 3556553 - DNA, 22 bp, Homo sapiens
gcctttggcctggggtgcatct

SEQ ID NO: 3556554 - DNA, 14 bp, Homo sapiens
gccttttatgtaaa

SEQ ID NO: 3556555 - DNA, 20 bp, Homo sapiens
gccttttatgtaaatttttt

SEQ ID NO: 3556556 - DNA, 22 bp, Homo sapiens
gccttttatgtaaattttttac

SEQ ID NO: 3556557 - DNA, 14 bp, Homo sapiens
gccttttgaataca

SEQ ID NO: 3556558 - DNA, 22 bp, Homo sapiens
gccttttgaatacatttgtatt

SEQ ID NO: 3556559 - DNA, 19 bp, Homo sapiens
gccttttgttttcattggt

SEQ ID NO: 3556560 - DNA, 14 bp, Homo sapiens
gcctttttacctgg

SEQ ID NO: 3556561 - DNA, 18 bp, Homo sapiens
gcctttttacctggccta

SEQ ID NO: 3556562 - DNA, 15 bp, Homo sapiens
gcctttttcatttat

SEQ ID NO: 3556563 - DNA, 22 bp, Homo sapiens
gcctttttcatttatctataat

SEQ ID NO: 3556564 - DNA, 16 bp, Homo sapiens
gcgaatctagaggagg

SEQ ID NO: 3556565 - DNA, 22 bp, Homo sapiens
gcgagacgcacacagctgagca

SEQ ID NO: 3556566 - DNA, 18 bp, Homo sapiens
gcgagcacagtattattt

SEQ ID NO: 3556567 - DNA, 19 bp, Homo sapiens
gcgagggatgatgagggaa

SEQ ID NO: 3556568 - DNA, 21 bp, Homo sapiens
gcgatgccctgggggccgtgc

SEQ ID NO: 3556569 - DNA, 18 bp, Homo sapiens
gcgcacagagggaagcca

SEQ ID NO: 3556570 - DNA, 19 bp, Homo sapiens
gcgcacagagggaagccat

SEQ ID NO: 3556571 - DNA, 12 bp, Homo sapiens
gcgcagctgcct

SEQ ID NO: 3556572 - DNA, 22 bp, Homo sapiens
gcgcatcctgcagggcttctcc

SEQ ID NO: 3556573 - DNA, 13 bp, Homo sapiens
gcgcatgtgtgca

SEQ ID NO: 3556574 - DNA, 21 bp, Homo sapiens
gcgccaaaacaagccaaagag

SEQ ID NO: 3556575 - DNA, 12 bp, Homo sapiens
gcgccctgcagg

SEQ ID NO: 3556576 - DNA, 15 bp, Homo sapiens
gcgccctgcagggcc

SEQ ID NO: 3556577 - DNA, 12 bp, Homo sapiens
gcgcctccagag

SEQ ID NO: 3556578 - DNA, 19 bp, Homo sapiens
gcgcctcggtatctggctt

SEQ ID NO: 3556579 - DNA, 21 bp, Homo sapiens
gcgcctcggtatctggcttcc

SEQ ID NO: 3556580 - DNA, 17 bp, Homo sapiens
gcgcctcgtgctggcgg

SEQ ID NO: 3556581 - DNA, 13 bp, Homo sapiens
gcgcctgcgtccg

SEQ ID NO: 3556582 - DNA, 15 bp, Homo sapiens
gcgcctttcccaact

SEQ ID NO: 3556583 - DNA, 16 bp, Homo sapiens
gcgcctttcccaactc

SEQ ID NO: 3556584 - DNA, 18 bp, Homo sapiens
gcgctggaatccagaagg

SEQ ID NO: 3556585 - DNA, 14 bp, Homo sapiens
gcggagcccagcct

SEQ ID NO: 3556586 - DNA, 18 bp, Homo sapiens
gcggaggggatccagcca

SEQ ID NO: 3556587 - DNA, 21 bp, Homo sapiens
gcggaggggatccagccactt

SEQ ID NO: 3556588 - DNA, 17 bp, Homo sapiens
gcggaggtctctgggag

SEQ ID NO: 3556589 - DNA, 22 bp, Homo sapiens
gcggaggtctctgggagcccag

SEQ ID NO: 3556590 - DNA, 12 bp, Homo sapiens
gcggcacagcct

SEQ ID NO: 3556591 - DNA, 17 bp, Homo sapiens
gcggcacgtccttgggc

SEQ ID NO: 3556592 - DNA, 16 bp, Homo sapiens
gcggcccgcgcagctg

SEQ ID NO: 3556593 - DNA, 19 bp, Homo sapiens
gcggcccgcgcagctgcct

SEQ ID NO: 3556594 - DNA, 21 bp, Homo sapiens
gcggcccggccggagggcagg

SEQ ID NO: 3556595 - DNA, 12 bp, Homo sapiens
gcggcctccaca

SEQ ID NO: 3556596 - DNA, 14 bp, Homo sapiens
gcggcggtcccagc

SEQ ID NO: 3556597 - DNA, 17 bp, Homo sapiens
gcggcggtcccagctcc

SEQ ID NO: 3556598 - DNA, 19 bp, Homo sapiens
gcgggaatggcagctgcca

SEQ ID NO: 3556599 - DNA, 22 bp, Homo sapiens
gcgggacaaagccttaaaatgc

SEQ ID NO: 3556600 - DNA, 18 bp, Homo sapiens
gcgggatcctccacagag

SEQ ID NO: 3556601 - DNA, 15 bp, Homo sapiens
gcgggatggtgcaga

SEQ ID NO: 3556602 - DNA, 22 bp, Homo sapiens
gcgggcacacctcctcccactg

SEQ ID NO: 3556603 - DNA, 23 bp, Homo sapiens
gcgggcggaggggatccagccac

SEQ ID NO: 3556604 - DNA, 13 bp, Homo sapiens
gcggtcccagctc

SEQ ID NO: 3556605 - DNA, 16 bp, Homo sapiens
gcggtggctgccccgg

SEQ ID NO: 3556606 - DNA, 21 bp, Homo sapiens
gcgtagatcaccagaataaac

SEQ ID NO: 3556607 - DNA, 18 bp, Homo sapiens
gcgtccagctcagccctg

SEQ ID NO: 3556608 - DNA, 19 bp, Homo sapiens
gcgtccagctcagccctgg

SEQ ID NO: 3556609 - DNA, 20 bp, Homo sapiens
gcgtccagctcagccctggc

SEQ ID NO: 3556610 - DNA, 16 bp, Homo sapiens
gcgtcgccctcccagg

SEQ ID NO: 3556611 - DNA, 15 bp, Homo sapiens
gcgtcggtcctggtg

SEQ ID NO: 3556612 - DNA, 17 bp, Homo sapiens
gcgtctctaatgtctgc

SEQ ID NO: 3556613 - DNA, 16 bp, Homo sapiens
gcgtctgttccccctt

SEQ ID NO: 3556614 - DNA, 17 bp, Homo sapiens
gcgtctgttcccccttc

SEQ ID NO: 3556615 - DNA, 21 bp, Homo sapiens
ggacacagctcttcattccat

SEQ ID NO: 3556616 - DNA, 22 bp, Homo sapiens
ggacacagctcttcattccatt

SEQ ID NO: 3556617 - DNA, 22 bp, Homo sapiens
ggacagacagatgttgggagga

SEQ ID NO: 3556618 - DNA, 16 bp, Homo sapiens
ggacagaggccccagc

SEQ ID NO: 3556619 - DNA, 20 bp, Homo sapiens
ggacagaggccccagcctcc

SEQ ID NO: 3556620 - DNA, 14 bp, Homo sapiens
ggacagccattttc

SEQ ID NO: 3556621 - DNA, 17 bp, Homo sapiens
ggacagctggctgggcc

SEQ ID NO: 3556622 - DNA, 18 bp, Homo sapiens
ggacagctggctgggcct

SEQ ID NO: 3556623 - DNA, 24 bp, Homo sapiens
ggacagctggctgggccttcacca

SEQ ID NO: 3556624 - DNA, 14 bp, Homo sapiens
ggacaggaccccag

SEQ ID NO: 3556625 - DNA, 18 bp, Homo sapiens
ggacaggaccccagctct

SEQ ID NO: 3556626 - DNA, 11 bp, Homo sapiens
ggacaggcccg

SEQ ID NO: 3556627 - DNA, 23 bp, Homo sapiens
ggacaggctgaagagagggacag

SEQ ID NO: 3556628 - DNA, 22 bp, Homo sapiens
ggacagggcatggccaggtggc

SEQ ID NO: 3556629 - DNA, 20 bp, Homo sapiens
ggacagttgatggagcccca

SEQ ID NO: 3556630 - DNA, 21 bp, Homo sapiens
ggacagttgatggagccccag

SEQ ID NO: 3556631 - DNA, 14 bp, Homo sapiens
ggacatcagctggt

SEQ ID NO: 3556632 - DNA, 15 bp, Homo sapiens
ggacatctgacccca

SEQ ID NO: 3556633 - DNA, 22 bp, Homo sapiens
ggacatctgaccccaagggggc

SEQ ID NO: 3556634 - DNA, 17 bp, Homo sapiens
ggacatgcataaaaatt

SEQ ID NO: 3556635 - DNA, 24 bp, Homo sapiens
ggaccaattctggacagacagatg

SEQ ID NO: 3556636 - DNA, 20 bp, Homo sapiens
ggaccaccgttcagtcattt

SEQ ID NO: 3556637 - DNA, 21 bp, Homo sapiens
ggaccactgggtgagagagga

SEQ ID NO: 3556638 - DNA, 17 bp, Homo sapiens
ggaccagggttggcacc

SEQ ID NO: 3556639 - DNA, 14 bp, Homo sapiens
ggaccatctgctgc

SEQ ID NO: 3556640 - DNA, 19 bp, Homo sapiens
ggaccatctgctgcagtta

SEQ ID NO: 3556641 - DNA, 17 bp, Homo sapiens
ggaccccagccatccag

SEQ ID NO: 3556642 - DNA, 19 bp, Homo sapiens
ggaccccgagaaccctgag

SEQ ID NO: 3556643 - DNA, 16 bp, Homo sapiens
ggaccctcgagagcct

SEQ ID NO: 3556644 - DNA, 18 bp, Homo sapiens
ggaccctcgagagcctta

SEQ ID NO: 3556645 - DNA, 15 bp, Homo sapiens
ggaccctgtcctgca

SEQ ID NO: 3556646 - DNA, 16 bp, Homo sapiens
ggaccctgtcctgcag

SEQ ID NO: 3556647 - DNA, 22 bp, Homo sapiens
ggacccttctgggtccagggag

SEQ ID NO: 3556648 - DNA, 20 bp, Homo sapiens
ggacccttgattcattctga

SEQ ID NO: 3556649 - DNA, 14 bp, Homo sapiens
ggaccggtgctgca

SEQ ID NO: 3556650 - DNA, 16 bp, Homo sapiens
ggacctgagagcatct

SEQ ID NO: 3556651 - DNA, 17 bp, Homo sapiens
ggacctgagagcatctc

SEQ ID NO: 3556652 - DNA, 18 bp, Homo sapiens
ggacctgtggtcatgtga

SEQ ID NO: 3556653 - DNA, 18 bp, Homo sapiens
ggaccttcgggctgtgcc

SEQ ID NO: 3556654 - DNA, 19 bp, Homo sapiens
ggaccttcgggctgtgccc

SEQ ID NO: 3556655 - DNA, 23 bp, Homo sapiens
ggacctttaacttttttttctct

SEQ ID NO: 3556656 - DNA, 15 bp, Homo sapiens
ggacgatcaggagga

SEQ ID NO: 3556657 - DNA, 22 bp, Homo sapiens
ggacgttagactgttgggacag

SEQ ID NO: 3556658 - DNA, 17 bp, Homo sapiens
ggacgttaggccaggcc

SEQ ID NO: 3556659 - DNA, 19 bp, Homo sapiens
ggactagagggacctctcc

SEQ ID NO: 3556660 - DNA, 21 bp, Homo sapiens
ggactagagggacctctccca

SEQ ID NO: 3556661 - DNA, 13 bp, Homo sapiens
ggactcaggatcc

SEQ ID NO: 3556662 - DNA, 18 bp, Homo sapiens
ggactcaggatccagtga

SEQ ID NO: 3556663 - DNA, 19 bp, Homo sapiens
ggactcaggatccagtgac

SEQ ID NO: 3556664 - DNA, 22 bp, Homo sapiens
ggactcattttaaaaaatggaa

SEQ ID NO: 3556665 - DNA, 17 bp, Homo sapiens
ggactccatttctttct

SEQ ID NO: 3556666 - DNA, 12 bp, Homo sapiens
ggactcctggca

SEQ ID NO: 3556667 - DNA, 13 bp, Homo sapiens
ggactcctggcag

SEQ ID NO: 3556668 - DNA, 16 bp, Homo sapiens
ggactcggagggtgcc

SEQ ID NO: 3556669 - DNA, 14 bp, Homo sapiens
ggactctctccagg

SEQ ID NO: 3556670 - DNA, 22 bp, Homo sapiens
ggactctctccaggagggctcg

SEQ ID NO: 3556671 - DNA, 16 bp, Homo sapiens
ggactgaaaacctctc

SEQ ID NO: 3556672 - DNA, 17 bp, Homo sapiens
ggactgccaggctgttt

SEQ ID NO: 3556673 - DNA, 21 bp, Homo sapiens
ggactgccagtccccctgccc

SEQ ID NO: 3556674 - DNA, 11 bp, Homo sapiens
ggactgccccc

SEQ ID NO: 3556675 - DNA, 14 bp, Homo sapiens
ggactgcccccaga

SEQ ID NO: 3556676 - DNA, 23 bp, Homo sapiens
ggactggttctgaggccagaaag

SEQ ID NO: 3556677 - DNA, 23 bp, Homo sapiens
ggacttaagcatctggctctaat

SEQ ID NO: 3556678 - DNA, 18 bp, Homo sapiens
ggacttcctgtccagctc

SEQ ID NO: 3556679 - DNA, 20 bp, Homo sapiens
ggacttcctgtccagctcca

SEQ ID NO: 3556680 - DNA, 15 bp, Homo sapiens
ggacttgtgattggc

SEQ ID NO: 3556681 - DNA, 17 bp, Homo sapiens
ggacttgtgattggctg

SEQ ID NO: 3556682 - DNA, 19 bp, Homo sapiens
ggacttgtgattggctgca

SEQ ID NO: 3556683 - DNA, 16 bp, Homo sapiens
ggacttgtgtctctgt

SEQ ID NO: 3556684 - DNA, 16 bp, Homo sapiens
ggactttatttatttc

SEQ ID NO: 3556685 - DNA, 19 bp, Homo sapiens
ggagaaaaaaaaagcaaat

SEQ ID NO: 3556686 - DNA, 12 bp, Homo sapiens
ggagaaaaagaa

SEQ ID NO: 3556687 - DNA, 16 bp, Homo sapiens
ggagaaacaaaatcct

SEQ ID NO: 3556688 - DNA, 12 bp, Homo sapiens
ggagaaagagct

SEQ ID NO: 3556689 - DNA, 17 bp, Homo sapiens
ggagaaagagctgcctg

SEQ ID NO: 3556690 - DNA, 21 bp, Homo sapiens
ggagaaccagggctcttctca

SEQ ID NO: 3556691 - DNA, 15 bp, Homo sapiens
ggagaagagctgttc

SEQ ID NO: 3556692 - DNA, 13 bp, Homo sapiens
ggagaagccagga

SEQ ID NO: 3556693 - DNA, 15 bp, Homo sapiens
ggagaagccaggaat

SEQ ID NO: 3556694 - DNA, 12 bp, Homo sapiens
ggagaaggcctg

SEQ ID NO: 3556695 - DNA, 16 bp, Homo sapiens
ggagaaggtctgtggt

SEQ ID NO: 3556696 - DNA, 17 bp, Homo sapiens
ggagaaggtctgtggtg

SEQ ID NO: 3556697 - DNA, 22 bp, Homo sapiens
ggagaagtcttctatttattta

SEQ ID NO: 3556698 - DNA, 20 bp, Homo sapiens
ggagaatcacttgaacccag

SEQ ID NO: 3556699 - DNA, 22 bp, Homo sapiens
ggagaatggcatggcaggagtc

SEQ ID NO: 3556700 - DNA, 22 bp, Homo sapiens
ggagaatgtcagtatgtggaag

SEQ ID NO: 3556701 - DNA, 16 bp, Homo sapiens
ggagacaaggtgctaa

SEQ ID NO: 3556702 - DNA, 17 bp, Homo sapiens
ggagacaccctctgggg

SEQ ID NO: 3556703 - DNA, 13 bp, Homo sapiens
ggagacagaccac

SEQ ID NO: 3556704 - DNA, 19 bp, Homo sapiens
ggagacagatcactcctgg

SEQ ID NO: 3556705 - DNA, 16 bp, Homo sapiens
ggagacagcagtttcc

SEQ ID NO: 3556706 - DNA, 19 bp, Homo sapiens
ggagacagcttctctgcag

SEQ ID NO: 3556707 - DNA, 20 bp, Homo sapiens
ggagacaggcagggagggct

SEQ ID NO: 3556708 - DNA, 13 bp, Homo sapiens
ggagaccaggctc

SEQ ID NO: 3556709 - DNA, 22 bp, Homo sapiens
ggagagagccaggatgcccaga

SEQ ID NO: 3556710 - DNA, 15 bp, Homo sapiens
ggagagccccatggt

SEQ ID NO: 3556711 - DNA, 18 bp, Homo sapiens
ggagagccccatggtggg

SEQ ID NO: 3556712 - DNA, 18 bp, Homo sapiens
ggagagggcccaggtccc

SEQ ID NO: 3556713 - DNA, 22 bp, Homo sapiens
ggagaggtgattctcagggctg

SEQ ID NO: 3556714 - DNA, 18 bp, Homo sapiens
ggagataaggtggcttct

SEQ ID NO: 3556715 - DNA, 12 bp, Homo sapiens
ggagatggaggg

SEQ ID NO: 3556716 - DNA, 15 bp, Homo sapiens
ggagatggagggctt

SEQ ID NO: 3556717 - DNA, 20 bp, Homo sapiens
ggagatggggaataatttcc

SEQ ID NO: 3556718 - DNA, 20 bp, Homo sapiens
ggagatttggaatacacatg

SEQ ID NO: 3556719 - DNA, 15 bp, Homo sapiens
ggagcaagcaggagt

SEQ ID NO: 3556720 - DNA, 19 bp, Homo sapiens
ggagcacccagagcacccc

SEQ ID NO: 3556721 - DNA, 16 bp, Homo sapiens
ggagcagcaggcctct

SEQ ID NO: 3556722 - DNA, 12 bp, Homo sapiens
ggagcagccccc

SEQ ID NO: 3556723 - DNA, 12 bp, Homo sapiens
ggagcaggccca

SEQ ID NO: 3556724 - DNA, 13 bp, Homo sapiens
ggagcaggcccaa

SEQ ID NO: 3556725 - DNA, 18 bp, Homo sapiens
ggagcaggcttgtggcag

SEQ ID NO: 3556726 - DNA, 18 bp, Homo sapiens
ggagcaggttccccaagg

SEQ ID NO: 3556727 - DNA, 20 bp, Homo sapiens
ggagcatttaatggcagcta

SEQ ID NO: 3556728 - DNA, 24 bp, Homo sapiens
ggagcatttaatggcagctagtgc

SEQ ID NO: 3556729 - DNA, 18 bp, Homo sapiens
ggagccaagggatggaca

SEQ ID NO: 3556730 - DNA, 14 bp, Homo sapiens
ggagccaccagttc

SEQ ID NO: 3556731 - DNA, 11 bp, Homo sapiens
ggagccaggac

SEQ ID NO: 3556732 - DNA, 14 bp, Homo sapiens
ggagccaggactcc

SEQ ID NO: 3556733 - DNA, 18 bp, Homo sapiens
ggagccaggactcccaga

SEQ ID NO: 3556734 - DNA, 12 bp, Homo sapiens
ggagcccactgt

SEQ ID NO: 3556735 - DNA, 17 bp, Homo sapiens
ggagcccactgtcctgg

SEQ ID NO: 3556736 - DNA, 23 bp, Homo sapiens
ggagcccactgtcctgggcctgc

SEQ ID NO: 3556737 - DNA, 14 bp, Homo sapiens
ggagcccagaaccc

SEQ ID NO: 3556738 - DNA, 13 bp, Homo sapiens
ggagcccagaggg

SEQ ID NO: 3556739 - DNA, 21 bp, Homo sapiens
ggagccccgccaggtgcccgc

SEQ ID NO: 3556740 - DNA, 15 bp, Homo sapiens
ggagccgaagcccag

SEQ ID NO: 3556741 - DNA, 18 bp, Homo sapiens
ggagccggtaactgtcct

SEQ ID NO: 3556742 - DNA, 16 bp, Homo sapiens
ggagcctacctctgtc

SEQ ID NO: 3556743 - DNA, 22 bp, Homo sapiens
ggagcctacctctgtctgagac

SEQ ID NO: 3556744 - DNA, 20 bp, Homo sapiens
ggagcctagcggagcccagc

SEQ ID NO: 3556745 - DNA, 23 bp, Homo sapiens
ggagcctagcggagcccagcctg

SEQ ID NO: 3556746 - DNA, 18 bp, Homo sapiens
ggagcctgaagggtgcct

SEQ ID NO: 3556747 - DNA, 17 bp, Homo sapiens
ggctagctgtgctggta

SEQ ID NO: 3556748 - DNA, 16 bp, Homo sapiens
ggctagtcaagctcct

SEQ ID NO: 3556749 - DNA, 13 bp, Homo sapiens
ggctatgaacaga

SEQ ID NO: 3556750 - DNA, 19 bp, Homo sapiens
ggctatgggggcactgagg

SEQ ID NO: 3556751 - DNA, 16 bp, Homo sapiens
ggctcacacctgtaat

SEQ ID NO: 3556752 - DNA, 15 bp, Homo sapiens
ggctcactggcaggt

SEQ ID NO: 3556753 - DNA, 20 bp, Homo sapiens
ggctcactggcaggtgtggg

SEQ ID NO: 3556754 - DNA, 12 bp, Homo sapiens
ggctcaggagaa

SEQ ID NO: 3556755 - DNA, 12 bp, Homo sapiens
ggctccagctca

SEQ ID NO: 3556756 - DNA, 17 bp, Homo sapiens
ggctcccacaggccctt

SEQ ID NO: 3556757 - DNA, 18 bp, Homo sapiens
ggctcccacaggcccttc

SEQ ID NO: 3556758 - DNA, 17 bp, Homo sapiens
ggctcccatgtcaagag

SEQ ID NO: 3556759 - DNA, 19 bp, Homo sapiens
ggctcccgggggccccacc

SEQ ID NO: 3556760 - DNA, 19 bp, Homo sapiens
ggctccctcttcctctcca

SEQ ID NO: 3556761 - DNA, 16 bp, Homo sapiens
ggctcctcctcaccca

SEQ ID NO: 3556762 - DNA, 19 bp, Homo sapiens
ggctcctcctcacccacct

SEQ ID NO: 3556763 - DNA, 22 bp, Homo sapiens
ggctcctcctcacccacctctg

SEQ ID NO: 3556764 - DNA, 20 bp, Homo sapiens
ggctcctcttagctcagctg

SEQ ID NO: 3556765 - DNA, 23 bp, Homo sapiens
ggctcctgcaaaaggaggtgaaa

SEQ ID NO: 3556766 - DNA, 22 bp, Homo sapiens
ggctcgccgtgtctcagcctct

SEQ ID NO: 3556767 - DNA, 20 bp, Homo sapiens
ggctctgcacagacaagcag

SEQ ID NO: 3556768 - DNA, 18 bp, Homo sapiens
ggctctgccccctccccc

SEQ ID NO: 3556769 - DNA, 14 bp, Homo sapiens
ggctctgccccgca

SEQ ID NO: 3556770 - DNA, 17 bp, Homo sapiens
ggctctgggtgctgccc

SEQ ID NO: 3556771 - DNA, 16 bp, Homo sapiens
ggctcttctgagcaga

SEQ ID NO: 3556772 - DNA, 20 bp, Homo sapiens
ggctgaaatatccacccagc

SEQ ID NO: 3556773 - DNA, 22 bp, Homo sapiens
ggctgaaatatccacccagcag

SEQ ID NO: 3556774 - DNA, 21 bp, Homo sapiens
ggctgacatgctcacacatta

SEQ ID NO: 3556775 - DNA, 17 bp, Homo sapiens
ggctgacccagcatctc

SEQ ID NO: 3556776 - DNA, 18 bp, Homo sapiens
ggctgacccagcatctcc

SEQ ID NO: 3556777 - DNA, 12 bp, Homo sapiens
ggctgacccctc

SEQ ID NO: 3556778 - DNA, 13 bp, Homo sapiens
ggctgacccctct

SEQ ID NO: 3556779 - DNA, 18 bp, Homo sapiens
ggctgagcccctggggaa

SEQ ID NO: 3556780 - DNA, 13 bp, Homo sapiens
ggctgaggagcag

SEQ ID NO: 3556781 - DNA, 18 bp, Homo sapiens
ggctgagggtcgtgggaa

SEQ ID NO: 3556782 - DNA, 16 bp, Homo sapiens
ggctgagtggcagcag

SEQ ID NO: 3556783 - DNA, 16 bp, Homo sapiens
ggctgcacaacagccc

SEQ ID NO: 3556784 - DNA, 18 bp, Homo sapiens
ggctgcacaacagccctg

SEQ ID NO: 3556785 - DNA, 14 bp, Homo sapiens
ggctgcacaggctg

SEQ ID NO: 3556786 - DNA, 22 bp, Homo sapiens
ggctgcacctcctaccctccca

SEQ ID NO: 3556787 - DNA, 13 bp, Homo sapiens
ggctgcaggcagg

SEQ ID NO: 3556788 - DNA, 18 bp, Homo sapiens
ggctgccaggggctctgt

SEQ ID NO: 3556789 - DNA, 22 bp, Homo sapiens
ggctgccaggggctctgtggca

SEQ ID NO: 3556790 - DNA, 12 bp, Homo sapiens
ggctgcccagga

SEQ ID NO: 3556791 - DNA, 23 bp, Homo sapiens
ggctgcccaggagacagaccact

SEQ ID NO: 3556792 - DNA, 14 bp, Homo sapiens
ggctgccctggtgc

SEQ ID NO: 3556793 - DNA, 16 bp, Homo sapiens
ggctgccctggtgctg

SEQ ID NO: 3556794 - DNA, 15 bp, Homo sapiens
ggctgccgagccacc

SEQ ID NO: 3556795 - DNA, 18 bp, Homo sapiens
ggctgccgagccaccatg

SEQ ID NO: 3556796 - DNA, 18 bp, Homo sapiens
ggctgcttaaactggaaa

SEQ ID NO: 3556797 - DNA, 19 bp, Homo sapiens
ggctggaaagcagagcctc

SEQ ID NO: 3556798 - DNA, 16 bp, Homo sapiens
ggctggagcctggggt

SEQ ID NO: 3556799 - DNA, 17 bp, Homo sapiens
ggctggagttggggcag

SEQ ID NO: 3556800 - DNA, 18 bp, Homo sapiens
ggctggcacgtgacaggc

SEQ ID NO: 3556801 - DNA, 19 bp, Homo sapiens
ggctgggggaggtccaagc

SEQ ID NO: 3556802 - DNA, 13 bp, Homo sapiens
ggctggtagcagc

SEQ ID NO: 3556803 - DNA, 20 bp, Homo sapiens
ggctggtagcagcaggctca

SEQ ID NO: 3556804 - DNA, 21 bp, Homo sapiens
ggctggtagcagcaggctcag

SEQ ID NO: 3556805 - DNA, 22 bp, Homo sapiens
ggctggtagcagcaggctcagg

SEQ ID NO: 3556806 - DNA, 17 bp, Homo sapiens
ggctggtgaggtcctgg

SEQ ID NO: 3556807 - DNA, 16 bp, Homo sapiens
ggctggtgggaaggcc

SEQ ID NO: 3556808 - DNA, 22 bp, Homo sapiens
ggctgtaaatcctagacttgaa

SEQ ID NO: 3556809 - DNA, 12 bp, Homo sapiens
ggctgtacatag

SEQ ID NO: 3556810 - DNA, 21 bp, Homo sapiens
ggctgtccttaacccacctct

SEQ ID NO: 3556811 - DNA, 11 bp, Homo sapiens
ggctgtgccaa

SEQ ID NO: 3556812 - DNA, 16 bp, Homo sapiens
ggctgtgttatgaaaa

SEQ ID NO: 3556813 - DNA, 17 bp, Homo sapiens
ggctgttaaaaaaaaga

SEQ ID NO: 3556814 - DNA, 14 bp, Homo sapiens
ggctgttaccattt

SEQ ID NO: 3556815 - DNA, 15 bp, Homo sapiens
ggcttaaagggatgg

SEQ ID NO: 3556816 - DNA, 22 bp, Homo sapiens
ggcttaataatattaataagaa

SEQ ID NO: 3556817 - DNA, 21 bp, Homo sapiens
ggcttaattattgatgttttc

SEQ ID NO: 3556818 - DNA, 17 bp, Homo sapiens
ggcttcaacagccaagc

SEQ ID NO: 3556819 - DNA, 14 bp, Homo sapiens
ggcttcccgctcag

SEQ ID NO: 3556820 - DNA, 15 bp, Homo sapiens
ggcttcccgctcagc

SEQ ID NO: 3556821 - DNA, 17 bp, Homo sapiens
ggcttcccgctcagccc

SEQ ID NO: 3556822 - DNA, 20 bp, Homo sapiens
ggcttccctggaagctctcc

SEQ ID NO: 3556823 - DNA, 24 bp, Homo sapiens
ggctttaaagctgagagaccctgg

SEQ ID NO: 3556824 - DNA, 12 bp, Homo sapiens
ggctttctcttc

SEQ ID NO: 3556825 - DNA, 18 bp, Homo sapiens
ggctttgcccacccctca

SEQ ID NO: 3556826 - DNA, 21 bp, Homo sapiens
ggctttgcccacccctcactc

SEQ ID NO: 3556827 - DNA, 17 bp, Homo sapiens
ggctttgcctcttcttt

SEQ ID NO: 3556828 - DNA, 21 bp, Homo sapiens
ggctttgggaagtttgctgtg

SEQ ID NO: 3556829 - DNA, 20 bp, Homo sapiens
ggctttgttgtgagaatggc

SEQ ID NO: 3556830 - DNA, 13 bp, Homo sapiens
ggcttttcactgc

SEQ ID NO: 3556831 - DNA, 17 bp, Homo sapiens
ggcttttcactgctggc

SEQ ID NO: 3556832 - DNA, 19 bp, Homo sapiens
ggcttttcactgctggctg

SEQ ID NO: 3556833 - DNA, 22 bp, Homo sapiens
ggcttttcactgctggctgcct

SEQ ID NO: 3556834 - DNA, 13 bp, Homo sapiens
gggaaaagcagct

SEQ ID NO: 3556835 - DNA, 19 bp, Homo sapiens
gggaaacactgaaatgaaa

SEQ ID NO: 3556836 - DNA, 13 bp, Homo sapiens
gggaaagcctctg

SEQ ID NO: 3556837 - DNA, 16 bp, Homo sapiens
gggaaagcgggcagcc

SEQ ID NO: 3556838 - DNA, 18 bp, Homo sapiens
gggaaagcgggcagcccc

SEQ ID NO: 3556839 - DNA, 23 bp, Homo sapiens
gggaaagtgtgagctcttccctt

SEQ ID NO: 3556840 - DNA, 17 bp, Homo sapiens
gggaacactgagaaaga

SEQ ID NO: 3556841 - DNA, 21 bp, Homo sapiens
gggaaccactcccaccacagg

SEQ ID NO: 3556842 - DNA, 16 bp, Homo sapiens
gggaagacagtggccc

SEQ ID NO: 3556843 - DNA, 16 bp, Homo sapiens
gggaaggccagccttg

SEQ ID NO: 3556844 - DNA, 21 bp, Homo sapiens
gggaagggagccaagggatgg

SEQ ID NO: 3556845 - DNA, 20 bp, Homo sapiens
gggaagtcgggcatggtggc

SEQ ID NO: 3556846 - DNA, 18 bp, Homo sapiens
gggaagtttgctgtgctt

SEQ ID NO: 3556847 - DNA, 22 bp, Homo sapiens
gggaataatttccttcaggcag

SEQ ID NO: 3556848 - DNA, 14 bp, Homo sapiens
gggaatgcagcagg

SEQ ID NO: 3556849 - DNA, 14 bp, Homo sapiens
gggaatgggagagg

SEQ ID NO: 3556850 - DNA, 20 bp, Homo sapiens
gggacagaggccccagcctc

SEQ ID NO: 3556851 - DNA, 13 bp, Homo sapiens
gggacagcttcct

SEQ ID NO: 3556852 - DNA, 14 bp, Homo sapiens
gggacagcttcctc

SEQ ID NO: 3556853 - DNA, 22 bp, Homo sapiens
gggacaggaccccagctctgcg

SEQ ID NO: 3556854 - DNA, 12 bp, Homo sapiens
gggacaggctga

SEQ ID NO: 3556855 - DNA, 19 bp, Homo sapiens
gggacaggctgaagagagg

SEQ ID NO: 3556856 - DNA, 22 bp, Homo sapiens
gggaccaattctggacagacag

SEQ ID NO: 3556857 - DNA, 16 bp, Homo sapiens
gggacctctcccaggg

SEQ ID NO: 3556858 - DNA, 23 bp, Homo sapiens
gggacctctcccagggtccctgg

SEQ ID NO: 3556859 - DNA, 14 bp, Homo sapiens
gggacctttaactt

SEQ ID NO: 3556860 - DNA, 18 bp, Homo sapiens
gggactacctctgtgcct

SEQ ID NO: 3556861 - DNA, 18 bp, Homo sapiens
gggactgaaaacctctcc

SEQ ID NO: 3556862 - DNA, 19 bp, Homo sapiens
gggactgaaaacctctcct

SEQ ID NO: 3556863 - DNA, 17 bp, Homo sapiens
gggactgccaggctgtt

SEQ ID NO: 3556864 - DNA, 16 bp, Homo sapiens
gggagaaaaaaaaagc

SEQ ID NO: 3556865 - DNA, 20 bp, Homo sapiens
gggagaaaaaaaaagcaaat

SEQ ID NO: 3556866 - DNA, 23 bp, Homo sapiens
gggagaatgtcaaggaagacttt

SEQ ID NO: 3556867 - DNA, 22 bp, Homo sapiens
gggagaatgtcagtatgtggaa

SEQ ID NO: 3556868 - DNA, 15 bp, Homo sapiens
gggagagcggctgga

SEQ ID NO: 3556869 - DNA, 14 bp, Homo sapiens
gggagccaagggat

SEQ ID NO: 3556870 - DNA, 15 bp, Homo sapiens
gggagccaagggatg

SEQ ID NO: 3556871 - DNA, 13 bp, Homo sapiens
gggagccaggact

SEQ ID NO: 3556872 - DNA, 19 bp, Homo sapiens
gggagccaggactcccaga

SEQ ID NO: 3556873 - DNA, 20 bp, Homo sapiens
gggagcccactgtcctgggc

SEQ ID NO: 3556874 - DNA, 21 bp, Homo sapiens
gggagcccactgtcctgggcc

SEQ ID NO: 3556875 - DNA, 14 bp, Homo sapiens
gggagccctagccc

SEQ ID NO: 3556876 - DNA, 21 bp, Homo sapiens
gggagccctagccctgctcca

SEQ ID NO: 3556877 - DNA, 18 bp, Homo sapiens
gggagcctagctcctgcc

SEQ ID NO: 3556878 - DNA, 16 bp, Homo sapiens
gggagccttgtcagtg

SEQ ID NO: 3556879 - DNA, 20 bp, Homo sapiens
ggtggccactccagacccct

SEQ ID NO: 3556880 - DNA, 23 bp, Homo sapiens
ggtggccactccagacccctggc

SEQ ID NO: 3556881 - DNA, 16 bp, Homo sapiens
ggtggcccgacagcct

SEQ ID NO: 3556882 - DNA, 17 bp, Homo sapiens
ggtggcccgacagcctg

SEQ ID NO: 3556883 - DNA, 18 bp, Homo sapiens
ggtggcctggaggtgggc

SEQ ID NO: 3556884 - DNA, 20 bp, Homo sapiens
ggtggctagtcaagctcctc

SEQ ID NO: 3556885 - DNA, 23 bp, Homo sapiens
ggtggctctgggaatgggagagg

SEQ ID NO: 3556886 - DNA, 18 bp, Homo sapiens
ggtggctgccccggcctc

SEQ ID NO: 3556887 - DNA, 12 bp, Homo sapiens
ggtgggcagtgg

SEQ ID NO: 3556888 - DNA, 12 bp, Homo sapiens
ggtgggccaggc

SEQ ID NO: 3556889 - DNA, 13 bp, Homo sapiens
ggtgggggtgctg

SEQ ID NO: 3556890 - DNA, 22 bp, Homo sapiens
ggtgggtaattgtacaataaat

SEQ ID NO: 3556891 - DNA, 23 bp, Homo sapiens
ggtggttgctgttttcctccctt

SEQ ID NO: 3556892 - DNA, 16 bp, Homo sapiens
ggtgtaacttcctgct

SEQ ID NO: 3556893 - DNA, 18 bp, Homo sapiens
ggtgtccccaccatctgc

SEQ ID NO: 3556894 - DNA, 13 bp, Homo sapiens
ggtgtcctgagca

SEQ ID NO: 3556895 - DNA, 14 bp, Homo sapiens
ggtgtgaggagaga

SEQ ID NO: 3556896 - DNA, 19 bp, Homo sapiens
ggtgtgtggtgaggggctt

SEQ ID NO: 3556897 - DNA, 17 bp, Homo sapiens
ggtgttaattttgctaa

SEQ ID NO: 3556898 - DNA, 22 bp, Homo sapiens
ggtgttaattttgctaactggg

SEQ ID NO: 3556899 - DNA, 15 bp, Homo sapiens
ggtgttctgtctggg

SEQ ID NO: 3556900 - DNA, 13 bp, Homo sapiens
ggtgtttgtcatg

SEQ ID NO: 3556901 - DNA, 19 bp, Homo sapiens
ggttaatcatatttgaaaa

SEQ ID NO: 3556902 - DNA, 13 bp, Homo sapiens
ggttacctggaga

SEQ ID NO: 3556903 - DNA, 23 bp, Homo sapiens
ggttattttgatgtaaagatgtt

SEQ ID NO: 3556904 - DNA, 13 bp, Homo sapiens
ggttcaatttttt

SEQ ID NO: 3556905 - DNA, 14 bp, Homo sapiens
ggttcacctgtgac

SEQ ID NO: 3556906 - DNA, 15 bp, Homo sapiens
ggttcagacacagct

SEQ ID NO: 3556907 - DNA, 16 bp, Homo sapiens
ggttccatgttgactg

SEQ ID NO: 3556908 - DNA, 20 bp, Homo sapiens
ggttcctgaaatatccagga

SEQ ID NO: 3556909 - DNA, 18 bp, Homo sapiens
ggttcctggtgactcctg

SEQ ID NO: 3556910 - DNA, 13 bp, Homo sapiens
ggttccttctctg

SEQ ID NO: 3556911 - DNA, 19 bp, Homo sapiens
ggttcgtgctgtgctctgg

SEQ ID NO: 3556912 - DNA, 20 bp, Homo sapiens
ggttctgtgctaatcaaaac

SEQ ID NO: 3556913 - DNA, 22 bp, Homo sapiens
ggttctgtgtcctctgcctggg

SEQ ID NO: 3556914 - DNA, 16 bp, Homo sapiens
ggttctttcttcctct

SEQ ID NO: 3556915 - DNA, 21 bp, Homo sapiens
ggttgagtgtgtggtctctgc

SEQ ID NO: 3556916 - DNA, 15 bp, Homo sapiens
ggttgatggaaaata

SEQ ID NO: 3556917 - DNA, 16 bp, Homo sapiens
ggttgatggaaaataa

SEQ ID NO: 3556918 - DNA, 18 bp, Homo sapiens
ggttgcgtctgaggcctg

SEQ ID NO: 3556919 - DNA, 16 bp, Homo sapiens
ggttgctcctttgatt

SEQ ID NO: 3556920 - DNA, 19 bp, Homo sapiens
ggttgctggtcctgcacat

SEQ ID NO: 3556921 - DNA, 18 bp, Homo sapiens
ggttgctgttttcctccc

SEQ ID NO: 3556922 - DNA, 20 bp, Homo sapiens
ggttgtggggcctcaggctc

SEQ ID NO: 3556923 - DNA, 15 bp, Homo sapiens
ggttgtgttgaggtt

SEQ ID NO: 3556924 - DNA, 17 bp, Homo sapiens
ggtttaggctggtggcc

SEQ ID NO: 3556925 - DNA, 13 bp, Homo sapiens
ggtttattctttg

SEQ ID NO: 3556926 - DNA, 22 bp, Homo sapiens
ggtttcacatggttacatatca

SEQ ID NO: 3556927 - DNA, 17 bp, Homo sapiens
ggtttcccattggttca

SEQ ID NO: 3556928 - DNA, 17 bp, Homo sapiens
ggtttcgactggtccag

SEQ ID NO: 3556929 - DNA, 19 bp, Homo sapiens
ggtttcgactggtccagct

SEQ ID NO: 3556930 - DNA, 15 bp, Homo sapiens
ggtttcgatatttat

SEQ ID NO: 3556931 - DNA, 15 bp, Homo sapiens
ggtttgggagccagg

SEQ ID NO: 3556932 - DNA, 17 bp, Homo sapiens
ggtttgggagccaggac

SEQ ID NO: 3556933 - DNA, 19 bp, Homo sapiens
ggtttgtgtttgattggct

SEQ ID NO: 3556934 - DNA, 22 bp, Homo sapiens
ggtttgtttagaagaagtgtgt

SEQ ID NO: 3556935 - DNA, 20 bp, Homo sapiens
ggtttttaaatatatatttt

SEQ ID NO: 3556936 - DNA, 13 bp, Homo sapiens
ggtttttcaatta

SEQ ID NO: 3556937 - DNA, 16 bp, Homo sapiens
ggtttttcaattaaac

SEQ ID NO: 3556938 - DNA, 17 bp, Homo sapiens
ggtttttcaattaaacg

SEQ ID NO: 3556939 - DNA, 18 bp, Homo sapiens
ggtttttcaattaaacgg

SEQ ID NO: 3556940 - DNA, 15 bp, Homo sapiens
ggtttttgaaatcca

SEQ ID NO: 3556941 - DNA, 22 bp, Homo sapiens
ggtttttttctttggctgcagg

SEQ ID NO: 3556942 - DNA, 19 bp, Homo sapiens
gtaaaaaaaaaaacaatta

SEQ ID NO: 3556943 - DNA, 12 bp, Homo sapiens
gtaaaaatacaa

SEQ ID NO: 3556944 - DNA, 14 bp, Homo sapiens
gtaaaaccacagca

SEQ ID NO: 3556945 - DNA, 15 bp, Homo sapiens
gtaaaaccacagcag

SEQ ID NO: 3556946 - DNA, 16 bp, Homo sapiens
gtaaaaccacagcagt

SEQ ID NO: 3556947 - DNA, 23 bp, Homo sapiens
gtaaaaccacagcagttgaaaag

SEQ ID NO: 3556948 - DNA, 14 bp, Homo sapiens
gtaaaacttctgct

SEQ ID NO: 3556949 - DNA, 15 bp, Homo sapiens
gtaaaacttctgctc

SEQ ID NO: 3556950 - DNA, 12 bp, Homo sapiens
gtaaaagaaaaa

SEQ ID NO: 3556951 - DNA, 17 bp, Homo sapiens
gtaaaatttcaggatta

SEQ ID NO: 3556952 - DNA, 23 bp, Homo sapiens
gtaaactcaaaatatttgtacat

SEQ ID NO: 3556953 - DNA, 19 bp, Homo sapiens
gtaaagcaaccaaaaagaa

SEQ ID NO: 3556954 - DNA, 15 bp, Homo sapiens
gtaaagtctgggcca

SEQ ID NO: 3556955 - DNA, 17 bp, Homo sapiens
gtaaatacatgcatata

SEQ ID NO: 3556956 - DNA, 19 bp, Homo sapiens
gtaaatactttccatgttt

SEQ ID NO: 3556957 - DNA, 20 bp, Homo sapiens
gtaaatcccagactgacaga

SEQ ID NO: 3556958 - DNA, 16 bp, Homo sapiens
gtaaatggtatgtcat

SEQ ID NO: 3556959 - DNA, 12 bp, Homo sapiens
gtaaatgtctgc

SEQ ID NO: 3556960 - DNA, 17 bp, Homo sapiens
gtaaatgtctgcactga

SEQ ID NO: 3556961 - DNA, 17 bp, Homo sapiens
gtaaatttatgtgatgg

SEQ ID NO: 3556962 - DNA, 22 bp, Homo sapiens
gtaaattttttacgtagctatt

SEQ ID NO: 3556963 - DNA, 18 bp, Homo sapiens
gtaacaaaggtttaaagt

SEQ ID NO: 3556964 - DNA, 17 bp, Homo sapiens
gtaacagacacacgatg

SEQ ID NO: 3556965 - DNA, 22 bp, Homo sapiens
gtaacaggatacaggtgacagt

SEQ ID NO: 3556966 - DNA, 21 bp, Homo sapiens
gtaaccctggtggttgctgtt

SEQ ID NO: 3556967 - DNA, 20 bp, Homo sapiens
gtaactaaaataattttgta

SEQ ID NO: 3556968 - DNA, 12 bp, Homo sapiens
gtaactacttta

SEQ ID NO: 3556969 - DNA, 22 bp, Homo sapiens
gtaactgtttagatgaatgtca

SEQ ID NO: 3556970 - DNA, 19 bp, Homo sapiens
gtaacttccaaataaataa

SEQ ID NO: 3556971 - DNA, 13 bp, Homo sapiens
gtaacttcctgct

SEQ ID NO: 3556972 - DNA, 16 bp, Homo sapiens
gtaacttcctgctgca

SEQ ID NO: 3556973 - DNA, 17 bp, Homo sapiens
gtaacttgagattcaag

SEQ ID NO: 3556974 - DNA, 14 bp, Homo sapiens
gtaacttttgtaag

SEQ ID NO: 3556975 - DNA, 15 bp, Homo sapiens
gtaacttttgtaaga

SEQ ID NO: 3556976 - DNA, 22 bp, Homo sapiens
gtaaggcatactgccttgttta

SEQ ID NO: 3556977 - DNA, 11 bp, Homo sapiens
gtaaggctgta

SEQ ID NO: 3556978 - DNA, 12 bp, Homo sapiens
gtaaggctgtac

SEQ ID NO: 3556979 - DNA, 18 bp, Homo sapiens
gtaagggaaactgccagc

SEQ ID NO: 3556980 - DNA, 11 bp, Homo sapiens
gtaagggcagt

SEQ ID NO: 3556981 - DNA, 12 bp, Homo sapiens
gtaagggcagtg

SEQ ID NO: 3556982 - DNA, 15 bp, Homo sapiens
gtaagtttatccaaa

SEQ ID NO: 3556983 - DNA, 16 bp, Homo sapiens
gtaagtttatccaaat

SEQ ID NO: 3556984 - DNA, 13 bp, Homo sapiens
gtaataatagact

SEQ ID NO: 3556985 - DNA, 19 bp, Homo sapiens
gtaatacgtagctctctta

SEQ ID NO: 3556986 - DNA, 13 bp, Homo sapiens
gtaataggcattt

SEQ ID NO: 3556987 - DNA, 16 bp, Homo sapiens
gtaataggcattttaa

SEQ ID NO: 3556988 - DNA, 19 bp, Homo sapiens
gtaatattgacttgtatat

SEQ ID NO: 3556989 - DNA, 20 bp, Homo sapiens
gtaatcattttaaattccac

SEQ ID NO: 3556990 - DNA, 21 bp, Homo sapiens
gtaatgacaaaagatacaaaa

SEQ ID NO: 3556991 - DNA, 17 bp, Homo sapiens
gtaatgcattgcctgta

SEQ ID NO: 3556992 - DNA, 22 bp, Homo sapiens
gtaatgctgcctcaggacccat

SEQ ID NO: 3556993 - DNA, 18 bp, Homo sapiens
gtaatgtttttatttcaa

SEQ ID NO: 3556994 - DNA, 21 bp, Homo sapiens
gtaattagtgccacttaatgt

SEQ ID NO: 3556995 - DNA, 12 bp, Homo sapiens
gtaattgggaac

SEQ ID NO: 3556996 - DNA, 13 bp, Homo sapiens
gtaattgtacaat

SEQ ID NO: 3556997 - DNA, 16 bp, Homo sapiens
gtaattgtacaataaa

SEQ ID NO: 3556998 - DNA, 20 bp, Homo sapiens
gtaatttagaagatattatt

SEQ ID NO: 3556999 - DNA, 12 bp, Homo sapiens
gtaatttctgcc

SEQ ID NO: 3557000 - DNA, 12 bp, Homo sapiens
gtacaaaataaa

SEQ ID NO: 3557001 - DNA, 14 bp, Homo sapiens
gtacaaactcagat

SEQ ID NO: 3557002 - DNA, 18 bp, Homo sapiens
gtacaaactcagatcctt

SEQ ID NO: 3557003 - DNA, 22 bp, Homo sapiens
gtacaaatgccttaaaatggaa

SEQ ID NO: 3557004 - DNA, 20 bp, Homo sapiens
gtacaaccccctccaccccc

SEQ ID NO: 3557005 - DNA, 12 bp, Homo sapiens
gtacaataaatt

SEQ ID NO: 3557006 - DNA, 15 bp, Homo sapiens
gtacaataaattttt

SEQ ID NO: 3557007 - DNA, 20 bp, Homo sapiens
gtacacaataagcaaaaaca

SEQ ID NO: 3557008 - DNA, 24 bp, Homo sapiens
gtacacacccgcctgacaccgtgg

SEQ ID NO: 3557009 - DNA, 18 bp, Homo sapiens
gtacacccatgaaagaaa

SEQ ID NO: 3557010 - DNA, 18 bp, Homo sapiens
gtacacgggaccagctca

SEQ ID NO: 3557011 - DNA, 18 bp, Homo sapiens
gtacataactcctgtccc

SEQ ID NO: 3557012 - DNA, 12 bp, Homo sapiens
gtgacatgcagt

SEQ ID NO: 3557013 - DNA, 21 bp, Homo sapiens
gtgacatgcagttatatattt

SEQ ID NO: 3557014 - DNA, 16 bp, Homo sapiens
gtgacatttctcttcc

SEQ ID NO: 3557015 - DNA, 19 bp, Homo sapiens
gtgacattttacattaaat

SEQ ID NO: 3557016 - DNA, 20 bp, Homo sapiens
gtgacattttacattaaatt

SEQ ID NO: 3557017 - DNA, 17 bp, Homo sapiens
gtgacctcactggcctg

SEQ ID NO: 3557018 - DNA, 14 bp, Homo sapiens
gtgacgtttttcca

SEQ ID NO: 3557019 - DNA, 21 bp, Homo sapiens
gtgactccccagcccagcacc

SEQ ID NO: 3557020 - DNA, 15 bp, Homo sapiens
gtgactcctgctggt

SEQ ID NO: 3557021 - DNA, 19 bp, Homo sapiens
gtgactccttatctctttc

SEQ ID NO: 3557022 - DNA, 22 bp, Homo sapiens
gtgactctcctgcctcagcctc

SEQ ID NO: 3557023 - DNA, 19 bp, Homo sapiens
gtgagaaagggattgctga

SEQ ID NO: 3557024 - DNA, 18 bp, Homo sapiens
gtgagaatggcctggagc

SEQ ID NO: 3557025 - DNA, 12 bp, Homo sapiens
gtgagacagact

SEQ ID NO: 3557026 - DNA, 12 bp, Homo sapiens
gtgagagaaaga

SEQ ID NO: 3557027 - DNA, 23 bp, Homo sapiens
gtgagagaaagagagaagccagc

SEQ ID NO: 3557028 - DNA, 11 bp, Homo sapiens
gtgagagagga

SEQ ID NO: 3557029 - DNA, 15 bp, Homo sapiens
gtgagatcaatgtga

SEQ ID NO: 3557030 - DNA, 16 bp, Homo sapiens
gtgagatcaatgtgac

SEQ ID NO: 3557031 - DNA, 14 bp, Homo sapiens
gtgagcaagcacca

SEQ ID NO: 3557032 - DNA, 13 bp, Homo sapiens
gtgagcacaaaga

SEQ ID NO: 3557033 - DNA, 16 bp, Homo sapiens
gtgagcatggggccag

SEQ ID NO: 3557034 - DNA, 18 bp, Homo sapiens
gtgagcatggggccagga

SEQ ID NO: 3557035 - DNA, 16 bp, Homo sapiens
gtgagcccctccccag

SEQ ID NO: 3557036 - DNA, 19 bp, Homo sapiens
gtgagcccctccccagcca

SEQ ID NO: 3557037 - DNA, 19 bp, Homo sapiens
gtgagctggggactcaggg

SEQ ID NO: 3557038 - DNA, 14 bp, Homo sapiens
gtgagctgtgatca

SEQ ID NO: 3557039 - DNA, 13 bp, Homo sapiens
gtgaggagctggg

SEQ ID NO: 3557040 - DNA, 15 bp, Homo sapiens
gtgaggataggacag

SEQ ID NO: 3557041 - DNA, 15 bp, Homo sapiens
gtgaggatgtctggg

SEQ ID NO: 3557042 - DNA, 19 bp, Homo sapiens
gtgaggggcaagctaggcc

SEQ ID NO: 3557043 - DNA, 16 bp, Homo sapiens
gtgaggggcaggtcta

SEQ ID NO: 3557044 - DNA, 15 bp, Homo sapiens
gtgaggggctttctc

SEQ ID NO: 3557045 - DNA, 19 bp, Homo sapiens
gtgaggggctttctcttcc

SEQ ID NO: 3557046 - DNA, 18 bp, Homo sapiens
gtgagggtaagtattttc

SEQ ID NO: 3557047 - DNA, 14 bp, Homo sapiens
gtgagggtcctgca

SEQ ID NO: 3557048 - DNA, 16 bp, Homo sapiens
gtgaggtgaactccag

SEQ ID NO: 3557049 - DNA, 17 bp, Homo sapiens
gtgaggtgaactccagg

SEQ ID NO: 3557050 - DNA, 19 bp, Homo sapiens
gtgagtcacctgctccaga

SEQ ID NO: 3557051 - DNA, 14 bp, Homo sapiens
gtgatcctgttctg

SEQ ID NO: 3557052 - DNA, 20 bp, Homo sapiens
gtgatctctgttacaaaaga

SEQ ID NO: 3557053 - DNA, 10 bp, Homo sapiens
gtgatgtgtc

SEQ ID NO: 3557054 - DNA, 16 bp, Homo sapiens
gtgattctcagggctg

SEQ ID NO: 3557055 - DNA, 21 bp, Homo sapiens
gtgattgacagctttgctgct

SEQ ID NO: 3557056 - DNA, 12 bp, Homo sapiens
gtgattggctgc

SEQ ID NO: 3557057 - DNA, 13 bp, Homo sapiens
gtgattggctgca

SEQ ID NO: 3557058 - DNA, 13 bp, Homo sapiens
gtgattggctggt

SEQ ID NO: 3557059 - DNA, 12 bp, Homo sapiens
gtgatttccatt

SEQ ID NO: 3557060 - DNA, 16 bp, Homo sapiens
gtgatttccatttctg

SEQ ID NO: 3557061 - DNA, 14 bp, Homo sapiens
gtgatttgaattct

SEQ ID NO: 3557062 - DNA, 16 bp, Homo sapiens
gtgatttttatcacaa

SEQ ID NO: 3557063 - DNA, 22 bp, Homo sapiens
gtgcaaagttccctacttcctg

SEQ ID NO: 3557064 - DNA, 21 bp, Homo sapiens
gtgcacctgcctccaccagca

SEQ ID NO: 3557065 - DNA, 18 bp, Homo sapiens
gtgcacgcaggcacagca

SEQ ID NO: 3557066 - DNA, 13 bp, Homo sapiens
gtgcactccagac

SEQ ID NO: 3557067 - DNA, 14 bp, Homo sapiens
gtgcactgcctgca

SEQ ID NO: 3557068 - DNA, 16 bp, Homo sapiens
gtgcagacccagtccc

SEQ ID NO: 3557069 - DNA, 17 bp, Homo sapiens
gtgcagacccagtccca

SEQ ID NO: 3557070 - DNA, 19 bp, Homo sapiens
gtgcagacccagtcccaca

SEQ ID NO: 3557071 - DNA, 16 bp, Homo sapiens
gtgcagccccagggcc

SEQ ID NO: 3557072 - DNA, 20 bp, Homo sapiens
gtgcagccttcccctccctg

SEQ ID NO: 3557073 - DNA, 19 bp, Homo sapiens
gtgcataagttaacttcca

SEQ ID NO: 3557074 - DNA, 18 bp, Homo sapiens
gtgcatctcagcccacat

SEQ ID NO: 3557075 - DNA, 20 bp, Homo sapiens
gtgcatgctagtgttgtatt

SEQ ID NO: 3557076 - DNA, 12 bp, Homo sapiens
gtgcatgggctc

SEQ ID NO: 3557077 - DNA, 17 bp, Homo sapiens
gtgcatgtgctgtgtga

SEQ ID NO: 3557078 - DNA, 16 bp, Homo sapiens
gtgccaccaccctgcc

SEQ ID NO: 3557079 - DNA, 20 bp, Homo sapiens
gtgccagcaagtccttaggc

SEQ ID NO: 3557080 - DNA, 16 bp, Homo sapiens
gtgccaggtccttgcc

SEQ ID NO: 3557081 - DNA, 17 bp, Homo sapiens
gtgccccacttctggcc

SEQ ID NO: 3557082 - DNA, 18 bp, Homo sapiens
gtgcccccactgaccaga

SEQ ID NO: 3557083 - DNA, 15 bp, Homo sapiens
gtgccccttccctgg

SEQ ID NO: 3557084 - DNA, 15 bp, Homo sapiens
gtgcccgcgccaggc

SEQ ID NO: 3557085 - DNA, 18 bp, Homo sapiens
gtgcccgcgccaggccct

SEQ ID NO: 3557086 - DNA, 18 bp, Homo sapiens
gtgccctggatgcccagg

SEQ ID NO: 3557087 - DNA, 21 bp, Homo sapiens
gtgccgaccacgccccaggac

SEQ ID NO: 3557088 - DNA, 14 bp, Homo sapiens
gtgccgctgtctct

SEQ ID NO: 3557089 - DNA, 15 bp, Homo sapiens
gtgccgctgtctctg

SEQ ID NO: 3557090 - DNA, 17 bp, Homo sapiens
gtgccgtgcgggcgagg

SEQ ID NO: 3557091 - DNA, 22 bp, Homo sapiens
gtgccgtgtcccctgacagggc

SEQ ID NO: 3557092 - DNA, 16 bp, Homo sapiens
gtgcctaacctgggac

SEQ ID NO: 3557093 - DNA, 17 bp, Homo sapiens
gtgcctaacctgggacc

SEQ ID NO: 3557094 - DNA, 23 bp, Homo sapiens
gtgcctccacatgctgcctggca

SEQ ID NO: 3557095 - DNA, 15 bp, Homo sapiens
gtgcctctgcctgtc

SEQ ID NO: 3557096 - DNA, 11 bp, Homo sapiens
gtgcctggagt

SEQ ID NO: 3557097 - DNA, 17 bp, Homo sapiens
gtgcctggccgcagggc

SEQ ID NO: 3557098 - DNA, 11 bp, Homo sapiens
gtgcctgggct

SEQ ID NO: 3557099 - DNA, 20 bp, Homo sapiens
gtgccttgccacattaaatt

SEQ ID NO: 3557100 - DNA, 19 bp, Homo sapiens
gtgcctttctttgcctctg

SEQ ID NO: 3557101 - DNA, 14 bp, Homo sapiens
gtgcctttggcctg

SEQ ID NO: 3557102 - DNA, 18 bp, Homo sapiens
gtgcggcggtcccagctc

SEQ ID NO: 3557103 - DNA, 13 bp, Homo sapiens
gtgcggttcctca

SEQ ID NO: 3557104 - DNA, 19 bp, Homo sapiens
gtgcgtttataattggctt

SEQ ID NO: 3557105 - DNA, 21 bp, Homo sapiens
gtgctacaaaaacacagcaag

SEQ ID NO: 3557106 - DNA, 13 bp, Homo sapiens
gtgctcatgctgc

SEQ ID NO: 3557107 - DNA, 19 bp, Homo sapiens
gtgctccgtagctctgctg

SEQ ID NO: 3557108 - DNA, 20 bp, Homo sapiens
gtgctccgtagctctgctgc

SEQ ID NO: 3557109 - DNA, 21 bp, Homo sapiens
gtgctccgtagctctgctgct

SEQ ID NO: 3557110 - DNA, 22 bp, Homo sapiens
gtgctccgtagctctgctgctg

SEQ ID NO: 3557111 - DNA, 22 bp, Homo sapiens
gtgctctggcaccatcagcctg

SEQ ID NO: 3557112 - DNA, 19 bp, Homo sapiens
gtgctcttcccactccagc

SEQ ID NO: 3557113 - DNA, 20 bp, Homo sapiens
gtgctcttcccactccagct

SEQ ID NO: 3557114 - DNA, 20 bp, Homo sapiens
gtgctcttttctcctcactg

SEQ ID NO: 3557115 - DNA, 16 bp, Homo sapiens
gtgctgacagctgctc

SEQ ID NO: 3557116 - DNA, 22 bp, Homo sapiens
gtgctgcagatttgatatttgc

SEQ ID NO: 3557117 - DNA, 11 bp, Homo sapiens
gtgctgcagga

SEQ ID NO: 3557118 - DNA, 21 bp, Homo sapiens
gtgctgcccatgcaccttcca

SEQ ID NO: 3557119 - DNA, 22 bp, Homo sapiens
gtgctgcccatgcaccttccag

SEQ ID NO: 3557120 - DNA, 14 bp, Homo sapiens
gtgctgctgtggag

SEQ ID NO: 3557121 - DNA, 23 bp, Homo sapiens
gtgctgggaggtataggggtcct

SEQ ID NO: 3557122 - DNA, 20 bp, Homo sapiens
gtgctgggattacaggcgtg

SEQ ID NO: 3557123 - DNA, 17 bp, Homo sapiens
gtgctgtttgaaaataa

SEQ ID NO: 3557124 - DNA, 15 bp, Homo sapiens
gtgcttcctgctgta

SEQ ID NO: 3557125 - DNA, 14 bp, Homo sapiens
gtgcttggccagga

SEQ ID NO: 3557126 - DNA, 18 bp, Homo sapiens
gtgctttagttaggtcat

SEQ ID NO: 3557127 - DNA, 14 bp, Homo sapiens
gtgcttttggcaga

SEQ ID NO: 3557128 - DNA, 16 bp, Homo sapiens
gtgctttttgtcatgt

SEQ ID NO: 3557129 - DNA, 13 bp, Homo sapiens
gtggaagcttcta

SEQ ID NO: 3557130 - DNA, 14 bp, Homo sapiens
gtggaagtgtgggt

SEQ ID NO: 3557131 - DNA, 22 bp, Homo sapiens
gtggaagtgtgggtctgtgtgt

SEQ ID NO: 3557132 - DNA, 22 bp, Homo sapiens
gtggaatagtatcctccaggtt

SEQ ID NO: 3557133 - DNA, 23 bp, Homo sapiens
gtggaatagtatcctccaggttt

SEQ ID NO: 3557134 - DNA, 20 bp, Homo sapiens
gtggacgttaggccaggcct

SEQ ID NO: 3557135 - DNA, 14 bp, Homo sapiens
gtggagacagtcct

SEQ ID NO: 3557136 - DNA, 15 bp, Homo sapiens
gtggagagagcaggg

SEQ ID NO: 3557137 - DNA, 18 bp, Homo sapiens
gtggagatggactcagga

SEQ ID NO: 3557138 - DNA, 22 bp, Homo sapiens
gtggatcttcagaactgccctt

SEQ ID NO: 3557139 - DNA, 18 bp, Homo sapiens
gtggattgtatttaagac

SEQ ID NO: 3557140 - DNA, 21 bp, Homo sapiens
gtggatttgtacttgctcctt

SEQ ID NO: 3557141 - DNA, 21 bp, Homo sapiens
gtggcaaaaagagtcagacat

SEQ ID NO: 3557142 - DNA, 13 bp, Homo sapiens
gtggcacagctgg

SEQ ID NO: 3557143 - DNA, 20 bp, Homo sapiens
gtggcagcctgattcggggc

SEQ ID NO: 3557144 - DNA, 18 bp, Homo sapiens
gtggcagggggccccgcc

SEQ ID NO: 3557145 - DNA, 14 bp, Homo sapiens
gtgtttgtttttgc

SEQ ID NO: 3557146 - DNA, 17 bp, Homo sapiens
gtgtttttcatgtttta

SEQ ID NO: 3557147 - DNA, 15 bp, Homo sapiens
gtgtttttttctaaa

SEQ ID NO: 3557148 - DNA, 22 bp, Homo sapiens
gttaacacatcaaatatttctt

SEQ ID NO: 3557149 - DNA, 18 bp, Homo sapiens
gttaactgttaactatga

SEQ ID NO: 3557150 - DNA, 14 bp, Homo sapiens
gttaagacctggca

SEQ ID NO: 3557151 - DNA, 14 bp, Homo sapiens
gttaatatttcttc

SEQ ID NO: 3557152 - DNA, 16 bp, Homo sapiens
gttaatattttatgtg

SEQ ID NO: 3557153 - DNA, 17 bp, Homo sapiens
gttaatctgatgtataa

SEQ ID NO: 3557154 - DNA, 21 bp, Homo sapiens
gttaatctgatgtataatgta

SEQ ID NO: 3557155 - DNA, 18 bp, Homo sapiens
gttaatttataatgtatt

SEQ ID NO: 3557156 - DNA, 19 bp, Homo sapiens
gttaatttataatgtattt

SEQ ID NO: 3557157 - DNA, 22 bp, Homo sapiens
gttaattttgaagtgctgttta

SEQ ID NO: 3557158 - DNA, 21 bp, Homo sapiens
gttaattttgctaactgggtt

SEQ ID NO: 3557159 - DNA, 20 bp, Homo sapiens
gttaatttttccaactacta

SEQ ID NO: 3557160 - DNA, 18 bp, Homo sapiens
gttacactttttggaagt

SEQ ID NO: 3557161 - DNA, 22 bp, Homo sapiens
gttacactttttggaagtgaaa

SEQ ID NO: 3557162 - DNA, 16 bp, Homo sapiens
gttacagccaagtgcc

SEQ ID NO: 3557163 - DNA, 23 bp, Homo sapiens
gttacagccaagtgccaaatgct

SEQ ID NO: 3557164 - DNA, 22 bp, Homo sapiens
gttacagggaagtggtctcccc

SEQ ID NO: 3557165 - DNA, 13 bp, Homo sapiens
gttacagttctgt

SEQ ID NO: 3557166 - DNA, 14 bp, Homo sapiens
gttacattaaaata

SEQ ID NO: 3557167 - DNA, 18 bp, Homo sapiens
gttacattaaaataaacc

SEQ ID NO: 3557168 - DNA, 20 bp, Homo sapiens
gttaccttatagttactgtg

SEQ ID NO: 3557169 - DNA, 19 bp, Homo sapiens
gttactcacacctgtaatc

SEQ ID NO: 3557170 - DNA, 19 bp, Homo sapiens
gttactccctacactgatg

SEQ ID NO: 3557171 - DNA, 20 bp, Homo sapiens
gttactccctacactgatgc

SEQ ID NO: 3557172 - DNA, 15 bp, Homo sapiens
gttagaaaatgactt

SEQ ID NO: 3557173 - DNA, 19 bp, Homo sapiens
gttagaaatgcagaatcct

SEQ ID NO: 3557174 - DNA, 11 bp, Homo sapiens
gttagcaaaga

SEQ ID NO: 3557175 - DNA, 21 bp, Homo sapiens
gttagctgacagtcagctgtg

SEQ ID NO: 3557176 - DNA, 14 bp, Homo sapiens
gttaggcagcaagc

SEQ ID NO: 3557177 - DNA, 22 bp, Homo sapiens
gttagttaccttatagttactg

SEQ ID NO: 3557178 - DNA, 24 bp, Homo sapiens
gttagttcaatcctgattcatatt

SEQ ID NO: 3557179 - DNA, 18 bp, Homo sapiens
gttataaaccaatgaaat

SEQ ID NO: 3557180 - DNA, 16 bp, Homo sapiens
gttatatgtacagttt

SEQ ID NO: 3557181 - DNA, 22 bp, Homo sapiens
gttatattacttgcctatctga

SEQ ID NO: 3557182 - DNA, 21 bp, Homo sapiens
gttatattggaattataaata

SEQ ID NO: 3557183 - DNA, 22 bp, Homo sapiens
gttatatttgacttgaaaagaa

SEQ ID NO: 3557184 - DNA, 17 bp, Homo sapiens
gttatcaaaatagtcta

SEQ ID NO: 3557185 - DNA, 20 bp, Homo sapiens
gttatcaaactgctgtcgtt

SEQ ID NO: 3557186 - DNA, 18 bp, Homo sapiens
gttatcccaatcattgtt

SEQ ID NO: 3557187 - DNA, 11 bp, Homo sapiens
gttatgaaaat

SEQ ID NO: 3557188 - DNA, 15 bp, Homo sapiens
gttatgactatgtaa

SEQ ID NO: 3557189 - DNA, 17 bp, Homo sapiens
gttatgcagtgaactat

SEQ ID NO: 3557190 - DNA, 18 bp, Homo sapiens
gttatgcagtgaactatt

SEQ ID NO: 3557191 - DNA, 15 bp, Homo sapiens
gttattaattaaaga

SEQ ID NO: 3557192 - DNA, 22 bp, Homo sapiens
gttattaattaaagaaaattaa

SEQ ID NO: 3557193 - DNA, 16 bp, Homo sapiens
gttatttattccccag

SEQ ID NO: 3557194 - DNA, 15 bp, Homo sapiens
gttatttcttccctg

SEQ ID NO: 3557195 - DNA, 16 bp, Homo sapiens
gttattttccttctga

SEQ ID NO: 3557196 - DNA, 18 bp, Homo sapiens
gttattttgatgtaaaga

SEQ ID NO: 3557197 - DNA, 20 bp, Homo sapiens
gttattttgatgtaaagatg

SEQ ID NO: 3557198 - DNA, 23 bp, Homo sapiens
gttatttttatttatttaaattt

SEQ ID NO: 3557199 - DNA, 16 bp, Homo sapiens
gttcaagtattaagca

SEQ ID NO: 3557200 - DNA, 22 bp, Homo sapiens
gttcaatcctgattcatattta

SEQ ID NO: 3557201 - DNA, 16 bp, Homo sapiens
gttcacctgtgactcc

SEQ ID NO: 3557202 - DNA, 24 bp, Homo sapiens
gttcactggacacttcacgccctt

SEQ ID NO: 3557203 - DNA, 15 bp, Homo sapiens
gttcagacacagctc

SEQ ID NO: 3557204 - DNA, 19 bp, Homo sapiens
gttcagctaagctaggaat

SEQ ID NO: 3557205 - DNA, 18 bp, Homo sapiens
gttcatcaccatttcctc

SEQ ID NO: 3557206 - DNA, 17 bp, Homo sapiens
gttcatccaaggctgtt

SEQ ID NO: 3557207 - DNA, 12 bp, Homo sapiens
gttcatcttgca

SEQ ID NO: 3557208 - DNA, 19 bp, Homo sapiens
gttcatgagaatctatatt

SEQ ID NO: 3557209 - DNA, 16 bp, Homo sapiens
gttcatgcagctgtgg

SEQ ID NO: 3557210 - DNA, 13 bp, Homo sapiens
gttccactgagac

SEQ ID NO: 3557211 - DNA, 15 bp, Homo sapiens
gttcccactgccctg

SEQ ID NO: 3557212 - DNA, 19 bp, Homo sapiens
gttcccactgccctgggca

SEQ ID NO: 3557213 - DNA, 19 bp, Homo sapiens
gttccccaagggccctggc

SEQ ID NO: 3557214 - DNA, 13 bp, Homo sapiens
gttcccccagcaa

SEQ ID NO: 3557215 - DNA, 18 bp, Homo sapiens
gttccccctgtttcagag

SEQ ID NO: 3557216 - DNA, 17 bp, Homo sapiens
gttcccctgttcactct

SEQ ID NO: 3557217 - DNA, 20 bp, Homo sapiens
gttccctacttcctgtgact

SEQ ID NO: 3557218 - DNA, 23 bp, Homo sapiens
gttcctagtgatggcttatgata

SEQ ID NO: 3557219 - DNA, 20 bp, Homo sapiens
gttcctcatctgagaggctc

SEQ ID NO: 3557220 - DNA, 19 bp, Homo sapiens
gttcctccttttcttcacc

SEQ ID NO: 3557221 - DNA, 14 bp, Homo sapiens
gttcctctgcagtt

SEQ ID NO: 3557222 - DNA, 11 bp, Homo sapiens
gttcctgaaat

SEQ ID NO: 3557223 - DNA, 20 bp, Homo sapiens
gttcctgaagctgctgtgtc

SEQ ID NO: 3557224 - DNA, 15 bp, Homo sapiens
gttcctgtcccacat

SEQ ID NO: 3557225 - DNA, 16 bp, Homo sapiens
gttcctgtcccacatg

SEQ ID NO: 3557226 - DNA, 21 bp, Homo sapiens
gttcctgtgtgaccctgggca

SEQ ID NO: 3557227 - DNA, 17 bp, Homo sapiens
gttccttatccctctct

SEQ ID NO: 3557228 - DNA, 15 bp, Homo sapiens
gttccttctctgggt

SEQ ID NO: 3557229 - DNA, 16 bp, Homo sapiens
gttcctttctctgggc

SEQ ID NO: 3557230 - DNA, 16 bp, Homo sapiens
gttcgactcagcctca

SEQ ID NO: 3557231 - DNA, 16 bp, Homo sapiens
gttcgagaccagcctg

SEQ ID NO: 3557232 - DNA, 17 bp, Homo sapiens
gttcgatacctggagca

SEQ ID NO: 3557233 - DNA, 14 bp, Homo sapiens
gttcgtgctgtgct

SEQ ID NO: 3557234 - DNA, 16 bp, Homo sapiens
gttctaaaatataata

SEQ ID NO: 3557235 - DNA, 14 bp, Homo sapiens
gttctaaagatgga

SEQ ID NO: 3557236 - DNA, 17 bp, Homo sapiens
gttctaaagatggaaaa

SEQ ID NO: 3557237 - DNA, 19 bp, Homo sapiens
gttctaccgtggatttgta

SEQ ID NO: 3557238 - DNA, 20 bp, Homo sapiens
gttctaccgtggatttgtac

SEQ ID NO: 3557239 - DNA, 21 bp, Homo sapiens
gttctaccgtggatttgtact

SEQ ID NO: 3557240 - DNA, 17 bp, Homo sapiens
gttctaggcctttcctc

SEQ ID NO: 3557241 - DNA, 10 bp, Homo sapiens
gttctattta

SEQ ID NO: 3557242 - DNA, 16 bp, Homo sapiens
gttctatttaaaatgg

SEQ ID NO: 3557243 - DNA, 16 bp, Homo sapiens
gttctatttcttgaag

SEQ ID NO: 3557244 - DNA, 15 bp, Homo sapiens
gttctattttactgt

SEQ ID NO: 3557245 - DNA, 14 bp, Homo sapiens
gttctcccaaagat

SEQ ID NO: 3557246 - DNA, 15 bp, Homo sapiens
gttctcccaaagatt

SEQ ID NO: 3557247 - DNA, 20 bp, Homo sapiens
gttctccctttctctctcct

SEQ ID NO: 3557248 - DNA, 20 bp, Homo sapiens
gttctctcatcggaggccca

SEQ ID NO: 3557249 - DNA, 22 bp, Homo sapiens
gttctctcatcggaggcccatg

SEQ ID NO: 3557250 - DNA, 13 bp, Homo sapiens
gttctgaggccag

SEQ ID NO: 3557251 - DNA, 19 bp, Homo sapiens
gttctgcctctccctgggt

SEQ ID NO: 3557252 - DNA, 20 bp, Homo sapiens
gttctgcctctccctgggtc

SEQ ID NO: 3557253 - DNA, 17 bp, Homo sapiens
gttctgcctgccagctg

SEQ ID NO: 3557254 - DNA, 22 bp, Homo sapiens
gttctgcctgccagctgcactg

SEQ ID NO: 3557255 - DNA, 23 bp, Homo sapiens
gttctgcctgccagctgcactga

SEQ ID NO: 3557256 - DNA, 12 bp, Homo sapiens
gttctgcctgga

SEQ ID NO: 3557257 - DNA, 11 bp, Homo sapiens
gttctgctcct

SEQ ID NO: 3557258 - DNA, 21 bp, Homo sapiens
gttctgtagattcatgcaagt

SEQ ID NO: 3557259 - DNA, 13 bp, Homo sapiens
gttctgtggttcc

SEQ ID NO: 3557260 - DNA, 16 bp, Homo sapiens
gttctgtggttccagt

SEQ ID NO: 3557261 - DNA, 17 bp, Homo sapiens
gttctgtggttccagta

SEQ ID NO: 3557262 - DNA, 23 bp, Homo sapiens
gttcttgggcctcaggctctgca

SEQ ID NO: 3557263 - DNA, 22 bp, Homo sapiens
gttcttgggggaggccacccca

SEQ ID NO: 3557264 - DNA, 21 bp, Homo sapiens
gttctttcacccatcctagga

SEQ ID NO: 3557265 - DNA, 22 bp, Homo sapiens
gttctttcacccatcctaggaa

SEQ ID NO: 3557266 - DNA, 20 bp, Homo sapiens
gttctttcctccccctgcaa

SEQ ID NO: 3557267 - DNA, 14 bp, Homo sapiens
gttctttctgctct

SEQ ID NO: 3557268 - DNA, 23 bp, Homo sapiens
gttctttctgctctatactgtgg

SEQ ID NO: 3557269 - DNA, 19 bp, Homo sapiens
gttctttcttcctctgctg

SEQ ID NO: 3557270 - DNA, 16 bp, Homo sapiens
gttctttgggccagac

SEQ ID NO: 3557271 - DNA, 17 bp, Homo sapiens
gttctttgggccagaca

SEQ ID NO: 3557272 - DNA, 17 bp, Homo sapiens
gttgaaaagactccaaa

SEQ ID NO: 3557273 - DNA, 22 bp, Homo sapiens
gttgaaaagactccaaagaaat

SEQ ID NO: 3557274 - DNA, 13 bp, Homo sapiens
gttgaaacagaaa

SEQ ID NO: 3557275 - DNA, 16 bp, Homo sapiens
gttgaagactttgttt

SEQ ID NO: 3557276 - DNA, 12 bp, Homo sapiens
gttgaatataat

SEQ ID NO: 3557277 - DNA, 17 bp, Homo sapiens
taatgtctggtgtttgt

SEQ ID NO: 3557278 - DNA, 22 bp, Homo sapiens
taatgtctggtgtttgtcatgg

SEQ ID NO: 3557279 - DNA, 15 bp, Homo sapiens
taatgttattttcct

SEQ ID NO: 3557280 - DNA, 16 bp, Homo sapiens
taatgttattttcctt

SEQ ID NO: 3557281 - DNA, 20 bp, Homo sapiens
taatgttattttccttctga

SEQ ID NO: 3557282 - DNA, 13 bp, Homo sapiens
taatgttccagtt

SEQ ID NO: 3557283 - DNA, 23 bp, Homo sapiens
taatgttcttatgcaaaatggaa

SEQ ID NO: 3557284 - DNA, 20 bp, Homo sapiens
taatgttgattttaatcctg

SEQ ID NO: 3557285 - DNA, 11 bp, Homo sapiens
taatgtttcct

SEQ ID NO: 3557286 - DNA, 17 bp, Homo sapiens
taatgtttgatagtaaa

SEQ ID NO: 3557287 - DNA, 17 bp, Homo sapiens
taatgtttttatttcaa

SEQ ID NO: 3557288 - DNA, 23 bp, Homo sapiens
taattaaaaactgtgatttttat

SEQ ID NO: 3557289 - DNA, 20 bp, Homo sapiens
taattaaaagaatattttaa

SEQ ID NO: 3557290 - DNA, 22 bp, Homo sapiens
taattacaaacaataagaacaa

SEQ ID NO: 3557291 - DNA, 13 bp, Homo sapiens
taattactggaat

SEQ ID NO: 3557292 - DNA, 21 bp, Homo sapiens
taattactggaattcttctgc

SEQ ID NO: 3557293 - DNA, 16 bp, Homo sapiens
taattatatctaaaat

SEQ ID NO: 3557294 - DNA, 20 bp, Homo sapiens
taattatcagttggtttgga

SEQ ID NO: 3557295 - DNA, 20 bp, Homo sapiens
taattatgtgtagttataaa

SEQ ID NO: 3557296 - DNA, 16 bp, Homo sapiens
taattattgatgtttt

SEQ ID NO: 3557297 - DNA, 19 bp, Homo sapiens
taattcaagcctctaaaca

SEQ ID NO: 3557298 - DNA, 22 bp, Homo sapiens
taattcacagtgctcttttctc

SEQ ID NO: 3557299 - DNA, 12 bp, Homo sapiens
taattcagcact

SEQ ID NO: 3557300 - DNA, 21 bp, Homo sapiens
taattcagggtggtaaagtat

SEQ ID NO: 3557301 - DNA, 21 bp, Homo sapiens
taattcgtacataataagttt

SEQ ID NO: 3557302 - DNA, 15 bp, Homo sapiens
taattcttcctttgt

SEQ ID NO: 3557303 - DNA, 20 bp, Homo sapiens
taattgacaggattattgga

SEQ ID NO: 3557304 - DNA, 23 bp, Homo sapiens
taattgcagataactttgacttt

SEQ ID NO: 3557305 - DNA, 16 bp, Homo sapiens
taattgccagcaaata

SEQ ID NO: 3557306 - DNA, 18 bp, Homo sapiens
taattgccagcaaataaa

SEQ ID NO: 3557307 - DNA, 15 bp, Homo sapiens
taattggatttccta

SEQ ID NO: 3557308 - DNA, 20 bp, Homo sapiens
taattggctttactattttt

SEQ ID NO: 3557309 - DNA, 14 bp, Homo sapiens
taattgtgccccta

SEQ ID NO: 3557310 - DNA, 21 bp, Homo sapiens
taatttagaagatattatttg

SEQ ID NO: 3557311 - DNA, 22 bp, Homo sapiens
taatttagaagatattatttgt

SEQ ID NO: 3557312 - DNA, 21 bp, Homo sapiens
taatttagaatggttgagtta

SEQ ID NO: 3557313 - DNA, 16 bp, Homo sapiens
taatttatcttcatgt

SEQ ID NO: 3557314 - DNA, 17 bp, Homo sapiens
taatttattaattgctt

SEQ ID NO: 3557315 - DNA, 20 bp, Homo sapiens
taatttattaattgctttga

SEQ ID NO: 3557316 - DNA, 10 bp, Homo sapiens
taatttctgc

SEQ ID NO: 3557317 - DNA, 20 bp, Homo sapiens
taatttctgccaataaattc

SEQ ID NO: 3557318 - DNA, 18 bp, Homo sapiens
taatttgaggacaaccat

SEQ ID NO: 3557319 - DNA, 21 bp, Homo sapiens
taatttggctttcacatttaa

SEQ ID NO: 3557320 - DNA, 17 bp, Homo sapiens
taatttgtaaaacttct

SEQ ID NO: 3557321 - DNA, 14 bp, Homo sapiens
taattttattcatt

SEQ ID NO: 3557322 - DNA, 22 bp, Homo sapiens
taattttcctttaatatgaaat

SEQ ID NO: 3557323 - DNA, 18 bp, Homo sapiens
taattttgaagtgctgtt

SEQ ID NO: 3557324 - DNA, 12 bp, Homo sapiens
taattttgtaat

SEQ ID NO: 3557325 - DNA, 14 bp, Homo sapiens
tacaaaacattaaa

SEQ ID NO: 3557326 - DNA, 16 bp, Homo sapiens
tacaaaagctttttaa

SEQ ID NO: 3557327 - DNA, 19 bp, Homo sapiens
tacaaaataaacaaataac

SEQ ID NO: 3557328 - DNA, 14 bp, Homo sapiens
tacaaaatgttact

SEQ ID NO: 3557329 - DNA, 12 bp, Homo sapiens
tacaaacaataa

SEQ ID NO: 3557330 - DNA, 17 bp, Homo sapiens
tacaaacaataagaaca

SEQ ID NO: 3557331 - DNA, 17 bp, Homo sapiens
tacaaactcagatcctt

SEQ ID NO: 3557332 - DNA, 19 bp, Homo sapiens
tacaaagaaccatgcagga

SEQ ID NO: 3557333 - DNA, 22 bp, Homo sapiens
tacaaagggaaagcctctggcc

SEQ ID NO: 3557334 - DNA, 20 bp, Homo sapiens
tacaaagtttcaatttgttt

SEQ ID NO: 3557335 - DNA, 15 bp, Homo sapiens
tacaaatataggttt

SEQ ID NO: 3557336 - DNA, 22 bp, Homo sapiens
tacaaatcagaagtcatcttgc

SEQ ID NO: 3557337 - DNA, 20 bp, Homo sapiens
tacaaatttataaaggtctg

SEQ ID NO: 3557338 - DNA, 16 bp, Homo sapiens
tacaaccctaccctgg

SEQ ID NO: 3557339 - DNA, 18 bp, Homo sapiens
tacaagccagctggagaa

SEQ ID NO: 3557340 - DNA, 19 bp, Homo sapiens
tacaagggcataaagtaaa

SEQ ID NO: 3557341 - DNA, 17 bp, Homo sapiens
tacaagtaatattatta

SEQ ID NO: 3557342 - DNA, 20 bp, Homo sapiens
tacaataaaatcttgaaaat

SEQ ID NO: 3557343 - DNA, 14 bp, Homo sapiens
tacaataaactggt

SEQ ID NO: 3557344 - DNA, 20 bp, Homo sapiens
tacaatattgtgcatgctag

SEQ ID NO: 3557345 - DNA, 20 bp, Homo sapiens
tacaatcagcccagtgcaaa

SEQ ID NO: 3557346 - DNA, 15 bp, Homo sapiens
tacaatcgcaaatca

SEQ ID NO: 3557347 - DNA, 18 bp, Homo sapiens
tacaatcgcaaatcaaaa

SEQ ID NO: 3557348 - DNA, 23 bp, Homo sapiens
tacaattaggaactgagtatgtg

SEQ ID NO: 3557349 - DNA, 20 bp, Homo sapiens
tacacaaagaacttgctgct

SEQ ID NO: 3557350 - DNA, 15 bp, Homo sapiens
tacacaataagcaaa

SEQ ID NO: 3557351 - DNA, 15 bp, Homo sapiens
tacacagctctagac

SEQ ID NO: 3557352 - DNA, 18 bp, Homo sapiens
tacaccagcattcctttt

SEQ ID NO: 3557353 - DNA, 16 bp, Homo sapiens
tacaccatatactgtt

SEQ ID NO: 3557354 - DNA, 20 bp, Homo sapiens
tacacctttctcctttgtac

SEQ ID NO: 3557355 - DNA, 16 bp, Homo sapiens
tacactgtaagctttg

SEQ ID NO: 3557356 - DNA, 13 bp, Homo sapiens
tacactttatgca

SEQ ID NO: 3557357 - DNA, 16 bp, Homo sapiens
tacagaaactgatgcc

SEQ ID NO: 3557358 - DNA, 21 bp, Homo sapiens
tacagacagcttacaggagcc

SEQ ID NO: 3557359 - DNA, 17 bp, Homo sapiens
tacagacctcagtttta

SEQ ID NO: 3557360 - DNA, 14 bp, Homo sapiens
tacagactccatct

SEQ ID NO: 3557361 - DNA, 11 bp, Homo sapiens
tacagaggaaa

SEQ ID NO: 3557362 - DNA, 12 bp, Homo sapiens
tacagaggagaa

SEQ ID NO: 3557363 - DNA, 23 bp, Homo sapiens
tacagagtgggccccgggctgga

SEQ ID NO: 3557364 - DNA, 17 bp, Homo sapiens
tacagccatatgtaaca

SEQ ID NO: 3557365 - DNA, 20 bp, Homo sapiens
tacagccctaagtggctgcc

SEQ ID NO: 3557366 - DNA, 22 bp, Homo sapiens
tacagccctaagtggctgcctt

SEQ ID NO: 3557367 - DNA, 18 bp, Homo sapiens
tacagcctatagtaaatg

SEQ ID NO: 3557368 - DNA, 13 bp, Homo sapiens
tacaggaacagaa

SEQ ID NO: 3557369 - DNA, 13 bp, Homo sapiens
tacaggagaggca

SEQ ID NO: 3557370 - DNA, 14 bp, Homo sapiens
tacaggagccagcc

SEQ ID NO: 3557371 - DNA, 12 bp, Homo sapiens
tacagtatataa

SEQ ID NO: 3557372 - DNA, 16 bp, Homo sapiens
tacagtatttctacat

SEQ ID NO: 3557373 - DNA, 16 bp, Homo sapiens
tacagtgactccctgg

SEQ ID NO: 3557374 - DNA, 19 bp, Homo sapiens
tacagtgactccctgggag

SEQ ID NO: 3557375 - DNA, 15 bp, Homo sapiens
tacagttctgtggtt

SEQ ID NO: 3557376 - DNA, 22 bp, Homo sapiens
tacagtttattgatattcaata

SEQ ID NO: 3557377 - DNA, 13 bp, Homo sapiens
tacataaaagaaa

SEQ ID NO: 3557378 - DNA, 13 bp, Homo sapiens
tacataactcctg

SEQ ID NO: 3557379 - DNA, 15 bp, Homo sapiens
tacataagtttagga

SEQ ID NO: 3557380 - DNA, 23 bp, Homo sapiens
tacataatggtactcccaaactg

SEQ ID NO: 3557381 - DNA, 14 bp, Homo sapiens
tacatacaccagca

SEQ ID NO: 3557382 - DNA, 12 bp, Homo sapiens
tacatagtcctt

SEQ ID NO: 3557383 - DNA, 13 bp, Homo sapiens
tacatagtccttt

SEQ ID NO: 3557384 - DNA, 22 bp, Homo sapiens
tacatatatttttaaaaaatga

SEQ ID NO: 3557385 - DNA, 13 bp, Homo sapiens
tacatatgtaaac

SEQ ID NO: 3557386 - DNA, 14 bp, Homo sapiens
tacatatgtaaaca

SEQ ID NO: 3557387 - DNA, 14 bp, Homo sapiens
tacatgaaacagaa

SEQ ID NO: 3557388 - DNA, 15 bp, Homo sapiens
tacatgaaacagaaa

SEQ ID NO: 3557389 - DNA, 21 bp, Homo sapiens
tacatgaaacagaaacaaaaa

SEQ ID NO: 3557390 - DNA, 17 bp, Homo sapiens
tacatgaagcagaacct

SEQ ID NO: 3557391 - DNA, 22 bp, Homo sapiens
tacatgaatgggcatttctaaa

SEQ ID NO: 3557392 - DNA, 14 bp, Homo sapiens
tacatgcatataat

SEQ ID NO: 3557393 - DNA, 20 bp, Homo sapiens
tacatgcatataatgaataa

SEQ ID NO: 3557394 - DNA, 19 bp, Homo sapiens
tacatgtatcaagcctaga

SEQ ID NO: 3557395 - DNA, 19 bp, Homo sapiens
tacatgtattgcacattgt

SEQ ID NO: 3557396 - DNA, 16 bp, Homo sapiens
tacatgttctttgtac

SEQ ID NO: 3557397 - DNA, 22 bp, Homo sapiens
tacatgttctttgtaccttttg

SEQ ID NO: 3557398 - DNA, 23 bp, Homo sapiens
tacattactaaatatataaagta

SEQ ID NO: 3557399 - DNA, 23 bp, Homo sapiens
tacattagtgattccatcaaaga

SEQ ID NO: 3557400 - DNA, 15 bp, Homo sapiens
tacattccaccctgt

SEQ ID NO: 3557401 - DNA, 20 bp, Homo sapiens
tacattccaccctgttactt

SEQ ID NO: 3557402 - DNA, 22 bp, Homo sapiens
tacattctgaaggccttgttaa

SEQ ID NO: 3557403 - DNA, 21 bp, Homo sapiens
tacattgagcaaataaactta

SEQ ID NO: 3557404 - DNA, 22 bp, Homo sapiens
tacattgtgtcctgcttatact

SEQ ID NO: 3557405 - DNA, 15 bp, Homo sapiens
tacatttaaaacatt

SEQ ID NO: 3557406 - DNA, 17 bp, Homo sapiens
tacatttaataatatca

SEQ ID NO: 3557407 - DNA, 19 bp, Homo sapiens
tacatttaataatatcaaa

SEQ ID NO: 3557408 - DNA, 16 bp, Homo sapiens
tacatttctactatga

SEQ ID NO: 3557409 - DNA, 12 bp, Homo sapiens
tatcaaaacatc

SEQ ID NO: 3557410 - DNA, 19 bp, Homo sapiens
tatcaaagagaagatgcct

SEQ ID NO: 3557411 - DNA, 12 bp, Homo sapiens
tatcaaagtcat

SEQ ID NO: 3557412 - DNA, 20 bp, Homo sapiens
tatcaaagtcattaaagaca

SEQ ID NO: 3557413 - DNA, 16 bp, Homo sapiens
tatcaacagcttccct

SEQ ID NO: 3557414 - DNA, 18 bp, Homo sapiens
tatcaagcaacattcttg

SEQ ID NO: 3557415 - DNA, 22 bp, Homo sapiens
tatcaagcctagatgttttata

SEQ ID NO: 3557416 - DNA, 14 bp, Homo sapiens
tatcacaaatctta

SEQ ID NO: 3557417 - DNA, 16 bp, Homo sapiens
tatcacaaatcttaac

SEQ ID NO: 3557418 - DNA, 18 bp, Homo sapiens
tatcacctagcagcctca

SEQ ID NO: 3557419 - DNA, 18 bp, Homo sapiens
tatcacctcgagaagtaa

SEQ ID NO: 3557420 - DNA, 22 bp, Homo sapiens
tatcacctgttcatttgaagaa

SEQ ID NO: 3557421 - DNA, 20 bp, Homo sapiens
tatcacttccatgacataag

SEQ ID NO: 3557422 - DNA, 12 bp, Homo sapiens
tatcagcaatgc

SEQ ID NO: 3557423 - DNA, 14 bp, Homo sapiens
tatcatagaaatgt

SEQ ID NO: 3557424 - DNA, 23 bp, Homo sapiens
tatcatttgagtttagggttctg

SEQ ID NO: 3557425 - DNA, 16 bp, Homo sapiens
tatccaaatcttgaat

SEQ ID NO: 3557426 - DNA, 13 bp, Homo sapiens
tatccacccagca

SEQ ID NO: 3557427 - DNA, 19 bp, Homo sapiens
tatccacccagcaggcaga

SEQ ID NO: 3557428 - DNA, 15 bp, Homo sapiens
tatccctacatgtat

SEQ ID NO: 3557429 - DNA, 17 bp, Homo sapiens
tatcccttggacatttt

SEQ ID NO: 3557430 - DNA, 14 bp, Homo sapiens
tatcctccaggttt

SEQ ID NO: 3557431 - DNA, 23 bp, Homo sapiens
tatcctccaggtttttcaattaa

SEQ ID NO: 3557432 - DNA, 14 bp, Homo sapiens
tatcctggccctgg

SEQ ID NO: 3557433 - DNA, 19 bp, Homo sapiens
tatcgaaatgacggtgtta

SEQ ID NO: 3557434 - DNA, 16 bp, Homo sapiens
tatctataatttacct

SEQ ID NO: 3557435 - DNA, 19 bp, Homo sapiens
tatctataatttacctaag

SEQ ID NO: 3557436 - DNA, 14 bp, Homo sapiens
tatctatgttttac

SEQ ID NO: 3557437 - DNA, 19 bp, Homo sapiens
tatctcccccactccacta

SEQ ID NO: 3557438 - DNA, 16 bp, Homo sapiens
tatctccgttccatct

SEQ ID NO: 3557439 - DNA, 14 bp, Homo sapiens
tatctctgaggcta

SEQ ID NO: 3557440 - DNA, 16 bp, Homo sapiens
tatctctgtgtgcaca

SEQ ID NO: 3557441 - DNA, 17 bp, Homo sapiens
tatctctgtgtgcacaa

SEQ ID NO: 3557442 - DNA, 18 bp, Homo sapiens
tatctctgtgtgcacaaa

SEQ ID NO: 3557443 - DNA, 22 bp, Homo sapiens
tatctgaaaggccagcagctga

SEQ ID NO: 3557444 - DNA, 12 bp, Homo sapiens
tatctgctgttc

SEQ ID NO: 3557445 - DNA, 13 bp, Homo sapiens
tatctgctgttct

SEQ ID NO: 3557446 - DNA, 17 bp, Homo sapiens
tatctgctgttcttcag

SEQ ID NO: 3557447 - DNA, 17 bp, Homo sapiens
tatctggcttccctgga

SEQ ID NO: 3557448 - DNA, 15 bp, Homo sapiens
tatctgtcagctgca

SEQ ID NO: 3557449 - DNA, 14 bp, Homo sapiens
tatctgtgaacgtg

SEQ ID NO: 3557450 - DNA, 18 bp, Homo sapiens
tatctgtttaaagcatat

SEQ ID NO: 3557451 - DNA, 23 bp, Homo sapiens
tatcttacgcacgatatctagtg

SEQ ID NO: 3557452 - DNA, 22 bp, Homo sapiens
tatcttataaagtggaagtatg

SEQ ID NO: 3557453 - DNA, 14 bp, Homo sapiens
tatcttatcattta

SEQ ID NO: 3557454 - DNA, 23 bp, Homo sapiens
tatcttggtgaatttttttttcc

SEQ ID NO: 3557455 - DNA, 21 bp, Homo sapiens
tatgaaaatatagacattctc

SEQ ID NO: 3557456 - DNA, 18 bp, Homo sapiens
tatgaaacaatcttccaa

SEQ ID NO: 3557457 - DNA, 19 bp, Homo sapiens
tatgaaacaatcttccaaa

SEQ ID NO: 3557458 - DNA, 15 bp, Homo sapiens
tatgaatactttgca

SEQ ID NO: 3557459 - DNA, 21 bp, Homo sapiens
tatgacaaaaaaaattaagtc

SEQ ID NO: 3557460 - DNA, 15 bp, Homo sapiens
tatgacagatatatt

SEQ ID NO: 3557461 - DNA, 21 bp, Homo sapiens
tatgacagatatatttaagcc

SEQ ID NO: 3557462 - DNA, 20 bp, Homo sapiens
tatgacatcacttgtacaaa

SEQ ID NO: 3557463 - DNA, 24 bp, Homo sapiens
tatgacatcacttgtacaaaataa

SEQ ID NO: 3557464 - DNA, 16 bp, Homo sapiens
tatgacatgaaaagtt

SEQ ID NO: 3557465 - DNA, 21 bp, Homo sapiens
tatgacatgaaaagttattta

SEQ ID NO: 3557466 - DNA, 13 bp, Homo sapiens
tatgatatgcatg

SEQ ID NO: 3557467 - DNA, 14 bp, Homo sapiens
tatgatatgcatgt

SEQ ID NO: 3557468 - DNA, 15 bp, Homo sapiens
tatgatatgcatgta

SEQ ID NO: 3557469 - DNA, 17 bp, Homo sapiens
tatgatcagaagaacat

SEQ ID NO: 3557470 - DNA, 20 bp, Homo sapiens
tatgatcagaagaacatgat

SEQ ID NO: 3557471 - DNA, 20 bp, Homo sapiens
tatgatctgttttgtatctt

SEQ ID NO: 3557472 - DNA, 19 bp, Homo sapiens
tatgatgttagttttcctt

SEQ ID NO: 3557473 - DNA, 21 bp, Homo sapiens
tatgattgtttctcaaatctt

SEQ ID NO: 3557474 - DNA, 14 bp, Homo sapiens
tatgcaaaatggaa

SEQ ID NO: 3557475 - DNA, 12 bp, Homo sapiens
tatgcaaataca

SEQ ID NO: 3557476 - DNA, 22 bp, Homo sapiens
tatgcaatggattttcaaccag

SEQ ID NO: 3557477 - DNA, 16 bp, Homo sapiens
tatgcaatttcctttt

SEQ ID NO: 3557478 - DNA, 12 bp, Homo sapiens
tatgcagtgaac

SEQ ID NO: 3557479 - DNA, 18 bp, Homo sapiens
tatgcatggtgccccagg

SEQ ID NO: 3557480 - DNA, 22 bp, Homo sapiens
tatgcatggtgccccaggacca

SEQ ID NO: 3557481 - DNA, 11 bp, Homo sapiens
tatgcatgtag

SEQ ID NO: 3557482 - DNA, 21 bp, Homo sapiens
tatgcatgtagcatataaatg

SEQ ID NO: 3557483 - DNA, 15 bp, Homo sapiens
tatgcattagtatca

SEQ ID NO: 3557484 - DNA, 14 bp, Homo sapiens
tatgctgacagctc

SEQ ID NO: 3557485 - DNA, 15 bp, Homo sapiens
tatgctgacagctct

SEQ ID NO: 3557486 - DNA, 14 bp, Homo sapiens
tatgctggtagatg

SEQ ID NO: 3557487 - DNA, 16 bp, Homo sapiens
tatgctgtttcctagc

SEQ ID NO: 3557488 - DNA, 22 bp, Homo sapiens
tatgcttatacacttacacttt

SEQ ID NO: 3557489 - DNA, 17 bp, Homo sapiens
tatgcttttaaactgat

SEQ ID NO: 3557490 - DNA, 15 bp, Homo sapiens
tatggagaacatgtt

SEQ ID NO: 3557491 - DNA, 19 bp, Homo sapiens
tatggaggactgtgacaga

SEQ ID NO: 3557492 - DNA, 17 bp, Homo sapiens
tatggataatctgagca

SEQ ID NO: 3557493 - DNA, 18 bp, Homo sapiens
tatggcaggactcctggc

SEQ ID NO: 3557494 - DNA, 19 bp, Homo sapiens
tatgggtgggattttgcaa

SEQ ID NO: 3557495 - DNA, 14 bp, Homo sapiens
tatggtatgtagcc

SEQ ID NO: 3557496 - DNA, 21 bp, Homo sapiens
tatgtaccatatgatctgttt

SEQ ID NO: 3557497 - DNA, 22 bp, Homo sapiens
tatgtaccatatgatctgtttt

SEQ ID NO: 3557498 - DNA, 19 bp, Homo sapiens
tatgtacttttattttttg

SEQ ID NO: 3557499 - DNA, 18 bp, Homo sapiens
tatgtataactttaactt

SEQ ID NO: 3557500 - DNA, 17 bp, Homo sapiens
tatgtatatcttctaca

SEQ ID NO: 3557501 - DNA, 19 bp, Homo sapiens
tatgtatcaaatgtaactt

SEQ ID NO: 3557502 - DNA, 13 bp, Homo sapiens
tatgtattctgta

SEQ ID NO: 3557503 - DNA, 16 bp, Homo sapiens
tatgtattctgtaaaa

SEQ ID NO: 3557504 - DNA, 13 bp, Homo sapiens
tatgtatttaaga

SEQ ID NO: 3557505 - DNA, 15 bp, Homo sapiens
tatgtattttccaag

SEQ ID NO: 3557506 - DNA, 22 bp, Homo sapiens
tatgtattttccaagtaaaata

SEQ ID NO: 3557507 - DNA, 13 bp, Homo sapiens
tatgtgaagatat

SEQ ID NO: 3557508 - DNA, 17 bp, Homo sapiens
tatgtgaagatataagt

SEQ ID NO: 3557509 - DNA, 19 bp, Homo sapiens
tatgtgaagatataagtaa

SEQ ID NO: 3557510 - DNA, 19 bp, Homo sapiens
tatgtgacatttctcttcc

SEQ ID NO: 3557511 - DNA, 18 bp, Homo sapiens
tatgtgacattttacatt

SEQ ID NO: 3557512 - DNA, 17 bp, Homo sapiens
tatgtgagcgagcaagc

SEQ ID NO: 3557513 - DNA, 15 bp, Homo sapiens
tatgtgagctgtaaa

SEQ ID NO: 3557514 - DNA, 22 bp, Homo sapiens
tatgtggctgtaatgacaaaag

SEQ ID NO: 3557515 - DNA, 11 bp, Homo sapiens
tatgtgtgtgt

SEQ ID NO: 3557516 - DNA, 21 bp, Homo sapiens
tatgtgtgtgtgtgtgtgtaa

SEQ ID NO: 3557517 - DNA, 14 bp, Homo sapiens
tatgtgtgtgtgtt

SEQ ID NO: 3557518 - DNA, 23 bp, Homo sapiens
tatgtgtgtgtgttgtgtgtggg

SEQ ID NO: 3557519 - DNA, 13 bp, Homo sapiens
tatgttaaagttt

SEQ ID NO: 3557520 - DNA, 13 bp, Homo sapiens
tatgttaatattt

SEQ ID NO: 3557521 - DNA, 21 bp, Homo sapiens
tatgttagcattaaagttcta

SEQ ID NO: 3557522 - DNA, 10 bp, Homo sapiens
tatgttctct

SEQ ID NO: 3557523 - DNA, 13 bp, Homo sapiens
tatgttctctgaa

SEQ ID NO: 3557524 - DNA, 23 bp, Homo sapiens
tatgttcttagcaataaatgctt

SEQ ID NO: 3557525 - DNA, 12 bp, Homo sapiens
tatgttctttca

SEQ ID NO: 3557526 - DNA, 11 bp, Homo sapiens
tattaaaattg

SEQ ID NO: 3557527 - DNA, 14 bp, Homo sapiens
tattaaaattgtta

SEQ ID NO: 3557528 - DNA, 15 bp, Homo sapiens
tattaaacttcagca

SEQ ID NO: 3557529 - DNA, 18 bp, Homo sapiens
tattaaagggtctggaaa

SEQ ID NO: 3557530 - DNA, 19 bp, Homo sapiens
tattaaattctcaaagttt

SEQ ID NO: 3557531 - DNA, 18 bp, Homo sapiens
tattaacatattatttca

SEQ ID NO: 3557532 - DNA, 15 bp, Homo sapiens
tattaacgatgtcca

SEQ ID NO: 3557533 - DNA, 23 bp, Homo sapiens
tattaactgtattttctttcact

SEQ ID NO: 3557534 - DNA, 16 bp, Homo sapiens
tattaataatgaagta

SEQ ID NO: 3557535 - DNA, 14 bp, Homo sapiens
tattaatcaagaga

SEQ ID NO: 3557536 - DNA, 20 bp, Homo sapiens
tattaattttccaatgcaca

SEQ ID NO: 3557537 - DNA, 15 bp, Homo sapiens
tattactttaaatta

SEQ ID NO: 3557538 - DNA, 21 bp, Homo sapiens
tattactttatgaacaatttt

SEQ ID NO: 3557539 - DNA, 16 bp, Homo sapiens
tattataaaggataaa

SEQ ID NO: 3557540 - DNA, 18 bp, Homo sapiens
tattataaaggataaaga

SEQ ID NO: 3557541 - DNA, 21 bp, Homo sapiens
tattataaattctactaagtt

SEQ ID NO: 3557542 - DNA, 21 bp, Homo sapiens
tccaagcatttcatgaaaaag

SEQ ID NO: 3557543 - DNA, 15 bp, Homo sapiens
tccaagccagcggga

SEQ ID NO: 3557544 - DNA, 13 bp, Homo sapiens
tccaaggcaaaca

SEQ ID NO: 3557545 - DNA, 20 bp, Homo sapiens
tccaaggctttaaagctgag

SEQ ID NO: 3557546 - DNA, 17 bp, Homo sapiens
tccaagtccaataagac

SEQ ID NO: 3557547 - DNA, 21 bp, Homo sapiens
tccaagtgccccaccactccc

SEQ ID NO: 3557548 - DNA, 23 bp, Homo sapiens
tccaataagacactcaaatatga

SEQ ID NO: 3557549 - DNA, 22 bp, Homo sapiens
tccaatctgtgatgacattccc

SEQ ID NO: 3557550 - DNA, 21 bp, Homo sapiens
tccaatgactgagcagcatcc

SEQ ID NO: 3557551 - DNA, 17 bp, Homo sapiens
tccaatttacatactct

SEQ ID NO: 3557552 - DNA, 14 bp, Homo sapiens
tccaattttctgga

SEQ ID NO: 3557553 - DNA, 22 bp, Homo sapiens
tccaattttctggaatacatga

SEQ ID NO: 3557554 - DNA, 15 bp, Homo sapiens
tccacacccaccccc

SEQ ID NO: 3557555 - DNA, 16 bp, Homo sapiens
tccacacccaccccct

SEQ ID NO: 3557556 - DNA, 23 bp, Homo sapiens
tccacacccaccccctctggaga

SEQ ID NO: 3557557 - DNA, 23 bp, Homo sapiens
tccacactcagaaaattccctgg

SEQ ID NO: 3557558 - DNA, 18 bp, Homo sapiens
tccacagcctgcaagtca

SEQ ID NO: 3557559 - DNA, 23 bp, Homo sapiens
tccacagctggaaagttgggccc

SEQ ID NO: 3557560 - DNA, 14 bp, Homo sapiens
tccacaggggccac

SEQ ID NO: 3557561 - DNA, 18 bp, Homo sapiens
tccacatgctgcctggca

SEQ ID NO: 3557562 - DNA, 13 bp, Homo sapiens
tccaccagcaagg

SEQ ID NO: 3557563 - DNA, 13 bp, Homo sapiens
tccaccagcagca

SEQ ID NO: 3557564 - DNA, 14 bp, Homo sapiens
tccaccagcagcat

SEQ ID NO: 3557565 - DNA, 17 bp, Homo sapiens
tccaccataccttagag

SEQ ID NO: 3557566 - DNA, 15 bp, Homo sapiens
tccaccatgcactca

SEQ ID NO: 3557567 - DNA, 20 bp, Homo sapiens
tccacccagcaggcagagtg

SEQ ID NO: 3557568 - DNA, 16 bp, Homo sapiens
tccaccccccactcag

SEQ ID NO: 3557569 - DNA, 17 bp, Homo sapiens
tccaccccccactcagt

SEQ ID NO: 3557570 - DNA, 22 bp, Homo sapiens
tccaccccccactcagtgcctc

SEQ ID NO: 3557571 - DNA, 17 bp, Homo sapiens
tccaccgaccaactgcc

SEQ ID NO: 3557572 - DNA, 15 bp, Homo sapiens
tccaccttcccatgc

SEQ ID NO: 3557573 - DNA, 17 bp, Homo sapiens
tccactaccaaaagaca

SEQ ID NO: 3557574 - DNA, 18 bp, Homo sapiens
tccactatttgcagaggc

SEQ ID NO: 3557575 - DNA, 20 bp, Homo sapiens
tccactcaggcctccatctt

SEQ ID NO: 3557576 - DNA, 14 bp, Homo sapiens
tccactcccaggat

SEQ ID NO: 3557577 - DNA, 13 bp, Homo sapiens
tccactcccagtg

SEQ ID NO: 3557578 - DNA, 15 bp, Homo sapiens
tccactcccagtgct

SEQ ID NO: 3557579 - DNA, 17 bp, Homo sapiens
tccactcgacccagaat

SEQ ID NO: 3557580 - DNA, 14 bp, Homo sapiens
tccactcgtgtgtt

SEQ ID NO: 3557581 - DNA, 19 bp, Homo sapiens
tccactcttgatctctctt

SEQ ID NO: 3557582 - DNA, 21 bp, Homo sapiens
tcctacagtgactccctggga

SEQ ID NO: 3557583 - DNA, 23 bp, Homo sapiens
tcctacagtgactccctgggagc

SEQ ID NO: 3557584 - DNA, 18 bp, Homo sapiens
tcctacctgtctgctgcc

SEQ ID NO: 3557585 - DNA, 22 bp, Homo sapiens
tcctacctgtctgctgccagca

SEQ ID NO: 3557586 - DNA, 20 bp, Homo sapiens
tcctactgcgcctcgtgctg

SEQ ID NO: 3557587 - DNA, 14 bp, Homo sapiens
tcctagactgctcc

SEQ ID NO: 3557588 - DNA, 17 bp, Homo sapiens
tcctagactgctcctgg

SEQ ID NO: 3557589 - DNA, 18 bp, Homo sapiens
tcctagactgctcctggg

SEQ ID NO: 3557590 - DNA, 20 bp, Homo sapiens
tcctagactgctcctgggca

SEQ ID NO: 3557591 - DNA, 15 bp, Homo sapiens
tcctagacttgaaag

SEQ ID NO: 3557592 - DNA, 20 bp, Homo sapiens
tcctagagggaggggcctag

SEQ ID NO: 3557593 - DNA, 21 bp, Homo sapiens
tcctagcctgtgcctctggga

SEQ ID NO: 3557594 - DNA, 13 bp, Homo sapiens
tcctaggaaccag

SEQ ID NO: 3557595 - DNA, 18 bp, Homo sapiens
tcctaggaaccagccaac

SEQ ID NO: 3557596 - DNA, 21 bp, Homo sapiens
tcctaggtcatgcctcctccc

SEQ ID NO: 3557597 - DNA, 21 bp, Homo sapiens
tcctagtggagttttataaat

SEQ ID NO: 3557598 - DNA, 20 bp, Homo sapiens
tcctagttttctcctcccag

SEQ ID NO: 3557599 - DNA, 17 bp, Homo sapiens
tcctataaagtgcctcg

SEQ ID NO: 3557600 - DNA, 21 bp, Homo sapiens
tcctataaagtgcctcggaca

SEQ ID NO: 3557601 - DNA, 20 bp, Homo sapiens
tcctatagctacatgttctt

SEQ ID NO: 3557602 - DNA, 13 bp, Homo sapiens
tcctatccttata

SEQ ID NO: 3557603 - DNA, 18 bp, Homo sapiens
tcctatctccctggctca

SEQ ID NO: 3557604 - DNA, 21 bp, Homo sapiens
tcctatgatggatggcagact

SEQ ID NO: 3557605 - DNA, 18 bp, Homo sapiens
tcctcaaagaaagtgtat

SEQ ID NO: 3557606 - DNA, 20 bp, Homo sapiens
tcctcacccccagctttgct

SEQ ID NO: 3557607 - DNA, 15 bp, Homo sapiens
tcctcactctgtccc

SEQ ID NO: 3557608 - DNA, 19 bp, Homo sapiens
tcctcactctgtccctgtc

SEQ ID NO: 3557609 - DNA, 17 bp, Homo sapiens
tcctcagagaatttcta

SEQ ID NO: 3557610 - DNA, 11 bp, Homo sapiens
tcctcagcctt

SEQ ID NO: 3557611 - DNA, 21 bp, Homo sapiens
tcctcagccttgccagagatc

SEQ ID NO: 3557612 - DNA, 12 bp, Homo sapiens
tcctcagctccc

SEQ ID NO: 3557613 - DNA, 19 bp, Homo sapiens
tcctcagctccctgcctgt

SEQ ID NO: 3557614 - DNA, 22 bp, Homo sapiens
tcctcaggagccgaagcccagg

SEQ ID NO: 3557615 - DNA, 16 bp, Homo sapiens
tcctcagtgatggaat

SEQ ID NO: 3557616 - DNA, 18 bp, Homo sapiens
tcctcatctccaaggcag

SEQ ID NO: 3557617 - DNA, 19 bp, Homo sapiens
tcctcatctgggggagtgg

SEQ ID NO: 3557618 - DNA, 17 bp, Homo sapiens
tcctcatgttctgcttt

SEQ ID NO: 3557619 - DNA, 14 bp, Homo sapiens
tcctccacagagag

SEQ ID NO: 3557620 - DNA, 15 bp, Homo sapiens
tcctccacagagagg

SEQ ID NO: 3557621 - DNA, 13 bp, Homo sapiens
tcctccaccatgc

SEQ ID NO: 3557622 - DNA, 15 bp, Homo sapiens
tcctccaccatgcac

SEQ ID NO: 3557623 - DNA, 14 bp, Homo sapiens
tcctccagcctccc

SEQ ID NO: 3557624 - DNA, 12 bp, Homo sapiens
tcctccagctgg

SEQ ID NO: 3557625 - DNA, 13 bp, Homo sapiens
tcctccagctggg

SEQ ID NO: 3557626 - DNA, 19 bp, Homo sapiens
tcctccaggtttttcaatt

SEQ ID NO: 3557627 - DNA, 20 bp, Homo sapiens
tcctccaggtttttcaatta

SEQ ID NO: 3557628 - DNA, 23 bp, Homo sapiens
tcctccaggtttttcaattaaac

SEQ ID NO: 3557629 - DNA, 21 bp, Homo sapiens
tcctccatctttctacagaga

SEQ ID NO: 3557630 - DNA, 20 bp, Homo sapiens
tcctccattactctattgat

SEQ ID NO: 3557631 - DNA, 21 bp, Homo sapiens
tcctcccaatttcagactccc

SEQ ID NO: 3557632 - DNA, 16 bp, Homo sapiens
tcctcccactgcccac

SEQ ID NO: 3557633 - DNA, 13 bp, Homo sapiens
tcctcccaggcgc

SEQ ID NO: 3557634 - DNA, 15 bp, Homo sapiens
tcctccccctgcaac

SEQ ID NO: 3557635 - DNA, 14 bp, Homo sapiens
tcctcccctactct

SEQ ID NO: 3557636 - DNA, 13 bp, Homo sapiens
tcctcccgccctt

SEQ ID NO: 3557637 - DNA, 18 bp, Homo sapiens
tcctcccgcccttccatg

SEQ ID NO: 3557638 - DNA, 10 bp, Homo sapiens
tcctcccttc

SEQ ID NO: 3557639 - DNA, 16 bp, Homo sapiens
tcctcccttctgctac

SEQ ID NO: 3557640 - DNA, 18 bp, Homo sapiens
tcctcccttctgctactg

SEQ ID NO: 3557641 - DNA, 16 bp, Homo sapiens
tcctccgtagggtctt

SEQ ID NO: 3557642 - DNA, 23 bp, Homo sapiens
tcctccgtagggtctttcttggg

SEQ ID NO: 3557643 - DNA, 15 bp, Homo sapiens
tcctccgtgaaaata

SEQ ID NO: 3557644 - DNA, 16 bp, Homo sapiens
tcctcctacctcagcc

SEQ ID NO: 3557645 - DNA, 20 bp, Homo sapiens
tcctcctatctccctggctc

SEQ ID NO: 3557646 - DNA, 20 bp, Homo sapiens
tcctcctccatctttctaca

SEQ ID NO: 3557647 - DNA, 22 bp, Homo sapiens
tcctcgatggtaatacccgtcc

SEQ ID NO: 3557648 - DNA, 18 bp, Homo sapiens
tcctcgcacacactggct

SEQ ID NO: 3557649 - DNA, 19 bp, Homo sapiens
tcctcggagagcagcagca

SEQ ID NO: 3557650 - DNA, 17 bp, Homo sapiens
tcctcgtgggtcccaga

SEQ ID NO: 3557651 - DNA, 20 bp, Homo sapiens
tcctcgtgggtcccagagac

SEQ ID NO: 3557652 - DNA, 15 bp, Homo sapiens
tcctctcaggctctt

SEQ ID NO: 3557653 - DNA, 13 bp, Homo sapiens
tcctctccatacc

SEQ ID NO: 3557654 - DNA, 21 bp, Homo sapiens
tcctctccatacctgcccctg

SEQ ID NO: 3557655 - DNA, 23 bp, Homo sapiens
tcctctcccattgtccctctgcc

SEQ ID NO: 3557656 - DNA, 18 bp, Homo sapiens
tcctctccccagcccaga

SEQ ID NO: 3557657 - DNA, 23 bp, Homo sapiens
tcctctccccagcccagagacat

SEQ ID NO: 3557658 - DNA, 18 bp, Homo sapiens
tcctctcggctgccaggg

SEQ ID NO: 3557659 - DNA, 20 bp, Homo sapiens
tcctctctgagtcaaatcca

SEQ ID NO: 3557660 - DNA, 22 bp, Homo sapiens
tcctctctgagtcaaatccagt

SEQ ID NO: 3557661 - DNA, 13 bp, Homo sapiens
tcctctctgcttc

SEQ ID NO: 3557662 - DNA, 16 bp, Homo sapiens
tcctctcttgggtagg

SEQ ID NO: 3557663 - DNA, 16 bp, Homo sapiens
tcctctgcactcccac

SEQ ID NO: 3557664 - DNA, 14 bp, Homo sapiens
tcctctgcctgggc

SEQ ID NO: 3557665 - DNA, 12 bp, Homo sapiens
tcctctgctggg

SEQ ID NO: 3557666 - DNA, 13 bp, Homo sapiens
tcctctgctggga

SEQ ID NO: 3557667 - DNA, 24 bp, Homo sapiens
tcctctggtaaacattcctccagc

SEQ ID NO: 3557668 - DNA, 22 bp, Homo sapiens
tcctctgtccaggcactgctgc

SEQ ID NO: 3557669 - DNA, 11 bp, Homo sapiens
tcctctgttct

SEQ ID NO: 3557670 - DNA, 19 bp, Homo sapiens
tcctcttctattttgtaaa

SEQ ID NO: 3557671 - DNA, 12 bp, Homo sapiens
tcctcttctgct

SEQ ID NO: 3557672 - DNA, 15 bp, Homo sapiens
tcctcttgagagaaa

SEQ ID NO: 3557673 - DNA, 21 bp, Homo sapiens
tcctcttgttcctgaaatgtg

SEQ ID NO: 3557674 - DNA, 15 bp, Homo sapiens
tcctctttgctttgc

SEQ ID NO: 3557675 - DNA, 20 bp, Homo sapiens
tcctctttgctttgctttct

SEQ ID NO: 3557676 - DNA, 23 bp, Homo sapiens
tcctctttgctttgctttctgct

SEQ ID NO: 3557677 - DNA, 19 bp, Homo sapiens
tcctcttttcctggcagct

SEQ ID NO: 3557678 - DNA, 21 bp, Homo sapiens
tcctcttttcctggcagctgc

SEQ ID NO: 3557679 - DNA, 22 bp, Homo sapiens
tcctcttttcctggcagctgct

SEQ ID NO: 3557680 - DNA, 15 bp, Homo sapiens
tcctgaaatttcaga

SEQ ID NO: 3557681 - DNA, 14 bp, Homo sapiens
tcctgaagaaccag

SEQ ID NO: 3557682 - DNA, 16 bp, Homo sapiens
tcctgaagaaccagtc

SEQ ID NO: 3557683 - DNA, 18 bp, Homo sapiens
tcctgaagctgctgtgtc

SEQ ID NO: 3557684 - DNA, 23 bp, Homo sapiens
tcctgaagtgacctcactggcct

SEQ ID NO: 3557685 - DNA, 14 bp, Homo sapiens
tcctgaccttgggt

SEQ ID NO: 3557686 - DNA, 14 bp, Homo sapiens
tcctgagctggcct

SEQ ID NO: 3557687 - DNA, 14 bp, Homo sapiens
tcctgagtgcccca

SEQ ID NO: 3557688 - DNA, 15 bp, Homo sapiens
tcctgataccattct

SEQ ID NO: 3557689 - DNA, 16 bp, Homo sapiens
tcctgataccattcta

SEQ ID NO: 3557690 - DNA, 12 bp, Homo sapiens
tcctgcacacag

SEQ ID NO: 3557691 - DNA, 20 bp, Homo sapiens
tcctgcaggccaggccagct

SEQ ID NO: 3557692 - DNA, 18 bp, Homo sapiens
tcctgccaccagcatcca

SEQ ID NO: 3557693 - DNA, 20 bp, Homo sapiens
tcctgccacccagccccagc

SEQ ID NO: 3557694 - DNA, 22 bp, Homo sapiens
tcctgccacccagccccagcca

SEQ ID NO: 3557695 - DNA, 12 bp, Homo sapiens
tcctgccccctg

SEQ ID NO: 3557696 - DNA, 14 bp, Homo sapiens
tcctgccccctgcc

SEQ ID NO: 3557697 - DNA, 16 bp, Homo sapiens
tcctgccccctgccag

SEQ ID NO: 3557698 - DNA, 14 bp, Homo sapiens
tcctgcctttaagc

SEQ ID NO: 3557699 - DNA, 16 bp, Homo sapiens
tcctgcctttaagcca

SEQ ID NO: 3557700 - DNA, 18 bp, Homo sapiens
tcctgcgccctgtgcccg

SEQ ID NO: 3557701 - DNA, 20 bp, Homo sapiens
tcctgctccctgtggcactc

SEQ ID NO: 3557702 - DNA, 12 bp, Homo sapiens
tcctgctgcacc

SEQ ID NO: 3557703 - DNA, 13 bp, Homo sapiens
tcctgctggggcc

SEQ ID NO: 3557704 - DNA, 13 bp, Homo sapiens
tcctgcttttctg

SEQ ID NO: 3557705 - DNA, 17 bp, Homo sapiens
tcctggaaacagcatga

SEQ ID NO: 3557706 - DNA, 18 bp, Homo sapiens
tcctggaaacagcatgaa

SEQ ID NO: 3557707 - DNA, 13 bp, Homo sapiens
tcctggaggccca

SEQ ID NO: 3557708 - DNA, 14 bp, Homo sapiens
tcctggaggcccag

SEQ ID NO: 3557709 - DNA, 15 bp, Homo sapiens
tcctggaggctgcct

SEQ ID NO: 3557710 - DNA, 21 bp, Homo sapiens
tcctggagggaagcactgcct

SEQ ID NO: 3557711 - DNA, 16 bp, Homo sapiens
tcctggcagctgctgt

SEQ ID NO: 3557712 - DNA, 22 bp, Homo sapiens
tcctggcagggccacctgcagg

SEQ ID NO: 3557713 - DNA, 16 bp, Homo sapiens
tcctggccatcccaca

SEQ ID NO: 3557714 - DNA, 12 bp, Homo sapiens
aaaaaaaagaaa

SEQ ID NO: 3557715 - DNA, 11 bp, Homo sapiens
aaaaaaagaca

SEQ ID NO: 3557716 - DNA, 14 bp, Homo sapiens
aaaaaaagcctcca

SEQ ID NO: 3557717 - DNA, 11 bp, Homo sapiens
aaaaaagcaaa

SEQ ID NO: 3557718 - DNA, 13 bp, Homo sapiens
aaaaaatgaatag

SEQ ID NO: 3557719 - DNA, 17 bp, Homo sapiens
aaaaaatgaatagtaca

SEQ ID NO: 3557720 - DNA, 18 bp, Homo sapiens
aaaaactggatatttcaa

SEQ ID NO: 3557721 - DNA, 14 bp, Homo sapiens
aaaaacttttgagg

SEQ ID NO: 3557722 - DNA, 16 bp, Homo sapiens
aaaaagaaacttttct

SEQ ID NO: 3557723 - DNA, 18 bp, Homo sapiens
aaaaagaaagaaagagga

SEQ ID NO: 3557724 - DNA, 11 bp, Homo sapiens
aaaaagacata

SEQ ID NO: 3557725 - DNA, 15 bp, Homo sapiens
aaaaagcaaatcaga

SEQ ID NO: 3557726 - DNA, 23 bp, Homo sapiens
aaaaagcctccaagggtttcgac

SEQ ID NO: 3557727 - DNA, 16 bp, Homo sapiens
aaaaaggacatcagca

SEQ ID NO: 3557728 - DNA, 14 bp, Homo sapiens
aaaaagttgttctt

SEQ ID NO: 3557729 - DNA, 11 bp, Homo sapiens
aaaaatatatt

SEQ ID NO: 3557730 - DNA, 13 bp, Homo sapiens
aaaaatcatatag

SEQ ID NO: 3557731 - DNA, 16 bp, Homo sapiens
aaaaatcatatagacc

SEQ ID NO: 3557732 - DNA, 20 bp, Homo sapiens
aaaaatcatatagaccaatt

SEQ ID NO: 3557733 - DNA, 13 bp, Homo sapiens
aaaaatggtaatt

SEQ ID NO: 3557734 - DNA, 14 bp, Homo sapiens
aaaaatggttgatg

SEQ ID NO: 3557735 - DNA, 19 bp, Homo sapiens
aaaaatggttgatggaaaa

SEQ ID NO: 3557736 - DNA, 23 bp, Homo sapiens
aaaaatgtgaaatgcttttatat

SEQ ID NO: 3557737 - DNA, 12 bp, Homo sapiens
aaaaattacaaa

SEQ ID NO: 3557738 - DNA, 19 bp, Homo sapiens
aaaaattatctatagctaa

SEQ ID NO: 3557739 - DNA, 10 bp, Homo sapiens
aaaacaaaac

SEQ ID NO: 3557740 - DNA, 11 bp, Homo sapiens
aaaacaaaaca

SEQ ID NO: 3557741 - DNA, 12 bp, Homo sapiens
aaaacaaaacaa

SEQ ID NO: 3557742 - DNA, 21 bp, Homo sapiens
aaaacattttttttttaaatc

SEQ ID NO: 3557743 - DNA, 19 bp, Homo sapiens
aaaaccaagccgtggcttc

SEQ ID NO: 3557744 - DNA, 13 bp, Homo sapiens
aaaaccacagcag

SEQ ID NO: 3557745 - DNA, 19 bp, Homo sapiens
aaaacccagctgcacccct

SEQ ID NO: 3557746 - DNA, 22 bp, Homo sapiens
aaaacccagctgcaccccttcc

SEQ ID NO: 3557747 - DNA, 18 bp, Homo sapiens
aaaacctatttttccttt

SEQ ID NO: 3557748 - DNA, 15 bp, Homo sapiens
aaaaccttaaaagta

SEQ ID NO: 3557749 - DNA, 16 bp, Homo sapiens
aaaactatcaactaca

SEQ ID NO: 3557750 - DNA, 21 bp, Homo sapiens
aaaactatgtattaatttaga

SEQ ID NO: 3557751 - DNA, 17 bp, Homo sapiens
aaaactgaagcttttta

SEQ ID NO: 3557752 - DNA, 20 bp, Homo sapiens
aaaactggatatttcaatct

SEQ ID NO: 3557753 - DNA, 18 bp, Homo sapiens
aaaacttcattctcgtga

SEQ ID NO: 3557754 - DNA, 18 bp, Homo sapiens
aaaacttctattatccag

SEQ ID NO: 3557755 - DNA, 15 bp, Homo sapiens
aaaacttctgctcgt

SEQ ID NO: 3557756 - DNA, 22 bp, Homo sapiens
aaaacttgatgtgttatctctt

SEQ ID NO: 3557757 - DNA, 19 bp, Homo sapiens
aaaagaaacaccagtgtta

SEQ ID NO: 3557758 - DNA, 12 bp, Homo sapiens
aaaagaaacttt

SEQ ID NO: 3557759 - DNA, 14 bp, Homo sapiens
aaaagaagaaaaga

SEQ ID NO: 3557760 - DNA, 17 bp, Homo sapiens
aaaagaagaaaagattc

SEQ ID NO: 3557761 - DNA, 17 bp, Homo sapiens
aaaagaataaaaacttt

SEQ ID NO: 3557762 - DNA, 11 bp, Homo sapiens
aaaagacatta

SEQ ID NO: 3557763 - DNA, 15 bp, Homo sapiens
aaaagatgaaaaaga

SEQ ID NO: 3557764 - DNA, 17 bp, Homo sapiens
aaaagatgaaaatattt

SEQ ID NO: 3557765 - DNA, 20 bp, Homo sapiens
aaaagatgaggactcagaag

SEQ ID NO: 3557766 - DNA, 17 bp, Homo sapiens
aaaagcaaatcagaaaa

SEQ ID NO: 3557767 - DNA, 14 bp, Homo sapiens
aaaagcagacattt

SEQ ID NO: 3557768 - DNA, 14 bp, Homo sapiens
aaaagcattttgta

SEQ ID NO: 3557769 - DNA, 14 bp, Homo sapiens
aaaagccacagcag

SEQ ID NO: 3557770 - DNA, 18 bp, Homo sapiens
aaaagccacagcagagca

SEQ ID NO: 3557771 - DNA, 23 bp, Homo sapiens
aaaagctctgttccatgcaactg

SEQ ID NO: 3557772 - DNA, 19 bp, Homo sapiens
aaaaggaacaaaaattaca

SEQ ID NO: 3557773 - DNA, 21 bp, Homo sapiens
aaaaggatgtataaattttta

SEQ ID NO: 3557774 - DNA, 11 bp, Homo sapiens
aaaaggcaggt

SEQ ID NO: 3557775 - DNA, 15 bp, Homo sapiens
aaaaggtattaaatt

SEQ ID NO: 3557776 - DNA, 14 bp, Homo sapiens
aaaagtaataaaga

SEQ ID NO: 3557777 - DNA, 15 bp, Homo sapiens
aaaagtaataaagag

SEQ ID NO: 3557778 - DNA, 16 bp, Homo sapiens
aaaagtaataaagaga

SEQ ID NO: 3557779 - DNA, 17 bp, Homo sapiens
aaaagtaataaagagaa

SEQ ID NO: 3557780 - DNA, 21 bp, Homo sapiens
aaaagtctacctgtgtttttt

SEQ ID NO: 3557781 - DNA, 13 bp, Homo sapiens
aaaagttatttat

SEQ ID NO: 3557782 - DNA, 18 bp, Homo sapiens
aaaagttgaagatcgtga

SEQ ID NO: 3557783 - DNA, 11 bp, Homo sapiens
aaaagtttcta

SEQ ID NO: 3557784 - DNA, 13 bp, Homo sapiens
aaaataaaccaaa

SEQ ID NO: 3557785 - DNA, 13 bp, Homo sapiens
aaaataaagcaag

SEQ ID NO: 3557786 - DNA, 14 bp, Homo sapiens
aaaataaagcaatg

SEQ ID NO: 3557787 - DNA, 19 bp, Homo sapiens
aaaataaatcttagtgttc

SEQ ID NO: 3557788 - DNA, 12 bp, Homo sapiens
aaaataaattat

SEQ ID NO: 3557789 - DNA, 12 bp, Homo sapiens
aaaataaattta

SEQ ID NO: 3557790 - DNA, 13 bp, Homo sapiens
aaaataactgaac

SEQ ID NO: 3557791 - DNA, 13 bp, Homo sapiens
aaaataagtcaaa

SEQ ID NO: 3557792 - DNA, 18 bp, Homo sapiens
aacattcagctctggaga

SEQ ID NO: 3557793 - DNA, 19 bp, Homo sapiens
aacattcagctctggagaa

SEQ ID NO: 3557794 - DNA, 21 bp, Homo sapiens
aacattggcacatgccacctg

SEQ ID NO: 3557795 - DNA, 14 bp, Homo sapiens
aacatttctcatgt

SEQ ID NO: 3557796 - DNA, 23 bp, Homo sapiens
aacatttctcatgttgaagcttt

SEQ ID NO: 3557797 - DNA, 21 bp, Homo sapiens
aacatttgggacctggataat

SEQ ID NO: 3557798 - DNA, 19 bp, Homo sapiens
aacattttttttttaaatc

SEQ ID NO: 3557799 - DNA, 16 bp, Homo sapiens
aaccaaatatgttaaa

SEQ ID NO: 3557800 - DNA, 16 bp, Homo sapiens
aaccaaattgcactga

SEQ ID NO: 3557801 - DNA, 18 bp, Homo sapiens
aaccaaattgcactgaag

SEQ ID NO: 3557802 - DNA, 23 bp, Homo sapiens
aaccacaccacatctaagcctga

SEQ ID NO: 3557803 - DNA, 15 bp, Homo sapiens
aaccacagttattaa

SEQ ID NO: 3557804 - DNA, 20 bp, Homo sapiens
aaccacctggttgaatataa

SEQ ID NO: 3557805 - DNA, 18 bp, Homo sapiens
aaccagaacgtggtttgc

SEQ ID NO: 3557806 - DNA, 13 bp, Homo sapiens
aaccagataacat

SEQ ID NO: 3557807 - DNA, 21 bp, Homo sapiens
aaccagcccgacagtgccatc

SEQ ID NO: 3557808 - DNA, 22 bp, Homo sapiens
aacccaaaggtggcagcttgtg

SEQ ID NO: 3557809 - DNA, 16 bp, Homo sapiens
aacccaaggtgaggtg

SEQ ID NO: 3557810 - DNA, 14 bp, Homo sapiens
aacccacaattgaa

SEQ ID NO: 3557811 - DNA, 21 bp, Homo sapiens
aacccacataaaagccccagc

SEQ ID NO: 3557812 - DNA, 22 bp, Homo sapiens
aacccacataaaagccccagct

SEQ ID NO: 3557813 - DNA, 16 bp, Homo sapiens
aacccacctctcctgc

SEQ ID NO: 3557814 - DNA, 20 bp, Homo sapiens
aacccacctctcctgccctg

SEQ ID NO: 3557815 - DNA, 18 bp, Homo sapiens
aacccacgacctgtcctg

SEQ ID NO: 3557816 - DNA, 12 bp, Homo sapiens
aacccagactca

SEQ ID NO: 3557817 - DNA, 21 bp, Homo sapiens
aacccagactgtctccacggc

SEQ ID NO: 3557818 - DNA, 22 bp, Homo sapiens
aacccagagggttgctggtcct

SEQ ID NO: 3557819 - DNA, 11 bp, Homo sapiens
aacccagctgc

SEQ ID NO: 3557820 - DNA, 15 bp, Homo sapiens
aacccagctgcaccc

SEQ ID NO: 3557821 - DNA, 21 bp, Homo sapiens
aacccagctgcaccccttcct

SEQ ID NO: 3557822 - DNA, 14 bp, Homo sapiens
aacccagtctttct

SEQ ID NO: 3557823 - DNA, 15 bp, Homo sapiens
aacccagtctttctt

SEQ ID NO: 3557824 - DNA, 13 bp, Homo sapiens
aaccccagcccca

SEQ ID NO: 3557825 - DNA, 19 bp, Homo sapiens
aacccctctccaggcctgt

SEQ ID NO: 3557826 - DNA, 14 bp, Homo sapiens
aacccctctcttag

SEQ ID NO: 3557827 - DNA, 19 bp, Homo sapiens
aaccctacagtatataagc

SEQ ID NO: 3557828 - DNA, 21 bp, Homo sapiens
aacccttggagccaatggaga

SEQ ID NO: 3557829 - DNA, 16 bp, Homo sapiens
aaccggaaggaggcca

SEQ ID NO: 3557830 - DNA, 13 bp, Homo sapiens
aaccgggatggga

SEQ ID NO: 3557831 - DNA, 23 bp, Homo sapiens
aacctacagactccatctcttct

SEQ ID NO: 3557832 - DNA, 13 bp, Homo sapiens
aacctacattcca

SEQ ID NO: 3557833 - DNA, 15 bp, Homo sapiens
aacctatttttcctt

SEQ ID NO: 3557834 - DNA, 18 bp, Homo sapiens
aacctcagattcttcatt

SEQ ID NO: 3557835 - DNA, 13 bp, Homo sapiens
aacctcagcctgg

SEQ ID NO: 3557836 - DNA, 14 bp, Homo sapiens
aacctcattctggt

SEQ ID NO: 3557837 - DNA, 11 bp, Homo sapiens
aacctccagac

SEQ ID NO: 3557838 - DNA, 12 bp, Homo sapiens
aacctccagact

SEQ ID NO: 3557839 - DNA, 18 bp, Homo sapiens
aacctccagactcagcag

SEQ ID NO: 3557840 - DNA, 17 bp, Homo sapiens
aacctctaagtgctgct

SEQ ID NO: 3557841 - DNA, 18 bp, Homo sapiens
aacctctaagtgctgctg

SEQ ID NO: 3557842 - DNA, 19 bp, Homo sapiens
aacctctaagtgctgctgt

SEQ ID NO: 3557843 - DNA, 20 bp, Homo sapiens
aacctctaagtgctgctgtg

SEQ ID NO: 3557844 - DNA, 22 bp, Homo sapiens
aacctgactcaattatttgcat

SEQ ID NO: 3557845 - DNA, 18 bp, Homo sapiens
aacctgaggtctcattca

SEQ ID NO: 3557846 - DNA, 20 bp, Homo sapiens
aacctgctctcctcttgcca

SEQ ID NO: 3557847 - DNA, 13 bp, Homo sapiens
aacctgcttttca

SEQ ID NO: 3557848 - DNA, 23 bp, Homo sapiens
aacctgggaaggccagccttgta

SEQ ID NO: 3557849 - DNA, 15 bp, Homo sapiens
aacctgggaggcaga

SEQ ID NO: 3557850 - DNA, 23 bp, Homo sapiens
aacctggggtgaatacttatttt

SEQ ID NO: 3557851 - DNA, 22 bp, Homo sapiens
aacctgtgaccagtctgaccct

SEQ ID NO: 3557852 - DNA, 18 bp, Homo sapiens
aacctgttcttagagtgt

SEQ ID NO: 3557853 - DNA, 13 bp, Homo sapiens
aaccttaaaagta

SEQ ID NO: 3557854 - DNA, 22 bp, Homo sapiens
aaccttaaaagtaataaagaga

SEQ ID NO: 3557855 - DNA, 13 bp, Homo sapiens
aaccttaatgaca

SEQ ID NO: 3557856 - DNA, 18 bp, Homo sapiens
aaccttaatgacaacact

SEQ ID NO: 3557857 - DNA, 14 bp, Homo sapiens
aaccttcaacccag

SEQ ID NO: 3557858 - DNA, 13 bp, Homo sapiens
aaccttccaccca

SEQ ID NO: 3557859 - DNA, 15 bp, Homo sapiens
aacgagcagcccagg

SEQ ID NO: 3557860 - DNA, 16 bp, Homo sapiens
aacgcagccctgcttt

SEQ ID NO: 3557861 - DNA, 20 bp, Homo sapiens
aacgcccctccaaacctcca

SEQ ID NO: 3557862 - DNA, 21 bp, Homo sapiens
aacgcccctccaaacctccag

SEQ ID NO: 3557863 - DNA, 14 bp, Homo sapiens
aacgcccctgtggc

SEQ ID NO: 3557864 - DNA, 19 bp, Homo sapiens
aacgccctggtaaggctgg

SEQ ID NO: 3557865 - DNA, 14 bp, Homo sapiens
aacgcgtctgcctg

SEQ ID NO: 3557866 - DNA, 19 bp, Homo sapiens
aacgcgtctgcctgggccg

SEQ ID NO: 3557867 - DNA, 16 bp, Homo sapiens
aacggattattttttc

SEQ ID NO: 3557868 - DNA, 18 bp, Homo sapiens
aacggattattttttcag

SEQ ID NO: 3557869 - DNA, 20 bp, Homo sapiens
aacggattattttttcagac

SEQ ID NO: 3557870 - DNA, 18 bp, Homo sapiens
aacggcaacgtagcctgg

SEQ ID NO: 3557871 - DNA, 14 bp, Homo sapiens
aacgggtcagtatt

SEQ ID NO: 3557872 - DNA, 23 bp, Homo sapiens
aacgtgagagaaagagagaagcc

SEQ ID NO: 3557873 - DNA, 23 bp, Homo sapiens
aacgtggattgtatttaagacat

SEQ ID NO: 3557874 - DNA, 15 bp, Homo sapiens
aactaaaataatttt

SEQ ID NO: 3557875 - DNA, 18 bp, Homo sapiens
aactaccatgctttgttt

SEQ ID NO: 3557876 - DNA, 19 bp, Homo sapiens
aactacctatccttacatt

SEQ ID NO: 3557877 - DNA, 20 bp, Homo sapiens
aactactacctgtaatgaca

SEQ ID NO: 3557878 - DNA, 15 bp, Homo sapiens
aactactctttgatt

SEQ ID NO: 3557879 - DNA, 22 bp, Homo sapiens
aactacttctcttgttaggtaa

SEQ ID NO: 3557880 - DNA, 17 bp, Homo sapiens
aactactttataactaa

SEQ ID NO: 3557881 - DNA, 15 bp, Homo sapiens
aactatatataatgt

SEQ ID NO: 3557882 - DNA, 16 bp, Homo sapiens
aactatatataatgta

SEQ ID NO: 3557883 - DNA, 18 bp, Homo sapiens
aactatatgtgaaacatt

SEQ ID NO: 3557884 - DNA, 17 bp, Homo sapiens
aactatgcatggtgccc

SEQ ID NO: 3557885 - DNA, 13 bp, Homo sapiens
aactattacagtg

SEQ ID NO: 3557886 - DNA, 15 bp, Homo sapiens
aactattacagtgtt

SEQ ID NO: 3557887 - DNA, 16 bp, Homo sapiens
aactattacagtgttg

SEQ ID NO: 3557888 - DNA, 19 bp, Homo sapiens
aactattctgggggcccga

SEQ ID NO: 3557889 - DNA, 15 bp, Homo sapiens
aactattgcatttat

SEQ ID NO: 3557890 - DNA, 16 bp, Homo sapiens
aactattgcatttata

SEQ ID NO: 3557891 - DNA, 21 bp, Homo sapiens
aactattgcatttatatgtac

SEQ ID NO: 3557892 - DNA, 24 bp, Homo sapiens
aactattgtgctcagagacactgt

SEQ ID NO: 3557893 - DNA, 16 bp, Homo sapiens
aactcaaaatatttgt

SEQ ID NO: 3557894 - DNA, 23 bp, Homo sapiens
aactcaccctgggagccagtcct

SEQ ID NO: 3557895 - DNA, 12 bp, Homo sapiens
aactcagatcca

SEQ ID NO: 3557896 - DNA, 15 bp, Homo sapiens
aactcagatccaggg

SEQ ID NO: 3557897 - DNA, 22 bp, Homo sapiens
aactcagatccagggacagagg

SEQ ID NO: 3557898 - DNA, 22 bp, Homo sapiens
aactcattgctctgttaataat

SEQ ID NO: 3557899 - DNA, 21 bp, Homo sapiens
aactccaccgaccaactgccc

SEQ ID NO: 3557900 - DNA, 13 bp, Homo sapiens
aactccaggcatg

SEQ ID NO: 3557901 - DNA, 16 bp, Homo sapiens
aactccaggctggaag

SEQ ID NO: 3557902 - DNA, 17 bp, Homo sapiens
aactccaggggcaccta

SEQ ID NO: 3557903 - DNA, 19 bp, Homo sapiens
aactccatctcaaaacaaa

SEQ ID NO: 3557904 - DNA, 18 bp, Homo sapiens
aactcccaacttcttcct

SEQ ID NO: 3557905 - DNA, 14 bp, Homo sapiens
aactcctggccttt

SEQ ID NO: 3557906 - DNA, 19 bp, Homo sapiens
aactcctgtcttctttctc

SEQ ID NO: 3557907 - DNA, 23 bp, Homo sapiens
aactcggtgtccccaccatctgc

SEQ ID NO: 3557908 - DNA, 13 bp, Homo sapiens
aactctaccctga

SEQ ID NO: 3557909 - DNA, 12 bp, Homo sapiens
aactctagctgg

SEQ ID NO: 3557910 - DNA, 23 bp, Homo sapiens
aactctagctgggggtgggccag

SEQ ID NO: 3557911 - DNA, 22 bp, Homo sapiens
aactctcaccatgatgtgaaga

SEQ ID NO: 3557912 - DNA, 16 bp, Homo sapiens
aactctcagaaataaa

SEQ ID NO: 3557913 - DNA, 22 bp, Homo sapiens
aactctgctgtctaacctgtga

SEQ ID NO: 3557914 - DNA, 22 bp, Homo sapiens
aactctgttacactttttggaa

SEQ ID NO: 3557915 - DNA, 22 bp, Homo sapiens
aactctgttgcaagtgcaataa

SEQ ID NO: 3557916 - DNA, 21 bp, Homo sapiens
aactcttcaatctcttgcact

SEQ ID NO: 3557917 - DNA, 21 bp, Homo sapiens
aactcttctttgctgcattcc

SEQ ID NO: 3557918 - DNA, 14 bp, Homo sapiens
aactgaaccaaatt

SEQ ID NO: 3557919 - DNA, 11 bp, Homo sapiens
aactgaagcat

SEQ ID NO: 3557920 - DNA, 14 bp, Homo sapiens
aactgacaatttta

SEQ ID NO: 3557921 - DNA, 23 bp, Homo sapiens
aactgacctgagcggcaccctgg

SEQ ID NO: 3557922 - DNA, 22 bp, Homo sapiens
aactgacgattcttaatcaaga

SEQ ID NO: 3557923 - DNA, 20 bp, Homo sapiens
aactgaggagatgaccaggg

SEQ ID NO: 3557924 - DNA, 21 bp, Homo sapiens
aataggaatcttcactagaag

SEQ ID NO: 3557925 - DNA, 15 bp, Homo sapiens
aataggatcctggag

SEQ ID NO: 3557926 - DNA, 21 bp, Homo sapiens
aataggcagggggccctgccc

SEQ ID NO: 3557927 - DNA, 23 bp, Homo sapiens
aataggcagggggccctgcccca

SEQ ID NO: 3557928 - DNA, 17 bp, Homo sapiens
aataggcattttaagta

SEQ ID NO: 3557929 - DNA, 18 bp, Homo sapiens
aataggtcatatgttgtg

SEQ ID NO: 3557930 - DNA, 17 bp, Homo sapiens
aatagtacatgcagaaa

SEQ ID NO: 3557931 - DNA, 20 bp, Homo sapiens
aatagtatcctccaggtttt

SEQ ID NO: 3557932 - DNA, 14 bp, Homo sapiens
aatagtctagatgg

SEQ ID NO: 3557933 - DNA, 20 bp, Homo sapiens
aatatagatgtaatttttca

SEQ ID NO: 3557934 - DNA, 14 bp, Homo sapiens
aatatatattttgt

SEQ ID NO: 3557935 - DNA, 12 bp, Homo sapiens
aatatattttag

SEQ ID NO: 3557936 - DNA, 12 bp, Homo sapiens
aatatattttct

SEQ ID NO: 3557937 - DNA, 14 bp, Homo sapiens
aatatcaatcaagc

SEQ ID NO: 3557938 - DNA, 20 bp, Homo sapiens
aatatcaccaaaaacctatt

SEQ ID NO: 3557939 - DNA, 16 bp, Homo sapiens
aatatccctacatgta

SEQ ID NO: 3557940 - DNA, 17 bp, Homo sapiens
aatatccctacatgtat

SEQ ID NO: 3557941 - DNA, 18 bp, Homo sapiens
aatatccctacatgtatt

SEQ ID NO: 3557942 - DNA, 19 bp, Homo sapiens
aatatccctacatgtattg

SEQ ID NO: 3557943 - DNA, 19 bp, Homo sapiens
aatatcccttggacatttt

SEQ ID NO: 3557944 - DNA, 20 bp, Homo sapiens
aatatcccttggacatttta

SEQ ID NO: 3557945 - DNA, 23 bp, Homo sapiens
aatatcgttagggtgaagcatta

SEQ ID NO: 3557946 - DNA, 20 bp, Homo sapiens
aatatgacaaacatcattgt

SEQ ID NO: 3557947 - DNA, 18 bp, Homo sapiens
aatatgcaagcagctttt

SEQ ID NO: 3557948 - DNA, 18 bp, Homo sapiens
aatatggtcttttggtta

SEQ ID NO: 3557949 - DNA, 16 bp, Homo sapiens
aatatgtagtatctat

SEQ ID NO: 3557950 - DNA, 21 bp, Homo sapiens
aatatgtattctgtaaaagaa

SEQ ID NO: 3557951 - DNA, 14 bp, Homo sapiens
aatatgttaaagtt

SEQ ID NO: 3557952 - DNA, 16 bp, Homo sapiens
aatattaaaattgtta

SEQ ID NO: 3557953 - DNA, 17 bp, Homo sapiens
aatattaaaattgttaa

SEQ ID NO: 3557954 - DNA, 20 bp, Homo sapiens
aatattaacatattatttca

SEQ ID NO: 3557955 - DNA, 22 bp, Homo sapiens
aatattactcagtttatgttgt

SEQ ID NO: 3557956 - DNA, 20 bp, Homo sapiens
aatattagttggctttcata

SEQ ID NO: 3557957 - DNA, 21 bp, Homo sapiens
aatattatacttctttattca

SEQ ID NO: 3557958 - DNA, 13 bp, Homo sapiens
aatattcctttat

SEQ ID NO: 3557959 - DNA, 21 bp, Homo sapiens
aatattcctttgcatattata

SEQ ID NO: 3557960 - DNA, 14 bp, Homo sapiens
aatattgacttgta

SEQ ID NO: 3557961 - DNA, 17 bp, Homo sapiens
aatattgatatgcttat

SEQ ID NO: 3557962 - DNA, 13 bp, Homo sapiens
aatattgtgcatg

SEQ ID NO: 3557963 - DNA, 12 bp, Homo sapiens
aatatttaagac

SEQ ID NO: 3557964 - DNA, 15 bp, Homo sapiens
aatatttaccaaagt

SEQ ID NO: 3557965 - DNA, 19 bp, Homo sapiens
aatatttattacacaaaga

SEQ ID NO: 3557966 - DNA, 20 bp, Homo sapiens
aatatttcttgctgcttcta

SEQ ID NO: 3557967 - DNA, 16 bp, Homo sapiens
aatattttaattaaaa

SEQ ID NO: 3557968 - DNA, 21 bp, Homo sapiens
aatattttaggtgtaaaataa

SEQ ID NO: 3557969 - DNA, 16 bp, Homo sapiens
aatattttatgtgtaa

SEQ ID NO: 3557970 - DNA, 18 bp, Homo sapiens
aatatttttatatacaga

SEQ ID NO: 3557971 - DNA, 21 bp, Homo sapiens
aatattttttatttctaagta

SEQ ID NO: 3557972 - DNA, 14 bp, Homo sapiens
aatcaaaacaagtg

SEQ ID NO: 3557973 - DNA, 13 bp, Homo sapiens
aatcaaatatatt

SEQ ID NO: 3557974 - DNA, 16 bp, Homo sapiens
aatcaaatatattatt

SEQ ID NO: 3557975 - DNA, 13 bp, Homo sapiens
aatcaaattctgt

SEQ ID NO: 3557976 - DNA, 16 bp, Homo sapiens
aatcaaattctgtctg

SEQ ID NO: 3557977 - DNA, 20 bp, Homo sapiens
aatcaaattctgtctgggga

SEQ ID NO: 3557978 - DNA, 15 bp, Homo sapiens
aatcaagagaaactt

SEQ ID NO: 3557979 - DNA, 14 bp, Homo sapiens
aatcaagtattttg

SEQ ID NO: 3557980 - DNA, 19 bp, Homo sapiens
aatcacactgtcttctgat

SEQ ID NO: 3557981 - DNA, 21 bp, Homo sapiens
aatcacagggaatggccacaa

SEQ ID NO: 3557982 - DNA, 21 bp, Homo sapiens
aatcactgtgcttaatttaaa

SEQ ID NO: 3557983 - DNA, 11 bp, Homo sapiens
aatcagaaaac

SEQ ID NO: 3557984 - DNA, 19 bp, Homo sapiens
aatcagaacagatgctgag

SEQ ID NO: 3557985 - DNA, 23 bp, Homo sapiens
aatcagaactcaaatggggccag

SEQ ID NO: 3557986 - DNA, 12 bp, Homo sapiens
aatcagcattct

SEQ ID NO: 3557987 - DNA, 17 bp, Homo sapiens
aatcagcccagtgcaaa

SEQ ID NO: 3557988 - DNA, 22 bp, Homo sapiens
aatcagctggacatactgctgg

SEQ ID NO: 3557989 - DNA, 12 bp, Homo sapiens
aatcagtgatta

SEQ ID NO: 3557990 - DNA, 13 bp, Homo sapiens
aatcatacaaact

SEQ ID NO: 3557991 - DNA, 15 bp, Homo sapiens
aatcatcccttaata

SEQ ID NO: 3557992 - DNA, 12 bp, Homo sapiens
aatcattgttgc

SEQ ID NO: 3557993 - DNA, 22 bp, Homo sapiens
aatccaaaaagctctgaaaaca

SEQ ID NO: 3557994 - DNA, 22 bp, Homo sapiens
aatccacccccaggtgcagccc

SEQ ID NO: 3557995 - DNA, 21 bp, Homo sapiens
aatccaggcagatccaggact

SEQ ID NO: 3557996 - DNA, 14 bp, Homo sapiens
aatccagtattatc

SEQ ID NO: 3557997 - DNA, 14 bp, Homo sapiens
aatccagtggtggg

SEQ ID NO: 3557998 - DNA, 19 bp, Homo sapiens
aatccatgaaagaacttaa

SEQ ID NO: 3557999 - DNA, 21 bp, Homo sapiens
aatccattcacaagcctcctg

SEQ ID NO: 3558000 - DNA, 14 bp, Homo sapiens
aatccattttttag

SEQ ID NO: 3558001 - DNA, 18 bp, Homo sapiens
aatcccaatctttctata

SEQ ID NO: 3558002 - DNA, 17 bp, Homo sapiens
aatcccagactgacaga

SEQ ID NO: 3558003 - DNA, 15 bp, Homo sapiens
aatccgtacttgggt

SEQ ID NO: 3558004 - DNA, 21 bp, Homo sapiens
aatcctagactgctcctgggc

SEQ ID NO: 3558005 - DNA, 22 bp, Homo sapiens
aatcctagactgctcctgggca

SEQ ID NO: 3558006 - DNA, 19 bp, Homo sapiens
aatcctagacttgaaagtt

SEQ ID NO: 3558007 - DNA, 17 bp, Homo sapiens
aatcctatatagaatgc

SEQ ID NO: 3558008 - DNA, 21 bp, Homo sapiens
aatcctattctgatgaatctc

SEQ ID NO: 3558009 - DNA, 16 bp, Homo sapiens
aatcctcaggaaatta

SEQ ID NO: 3558010 - DNA, 17 bp, Homo sapiens
aatcctgaactttctcc

SEQ ID NO: 3558011 - DNA, 16 bp, Homo sapiens
aatcctgattcatatt

SEQ ID NO: 3558012 - DNA, 13 bp, Homo sapiens
aatccttgcttat

SEQ ID NO: 3558013 - DNA, 18 bp, Homo sapiens
aatccttttcctgttcat

SEQ ID NO: 3558014 - DNA, 17 bp, Homo sapiens
aatccttttccttattt

SEQ ID NO: 3558015 - DNA, 14 bp, Homo sapiens
aatctaaaatggca

SEQ ID NO: 3558016 - DNA, 20 bp, Homo sapiens
aatctaaaatggcagagaag

SEQ ID NO: 3558017 - DNA, 14 bp, Homo sapiens
aatctaaaatttca

SEQ ID NO: 3558018 - DNA, 19 bp, Homo sapiens
aatctaaaatttcataatt

SEQ ID NO: 3558019 - DNA, 15 bp, Homo sapiens
aatctaatctgaact

SEQ ID NO: 3558020 - DNA, 23 bp, Homo sapiens
aatctaatgtgagtgtgaagctt

SEQ ID NO: 3558021 - DNA, 14 bp, Homo sapiens
aatctaattttttc

SEQ ID NO: 3558022 - DNA, 15 bp, Homo sapiens
aatctagaggagggg

SEQ ID NO: 3558023 - DNA, 17 bp, Homo sapiens
aatctatttcacttatt

SEQ ID NO: 3558024 - DNA, 17 bp, Homo sapiens
aatctcattgcttacaa

SEQ ID NO: 3558025 - DNA, 12 bp, Homo sapiens
aatctgacccag

SEQ ID NO: 3558026 - DNA, 13 bp, Homo sapiens
aatctgacccagt

SEQ ID NO: 3558027 - DNA, 15 bp, Homo sapiens
aatctgacccagtgc

SEQ ID NO: 3558028 - DNA, 22 bp, Homo sapiens
aatctgagcaggtacatttctg

SEQ ID NO: 3558029 - DNA, 15 bp, Homo sapiens
aatctgatgtataat

SEQ ID NO: 3558030 - DNA, 19 bp, Homo sapiens
aatctgatgtataatgtaa

SEQ ID NO: 3558031 - DNA, 16 bp, Homo sapiens
aatctgcttcatccaa

SEQ ID NO: 3558032 - DNA, 18 bp, Homo sapiens
aatctggactcctctgtc

SEQ ID NO: 3558033 - DNA, 15 bp, Homo sapiens
aatctgtgcaaacag

SEQ ID NO: 3558034 - DNA, 16 bp, Homo sapiens
aatctgtgcaaacagt

SEQ ID NO: 3558035 - DNA, 14 bp, Homo sapiens
aatcttaatgtctg

SEQ ID NO: 3558036 - DNA, 19 bp, Homo sapiens
aatcttaatgtctggtgtt

SEQ ID NO: 3558037 - DNA, 23 bp, Homo sapiens
aatcttagtgtatgattactggc

SEQ ID NO: 3558038 - DNA, 14 bp, Homo sapiens
aatcttagtgttca

SEQ ID NO: 3558039 - DNA, 22 bp, Homo sapiens
aatcttattgtttaatcttttt

SEQ ID NO: 3558040 - DNA, 19 bp, Homo sapiens
aatcttgaccaacagaaac

SEQ ID NO: 3558041 - DNA, 21 bp, Homo sapiens
aatctttagagaagtatacat

SEQ ID NO: 3558042 - DNA, 22 bp, Homo sapiens
aatctttagagaagtatacata

SEQ ID NO: 3558043 - DNA, 12 bp, Homo sapiens
aatctttagcct

SEQ ID NO: 3558044 - DNA, 20 bp, Homo sapiens
aatctttcatgtcttgtcat

SEQ ID NO: 3558045 - DNA, 15 bp, Homo sapiens
aatctttctatataa

SEQ ID NO: 3558046 - DNA, 16 bp, Homo sapiens
aatctttctatataaa

SEQ ID NO: 3558047 - DNA, 20 bp, Homo sapiens
aatctttctatataaaatgt

SEQ ID NO: 3558048 - DNA, 13 bp, Homo sapiens
aatctttctgcag

SEQ ID NO: 3558049 - DNA, 16 bp, Homo sapiens
aatcttttaaattgca

SEQ ID NO: 3558050 - DNA, 19 bp, Homo sapiens
aatgaaaataactgaacca

SEQ ID NO: 3558051 - DNA, 21 bp, Homo sapiens
aatgaaatcctgcttcagtgt

SEQ ID NO: 3558052 - DNA, 17 bp, Homo sapiens
aatgaaatccttttcct

SEQ ID NO: 3558053 - DNA, 14 bp, Homo sapiens
aatgaaatgcatat

SEQ ID NO: 3558054 - DNA, 17 bp, Homo sapiens
aatgaaatttaattaca

SEQ ID NO: 3558055 - DNA, 22 bp, Homo sapiens
aatgaaatttaattacaaacaa

SEQ ID NO: 3558056 - DNA, 23 bp, Homo sapiens
acagtccgcagttgtagcagaaa

SEQ ID NO: 3558057 - DNA, 15 bp, Homo sapiens
acagtctcaggaaat

SEQ ID NO: 3558058 - DNA, 13 bp, Homo sapiens
acagtctgctcct

SEQ ID NO: 3558059 - DNA, 18 bp, Homo sapiens
acagtctgctcctcttgt

SEQ ID NO: 3558060 - DNA, 15 bp, Homo sapiens
acagtgactccctgg

SEQ ID NO: 3558061 - DNA, 17 bp, Homo sapiens
acagtgagcctgaattt

SEQ ID NO: 3558062 - DNA, 17 bp, Homo sapiens
acagtgcatctcagccc

SEQ ID NO: 3558063 - DNA, 14 bp, Homo sapiens
acagtggcctcttg

SEQ ID NO: 3558064 - DNA, 20 bp, Homo sapiens
acagtgggagctgagctgga

SEQ ID NO: 3558065 - DNA, 23 bp, Homo sapiens
acagtgggcgttgggagcctagc

SEQ ID NO: 3558066 - DNA, 18 bp, Homo sapiens
acagtggggctgcaggca

SEQ ID NO: 3558067 - DNA, 20 bp, Homo sapiens
acagtggggctgcaggcagg

SEQ ID NO: 3558068 - DNA, 15 bp, Homo sapiens
acagtggttgcctgg

SEQ ID NO: 3558069 - DNA, 17 bp, Homo sapiens
acagtgtaaatcccaga

SEQ ID NO: 3558070 - DNA, 19 bp, Homo sapiens
acagtgttgaaaatgttca

SEQ ID NO: 3558071 - DNA, 17 bp, Homo sapiens
acagttattaattaaag

SEQ ID NO: 3558072 - DNA, 22 bp, Homo sapiens
acagttctttgggccagacatg

SEQ ID NO: 3558073 - DNA, 15 bp, Homo sapiens
acagttggtaacttt

SEQ ID NO: 3558074 - DNA, 22 bp, Homo sapiens
acagtttattgatattcaataa

SEQ ID NO: 3558075 - DNA, 19 bp, Homo sapiens
acagtttcttgcttggaag

SEQ ID NO: 3558076 - DNA, 16 bp, Homo sapiens
acagttttctgagaaa

SEQ ID NO: 3558077 - DNA, 18 bp, Homo sapiens
acagttttctgagaaaga

SEQ ID NO: 3558078 - DNA, 21 bp, Homo sapiens
acagttttctgagaaagacta

SEQ ID NO: 3558079 - DNA, 14 bp, Homo sapiens
acagttttcttcat

SEQ ID NO: 3558080 - DNA, 14 bp, Homo sapiens
acataaaaaggaca

SEQ ID NO: 3558081 - DNA, 15 bp, Homo sapiens
acataaaaaggacat

SEQ ID NO: 3558082 - DNA, 12 bp, Homo sapiens
acataaacaaag

SEQ ID NO: 3558083 - DNA, 21 bp, Homo sapiens
acataaacaaagacattgaca

SEQ ID NO: 3558084 - DNA, 19 bp, Homo sapiens
acataacggaaagttttta

SEQ ID NO: 3558085 - DNA, 14 bp, Homo sapiens
acataataaatcac

SEQ ID NO: 3558086 - DNA, 17 bp, Homo sapiens
acataataagtttcata

SEQ ID NO: 3558087 - DNA, 13 bp, Homo sapiens
acataatggtact

SEQ ID NO: 3558088 - DNA, 17 bp, Homo sapiens
acataatggtactccca

SEQ ID NO: 3558089 - DNA, 21 bp, Homo sapiens
acataatggtactcccaaact

SEQ ID NO: 3558090 - DNA, 23 bp, Homo sapiens
acatacagagtgggccccgggct

SEQ ID NO: 3558091 - DNA, 14 bp, Homo sapiens
acatactctgctta

SEQ ID NO: 3558092 - DNA, 16 bp, Homo sapiens
acatacttgaagggcc

SEQ ID NO: 3558093 - DNA, 21 bp, Homo sapiens
acatacttgaagggccagagc

SEQ ID NO: 3558094 - DNA, 14 bp, Homo sapiens
acatagaatctgtg

SEQ ID NO: 3558095 - DNA, 18 bp, Homo sapiens
acatatagaataagggtt

SEQ ID NO: 3558096 - DNA, 21 bp, Homo sapiens
acatattatgcctgaatgact

SEQ ID NO: 3558097 - DNA, 15 bp, Homo sapiens
acatattatttcatt

SEQ ID NO: 3558098 - DNA, 14 bp, Homo sapiens
acatcaaataaatt

SEQ ID NO: 3558099 - DNA, 17 bp, Homo sapiens
acatcaaataaatttct

SEQ ID NO: 3558100 - DNA, 23 bp, Homo sapiens
acatcaaataaatttctgggata

SEQ ID NO: 3558101 - DNA, 16 bp, Homo sapiens
acatcaacatcttggt

SEQ ID NO: 3558102 - DNA, 13 bp, Homo sapiens
acatcaagccatc

SEQ ID NO: 3558103 - DNA, 18 bp, Homo sapiens
acatcacacccatttaaa

SEQ ID NO: 3558104 - DNA, 16 bp, Homo sapiens
acatcacttgtacaaa

SEQ ID NO: 3558105 - DNA, 15 bp, Homo sapiens
acatcccttcctgga

SEQ ID NO: 3558106 - DNA, 17 bp, Homo sapiens
acatcctatgaaatact

SEQ ID NO: 3558107 - DNA, 21 bp, Homo sapiens
acatcgcaatagttttttact

SEQ ID NO: 3558108 - DNA, 13 bp, Homo sapiens
acatctaagcctg

SEQ ID NO: 3558109 - DNA, 21 bp, Homo sapiens
acatctcagggaactgaccct

SEQ ID NO: 3558110 - DNA, 21 bp, Homo sapiens
acatctgaccccaagggggct

SEQ ID NO: 3558111 - DNA, 21 bp, Homo sapiens
acatcttgctctgcatttata

SEQ ID NO: 3558112 - DNA, 19 bp, Homo sapiens
acatcttggtcagatttga

SEQ ID NO: 3558113 - DNA, 13 bp, Homo sapiens
acatgaaacagaa

SEQ ID NO: 3558114 - DNA, 22 bp, Homo sapiens
acatgaaatgccctcctaaatg

SEQ ID NO: 3558115 - DNA, 16 bp, Homo sapiens
acatgaagaatgcatt

SEQ ID NO: 3558116 - DNA, 16 bp, Homo sapiens
acatgaagcagaacct

SEQ ID NO: 3558117 - DNA, 22 bp, Homo sapiens
acatgaatgggcatttctaaaa

SEQ ID NO: 3558118 - DNA, 17 bp, Homo sapiens
acatgacagatatttta

SEQ ID NO: 3558119 - DNA, 17 bp, Homo sapiens
acatgacattcttagct

SEQ ID NO: 3558120 - DNA, 13 bp, Homo sapiens
acatgactctcat

SEQ ID NO: 3558121 - DNA, 15 bp, Homo sapiens
acatgagtcaaaaca

SEQ ID NO: 3558122 - DNA, 16 bp, Homo sapiens
acatgagtcaaaacaa

SEQ ID NO: 3558123 - DNA, 14 bp, Homo sapiens
acatgatgttatgt

SEQ ID NO: 3558124 - DNA, 17 bp, Homo sapiens
acatgcactcagctctt

SEQ ID NO: 3558125 - DNA, 22 bp, Homo sapiens
acatgcataaaaattaaatgga

SEQ ID NO: 3558126 - DNA, 21 bp, Homo sapiens
acatgcattcacatatctgct

SEQ ID NO: 3558127 - DNA, 15 bp, Homo sapiens
acatgccaggggcct

SEQ ID NO: 3558128 - DNA, 13 bp, Homo sapiens
acatgctgcctgg

SEQ ID NO: 3558129 - DNA, 15 bp, Homo sapiens
acatgctgcctggca

SEQ ID NO: 3558130 - DNA, 16 bp, Homo sapiens
acatgctgcctggcac

SEQ ID NO: 3558131 - DNA, 21 bp, Homo sapiens
acatgcttttctgccactcca

SEQ ID NO: 3558132 - DNA, 21 bp, Homo sapiens
acatggtaaacgctgtcccta

SEQ ID NO: 3558133 - DNA, 19 bp, Homo sapiens
acatggtggggtctcctca

SEQ ID NO: 3558134 - DNA, 14 bp, Homo sapiens
acatggtgtggggg

SEQ ID NO: 3558135 - DNA, 18 bp, Homo sapiens
acatggttacatatcaaa

SEQ ID NO: 3558136 - DNA, 19 bp, Homo sapiens
acatgtattgcacattgta

SEQ ID NO: 3558137 - DNA, 22 bp, Homo sapiens
acatgtcagccactgtgataga

SEQ ID NO: 3558138 - DNA, 18 bp, Homo sapiens
acatgtgaaaagaataga

SEQ ID NO: 3558139 - DNA, 16 bp, Homo sapiens
acatgtgacatttata

SEQ ID NO: 3558140 - DNA, 20 bp, Homo sapiens
acatgtgttttcatcatttc

SEQ ID NO: 3558141 - DNA, 23 bp, Homo sapiens
acatgtgttttcatcatttcagc

SEQ ID NO: 3558142 - DNA, 16 bp, Homo sapiens
acatgttctttgtacc

SEQ ID NO: 3558143 - DNA, 13 bp, Homo sapiens
acatgtttccatc

SEQ ID NO: 3558144 - DNA, 13 bp, Homo sapiens
acatgtttctgtt

SEQ ID NO: 3558145 - DNA, 19 bp, Homo sapiens
acatgttttatactgctct

SEQ ID NO: 3558146 - DNA, 21 bp, Homo sapiens
acattaaattgataacatgga

SEQ ID NO: 3558147 - DNA, 18 bp, Homo sapiens
acattaatatttaccaaa

SEQ ID NO: 3558148 - DNA, 15 bp, Homo sapiens
acattacaacagtag

SEQ ID NO: 3558149 - DNA, 16 bp, Homo sapiens
acattagagaaaacct

SEQ ID NO: 3558150 - DNA, 19 bp, Homo sapiens
acattagagaaaaccttaa

SEQ ID NO: 3558151 - DNA, 21 bp, Homo sapiens
acattagagaaaaccttaaaa

SEQ ID NO: 3558152 - DNA, 22 bp, Homo sapiens
acattagcagtttgctttgtat

SEQ ID NO: 3558153 - DNA, 13 bp, Homo sapiens
acattaggctgtt

SEQ ID NO: 3558154 - DNA, 22 bp, Homo sapiens
acattagtcgttatatttgact

SEQ ID NO: 3558155 - DNA, 14 bp, Homo sapiens
acattatattctct

SEQ ID NO: 3558156 - DNA, 13 bp, Homo sapiens
acattcagctctg

SEQ ID NO: 3558157 - DNA, 18 bp, Homo sapiens
acattcccaaggttactt

SEQ ID NO: 3558158 - DNA, 13 bp, Homo sapiens
acattcccctccc

SEQ ID NO: 3558159 - DNA, 12 bp, Homo sapiens
acattcctccag

SEQ ID NO: 3558160 - DNA, 20 bp, Homo sapiens
acattcctccagcctcccct

SEQ ID NO: 3558161 - DNA, 23 bp, Homo sapiens
acattcctccagcctcccctccc

SEQ ID NO: 3558162 - DNA, 15 bp, Homo sapiens
acattcgtgagctgg

SEQ ID NO: 3558163 - DNA, 22 bp, Homo sapiens
acattcttagctgtaacttaac

SEQ ID NO: 3558164 - DNA, 20 bp, Homo sapiens
acattgaatggatcaataca

SEQ ID NO: 3558165 - DNA, 16 bp, Homo sapiens
acattgacagcaattc

SEQ ID NO: 3558166 - DNA, 22 bp, Homo sapiens
acattgacagcaattcatggtt

SEQ ID NO: 3558167 - DNA, 12 bp, Homo sapiens
acattgctgcct

SEQ ID NO: 3558168 - DNA, 19 bp, Homo sapiens
acattgtgtcctgcttata

SEQ ID NO: 3558169 - DNA, 22 bp, Homo sapiens
acatttccattcatggatattt

SEQ ID NO: 3558170 - DNA, 23 bp, Homo sapiens
acatttctactatgatcagaaga

SEQ ID NO: 3558171 - DNA, 17 bp, Homo sapiens
acatttctcatgttgaa

SEQ ID NO: 3558172 - DNA, 14 bp, Homo sapiens
acatttctcttccc

SEQ ID NO: 3558173 - DNA, 15 bp, Homo sapiens
acatttctgattctg

SEQ ID NO: 3558174 - DNA, 14 bp, Homo sapiens
acatttctttggaa

SEQ ID NO: 3558175 - DNA, 17 bp, Homo sapiens
acatttgccttcagtct

SEQ ID NO: 3558176 - DNA, 21 bp, Homo sapiens
acatttgggagacatgtgaca

SEQ ID NO: 3558177 - DNA, 21 bp, Homo sapiens
acatttgtatttatgtggctg

SEQ ID NO: 3558178 - DNA, 20 bp, Homo sapiens
acattttaaaaaatggtcac

SEQ ID NO: 3558179 - DNA, 15 bp, Homo sapiens
acattttacattaaa

SEQ ID NO: 3558180 - DNA, 19 bp, Homo sapiens
acattttagaatgtcaata

SEQ ID NO: 3558181 - DNA, 15 bp, Homo sapiens
acattttatgtcttt

SEQ ID NO: 3558182 - DNA, 14 bp, Homo sapiens
acattttgtatcaa

SEQ ID NO: 3558183 - DNA, 14 bp, Homo sapiens
accaaaaagaaaaa

SEQ ID NO: 3558184 - DNA, 12 bp, Homo sapiens
accaaaagacat

SEQ ID NO: 3558185 - DNA, 14 bp, Homo sapiens
accaaaagacatta

SEQ ID NO: 3558186 - DNA, 19 bp, Homo sapiens
accaaagcaaagaaaataa

SEQ ID NO: 3558187 - DNA, 23 bp, Homo sapiens
accaaatagtgattgtaacaaat

SEQ ID NO: 3558188 - DNA, 19 bp, Homo sapiens
acggattattttttcagac

SEQ ID NO: 3558189 - DNA, 17 bp, Homo sapiens
acggcaacgtagcctgg

SEQ ID NO: 3558190 - DNA, 24 bp, Homo sapiens
acggcagggaaatgtatgtgtgtc

SEQ ID NO: 3558191 - DNA, 15 bp, Homo sapiens
acggccatctctttg

SEQ ID NO: 3558192 - DNA, 20 bp, Homo sapiens
acggcctgcccagtcgaccc

SEQ ID NO: 3558193 - DNA, 15 bp, Homo sapiens
acgggatgacctcca

SEQ ID NO: 3558194 - DNA, 20 bp, Homo sapiens
acgggctcagcagccagagg

SEQ ID NO: 3558195 - DNA, 20 bp, Homo sapiens
acgggtcagtattaaggttt

SEQ ID NO: 3558196 - DNA, 22 bp, Homo sapiens
acggtgttaattttgctaactg

SEQ ID NO: 3558197 - DNA, 13 bp, Homo sapiens
acggttcctggtg

SEQ ID NO: 3558198 - DNA, 17 bp, Homo sapiens
acgtaatgcattgcctg

SEQ ID NO: 3558199 - DNA, 18 bp, Homo sapiens
acgtaatgcattgcctgt

SEQ ID NO: 3558200 - DNA, 21 bp, Homo sapiens
acgtagctatttttatacact

SEQ ID NO: 3558201 - DNA, 21 bp, Homo sapiens
acgtcactggaccactgggca

SEQ ID NO: 3558202 - DNA, 22 bp, Homo sapiens
acgtcccagcatccctggagca

SEQ ID NO: 3558203 - DNA, 16 bp, Homo sapiens
acgtcgcggccgcctt

SEQ ID NO: 3558204 - DNA, 14 bp, Homo sapiens
acgtctccccttct

SEQ ID NO: 3558205 - DNA, 14 bp, Homo sapiens
acgtgacaggctcg

SEQ ID NO: 3558206 - DNA, 21 bp, Homo sapiens
acgtgatctctgttacaaaag

SEQ ID NO: 3558207 - DNA, 22 bp, Homo sapiens
acgtgctccgtagctctgctgc

SEQ ID NO: 3558208 - DNA, 23 bp, Homo sapiens
acgtgctccgtagctctgctgct

SEQ ID NO: 3558209 - DNA, 18 bp, Homo sapiens
acgtgctctgtgggtctc

SEQ ID NO: 3558210 - DNA, 22 bp, Homo sapiens
acgtggatgggcaaagcttgtc

SEQ ID NO: 3558211 - DNA, 14 bp, Homo sapiens
acgtggattgtatt

SEQ ID NO: 3558212 - DNA, 19 bp, Homo sapiens
acgtggattgtatttaaga

SEQ ID NO: 3558213 - DNA, 15 bp, Homo sapiens
acgtggctctgctgg

SEQ ID NO: 3558214 - DNA, 14 bp, Homo sapiens
acgtggggcccact

SEQ ID NO: 3558215 - DNA, 19 bp, Homo sapiens
acgtgtaaaggaaaataat

SEQ ID NO: 3558216 - DNA, 18 bp, Homo sapiens
acgtgtatagtatctgta

SEQ ID NO: 3558217 - DNA, 20 bp, Homo sapiens
acgtgtgcgcacgcgcagcg

SEQ ID NO: 3558218 - DNA, 22 bp, Homo sapiens
acgtgttccagtgtctgtctga

SEQ ID NO: 3558219 - DNA, 23 bp, Homo sapiens
acgttaagtccaaggagaagaag

SEQ ID NO: 3558220 - DNA, 14 bp, Homo sapiens
acgttttaataatt

SEQ ID NO: 3558221 - DNA, 14 bp, Homo sapiens
actaaaaatacacc

SEQ ID NO: 3558222 - DNA, 16 bp, Homo sapiens
actaaaataattttgt

SEQ ID NO: 3558223 - DNA, 19 bp, Homo sapiens
actaaaataattttgtaat

SEQ ID NO: 3558224 - DNA, 20 bp, Homo sapiens
actaaaataattttgtaatg

SEQ ID NO: 3558225 - DNA, 19 bp, Homo sapiens
actaaactccatgatattt

SEQ ID NO: 3558226 - DNA, 17 bp, Homo sapiens
actaaactttttttctg

SEQ ID NO: 3558227 - DNA, 20 bp, Homo sapiens
actaaactttttttctgtac

SEQ ID NO: 3558228 - DNA, 22 bp, Homo sapiens
actaaactttttttctgtacca

SEQ ID NO: 3558229 - DNA, 22 bp, Homo sapiens
actaaagaagaggagaaaaaga

SEQ ID NO: 3558230 - DNA, 23 bp, Homo sapiens
actaaagaagaggagaaaaagaa

SEQ ID NO: 3558231 - DNA, 14 bp, Homo sapiens
actaaagcttcaga

SEQ ID NO: 3558232 - DNA, 23 bp, Homo sapiens
actaaatatataaagtatatgtt

SEQ ID NO: 3558233 - DNA, 22 bp, Homo sapiens
actaaattgcagtttacagtat

SEQ ID NO: 3558234 - DNA, 22 bp, Homo sapiens
actaagcagaggaggggccgct

SEQ ID NO: 3558235 - DNA, 21 bp, Homo sapiens
actaaggatttttcaagagat

SEQ ID NO: 3558236 - DNA, 12 bp, Homo sapiens
actaaggggccc

SEQ ID NO: 3558237 - DNA, 15 bp, Homo sapiens
actaagttattttat

SEQ ID NO: 3558238 - DNA, 18 bp, Homo sapiens
actaatataaaatgagta

SEQ ID NO: 3558239 - DNA, 16 bp, Homo sapiens
actaatgtaaaatgat

SEQ ID NO: 3558240 - DNA, 23 bp, Homo sapiens
actaatgtctcttctaacatctt

SEQ ID NO: 3558241 - DNA, 14 bp, Homo sapiens
actaattaaaaaat

SEQ ID NO: 3558242 - DNA, 16 bp, Homo sapiens
actaattaaaaaatag

SEQ ID NO: 3558243 - DNA, 12 bp, Homo sapiens
actaattggaag

SEQ ID NO: 3558244 - DNA, 19 bp, Homo sapiens
actaatttggctttcacat

SEQ ID NO: 3558245 - DNA, 15 bp, Homo sapiens
actaccaaaagacat

SEQ ID NO: 3558246 - DNA, 16 bp, Homo sapiens
actaccaaaagacatt

SEQ ID NO: 3558247 - DNA, 22 bp, Homo sapiens
actaccaaaagacattagagaa

SEQ ID NO: 3558248 - DNA, 14 bp, Homo sapiens
actaccagccagcc

SEQ ID NO: 3558249 - DNA, 21 bp, Homo sapiens
actaccagggtctctcaggga

SEQ ID NO: 3558250 - DNA, 15 bp, Homo sapiens
actacccagctctgt

SEQ ID NO: 3558251 - DNA, 12 bp, Homo sapiens
actacctggctg

SEQ ID NO: 3558252 - DNA, 22 bp, Homo sapiens
actacctgtaatgacaggcctg

SEQ ID NO: 3558253 - DNA, 19 bp, Homo sapiens
actactaatagaataaagg

SEQ ID NO: 3558254 - DNA, 13 bp, Homo sapiens
actactagtgtga

SEQ ID NO: 3558255 - DNA, 14 bp, Homo sapiens
actactctttgatt

SEQ ID NO: 3558256 - DNA, 16 bp, Homo sapiens
actactgcagtcttta

SEQ ID NO: 3558257 - DNA, 18 bp, Homo sapiens
actactgcagtctttatt

SEQ ID NO: 3558258 - DNA, 15 bp, Homo sapiens
actacttttctaaaa

SEQ ID NO: 3558259 - DNA, 19 bp, Homo sapiens
actagaagattagaaacta

SEQ ID NO: 3558260 - DNA, 17 bp, Homo sapiens
actagatgtagtatttt

SEQ ID NO: 3558261 - DNA, 15 bp, Homo sapiens
actagattgtgatcc

SEQ ID NO: 3558262 - DNA, 16 bp, Homo sapiens
actagtggaaagtcag

SEQ ID NO: 3558263 - DNA, 14 bp, Homo sapiens
actagtttatgcta

SEQ ID NO: 3558264 - DNA, 18 bp, Homo sapiens
actatagcggcatataga

SEQ ID NO: 3558265 - DNA, 21 bp, Homo sapiens
actatatgtgaaacatttttt

SEQ ID NO: 3558266 - DNA, 15 bp, Homo sapiens
actatcaactacaaa

SEQ ID NO: 3558267 - DNA, 13 bp, Homo sapiens
actatcataaaat

SEQ ID NO: 3558268 - DNA, 18 bp, Homo sapiens
actatgacagatatattt

SEQ ID NO: 3558269 - DNA, 17 bp, Homo sapiens
actatgatcagaagaac

SEQ ID NO: 3558270 - DNA, 15 bp, Homo sapiens
actatgattattaac

SEQ ID NO: 3558271 - DNA, 17 bp, Homo sapiens
actatgcacaacagagt

SEQ ID NO: 3558272 - DNA, 21 bp, Homo sapiens
actatgcatggtgccccagga

SEQ ID NO: 3558273 - DNA, 23 bp, Homo sapiens
actatgcatggtgccccaggacc

SEQ ID NO: 3558274 - DNA, 24 bp, Homo sapiens
actatgcatggtgccccaggacca

SEQ ID NO: 3558275 - DNA, 11 bp, Homo sapiens
actatgtaaac

SEQ ID NO: 3558276 - DNA, 14 bp, Homo sapiens
actatgtattaatt

SEQ ID NO: 3558277 - DNA, 16 bp, Homo sapiens
actattacagtgttgg

SEQ ID NO: 3558278 - DNA, 16 bp, Homo sapiens
actattcaaacagtct

SEQ ID NO: 3558279 - DNA, 15 bp, Homo sapiens
actattgtgccaact

SEQ ID NO: 3558280 - DNA, 21 bp, Homo sapiens
actattgtgccaactgccagg

SEQ ID NO: 3558281 - DNA, 15 bp, Homo sapiens
actatttgcagaggc

SEQ ID NO: 3558282 - DNA, 16 bp, Homo sapiens
actatttttattttta

SEQ ID NO: 3558283 - DNA, 21 bp, Homo sapiens
actcaaagacttcctctggct

SEQ ID NO: 3558284 - DNA, 18 bp, Homo sapiens
actcaaatgctcagacca

SEQ ID NO: 3558285 - DNA, 23 bp, Homo sapiens
actcaaatgctcagaccagctct

SEQ ID NO: 3558286 - DNA, 13 bp, Homo sapiens
actcaatattaaa

SEQ ID NO: 3558287 - DNA, 22 bp, Homo sapiens
actcacaagtgctcatctgttg

SEQ ID NO: 3558288 - DNA, 19 bp, Homo sapiens
actcaccactaccagccag

SEQ ID NO: 3558289 - DNA, 15 bp, Homo sapiens
actcacccctagccc

SEQ ID NO: 3558290 - DNA, 17 bp, Homo sapiens
actcacccctagccctg

SEQ ID NO: 3558291 - DNA, 21 bp, Homo sapiens
actcagaaaattccctggggt

SEQ ID NO: 3558292 - DNA, 22 bp, Homo sapiens
actcagaaaattccctggggtc

SEQ ID NO: 3558293 - DNA, 11 bp, Homo sapiens
actcagatcca

SEQ ID NO: 3558294 - DNA, 12 bp, Homo sapiens
actcagatccag

SEQ ID NO: 3558295 - DNA, 16 bp, Homo sapiens
actcagatttaagcct

SEQ ID NO: 3558296 - DNA, 19 bp, Homo sapiens
actcagatttaagccttac

SEQ ID NO: 3558297 - DNA, 15 bp, Homo sapiens
actcagcatcaccca

SEQ ID NO: 3558298 - DNA, 22 bp, Homo sapiens
actcagctcttggctccactgg

SEQ ID NO: 3558299 - DNA, 12 bp, Homo sapiens
actcaggatcca

SEQ ID NO: 3558300 - DNA, 19 bp, Homo sapiens
actcaggccacagtggggc

SEQ ID NO: 3558301 - DNA, 23 bp, Homo sapiens
actcagggaccggtgctgcagga

SEQ ID NO: 3558302 - DNA, 21 bp, Homo sapiens
actcagggaggctaaatcagt

SEQ ID NO: 3558303 - DNA, 18 bp, Homo sapiens
actcagggcttctagttt

SEQ ID NO: 3558304 - DNA, 23 bp, Homo sapiens
actcagtctctcttctctccagc

SEQ ID NO: 3558305 - DNA, 18 bp, Homo sapiens
actcagtgcctccacatg

SEQ ID NO: 3558306 - DNA, 16 bp, Homo sapiens
actcagtttatgctgt

SEQ ID NO: 3558307 - DNA, 20 bp, Homo sapiens
actcagtttatgttgtacaa

SEQ ID NO: 3558308 - DNA, 23 bp, Homo sapiens
actcagtttatgttgtacaatgt

SEQ ID NO: 3558309 - DNA, 16 bp, Homo sapiens
actcatattgccctaa

SEQ ID NO: 3558310 - DNA, 22 bp, Homo sapiens
actcatcttggccctcctcagc

SEQ ID NO: 3558311 - DNA, 19 bp, Homo sapiens
actcatggggaagcttcca

SEQ ID NO: 3558312 - DNA, 17 bp, Homo sapiens
actccaccgaccaactg

SEQ ID NO: 3558313 - DNA, 21 bp, Homo sapiens
actccagacccctggcttttc

SEQ ID NO: 3558314 - DNA, 16 bp, Homo sapiens
actccagactctgggg

SEQ ID NO: 3558315 - DNA, 22 bp, Homo sapiens
actccagactctgggggtggac

SEQ ID NO: 3558316 - DNA, 15 bp, Homo sapiens
actccaggcatgtgt

SEQ ID NO: 3558317 - DNA, 22 bp, Homo sapiens
actccaggcatgtgtctggccc

SEQ ID NO: 3558318 - DNA, 12 bp, Homo sapiens
actccaggctgg

SEQ ID NO: 3558319 - DNA, 20 bp, Homo sapiens
agaacacagcaattcctcag

SEQ ID NO: 3558320 - DNA, 21 bp, Homo sapiens
agaacattcagctctggagaa

SEQ ID NO: 3558321 - DNA, 19 bp, Homo sapiens
agaaccaaaaatcccacct

SEQ ID NO: 3558322 - DNA, 17 bp, Homo sapiens
agaaccaaagctcaaat

SEQ ID NO: 3558323 - DNA, 13 bp, Homo sapiens
agaaccaaatctt

SEQ ID NO: 3558324 - DNA, 17 bp, Homo sapiens
agaaccagccgtatttt

SEQ ID NO: 3558325 - DNA, 18 bp, Homo sapiens
agaaccagccgtatttta

SEQ ID NO: 3558326 - DNA, 19 bp, Homo sapiens
agaaccagccgtattttac

SEQ ID NO: 3558327 - DNA, 21 bp, Homo sapiens
agaaccagccgtattttacat

SEQ ID NO: 3558328 - DNA, 16 bp, Homo sapiens
agaaccagtcccccca

SEQ ID NO: 3558329 - DNA, 16 bp, Homo sapiens
agaaccagtctcctca

SEQ ID NO: 3558330 - DNA, 18 bp, Homo sapiens
agaaccatgcaggaagga

SEQ ID NO: 3558331 - DNA, 23 bp, Homo sapiens
agaacccacataaaagccccagc

SEQ ID NO: 3558332 - DNA, 13 bp, Homo sapiens
agaaccctgagca

SEQ ID NO: 3558333 - DNA, 14 bp, Homo sapiens
agaaccctgagcag

SEQ ID NO: 3558334 - DNA, 23 bp, Homo sapiens
agaacctacagactccatctctt

SEQ ID NO: 3558335 - DNA, 23 bp, Homo sapiens
agaacctctaagtgctgctgtgg

SEQ ID NO: 3558336 - DNA, 19 bp, Homo sapiens
agaacctgaggtctcattc

SEQ ID NO: 3558337 - DNA, 15 bp, Homo sapiens
agaaccttaatgaca

SEQ ID NO: 3558338 - DNA, 22 bp, Homo sapiens
agaactattctgggggcccgac

SEQ ID NO: 3558339 - DNA, 18 bp, Homo sapiens
agaactcctgtcttcttt

SEQ ID NO: 3558340 - DNA, 20 bp, Homo sapiens
agaactcctgtcttctttct

SEQ ID NO: 3558341 - DNA, 13 bp, Homo sapiens
agaactcttcctc

SEQ ID NO: 3558342 - DNA, 15 bp, Homo sapiens
agaactcttcctcct

SEQ ID NO: 3558343 - DNA, 22 bp, Homo sapiens
agaactgcccttgctgcccgcg

SEQ ID NO: 3558344 - DNA, 13 bp, Homo sapiens
agaacttgctgct

SEQ ID NO: 3558345 - DNA, 14 bp, Homo sapiens
agaacttgctgctg

SEQ ID NO: 3558346 - DNA, 13 bp, Homo sapiens
agaactttttcct

SEQ ID NO: 3558347 - DNA, 15 bp, Homo sapiens
agaagaagagaggca

SEQ ID NO: 3558348 - DNA, 14 bp, Homo sapiens
agaagaaggccaga

SEQ ID NO: 3558349 - DNA, 13 bp, Homo sapiens
agaagagaggcat

SEQ ID NO: 3558350 - DNA, 13 bp, Homo sapiens
agaagagctgttc

SEQ ID NO: 3558351 - DNA, 20 bp, Homo sapiens
agaagagctgttcacagcca

SEQ ID NO: 3558352 - DNA, 16 bp, Homo sapiens
agaagaggagaaaaag

SEQ ID NO: 3558353 - DNA, 23 bp, Homo sapiens
agaagagttttagagaaaataaa

SEQ ID NO: 3558354 - DNA, 16 bp, Homo sapiens
agaagatagctctctg

SEQ ID NO: 3558355 - DNA, 22 bp, Homo sapiens
agaagatgccagcttctctctc

SEQ ID NO: 3558356 - DNA, 18 bp, Homo sapiens
agaagattttgaaatttt

SEQ ID NO: 3558357 - DNA, 12 bp, Homo sapiens
agaagcaagaca

SEQ ID NO: 3558358 - DNA, 12 bp, Homo sapiens
agaagcaatggg

SEQ ID NO: 3558359 - DNA, 23 bp, Homo sapiens
agaagccaactatgattattaac

SEQ ID NO: 3558360 - DNA, 10 bp, Homo sapiens
agaagccagc

SEQ ID NO: 3558361 - DNA, 14 bp, Homo sapiens
agaagccagccaca

SEQ ID NO: 3558362 - DNA, 12 bp, Homo sapiens
agaagcccccag

SEQ ID NO: 3558363 - DNA, 17 bp, Homo sapiens
agaagcccccagctaag

SEQ ID NO: 3558364 - DNA, 20 bp, Homo sapiens
agaagctataaattcctctt

SEQ ID NO: 3558365 - DNA, 21 bp, Homo sapiens
agaagctataaattcctcttt

SEQ ID NO: 3558366 - DNA, 22 bp, Homo sapiens
agaagctcctctccccagccca

SEQ ID NO: 3558367 - DNA, 20 bp, Homo sapiens
agaaggccagagagggaaaa

SEQ ID NO: 3558368 - DNA, 21 bp, Homo sapiens
agaagggatatctactgtggt

SEQ ID NO: 3558369 - DNA, 15 bp, Homo sapiens
agaagggggccctgc

SEQ ID NO: 3558370 - DNA, 14 bp, Homo sapiens
agaaggtctgtggt

SEQ ID NO: 3558371 - DNA, 22 bp, Homo sapiens
agaaggtctgtggtgcagtgtg

SEQ ID NO: 3558372 - DNA, 23 bp, Homo sapiens
agaaggtctgtggtgcagtgtgt

SEQ ID NO: 3558373 - DNA, 18 bp, Homo sapiens
agaagtcttctatttatt

SEQ ID NO: 3558374 - DNA, 20 bp, Homo sapiens
agaagttgaggattgttgaa

SEQ ID NO: 3558375 - DNA, 16 bp, Homo sapiens
agaagtttgtagccag

SEQ ID NO: 3558376 - DNA, 18 bp, Homo sapiens
agaagtttgtagccaggt

SEQ ID NO: 3558377 - DNA, 15 bp, Homo sapiens
agaataaaaactttt

SEQ ID NO: 3558378 - DNA, 17 bp, Homo sapiens
agaataaaaacttttga

SEQ ID NO: 3558379 - DNA, 20 bp, Homo sapiens
agaataaacttacatattta

SEQ ID NO: 3558380 - DNA, 20 bp, Homo sapiens
agaataaaggcagttttcta

SEQ ID NO: 3558381 - DNA, 21 bp, Homo sapiens
agaataaaggcagttttctaa

SEQ ID NO: 3558382 - DNA, 13 bp, Homo sapiens
agaataaattcta

SEQ ID NO: 3558383 - DNA, 13 bp, Homo sapiens
agaatcattttta

SEQ ID NO: 3558384 - DNA, 12 bp, Homo sapiens
agaatcttcctg

SEQ ID NO: 3558385 - DNA, 14 bp, Homo sapiens
agaatctttagaga

SEQ ID NO: 3558386 - DNA, 15 bp, Homo sapiens
agaatcttttcaatg

SEQ ID NO: 3558387 - DNA, 12 bp, Homo sapiens
agaatgagcctc

SEQ ID NO: 3558388 - DNA, 13 bp, Homo sapiens
agaatgatttcat

SEQ ID NO: 3558389 - DNA, 23 bp, Homo sapiens
agaatggataaaataatgctgca

SEQ ID NO: 3558390 - DNA, 17 bp, Homo sapiens
agaatggcagtcctgga

SEQ ID NO: 3558391 - DNA, 19 bp, Homo sapiens
agaatggcagtcctggagg

SEQ ID NO: 3558392 - DNA, 20 bp, Homo sapiens
agaatggcagtcctggaggc

SEQ ID NO: 3558393 - DNA, 14 bp, Homo sapiens
agaatggcatggca

SEQ ID NO: 3558394 - DNA, 17 bp, Homo sapiens
agaatggcatggcagga

SEQ ID NO: 3558395 - DNA, 16 bp, Homo sapiens
agaatggcctggagca

SEQ ID NO: 3558396 - DNA, 22 bp, Homo sapiens
agaatgggacgaggacatttgt

SEQ ID NO: 3558397 - DNA, 23 bp, Homo sapiens
agaatgggacgaggacatttgtg

SEQ ID NO: 3558398 - DNA, 14 bp, Homo sapiens
agaatgtcaataaa

SEQ ID NO: 3558399 - DNA, 15 bp, Homo sapiens
agaatgtcaataaat

SEQ ID NO: 3558400 - DNA, 15 bp, Homo sapiens
agaatgtcagtatgt

SEQ ID NO: 3558401 - DNA, 17 bp, Homo sapiens
agaatgtcagtatgtgg

SEQ ID NO: 3558402 - DNA, 17 bp, Homo sapiens
agaatgtgtgtgtgtgg

SEQ ID NO: 3558403 - DNA, 12 bp, Homo sapiens
agaatgttttca

SEQ ID NO: 3558404 - DNA, 15 bp, Homo sapiens
agaatgttttcaaat

SEQ ID NO: 3558405 - DNA, 21 bp, Homo sapiens
agaatgttttcaaatgttctc

SEQ ID NO: 3558406 - DNA, 13 bp, Homo sapiens
agaattatctcaa

SEQ ID NO: 3558407 - DNA, 22 bp, Homo sapiens
agaattatctcaagtaaaacaa

SEQ ID NO: 3558408 - DNA, 17 bp, Homo sapiens
agaattctcttatccaa

SEQ ID NO: 3558409 - DNA, 12 bp, Homo sapiens
agaattgaattg

SEQ ID NO: 3558410 - DNA, 16 bp, Homo sapiens
agaattgaattggaaa

SEQ ID NO: 3558411 - DNA, 16 bp, Homo sapiens
agaatttctaccattt

SEQ ID NO: 3558412 - DNA, 13 bp, Homo sapiens
agacaagagctgt

SEQ ID NO: 3558413 - DNA, 21 bp, Homo sapiens
agacaagagctgttatgctgt

SEQ ID NO: 3558414 - DNA, 19 bp, Homo sapiens
agacaagcagcccttgctt

SEQ ID NO: 3558415 - DNA, 14 bp, Homo sapiens
agacaaggtgctaa

SEQ ID NO: 3558416 - DNA, 15 bp, Homo sapiens
agacaatcactgcca

SEQ ID NO: 3558417 - DNA, 12 bp, Homo sapiens
agacacagctct

SEQ ID NO: 3558418 - DNA, 13 bp, Homo sapiens
agacacaggccct

SEQ ID NO: 3558419 - DNA, 13 bp, Homo sapiens
agacacccaggac

SEQ ID NO: 3558420 - DNA, 13 bp, Homo sapiens
agacaccctctgg

SEQ ID NO: 3558421 - DNA, 16 bp, Homo sapiens
agacaccctctggggg

SEQ ID NO: 3558422 - DNA, 17 bp, Homo sapiens
agacaccgttcattcag

SEQ ID NO: 3558423 - DNA, 16 bp, Homo sapiens
agacactcaaatatga

SEQ ID NO: 3558424 - DNA, 13 bp, Homo sapiens
agacactttggaa

SEQ ID NO: 3558425 - DNA, 21 bp, Homo sapiens
agacagaaaagtgcctgagct

SEQ ID NO: 3558426 - DNA, 17 bp, Homo sapiens
agacagaacccctacat

SEQ ID NO: 3558427 - DNA, 19 bp, Homo sapiens
agacagatcactcctggag

SEQ ID NO: 3558428 - DNA, 20 bp, Homo sapiens
agacagatcactcctggagg

SEQ ID NO: 3558429 - DNA, 14 bp, Homo sapiens
agacagcagacaaa

SEQ ID NO: 3558430 - DNA, 17 bp, Homo sapiens
agacagcagtttccaga

SEQ ID NO: 3558431 - DNA, 19 bp, Homo sapiens
agacagcttacaggagcca

SEQ ID NO: 3558432 - DNA, 11 bp, Homo sapiens
agacagcttct

SEQ ID NO: 3558433 - DNA, 14 bp, Homo sapiens
agacagcttctctg

SEQ ID NO: 3558434 - DNA, 15 bp, Homo sapiens
agacagcttctctgc

SEQ ID NO: 3558435 - DNA, 16 bp, Homo sapiens
agacagcttctctgca

SEQ ID NO: 3558436 - DNA, 14 bp, Homo sapiens
agacagggtcttgc

SEQ ID NO: 3558437 - DNA, 21 bp, Homo sapiens
agacaggtgcctaacctggga

SEQ ID NO: 3558438 - DNA, 22 bp, Homo sapiens
agacaggtgcctaacctgggac

SEQ ID NO: 3558439 - DNA, 13 bp, Homo sapiens
agacataaaacag

SEQ ID NO: 3558440 - DNA, 12 bp, Homo sapiens
agacataaacaa

SEQ ID NO: 3558441 - DNA, 15 bp, Homo sapiens
agacataaacaaaga

SEQ ID NO: 3558442 - DNA, 14 bp, Homo sapiens
agacatacttgaag

SEQ ID NO: 3558443 - DNA, 18 bp, Homo sapiens
agacatggaacagtgtaa

SEQ ID NO: 3558444 - DNA, 12 bp, Homo sapiens
agacatgtgaca

SEQ ID NO: 3558445 - DNA, 15 bp, Homo sapiens
agacatgtgacattt

SEQ ID NO: 3558446 - DNA, 14 bp, Homo sapiens
agacattagagaaa

SEQ ID NO: 3558447 - DNA, 14 bp, Homo sapiens
agacattctcacat

SEQ ID NO: 3558448 - DNA, 15 bp, Homo sapiens
agacattctcacata

SEQ ID NO: 3558449 - DNA, 19 bp, Homo sapiens
agacattctcacataagcc

SEQ ID NO: 3558450 - DNA, 15 bp, Homo sapiens
agacattgacagcaa

SEQ ID NO: 3558451 - DNA, 17 bp, Homo sapiens
agacattgacagcaatt

SEQ ID NO: 3558452 - DNA, 11 bp, Homo sapiens
agaccaaagca

SEQ ID NO: 3558453 - DNA, 19 bp, Homo sapiens
agagctcttgtgttcagaa

SEQ ID NO: 3558454 - DNA, 22 bp, Homo sapiens
agagctcttgtgttcagaagaa

SEQ ID NO: 3558455 - DNA, 15 bp, Homo sapiens
agagctgcctggatg

SEQ ID NO: 3558456 - DNA, 16 bp, Homo sapiens
agagctgcctggatga

SEQ ID NO: 3558457 - DNA, 17 bp, Homo sapiens
agagctgttatgctgtt

SEQ ID NO: 3558458 - DNA, 18 bp, Homo sapiens
agagctgttatgctgttt

SEQ ID NO: 3558459 - DNA, 20 bp, Homo sapiens
agagctgttatgctgtttcc

SEQ ID NO: 3558460 - DNA, 19 bp, Homo sapiens
agagctgttcacagccaga

SEQ ID NO: 3558461 - DNA, 21 bp, Homo sapiens
agagctgttcacagccagact

SEQ ID NO: 3558462 - DNA, 19 bp, Homo sapiens
agagctttctgccttagcc

SEQ ID NO: 3558463 - DNA, 15 bp, Homo sapiens
agagcttttaaaaat

SEQ ID NO: 3558464 - DNA, 16 bp, Homo sapiens
agagcttttaaaaatg

SEQ ID NO: 3558465 - DNA, 14 bp, Homo sapiens
agaggaaaagaaat

SEQ ID NO: 3558466 - DNA, 14 bp, Homo sapiens
agaggaaatctgta

SEQ ID NO: 3558467 - DNA, 14 bp, Homo sapiens
agaggaaggagggt

SEQ ID NO: 3558468 - DNA, 18 bp, Homo sapiens
agaggaattacgtgctct

SEQ ID NO: 3558469 - DNA, 19 bp, Homo sapiens
agaggactggttctgaggc

SEQ ID NO: 3558470 - DNA, 20 bp, Homo sapiens
agaggactggttctgaggcc

SEQ ID NO: 3558471 - DNA, 24 bp, Homo sapiens
agaggactggttctgaggccagaa

SEQ ID NO: 3558472 - DNA, 17 bp, Homo sapiens
agaggagaaaaagaaga

SEQ ID NO: 3558473 - DNA, 20 bp, Homo sapiens
agaggagaaaaagaagaaaa

SEQ ID NO: 3558474 - DNA, 19 bp, Homo sapiens
agaggagaacttgctgcct

SEQ ID NO: 3558475 - DNA, 20 bp, Homo sapiens
agaggagataaggtggcttc

SEQ ID NO: 3558476 - DNA, 23 bp, Homo sapiens
agaggagggggcaggctgagggt

SEQ ID NO: 3558477 - DNA, 19 bp, Homo sapiens
agaggcagagattggagtg

SEQ ID NO: 3558478 - DNA, 17 bp, Homo sapiens
agaggcagcatgcttgg

SEQ ID NO: 3558479 - DNA, 19 bp, Homo sapiens
agaggcagcatgcttgggc

SEQ ID NO: 3558480 - DNA, 22 bp, Homo sapiens
agaggcagcatgcttgggctga

SEQ ID NO: 3558481 - DNA, 13 bp, Homo sapiens
agaggccccagcc

SEQ ID NO: 3558482 - DNA, 23 bp, Homo sapiens
agaggccccagcctccctgaagc

SEQ ID NO: 3558483 - DNA, 14 bp, Homo sapiens
agaggccctctgga

SEQ ID NO: 3558484 - DNA, 16 bp, Homo sapiens
agaggcctgctgccag

SEQ ID NO: 3558485 - DNA, 20 bp, Homo sapiens
agaggccttcccatggccat

SEQ ID NO: 3558486 - DNA, 23 bp, Homo sapiens
agaggcgtactacccagctctgt

SEQ ID NO: 3558487 - DNA, 14 bp, Homo sapiens
agaggctgtctgtt

SEQ ID NO: 3558488 - DNA, 16 bp, Homo sapiens
agagggaaaatcttca

SEQ ID NO: 3558489 - DNA, 17 bp, Homo sapiens
agagggaagatgacctg

SEQ ID NO: 3558490 - DNA, 15 bp, Homo sapiens
agagggacctctccc

SEQ ID NO: 3558491 - DNA, 16 bp, Homo sapiens
agagggacctctccca

SEQ ID NO: 3558492 - DNA, 22 bp, Homo sapiens
agagggactgttcttttgtccc

SEQ ID NO: 3558493 - DNA, 14 bp, Homo sapiens
agagggaggggcct

SEQ ID NO: 3558494 - DNA, 16 bp, Homo sapiens
agagggaggggcctag

SEQ ID NO: 3558495 - DNA, 20 bp, Homo sapiens
agagggcaatctttgccttt

SEQ ID NO: 3558496 - DNA, 13 bp, Homo sapiens
agagggcccagcc

SEQ ID NO: 3558497 - DNA, 19 bp, Homo sapiens
agagggcccagcccagagc

SEQ ID NO: 3558498 - DNA, 21 bp, Homo sapiens
agagggcccagcccagagcca

SEQ ID NO: 3558499 - DNA, 21 bp, Homo sapiens
agagggcgagggatgatgagg

SEQ ID NO: 3558500 - DNA, 16 bp, Homo sapiens
agagggggagtagcca

SEQ ID NO: 3558501 - DNA, 21 bp, Homo sapiens
agagggtgatggaacaagaga

SEQ ID NO: 3558502 - DNA, 16 bp, Homo sapiens
agagggttgctggtcc

SEQ ID NO: 3558503 - DNA, 20 bp, Homo sapiens
agagggttgctggtcctgca

SEQ ID NO: 3558504 - DNA, 17 bp, Homo sapiens
agaggtatttatcttta

SEQ ID NO: 3558505 - DNA, 15 bp, Homo sapiens
agaggtgaaaatgaa

SEQ ID NO: 3558506 - DNA, 18 bp, Homo sapiens
agaggtgaaaatgaagaa

SEQ ID NO: 3558507 - DNA, 18 bp, Homo sapiens
agaggtgattctcagggc

SEQ ID NO: 3558508 - DNA, 13 bp, Homo sapiens
agagtaaaagtcc

SEQ ID NO: 3558509 - DNA, 16 bp, Homo sapiens
agagtacaccctttcc

SEQ ID NO: 3558510 - DNA, 24 bp, Homo sapiens
agagtatatttttgtctgcagctg

SEQ ID NO: 3558511 - DNA, 12 bp, Homo sapiens
agagtcagacat

SEQ ID NO: 3558512 - DNA, 21 bp, Homo sapiens
agagtcagacatttctttgga

SEQ ID NO: 3558513 - DNA, 15 bp, Homo sapiens
agagtccccccactc

SEQ ID NO: 3558514 - DNA, 14 bp, Homo sapiens
agagtcgctgtgcc

SEQ ID NO: 3558515 - DNA, 12 bp, Homo sapiens
agagtggcctcc

SEQ ID NO: 3558516 - DNA, 14 bp, Homo sapiens
agagtggcgtggcc

SEQ ID NO: 3558517 - DNA, 17 bp, Homo sapiens
agagtgggccccgggct

SEQ ID NO: 3558518 - DNA, 20 bp, Homo sapiens
agagtgggccccgggctgga

SEQ ID NO: 3558519 - DNA, 22 bp, Homo sapiens
agagtgggccccgggctggaga

SEQ ID NO: 3558520 - DNA, 23 bp, Homo sapiens
agagtgggccccgggctggagaa

SEQ ID NO: 3558521 - DNA, 23 bp, Homo sapiens
agagtgtagcctaaagggcaggg

SEQ ID NO: 3558522 - DNA, 14 bp, Homo sapiens
agagtgtagctgta

SEQ ID NO: 3558523 - DNA, 23 bp, Homo sapiens
agagtgtagctgtaagggcagtg

SEQ ID NO: 3558524 - DNA, 17 bp, Homo sapiens
agagttacagttctgtg

SEQ ID NO: 3558525 - DNA, 22 bp, Homo sapiens
agagttacagttctgtggtttc

SEQ ID NO: 3558526 - DNA, 17 bp, Homo sapiens
agagttccggggagaaa

SEQ ID NO: 3558527 - DNA, 20 bp, Homo sapiens
agagttccggggagaaaccc

SEQ ID NO: 3558528 - DNA, 14 bp, Homo sapiens
agagttctttgctg

SEQ ID NO: 3558529 - DNA, 20 bp, Homo sapiens
agagtttaaacaaaaaaccc

SEQ ID NO: 3558530 - DNA, 15 bp, Homo sapiens
agagtttctgtttga

SEQ ID NO: 3558531 - DNA, 12 bp, Homo sapiens
agataaacatta

SEQ ID NO: 3558532 - DNA, 19 bp, Homo sapiens
agataactttgactttctt

SEQ ID NO: 3558533 - DNA, 16 bp, Homo sapiens
agataaggtggcttct

SEQ ID NO: 3558534 - DNA, 21 bp, Homo sapiens
agataatagggttttcagatg

SEQ ID NO: 3558535 - DNA, 23 bp, Homo sapiens
agataatctagaacacaggcaaa

SEQ ID NO: 3558536 - DNA, 15 bp, Homo sapiens
agatactgtgtatat

SEQ ID NO: 3558537 - DNA, 14 bp, Homo sapiens
agatatatgccttc

SEQ ID NO: 3558538 - DNA, 18 bp, Homo sapiens
agatatatttaagcctta

SEQ ID NO: 3558539 - DNA, 19 bp, Homo sapiens
agatatatttaagccttat

SEQ ID NO: 3558540 - DNA, 15 bp, Homo sapiens
agatattatttgtct

SEQ ID NO: 3558541 - DNA, 16 bp, Homo sapiens
agatattatttgtctt

SEQ ID NO: 3558542 - DNA, 18 bp, Homo sapiens
agatattgttataaataa

SEQ ID NO: 3558543 - DNA, 14 bp, Homo sapiens
agatcagaacattc

SEQ ID NO: 3558544 - DNA, 20 bp, Homo sapiens
agatcagaacattcagctct

SEQ ID NO: 3558545 - DNA, 23 bp, Homo sapiens
agatcagaacattcagctctgga

SEQ ID NO: 3558546 - DNA, 20 bp, Homo sapiens
agatcatatggtaggaccct

SEQ ID NO: 3558547 - DNA, 11 bp, Homo sapiens
agatcatgggt

SEQ ID NO: 3558548 - DNA, 23 bp, Homo sapiens
agatccaaaagaagcccccagct

SEQ ID NO: 3558549 - DNA, 17 bp, Homo sapiens
agatccagcccaaacct

SEQ ID NO: 3558550 - DNA, 23 bp, Homo sapiens
agatccagcccaaacctgggaag

SEQ ID NO: 3558551 - DNA, 13 bp, Homo sapiens
agatccaggacta

SEQ ID NO: 3558552 - DNA, 19 bp, Homo sapiens
agatccagggacagaggcc

SEQ ID NO: 3558553 - DNA, 16 bp, Homo sapiens
agatccctgcagaacc

SEQ ID NO: 3558554 - DNA, 17 bp, Homo sapiens
agatccctgcagaaccc

SEQ ID NO: 3558555 - DNA, 14 bp, Homo sapiens
agatcctttcaaaa

SEQ ID NO: 3558556 - DNA, 20 bp, Homo sapiens
agatctgcaccaccatgccc

SEQ ID NO: 3558557 - DNA, 13 bp, Homo sapiens
agatctggaacct

SEQ ID NO: 3558558 - DNA, 19 bp, Homo sapiens
agatctggaacctcagcct

SEQ ID NO: 3558559 - DNA, 14 bp, Homo sapiens
agatctgtcctcag

SEQ ID NO: 3558560 - DNA, 15 bp, Homo sapiens
agatctgtcctcagc

SEQ ID NO: 3558561 - DNA, 18 bp, Homo sapiens
agatctgtcctcagcctt

SEQ ID NO: 3558562 - DNA, 14 bp, Homo sapiens
agatctgtgtggct

SEQ ID NO: 3558563 - DNA, 20 bp, Homo sapiens
agatctgtgtggctcctggg

SEQ ID NO: 3558564 - DNA, 21 bp, Homo sapiens
agatctgtgtggctcctgggc

SEQ ID NO: 3558565 - DNA, 20 bp, Homo sapiens
agatctttctttccaaaaca

SEQ ID NO: 3558566 - DNA, 21 bp, Homo sapiens
agatctttggcatgatttaaa

SEQ ID NO: 3558567 - DNA, 22 bp, Homo sapiens
agatgaatgtcagttgttattt

SEQ ID NO: 3558568 - DNA, 15 bp, Homo sapiens
agatgacctgcccca

SEQ ID NO: 3558569 - DNA, 23 bp, Homo sapiens
agatgactttgcagatggaaaga

SEQ ID NO: 3558570 - DNA, 13 bp, Homo sapiens
agatgaggctcag

SEQ ID NO: 3558571 - DNA, 17 bp, Homo sapiens
agatgaggctcagagag

SEQ ID NO: 3558572 - DNA, 19 bp, Homo sapiens
agatgatgatgatctttaa

SEQ ID NO: 3558573 - DNA, 21 bp, Homo sapiens
agatgatttaatgttgatttt

SEQ ID NO: 3558574 - DNA, 22 bp, Homo sapiens
agatgcagttcaaaaacaagac

SEQ ID NO: 3558575 - DNA, 15 bp, Homo sapiens
agatgcagtttggag

SEQ ID NO: 3558576 - DNA, 15 bp, Homo sapiens
agatgcatatagaca

SEQ ID NO: 3558577 - DNA, 22 bp, Homo sapiens
agatgccagcttctctctccag

SEQ ID NO: 3558578 - DNA, 14 bp, Homo sapiens
agatgccccctcca

SEQ ID NO: 3558579 - DNA, 19 bp, Homo sapiens
agatgccccctccaggaga

SEQ ID NO: 3558580 - DNA, 19 bp, Homo sapiens
agatgccccgagcccaggc

SEQ ID NO: 3558581 - DNA, 17 bp, Homo sapiens
agatgcctgatttcatt

SEQ ID NO: 3558582 - DNA, 21 bp, Homo sapiens
agatgctgaggcccctaggtg

SEQ ID NO: 3558583 - DNA, 19 bp, Homo sapiens
agatgcttttgctaatacc

SEQ ID NO: 3558584 - DNA, 23 bp, Homo sapiens
agccttgcaacccaaggtgaggt

SEQ ID NO: 3558585 - DNA, 14 bp, Homo sapiens
agccttgccagaga

SEQ ID NO: 3558586 - DNA, 15 bp, Homo sapiens
agccttgccagagat

SEQ ID NO: 3558587 - DNA, 23 bp, Homo sapiens
agccttgcctaaatttaatgctg

SEQ ID NO: 3558588 - DNA, 18 bp, Homo sapiens
agccttgtacagtctgct

SEQ ID NO: 3558589 - DNA, 22 bp, Homo sapiens
agccttgtcagtgtgtcagttt

SEQ ID NO: 3558590 - DNA, 13 bp, Homo sapiens
agcctttgtgctt

SEQ ID NO: 3558591 - DNA, 22 bp, Homo sapiens
agccttttatgtattttccaag

SEQ ID NO: 3558592 - DNA, 23 bp, Homo sapiens
agccttttatgtattttccaagt

SEQ ID NO: 3558593 - DNA, 22 bp, Homo sapiens
agcgaccccaggacctcttctg

SEQ ID NO: 3558594 - DNA, 18 bp, Homo sapiens
agcgacttcaggtcaggt

SEQ ID NO: 3558595 - DNA, 16 bp, Homo sapiens
agcgagcaagccggca

SEQ ID NO: 3558596 - DNA, 18 bp, Homo sapiens
agcgagcaagccggcaag

SEQ ID NO: 3558597 - DNA, 14 bp, Homo sapiens
agcgagcacagtat

SEQ ID NO: 3558598 - DNA, 19 bp, Homo sapiens
agcgaggaaaggattttac

SEQ ID NO: 3558599 - DNA, 12 bp, Homo sapiens
agcgagtaaagt

SEQ ID NO: 3558600 - DNA, 16 bp, Homo sapiens
agcgcaggcagcgcag

SEQ ID NO: 3558601 - DNA, 21 bp, Homo sapiens
agcgcatgtgtgcatgtgctg

SEQ ID NO: 3558602 - DNA, 18 bp, Homo sapiens
agcgccgtccggcggccc

SEQ ID NO: 3558603 - DNA, 21 bp, Homo sapiens
agcgcggacccttctgggtcc

SEQ ID NO: 3558604 - DNA, 13 bp, Homo sapiens
agcggagcccagc

SEQ ID NO: 3558605 - DNA, 16 bp, Homo sapiens
agcggcaccctggtct

SEQ ID NO: 3558606 - DNA, 14 bp, Homo sapiens
agcggctggagaaa

SEQ ID NO: 3558607 - DNA, 11 bp, Homo sapiens
agcgggagccc

SEQ ID NO: 3558608 - DNA, 13 bp, Homo sapiens
agcgggcggaggg

SEQ ID NO: 3558609 - DNA, 22 bp, Homo sapiens
agcgggtacttatttctcagct

SEQ ID NO: 3558610 - DNA, 15 bp, Homo sapiens
agcgtgcataagtta

SEQ ID NO: 3558611 - DNA, 17 bp, Homo sapiens
agcgttttttaaatgta

SEQ ID NO: 3558612 - DNA, 19 bp, Homo sapiens
agcgttttttaaatgtata

SEQ ID NO: 3558613 - DNA, 15 bp, Homo sapiens
agctaaaaaggccct

SEQ ID NO: 3558614 - DNA, 12 bp, Homo sapiens
agctaagaacct

SEQ ID NO: 3558615 - DNA, 17 bp, Homo sapiens
agctaagctaggaatga

SEQ ID NO: 3558616 - DNA, 21 bp, Homo sapiens
agctaatcagcattctcactc

SEQ ID NO: 3558617 - DNA, 12 bp, Homo sapiens
agctaattattt

SEQ ID NO: 3558618 - DNA, 19 bp, Homo sapiens
agctacaaccctaccctgg

SEQ ID NO: 3558619 - DNA, 20 bp, Homo sapiens
agctacaaccctaccctggc

SEQ ID NO: 3558620 - DNA, 14 bp, Homo sapiens
agctacatgttctt

SEQ ID NO: 3558621 - DNA, 18 bp, Homo sapiens
agctacatgttctttgta

SEQ ID NO: 3558622 - DNA, 23 bp, Homo sapiens
agctactcagtggggctggcatc

SEQ ID NO: 3558623 - DNA, 15 bp, Homo sapiens
agctactttggcatt

SEQ ID NO: 3558624 - DNA, 20 bp, Homo sapiens
agctaggaaccctggaggta

SEQ ID NO: 3558625 - DNA, 18 bp, Homo sapiens
agctaggagcaggcttgt

SEQ ID NO: 3558626 - DNA, 15 bp, Homo sapiens
agctaggccccagag

SEQ ID NO: 3558627 - DNA, 19 bp, Homo sapiens
agctaggccccagaggccc

SEQ ID NO: 3558628 - DNA, 19 bp, Homo sapiens
agctagtaggaatgtacat

SEQ ID NO: 3558629 - DNA, 12 bp, Homo sapiens
agctagtgcctt

SEQ ID NO: 3558630 - DNA, 17 bp, Homo sapiens
agctagtgcctttagag

SEQ ID NO: 3558631 - DNA, 22 bp, Homo sapiens
agctatttcagcctcctgtttg

SEQ ID NO: 3558632 - DNA, 19 bp, Homo sapiens
agctatttttatacactgt

SEQ ID NO: 3558633 - DNA, 16 bp, Homo sapiens
agctcaagggctggca

SEQ ID NO: 3558634 - DNA, 19 bp, Homo sapiens
agctcagccccaactcttt

SEQ ID NO: 3558635 - DNA, 17 bp, Homo sapiens
agctcagccctggcctg

SEQ ID NO: 3558636 - DNA, 20 bp, Homo sapiens
agctcagccctggcctggct

SEQ ID NO: 3558637 - DNA, 23 bp, Homo sapiens
agctcagctgagcatggagacag

SEQ ID NO: 3558638 - DNA, 17 bp, Homo sapiens
agctcaggacagatgcc

SEQ ID NO: 3558639 - DNA, 18 bp, Homo sapiens
agctcaggacagatgcca

SEQ ID NO: 3558640 - DNA, 22 bp, Homo sapiens
agctcatgtgcattattttcca

SEQ ID NO: 3558641 - DNA, 14 bp, Homo sapiens
agctcattcccaac

SEQ ID NO: 3558642 - DNA, 15 bp, Homo sapiens
agctccaacctgcaa

SEQ ID NO: 3558643 - DNA, 18 bp, Homo sapiens
agctccaacctgcaaaga

SEQ ID NO: 3558644 - DNA, 13 bp, Homo sapiens
agctccatctcca

SEQ ID NO: 3558645 - DNA, 13 bp, Homo sapiens
agctcccacccca

SEQ ID NO: 3558646 - DNA, 17 bp, Homo sapiens
agctcccctcggagaag

SEQ ID NO: 3558647 - DNA, 20 bp, Homo sapiens
agctcccctcggagaagagc

SEQ ID NO: 3558648 - DNA, 15 bp, Homo sapiens
agctccctgcctgtt

SEQ ID NO: 3558649 - DNA, 18 bp, Homo sapiens
agctccgtgtttctctaa

SEQ ID NO: 3558650 - DNA, 16 bp, Homo sapiens
agctcctcagcggctc

SEQ ID NO: 3558651 - DNA, 23 bp, Homo sapiens
agctcctcctccctgcatctgac

SEQ ID NO: 3558652 - DNA, 17 bp, Homo sapiens
agctcctctccccagcc

SEQ ID NO: 3558653 - DNA, 20 bp, Homo sapiens
agctcctctccccagcccag

SEQ ID NO: 3558654 - DNA, 21 bp, Homo sapiens
agctcctctccccagcccaga

SEQ ID NO: 3558655 - DNA, 22 bp, Homo sapiens
agctcctctccccagcccagag

SEQ ID NO: 3558656 - DNA, 21 bp, Homo sapiens
agctcctgaccttgggtcctg

SEQ ID NO: 3558657 - DNA, 20 bp, Homo sapiens
agctcctgccacatggagcc

SEQ ID NO: 3558658 - DNA, 14 bp, Homo sapiens
agctctaaaatctg

SEQ ID NO: 3558659 - DNA, 12 bp, Homo sapiens
agctctcacaga

SEQ ID NO: 3558660 - DNA, 21 bp, Homo sapiens
agctctcaggaccgtgccctc

SEQ ID NO: 3558661 - DNA, 16 bp, Homo sapiens
agctctccgagctctg

SEQ ID NO: 3558662 - DNA, 15 bp, Homo sapiens
agctctgacatccct

SEQ ID NO: 3558663 - DNA, 18 bp, Homo sapiens
agctctgacatcccttcc

SEQ ID NO: 3558664 - DNA, 20 bp, Homo sapiens
agctctgacatcccttcctg

SEQ ID NO: 3558665 - DNA, 22 bp, Homo sapiens
agctctgcgtcggtcctggtgc

SEQ ID NO: 3558666 - DNA, 11 bp, Homo sapiens
agctctgctgc

SEQ ID NO: 3558667 - DNA, 14 bp, Homo sapiens
agctctgctgctga

SEQ ID NO: 3558668 - DNA, 15 bp, Homo sapiens
agctctgctgctgat

SEQ ID NO: 3558669 - DNA, 17 bp, Homo sapiens
agctctggacagcccca

SEQ ID NO: 3558670 - DNA, 21 bp, Homo sapiens
agctctggacagccccaccct

SEQ ID NO: 3558671 - DNA, 20 bp, Homo sapiens
agctctggggtgggcagttt

SEQ ID NO: 3558672 - DNA, 16 bp, Homo sapiens
agctctggtgctttag

SEQ ID NO: 3558673 - DNA, 11 bp, Homo sapiens
agctcttccct

SEQ ID NO: 3558674 - DNA, 16 bp, Homo sapiens
agctcttggcaggagt

SEQ ID NO: 3558675 - DNA, 18 bp, Homo sapiens
agctcttggcaggagtgg

SEQ ID NO: 3558676 - DNA, 18 bp, Homo sapiens
agctgaaatatgctggct

SEQ ID NO: 3558677 - DNA, 12 bp, Homo sapiens
agctgaaggcag

SEQ ID NO: 3558678 - DNA, 20 bp, Homo sapiens
agctgaatattttttatttc

SEQ ID NO: 3558679 - DNA, 19 bp, Homo sapiens
agctgagagaccctggcct

SEQ ID NO: 3558680 - DNA, 20 bp, Homo sapiens
agctgagagaccctggcctc

SEQ ID NO: 3558681 - DNA, 18 bp, Homo sapiens
agctgagcatggagacag

SEQ ID NO: 3558682 - DNA, 21 bp, Homo sapiens
agctgagcatggagacagcag

SEQ ID NO: 3558683 - DNA, 22 bp, Homo sapiens
agctgagcatggagacagcagt

SEQ ID NO: 3558684 - DNA, 11 bp, Homo sapiens
agctgagctgg

SEQ ID NO: 3558685 - DNA, 15 bp, Homo sapiens
agctgagctggaagg

SEQ ID NO: 3558686 - DNA, 17 bp, Homo sapiens
agctgcaccccttcctg

SEQ ID NO: 3558687 - DNA, 11 bp, Homo sapiens
agctgcactga

SEQ ID NO: 3558688 - DNA, 13 bp, Homo sapiens
agctgcagccttc

SEQ ID NO: 3558689 - DNA, 18 bp, Homo sapiens
agctgcaggggcctctgt

SEQ ID NO: 3558690 - DNA, 16 bp, Homo sapiens
agctgccatttccctt

SEQ ID NO: 3558691 - DNA, 15 bp, Homo sapiens
agctgccctagctga

SEQ ID NO: 3558692 - DNA, 22 bp, Homo sapiens
agctgccctagctgaccccgag

SEQ ID NO: 3558693 - DNA, 20 bp, Homo sapiens
agctgcctggatgagaaaca

SEQ ID NO: 3558694 - DNA, 11 bp, Homo sapiens
agctgcctggg

SEQ ID NO: 3558695 - DNA, 13 bp, Homo sapiens
agctgcctgggcc

SEQ ID NO: 3558696 - DNA, 15 bp, Homo sapiens
agctgctatagcctg

SEQ ID NO: 3558697 - DNA, 16 bp, Homo sapiens
agctgctatagcctgg

SEQ ID NO: 3558698 - DNA, 20 bp, Homo sapiens
agctgctcctagagggaggg

SEQ ID NO: 3558699 - DNA, 16 bp, Homo sapiens
agctgctgaaacaaca

SEQ ID NO: 3558700 - DNA, 20 bp, Homo sapiens
agctgctgaaacaacaaata

SEQ ID NO: 3558701 - DNA, 17 bp, Homo sapiens
agctgctgtgtcctcta

SEQ ID NO: 3558702 - DNA, 21 bp, Homo sapiens
agctgcttgtcctgggcctgc

SEQ ID NO: 3558703 - DNA, 18 bp, Homo sapiens
agctggaaagttgggccc

SEQ ID NO: 3558704 - DNA, 18 bp, Homo sapiens
agctggaaggggccacgt

SEQ ID NO: 3558705 - DNA, 15 bp, Homo sapiens
agctggagaagaccc

SEQ ID NO: 3558706 - DNA, 16 bp, Homo sapiens
agctggcaaccagcca

SEQ ID NO: 3558707 - DNA, 19 bp, Homo sapiens
agctggcaaccagccagcg

SEQ ID NO: 3558708 - DNA, 21 bp, Homo sapiens
agctggcaaccagccagcgtc

SEQ ID NO: 3558709 - DNA, 22 bp, Homo sapiens
agctggcaaccagccagcgtcc

SEQ ID NO: 3558710 - DNA, 13 bp, Homo sapiens
agctggcacaaaa

SEQ ID NO: 3558711 - DNA, 21 bp, Homo sapiens
agctggcccccagccctgggg

SEQ ID NO: 3558712 - DNA, 13 bp, Homo sapiens
agctggcccttgg

SEQ ID NO: 3558713 - DNA, 19 bp, Homo sapiens
agctggcctgtctgcgtgg

SEQ ID NO: 3558714 - DNA, 12 bp, Homo sapiens
agctggctgggc

SEQ ID NO: 3558715 - DNA, 18 bp, Homo sapiens
agctgggggtgggccagg

SEQ ID NO: 3558716 - DNA, 22 bp, Homo sapiens
agggactatctttgctgcagag

SEQ ID NO: 3558717 - DNA, 23 bp, Homo sapiens
agggactgccagtccccctgccc

SEQ ID NO: 3558718 - DNA, 18 bp, Homo sapiens
agggacttttattttctt

SEQ ID NO: 3558719 - DNA, 14 bp, Homo sapiens
agggagaaacccac

SEQ ID NO: 3558720 - DNA, 22 bp, Homo sapiens
agggagacaggcagggagggct

SEQ ID NO: 3558721 - DNA, 23 bp, Homo sapiens
agggagactgaccatcatgccct

SEQ ID NO: 3558722 - DNA, 13 bp, Homo sapiens
agggagagaagat

SEQ ID NO: 3558723 - DNA, 19 bp, Homo sapiens
agggagagagtagctgcag

SEQ ID NO: 3558724 - DNA, 14 bp, Homo sapiens
agggagcattgcag

SEQ ID NO: 3558725 - DNA, 10 bp, Homo sapiens
agggagccaa

SEQ ID NO: 3558726 - DNA, 11 bp, Homo sapiens
agggagccaag

SEQ ID NO: 3558727 - DNA, 13 bp, Homo sapiens
agggagccaaggg

SEQ ID NO: 3558728 - DNA, 14 bp, Homo sapiens
agggagccaaggga

SEQ ID NO: 3558729 - DNA, 20 bp, Homo sapiens
agggagccaagggatggaca

SEQ ID NO: 3558730 - DNA, 14 bp, Homo sapiens
agggaggcaagccc

SEQ ID NO: 3558731 - DNA, 15 bp, Homo sapiens
agggaggcaagccct

SEQ ID NO: 3558732 - DNA, 13 bp, Homo sapiens
agggaggcagggg

SEQ ID NO: 3558733 - DNA, 17 bp, Homo sapiens
agggagggatgaccttc

SEQ ID NO: 3558734 - DNA, 21 bp, Homo sapiens
agggagggatgaccttcccag

SEQ ID NO: 3558735 - DNA, 15 bp, Homo sapiens
agggaggggcctagg

SEQ ID NO: 3558736 - DNA, 20 bp, Homo sapiens
agggatccccaggaggcctg

SEQ ID NO: 3558737 - DNA, 22 bp, Homo sapiens
agggatctggtcctacccatcc

SEQ ID NO: 3558738 - DNA, 21 bp, Homo sapiens
agggatctgtttgaacactta

SEQ ID NO: 3558739 - DNA, 15 bp, Homo sapiens
agggatgactaaaat

SEQ ID NO: 3558740 - DNA, 22 bp, Homo sapiens
agggatgatggcagagccaggc

SEQ ID NO: 3558741 - DNA, 21 bp, Homo sapiens
agggatgccctggaggtggct

SEQ ID NO: 3558742 - DNA, 23 bp, Homo sapiens
agggatgcggatcctgctggggc

SEQ ID NO: 3558743 - DNA, 17 bp, Homo sapiens
agggatggacatcttgt

SEQ ID NO: 3558744 - DNA, 20 bp, Homo sapiens
agggatggacttgtgattgg

SEQ ID NO: 3558745 - DNA, 21 bp, Homo sapiens
agggatggacttgtgattggc

SEQ ID NO: 3558746 - DNA, 13 bp, Homo sapiens
agggatggagaaa

SEQ ID NO: 3558747 - DNA, 21 bp, Homo sapiens
agggatggagaaagaagtgga

SEQ ID NO: 3558748 - DNA, 20 bp, Homo sapiens
agggatggagggaagacctg

SEQ ID NO: 3558749 - DNA, 17 bp, Homo sapiens
agggcactggtggcccg

SEQ ID NO: 3558750 - DNA, 13 bp, Homo sapiens
agggcagcaggcc

SEQ ID NO: 3558751 - DNA, 14 bp, Homo sapiens
agggcagcaggcca

SEQ ID NO: 3558752 - DNA, 16 bp, Homo sapiens
agggcagcaggccaga

SEQ ID NO: 3558753 - DNA, 12 bp, Homo sapiens
agggcagcggct

SEQ ID NO: 3558754 - DNA, 14 bp, Homo sapiens
agggcagcggctcc

SEQ ID NO: 3558755 - DNA, 15 bp, Homo sapiens
agggcagcggctcca

SEQ ID NO: 3558756 - DNA, 22 bp, Homo sapiens
agggcagctggcccccagccct

SEQ ID NO: 3558757 - DNA, 18 bp, Homo sapiens
agggcagggcccacgtgt

SEQ ID NO: 3558758 - DNA, 21 bp, Homo sapiens
agggcagtgcccatgtgtaca

SEQ ID NO: 3558759 - DNA, 13 bp, Homo sapiens
agggcataaagta

SEQ ID NO: 3558760 - DNA, 14 bp, Homo sapiens
agggcataaagtaa

SEQ ID NO: 3558761 - DNA, 19 bp, Homo sapiens
agggccaagagatctgtgt

SEQ ID NO: 3558762 - DNA, 21 bp, Homo sapiens
agggccaccggtgggcagtgg

SEQ ID NO: 3558763 - DNA, 15 bp, Homo sapiens
agggccacctgcagg

SEQ ID NO: 3558764 - DNA, 11 bp, Homo sapiens
agggccagagc

SEQ ID NO: 3558765 - DNA, 14 bp, Homo sapiens
agggccagagccag

SEQ ID NO: 3558766 - DNA, 18 bp, Homo sapiens
agggccaggtgcagacct

SEQ ID NO: 3558767 - DNA, 15 bp, Homo sapiens
agggccatctgactg

SEQ ID NO: 3558768 - DNA, 23 bp, Homo sapiens
agggccatctgactgccaagcca

SEQ ID NO: 3558769 - DNA, 14 bp, Homo sapiens
agggcccacacctg

SEQ ID NO: 3558770 - DNA, 14 bp, Homo sapiens
agggcccagagccc

SEQ ID NO: 3558771 - DNA, 16 bp, Homo sapiens
agggcccagagcccag

SEQ ID NO: 3558772 - DNA, 18 bp, Homo sapiens
agggcccagcccagagcc

SEQ ID NO: 3558773 - DNA, 23 bp, Homo sapiens
agggcccccaccgaggttcccag

SEQ ID NO: 3558774 - DNA, 15 bp, Homo sapiens
agggccctgagctga

SEQ ID NO: 3558775 - DNA, 19 bp, Homo sapiens
agggccctgagctgagggc

SEQ ID NO: 3558776 - DNA, 15 bp, Homo sapiens
agggccgggcagggg

SEQ ID NO: 3558777 - DNA, 12 bp, Homo sapiens
agggcctccagg

SEQ ID NO: 3558778 - DNA, 14 bp, Homo sapiens
agggcctccagggc

SEQ ID NO: 3558779 - DNA, 17 bp, Homo sapiens
agggcctgacaccccct

SEQ ID NO: 3558780 - DNA, 20 bp, Homo sapiens
agggcctgacaccccctccc

SEQ ID NO: 3558781 - DNA, 17 bp, Homo sapiens
agggcctggagccccat

SEQ ID NO: 3558782 - DNA, 17 bp, Homo sapiens
agggcctgtatgcctgg

SEQ ID NO: 3558783 - DNA, 15 bp, Homo sapiens
agggctaaataaaga

SEQ ID NO: 3558784 - DNA, 17 bp, Homo sapiens
agggctaaataaagagg

SEQ ID NO: 3558785 - DNA, 24 bp, Homo sapiens
agggctcaatctctgggggctgag

SEQ ID NO: 3558786 - DNA, 15 bp, Homo sapiens
agggctcagggcagt

SEQ ID NO: 3558787 - DNA, 18 bp, Homo sapiens
agggctcggggtgtgtca

SEQ ID NO: 3558788 - DNA, 17 bp, Homo sapiens
agggctgagcctggtcc

SEQ ID NO: 3558789 - DNA, 21 bp, Homo sapiens
agggctggagacttcctctgg

SEQ ID NO: 3558790 - DNA, 17 bp, Homo sapiens
agggctggttaatgtag

SEQ ID NO: 3558791 - DNA, 17 bp, Homo sapiens
agggctttggttccttc

SEQ ID NO: 3558792 - DNA, 20 bp, Homo sapiens
agggctttggttccttctct

SEQ ID NO: 3558793 - DNA, 24 bp, Homo sapiens
aggggaccaattctggacagacag

SEQ ID NO: 3558794 - DNA, 15 bp, Homo sapiens
aggggagacaggagc

SEQ ID NO: 3558795 - DNA, 17 bp, Homo sapiens
aggggagcccactgtcc

SEQ ID NO: 3558796 - DNA, 11 bp, Homo sapiens
aggggagccct

SEQ ID NO: 3558797 - DNA, 12 bp, Homo sapiens
aggggagccctc

SEQ ID NO: 3558798 - DNA, 16 bp, Homo sapiens
aggggagccctccacg

SEQ ID NO: 3558799 - DNA, 23 bp, Homo sapiens
aggggaggcacactttctggcaa

SEQ ID NO: 3558800 - DNA, 16 bp, Homo sapiens
aggggatccagccact

SEQ ID NO: 3558801 - DNA, 16 bp, Homo sapiens
aggggcaagctaggcc

SEQ ID NO: 3558802 - DNA, 20 bp, Homo sapiens
aggggcagcgcatgtgtgca

SEQ ID NO: 3558803 - DNA, 13 bp, Homo sapiens
aggggcaggtcta

SEQ ID NO: 3558804 - DNA, 16 bp, Homo sapiens
aggggccaacctcagg

SEQ ID NO: 3558805 - DNA, 21 bp, Homo sapiens
aggggccaacctcaggctcct

SEQ ID NO: 3558806 - DNA, 22 bp, Homo sapiens
aggggccaacctcaggctccta

SEQ ID NO: 3558807 - DNA, 18 bp, Homo sapiens
aggggccccgtgtcctgc

SEQ ID NO: 3558808 - DNA, 23 bp, Homo sapiens
aggggcccggccagccatgtctg

SEQ ID NO: 3558809 - DNA, 16 bp, Homo sapiens
aggggccctggccagg

SEQ ID NO: 3558810 - DNA, 15 bp, Homo sapiens
aggggccgctgccac

SEQ ID NO: 3558811 - DNA, 23 bp, Homo sapiens
aggggcctaggcctcagccagag

SEQ ID NO: 3558812 - DNA, 20 bp, Homo sapiens
aggggcctgcagaaggaaag

SEQ ID NO: 3558813 - DNA, 22 bp, Homo sapiens
aggggcctggaggtctggctga

SEQ ID NO: 3558814 - DNA, 20 bp, Homo sapiens
aggggcgtgggagtggcctg

SEQ ID NO: 3558815 - DNA, 14 bp, Homo sapiens
aggggctgagtgag

SEQ ID NO: 3558816 - DNA, 21 bp, Homo sapiens
aggggcttaattattgatgtt

SEQ ID NO: 3558817 - DNA, 14 bp, Homo sapiens
aggggctttctctt

SEQ ID NO: 3558818 - DNA, 16 bp, Homo sapiens
aggggctttctcttcc

SEQ ID NO: 3558819 - DNA, 23 bp, Homo sapiens
agggggagccggtaactgtcctg

SEQ ID NO: 3558820 - DNA, 18 bp, Homo sapiens
agggggagtagccaagct

SEQ ID NO: 3558821 - DNA, 15 bp, Homo sapiens
agggggcaggctgag

SEQ ID NO: 3558822 - DNA, 13 bp, Homo sapiens
agggggccccgcc

SEQ ID NO: 3558823 - DNA, 22 bp, Homo sapiens
agggggccccgccagggctggg

SEQ ID NO: 3558824 - DNA, 13 bp, Homo sapiens
agggggccctgct

SEQ ID NO: 3558825 - DNA, 13 bp, Homo sapiens
agggggctgctgc

SEQ ID NO: 3558826 - DNA, 13 bp, Homo sapiens
aggggggagggaa

SEQ ID NO: 3558827 - DNA, 16 bp, Homo sapiens
aggggggctgtgccaa

SEQ ID NO: 3558828 - DNA, 17 bp, Homo sapiens
agggggtaaagcagttc

SEQ ID NO: 3558829 - DNA, 17 bp, Homo sapiens
agggggtgggggtgccg

SEQ ID NO: 3558830 - DNA, 22 bp, Homo sapiens
aggggtatgttccctcttgtcc

SEQ ID NO: 3558831 - DNA, 15 bp, Homo sapiens
aggggtgaggatagg

SEQ ID NO: 3558832 - DNA, 23 bp, Homo sapiens
aggggtgcggcggtcccagctcc

SEQ ID NO: 3558833 - DNA, 23 bp, Homo sapiens
aggggtggaatgccgctgtctct

SEQ ID NO: 3558834 - DNA, 22 bp, Homo sapiens
aggggtgggggtgccgctgtct

SEQ ID NO: 3558835 - DNA, 14 bp, Homo sapiens
agggtaggtggggc

SEQ ID NO: 3558836 - DNA, 19 bp, Homo sapiens
agggtccacagctggaaag

SEQ ID NO: 3558837 - DNA, 15 bp, Homo sapiens
agggtccacctggag

SEQ ID NO: 3558838 - DNA, 21 bp, Homo sapiens
agggtccctgaacgccctggt

SEQ ID NO: 3558839 - DNA, 17 bp, Homo sapiens
agggtcctgcagcctgc

SEQ ID NO: 3558840 - DNA, 17 bp, Homo sapiens
agggtccttttgacact

SEQ ID NO: 3558841 - DNA, 22 bp, Homo sapiens
agggtccttttgacactgctct

SEQ ID NO: 3558842 - DNA, 14 bp, Homo sapiens
agggtctcccctcc

SEQ ID NO: 3558843 - DNA, 17 bp, Homo sapiens
agggtctcccctcctgc

SEQ ID NO: 3558844 - DNA, 17 bp, Homo sapiens
agggtctctctccaggt

SEQ ID NO: 3558845 - DNA, 22 bp, Homo sapiens
agggtctctctccaggtcagcc

SEQ ID NO: 3558846 - DNA, 19 bp, Homo sapiens
agggtgatggaacaagaga

SEQ ID NO: 3558847 - DNA, 21 bp, Homo sapiens
agggtgatgggaaagcattgt

SEQ ID NO: 3558848 - DNA, 18 bp, Homo sapiens
agttctttcctccccctg

SEQ ID NO: 3558849 - DNA, 17 bp, Homo sapiens
agttctttgctgcccct

SEQ ID NO: 3558850 - DNA, 20 bp, Homo sapiens
agttctttgctgcccctgtc

SEQ ID NO: 3558851 - DNA, 15 bp, Homo sapiens
agttctttgggccag

SEQ ID NO: 3558852 - DNA, 16 bp, Homo sapiens
agttctttgggccaga

SEQ ID NO: 3558853 - DNA, 17 bp, Homo sapiens
agttctttgggccagac

SEQ ID NO: 3558854 - DNA, 18 bp, Homo sapiens
agttgaaaagactccaaa

SEQ ID NO: 3558855 - DNA, 19 bp, Homo sapiens
agttgaaaagactccaaag

SEQ ID NO: 3558856 - DNA, 13 bp, Homo sapiens
agttgacagtatt

SEQ ID NO: 3558857 - DNA, 14 bp, Homo sapiens
agttgacagtatta

SEQ ID NO: 3558858 - DNA, 17 bp, Homo sapiens
agttgacctttatttat

SEQ ID NO: 3558859 - DNA, 20 bp, Homo sapiens
agttgacctttatttattaa

SEQ ID NO: 3558860 - DNA, 21 bp, Homo sapiens
agttgacttactgacaaaagg

SEQ ID NO: 3558861 - DNA, 15 bp, Homo sapiens
agttgacttatagta

SEQ ID NO: 3558862 - DNA, 15 bp, Homo sapiens
agttgatctggaacc

SEQ ID NO: 3558863 - DNA, 18 bp, Homo sapiens
agttgatctggaacccag

SEQ ID NO: 3558864 - DNA, 16 bp, Homo sapiens
agttgatgtatggtat

SEQ ID NO: 3558865 - DNA, 15 bp, Homo sapiens
agttgcaaagcattt

SEQ ID NO: 3558866 - DNA, 21 bp, Homo sapiens
agttgccaatctaaaatggca

SEQ ID NO: 3558867 - DNA, 14 bp, Homo sapiens
agttgcctttattt

SEQ ID NO: 3558868 - DNA, 19 bp, Homo sapiens
agttgcctttatttgctgt

SEQ ID NO: 3558869 - DNA, 14 bp, Homo sapiens
agttgctgttaatc

SEQ ID NO: 3558870 - DNA, 16 bp, Homo sapiens
agttgggcccctgagg

SEQ ID NO: 3558871 - DNA, 16 bp, Homo sapiens
agttggggcagaggag

SEQ ID NO: 3558872 - DNA, 15 bp, Homo sapiens
agttggtaacttttg

SEQ ID NO: 3558873 - DNA, 21 bp, Homo sapiens
agttggtgtaatcattttaaa

SEQ ID NO: 3558874 - DNA, 21 bp, Homo sapiens
agttgtaaaatagaaaaagtg

SEQ ID NO: 3558875 - DNA, 17 bp, Homo sapiens
agttgtagcagaaacca

SEQ ID NO: 3558876 - DNA, 23 bp, Homo sapiens
agttgtatcagcacgtgtggcct

SEQ ID NO: 3558877 - DNA, 20 bp, Homo sapiens
agttgttagattaagaaata

SEQ ID NO: 3558878 - DNA, 14 bp, Homo sapiens
agttgttatttatt

SEQ ID NO: 3558879 - DNA, 17 bp, Homo sapiens
agttgttatttattgaa

SEQ ID NO: 3558880 - DNA, 12 bp, Homo sapiens
agtttaaacaaa

SEQ ID NO: 3558881 - DNA, 14 bp, Homo sapiens
agtttaaacaaaaa

SEQ ID NO: 3558882 - DNA, 15 bp, Homo sapiens
agtttaaacaaaaaa

SEQ ID NO: 3558883 - DNA, 13 bp, Homo sapiens
agtttaaattcta

SEQ ID NO: 3558884 - DNA, 23 bp, Homo sapiens
agtttaagccgcagacctggagc

SEQ ID NO: 3558885 - DNA, 23 bp, Homo sapiens
agtttaagtgtgcagccatagtt

SEQ ID NO: 3558886 - DNA, 23 bp, Homo sapiens
agtttaattgaaagaatgtaaag

SEQ ID NO: 3558887 - DNA, 14 bp, Homo sapiens
agtttaccttgtat

SEQ ID NO: 3558888 - DNA, 22 bp, Homo sapiens
agtttattgtttgatgttttta

SEQ ID NO: 3558889 - DNA, 14 bp, Homo sapiens
agtttcaatttgtt

SEQ ID NO: 3558890 - DNA, 13 bp, Homo sapiens
agtttcctcagtg

SEQ ID NO: 3558891 - DNA, 19 bp, Homo sapiens
agtttcctcagtgatggaa

SEQ ID NO: 3558892 - DNA, 13 bp, Homo sapiens
agtttctattctg

SEQ ID NO: 3558893 - DNA, 13 bp, Homo sapiens
agtttctcagctc

SEQ ID NO: 3558894 - DNA, 22 bp, Homo sapiens
agtttctgtcgttaaaaacaga

SEQ ID NO: 3558895 - DNA, 23 bp, Homo sapiens
agtttcttgcttggaagccaggt

SEQ ID NO: 3558896 - DNA, 20 bp, Homo sapiens
agtttgaagaccaatcaaat

SEQ ID NO: 3558897 - DNA, 21 bp, Homo sapiens
agtttgaagaccaatcaaata

SEQ ID NO: 3558898 - DNA, 23 bp, Homo sapiens
agtttgaagaccaatcaaatata

SEQ ID NO: 3558899 - DNA, 23 bp, Homo sapiens
agtttgctctaccaaatagtgat

SEQ ID NO: 3558900 - DNA, 14 bp, Homo sapiens
agtttgctgtgctt

SEQ ID NO: 3558901 - DNA, 20 bp, Homo sapiens
agtttgctgtgctttggaac

SEQ ID NO: 3558902 - DNA, 15 bp, Homo sapiens
agtttgggcatattt

SEQ ID NO: 3558903 - DNA, 16 bp, Homo sapiens
agtttggtgtgtcctc

SEQ ID NO: 3558904 - DNA, 16 bp, Homo sapiens
agtttgtagccaggta

SEQ ID NO: 3558905 - DNA, 12 bp, Homo sapiens
agtttgtgtaaa

SEQ ID NO: 3558906 - DNA, 16 bp, Homo sapiens
agttttatttgtatta

SEQ ID NO: 3558907 - DNA, 17 bp, Homo sapiens
agttttctcctcccagg

SEQ ID NO: 3558908 - DNA, 17 bp, Homo sapiens
agttttctgagaaagac

SEQ ID NO: 3558909 - DNA, 17 bp, Homo sapiens
agttttgaagattctat

SEQ ID NO: 3558910 - DNA, 18 bp, Homo sapiens
agttttgaagattctatg

SEQ ID NO: 3558911 - DNA, 17 bp, Homo sapiens
agttttgagtaattcaa

SEQ ID NO: 3558912 - DNA, 20 bp, Homo sapiens
agtttttcataagatatttt

SEQ ID NO: 3558913 - DNA, 14 bp, Homo sapiens
ataaaaacttttga

SEQ ID NO: 3558914 - DNA, 11 bp, Homo sapiens
ataaaaaggac

SEQ ID NO: 3558915 - DNA, 17 bp, Homo sapiens
ataaaaagtaatgactt

SEQ ID NO: 3558916 - DNA, 12 bp, Homo sapiens
ataaaaatatat

SEQ ID NO: 3558917 - DNA, 14 bp, Homo sapiens
ataaaaatcacacc

SEQ ID NO: 3558918 - DNA, 16 bp, Homo sapiens
ataaaaatcatataga

SEQ ID NO: 3558919 - DNA, 14 bp, Homo sapiens
ataaaagatatgtt

SEQ ID NO: 3558920 - DNA, 23 bp, Homo sapiens
ataaaataatgggattttctttt

SEQ ID NO: 3558921 - DNA, 18 bp, Homo sapiens
ataaaatagtatgaaaat

SEQ ID NO: 3558922 - DNA, 16 bp, Homo sapiens
ataaaatgtaaactgt

SEQ ID NO: 3558923 - DNA, 16 bp, Homo sapiens
ataaaatgtattcaag

SEQ ID NO: 3558924 - DNA, 13 bp, Homo sapiens
ataaacaaagaca

SEQ ID NO: 3558925 - DNA, 15 bp, Homo sapiens
ataaacaaagacatt

SEQ ID NO: 3558926 - DNA, 17 bp, Homo sapiens
ataaacaaagacattga

SEQ ID NO: 3558927 - DNA, 21 bp, Homo sapiens
ataaacactgttttatagaaa

SEQ ID NO: 3558928 - DNA, 19 bp, Homo sapiens
ataaacggttcctggtgac

SEQ ID NO: 3558929 - DNA, 16 bp, Homo sapiens
ataaactactctttga

SEQ ID NO: 3558930 - DNA, 17 bp, Homo sapiens
ataaactactctttgat

SEQ ID NO: 3558931 - DNA, 22 bp, Homo sapiens
ataaactgactatcataaaatc

SEQ ID NO: 3558932 - DNA, 17 bp, Homo sapiens
ataaacttacagatctg

SEQ ID NO: 3558933 - DNA, 23 bp, Homo sapiens
ataaagaaggatgatgtcttttt

SEQ ID NO: 3558934 - DNA, 11 bp, Homo sapiens
ataaagcaatt

SEQ ID NO: 3558935 - DNA, 12 bp, Homo sapiens
ataaagcatgtg

SEQ ID NO: 3558936 - DNA, 16 bp, Homo sapiens
ataaagcttttggaag

SEQ ID NO: 3558937 - DNA, 16 bp, Homo sapiens
ataaaggcagttttct

SEQ ID NO: 3558938 - DNA, 16 bp, Homo sapiens
ataaaggctaactatg

SEQ ID NO: 3558939 - DNA, 18 bp, Homo sapiens
ataaagtaaatacatgca

SEQ ID NO: 3558940 - DNA, 23 bp, Homo sapiens
ataaatacgtgtcaaaaaagaat

SEQ ID NO: 3558941 - DNA, 17 bp, Homo sapiens
ataaataggtttatatt

SEQ ID NO: 3558942 - DNA, 22 bp, Homo sapiens
ataaataggtttatattattga

SEQ ID NO: 3558943 - DNA, 15 bp, Homo sapiens
ataaatagtattcca

SEQ ID NO: 3558944 - DNA, 15 bp, Homo sapiens
ataaatattttccgt

SEQ ID NO: 3558945 - DNA, 22 bp, Homo sapiens
ataaatcacagatgcatataga

SEQ ID NO: 3558946 - DNA, 16 bp, Homo sapiens
ataaatgcttttctaa

SEQ ID NO: 3558947 - DNA, 17 bp, Homo sapiens
ataaatgtatcatagaa

SEQ ID NO: 3558948 - DNA, 21 bp, Homo sapiens
ataaatgtatcatagaaatgt

SEQ ID NO: 3558949 - DNA, 23 bp, Homo sapiens
ataaatgtcactttttgaggcaa

SEQ ID NO: 3558950 - DNA, 19 bp, Homo sapiens
ataaatgtgccttcatttt

SEQ ID NO: 3558951 - DNA, 18 bp, Homo sapiens
ataaatgtttatattgtt

SEQ ID NO: 3558952 - DNA, 14 bp, Homo sapiens
ataaattattactt

SEQ ID NO: 3558953 - DNA, 16 bp, Homo sapiens
ataaattattacttta

SEQ ID NO: 3558954 - DNA, 20 bp, Homo sapiens
ataaattattactttaaatt

SEQ ID NO: 3558955 - DNA, 11 bp, Homo sapiens
ataaattattt

SEQ ID NO: 3558956 - DNA, 12 bp, Homo sapiens
ataaattctaaa

SEQ ID NO: 3558957 - DNA, 16 bp, Homo sapiens
ataaattctactaagt

SEQ ID NO: 3558958 - DNA, 18 bp, Homo sapiens
ataaattctactaagtta

SEQ ID NO: 3558959 - DNA, 16 bp, Homo sapiens
ataaatttactttaca

SEQ ID NO: 3558960 - DNA, 21 bp, Homo sapiens
ataaatttctgggatatttaa

SEQ ID NO: 3558961 - DNA, 14 bp, Homo sapiens
ataaattttttgaa

SEQ ID NO: 3558962 - DNA, 16 bp, Homo sapiens
ataaattttttgaaac

SEQ ID NO: 3558963 - DNA, 13 bp, Homo sapiens
ataacaaaatgga

SEQ ID NO: 3558964 - DNA, 15 bp, Homo sapiens
ataacagtagtgtta

SEQ ID NO: 3558965 - DNA, 18 bp, Homo sapiens
ataaccctgtcacccaca

SEQ ID NO: 3558966 - DNA, 15 bp, Homo sapiens
ataactattacagtg

SEQ ID NO: 3558967 - DNA, 16 bp, Homo sapiens
ataactattacagtgt

SEQ ID NO: 3558968 - DNA, 17 bp, Homo sapiens
ataactcctgtcccttt

SEQ ID NO: 3558969 - DNA, 14 bp, Homo sapiens
ataacttgctttct

SEQ ID NO: 3558970 - DNA, 20 bp, Homo sapiens
ataacttgctttcttctttc

SEQ ID NO: 3558971 - DNA, 16 bp, Homo sapiens
ataactttaacttctg

SEQ ID NO: 3558972 - DNA, 22 bp, Homo sapiens
ataactttaacttctgttttac

SEQ ID NO: 3558973 - DNA, 15 bp, Homo sapiens
ataagactattccaa

SEQ ID NO: 3558974 - DNA, 11 bp, Homo sapiens
ataagagaaac

SEQ ID NO: 3558975 - DNA, 22 bp, Homo sapiens
ataagagcttccaattttcctt

SEQ ID NO: 3558976 - DNA, 21 bp, Homo sapiens
ataagattcatatttacttct

SEQ ID NO: 3558977 - DNA, 19 bp, Homo sapiens
ataagcacctaaaacccaa

SEQ ID NO: 3558978 - DNA, 21 bp, Homo sapiens
ataagctaacaccagacagac

SEQ ID NO: 3558979 - DNA, 21 bp, Homo sapiens
ataagctatcacctagcagcc

SEQ ID NO: 3558980 - DNA, 23 bp, Homo sapiens
ataaggcccagagcgaggaaagg

SEQ ID NO: 3558981 - DNA, 18 bp, Homo sapiens
atcaagatttttttcctg

SEQ ID NO: 3558982 - DNA, 21 bp, Homo sapiens
atcaagccatgtataaatgtg

SEQ ID NO: 3558983 - DNA, 19 bp, Homo sapiens
atcaaggataaatatctta

SEQ ID NO: 3558984 - DNA, 18 bp, Homo sapiens
atcaagggaagaactatt

SEQ ID NO: 3558985 - DNA, 16 bp, Homo sapiens
atcaaggtagaacaaa

SEQ ID NO: 3558986 - DNA, 13 bp, Homo sapiens
atcaagtattttg

SEQ ID NO: 3558987 - DNA, 20 bp, Homo sapiens
atcaattaactgagtagctc

SEQ ID NO: 3558988 - DNA, 16 bp, Homo sapiens
atcaattcatatctat

SEQ ID NO: 3558989 - DNA, 20 bp, Homo sapiens
atcacagatgcatatagaca

SEQ ID NO: 3558990 - DNA, 19 bp, Homo sapiens
atcacagggaatggccaca

SEQ ID NO: 3558991 - DNA, 24 bp, Homo sapiens
atcacagggtgagggccacctcca

SEQ ID NO: 3558992 - DNA, 16 bp, Homo sapiens
atcaccagaataaacc

SEQ ID NO: 3558993 - DNA, 16 bp, Homo sapiens
atcaccgactgaaaat

SEQ ID NO: 3558994 - DNA, 24 bp, Homo sapiens
atcactaatttggctttcacattt

SEQ ID NO: 3558995 - DNA, 20 bp, Homo sapiens
atcacttaggagaagtcttc

SEQ ID NO: 3558996 - DNA, 14 bp, Homo sapiens
atcacttccatgac

SEQ ID NO: 3558997 - DNA, 17 bp, Homo sapiens
atcagaaatacaaaaaa

SEQ ID NO: 3558998 - DNA, 15 bp, Homo sapiens
atcagaacaaaactt

SEQ ID NO: 3558999 - DNA, 13 bp, Homo sapiens
atcagaacatgaa

SEQ ID NO: 3559000 - DNA, 18 bp, Homo sapiens
atcagaacattcagctct

SEQ ID NO: 3559001 - DNA, 16 bp, Homo sapiens
atcagaactcttcctc

SEQ ID NO: 3559002 - DNA, 14 bp, Homo sapiens
atcagcctgtgcca

SEQ ID NO: 3559003 - DNA, 23 bp, Homo sapiens
atcagccttttatgtattttcca

SEQ ID NO: 3559004 - DNA, 23 bp, Homo sapiens
atcaggagaaagcttggttctgt

SEQ ID NO: 3559005 - DNA, 16 bp, Homo sapiens
atcaggctactagaat

SEQ ID NO: 3559006 - DNA, 17 bp, Homo sapiens
atcaggtgtataaatgt

SEQ ID NO: 3559007 - DNA, 18 bp, Homo sapiens
atcagttaactattgcat

SEQ ID NO: 3559008 - DNA, 14 bp, Homo sapiens
atcataaaatcaaa

SEQ ID NO: 3559009 - DNA, 21 bp, Homo sapiens
atcataaggagttggtgtaat

SEQ ID NO: 3559010 - DNA, 17 bp, Homo sapiens
atcatacacttccttct

SEQ ID NO: 3559011 - DNA, 12 bp, Homo sapiens
atcatagaaatg

SEQ ID NO: 3559012 - DNA, 15 bp, Homo sapiens
atcatagaaatgtaa

SEQ ID NO: 3559013 - DNA, 23 bp, Homo sapiens
atcatagtgtacccatctttaat

SEQ ID NO: 3559014 - DNA, 17 bp, Homo sapiens
atcatatggtaggaccc

SEQ ID NO: 3559015 - DNA, 19 bp, Homo sapiens
atcatatggtaggaccctc

SEQ ID NO: 3559016 - DNA, 23 bp, Homo sapiens
atcatatggtaggaccctcgaga

SEQ ID NO: 3559017 - DNA, 14 bp, Homo sapiens
atcatcttattcag

SEQ ID NO: 3559018 - DNA, 19 bp, Homo sapiens
atcatgccctctctcggga

SEQ ID NO: 3559019 - DNA, 19 bp, Homo sapiens
atcatggaggtttgaagat

SEQ ID NO: 3559020 - DNA, 14 bp, Homo sapiens
atcatgggtcaaga

SEQ ID NO: 3559021 - DNA, 21 bp, Homo sapiens
atcatgttgttgtgtgtatat

SEQ ID NO: 3559022 - DNA, 18 bp, Homo sapiens
atcatgtttacagaggac

SEQ ID NO: 3559023 - DNA, 20 bp, Homo sapiens
atcattactgttccagattc

SEQ ID NO: 3559024 - DNA, 20 bp, Homo sapiens
atcattatcagcctgtgcca

SEQ ID NO: 3559025 - DNA, 12 bp, Homo sapiens
atcattctttta

SEQ ID NO: 3559026 - DNA, 14 bp, Homo sapiens
atcattgttgcctc

SEQ ID NO: 3559027 - DNA, 15 bp, Homo sapiens
atcatttattggatg

SEQ ID NO: 3559028 - DNA, 14 bp, Homo sapiens
atcatttcagccaa

SEQ ID NO: 3559029 - DNA, 20 bp, Homo sapiens
atcatttctgcatcagctgc

SEQ ID NO: 3559030 - DNA, 17 bp, Homo sapiens
atcattttaaattccac

SEQ ID NO: 3559031 - DNA, 17 bp, Homo sapiens
atccaaaaagctctgaa

SEQ ID NO: 3559032 - DNA, 17 bp, Homo sapiens
atccaaaacttctcttg

SEQ ID NO: 3559033 - DNA, 18 bp, Homo sapiens
atccaaaagaagccccca

SEQ ID NO: 3559034 - DNA, 19 bp, Homo sapiens
atccaaatcttgaatttct

SEQ ID NO: 3559035 - DNA, 17 bp, Homo sapiens
atccaaggcaaacaatc

SEQ ID NO: 3559036 - DNA, 12 bp, Homo sapiens
atccaagtggcc

SEQ ID NO: 3559037 - DNA, 17 bp, Homo sapiens
atccacagccttgcagc

SEQ ID NO: 3559038 - DNA, 15 bp, Homo sapiens
atccacataaccctg

SEQ ID NO: 3559039 - DNA, 18 bp, Homo sapiens
atccacccagcaggcaga

SEQ ID NO: 3559040 - DNA, 11 bp, Homo sapiens
atccaccccca

SEQ ID NO: 3559041 - DNA, 14 bp, Homo sapiens
atccagaaggaagc

SEQ ID NO: 3559042 - DNA, 15 bp, Homo sapiens
atccagaaggaagct

SEQ ID NO: 3559043 - DNA, 13 bp, Homo sapiens
atccagaagtttt

SEQ ID NO: 3559044 - DNA, 19 bp, Homo sapiens
atccagaagttttaacttc

SEQ ID NO: 3559045 - DNA, 14 bp, Homo sapiens
atccagagctgttt

SEQ ID NO: 3559046 - DNA, 19 bp, Homo sapiens
atccagccacttccccctc

SEQ ID NO: 3559047 - DNA, 15 bp, Homo sapiens
atccagcccaaacct

SEQ ID NO: 3559048 - DNA, 23 bp, Homo sapiens
atccaggactatatttgggcctg

SEQ ID NO: 3559049 - DNA, 21 bp, Homo sapiens
atccaggcccctccctctcca

SEQ ID NO: 3559050 - DNA, 22 bp, Homo sapiens
atccaggctggtgttctgtctg

SEQ ID NO: 3559051 - DNA, 14 bp, Homo sapiens
atccagggacagag

SEQ ID NO: 3559052 - DNA, 15 bp, Homo sapiens
atccagggcagcagg

SEQ ID NO: 3559053 - DNA, 19 bp, Homo sapiens
atccagggcagcaggccag

SEQ ID NO: 3559054 - DNA, 23 bp, Homo sapiens
atccagggcagcaggccagagaa

SEQ ID NO: 3559055 - DNA, 15 bp, Homo sapiens
atccaggttccctcc

SEQ ID NO: 3559056 - DNA, 21 bp, Homo sapiens
atccaggttggttttgctgtt

SEQ ID NO: 3559057 - DNA, 19 bp, Homo sapiens
atccagtggtgggtaattg

SEQ ID NO: 3559058 - DNA, 14 bp, Homo sapiens
atccagtttttcat

SEQ ID NO: 3559059 - DNA, 14 bp, Homo sapiens
atccataaagacaa

SEQ ID NO: 3559060 - DNA, 22 bp, Homo sapiens
atccataaagacaatcactgcc

SEQ ID NO: 3559061 - DNA, 11 bp, Homo sapiens
atccatcctga

SEQ ID NO: 3559062 - DNA, 12 bp, Homo sapiens
atccatcctgag

SEQ ID NO: 3559063 - DNA, 21 bp, Homo sapiens
atccattaaaaagttgttctt

SEQ ID NO: 3559064 - DNA, 22 bp, Homo sapiens
atccattaaaaagttgttcttt

SEQ ID NO: 3559065 - DNA, 23 bp, Homo sapiens
atccattatgactgttgttctta

SEQ ID NO: 3559066 - DNA, 13 bp, Homo sapiens
atccattcacaag

SEQ ID NO: 3559067 - DNA, 13 bp, Homo sapiens
atccattcctaat

SEQ ID NO: 3559068 - DNA, 17 bp, Homo sapiens
atccatttcaggactct

SEQ ID NO: 3559069 - DNA, 18 bp, Homo sapiens
atccatttcaggactctc

SEQ ID NO: 3559070 - DNA, 17 bp, Homo sapiens
atcccaatcattgttgc

SEQ ID NO: 3559071 - DNA, 18 bp, Homo sapiens
atcccaatctttctatat

SEQ ID NO: 3559072 - DNA, 19 bp, Homo sapiens
atcccaccccctcctcccc

SEQ ID NO: 3559073 - DNA, 13 bp, Homo sapiens
atccccgtctctg

SEQ ID NO: 3559074 - DNA, 23 bp, Homo sapiens
atccccgtctctgccctgggctc

SEQ ID NO: 3559075 - DNA, 19 bp, Homo sapiens
atcccctccctgcctgctc

SEQ ID NO: 3559076 - DNA, 20 bp, Homo sapiens
atcccctccctgcctgctcc

SEQ ID NO: 3559077 - DNA, 18 bp, Homo sapiens
atccccttcctaccaccc

SEQ ID NO: 3559078 - DNA, 19 bp, Homo sapiens
atcccgcttctgaagctgc

SEQ ID NO: 3559079 - DNA, 19 bp, Homo sapiens
atccctcacccatcctaga

SEQ ID NO: 3559080 - DNA, 18 bp, Homo sapiens
atccctcccccccatgca

SEQ ID NO: 3559081 - DNA, 11 bp, Homo sapiens
atccctctctt

SEQ ID NO: 3559082 - DNA, 15 bp, Homo sapiens
atccctctcttcccc

SEQ ID NO: 3559083 - DNA, 22 bp, Homo sapiens
atccctctcttccccttccctt

SEQ ID NO: 3559084 - DNA, 15 bp, Homo sapiens
atccctgcctcaggc

SEQ ID NO: 3559085 - DNA, 20 bp, Homo sapiens
atccctgcctcaggccaagg

SEQ ID NO: 3559086 - DNA, 16 bp, Homo sapiens
atccctgcctggaggc

SEQ ID NO: 3559087 - DNA, 17 bp, Homo sapiens
atccctgcctggaggct

SEQ ID NO: 3559088 - DNA, 12 bp, Homo sapiens
atcccttcctgg

SEQ ID NO: 3559089 - DNA, 13 bp, Homo sapiens
atcccttcctgga

SEQ ID NO: 3559090 - DNA, 14 bp, Homo sapiens
atcccttcctggaa

SEQ ID NO: 3559091 - DNA, 16 bp, Homo sapiens
atcccttcctggaaac

SEQ ID NO: 3559092 - DNA, 17 bp, Homo sapiens
atcccttcctggaaaca

SEQ ID NO: 3559093 - DNA, 21 bp, Homo sapiens
atcccttcctggaaacagcat

SEQ ID NO: 3559094 - DNA, 17 bp, Homo sapiens
atcccttggacatttta

SEQ ID NO: 3559095 - DNA, 21 bp, Homo sapiens
atcccttggacattttatgtc

SEQ ID NO: 3559096 - DNA, 16 bp, Homo sapiens
atccctttttttacat

SEQ ID NO: 3559097 - DNA, 17 bp, Homo sapiens
atccgtgcctcttttta

SEQ ID NO: 3559098 - DNA, 16 bp, Homo sapiens
atcctaaagaacaaag

SEQ ID NO: 3559099 - DNA, 19 bp, Homo sapiens
atcctagactgctcctggg

SEQ ID NO: 3559100 - DNA, 20 bp, Homo sapiens
atcctagacttgaaagtttt

SEQ ID NO: 3559101 - DNA, 15 bp, Homo sapiens
atcctaggaaccagc

SEQ ID NO: 3559102 - DNA, 18 bp, Homo sapiens
atcctatatagaatgctg

SEQ ID NO: 3559103 - DNA, 16 bp, Homo sapiens
atcctcaaagaaagtg

SEQ ID NO: 3559104 - DNA, 18 bp, Homo sapiens
atcctcaaagaaagtgta

SEQ ID NO: 3559105 - DNA, 19 bp, Homo sapiens
atcctcaaagaaagtgtat

SEQ ID NO: 3559106 - DNA, 21 bp, Homo sapiens
atcctcaaagaaagtgtattg

SEQ ID NO: 3559107 - DNA, 16 bp, Homo sapiens
atcctcacgccttggc

SEQ ID NO: 3559108 - DNA, 18 bp, Homo sapiens
atcctcacgccttggcct

SEQ ID NO: 3559109 - DNA, 14 bp, Homo sapiens
atcctcatccctga

SEQ ID NO: 3559110 - DNA, 12 bp, Homo sapiens
atcctccacaga

SEQ ID NO: 3559111 - DNA, 13 bp, Homo sapiens
atcctccacagag

SEQ ID NO: 3559112 - DNA, 15 bp, Homo sapiens
atcctccacagagag

SEQ ID NO: 3559113 - DNA, 13 bp, Homo sapiens
atcctccaggttt

SEQ ID NO: 3559114 - DNA, 16 bp, Homo sapiens
atgcatggtgccccag

SEQ ID NO: 3559115 - DNA, 19 bp, Homo sapiens
atgcatggtgccccaggac

SEQ ID NO: 3559116 - DNA, 22 bp, Homo sapiens
atgcatggtgccccaggaccag

SEQ ID NO: 3559117 - DNA, 19 bp, Homo sapiens
atgcatgtagcatataaat

SEQ ID NO: 3559118 - DNA, 23 bp, Homo sapiens
atgcatgtagcatataaatgttt

SEQ ID NO: 3559119 - DNA, 22 bp, Homo sapiens
atgcattataggatcatttgtt

SEQ ID NO: 3559120 - DNA, 14 bp, Homo sapiens
atgcattgcctgta

SEQ ID NO: 3559121 - DNA, 18 bp, Homo sapiens
atgcattgcctgtaacaa

SEQ ID NO: 3559122 - DNA, 17 bp, Homo sapiens
atgccacacctggcctt

SEQ ID NO: 3559123 - DNA, 21 bp, Homo sapiens
atgccactgggacagctggct

SEQ ID NO: 3559124 - DNA, 13 bp, Homo sapiens
atgccagcttctc

SEQ ID NO: 3559125 - DNA, 15 bp, Homo sapiens
atgccagcttctctc

SEQ ID NO: 3559126 - DNA, 21 bp, Homo sapiens
atgccagcttctctctccagg

SEQ ID NO: 3559127 - DNA, 13 bp, Homo sapiens
atgccaggggcct

SEQ ID NO: 3559128 - DNA, 21 bp, Homo sapiens
atgccatttaaagcttattaa

SEQ ID NO: 3559129 - DNA, 13 bp, Homo sapiens
atgcccagatgaa

SEQ ID NO: 3559130 - DNA, 19 bp, Homo sapiens
atgcccagatgaactgact

SEQ ID NO: 3559131 - DNA, 12 bp, Homo sapiens
atgccccagtcg

SEQ ID NO: 3559132 - DNA, 16 bp, Homo sapiens
atgcccgcccggggag

SEQ ID NO: 3559133 - DNA, 19 bp, Homo sapiens
atgcccgcccggggagttt

SEQ ID NO: 3559134 - DNA, 20 bp, Homo sapiens
atgccctactctcttatgca

SEQ ID NO: 3559135 - DNA, 14 bp, Homo sapiens
atgccctcctctcc

SEQ ID NO: 3559136 - DNA, 22 bp, Homo sapiens
atgccctctctcgggagcccta

SEQ ID NO: 3559137 - DNA, 14 bp, Homo sapiens
atgccgctgtctct

SEQ ID NO: 3559138 - DNA, 15 bp, Homo sapiens
atgccgctgtctctg

SEQ ID NO: 3559139 - DNA, 18 bp, Homo sapiens
atgccgctgtctctgagg

SEQ ID NO: 3559140 - DNA, 23 bp, Homo sapiens
atgcctaggagatgttgggaaca

SEQ ID NO: 3559141 - DNA, 13 bp, Homo sapiens
atgcctcctcagg

SEQ ID NO: 3559142 - DNA, 14 bp, Homo sapiens
atgcctcctcagga

SEQ ID NO: 3559143 - DNA, 15 bp, Homo sapiens
atgcctcctcaggag

SEQ ID NO: 3559144 - DNA, 15 bp, Homo sapiens
atgcctcgctccctt

SEQ ID NO: 3559145 - DNA, 21 bp, Homo sapiens
atgcctctgacagtccacagg

SEQ ID NO: 3559146 - DNA, 16 bp, Homo sapiens
atgcctgttaatttat

SEQ ID NO: 3559147 - DNA, 18 bp, Homo sapiens
atgccttaaaatggaatt

SEQ ID NO: 3559148 - DNA, 23 bp, Homo sapiens
atgccttttgaatacatttgtat

SEQ ID NO: 3559149 - DNA, 19 bp, Homo sapiens
atgcctttttttctctgca

SEQ ID NO: 3559150 - DNA, 20 bp, Homo sapiens
atgcgcacagagggaagcca

SEQ ID NO: 3559151 - DNA, 16 bp, Homo sapiens
atgcggatcctgctgg

SEQ ID NO: 3559152 - DNA, 14 bp, Homo sapiens
atgcgtgtgtttgg

SEQ ID NO: 3559153 - DNA, 14 bp, Homo sapiens
atgctaacatctaa

SEQ ID NO: 3559154 - DNA, 16 bp, Homo sapiens
atgctaacatctaaaa

SEQ ID NO: 3559155 - DNA, 17 bp, Homo sapiens
atgctaacatctaaaaa

SEQ ID NO: 3559156 - DNA, 19 bp, Homo sapiens
atgctaacatctaaaaata

SEQ ID NO: 3559157 - DNA, 13 bp, Homo sapiens
atgctataaattt

SEQ ID NO: 3559158 - DNA, 17 bp, Homo sapiens
atgctcaacccccctcc

SEQ ID NO: 3559159 - DNA, 15 bp, Homo sapiens
atgctcaatttcagc

SEQ ID NO: 3559160 - DNA, 14 bp, Homo sapiens
atgctcagaccagc

SEQ ID NO: 3559161 - DNA, 17 bp, Homo sapiens
atgctgaggcccctagg

SEQ ID NO: 3559162 - DNA, 12 bp, Homo sapiens
atgctgcccctc

SEQ ID NO: 3559163 - DNA, 14 bp, Homo sapiens
atgctgcctcagga

SEQ ID NO: 3559164 - DNA, 11 bp, Homo sapiens
atgctgcctgg

SEQ ID NO: 3559165 - DNA, 14 bp, Homo sapiens
atgctgcctggcac

SEQ ID NO: 3559166 - DNA, 12 bp, Homo sapiens
atgctgccttca

SEQ ID NO: 3559167 - DNA, 22 bp, Homo sapiens
atgctgccttcagggagacagg

SEQ ID NO: 3559168 - DNA, 18 bp, Homo sapiens
atgctgctcccctaaagc

SEQ ID NO: 3559169 - DNA, 21 bp, Homo sapiens
atgctgctcccctaaagccag

SEQ ID NO: 3559170 - DNA, 13 bp, Homo sapiens
atgctgctgggga

SEQ ID NO: 3559171 - DNA, 20 bp, Homo sapiens
atgctgctggggaagacagt

SEQ ID NO: 3559172 - DNA, 13 bp, Homo sapiens
atgctggcccagg

SEQ ID NO: 3559173 - DNA, 21 bp, Homo sapiens
atgctggcccagggcccagag

SEQ ID NO: 3559174 - DNA, 23 bp, Homo sapiens
atgctggcccagggcccagagcc

SEQ ID NO: 3559175 - DNA, 19 bp, Homo sapiens
atgctgggccactggggac

SEQ ID NO: 3559176 - DNA, 13 bp, Homo sapiens
atgctgggctggg

SEQ ID NO: 3559177 - DNA, 16 bp, Homo sapiens
atgctgggctgggccc

SEQ ID NO: 3559178 - DNA, 17 bp, Homo sapiens
atgctggtagatgctga

SEQ ID NO: 3559179 - DNA, 17 bp, Homo sapiens
atgctgtctggccctgg

SEQ ID NO: 3559180 - DNA, 18 bp, Homo sapiens
atgctgtctttcttgctc

SEQ ID NO: 3559181 - DNA, 23 bp, Homo sapiens
atgctgtctttcttgctccctga

SEQ ID NO: 3559182 - DNA, 18 bp, Homo sapiens
atgctgtgcccctggcct

SEQ ID NO: 3559183 - DNA, 14 bp, Homo sapiens
atgctgttgagggc

SEQ ID NO: 3559184 - DNA, 22 bp, Homo sapiens
atgctgtttgtagtgaaataat

SEQ ID NO: 3559185 - DNA, 15 bp, Homo sapiens
atgcttgcatggaga

SEQ ID NO: 3559186 - DNA, 18 bp, Homo sapiens
atgcttgcatggagaatg

SEQ ID NO: 3559187 - DNA, 20 bp, Homo sapiens
atgcttgcatggagaatggg

SEQ ID NO: 3559188 - DNA, 15 bp, Homo sapiens
atgcttttatattct

SEQ ID NO: 3559189 - DNA, 16 bp, Homo sapiens
atgcttttatattcta

SEQ ID NO: 3559190 - DNA, 16 bp, Homo sapiens
atggaaaataaacatc

SEQ ID NO: 3559191 - DNA, 13 bp, Homo sapiens
atggaaacactga

SEQ ID NO: 3559192 - DNA, 17 bp, Homo sapiens
atggaaacactgatttt

SEQ ID NO: 3559193 - DNA, 12 bp, Homo sapiens
atggaaagaggt

SEQ ID NO: 3559194 - DNA, 17 bp, Homo sapiens
atggaagaagaaaggac

SEQ ID NO: 3559195 - DNA, 17 bp, Homo sapiens
atggaatttctcccagt

SEQ ID NO: 3559196 - DNA, 12 bp, Homo sapiens
atggacatcttg

SEQ ID NO: 3559197 - DNA, 17 bp, Homo sapiens
atggacatcttgtcatt

SEQ ID NO: 3559198 - DNA, 20 bp, Homo sapiens
atggaccgaggttcccactc

SEQ ID NO: 3559199 - DNA, 20 bp, Homo sapiens
atggacttgtgattggctgc

SEQ ID NO: 3559200 - DNA, 21 bp, Homo sapiens
atggacttgtgattggctgca

SEQ ID NO: 3559201 - DNA, 22 bp, Homo sapiens
atggacttgtgattggctgcag

SEQ ID NO: 3559202 - DNA, 14 bp, Homo sapiens
atggagaatgggac

SEQ ID NO: 3559203 - DNA, 20 bp, Homo sapiens
atggagacaccctctggggg

SEQ ID NO: 3559204 - DNA, 13 bp, Homo sapiens
atggagacagcag

SEQ ID NO: 3559205 - DNA, 14 bp, Homo sapiens
atggagacagcagt

SEQ ID NO: 3559206 - DNA, 11 bp, Homo sapiens
atggagagaat

SEQ ID NO: 3559207 - DNA, 13 bp, Homo sapiens
atggagccccagg

SEQ ID NO: 3559208 - DNA, 14 bp, Homo sapiens
atggagcctgctct

SEQ ID NO: 3559209 - DNA, 18 bp, Homo sapiens
atggagggaagacctgaa

SEQ ID NO: 3559210 - DNA, 20 bp, Homo sapiens
atggagtgagtcacctgctc

SEQ ID NO: 3559211 - DNA, 22 bp, Homo sapiens
atggagtgagtcacctgctcca

SEQ ID NO: 3559212 - DNA, 14 bp, Homo sapiens
atggagtttctctc

SEQ ID NO: 3559213 - DNA, 14 bp, Homo sapiens
atggataatctgag

SEQ ID NO: 3559214 - DNA, 15 bp, Homo sapiens
atggataatctgagc

SEQ ID NO: 3559215 - DNA, 16 bp, Homo sapiens
atggataatctgagca

SEQ ID NO: 3559216 - DNA, 23 bp, Homo sapiens
atggataatctgagcaggtacat

SEQ ID NO: 3559217 - DNA, 15 bp, Homo sapiens
atggataatgtgtat

SEQ ID NO: 3559218 - DNA, 20 bp, Homo sapiens
atggatatttgtcaacagat

SEQ ID NO: 3559219 - DNA, 15 bp, Homo sapiens
atggatcaatacaca

SEQ ID NO: 3559220 - DNA, 16 bp, Homo sapiens
atggatcctggaggat

SEQ ID NO: 3559221 - DNA, 20 bp, Homo sapiens
atggatcgatattaatgtat

SEQ ID NO: 3559222 - DNA, 13 bp, Homo sapiens
atggatcgtgttg

SEQ ID NO: 3559223 - DNA, 19 bp, Homo sapiens
atggatgggggaactcaga

SEQ ID NO: 3559224 - DNA, 21 bp, Homo sapiens
atggcagactctttaataaat

SEQ ID NO: 3559225 - DNA, 18 bp, Homo sapiens
atggcagagaagatgaaa

SEQ ID NO: 3559226 - DNA, 22 bp, Homo sapiens
atggcagagccaggctgttgga

SEQ ID NO: 3559227 - DNA, 14 bp, Homo sapiens
atggcagatttgca

SEQ ID NO: 3559228 - DNA, 17 bp, Homo sapiens
atggcagctcctgacct

SEQ ID NO: 3559229 - DNA, 18 bp, Homo sapiens
atggcaggactcctggca

SEQ ID NO: 3559230 - DNA, 13 bp, Homo sapiens
atggcagtcctgg

SEQ ID NO: 3559231 - DNA, 18 bp, Homo sapiens
atggcagtgactccccag

SEQ ID NO: 3559232 - DNA, 20 bp, Homo sapiens
atggcagtgactccccagcc

SEQ ID NO: 3559233 - DNA, 21 bp, Homo sapiens
atggcagtgactccccagccc

SEQ ID NO: 3559234 - DNA, 17 bp, Homo sapiens
atggcatccctttttca

SEQ ID NO: 3559235 - DNA, 21 bp, Homo sapiens
atggcatgcgccaccatgccc

SEQ ID NO: 3559236 - DNA, 22 bp, Homo sapiens
atggccagtgagatcaatgtga

SEQ ID NO: 3559237 - DNA, 20 bp, Homo sapiens
atggccatcttctttcttcc

SEQ ID NO: 3559238 - DNA, 21 bp, Homo sapiens
atggccatcttctttcttcca

SEQ ID NO: 3559239 - DNA, 14 bp, Homo sapiens
atggccattttaaa

SEQ ID NO: 3559240 - DNA, 16 bp, Homo sapiens
atggccattttaaaat

SEQ ID NO: 3559241 - DNA, 16 bp, Homo sapiens
atggccctcattcagt

SEQ ID NO: 3559242 - DNA, 21 bp, Homo sapiens
atggcctcttactaatgtaaa

SEQ ID NO: 3559243 - DNA, 18 bp, Homo sapiens
atggcctggagcaggccc

SEQ ID NO: 3559244 - DNA, 16 bp, Homo sapiens
atggcctgggggatgt

SEQ ID NO: 3559245 - DNA, 15 bp, Homo sapiens
atggcgaacatgtgt

SEQ ID NO: 3559246 - DNA, 19 bp, Homo sapiens
atggctaacttacaaagat

SEQ ID NO: 3559247 - DNA, 19 bp, Homo sapiens
attgccaaaacccagctgc

SEQ ID NO: 3559248 - DNA, 22 bp, Homo sapiens
attgccaaaacccagctgcacc

SEQ ID NO: 3559249 - DNA, 16 bp, Homo sapiens
attgccagcaaataaa

SEQ ID NO: 3559250 - DNA, 23 bp, Homo sapiens
attgccccatccagacctggctc

SEQ ID NO: 3559251 - DNA, 16 bp, Homo sapiens
attgccccctctcact

SEQ ID NO: 3559252 - DNA, 14 bp, Homo sapiens
attgcccctggctt

SEQ ID NO: 3559253 - DNA, 15 bp, Homo sapiens
attgccctaattaaa

SEQ ID NO: 3559254 - DNA, 16 bp, Homo sapiens
attgccctaattaaaa

SEQ ID NO: 3559255 - DNA, 20 bp, Homo sapiens
attgcctaagaataaacatt

SEQ ID NO: 3559256 - DNA, 22 bp, Homo sapiens
attgctagccagcattccatat

SEQ ID NO: 3559257 - DNA, 15 bp, Homo sapiens
attgctctacagata

SEQ ID NO: 3559258 - DNA, 13 bp, Homo sapiens
attgctggctgcc

SEQ ID NO: 3559259 - DNA, 13 bp, Homo sapiens
attgcttctaaaa

SEQ ID NO: 3559260 - DNA, 17 bp, Homo sapiens
attgcttctaaaacaat

SEQ ID NO: 3559261 - DNA, 14 bp, Homo sapiens
attgcttttttaaa

SEQ ID NO: 3559262 - DNA, 19 bp, Homo sapiens
attggaaagacttctcaaa

SEQ ID NO: 3559263 - DNA, 15 bp, Homo sapiens
attggaaggagaggg

SEQ ID NO: 3559264 - DNA, 14 bp, Homo sapiens
attggaatagcagc

SEQ ID NO: 3559265 - DNA, 23 bp, Homo sapiens
attggatttcctaatactgtcat

SEQ ID NO: 3559266 - DNA, 21 bp, Homo sapiens
attggcaaagtgacaaagcaa

SEQ ID NO: 3559267 - DNA, 12 bp, Homo sapiens
attggcaaagtt

SEQ ID NO: 3559268 - DNA, 22 bp, Homo sapiens
attggcaaagtttaaatgtatt

SEQ ID NO: 3559269 - DNA, 21 bp, Homo sapiens
attggcacatgccacctggca

SEQ ID NO: 3559270 - DNA, 23 bp, Homo sapiens
attggcatctctccccatatata

SEQ ID NO: 3559271 - DNA, 15 bp, Homo sapiens
attggctgcaggaag

SEQ ID NO: 3559272 - DNA, 16 bp, Homo sapiens
attggctgcaggaaga

SEQ ID NO: 3559273 - DNA, 18 bp, Homo sapiens
attgggagcttgggaatg

SEQ ID NO: 3559274 - DNA, 17 bp, Homo sapiens
attggggggtgggcttt

SEQ ID NO: 3559275 - DNA, 18 bp, Homo sapiens
attggtttaaagaaagtg

SEQ ID NO: 3559276 - DNA, 21 bp, Homo sapiens
attggttttatcgcagatttt

SEQ ID NO: 3559277 - DNA, 13 bp, Homo sapiens
attgtaaaagcat

SEQ ID NO: 3559278 - DNA, 20 bp, Homo sapiens
attgtaaaagcattttgtaa

SEQ ID NO: 3559279 - DNA, 21 bp, Homo sapiens
attgtaaaagcattttgtaat

SEQ ID NO: 3559280 - DNA, 23 bp, Homo sapiens
attgtaaaagcattttgtaataa

SEQ ID NO: 3559281 - DNA, 15 bp, Homo sapiens
attgtaaatgtgctt

SEQ ID NO: 3559282 - DNA, 17 bp, Homo sapiens
attgtacaataaatttt

SEQ ID NO: 3559283 - DNA, 17 bp, Homo sapiens
attgtagagccagaggt

SEQ ID NO: 3559284 - DNA, 15 bp, Homo sapiens
attgtatttaagaca

SEQ ID NO: 3559285 - DNA, 17 bp, Homo sapiens
attgtatttaagacata

SEQ ID NO: 3559286 - DNA, 18 bp, Homo sapiens
attgtcaacacaaactgg

SEQ ID NO: 3559287 - DNA, 17 bp, Homo sapiens
attgtcaccgcaggtgc

SEQ ID NO: 3559288 - DNA, 18 bp, Homo sapiens
attgtcaccgcaggtgct

SEQ ID NO: 3559289 - DNA, 22 bp, Homo sapiens
attgtcaccgcaggtgctcatg

SEQ ID NO: 3559290 - DNA, 14 bp, Homo sapiens
attgtccagtttgt

SEQ ID NO: 3559291 - DNA, 17 bp, Homo sapiens
attgtccctctgcccca

SEQ ID NO: 3559292 - DNA, 21 bp, Homo sapiens
attgtctcaacgcctccccct

SEQ ID NO: 3559293 - DNA, 23 bp, Homo sapiens
attgtctcaacgcctccccctcc

SEQ ID NO: 3559294 - DNA, 23 bp, Homo sapiens
attgtgcccctaaagagcatcct

SEQ ID NO: 3559295 - DNA, 15 bp, Homo sapiens
attgtgctcagagac

SEQ ID NO: 3559296 - DNA, 19 bp, Homo sapiens
attgtgtacttttcctttg

SEQ ID NO: 3559297 - DNA, 12 bp, Homo sapiens
attgtgtggaat

SEQ ID NO: 3559298 - DNA, 21 bp, Homo sapiens
attgttagaaaatgacttatt

SEQ ID NO: 3559299 - DNA, 12 bp, Homo sapiens
attgttatcaaa

SEQ ID NO: 3559300 - DNA, 15 bp, Homo sapiens
attgttttacaatag

SEQ ID NO: 3559301 - DNA, 17 bp, Homo sapiens
attgttttacaatagtt

SEQ ID NO: 3559302 - DNA, 18 bp, Homo sapiens
attgttttacaatagttc

SEQ ID NO: 3559303 - DNA, 19 bp, Homo sapiens
attgttttacaatagttct

SEQ ID NO: 3559304 - DNA, 14 bp, Homo sapiens
attgtttttatata

SEQ ID NO: 3559305 - DNA, 17 bp, Homo sapiens
attgtttttatatatta

SEQ ID NO: 3559306 - DNA, 13 bp, Homo sapiens
attgtttttgtat

SEQ ID NO: 3559307 - DNA, 16 bp, Homo sapiens
attgtttttgtattta

SEQ ID NO: 3559308 - DNA, 15 bp, Homo sapiens
atttaaaaaaaagaa

SEQ ID NO: 3559309 - DNA, 18 bp, Homo sapiens
atttaaaaaaaagaaact

SEQ ID NO: 3559310 - DNA, 19 bp, Homo sapiens
atttaaaaaaaagaaactt

SEQ ID NO: 3559311 - DNA, 20 bp, Homo sapiens
atttaaaaaatgaatagtac

SEQ ID NO: 3559312 - DNA, 20 bp, Homo sapiens
atttaaaattgtgatgtgtc

SEQ ID NO: 3559313 - DNA, 20 bp, Homo sapiens
atttaaatggttctgtgcta

SEQ ID NO: 3559314 - DNA, 16 bp, Homo sapiens
atttaaatgtgtacaa

SEQ ID NO: 3559315 - DNA, 18 bp, Homo sapiens
atttaactgattaaaaat

SEQ ID NO: 3559316 - DNA, 12 bp, Homo sapiens
atttaacttctg

SEQ ID NO: 3559317 - DNA, 15 bp, Homo sapiens
atttaagacactgaa

SEQ ID NO: 3559318 - DNA, 13 bp, Homo sapiens
atttaagacataa

SEQ ID NO: 3559319 - DNA, 16 bp, Homo sapiens
atttaagacataaaca

SEQ ID NO: 3559320 - DNA, 15 bp, Homo sapiens
atttaagatgtacat

SEQ ID NO: 3559321 - DNA, 19 bp, Homo sapiens
atttaagatgtacatttaa

SEQ ID NO: 3559322 - DNA, 23 bp, Homo sapiens
atttaagccttataaaccaatct

SEQ ID NO: 3559323 - DNA, 19 bp, Homo sapiens
atttaaggatagtgtgaag

SEQ ID NO: 3559324 - DNA, 13 bp, Homo sapiens
atttaataatatc

SEQ ID NO: 3559325 - DNA, 14 bp, Homo sapiens
atttaataatatca

SEQ ID NO: 3559326 - DNA, 21 bp, Homo sapiens
atttaatatggatttgttaca

SEQ ID NO: 3559327 - DNA, 17 bp, Homo sapiens
atttaatattacagata

SEQ ID NO: 3559328 - DNA, 12 bp, Homo sapiens
atttaattacaa

SEQ ID NO: 3559329 - DNA, 13 bp, Homo sapiens
atttaattacaaa

SEQ ID NO: 3559330 - DNA, 18 bp, Homo sapiens
atttaatttgtaaaactt

SEQ ID NO: 3559331 - DNA, 11 bp, Homo sapiens
atttaattttt

SEQ ID NO: 3559332 - DNA, 14 bp, Homo sapiens
atttaatttttcct

SEQ ID NO: 3559333 - DNA, 15 bp, Homo sapiens
atttaatttttcctt

SEQ ID NO: 3559334 - DNA, 14 bp, Homo sapiens
atttaccaaagtag

SEQ ID NO: 3559335 - DNA, 14 bp, Homo sapiens
atttacctaagatt

SEQ ID NO: 3559336 - DNA, 21 bp, Homo sapiens
atttactatgcacaacagagt

SEQ ID NO: 3559337 - DNA, 13 bp, Homo sapiens
atttactatttca

SEQ ID NO: 3559338 - DNA, 14 bp, Homo sapiens
atttactggaatta

SEQ ID NO: 3559339 - DNA, 16 bp, Homo sapiens
atttacttcttataca

SEQ ID NO: 3559340 - DNA, 17 bp, Homo sapiens
atttacttcttatacat

SEQ ID NO: 3559341 - DNA, 21 bp, Homo sapiens
atttagaaaatagagctttta

SEQ ID NO: 3559342 - DNA, 17 bp, Homo sapiens
atttagaagatattatt

SEQ ID NO: 3559343 - DNA, 21 bp, Homo sapiens
atttagaagccaactatgatt

SEQ ID NO: 3559344 - DNA, 22 bp, Homo sapiens
atttagaagccaactatgatta

SEQ ID NO: 3559345 - DNA, 16 bp, Homo sapiens
atttaggaagttgact

SEQ ID NO: 3559346 - DNA, 17 bp, Homo sapiens
atttaggagaagccagg

SEQ ID NO: 3559347 - DNA, 22 bp, Homo sapiens
atttaggcatgagctcttggca

SEQ ID NO: 3559348 - DNA, 14 bp, Homo sapiens
atttagtcctgtac

SEQ ID NO: 3559349 - DNA, 12 bp, Homo sapiens
atttataatgta

SEQ ID NO: 3559350 - DNA, 16 bp, Homo sapiens
atttataatgtatttg

SEQ ID NO: 3559351 - DNA, 20 bp, Homo sapiens
atttataatgtatttgaaaa

SEQ ID NO: 3559352 - DNA, 13 bp, Homo sapiens
atttatacctcaa

SEQ ID NO: 3559353 - DNA, 22 bp, Homo sapiens
atttatacctcaaactatctgg

SEQ ID NO: 3559354 - DNA, 20 bp, Homo sapiens
atttatcctgaaatttcaga

SEQ ID NO: 3559355 - DNA, 10 bp, Homo sapiens
atttatctat

SEQ ID NO: 3559356 - DNA, 11 bp, Homo sapiens
atttatctata

SEQ ID NO: 3559357 - DNA, 15 bp, Homo sapiens
atttatcttcatgtc

SEQ ID NO: 3559358 - DNA, 22 bp, Homo sapiens
atttatgccttgatgatttaat

SEQ ID NO: 3559359 - DNA, 22 bp, Homo sapiens
atttatgctataaattttttga

SEQ ID NO: 3559360 - DNA, 18 bp, Homo sapiens
atttatgtgaaatgcttt

SEQ ID NO: 3559361 - DNA, 13 bp, Homo sapiens
atttattaaactt

SEQ ID NO: 3559362 - DNA, 14 bp, Homo sapiens
atttattaaacttc

SEQ ID NO: 3559363 - DNA, 16 bp, Homo sapiens
atttattaaacttcag

SEQ ID NO: 3559364 - DNA, 19 bp, Homo sapiens
atttattaaacttcagcaa

SEQ ID NO: 3559365 - DNA, 21 bp, Homo sapiens
atttattaagcagtacaaatg

SEQ ID NO: 3559366 - DNA, 15 bp, Homo sapiens
atttattaattgctt

SEQ ID NO: 3559367 - DNA, 18 bp, Homo sapiens
atttattaattgctttga

SEQ ID NO: 3559368 - DNA, 19 bp, Homo sapiens
atttattaatttgaaacca

SEQ ID NO: 3559369 - DNA, 20 bp, Homo sapiens
atttattccccagtgactcc

SEQ ID NO: 3559370 - DNA, 15 bp, Homo sapiens
atttattgaaatgat

SEQ ID NO: 3559371 - DNA, 16 bp, Homo sapiens
atttattgatgttttc

SEQ ID NO: 3559372 - DNA, 12 bp, Homo sapiens
atttatttaaat

SEQ ID NO: 3559373 - DNA, 14 bp, Homo sapiens
atttatttaaattt

SEQ ID NO: 3559374 - DNA, 16 bp, Homo sapiens
atttatttatttattc

SEQ ID NO: 3559375 - DNA, 14 bp, Homo sapiens
atttatttatttgt

SEQ ID NO: 3559376 - DNA, 20 bp, Homo sapiens
atttatttcttttttgccaa

SEQ ID NO: 3559377 - DNA, 23 bp, Homo sapiens
atttattttcttttgaattgttt

SEQ ID NO: 3559378 - DNA, 18 bp, Homo sapiens
atttatttttaagaaaga

SEQ ID NO: 3559379 - DNA, 12 bp, Homo sapiens
atttcaaatgta

SEQ ID NO: 3559380 - DNA, 16 bp, Homo sapiens
caacgcctccccctcc

SEQ ID NO: 3559381 - DNA, 15 bp, Homo sapiens
caacgtagcctgggc

SEQ ID NO: 3559382 - DNA, 15 bp, Homo sapiens
caacgtgagagaaag

SEQ ID NO: 3559383 - DNA, 17 bp, Homo sapiens
caacgtgagagaaagag

SEQ ID NO: 3559384 - DNA, 14 bp, Homo sapiens
caacgtgcaaagcc

SEQ ID NO: 3559385 - DNA, 13 bp, Homo sapiens
caactactaatag

SEQ ID NO: 3559386 - DNA, 15 bp, Homo sapiens
caactactaatagaa

SEQ ID NO: 3559387 - DNA, 21 bp, Homo sapiens
caactactaatagaataaagg

SEQ ID NO: 3559388 - DNA, 19 bp, Homo sapiens
caactactagtgtgactcc

SEQ ID NO: 3559389 - DNA, 17 bp, Homo sapiens
caactagtaaaatgctg

SEQ ID NO: 3559390 - DNA, 13 bp, Homo sapiens
caactccaggggc

SEQ ID NO: 3559391 - DNA, 14 bp, Homo sapiens
caactccaggggca

SEQ ID NO: 3559392 - DNA, 19 bp, Homo sapiens
caactcttcgaagccttgc

SEQ ID NO: 3559393 - DNA, 15 bp, Homo sapiens
caactgaccagcctc

SEQ ID NO: 3559394 - DNA, 17 bp, Homo sapiens
caactgaccagcctcca

SEQ ID NO: 3559395 - DNA, 19 bp, Homo sapiens
caactgaccagcctccatg

SEQ ID NO: 3559396 - DNA, 18 bp, Homo sapiens
caactgcaaaaaaagcct

SEQ ID NO: 3559397 - DNA, 22 bp, Homo sapiens
caactgcaaaaaaagcctccaa

SEQ ID NO: 3559398 - DNA, 19 bp, Homo sapiens
caactgcaaagaaagtggg

SEQ ID NO: 3559399 - DNA, 15 bp, Homo sapiens
caactgccaggctgc

SEQ ID NO: 3559400 - DNA, 23 bp, Homo sapiens
caactggagttccttatccctct

SEQ ID NO: 3559401 - DNA, 18 bp, Homo sapiens
caactgggcatttcaatc

SEQ ID NO: 3559402 - DNA, 16 bp, Homo sapiens
caactgtttccctgct

SEQ ID NO: 3559403 - DNA, 17 bp, Homo sapiens
caactgtttccctgctg

SEQ ID NO: 3559404 - DNA, 14 bp, Homo sapiens
caacttaacatggg

SEQ ID NO: 3559405 - DNA, 16 bp, Homo sapiens
caacttaacatgggct

SEQ ID NO: 3559406 - DNA, 16 bp, Homo sapiens
caactttaagaggaca

SEQ ID NO: 3559407 - DNA, 16 bp, Homo sapiens
caagaaacagtttctt

SEQ ID NO: 3559408 - DNA, 16 bp, Homo sapiens
caagaaacctgactca

SEQ ID NO: 3559409 - DNA, 21 bp, Homo sapiens
caagaaccactccttcatgtt

SEQ ID NO: 3559410 - DNA, 14 bp, Homo sapiens
caagaatacttgaa

SEQ ID NO: 3559411 - DNA, 19 bp, Homo sapiens
caagacaagagctgttatg

SEQ ID NO: 3559412 - DNA, 17 bp, Homo sapiens
caagacacgtggcctcg

SEQ ID NO: 3559413 - DNA, 19 bp, Homo sapiens
caagacacgtggcctcgtg

SEQ ID NO: 3559414 - DNA, 17 bp, Homo sapiens
caagacagaaaagtgcc

SEQ ID NO: 3559415 - DNA, 22 bp, Homo sapiens
caagacagaaaagtgcctgagc

SEQ ID NO: 3559416 - DNA, 18 bp, Homo sapiens
caagaccacggagggagc

SEQ ID NO: 3559417 - DNA, 22 bp, Homo sapiens
caagaccacggagggagcgaca

SEQ ID NO: 3559418 - DNA, 20 bp, Homo sapiens
caagacctcatctgtggagc

SEQ ID NO: 3559419 - DNA, 20 bp, Homo sapiens
caagacgaggggcagggaag

SEQ ID NO: 3559420 - DNA, 16 bp, Homo sapiens
caagactggcccagtg

SEQ ID NO: 3559421 - DNA, 16 bp, Homo sapiens
caagagatctgtgtgg

SEQ ID NO: 3559422 - DNA, 18 bp, Homo sapiens
caagagatctgtgtggct

SEQ ID NO: 3559423 - DNA, 21 bp, Homo sapiens
caagagatctgtgtggctcct

SEQ ID NO: 3559424 - DNA, 20 bp, Homo sapiens
caagagctactcccacagca

SEQ ID NO: 3559425 - DNA, 18 bp, Homo sapiens
caagagctgttatgctgt

SEQ ID NO: 3559426 - DNA, 20 bp, Homo sapiens
caagagctgttatgctgttt

SEQ ID NO: 3559427 - DNA, 22 bp, Homo sapiens
caagagctgttatgctgtttcc

SEQ ID NO: 3559428 - DNA, 24 bp, Homo sapiens
caagagctgttatgctgtttccta

SEQ ID NO: 3559429 - DNA, 19 bp, Homo sapiens
caagagggcactggtggcc

SEQ ID NO: 3559430 - DNA, 14 bp, Homo sapiens
caagataaacatta

SEQ ID NO: 3559431 - DNA, 21 bp, Homo sapiens
caagatacatatgaggacaag

SEQ ID NO: 3559432 - DNA, 11 bp, Homo sapiens
caagcaaacat

SEQ ID NO: 3559433 - DNA, 18 bp, Homo sapiens
caagcaacacagaggaat

SEQ ID NO: 3559434 - DNA, 18 bp, Homo sapiens
caagcaacattcttgtta

SEQ ID NO: 3559435 - DNA, 16 bp, Homo sapiens
caagcaccaacctcca

SEQ ID NO: 3559436 - DNA, 20 bp, Homo sapiens
caagcaccaacctccagact

SEQ ID NO: 3559437 - DNA, 23 bp, Homo sapiens
caagcaccaacctccagactcag

SEQ ID NO: 3559438 - DNA, 22 bp, Homo sapiens
caagcagactgttctaaaatat

SEQ ID NO: 3559439 - DNA, 14 bp, Homo sapiens
caagcagcccttgc

SEQ ID NO: 3559440 - DNA, 15 bp, Homo sapiens
caagcagcccttgct

SEQ ID NO: 3559441 - DNA, 23 bp, Homo sapiens
caagcagttactccctacactga

SEQ ID NO: 3559442 - DNA, 24 bp, Homo sapiens
caagcagttactccctacactgat

SEQ ID NO: 3559443 - DNA, 13 bp, Homo sapiens
caagcatttcatg

SEQ ID NO: 3559444 - DNA, 19 bp, Homo sapiens
caagcatttcatgaaaaag

SEQ ID NO: 3559445 - DNA, 19 bp, Homo sapiens
caagccagattctcttgaa

SEQ ID NO: 3559446 - DNA, 17 bp, Homo sapiens
caagccatgtataaatg

SEQ ID NO: 3559447 - DNA, 14 bp, Homo sapiens
caagccccatttcc

SEQ ID NO: 3559448 - DNA, 14 bp, Homo sapiens
caagccgtggcttc

SEQ ID NO: 3559449 - DNA, 15 bp, Homo sapiens
caagccgtggcttcc

SEQ ID NO: 3559450 - DNA, 18 bp, Homo sapiens
caagccgtggcttcccgc

SEQ ID NO: 3559451 - DNA, 13 bp, Homo sapiens
caagcctcctgta

SEQ ID NO: 3559452 - DNA, 15 bp, Homo sapiens
caagctaggccccag

SEQ ID NO: 3559453 - DNA, 16 bp, Homo sapiens
caagctaggccccaga

SEQ ID NO: 3559454 - DNA, 17 bp, Homo sapiens
caagctaggccccagag

SEQ ID NO: 3559455 - DNA, 22 bp, Homo sapiens
caagctcctcctccctgcatct

SEQ ID NO: 3559456 - DNA, 13 bp, Homo sapiens
caagctggcacaa

SEQ ID NO: 3559457 - DNA, 14 bp, Homo sapiens
caagctggcacaaa

SEQ ID NO: 3559458 - DNA, 12 bp, Homo sapiens
caagctgtcaca

SEQ ID NO: 3559459 - DNA, 15 bp, Homo sapiens
caagctgtcacaggt

SEQ ID NO: 3559460 - DNA, 15 bp, Homo sapiens
caagctgtccctgca

SEQ ID NO: 3559461 - DNA, 19 bp, Homo sapiens
caagctgtccctgcagggc

SEQ ID NO: 3559462 - DNA, 21 bp, Homo sapiens
caagctgtccctgcagggcca

SEQ ID NO: 3559463 - DNA, 14 bp, Homo sapiens
caagctgttttctt

SEQ ID NO: 3559464 - DNA, 16 bp, Homo sapiens
caagctgttttcttct

SEQ ID NO: 3559465 - DNA, 16 bp, Homo sapiens
caagcttcccaacaga

SEQ ID NO: 3559466 - DNA, 20 bp, Homo sapiens
caaggaaccctcaggccacc

SEQ ID NO: 3559467 - DNA, 18 bp, Homo sapiens
caaggaatttaaaactgt

SEQ ID NO: 3559468 - DNA, 12 bp, Homo sapiens
caaggaatttct

SEQ ID NO: 3559469 - DNA, 15 bp, Homo sapiens
caaggaatttcttaa

SEQ ID NO: 3559470 - DNA, 16 bp, Homo sapiens
caaggaatttcttaac

SEQ ID NO: 3559471 - DNA, 18 bp, Homo sapiens
caaggaatttcttaactt

SEQ ID NO: 3559472 - DNA, 19 bp, Homo sapiens
caaggagcaagaaatgaac

SEQ ID NO: 3559473 - DNA, 18 bp, Homo sapiens
caaggagcatccttggca

SEQ ID NO: 3559474 - DNA, 22 bp, Homo sapiens
caaggagctgctatagcctggg

SEQ ID NO: 3559475 - DNA, 14 bp, Homo sapiens
caaggagtgtaaaa

SEQ ID NO: 3559476 - DNA, 22 bp, Homo sapiens
caaggagtgtaaaatgtatatt

SEQ ID NO: 3559477 - DNA, 19 bp, Homo sapiens
caaggataaatatcttacg

SEQ ID NO: 3559478 - DNA, 17 bp, Homo sapiens
caaggatagatgctggc

SEQ ID NO: 3559479 - DNA, 21 bp, Homo sapiens
caaggatagatgctggcccag

SEQ ID NO: 3559480 - DNA, 15 bp, Homo sapiens
caaggattacagaaa

SEQ ID NO: 3559481 - DNA, 16 bp, Homo sapiens
caaggattacagaaac

SEQ ID NO: 3559482 - DNA, 15 bp, Homo sapiens
caaggcactgtcact

SEQ ID NO: 3559483 - DNA, 16 bp, Homo sapiens
caaggcagcgacccca

SEQ ID NO: 3559484 - DNA, 17 bp, Homo sapiens
caaggccatccttccct

SEQ ID NO: 3559485 - DNA, 12 bp, Homo sapiens
caaggcccagga

SEQ ID NO: 3559486 - DNA, 14 bp, Homo sapiens
caaggccctgccct

SEQ ID NO: 3559487 - DNA, 17 bp, Homo sapiens
caaggccctgccctgcc

SEQ ID NO: 3559488 - DNA, 13 bp, Homo sapiens
caaggcctgcttg

SEQ ID NO: 3559489 - DNA, 17 bp, Homo sapiens
caaggctctcccctctc

SEQ ID NO: 3559490 - DNA, 15 bp, Homo sapiens
caaggctctgagcaa

SEQ ID NO: 3559491 - DNA, 23 bp, Homo sapiens
caaggctgataatatgacaaaca

SEQ ID NO: 3559492 - DNA, 15 bp, Homo sapiens
caaggctgtgcatct

SEQ ID NO: 3559493 - DNA, 16 bp, Homo sapiens
caagggagacaccagt

SEQ ID NO: 3559494 - DNA, 17 bp, Homo sapiens
caagggatctggtccta

SEQ ID NO: 3559495 - DNA, 18 bp, Homo sapiens
caagggccctggcacccc

SEQ ID NO: 3559496 - DNA, 22 bp, Homo sapiens
caagggggctgctgctcctctc

SEQ ID NO: 3559497 - DNA, 22 bp, Homo sapiens
caaggggtgaggataggacaga

SEQ ID NO: 3559498 - DNA, 23 bp, Homo sapiens
caaggggtgaggataggacagag

SEQ ID NO: 3559499 - DNA, 22 bp, Homo sapiens
caagggtttcgactggtccagc

SEQ ID NO: 3559500 - DNA, 21 bp, Homo sapiens
caaggtgaggtgaactccagg

SEQ ID NO: 3559501 - DNA, 21 bp, Homo sapiens
caaggtgccaccaccctgccc

SEQ ID NO: 3559502 - DNA, 13 bp, Homo sapiens
caaggtgctaaca

SEQ ID NO: 3559503 - DNA, 17 bp, Homo sapiens
caaggtggtgtgatctt

SEQ ID NO: 3559504 - DNA, 17 bp, Homo sapiens
caaggtttaggctggtg

SEQ ID NO: 3559505 - DNA, 21 bp, Homo sapiens
caaggtttaggctggtggccc

SEQ ID NO: 3559506 - DNA, 16 bp, Homo sapiens
caagtaaaacaaatga

SEQ ID NO: 3559507 - DNA, 18 bp, Homo sapiens
caagtaaaacaaatgaaa

SEQ ID NO: 3559508 - DNA, 12 bp, Homo sapiens
caagtaaaagaa

SEQ ID NO: 3559509 - DNA, 13 bp, Homo sapiens
caagtaatattat

SEQ ID NO: 3559510 - DNA, 12 bp, Homo sapiens
caagtacccatt

SEQ ID NO: 3559511 - DNA, 21 bp, Homo sapiens
caagtatgaataaagacacct

SEQ ID NO: 3559512 - DNA, 21 bp, Homo sapiens
cagaactattctgggggcccg

SEQ ID NO: 3559513 - DNA, 20 bp, Homo sapiens
cagaactcaaatggggccag

SEQ ID NO: 3559514 - DNA, 22 bp, Homo sapiens
cagaactcaaatggggccagat

SEQ ID NO: 3559515 - DNA, 22 bp, Homo sapiens
cagaactcggtgtccccaccat

SEQ ID NO: 3559516 - DNA, 14 bp, Homo sapiens
cagaactcttcctc

SEQ ID NO: 3559517 - DNA, 12 bp, Homo sapiens
cagaactgccct

SEQ ID NO: 3559518 - DNA, 19 bp, Homo sapiens
cagaactgcccttgctgcc

SEQ ID NO: 3559519 - DNA, 15 bp, Homo sapiens
cagaactttttcctc

SEQ ID NO: 3559520 - DNA, 16 bp, Homo sapiens
cagaactttttcctct

SEQ ID NO: 3559521 - DNA, 20 bp, Homo sapiens
cagaagatagcttcacccca

SEQ ID NO: 3559522 - DNA, 19 bp, Homo sapiens
cagaagatgccagcttctc

SEQ ID NO: 3559523 - DNA, 14 bp, Homo sapiens
cagaaggaaagaag

SEQ ID NO: 3559524 - DNA, 23 bp, Homo sapiens
cagaaggaaagaagggggccctg

SEQ ID NO: 3559525 - DNA, 12 bp, Homo sapiens
cagaaggaagct

SEQ ID NO: 3559526 - DNA, 14 bp, Homo sapiens
cagaaggccccaga

SEQ ID NO: 3559527 - DNA, 20 bp, Homo sapiens
cagaaggccccagagagacc

SEQ ID NO: 3559528 - DNA, 23 bp, Homo sapiens
cagaaggttgctctagattgaga

SEQ ID NO: 3559529 - DNA, 15 bp, Homo sapiens
cagaagtcaataggc

SEQ ID NO: 3559530 - DNA, 20 bp, Homo sapiens
cagaagtcatcttgctacca

SEQ ID NO: 3559531 - DNA, 15 bp, Homo sapiens
cagaatcttttcaat

SEQ ID NO: 3559532 - DNA, 21 bp, Homo sapiens
cagaatgagacatccagcaga

SEQ ID NO: 3559533 - DNA, 19 bp, Homo sapiens
cagaatggcagtcctggag

SEQ ID NO: 3559534 - DNA, 21 bp, Homo sapiens
cagaatggcagtcctggaggc

SEQ ID NO: 3559535 - DNA, 19 bp, Homo sapiens
cagaatttaccatcatctc

SEQ ID NO: 3559536 - DNA, 22 bp, Homo sapiens
cagaatttaccatcatctctga

SEQ ID NO: 3559537 - DNA, 14 bp, Homo sapiens
cagacaagcagccc

SEQ ID NO: 3559538 - DNA, 15 bp, Homo sapiens
cagacaagcagccct

SEQ ID NO: 3559539 - DNA, 15 bp, Homo sapiens
cagacaattccattc

SEQ ID NO: 3559540 - DNA, 20 bp, Homo sapiens
cagacacagctcttccaggg

SEQ ID NO: 3559541 - DNA, 21 bp, Homo sapiens
cagacacagctcttccagggc

SEQ ID NO: 3559542 - DNA, 23 bp, Homo sapiens
cagacacagctcttccagggcag

SEQ ID NO: 3559543 - DNA, 19 bp, Homo sapiens
cagacactaacgaaatatc

SEQ ID NO: 3559544 - DNA, 15 bp, Homo sapiens
cagacagccctggca

SEQ ID NO: 3559545 - DNA, 16 bp, Homo sapiens
cagacagccctggcaa

SEQ ID NO: 3559546 - DNA, 22 bp, Homo sapiens
cagacagcttacaggagccagc

SEQ ID NO: 3559547 - DNA, 22 bp, Homo sapiens
cagacaggaatttagaaaaagt

SEQ ID NO: 3559548 - DNA, 15 bp, Homo sapiens
cagacaggccctccc

SEQ ID NO: 3559549 - DNA, 20 bp, Homo sapiens
cagacaggccctccctgtct

SEQ ID NO: 3559550 - DNA, 17 bp, Homo sapiens
cagacatggtggggtct

SEQ ID NO: 3559551 - DNA, 14 bp, Homo sapiens
cagacattggcacc

SEQ ID NO: 3559552 - DNA, 12 bp, Homo sapiens
cagacatttctt

SEQ ID NO: 3559553 - DNA, 17 bp, Homo sapiens
cagacatttctttggaa

SEQ ID NO: 3559554 - DNA, 18 bp, Homo sapiens
cagacatttctttggaaa

SEQ ID NO: 3559555 - DNA, 16 bp, Homo sapiens
cagaccacttgccacg

SEQ ID NO: 3559556 - DNA, 19 bp, Homo sapiens
cagaccacttgccacgctg

SEQ ID NO: 3559557 - DNA, 20 bp, Homo sapiens
cagacccagtcccacactgt

SEQ ID NO: 3559558 - DNA, 14 bp, Homo sapiens
cagacccctggctt

SEQ ID NO: 3559559 - DNA, 16 bp, Homo sapiens
cagacccctggctttt

SEQ ID NO: 3559560 - DNA, 21 bp, Homo sapiens
cagacccctggcttttcactg

SEQ ID NO: 3559561 - DNA, 20 bp, Homo sapiens
cagacccctgggagcttccg

SEQ ID NO: 3559562 - DNA, 23 bp, Homo sapiens
cagacctgatcctggaggcccag

SEQ ID NO: 3559563 - DNA, 12 bp, Homo sapiens
cagacctggagc

SEQ ID NO: 3559564 - DNA, 21 bp, Homo sapiens
cagacctggagcttcagccag

SEQ ID NO: 3559565 - DNA, 11 bp, Homo sapiens
cagacctggct

SEQ ID NO: 3559566 - DNA, 18 bp, Homo sapiens
cagaccttgggggaagac

SEQ ID NO: 3559567 - DNA, 17 bp, Homo sapiens
cagacggtctgtgtgct

SEQ ID NO: 3559568 - DNA, 19 bp, Homo sapiens
cagactaaaaatacaccgt

SEQ ID NO: 3559569 - DNA, 15 bp, Homo sapiens
cagactactattttc

SEQ ID NO: 3559570 - DNA, 19 bp, Homo sapiens
cagactactattttctttt

SEQ ID NO: 3559571 - DNA, 15 bp, Homo sapiens
cagactagatgtagt

SEQ ID NO: 3559572 - DNA, 21 bp, Homo sapiens
cagactcactgggaagctccc

SEQ ID NO: 3559573 - DNA, 14 bp, Homo sapiens
cagactcagcagag

SEQ ID NO: 3559574 - DNA, 16 bp, Homo sapiens
cagactccatctcttc

SEQ ID NO: 3559575 - DNA, 17 bp, Homo sapiens
cagactccatctcttct

SEQ ID NO: 3559576 - DNA, 20 bp, Homo sapiens
cagactcccattcctgaaga

SEQ ID NO: 3559577 - DNA, 19 bp, Homo sapiens
cagactcggaatctatttt

SEQ ID NO: 3559578 - DNA, 23 bp, Homo sapiens
cagactcggaatctattttctca

SEQ ID NO: 3559579 - DNA, 18 bp, Homo sapiens
cagactctttaataaatt

SEQ ID NO: 3559580 - DNA, 23 bp, Homo sapiens
cagactctttaataaattgctta

SEQ ID NO: 3559581 - DNA, 21 bp, Homo sapiens
cagactgacccccatctgagc

SEQ ID NO: 3559582 - DNA, 14 bp, Homo sapiens
cagactgcttccaa

SEQ ID NO: 3559583 - DNA, 19 bp, Homo sapiens
cagactgggcactggggcc

SEQ ID NO: 3559584 - DNA, 17 bp, Homo sapiens
cagactgtgaacttgac

SEQ ID NO: 3559585 - DNA, 11 bp, Homo sapiens
cagactgtggt

SEQ ID NO: 3559586 - DNA, 16 bp, Homo sapiens
cagactttggacagtg

SEQ ID NO: 3559587 - DNA, 19 bp, Homo sapiens
cagactttggacagtggcc

SEQ ID NO: 3559588 - DNA, 22 bp, Homo sapiens
cagactttggacagtggcctct

SEQ ID NO: 3559589 - DNA, 20 bp, Homo sapiens
cagactttgtgttcatttca

SEQ ID NO: 3559590 - DNA, 21 bp, Homo sapiens
cagactttgtgttcatttcat

SEQ ID NO: 3559591 - DNA, 22 bp, Homo sapiens
cagactttgtgttcatttcatt

SEQ ID NO: 3559592 - DNA, 15 bp, Homo sapiens
cagagaaagcaaagg

SEQ ID NO: 3559593 - DNA, 19 bp, Homo sapiens
cagagaaagcaaaggtgca

SEQ ID NO: 3559594 - DNA, 19 bp, Homo sapiens
cagagaaaggggagcccac

SEQ ID NO: 3559595 - DNA, 16 bp, Homo sapiens
cagagaaatgccccag

SEQ ID NO: 3559596 - DNA, 13 bp, Homo sapiens
cagagaagaaaac

SEQ ID NO: 3559597 - DNA, 21 bp, Homo sapiens
cagagaagctataaattcctc

SEQ ID NO: 3559598 - DNA, 18 bp, Homo sapiens
cagagaagtttgtagcca

SEQ ID NO: 3559599 - DNA, 21 bp, Homo sapiens
cagagaagtttgtagccaggt

SEQ ID NO: 3559600 - DNA, 15 bp, Homo sapiens
cagagaattatctca

SEQ ID NO: 3559601 - DNA, 16 bp, Homo sapiens
cagagaattatctcaa

SEQ ID NO: 3559602 - DNA, 15 bp, Homo sapiens
cagagaattctctta

SEQ ID NO: 3559603 - DNA, 21 bp, Homo sapiens
cagagacactgttgataaaaa

SEQ ID NO: 3559604 - DNA, 22 bp, Homo sapiens
cagagacactgttgataaaaac

SEQ ID NO: 3559605 - DNA, 19 bp, Homo sapiens
cagagaccataagagaaac

SEQ ID NO: 3559606 - DNA, 13 bp, Homo sapiens
cagagacctcatc

SEQ ID NO: 3559607 - DNA, 15 bp, Homo sapiens
cagagagaccctgca

SEQ ID NO: 3559608 - DNA, 13 bp, Homo sapiens
cagagaggagggg

SEQ ID NO: 3559609 - DNA, 16 bp, Homo sapiens
cagagaggctgtggtt

SEQ ID NO: 3559610 - DNA, 12 bp, Homo sapiens
cagagagggaaa

SEQ ID NO: 3559611 - DNA, 16 bp, Homo sapiens
cagagagggaaaaggc

SEQ ID NO: 3559612 - DNA, 20 bp, Homo sapiens
cagagagggaaaaggcaggt

SEQ ID NO: 3559613 - DNA, 23 bp, Homo sapiens
cagagagggaaaaggcaggtgct

SEQ ID NO: 3559614 - DNA, 20 bp, Homo sapiens
cagagagggaagatgacctg

SEQ ID NO: 3559615 - DNA, 23 bp, Homo sapiens
cagagagggaagatgacctgccc

SEQ ID NO: 3559616 - DNA, 21 bp, Homo sapiens
cagagaggtttcgatatttat

SEQ ID NO: 3559617 - DNA, 17 bp, Homo sapiens
cagagagtggagagagc

SEQ ID NO: 3559618 - DNA, 23 bp, Homo sapiens
cagagagtggagagagcagggct

SEQ ID NO: 3559619 - DNA, 13 bp, Homo sapiens
cagagagtggctc

SEQ ID NO: 3559620 - DNA, 15 bp, Homo sapiens
cagagagtggctcct

SEQ ID NO: 3559621 - DNA, 16 bp, Homo sapiens
cagagataaagacctt

SEQ ID NO: 3559622 - DNA, 23 bp, Homo sapiens
cagagatccaaaagaagccccca

SEQ ID NO: 3559623 - DNA, 17 bp, Homo sapiens
cagagatgagtgtctgg

SEQ ID NO: 3559624 - DNA, 17 bp, Homo sapiens
cagagatgcctgatttc

SEQ ID NO: 3559625 - DNA, 23 bp, Homo sapiens
cagagatgcctgatttcattcct

SEQ ID NO: 3559626 - DNA, 17 bp, Homo sapiens
cagagcaaccagaagga

SEQ ID NO: 3559627 - DNA, 22 bp, Homo sapiens
cagagccacccctaaagagata

SEQ ID NO: 3559628 - DNA, 17 bp, Homo sapiens
cagagccagcctggctc

SEQ ID NO: 3559629 - DNA, 18 bp, Homo sapiens
cagagccaggctgttgga

SEQ ID NO: 3559630 - DNA, 16 bp, Homo sapiens
cagagcccccagccct

SEQ ID NO: 3559631 - DNA, 13 bp, Homo sapiens
cagagcctcctgg

SEQ ID NO: 3559632 - DNA, 22 bp, Homo sapiens
cagagcctttttacctggccta

SEQ ID NO: 3559633 - DNA, 13 bp, Homo sapiens
cagagctccgatg

SEQ ID NO: 3559634 - DNA, 18 bp, Homo sapiens
cagagctgtgccagcagg

SEQ ID NO: 3559635 - DNA, 18 bp, Homo sapiens
cagagctgtttggataca

SEQ ID NO: 3559636 - DNA, 18 bp, Homo sapiens
cagaggaaatctgtaaca

SEQ ID NO: 3559637 - DNA, 15 bp, Homo sapiens
cagaggacacagaga

SEQ ID NO: 3559638 - DNA, 22 bp, Homo sapiens
cagaggacagtatttgtgggga

SEQ ID NO: 3559639 - DNA, 18 bp, Homo sapiens
cagaggaccaatgcttgc

SEQ ID NO: 3559640 - DNA, 20 bp, Homo sapiens
cagaggaggggccgctgcca

SEQ ID NO: 3559641 - DNA, 16 bp, Homo sapiens
cagaggcctgctgcca

SEQ ID NO: 3559642 - DNA, 20 bp, Homo sapiens
cagaggcgtactacccagct

SEQ ID NO: 3559643 - DNA, 13 bp, Homo sapiens
caggggaggagcc

SEQ ID NO: 3559644 - DNA, 22 bp, Homo sapiens
caggggcacctatgagatggcc

SEQ ID NO: 3559645 - DNA, 20 bp, Homo sapiens
caggggccaacctcaggctc

SEQ ID NO: 3559646 - DNA, 23 bp, Homo sapiens
caggggccaacctcaggctccta

SEQ ID NO: 3559647 - DNA, 12 bp, Homo sapiens
caggggcctgga

SEQ ID NO: 3559648 - DNA, 21 bp, Homo sapiens
caggggctctgtggcaaaaag

SEQ ID NO: 3559649 - DNA, 12 bp, Homo sapiens
cagggggccccg

SEQ ID NO: 3559650 - DNA, 15 bp, Homo sapiens
cagggggccctgccc

SEQ ID NO: 3559651 - DNA, 17 bp, Homo sapiens
cagggggccctgcccca

SEQ ID NO: 3559652 - DNA, 20 bp, Homo sapiens
cagggggccctgccccaccc

SEQ ID NO: 3559653 - DNA, 22 bp, Homo sapiens
caggggggctgtgccaacctgt

SEQ ID NO: 3559654 - DNA, 22 bp, Homo sapiens
cagggggtgaggggcaggtcta

SEQ ID NO: 3559655 - DNA, 19 bp, Homo sapiens
cagggtccacagctggaaa

SEQ ID NO: 3559656 - DNA, 20 bp, Homo sapiens
cagggtccaggagagcctgg

SEQ ID NO: 3559657 - DNA, 19 bp, Homo sapiens
cagggtccttttgacactg

SEQ ID NO: 3559658 - DNA, 22 bp, Homo sapiens
cagggtgacaaggcctgcttga

SEQ ID NO: 3559659 - DNA, 16 bp, Homo sapiens
cagggtgtggggccat

SEQ ID NO: 3559660 - DNA, 20 bp, Homo sapiens
cagggttggcaccttccccc

SEQ ID NO: 3559661 - DNA, 19 bp, Homo sapiens
cagggtttacatgaagcag

SEQ ID NO: 3559662 - DNA, 13 bp, Homo sapiens
caggtacaggaga

SEQ ID NO: 3559663 - DNA, 20 bp, Homo sapiens
caggtacaggagaggcagca

SEQ ID NO: 3559664 - DNA, 17 bp, Homo sapiens
caggtcacacgaggggc

SEQ ID NO: 3559665 - DNA, 20 bp, Homo sapiens
caggtcccagccccttttcc

SEQ ID NO: 3559666 - DNA, 15 bp, Homo sapiens
caggtcctcagagaa

SEQ ID NO: 3559667 - DNA, 21 bp, Homo sapiens
caggtcctgcagtctggctga

SEQ ID NO: 3559668 - DNA, 19 bp, Homo sapiens
caggtcggagtgcctggag

SEQ ID NO: 3559669 - DNA, 14 bp, Homo sapiens
caggtctgactcca

SEQ ID NO: 3559670 - DNA, 18 bp, Homo sapiens
caggtctgactccaaagc

SEQ ID NO: 3559671 - DNA, 15 bp, Homo sapiens
caggtctgtatgtca

SEQ ID NO: 3559672 - DNA, 21 bp, Homo sapiens
caggtctttcctaaggctgca

SEQ ID NO: 3559673 - DNA, 17 bp, Homo sapiens
caggtgcagaccttggg

SEQ ID NO: 3559674 - DNA, 21 bp, Homo sapiens
caggtgcagaccttgggggaa

SEQ ID NO: 3559675 - DNA, 14 bp, Homo sapiens
caggtgcagcccca

SEQ ID NO: 3559676 - DNA, 15 bp, Homo sapiens
caggtgcagccccag

SEQ ID NO: 3559677 - DNA, 19 bp, Homo sapiens
caggtgcagccccagggcc

SEQ ID NO: 3559678 - DNA, 19 bp, Homo sapiens
caggtgccagttatggcta

SEQ ID NO: 3559679 - DNA, 15 bp, Homo sapiens
caggtgctagaagcc

SEQ ID NO: 3559680 - DNA, 16 bp, Homo sapiens
caggtgctagaagcct

SEQ ID NO: 3559681 - DNA, 14 bp, Homo sapiens
caggtgctcatgct

SEQ ID NO: 3559682 - DNA, 17 bp, Homo sapiens
caggtgctcatgctgct

SEQ ID NO: 3559683 - DNA, 13 bp, Homo sapiens
caggtgcttttgg

SEQ ID NO: 3559684 - DNA, 16 bp, Homo sapiens
caggtgcttttggcag

SEQ ID NO: 3559685 - DNA, 19 bp, Homo sapiens
caggtgcttttggcagaga

SEQ ID NO: 3559686 - DNA, 20 bp, Homo sapiens
caggtgcttttggcagagac

SEQ ID NO: 3559687 - DNA, 16 bp, Homo sapiens
caggtggccactccag

SEQ ID NO: 3559688 - DNA, 15 bp, Homo sapiens
caggtggcctggagg

SEQ ID NO: 3559689 - DNA, 14 bp, Homo sapiens
caggtgggcctggg

SEQ ID NO: 3559690 - DNA, 15 bp, Homo sapiens
caggtgtcctgagca

SEQ ID NO: 3559691 - DNA, 12 bp, Homo sapiens
caggtgttcttc

SEQ ID NO: 3559692 - DNA, 20 bp, Homo sapiens
caggttcaaggctacaacaa

SEQ ID NO: 3559693 - DNA, 20 bp, Homo sapiens
caggttccccaagggccctg

SEQ ID NO: 3559694 - DNA, 15 bp, Homo sapiens
caggttccctcccag

SEQ ID NO: 3559695 - DNA, 16 bp, Homo sapiens
caggttccctcccaga

SEQ ID NO: 3559696 - DNA, 12 bp, Homo sapiens
caggtttttcaa

SEQ ID NO: 3559697 - DNA, 18 bp, Homo sapiens
caggtttttcaattaaac

SEQ ID NO: 3559698 - DNA, 14 bp, Homo sapiens
cagtaaaatttcag

SEQ ID NO: 3559699 - DNA, 22 bp, Homo sapiens
cagtaagttctgtggttccagt

SEQ ID NO: 3559700 - DNA, 14 bp, Homo sapiens
cagtactaaaatta

SEQ ID NO: 3559701 - DNA, 16 bp, Homo sapiens
cagtactttggaggcc

SEQ ID NO: 3559702 - DNA, 15 bp, Homo sapiens
cagtagctccaacac

SEQ ID NO: 3559703 - DNA, 23 bp, Homo sapiens
cagtagctccaacactttgagca

SEQ ID NO: 3559704 - DNA, 20 bp, Homo sapiens
cagtaggtcccggccagctc

SEQ ID NO: 3559705 - DNA, 21 bp, Homo sapiens
cagtaggtcccggccagctct

SEQ ID NO: 3559706 - DNA, 14 bp, Homo sapiens
cagtatataagctt

SEQ ID NO: 3559707 - DNA, 15 bp, Homo sapiens
cagtatctgctgttc

SEQ ID NO: 3559708 - DNA, 19 bp, Homo sapiens
cagtatctgctgttcttca

SEQ ID NO: 3559709 - DNA, 21 bp, Homo sapiens
cagtatctgctgttcttcagt

SEQ ID NO: 3559710 - DNA, 12 bp, Homo sapiens
cagtatgtggaa

SEQ ID NO: 3559711 - DNA, 14 bp, Homo sapiens
cagtattaacacta

SEQ ID NO: 3559712 - DNA, 20 bp, Homo sapiens
cagtattatagatataaata

SEQ ID NO: 3559713 - DNA, 22 bp, Homo sapiens
cagtattgaaaacttcaaagct

SEQ ID NO: 3559714 - DNA, 23 bp, Homo sapiens
cagtattgaaaacttcaaagctg

SEQ ID NO: 3559715 - DNA, 17 bp, Homo sapiens
cagtattgccccctctc

SEQ ID NO: 3559716 - DNA, 14 bp, Homo sapiens
cagtatttctacat

SEQ ID NO: 3559717 - DNA, 23 bp, Homo sapiens
cagtatttctacattacagccat

SEQ ID NO: 3559718 - DNA, 20 bp, Homo sapiens
cagtcaacagagaggggcag

SEQ ID NO: 3559719 - DNA, 21 bp, Homo sapiens
cagtcaatggaagaaatggct

SEQ ID NO: 3559720 - DNA, 19 bp, Homo sapiens
cagtcagacgccaggcacc

SEQ ID NO: 3559721 - DNA, 18 bp, Homo sapiens
cagtcagcagatgctgtt

SEQ ID NO: 3559722 - DNA, 19 bp, Homo sapiens
cagtcattatgttaatatt

SEQ ID NO: 3559723 - DNA, 14 bp, Homo sapiens
cagtccaataaatt

SEQ ID NO: 3559724 - DNA, 15 bp, Homo sapiens
cagtccacaggggcc

SEQ ID NO: 3559725 - DNA, 21 bp, Homo sapiens
cagtccacaggggccaccacc

SEQ ID NO: 3559726 - DNA, 23 bp, Homo sapiens
cagtccaggatgctaacatctaa

SEQ ID NO: 3559727 - DNA, 15 bp, Homo sapiens
cagtccatttcctaa

SEQ ID NO: 3559728 - DNA, 12 bp, Homo sapiens
cagtcccacact

SEQ ID NO: 3559729 - DNA, 13 bp, Homo sapiens
cagtcccacactg

SEQ ID NO: 3559730 - DNA, 23 bp, Homo sapiens
cagtcccacactgtgcagaccca

SEQ ID NO: 3559731 - DNA, 24 bp, Homo sapiens
cagtcccacactgtgcagacccag

SEQ ID NO: 3559732 - DNA, 19 bp, Homo sapiens
cagtcccacactgtggcca

SEQ ID NO: 3559733 - DNA, 22 bp, Homo sapiens
cagtcccacactgtggccaggc

SEQ ID NO: 3559734 - DNA, 21 bp, Homo sapiens
cagtcccagacaattccattc

SEQ ID NO: 3559735 - DNA, 20 bp, Homo sapiens
cagtccccccaccctcattc

SEQ ID NO: 3559736 - DNA, 15 bp, Homo sapiens
cagtccgcagttgta

SEQ ID NO: 3559737 - DNA, 23 bp, Homo sapiens
cagtcctccactcgacccagaat

SEQ ID NO: 3559738 - DNA, 13 bp, Homo sapiens
cagtcctggaggc

SEQ ID NO: 3559739 - DNA, 14 bp, Homo sapiens
cagtcctgttcaga

SEQ ID NO: 3559740 - DNA, 16 bp, Homo sapiens
cagtcctttcccacca

SEQ ID NO: 3559741 - DNA, 13 bp, Homo sapiens
cagtcctttgtct

SEQ ID NO: 3559742 - DNA, 18 bp, Homo sapiens
cagtcctttgtctttctt

SEQ ID NO: 3559743 - DNA, 14 bp, Homo sapiens
cagtcggccccatc

SEQ ID NO: 3559744 - DNA, 15 bp, Homo sapiens
cagtctcaggaaatc

SEQ ID NO: 3559745 - DNA, 18 bp, Homo sapiens
cagtctccttcagcacgg

SEQ ID NO: 3559746 - DNA, 12 bp, Homo sapiens
cagtctgaccct

SEQ ID NO: 3559747 - DNA, 18 bp, Homo sapiens
cagtctggctgagccctg

SEQ ID NO: 3559748 - DNA, 13 bp, Homo sapiens
cagtcttcccagc

SEQ ID NO: 3559749 - DNA, 16 bp, Homo sapiens
cagtcttggctcactg

SEQ ID NO: 3559750 - DNA, 19 bp, Homo sapiens
cagtctttatttttttccc

SEQ ID NO: 3559751 - DNA, 21 bp, Homo sapiens
cagtctttatttttttcccat

SEQ ID NO: 3559752 - DNA, 21 bp, Homo sapiens
cagtgaactatttttaaggtc

SEQ ID NO: 3559753 - DNA, 23 bp, Homo sapiens
cagtgaaggtggggagaagctga

SEQ ID NO: 3559754 - DNA, 20 bp, Homo sapiens
cagtgacatgattctgaact

SEQ ID NO: 3559755 - DNA, 11 bp, Homo sapiens
cagtgactcca

SEQ ID NO: 3559756 - DNA, 12 bp, Homo sapiens
cagtgactccag

SEQ ID NO: 3559757 - DNA, 14 bp, Homo sapiens
cagtgactccccag

SEQ ID NO: 3559758 - DNA, 16 bp, Homo sapiens
cagtgactccccagcc

SEQ ID NO: 3559759 - DNA, 18 bp, Homo sapiens
cagtgactccccagccca

SEQ ID NO: 3559760 - DNA, 21 bp, Homo sapiens
cagtgactccccagcccagca

SEQ ID NO: 3559761 - DNA, 18 bp, Homo sapiens
cagtgactccctgggagc

SEQ ID NO: 3559762 - DNA, 14 bp, Homo sapiens
cagtgactcctgct

SEQ ID NO: 3559763 - DNA, 15 bp, Homo sapiens
cagtgactcctgctg

SEQ ID NO: 3559764 - DNA, 16 bp, Homo sapiens
cagtgactcctgctgg

SEQ ID NO: 3559765 - DNA, 15 bp, Homo sapiens
cagtgagcagtgttg

SEQ ID NO: 3559766 - DNA, 14 bp, Homo sapiens
cagtgagcccctcc

SEQ ID NO: 3559767 - DNA, 18 bp, Homo sapiens
cagtgagcccctccccag

SEQ ID NO: 3559768 - DNA, 22 bp, Homo sapiens
cagtgagcccctccccagccag

SEQ ID NO: 3559769 - DNA, 12 bp, Homo sapiens
cagtgagcctga

SEQ ID NO: 3559770 - DNA, 23 bp, Homo sapiens
cagtgagggtaagtattttcctg

SEQ ID NO: 3559771 - DNA, 22 bp, Homo sapiens
cagtgattatttttccagctcc

SEQ ID NO: 3559772 - DNA, 12 bp, Homo sapiens
cagtgcatctca

SEQ ID NO: 3559773 - DNA, 17 bp, Homo sapiens
cagtgcatctcagccca

SEQ ID NO: 3559774 - DNA, 17 bp, Homo sapiens
cagtgcccatgtgtaca

SEQ ID NO: 3559775 - DNA, 22 bp, Homo sapiens
cattctgttttcccccagcaac

SEQ ID NO: 3559776 - DNA, 13 bp, Homo sapiens
cattctttactgc

SEQ ID NO: 3559777 - DNA, 19 bp, Homo sapiens
cattctttactgcactcag

SEQ ID NO: 3559778 - DNA, 19 bp, Homo sapiens
cattctttataaaccataa

SEQ ID NO: 3559779 - DNA, 21 bp, Homo sapiens
cattctttataaaccataaaa

SEQ ID NO: 3559780 - DNA, 17 bp, Homo sapiens
cattgaaataataatat

SEQ ID NO: 3559781 - DNA, 12 bp, Homo sapiens
cattgacagcaa

SEQ ID NO: 3559782 - DNA, 14 bp, Homo sapiens
cattgacagcaatt

SEQ ID NO: 3559783 - DNA, 15 bp, Homo sapiens
cattgaggaaatatt

SEQ ID NO: 3559784 - DNA, 17 bp, Homo sapiens
cattgatcataaactga

SEQ ID NO: 3559785 - DNA, 18 bp, Homo sapiens
cattgcactccagcctgg

SEQ ID NO: 3559786 - DNA, 20 bp, Homo sapiens
cattgcagcctaagaagaag

SEQ ID NO: 3559787 - DNA, 17 bp, Homo sapiens
cattgcctgtaacaatg

SEQ ID NO: 3559788 - DNA, 20 bp, Homo sapiens
cattgcctgtaacaatgtaa

SEQ ID NO: 3559789 - DNA, 17 bp, Homo sapiens
cattgcttacacggatg

SEQ ID NO: 3559790 - DNA, 13 bp, Homo sapiens
cattggaagccat

SEQ ID NO: 3559791 - DNA, 13 bp, Homo sapiens
cattggtcttctt

SEQ ID NO: 3559792 - DNA, 22 bp, Homo sapiens
cattggtgaagtaaattaggca

SEQ ID NO: 3559793 - DNA, 15 bp, Homo sapiens
cattgtaaaagcatt

SEQ ID NO: 3559794 - DNA, 21 bp, Homo sapiens
cattgtaaaagcattttgtaa

SEQ ID NO: 3559795 - DNA, 19 bp, Homo sapiens
cattgtagagcttctggca

SEQ ID NO: 3559796 - DNA, 18 bp, Homo sapiens
cattgtcaccgcaggtgc

SEQ ID NO: 3559797 - DNA, 19 bp, Homo sapiens
cattgtccctctgccccat

SEQ ID NO: 3559798 - DNA, 19 bp, Homo sapiens
cattgtccctgaagagaag

SEQ ID NO: 3559799 - DNA, 12 bp, Homo sapiens
cattgtttaaaa

SEQ ID NO: 3559800 - DNA, 12 bp, Homo sapiens
catttaaaaaaa

SEQ ID NO: 3559801 - DNA, 13 bp, Homo sapiens
catttaaaagaca

SEQ ID NO: 3559802 - DNA, 16 bp, Homo sapiens
catttaaatggttctg

SEQ ID NO: 3559803 - DNA, 21 bp, Homo sapiens
catttaaatgtgtacaatgta

SEQ ID NO: 3559804 - DNA, 21 bp, Homo sapiens
catttaatggcagctagtgcc

SEQ ID NO: 3559805 - DNA, 17 bp, Homo sapiens
catttactatgcacaac

SEQ ID NO: 3559806 - DNA, 15 bp, Homo sapiens
catttagtgtgaata

SEQ ID NO: 3559807 - DNA, 17 bp, Homo sapiens
catttagtgtgaatatt

SEQ ID NO: 3559808 - DNA, 13 bp, Homo sapiens
catttatatattg

SEQ ID NO: 3559809 - DNA, 13 bp, Homo sapiens
catttatatgtac

SEQ ID NO: 3559810 - DNA, 18 bp, Homo sapiens
catttattaagcagtaca

SEQ ID NO: 3559811 - DNA, 20 bp, Homo sapiens
catttcaggactctctccag

SEQ ID NO: 3559812 - DNA, 21 bp, Homo sapiens
catttcaggactctctccagg

SEQ ID NO: 3559813 - DNA, 23 bp, Homo sapiens
catttcaggactctctccaggag

SEQ ID NO: 3559814 - DNA, 16 bp, Homo sapiens
catttcatacaacaga

SEQ ID NO: 3559815 - DNA, 15 bp, Homo sapiens
catttcatgaaaaag

SEQ ID NO: 3559816 - DNA, 20 bp, Homo sapiens
catttcatgaaaaagctgct

SEQ ID NO: 3559817 - DNA, 15 bp, Homo sapiens
catttccaaatgaac

SEQ ID NO: 3559818 - DNA, 16 bp, Homo sapiens
catttccaaatgaact

SEQ ID NO: 3559819 - DNA, 13 bp, Homo sapiens
catttccattcat

SEQ ID NO: 3559820 - DNA, 12 bp, Homo sapiens
catttcctaatg

SEQ ID NO: 3559821 - DNA, 22 bp, Homo sapiens
catttcctcacactaagagggc

SEQ ID NO: 3559822 - DNA, 21 bp, Homo sapiens
catttcggtggctagtcaagc

SEQ ID NO: 3559823 - DNA, 22 bp, Homo sapiens
catttctaaaatgttaaaacat

SEQ ID NO: 3559824 - DNA, 19 bp, Homo sapiens
catttctactatgatcaga

SEQ ID NO: 3559825 - DNA, 18 bp, Homo sapiens
catttctatattcctcca

SEQ ID NO: 3559826 - DNA, 22 bp, Homo sapiens
catttctatattcctccagctg

SEQ ID NO: 3559827 - DNA, 19 bp, Homo sapiens
catttctcataattttgca

SEQ ID NO: 3559828 - DNA, 12 bp, Homo sapiens
catttctcatgt

SEQ ID NO: 3559829 - DNA, 15 bp, Homo sapiens
catttctgattctga

SEQ ID NO: 3559830 - DNA, 20 bp, Homo sapiens
catttctggggggagaaaaa

SEQ ID NO: 3559831 - DNA, 21 bp, Homo sapiens
catttctggggggagaaaaaa

SEQ ID NO: 3559832 - DNA, 12 bp, Homo sapiens
catttcttccca

SEQ ID NO: 3559833 - DNA, 16 bp, Homo sapiens
catttctttcttccat

SEQ ID NO: 3559834 - DNA, 14 bp, Homo sapiens
catttctttggaaa

SEQ ID NO: 3559835 - DNA, 16 bp, Homo sapiens
catttgctttttcacc

SEQ ID NO: 3559836 - DNA, 21 bp, Homo sapiens
catttggtgagagtcaaagct

SEQ ID NO: 3559837 - DNA, 22 bp, Homo sapiens
catttggtgagagtcaaagctg

SEQ ID NO: 3559838 - DNA, 23 bp, Homo sapiens
catttgtaatctagttgtcaata

SEQ ID NO: 3559839 - DNA, 16 bp, Homo sapiens
catttgtataaagaaa

SEQ ID NO: 3559840 - DNA, 11 bp, Homo sapiens
catttgtattt

SEQ ID NO: 3559841 - DNA, 14 bp, Homo sapiens
catttgtgaaatga

SEQ ID NO: 3559842 - DNA, 22 bp, Homo sapiens
catttgtgggcaagcagatgac

SEQ ID NO: 3559843 - DNA, 16 bp, Homo sapiens
catttgttggaatgaa

SEQ ID NO: 3559844 - DNA, 21 bp, Homo sapiens
catttgtttctttctctgagg

SEQ ID NO: 3559845 - DNA, 21 bp, Homo sapiens
catttgtttgctgaaatttac

SEQ ID NO: 3559846 - DNA, 14 bp, Homo sapiens
cattttaaatgaaa

SEQ ID NO: 3559847 - DNA, 15 bp, Homo sapiens
cattttaaatgaaag

SEQ ID NO: 3559848 - DNA, 16 bp, Homo sapiens
cattttaacgctgcct

SEQ ID NO: 3559849 - DNA, 18 bp, Homo sapiens
cattttaagtaaaagtct

SEQ ID NO: 3559850 - DNA, 22 bp, Homo sapiens
cattttactttttcctggctca

SEQ ID NO: 3559851 - DNA, 13 bp, Homo sapiens
cattttatgtctt

SEQ ID NO: 3559852 - DNA, 18 bp, Homo sapiens
cattttatttacagctgt

SEQ ID NO: 3559853 - DNA, 21 bp, Homo sapiens
cattttatttacagctgtgct

SEQ ID NO: 3559854 - DNA, 22 bp, Homo sapiens
cattttatttacagctgtgctc

SEQ ID NO: 3559855 - DNA, 12 bp, Homo sapiens
cattttgcctct

SEQ ID NO: 3559856 - DNA, 13 bp, Homo sapiens
cattttgcctctg

SEQ ID NO: 3559857 - DNA, 22 bp, Homo sapiens
cattttggagagtttcctgaaa

SEQ ID NO: 3559858 - DNA, 13 bp, Homo sapiens
cattttgtaataa

SEQ ID NO: 3559859 - DNA, 20 bp, Homo sapiens
cattttgtcaggtgggagat

SEQ ID NO: 3559860 - DNA, 20 bp, Homo sapiens
catttttcccttgtcctttc

SEQ ID NO: 3559861 - DNA, 16 bp, Homo sapiens
catttttctcccaaga

SEQ ID NO: 3559862 - DNA, 20 bp, Homo sapiens
catttttctcccaagaaacc

SEQ ID NO: 3559863 - DNA, 20 bp, Homo sapiens
cattttttaaaaaagcaagg

SEQ ID NO: 3559864 - DNA, 14 bp, Homo sapiens
cattttttcttctg

SEQ ID NO: 3559865 - DNA, 18 bp, Homo sapiens
cattttttgggcagcaat

SEQ ID NO: 3559866 - DNA, 22 bp, Homo sapiens
cattttttgggcagcaatttaa

SEQ ID NO: 3559867 - DNA, 15 bp, Homo sapiens
cattttttttctttg

SEQ ID NO: 3559868 - DNA, 17 bp, Homo sapiens
cattttttttttaaatc

SEQ ID NO: 3559869 - DNA, 17 bp, Homo sapiens
ccaaaaagctctgaaaa

SEQ ID NO: 3559870 - DNA, 23 bp, Homo sapiens
ccaaaaagctctgaaaacaaggt

SEQ ID NO: 3559871 - DNA, 19 bp, Homo sapiens
ccaaaacaagccaaagagc

SEQ ID NO: 3559872 - DNA, 13 bp, Homo sapiens
ccaaaacatttct

SEQ ID NO: 3559873 - DNA, 14 bp, Homo sapiens
ccaaaacttctctt

SEQ ID NO: 3559874 - DNA, 22 bp, Homo sapiens
ccaaaacttctcttgaaaagtt

SEQ ID NO: 3559875 - DNA, 14 bp, Homo sapiens
ccaaaatcaagagt

SEQ ID NO: 3559876 - DNA, 16 bp, Homo sapiens
ccaaaatccaaaaagc

SEQ ID NO: 3559877 - DNA, 21 bp, Homo sapiens
ccaaaatcctgaactttctcc

SEQ ID NO: 3559878 - DNA, 12 bp, Homo sapiens
ccaaacccactc

SEQ ID NO: 3559879 - DNA, 14 bp, Homo sapiens
ccaaaccccagccc

SEQ ID NO: 3559880 - DNA, 15 bp, Homo sapiens
ccaaaccccctgcag

SEQ ID NO: 3559881 - DNA, 17 bp, Homo sapiens
ccaaaccccctgcagcc

SEQ ID NO: 3559882 - DNA, 15 bp, Homo sapiens
ccaaacccttaactg

SEQ ID NO: 3559883 - DNA, 19 bp, Homo sapiens
ccaaacccttaactgacat

SEQ ID NO: 3559884 - DNA, 20 bp, Homo sapiens
ccaaacctgggaaggccagc

SEQ ID NO: 3559885 - DNA, 14 bp, Homo sapiens
ccaaacctgtcttg

SEQ ID NO: 3559886 - DNA, 17 bp, Homo sapiens
ccaaagaaatgtaaggg

SEQ ID NO: 3559887 - DNA, 20 bp, Homo sapiens
ccaaaggaaaatgtctgtaa

SEQ ID NO: 3559888 - DNA, 17 bp, Homo sapiens
ccaaaggaacactgaca

SEQ ID NO: 3559889 - DNA, 16 bp, Homo sapiens
ccaaaggaactctaga

SEQ ID NO: 3559890 - DNA, 22 bp, Homo sapiens
ccaaatcaaaagactttttcct

SEQ ID NO: 3559891 - DNA, 18 bp, Homo sapiens
ccaaatgaaatatattta

SEQ ID NO: 3559892 - DNA, 20 bp, Homo sapiens
ccaaatgaccgagccctgga

SEQ ID NO: 3559893 - DNA, 19 bp, Homo sapiens
ccaaatggccattttaaaa

SEQ ID NO: 3559894 - DNA, 19 bp, Homo sapiens
ccaaattcaccttccccta

SEQ ID NO: 3559895 - DNA, 22 bp, Homo sapiens
ccaaattcaccttcccctaaac

SEQ ID NO: 3559896 - DNA, 23 bp, Homo sapiens
ccaaattgcactgaagtttttga

SEQ ID NO: 3559897 - DNA, 12 bp, Homo sapiens
ccaaatttcttt

SEQ ID NO: 3559898 - DNA, 17 bp, Homo sapiens
ccaaattttctttttat

SEQ ID NO: 3559899 - DNA, 19 bp, Homo sapiens
ccaacaagaaccactcctt

SEQ ID NO: 3559900 - DNA, 14 bp, Homo sapiens
ccaacacgagcagg

SEQ ID NO: 3559901 - DNA, 20 bp, Homo sapiens
ccaaccaagtggctcccaca

SEQ ID NO: 3559902 - DNA, 19 bp, Homo sapiens
ccaaccacagcatcgggag

SEQ ID NO: 3559903 - DNA, 21 bp, Homo sapiens
ccaaccacagcatcgggagca

SEQ ID NO: 3559904 - DNA, 14 bp, Homo sapiens
ccaacccctctcca

SEQ ID NO: 3559905 - DNA, 18 bp, Homo sapiens
ccaacccctctccaggcc

SEQ ID NO: 3559906 - DNA, 22 bp, Homo sapiens
ccaacccctctccaggcctgtc

SEQ ID NO: 3559907 - DNA, 20 bp, Homo sapiens
ccaggtttttcaattaaacg

SEQ ID NO: 3559908 - DNA, 23 bp, Homo sapiens
ccaggtttttcaattaaacggat

SEQ ID NO: 3559909 - DNA, 16 bp, Homo sapiens
ccagtaaaatttcagg

SEQ ID NO: 3559910 - DNA, 19 bp, Homo sapiens
ccagtaaaatttcaggatt

SEQ ID NO: 3559911 - DNA, 19 bp, Homo sapiens
ccagtattgaaaacttcaa

SEQ ID NO: 3559912 - DNA, 14 bp, Homo sapiens
ccagtattgccccc

SEQ ID NO: 3559913 - DNA, 16 bp, Homo sapiens
ccagtattgccccctc

SEQ ID NO: 3559914 - DNA, 22 bp, Homo sapiens
ccagtcattatgttaatatttc

SEQ ID NO: 3559915 - DNA, 19 bp, Homo sapiens
ccagtcccacactgtggcc

SEQ ID NO: 3559916 - DNA, 22 bp, Homo sapiens
ccagtcccacactgtggccagg

SEQ ID NO: 3559917 - DNA, 15 bp, Homo sapiens
ccagtccccccaccc

SEQ ID NO: 3559918 - DNA, 17 bp, Homo sapiens
ccagtcggccccatctc

SEQ ID NO: 3559919 - DNA, 15 bp, Homo sapiens
ccagtctcctcactc

SEQ ID NO: 3559920 - DNA, 13 bp, Homo sapiens
ccagtctcctccc

SEQ ID NO: 3559921 - DNA, 14 bp, Homo sapiens
ccagtgaaatgatt

SEQ ID NO: 3559922 - DNA, 13 bp, Homo sapiens
ccagtgagactgt

SEQ ID NO: 3559923 - DNA, 17 bp, Homo sapiens
ccagtgagatcaatgtg

SEQ ID NO: 3559924 - DNA, 15 bp, Homo sapiens
ccagtgagcagtgtt

SEQ ID NO: 3559925 - DNA, 16 bp, Homo sapiens
ccagtgagcagtgttg

SEQ ID NO: 3559926 - DNA, 13 bp, Homo sapiens
ccagtgcagccac

SEQ ID NO: 3559927 - DNA, 16 bp, Homo sapiens
ccagtgcccccactga

SEQ ID NO: 3559928 - DNA, 19 bp, Homo sapiens
ccagtgcggttcctcatct

SEQ ID NO: 3559929 - DNA, 17 bp, Homo sapiens
ccagtggccttccccag

SEQ ID NO: 3559930 - DNA, 19 bp, Homo sapiens
ccagtggccttccccagca

SEQ ID NO: 3559931 - DNA, 22 bp, Homo sapiens
ccagtgtctaggcactgagcag

SEQ ID NO: 3559932 - DNA, 15 bp, Homo sapiens
ccagtgtctgtctga

SEQ ID NO: 3559933 - DNA, 18 bp, Homo sapiens
ccagtgttcctgaagctg

SEQ ID NO: 3559934 - DNA, 19 bp, Homo sapiens
ccagtgttcctgaagctgc

SEQ ID NO: 3559935 - DNA, 20 bp, Homo sapiens
ccagtgttcctgaagctgct

SEQ ID NO: 3559936 - DNA, 18 bp, Homo sapiens
ccagttaatttttccaac

SEQ ID NO: 3559937 - DNA, 16 bp, Homo sapiens
ccagttacttgggctt

SEQ ID NO: 3559938 - DNA, 17 bp, Homo sapiens
ccagttacttgggcttc

SEQ ID NO: 3559939 - DNA, 16 bp, Homo sapiens
ccagttcacatttatt

SEQ ID NO: 3559940 - DNA, 13 bp, Homo sapiens
ccagttcaccctg

SEQ ID NO: 3559941 - DNA, 19 bp, Homo sapiens
ccagttcatcaccatttcc

SEQ ID NO: 3559942 - DNA, 15 bp, Homo sapiens
ccagttgtatttaat

SEQ ID NO: 3559943 - DNA, 21 bp, Homo sapiens
ccagttgttagattaagaaat

SEQ ID NO: 3559944 - DNA, 20 bp, Homo sapiens
ccagttttccctggaactcc

SEQ ID NO: 3559945 - DNA, 21 bp, Homo sapiens
ccagttttccgaagtctctga

SEQ ID NO: 3559946 - DNA, 22 bp, Homo sapiens
ccagttttccgaagtctctgat

SEQ ID NO: 3559947 - DNA, 14 bp, Homo sapiens
ccagttttgcctga

SEQ ID NO: 3559948 - DNA, 22 bp, Homo sapiens
ccataaacggttcctggtgact

SEQ ID NO: 3559949 - DNA, 19 bp, Homo sapiens
ccataaagacaatcactgc

SEQ ID NO: 3559950 - DNA, 12 bp, Homo sapiens
ccataacttgaa

SEQ ID NO: 3559951 - DNA, 13 bp, Homo sapiens
ccataagagaaac

SEQ ID NO: 3559952 - DNA, 21 bp, Homo sapiens
ccataatctggactcctctgt

SEQ ID NO: 3559953 - DNA, 19 bp, Homo sapiens
ccatacataaaagaaataa

SEQ ID NO: 3559954 - DNA, 16 bp, Homo sapiens
ccatacctgcccctgc

SEQ ID NO: 3559955 - DNA, 19 bp, Homo sapiens
ccatagtttgggtattttt

SEQ ID NO: 3559956 - DNA, 13 bp, Homo sapiens
ccatatagaaagc

SEQ ID NO: 3559957 - DNA, 12 bp, Homo sapiens
ccatatataaat

SEQ ID NO: 3559958 - DNA, 19 bp, Homo sapiens
ccatatataaattattact

SEQ ID NO: 3559959 - DNA, 16 bp, Homo sapiens
ccatatggaggactgt

SEQ ID NO: 3559960 - DNA, 16 bp, Homo sapiens
ccatattacctggatt

SEQ ID NO: 3559961 - DNA, 18 bp, Homo sapiens
ccatatttactaccttat

SEQ ID NO: 3559962 - DNA, 19 bp, Homo sapiens
ccatattttattgtatttt

SEQ ID NO: 3559963 - DNA, 20 bp, Homo sapiens
ccatattttattgtattttg

SEQ ID NO: 3559964 - DNA, 20 bp, Homo sapiens
ccatcatgtttacagaggac

SEQ ID NO: 3559965 - DNA, 12 bp, Homo sapiens
ccatcatttctg

SEQ ID NO: 3559966 - DNA, 18 bp, Homo sapiens
ccatccaaccactgtaca

SEQ ID NO: 3559967 - DNA, 13 bp, Homo sapiens
ccatccagccaga

SEQ ID NO: 3559968 - DNA, 12 bp, Homo sapiens
ccatcccctccc

SEQ ID NO: 3559969 - DNA, 14 bp, Homo sapiens
ccatcccctccctg

SEQ ID NO: 3559970 - DNA, 15 bp, Homo sapiens
ccatcccctccctgc

SEQ ID NO: 3559971 - DNA, 17 bp, Homo sapiens
ccatcccctccctgcct

SEQ ID NO: 3559972 - DNA, 18 bp, Homo sapiens
ccatcccctccctgcctg

SEQ ID NO: 3559973 - DNA, 18 bp, Homo sapiens
ccatccgactgcccctgc

SEQ ID NO: 3559974 - DNA, 21 bp, Homo sapiens
ccatccgactgcccctgctgt

SEQ ID NO: 3559975 - DNA, 22 bp, Homo sapiens
ccatccgactgcccctgctgtg

SEQ ID NO: 3559976 - DNA, 23 bp, Homo sapiens
ccatccgactgcccctgctgtgc

SEQ ID NO: 3559977 - DNA, 16 bp, Homo sapiens
ccatcctaggaaccag

SEQ ID NO: 3559978 - DNA, 16 bp, Homo sapiens
ccatcctccagcaggg

SEQ ID NO: 3559979 - DNA, 20 bp, Homo sapiens
ccatcctgcagatactttga

SEQ ID NO: 3559980 - DNA, 21 bp, Homo sapiens
ccatcctggggcagcactccc

SEQ ID NO: 3559981 - DNA, 20 bp, Homo sapiens
ccatccttccctgtctgcca

SEQ ID NO: 3559982 - DNA, 16 bp, Homo sapiens
ccatccttctgtgtac

SEQ ID NO: 3559983 - DNA, 15 bp, Homo sapiens
ccatctcaaaacaaa

SEQ ID NO: 3559984 - DNA, 16 bp, Homo sapiens
ccatctcaaaacaaaa

SEQ ID NO: 3559985 - DNA, 17 bp, Homo sapiens
ccatctcaaaacaaaac

SEQ ID NO: 3559986 - DNA, 17 bp, Homo sapiens
ccatctcaggagatgga

SEQ ID NO: 3559987 - DNA, 16 bp, Homo sapiens
ccatctctatcagaaa

SEQ ID NO: 3559988 - DNA, 23 bp, Homo sapiens
ccatctctgattttcaaagcttt

SEQ ID NO: 3559989 - DNA, 14 bp, Homo sapiens
ccatctcttctgca

SEQ ID NO: 3559990 - DNA, 21 bp, Homo sapiens
ccatctcttctgcaagcctca

SEQ ID NO: 3559991 - DNA, 21 bp, Homo sapiens
ccatctgactgccaagccaga

SEQ ID NO: 3559992 - DNA, 12 bp, Homo sapiens
ccatctgagctg

SEQ ID NO: 3559993 - DNA, 12 bp, Homo sapiens
ccatcttctttc

SEQ ID NO: 3559994 - DNA, 14 bp, Homo sapiens
ccatcttctttctt

SEQ ID NO: 3559995 - DNA, 22 bp, Homo sapiens
ccatcttctttcttccacccac

SEQ ID NO: 3559996 - DNA, 23 bp, Homo sapiens
ccatcttctttcttccacccaca

SEQ ID NO: 3559997 - DNA, 20 bp, Homo sapiens
ccatctttagcagtttcctc

SEQ ID NO: 3559998 - DNA, 23 bp, Homo sapiens
ccatctttagcagtttcctcagt

SEQ ID NO: 3559999 - DNA, 15 bp, Homo sapiens
ccatgagttgggggt

SEQ ID NO: 3560000 - DNA, 21 bp, Homo sapiens
ccatgatgacttagtacaaag

SEQ ID NO: 3560001 - DNA, 15 bp, Homo sapiens
ccatgatggcaacag

SEQ ID NO: 3560002 - DNA, 21 bp, Homo sapiens
ccatgcaccctcatacacaga

SEQ ID NO: 3560003 - DNA, 23 bp, Homo sapiens
ccatgcactcacccctagccctg

SEQ ID NO: 3560004 - DNA, 21 bp, Homo sapiens
ccatgcatcttccactggaac

SEQ ID NO: 3560005 - DNA, 17 bp, Homo sapiens
ccatgctcaacccccct

SEQ ID NO: 3560006 - DNA, 22 bp, Homo sapiens
ccatgctgctggggaagacagt

SEQ ID NO: 3560007 - DNA, 23 bp, Homo sapiens
ccatgctgctggggaagacagtg

SEQ ID NO: 3560008 - DNA, 14 bp, Homo sapiens
ccatgcttgcctga

SEQ ID NO: 3560009 - DNA, 17 bp, Homo sapiens
ccatgcttgcctgaagc

SEQ ID NO: 3560010 - DNA, 13 bp, Homo sapiens
ccatggaattccc

SEQ ID NO: 3560011 - DNA, 11 bp, Homo sapiens
ccatggagcct

SEQ ID NO: 3560012 - DNA, 12 bp, Homo sapiens
ccatggagccta

SEQ ID NO: 3560013 - DNA, 23 bp, Homo sapiens
ccatggcaattttgtaaattgac

SEQ ID NO: 3560014 - DNA, 13 bp, Homo sapiens
ccatggcagctcc

SEQ ID NO: 3560015 - DNA, 16 bp, Homo sapiens
ccatggcagctcctga

SEQ ID NO: 3560016 - DNA, 19 bp, Homo sapiens
ccatggcagctcctgacct

SEQ ID NO: 3560017 - DNA, 20 bp, Homo sapiens
ccatggcagctcctgacctt

SEQ ID NO: 3560018 - DNA, 16 bp, Homo sapiens
ccatggtactgtagca

SEQ ID NO: 3560019 - DNA, 17 bp, Homo sapiens
ccatggtgaaagggttt

SEQ ID NO: 3560020 - DNA, 18 bp, Homo sapiens
ccatgtaaataagatgat

SEQ ID NO: 3560021 - DNA, 18 bp, Homo sapiens
ccatgtgaaactctaccc

SEQ ID NO: 3560022 - DNA, 16 bp, Homo sapiens
ccatgtgcctttcttt

SEQ ID NO: 3560023 - DNA, 20 bp, Homo sapiens
ccatgtgcctttctttgcct

SEQ ID NO: 3560024 - DNA, 17 bp, Homo sapiens
ccatgtggggttgctga

SEQ ID NO: 3560025 - DNA, 22 bp, Homo sapiens
ccatgtgtacattctgcctaga

SEQ ID NO: 3560026 - DNA, 20 bp, Homo sapiens
ccatgtgtctttacacctcg

SEQ ID NO: 3560027 - DNA, 18 bp, Homo sapiens
ccatgttgtaatgctgca

SEQ ID NO: 3560028 - DNA, 17 bp, Homo sapiens
ccattatatttattgtt

SEQ ID NO: 3560029 - DNA, 14 bp, Homo sapiens
ccattccaaagctt

SEQ ID NO: 3560030 - DNA, 22 bp, Homo sapiens
ccattccaaagctttattacca

SEQ ID NO: 3560031 - DNA, 15 bp, Homo sapiens
ccattccctccattt

SEQ ID NO: 3560032 - DNA, 16 bp, Homo sapiens
ccattctattctccag

SEQ ID NO: 3560033 - DNA, 18 bp, Homo sapiens
ccattctattctccagac

SEQ ID NO: 3560034 - DNA, 19 bp, Homo sapiens
ccattctattctccagaca

SEQ ID NO: 3560035 - DNA, 18 bp, Homo sapiens
ccattgatcataaactga

SEQ ID NO: 3560036 - DNA, 15 bp, Homo sapiens
ccattgtccctctgc

SEQ ID NO: 3560037 - DNA, 19 bp, Homo sapiens
ccattgtccctctgcccca

SEQ ID NO: 3560038 - DNA, 13 bp, Homo sapiens
ccatttaaagctt

SEQ ID NO: 3560039 - DNA, 22 bp, Homo sapiens
ccggcgggtgacagctccggga

SEQ ID NO: 3560040 - DNA, 22 bp, Homo sapiens
ccggctatgggggcactgagga

SEQ ID NO: 3560041 - DNA, 23 bp, Homo sapiens
ccggctatgggggcactgaggac

SEQ ID NO: 3560042 - DNA, 19 bp, Homo sapiens
ccggctcgtgtatttatta

SEQ ID NO: 3560043 - DNA, 15 bp, Homo sapiens
ccggctctgggcctg

SEQ ID NO: 3560044 - DNA, 19 bp, Homo sapiens
ccggctgagtggcagcagc

SEQ ID NO: 3560045 - DNA, 22 bp, Homo sapiens
ccggctgagtggcagcagcccc

SEQ ID NO: 3560046 - DNA, 15 bp, Homo sapiens
ccgggagctgctgcc

SEQ ID NO: 3560047 - DNA, 17 bp, Homo sapiens
ccgggcaaactggccgc

SEQ ID NO: 3560048 - DNA, 16 bp, Homo sapiens
ccgggcaccaggggcc

SEQ ID NO: 3560049 - DNA, 11 bp, Homo sapiens
ccgggcagaaa

SEQ ID NO: 3560050 - DNA, 15 bp, Homo sapiens
ccgggcagggtgtgg

SEQ ID NO: 3560051 - DNA, 11 bp, Homo sapiens
ccgggccaggc

SEQ ID NO: 3560052 - DNA, 15 bp, Homo sapiens
ccgggcgcagccctc

SEQ ID NO: 3560053 - DNA, 16 bp, Homo sapiens
ccgggcgtgtgaagaa

SEQ ID NO: 3560054 - DNA, 13 bp, Homo sapiens
ccgggctggagaa

SEQ ID NO: 3560055 - DNA, 21 bp, Homo sapiens
ccggggccagcttggcaggga

SEQ ID NO: 3560056 - DNA, 22 bp, Homo sapiens
ccgggggcagctctggaggggg

SEQ ID NO: 3560057 - DNA, 23 bp, Homo sapiens
ccggggtgtaacttcctgctgca

SEQ ID NO: 3560058 - DNA, 15 bp, Homo sapiens
ccggtaactgtcctg

SEQ ID NO: 3560059 - DNA, 16 bp, Homo sapiens
ccggtaactgtcctgt

SEQ ID NO: 3560060 - DNA, 17 bp, Homo sapiens
ccggtcgggcagccagc

SEQ ID NO: 3560061 - DNA, 19 bp, Homo sapiens
ccggtcgggcagccagcag

SEQ ID NO: 3560062 - DNA, 16 bp, Homo sapiens
ccggtgctgcaggagt

SEQ ID NO: 3560063 - DNA, 14 bp, Homo sapiens
ccggtgggcagtgg

SEQ ID NO: 3560064 - DNA, 18 bp, Homo sapiens
ccggtgtatcctggccct

SEQ ID NO: 3560065 - DNA, 17 bp, Homo sapiens
ccgtagctctgctgctg

SEQ ID NO: 3560066 - DNA, 20 bp, Homo sapiens
ccgtagggtctttcttggga

SEQ ID NO: 3560067 - DNA, 20 bp, Homo sapiens
ccgtccatccgactgcccct

SEQ ID NO: 3560068 - DNA, 17 bp, Homo sapiens
ccgtcggactgccccca

SEQ ID NO: 3560069 - DNA, 18 bp, Homo sapiens
ccgtcggactgcccccag

SEQ ID NO: 3560070 - DNA, 13 bp, Homo sapiens
ccgtctctgccct

SEQ ID NO: 3560071 - DNA, 16 bp, Homo sapiens
ccgtctctgccctggg

SEQ ID NO: 3560072 - DNA, 17 bp, Homo sapiens
ccgtctctgccctgggc

SEQ ID NO: 3560073 - DNA, 20 bp, Homo sapiens
ccgtctctgccctgggctcc

SEQ ID NO: 3560074 - DNA, 17 bp, Homo sapiens
ccgtctggacctgggga

SEQ ID NO: 3560075 - DNA, 18 bp, Homo sapiens
ccgtctggacctggggag

SEQ ID NO: 3560076 - DNA, 18 bp, Homo sapiens
ccgtctggcccaccaggg

SEQ ID NO: 3560077 - DNA, 21 bp, Homo sapiens
ccgtgaactctggtgctcctg

SEQ ID NO: 3560078 - DNA, 14 bp, Homo sapiens
ccgtgatctcccct

SEQ ID NO: 3560079 - DNA, 21 bp, Homo sapiens
ccgtgcccacgagggtctccc

SEQ ID NO: 3560080 - DNA, 17 bp, Homo sapiens
ccgtgccccttccctgg

SEQ ID NO: 3560081 - DNA, 15 bp, Homo sapiens
ccgtgccttcagctc

SEQ ID NO: 3560082 - DNA, 17 bp, Homo sapiens
ccgtgccttcagctcta

SEQ ID NO: 3560083 - DNA, 17 bp, Homo sapiens
ccgtgctgacagctgct

SEQ ID NO: 3560084 - DNA, 20 bp, Homo sapiens
ccgtgctgacagctgctcct

SEQ ID NO: 3560085 - DNA, 16 bp, Homo sapiens
ccgtggatttgtactt

SEQ ID NO: 3560086 - DNA, 13 bp, Homo sapiens
ccgtggcacagct

SEQ ID NO: 3560087 - DNA, 18 bp, Homo sapiens
ccgtggccccgccctcag

SEQ ID NO: 3560088 - DNA, 11 bp, Homo sapiens
ccgtggcttcc

SEQ ID NO: 3560089 - DNA, 22 bp, Homo sapiens
ccgtggtggcggtggctgcccc

SEQ ID NO: 3560090 - DNA, 17 bp, Homo sapiens
ccgtgtcccctgacagg

SEQ ID NO: 3560091 - DNA, 19 bp, Homo sapiens
ccgtgtcccctgacagggc

SEQ ID NO: 3560092 - DNA, 14 bp, Homo sapiens
ccgtgtctcagcct

SEQ ID NO: 3560093 - DNA, 23 bp, Homo sapiens
ccgtgtttctctaaggaattatt

SEQ ID NO: 3560094 - DNA, 18 bp, Homo sapiens
ccgtttcgcgctggccgg

SEQ ID NO: 3560095 - DNA, 15 bp, Homo sapiens
ccgttttggggacgt

SEQ ID NO: 3560096 - DNA, 19 bp, Homo sapiens
ccgttttgtcactttttct

SEQ ID NO: 3560097 - DNA, 12 bp, Homo sapiens
cctaaaactggg

SEQ ID NO: 3560098 - DNA, 14 bp, Homo sapiens
cctaaactgcagcc

SEQ ID NO: 3560099 - DNA, 17 bp, Homo sapiens
cctaaagagcatcctga

SEQ ID NO: 3560100 - DNA, 19 bp, Homo sapiens
cctaaagccaggctcagga

SEQ ID NO: 3560101 - DNA, 21 bp, Homo sapiens
cctaaagccaggctcaggaga

SEQ ID NO: 3560102 - DNA, 13 bp, Homo sapiens
cctaaagggacta

SEQ ID NO: 3560103 - DNA, 23 bp, Homo sapiens
cctaaagggactacctctgtgcc

SEQ ID NO: 3560104 - DNA, 14 bp, Homo sapiens
cctaaagggcaggg

SEQ ID NO: 3560105 - DNA, 19 bp, Homo sapiens
cctaaatagcagaaagaag

SEQ ID NO: 3560106 - DNA, 13 bp, Homo sapiens
cctaaatttaatg

SEQ ID NO: 3560107 - DNA, 18 bp, Homo sapiens
cctaaatttaatgctgcc

SEQ ID NO: 3560108 - DNA, 12 bp, Homo sapiens
cctaagaagaag

SEQ ID NO: 3560109 - DNA, 14 bp, Homo sapiens
cctaagaagaaggc

SEQ ID NO: 3560110 - DNA, 16 bp, Homo sapiens
cctaagaagaaggcca

SEQ ID NO: 3560111 - DNA, 17 bp, Homo sapiens
cctaagaatctttagag

SEQ ID NO: 3560112 - DNA, 19 bp, Homo sapiens
cctaagagacacatacaga

SEQ ID NO: 3560113 - DNA, 18 bp, Homo sapiens
cctaagcccccagggcct

SEQ ID NO: 3560114 - DNA, 21 bp, Homo sapiens
cctaagtccttccacctgcca

SEQ ID NO: 3560115 - DNA, 18 bp, Homo sapiens
cctaagtggctgccttct

SEQ ID NO: 3560116 - DNA, 19 bp, Homo sapiens
cctaatccaggcagatcca

SEQ ID NO: 3560117 - DNA, 21 bp, Homo sapiens
cctaatccaggcagatccagg

SEQ ID NO: 3560118 - DNA, 12 bp, Homo sapiens
cctaatgtgttt

SEQ ID NO: 3560119 - DNA, 18 bp, Homo sapiens
cctaatttatcttcatgt

SEQ ID NO: 3560120 - DNA, 13 bp, Homo sapiens
cctacaataaact

SEQ ID NO: 3560121 - DNA, 15 bp, Homo sapiens
cctacagacagctta

SEQ ID NO: 3560122 - DNA, 14 bp, Homo sapiens
cctacagacatgga

SEQ ID NO: 3560123 - DNA, 16 bp, Homo sapiens
cctacagactccatct

SEQ ID NO: 3560124 - DNA, 18 bp, Homo sapiens
cctacagactccatctct

SEQ ID NO: 3560125 - DNA, 16 bp, Homo sapiens
cctacattccaccctg

SEQ ID NO: 3560126 - DNA, 21 bp, Homo sapiens
cctacattccaccctgttact

SEQ ID NO: 3560127 - DNA, 14 bp, Homo sapiens
cctaccccagccag

SEQ ID NO: 3560128 - DNA, 15 bp, Homo sapiens
cctaccccagccagg

SEQ ID NO: 3560129 - DNA, 20 bp, Homo sapiens
cctaccccagccaggctcct

SEQ ID NO: 3560130 - DNA, 15 bp, Homo sapiens
cctacctgtgcctga

SEQ ID NO: 3560131 - DNA, 19 bp, Homo sapiens
cctacgcaccattttgtca

SEQ ID NO: 3560132 - DNA, 20 bp, Homo sapiens
cctagaacctagataacgaa

SEQ ID NO: 3560133 - DNA, 14 bp, Homo sapiens
cctagactgctcct

SEQ ID NO: 3560134 - DNA, 16 bp, Homo sapiens
cctagagggaggggcc

SEQ ID NO: 3560135 - DNA, 17 bp, Homo sapiens
cctagagggaggggcct

SEQ ID NO: 3560136 - DNA, 18 bp, Homo sapiens
cctagagggaggggccta

SEQ ID NO: 3560137 - DNA, 22 bp, Homo sapiens
cctagcacacctgaatcagctg

SEQ ID NO: 3560138 - DNA, 12 bp, Homo sapiens
cctagccctggt

SEQ ID NO: 3560139 - DNA, 22 bp, Homo sapiens
cctagccctggttagctgacag

SEQ ID NO: 3560140 - DNA, 23 bp, Homo sapiens
cctagcctgtgcctctgggactg

SEQ ID NO: 3560141 - DNA, 16 bp, Homo sapiens
cctagcggagcccagc

SEQ ID NO: 3560142 - DNA, 19 bp, Homo sapiens
cctagctaggagcaggctt

SEQ ID NO: 3560143 - DNA, 17 bp, Homo sapiens
cctagctgtgttattcc

SEQ ID NO: 3560144 - DNA, 19 bp, Homo sapiens
cctaggtgcagctcctcag

SEQ ID NO: 3560145 - DNA, 21 bp, Homo sapiens
cctaggtgcagctcctcagcg

SEQ ID NO: 3560146 - DNA, 20 bp, Homo sapiens
cctagtggagttttataaat

SEQ ID NO: 3560147 - DNA, 23 bp, Homo sapiens
cctagtggagttttataaattaa

SEQ ID NO: 3560148 - DNA, 16 bp, Homo sapiens
cctagttttctcctcc

SEQ ID NO: 3560149 - DNA, 19 bp, Homo sapiens
cctagttttctcctcccag

SEQ ID NO: 3560150 - DNA, 15 bp, Homo sapiens
cctataaagggccca

SEQ ID NO: 3560151 - DNA, 19 bp, Homo sapiens
cctataaagtgcctcggac

SEQ ID NO: 3560152 - DNA, 16 bp, Homo sapiens
cctatagctacatgtt

SEQ ID NO: 3560153 - DNA, 13 bp, Homo sapiens
cctatcatttatt

SEQ ID NO: 3560154 - DNA, 16 bp, Homo sapiens
cctatctgacttcata

SEQ ID NO: 3560155 - DNA, 16 bp, Homo sapiens
cctatctgcctggagg

SEQ ID NO: 3560156 - DNA, 17 bp, Homo sapiens
cctatgaaactggttta

SEQ ID NO: 3560157 - DNA, 18 bp, Homo sapiens
cctatgagatggccatgc

SEQ ID NO: 3560158 - DNA, 15 bp, Homo sapiens
cctatgatggatggc

SEQ ID NO: 3560159 - DNA, 22 bp, Homo sapiens
cctatgatggatggcagactct

SEQ ID NO: 3560160 - DNA, 19 bp, Homo sapiens
cctatgtagacaatataag

SEQ ID NO: 3560161 - DNA, 11 bp, Homo sapiens
cctattctgaa

SEQ ID NO: 3560162 - DNA, 14 bp, Homo sapiens
cctatttgaccaga

SEQ ID NO: 3560163 - DNA, 20 bp, Homo sapiens
cctcaagccccatttcctca

SEQ ID NO: 3560164 - DNA, 15 bp, Homo sapiens
cctcaagtaaaagaa

SEQ ID NO: 3560165 - DNA, 20 bp, Homo sapiens
cctcaagtcactcccaagcc

SEQ ID NO: 3560166 - DNA, 12 bp, Homo sapiens
cctcacacccct

SEQ ID NO: 3560167 - DNA, 13 bp, Homo sapiens
cctcacacccctg

SEQ ID NO: 3560168 - DNA, 20 bp, Homo sapiens
cctcacacccctgtcccacc

SEQ ID NO: 3560169 - DNA, 17 bp, Homo sapiens
cctcacactgcaaggga

SEQ ID NO: 3560170 - DNA, 11 bp, Homo sapiens
cctcacagcta

SEQ ID NO: 3560171 - DNA, 14 bp, Homo sapiens
cctcaccacagcct

SEQ ID NO: 3560172 - DNA, 14 bp, Homo sapiens
cctgggaaggccag

SEQ ID NO: 3560173 - DNA, 14 bp, Homo sapiens
cctgggagccagtc

SEQ ID NO: 3560174 - DNA, 13 bp, Homo sapiens
cctgggaggcaga

SEQ ID NO: 3560175 - DNA, 20 bp, Homo sapiens
cctgggagggaggtggtcct

SEQ ID NO: 3560176 - DNA, 12 bp, Homo sapiens
cctgggcacaaa

SEQ ID NO: 3560177 - DNA, 17 bp, Homo sapiens
cctgggcacacgctgct

SEQ ID NO: 3560178 - DNA, 18 bp, Homo sapiens
cctgggcacacgctgctc

SEQ ID NO: 3560179 - DNA, 23 bp, Homo sapiens
cctgggcacacgctgctctgccc

SEQ ID NO: 3560180 - DNA, 22 bp, Homo sapiens
cctgggcagggatgatggcaga

SEQ ID NO: 3560181 - DNA, 22 bp, Homo sapiens
cctgggcatgggtccagggcct

SEQ ID NO: 3560182 - DNA, 22 bp, Homo sapiens
cctgggcattagcaaggcagag

SEQ ID NO: 3560183 - DNA, 23 bp, Homo sapiens
cctgggccggctgagtggcagca

SEQ ID NO: 3560184 - DNA, 12 bp, Homo sapiens
cctgggcctgca

SEQ ID NO: 3560185 - DNA, 19 bp, Homo sapiens
cctgggctattgctgctgc

SEQ ID NO: 3560186 - DNA, 17 bp, Homo sapiens
cctgggctcactgtgct

SEQ ID NO: 3560187 - DNA, 23 bp, Homo sapiens
cctgggctcagcctggtttctgg

SEQ ID NO: 3560188 - DNA, 15 bp, Homo sapiens
cctgggctctggaag

SEQ ID NO: 3560189 - DNA, 23 bp, Homo sapiens
cctgggctctggaagaggccttc

SEQ ID NO: 3560190 - DNA, 12 bp, Homo sapiens
cctgggctgggg

SEQ ID NO: 3560191 - DNA, 13 bp, Homo sapiens
cctgggctggggc

SEQ ID NO: 3560192 - DNA, 17 bp, Homo sapiens
cctgggctggttggaga

SEQ ID NO: 3560193 - DNA, 20 bp, Homo sapiens
cctgggctggttggagaagg

SEQ ID NO: 3560194 - DNA, 12 bp, Homo sapiens
cctggggaccca

SEQ ID NO: 3560195 - DNA, 13 bp, Homo sapiens
cctggggacccaa

SEQ ID NO: 3560196 - DNA, 17 bp, Homo sapiens
cctggggacccaaaccc

SEQ ID NO: 3560197 - DNA, 21 bp, Homo sapiens
cctggggacccaaaccccctg

SEQ ID NO: 3560198 - DNA, 16 bp, Homo sapiens
cctggggcagcactcc

SEQ ID NO: 3560199 - DNA, 17 bp, Homo sapiens
cctggggcagcactccc

SEQ ID NO: 3560200 - DNA, 19 bp, Homo sapiens
cctgggggattcctgagct

SEQ ID NO: 3560201 - DNA, 15 bp, Homo sapiens
cctgggggccgtgct

SEQ ID NO: 3560202 - DNA, 13 bp, Homo sapiens
cctgggggctctc

SEQ ID NO: 3560203 - DNA, 21 bp, Homo sapiens
cctgggggcttttgccactcc

SEQ ID NO: 3560204 - DNA, 15 bp, Homo sapiens
cctggggtgcatctc

SEQ ID NO: 3560205 - DNA, 21 bp, Homo sapiens
cctggggtggggatagggagc

SEQ ID NO: 3560206 - DNA, 17 bp, Homo sapiens
cctggggtgtcctacag

SEQ ID NO: 3560207 - DNA, 21 bp, Homo sapiens
cctgggtctggggacaggccc

SEQ ID NO: 3560208 - DNA, 14 bp, Homo sapiens
cctgggtgacattt

SEQ ID NO: 3560209 - DNA, 18 bp, Homo sapiens
cctgggtgatctgctgct

SEQ ID NO: 3560210 - DNA, 18 bp, Homo sapiens
cctgggtttgggagccag

SEQ ID NO: 3560211 - DNA, 22 bp, Homo sapiens
cctgggtttgggagccaggact

SEQ ID NO: 3560212 - DNA, 18 bp, Homo sapiens
cctggtaaggctggtgag

SEQ ID NO: 3560213 - DNA, 13 bp, Homo sapiens
cctggtccccact

SEQ ID NO: 3560214 - DNA, 18 bp, Homo sapiens
cctggtccccactgctga

SEQ ID NO: 3560215 - DNA, 23 bp, Homo sapiens
cctggtctgtggagatggactca

SEQ ID NO: 3560216 - DNA, 14 bp, Homo sapiens
cctggtgactcctg

SEQ ID NO: 3560217 - DNA, 23 bp, Homo sapiens
cctggtgcacgcaggcacagcag

SEQ ID NO: 3560218 - DNA, 20 bp, Homo sapiens
cctggtgccctggatgccca

SEQ ID NO: 3560219 - DNA, 21 bp, Homo sapiens
cctggtgccctggatgcccag

SEQ ID NO: 3560220 - DNA, 15 bp, Homo sapiens
cctggtgctgccaca

SEQ ID NO: 3560221 - DNA, 23 bp, Homo sapiens
cctggtgggccaacaaagaacac

SEQ ID NO: 3560222 - DNA, 21 bp, Homo sapiens
cctggttagctgacagtcagc

SEQ ID NO: 3560223 - DNA, 19 bp, Homo sapiens
cctggtttaattcagcaga

SEQ ID NO: 3560224 - DNA, 20 bp, Homo sapiens
cctgtaacaatgtaataaaa

SEQ ID NO: 3560225 - DNA, 17 bp, Homo sapiens
cctgtaccccagcactt

SEQ ID NO: 3560226 - DNA, 15 bp, Homo sapiens
cctgtactagctttt

SEQ ID NO: 3560227 - DNA, 16 bp, Homo sapiens
cctgtatgtctccagt

SEQ ID NO: 3560228 - DNA, 17 bp, Homo sapiens
cctgtcacccacagacc

SEQ ID NO: 3560229 - DNA, 15 bp, Homo sapiens
cctgtccagctccaa

SEQ ID NO: 3560230 - DNA, 12 bp, Homo sapiens
cctgtcccaccc

SEQ ID NO: 3560231 - DNA, 23 bp, Homo sapiens
cctgtcccttgcctctgccctgg

SEQ ID NO: 3560232 - DNA, 15 bp, Homo sapiens
cctgtcccttttccc

SEQ ID NO: 3560233 - DNA, 12 bp, Homo sapiens
cctgtcctgcag

SEQ ID NO: 3560234 - DNA, 15 bp, Homo sapiens
cctgtcctgggctgg

SEQ ID NO: 3560235 - DNA, 18 bp, Homo sapiens
cctgtcctgggctggtgg

SEQ ID NO: 3560236 - DNA, 18 bp, Homo sapiens
cctgtccttccctgttct

SEQ ID NO: 3560237 - DNA, 16 bp, Homo sapiens
cctgtctagagaggga

SEQ ID NO: 3560238 - DNA, 12 bp, Homo sapiens
cctgtctccagc

SEQ ID NO: 3560239 - DNA, 16 bp, Homo sapiens
cctgtctccagctgcc

SEQ ID NO: 3560240 - DNA, 21 bp, Homo sapiens
cctgtctccagggcccccacc

SEQ ID NO: 3560241 - DNA, 13 bp, Homo sapiens
cctgtctctgccc

SEQ ID NO: 3560242 - DNA, 15 bp, Homo sapiens
cctgtctgccagggc

SEQ ID NO: 3560243 - DNA, 12 bp, Homo sapiens
cctgtctgctgc

SEQ ID NO: 3560244 - DNA, 13 bp, Homo sapiens
cctgtctgctgcc

SEQ ID NO: 3560245 - DNA, 15 bp, Homo sapiens
cctgtctgctgccag

SEQ ID NO: 3560246 - DNA, 20 bp, Homo sapiens
cctgtctgctgccagcacag

SEQ ID NO: 3560247 - DNA, 13 bp, Homo sapiens
cctgtctggaaga

SEQ ID NO: 3560248 - DNA, 22 bp, Homo sapiens
cctgtctggaagacgtggctct

SEQ ID NO: 3560249 - DNA, 23 bp, Homo sapiens
cctgtctggaagacgtggctctg

SEQ ID NO: 3560250 - DNA, 18 bp, Homo sapiens
cctgtcttattaagactg

SEQ ID NO: 3560251 - DNA, 19 bp, Homo sapiens
cctgtcttcagagaaccca

SEQ ID NO: 3560252 - DNA, 14 bp, Homo sapiens
cctgtcttctttct

SEQ ID NO: 3560253 - DNA, 22 bp, Homo sapiens
cctgtcttctttctccatggag

SEQ ID NO: 3560254 - DNA, 17 bp, Homo sapiens
cctgtcttggggccact

SEQ ID NO: 3560255 - DNA, 21 bp, Homo sapiens
cctgtctttgatcgcctcttt

SEQ ID NO: 3560256 - DNA, 14 bp, Homo sapiens
cctgtgactcctgt

SEQ ID NO: 3560257 - DNA, 16 bp, Homo sapiens
cctgtgagcacaaaga

SEQ ID NO: 3560258 - DNA, 18 bp, Homo sapiens
cctgtgagcacaaagaag

SEQ ID NO: 3560259 - DNA, 20 bp, Homo sapiens
cctgtgagcacaaagaagaa

SEQ ID NO: 3560260 - DNA, 19 bp, Homo sapiens
cctgtgagcatggggccag

SEQ ID NO: 3560261 - DNA, 21 bp, Homo sapiens
cctgtgagcatggggccagga

SEQ ID NO: 3560262 - DNA, 18 bp, Homo sapiens
cctgtgcccgactgactg

SEQ ID NO: 3560263 - DNA, 21 bp, Homo sapiens
cctgtgcccgcatgtgtgcct

SEQ ID NO: 3560264 - DNA, 21 bp, Homo sapiens
cctgtgccctagatgcacgtg

SEQ ID NO: 3560265 - DNA, 15 bp, Homo sapiens
cctgtgcctcctcac

SEQ ID NO: 3560266 - DNA, 20 bp, Homo sapiens
cctgtgcctcctcaccccca

SEQ ID NO: 3560267 - DNA, 21 bp, Homo sapiens
cctgtgcctttcctatcacct

SEQ ID NO: 3560268 - DNA, 17 bp, Homo sapiens
cctgtgccttttgccat

SEQ ID NO: 3560269 - DNA, 16 bp, Homo sapiens
cctgtgcgtcccagct

SEQ ID NO: 3560270 - DNA, 19 bp, Homo sapiens
cctgtggaacataaaaagg

SEQ ID NO: 3560271 - DNA, 23 bp, Homo sapiens
cctgtggaacataaaaaggacat

SEQ ID NO: 3560272 - DNA, 14 bp, Homo sapiens
cctgtggccctggc

SEQ ID NO: 3560273 - DNA, 18 bp, Homo sapiens
cctgtgtattcaccacca

SEQ ID NO: 3560274 - DNA, 19 bp, Homo sapiens
cctgtgtgattgacagctt

SEQ ID NO: 3560275 - DNA, 23 bp, Homo sapiens
cctgtgtttttttctaaaaaggc

SEQ ID NO: 3560276 - DNA, 20 bp, Homo sapiens
cctgttaaaagatgaaaata

SEQ ID NO: 3560277 - DNA, 21 bp, Homo sapiens
cctgttcactctacttagcat

SEQ ID NO: 3560278 - DNA, 23 bp, Homo sapiens
cctgttcagaaaggggctcttct

SEQ ID NO: 3560279 - DNA, 12 bp, Homo sapiens
cctgttctccct

SEQ ID NO: 3560280 - DNA, 14 bp, Homo sapiens
cctgttctcccttt

SEQ ID NO: 3560281 - DNA, 19 bp, Homo sapiens
cctgttcttgggcctcagg

SEQ ID NO: 3560282 - DNA, 19 bp, Homo sapiens
cctgttgacacaggtcttt

SEQ ID NO: 3560283 - DNA, 18 bp, Homo sapiens
cctgtttcagaggctcag

SEQ ID NO: 3560284 - DNA, 20 bp, Homo sapiens
ccttaaaagtaataaagaga

SEQ ID NO: 3560285 - DNA, 15 bp, Homo sapiens
ccttaaacacaggct

SEQ ID NO: 3560286 - DNA, 17 bp, Homo sapiens
ccttaaacacaggctgt

SEQ ID NO: 3560287 - DNA, 22 bp, Homo sapiens
ccttaaacacaggctgtcctta

SEQ ID NO: 3560288 - DNA, 14 bp, Homo sapiens
ccttaacccacctc

SEQ ID NO: 3560289 - DNA, 17 bp, Homo sapiens
ccttaactatttcacat

SEQ ID NO: 3560290 - DNA, 12 bp, Homo sapiens
ccttaactgaca

SEQ ID NO: 3560291 - DNA, 16 bp, Homo sapiens
ccttaagcaaattttg

SEQ ID NO: 3560292 - DNA, 23 bp, Homo sapiens
ccttacaaagggaaagcctctgg

SEQ ID NO: 3560293 - DNA, 19 bp, Homo sapiens
ccttacaacgccgagtgca

SEQ ID NO: 3560294 - DNA, 22 bp, Homo sapiens
ccttacaacgccgagtgcactg

SEQ ID NO: 3560295 - DNA, 16 bp, Homo sapiens
ccttagaacctttctt

SEQ ID NO: 3560296 - DNA, 13 bp, Homo sapiens
ccttagagctctt

SEQ ID NO: 3560297 - DNA, 21 bp, Homo sapiens
ccttagagggaatctagccca

SEQ ID NO: 3560298 - DNA, 19 bp, Homo sapiens
ccttagctggcattacagc

SEQ ID NO: 3560299 - DNA, 20 bp, Homo sapiens
ccttatcacccccttgttgt

SEQ ID NO: 3560300 - DNA, 16 bp, Homo sapiens
ccttatccctctcttc

SEQ ID NO: 3560301 - DNA, 16 bp, Homo sapiens
ccttatctccaagacc

SEQ ID NO: 3560302 - DNA, 19 bp, Homo sapiens
ccttatctgaaaggccagc

SEQ ID NO: 3560303 - DNA, 22 bp, Homo sapiens
ccttatctgaaaggccagcagc

SEQ ID NO: 3560304 - DNA, 16 bp, Homo sapiens
cgtgtctcagcctctg

SEQ ID NO: 3560305 - DNA, 17 bp, Homo sapiens
cgtgttccagtgtctgt

SEQ ID NO: 3560306 - DNA, 14 bp, Homo sapiens
cgtgttggtatttt

SEQ ID NO: 3560307 - DNA, 12 bp, Homo sapiens
cgtgtttctcta

SEQ ID NO: 3560308 - DNA, 19 bp, Homo sapiens
cgttcccactgccctgggc

SEQ ID NO: 3560309 - DNA, 19 bp, Homo sapiens
cgttctcctgatgttttgc

SEQ ID NO: 3560310 - DNA, 14 bp, Homo sapiens
cgttgctatttcca

SEQ ID NO: 3560311 - DNA, 15 bp, Homo sapiens
cgttgtctggttgct

SEQ ID NO: 3560312 - DNA, 16 bp, Homo sapiens
cgtttacactgcacat

SEQ ID NO: 3560313 - DNA, 13 bp, Homo sapiens
cgtttcccctcct

SEQ ID NO: 3560314 - DNA, 13 bp, Homo sapiens
cgtttctcctttt

SEQ ID NO: 3560315 - DNA, 12 bp, Homo sapiens
cgtttggagaag

SEQ ID NO: 3560316 - DNA, 21 bp, Homo sapiens
ctaaaaatagacttaaatctc

SEQ ID NO: 3560317 - DNA, 16 bp, Homo sapiens
ctaaaacaataaagat

SEQ ID NO: 3560318 - DNA, 12 bp, Homo sapiens
ctaaaagcacac

SEQ ID NO: 3560319 - DNA, 17 bp, Homo sapiens
ctaaaataattttgtaa

SEQ ID NO: 3560320 - DNA, 14 bp, Homo sapiens
ctaaaatatttatt

SEQ ID NO: 3560321 - DNA, 16 bp, Homo sapiens
ctaaaatgttaaaaca

SEQ ID NO: 3560322 - DNA, 13 bp, Homo sapiens
ctaaaatgttcta

SEQ ID NO: 3560323 - DNA, 16 bp, Homo sapiens
ctaaacagacaggaat

SEQ ID NO: 3560324 - DNA, 20 bp, Homo sapiens
ctaaaccccaagcttcccaa

SEQ ID NO: 3560325 - DNA, 13 bp, Homo sapiens
ctaaactgcagcc

SEQ ID NO: 3560326 - DNA, 15 bp, Homo sapiens
ctaaactttttttct

SEQ ID NO: 3560327 - DNA, 18 bp, Homo sapiens
ctaaagaagaggagaaaa

SEQ ID NO: 3560328 - DNA, 17 bp, Homo sapiens
ctaaagagcatcctgat

SEQ ID NO: 3560329 - DNA, 23 bp, Homo sapiens
ctaaagccaagcactttatattt

SEQ ID NO: 3560330 - DNA, 13 bp, Homo sapiens
ctaaagccaggct

SEQ ID NO: 3560331 - DNA, 15 bp, Homo sapiens
ctaaagcttcagact

SEQ ID NO: 3560332 - DNA, 15 bp, Homo sapiens
ctaaaggctgttaaa

SEQ ID NO: 3560333 - DNA, 13 bp, Homo sapiens
ctaaagggaccat

SEQ ID NO: 3560334 - DNA, 21 bp, Homo sapiens
ctaaagggactacctctgtgc

SEQ ID NO: 3560335 - DNA, 16 bp, Homo sapiens
ctaaataacacagata

SEQ ID NO: 3560336 - DNA, 18 bp, Homo sapiens
ctaaataggatcctggag

SEQ ID NO: 3560337 - DNA, 16 bp, Homo sapiens
ctaaatatataaagta

SEQ ID NO: 3560338 - DNA, 13 bp, Homo sapiens
ctaaattacaaag

SEQ ID NO: 3560339 - DNA, 21 bp, Homo sapiens
ctaaattgcagtttacagtat

SEQ ID NO: 3560340 - DNA, 12 bp, Homo sapiens
ctaaattttcta

SEQ ID NO: 3560341 - DNA, 18 bp, Homo sapiens
ctaaattttctaaataac

SEQ ID NO: 3560342 - DNA, 15 bp, Homo sapiens
ctaaattttctgaaa

SEQ ID NO: 3560343 - DNA, 15 bp, Homo sapiens
ctaacacattaaatg

SEQ ID NO: 3560344 - DNA, 16 bp, Homo sapiens
ctaacacattaaatgt

SEQ ID NO: 3560345 - DNA, 17 bp, Homo sapiens
ctaacagatcagaacat

SEQ ID NO: 3560346 - DNA, 18 bp, Homo sapiens
ctaacagatcagaacatg

SEQ ID NO: 3560347 - DNA, 17 bp, Homo sapiens
ctaacatgccctgttca

SEQ ID NO: 3560348 - DNA, 12 bp, Homo sapiens
ctaaccaagttc

SEQ ID NO: 3560349 - DNA, 18 bp, Homo sapiens
ctaacctgggacctgtgg

SEQ ID NO: 3560350 - DNA, 16 bp, Homo sapiens
ctaactgggttaaata

SEQ ID NO: 3560351 - DNA, 22 bp, Homo sapiens
ctaactgggttaaatattttgc

SEQ ID NO: 3560352 - DNA, 17 bp, Homo sapiens
ctaacttcctgtgcctt

SEQ ID NO: 3560353 - DNA, 15 bp, Homo sapiens
ctaagaacctggaac

SEQ ID NO: 3560354 - DNA, 14 bp, Homo sapiens
ctaagaagaaggcc

SEQ ID NO: 3560355 - DNA, 17 bp, Homo sapiens
ctaagaagaaggccaga

SEQ ID NO: 3560356 - DNA, 18 bp, Homo sapiens
ctaagaagaaggccagag

SEQ ID NO: 3560357 - DNA, 19 bp, Homo sapiens
ctaagaagaaggccagaga

SEQ ID NO: 3560358 - DNA, 20 bp, Homo sapiens
ctaagaataaacatttgtta

SEQ ID NO: 3560359 - DNA, 13 bp, Homo sapiens
ctaagacagagga

SEQ ID NO: 3560360 - DNA, 22 bp, Homo sapiens
ctaagatgtgcagcatttcact

SEQ ID NO: 3560361 - DNA, 14 bp, Homo sapiens
ctaagcaaccacac

SEQ ID NO: 3560362 - DNA, 20 bp, Homo sapiens
ctaagcaaccacactgcttg

SEQ ID NO: 3560363 - DNA, 14 bp, Homo sapiens
ctaagcagaggagg

SEQ ID NO: 3560364 - DNA, 18 bp, Homo sapiens
ctaagcagaggaggggcc

SEQ ID NO: 3560365 - DNA, 20 bp, Homo sapiens
ctaagcagaggaggggccgc

SEQ ID NO: 3560366 - DNA, 23 bp, Homo sapiens
ctaagcagaggaggggccgctgc

SEQ ID NO: 3560367 - DNA, 22 bp, Homo sapiens
ctaagcccccagggcctccagg

SEQ ID NO: 3560368 - DNA, 22 bp, Homo sapiens
ctaagcgcacattcatgtgggc

SEQ ID NO: 3560369 - DNA, 22 bp, Homo sapiens
ctaagctaggaatgaaatcctg

SEQ ID NO: 3560370 - DNA, 19 bp, Homo sapiens
ctaagtaatttagaagata

SEQ ID NO: 3560371 - DNA, 11 bp, Homo sapiens
ctaagtattta

SEQ ID NO: 3560372 - DNA, 19 bp, Homo sapiens
ctaagtatttaaatgttct

SEQ ID NO: 3560373 - DNA, 18 bp, Homo sapiens
ctaagtccttccacctgc

SEQ ID NO: 3560374 - DNA, 16 bp, Homo sapiens
ctaagtcgcgagccag

SEQ ID NO: 3560375 - DNA, 17 bp, Homo sapiens
ctaagtgctgctgtgga

SEQ ID NO: 3560376 - DNA, 20 bp, Homo sapiens
ctaagtggctgccttctttc

SEQ ID NO: 3560377 - DNA, 15 bp, Homo sapiens
ctaatcaaaactttc

SEQ ID NO: 3560378 - DNA, 21 bp, Homo sapiens
ctaatcagcattctcactcct

SEQ ID NO: 3560379 - DNA, 14 bp, Homo sapiens
ctaatcagtgatta

SEQ ID NO: 3560380 - DNA, 22 bp, Homo sapiens
ctaatcagtgattatttttcca

SEQ ID NO: 3560381 - DNA, 20 bp, Homo sapiens
ctaatccaggcagatccagg

SEQ ID NO: 3560382 - DNA, 12 bp, Homo sapiens
ctaatccttttc

SEQ ID NO: 3560383 - DNA, 16 bp, Homo sapiens
ctaatccttttcctta

SEQ ID NO: 3560384 - DNA, 17 bp, Homo sapiens
ctaatccttttccttat

SEQ ID NO: 3560385 - DNA, 18 bp, Homo sapiens
ctaatctgtgctgtttca

SEQ ID NO: 3560386 - DNA, 20 bp, Homo sapiens
ctaatctgtgctgtttcaaa

SEQ ID NO: 3560387 - DNA, 14 bp, Homo sapiens
ctaatgtaaaatga

SEQ ID NO: 3560388 - DNA, 16 bp, Homo sapiens
ctaatgtactgcatat

SEQ ID NO: 3560389 - DNA, 15 bp, Homo sapiens
ctaatgtctgcagct

SEQ ID NO: 3560390 - DNA, 15 bp, Homo sapiens
ctaattaaaaactgt

SEQ ID NO: 3560391 - DNA, 16 bp, Homo sapiens
ctaattaaaaactgtg

SEQ ID NO: 3560392 - DNA, 15 bp, Homo sapiens
ctaattctgggaagg

SEQ ID NO: 3560393 - DNA, 19 bp, Homo sapiens
ctaattctgggaagggaga

SEQ ID NO: 3560394 - DNA, 15 bp, Homo sapiens
ctaattcttcctttg

SEQ ID NO: 3560395 - DNA, 18 bp, Homo sapiens
ctaattcttcctttgtaa

SEQ ID NO: 3560396 - DNA, 21 bp, Homo sapiens
ctaatttatcctgaaatttca

SEQ ID NO: 3560397 - DNA, 15 bp, Homo sapiens
ctaattttacactct

SEQ ID NO: 3560398 - DNA, 15 bp, Homo sapiens
ctacaaaaacacagc

SEQ ID NO: 3560399 - DNA, 16 bp, Homo sapiens
ctacaaaaacacagca

SEQ ID NO: 3560400 - DNA, 20 bp, Homo sapiens
ctacaaaaacacagcaaggg

SEQ ID NO: 3560401 - DNA, 20 bp, Homo sapiens
ctacaaccctaccctggcag

SEQ ID NO: 3560402 - DNA, 13 bp, Homo sapiens
ctacaataaactg

SEQ ID NO: 3560403 - DNA, 13 bp, Homo sapiens
ctacacattttta

SEQ ID NO: 3560404 - DNA, 23 bp, Homo sapiens
ctacagacagcttacaggagcca

SEQ ID NO: 3560405 - DNA, 15 bp, Homo sapiens
ctacagactccatct

SEQ ID NO: 3560406 - DNA, 18 bp, Homo sapiens
ctacagcgagctgcatta

SEQ ID NO: 3560407 - DNA, 14 bp, Homo sapiens
ctacagtatataag

SEQ ID NO: 3560408 - DNA, 13 bp, Homo sapiens
ctacatgaaacag

SEQ ID NO: 3560409 - DNA, 16 bp, Homo sapiens
ctacatgttctttgta

SEQ ID NO: 3560410 - DNA, 15 bp, Homo sapiens
ctacattccaccctg

SEQ ID NO: 3560411 - DNA, 18 bp, Homo sapiens
ctacatttctactatgat

SEQ ID NO: 3560412 - DNA, 14 bp, Homo sapiens
ctaccaaaagacat

SEQ ID NO: 3560413 - DNA, 22 bp, Homo sapiens
ctaccaaatgttaataaagccc

SEQ ID NO: 3560414 - DNA, 14 bp, Homo sapiens
ctaccaagctgtca

SEQ ID NO: 3560415 - DNA, 11 bp, Homo sapiens
ctaccagccag

SEQ ID NO: 3560416 - DNA, 18 bp, Homo sapiens
ctaccagccagcctcaga

SEQ ID NO: 3560417 - DNA, 13 bp, Homo sapiens
ctaccagtattta

SEQ ID NO: 3560418 - DNA, 22 bp, Homo sapiens
ctaccatgtgaaactctaccct

SEQ ID NO: 3560419 - DNA, 13 bp, Homo sapiens
ctacccaaccctg

SEQ ID NO: 3560420 - DNA, 14 bp, Homo sapiens
ctaccctggcaggg

SEQ ID NO: 3560421 - DNA, 22 bp, Homo sapiens
ctaccctggcagggacctgaga

SEQ ID NO: 3560422 - DNA, 17 bp, Homo sapiens
ctaccgagtctcttctc

SEQ ID NO: 3560423 - DNA, 21 bp, Homo sapiens
ctaccgagtctcttctccact

SEQ ID NO: 3560424 - DNA, 22 bp, Homo sapiens
ctaccgagtctcttctccactg

SEQ ID NO: 3560425 - DNA, 17 bp, Homo sapiens
ctaccgctggccctgcc

SEQ ID NO: 3560426 - DNA, 19 bp, Homo sapiens
ctacctcagcctcctgggt

SEQ ID NO: 3560427 - DNA, 15 bp, Homo sapiens
ctacctctgtctgag

SEQ ID NO: 3560428 - DNA, 16 bp, Homo sapiens
ctacctgccttggaga

SEQ ID NO: 3560429 - DNA, 19 bp, Homo sapiens
ctacctgctcagccctgca

SEQ ID NO: 3560430 - DNA, 14 bp, Homo sapiens
ctacctgtctgctg

SEQ ID NO: 3560431 - DNA, 16 bp, Homo sapiens
ctacctgtctgctgcc

SEQ ID NO: 3560432 - DNA, 21 bp, Homo sapiens
ctacctgtctgctgccagcac

SEQ ID NO: 3560433 - DNA, 21 bp, Homo sapiens
ctacctgtgtttttttctaaa

SEQ ID NO: 3560434 - DNA, 22 bp, Homo sapiens
ctacctgtgtttttttctaaaa

SEQ ID NO: 3560435 - DNA, 17 bp, Homo sapiens
ctactaatagaataaag

SEQ ID NO: 3560436 - DNA, 14 bp, Homo sapiens
ctactactgcagtc

SEQ ID NO: 3560437 - DNA, 15 bp, Homo sapiens
ctactactgcagtct

SEQ ID NO: 3560438 - DNA, 15 bp, Homo sapiens
ctccagctgcctggg

SEQ ID NO: 3560439 - DNA, 16 bp, Homo sapiens
ctccagctgcctgggc

SEQ ID NO: 3560440 - DNA, 17 bp, Homo sapiens
ctccagctgcctgggcc

SEQ ID NO: 3560441 - DNA, 16 bp, Homo sapiens
ctccaggagagagcca

SEQ ID NO: 3560442 - DNA, 12 bp, Homo sapiens
ctccaggcagga

SEQ ID NO: 3560443 - DNA, 17 bp, Homo sapiens
ctccaggcatgtgtctg

SEQ ID NO: 3560444 - DNA, 23 bp, Homo sapiens
ctccaggcatgtgtctggcccta

SEQ ID NO: 3560445 - DNA, 12 bp, Homo sapiens
ctccaggctgga

SEQ ID NO: 3560446 - DNA, 14 bp, Homo sapiens
ctccaggctggaag

SEQ ID NO: 3560447 - DNA, 21 bp, Homo sapiens
ctccaggggcctgcagaagga

SEQ ID NO: 3560448 - DNA, 13 bp, Homo sapiens
ctccagggtgaca

SEQ ID NO: 3560449 - DNA, 12 bp, Homo sapiens
ctccagggtgct

SEQ ID NO: 3560450 - DNA, 19 bp, Homo sapiens
ctccaggtcagcctggaag

SEQ ID NO: 3560451 - DNA, 22 bp, Homo sapiens
ctccaggtcggagtgcctggag

SEQ ID NO: 3560452 - DNA, 13 bp, Homo sapiens
ctccaggtttttc

SEQ ID NO: 3560453 - DNA, 16 bp, Homo sapiens
ctccaggtttttcaat

SEQ ID NO: 3560454 - DNA, 19 bp, Homo sapiens
ctccagtattgccccctct

SEQ ID NO: 3560455 - DNA, 13 bp, Homo sapiens
ctccagtgcagtc

SEQ ID NO: 3560456 - DNA, 17 bp, Homo sapiens
ctccatacacacgctgc

SEQ ID NO: 3560457 - DNA, 20 bp, Homo sapiens
ctccatacacacgctgcctt

SEQ ID NO: 3560458 - DNA, 20 bp, Homo sapiens
ctccataccttttctctttt

SEQ ID NO: 3560459 - DNA, 14 bp, Homo sapiens
ctccatactccact

SEQ ID NO: 3560460 - DNA, 19 bp, Homo sapiens
ctccatactccactccaag

SEQ ID NO: 3560461 - DNA, 15 bp, Homo sapiens
ctccatcccctccct

SEQ ID NO: 3560462 - DNA, 17 bp, Homo sapiens
ctccatcccctccctgc

SEQ ID NO: 3560463 - DNA, 19 bp, Homo sapiens
ctccatcccctccctgcct

SEQ ID NO: 3560464 - DNA, 15 bp, Homo sapiens
ctccatcctgcagat

SEQ ID NO: 3560465 - DNA, 12 bp, Homo sapiens
ctccatctcttc

SEQ ID NO: 3560466 - DNA, 13 bp, Homo sapiens
ctccatgatattt

SEQ ID NO: 3560467 - DNA, 11 bp, Homo sapiens
ctccatgcctg

SEQ ID NO: 3560468 - DNA, 23 bp, Homo sapiens
ctccatggagcctacctctgtct

SEQ ID NO: 3560469 - DNA, 13 bp, Homo sapiens
ctccattctattt

SEQ ID NO: 3560470 - DNA, 12 bp, Homo sapiens
ctccatttttct

SEQ ID NO: 3560471 - DNA, 16 bp, Homo sapiens
ctccatttttctccca

SEQ ID NO: 3560472 - DNA, 15 bp, Homo sapiens
ctcccaaaacatttt

SEQ ID NO: 3560473 - DNA, 12 bp, Homo sapiens
ctcccaaactga

SEQ ID NO: 3560474 - DNA, 14 bp, Homo sapiens
ctcccaaactgaca

SEQ ID NO: 3560475 - DNA, 15 bp, Homo sapiens
ctcccaaactgacaa

SEQ ID NO: 3560476 - DNA, 16 bp, Homo sapiens
ctcccaacttcttcct

SEQ ID NO: 3560477 - DNA, 20 bp, Homo sapiens
ctcccaaggcattctcccag

SEQ ID NO: 3560478 - DNA, 22 bp, Homo sapiens
ctcccacagcagccccaggaga

SEQ ID NO: 3560479 - DNA, 16 bp, Homo sapiens
ctcccacagcttcctg

SEQ ID NO: 3560480 - DNA, 19 bp, Homo sapiens
ctcccacagcttcctgagg

SEQ ID NO: 3560481 - DNA, 13 bp, Homo sapiens
ctcccacccaccg

SEQ ID NO: 3560482 - DNA, 17 bp, Homo sapiens
ctcccacccaccgccac

SEQ ID NO: 3560483 - DNA, 15 bp, Homo sapiens
ctcccaccccactca

SEQ ID NO: 3560484 - DNA, 15 bp, Homo sapiens
ctcccacctctcctt

SEQ ID NO: 3560485 - DNA, 14 bp, Homo sapiens
ctcccacctgacac

SEQ ID NO: 3560486 - DNA, 20 bp, Homo sapiens
ctcccacctgacacaccagg

SEQ ID NO: 3560487 - DNA, 21 bp, Homo sapiens
ctcccacctgacacaccaggc

SEQ ID NO: 3560488 - DNA, 13 bp, Homo sapiens
ctcccagaacctc

SEQ ID NO: 3560489 - DNA, 23 bp, Homo sapiens
ctcccagaacctctaagtgctgc

SEQ ID NO: 3560490 - DNA, 24 bp, Homo sapiens
ctcccagaacctctaagtgctgct

SEQ ID NO: 3560491 - DNA, 15 bp, Homo sapiens
ctcccagacaggccc

SEQ ID NO: 3560492 - DNA, 17 bp, Homo sapiens
ctcccagacaggccctc

SEQ ID NO: 3560493 - DNA, 22 bp, Homo sapiens
ctcccagacaggccctccctgt

SEQ ID NO: 3560494 - DNA, 21 bp, Homo sapiens
ctcccagaggagccaccagtt

SEQ ID NO: 3560495 - DNA, 19 bp, Homo sapiens
ctcccagcatcgcactctg

SEQ ID NO: 3560496 - DNA, 18 bp, Homo sapiens
ctcccaggaactgggcca

SEQ ID NO: 3560497 - DNA, 16 bp, Homo sapiens
ctcccaggagacagtt

SEQ ID NO: 3560498 - DNA, 19 bp, Homo sapiens
ctcccaggagacagttcaa

SEQ ID NO: 3560499 - DNA, 17 bp, Homo sapiens
ctcccaggatgacgtgc

SEQ ID NO: 3560500 - DNA, 20 bp, Homo sapiens
ctcccaggcgccccttcccc

SEQ ID NO: 3560501 - DNA, 13 bp, Homo sapiens
ctcccaggctctc

SEQ ID NO: 3560502 - DNA, 21 bp, Homo sapiens
ctcccaggttcccccagcaag

SEQ ID NO: 3560503 - DNA, 13 bp, Homo sapiens
ctcccatcctggg

SEQ ID NO: 3560504 - DNA, 14 bp, Homo sapiens
ctcccattcctgaa

SEQ ID NO: 3560505 - DNA, 16 bp, Homo sapiens
ctcccattcctgaaga

SEQ ID NO: 3560506 - DNA, 17 bp, Homo sapiens
ctcccattgtccctctg

SEQ ID NO: 3560507 - DNA, 20 bp, Homo sapiens
ctccccaacccctctccagg

SEQ ID NO: 3560508 - DNA, 14 bp, Homo sapiens
ctccccaaggctgc

SEQ ID NO: 3560509 - DNA, 17 bp, Homo sapiens
ctccccaattctcccct

SEQ ID NO: 3560510 - DNA, 15 bp, Homo sapiens
ctccccagagctgtg

SEQ ID NO: 3560511 - DNA, 16 bp, Homo sapiens
ctccccagagctgtgc

SEQ ID NO: 3560512 - DNA, 18 bp, Homo sapiens
ctccccagagctgtgcca

SEQ ID NO: 3560513 - DNA, 15 bp, Homo sapiens
ctccccagccagccc

SEQ ID NO: 3560514 - DNA, 16 bp, Homo sapiens
ctccccagccagccct

SEQ ID NO: 3560515 - DNA, 18 bp, Homo sapiens
ctccccagcccagagaca

SEQ ID NO: 3560516 - DNA, 12 bp, Homo sapiens
ctccccagctca

SEQ ID NO: 3560517 - DNA, 13 bp, Homo sapiens
ctccccagggagc

SEQ ID NO: 3560518 - DNA, 18 bp, Homo sapiens
ctccccagggagctctgg

SEQ ID NO: 3560519 - DNA, 19 bp, Homo sapiens
ctccccagggagctctggg

SEQ ID NO: 3560520 - DNA, 20 bp, Homo sapiens
ctccccagggagctctgggg

SEQ ID NO: 3560521 - DNA, 21 bp, Homo sapiens
ctccccatatataaattatta

SEQ ID NO: 3560522 - DNA, 14 bp, Homo sapiens
ctcccccagccact

SEQ ID NO: 3560523 - DNA, 13 bp, Homo sapiens
ctcccccccatgc

SEQ ID NO: 3560524 - DNA, 14 bp, Homo sapiens
ctccccctgcaact

SEQ ID NO: 3560525 - DNA, 23 bp, Homo sapiens
ctccccctgcaacttccgctgag

SEQ ID NO: 3560526 - DNA, 14 bp, Homo sapiens
ctccccgcccctgt

SEQ ID NO: 3560527 - DNA, 15 bp, Homo sapiens
ctccccgctcagggg

SEQ ID NO: 3560528 - DNA, 19 bp, Homo sapiens
ctcccctaaagccaggctc

SEQ ID NO: 3560529 - DNA, 21 bp, Homo sapiens
ctcccctaaagccaggctcag

SEQ ID NO: 3560530 - DNA, 17 bp, Homo sapiens
ctcccctatgctggtag

SEQ ID NO: 3560531 - DNA, 11 bp, Homo sapiens
ctcccctcaca

SEQ ID NO: 3560532 - DNA, 12 bp, Homo sapiens
ctcccctcctgc

SEQ ID NO: 3560533 - DNA, 20 bp, Homo sapiens
ctcccgaaaaatgtgtggtt

SEQ ID NO: 3560534 - DNA, 22 bp, Homo sapiens
ctcccgaaaaatgtgtggttct

SEQ ID NO: 3560535 - DNA, 15 bp, Homo sapiens
ctcccgcccttccat

SEQ ID NO: 3560536 - DNA, 21 bp, Homo sapiens
ctcccgcccttccatgtgcct

SEQ ID NO: 3560537 - DNA, 22 bp, Homo sapiens
ctcccgcccttccatgtgcctt

SEQ ID NO: 3560538 - DNA, 13 bp, Homo sapiens
ctcccgctcccag

SEQ ID NO: 3560539 - DNA, 16 bp, Homo sapiens
ctcccggagaggtggc

SEQ ID NO: 3560540 - DNA, 14 bp, Homo sapiens
ctcccgggggcccc

SEQ ID NO: 3560541 - DNA, 23 bp, Homo sapiens
ctccctcagtgccctcattttat

SEQ ID NO: 3560542 - DNA, 17 bp, Homo sapiens
ctccctcctccaggtcg

SEQ ID NO: 3560543 - DNA, 16 bp, Homo sapiens
ctccctctccagcagg

SEQ ID NO: 3560544 - DNA, 24 bp, Homo sapiens
ctccctgactgggggcagacatgg

SEQ ID NO: 3560545 - DNA, 13 bp, Homo sapiens
ctccctgcccctc

SEQ ID NO: 3560546 - DNA, 13 bp, Homo sapiens
ctccctgcctgct

SEQ ID NO: 3560547 - DNA, 15 bp, Homo sapiens
ctccctgcctgtttc

SEQ ID NO: 3560548 - DNA, 15 bp, Homo sapiens
ctccctgctgtgcca

SEQ ID NO: 3560549 - DNA, 16 bp, Homo sapiens
ctccctggctcactgg

SEQ ID NO: 3560550 - DNA, 17 bp, Homo sapiens
ctccctgtctccagctg

SEQ ID NO: 3560551 - DNA, 15 bp, Homo sapiens
ctccctgtctccagg

SEQ ID NO: 3560552 - DNA, 16 bp, Homo sapiens
ctccctgtctccaggg

SEQ ID NO: 3560553 - DNA, 22 bp, Homo sapiens
ctccctgtggcactcagggagc

SEQ ID NO: 3560554 - DNA, 17 bp, Homo sapiens
ctccctgttccccagag

SEQ ID NO: 3560555 - DNA, 17 bp, Homo sapiens
ctcccttaccctcctct

SEQ ID NO: 3560556 - DNA, 18 bp, Homo sapiens
ctcccttcaaccattccc

SEQ ID NO: 3560557 - DNA, 19 bp, Homo sapiens
ctcccttcaaccattcccc

SEQ ID NO: 3560558 - DNA, 22 bp, Homo sapiens
ctcccttcaaccattccccatg

SEQ ID NO: 3560559 - DNA, 22 bp, Homo sapiens
ctcccttcctatgctgttcact

SEQ ID NO: 3560560 - DNA, 16 bp, Homo sapiens
ctccctttctctctcc

SEQ ID NO: 3560561 - DNA, 18 bp, Homo sapiens
ctccctttctctctcctc

SEQ ID NO: 3560562 - DNA, 16 bp, Homo sapiens
ctccgaaatgctgtct

SEQ ID NO: 3560563 - DNA, 21 bp, Homo sapiens
ctccgactctgcacccgcctc

SEQ ID NO: 3560564 - DNA, 13 bp, Homo sapiens
ctccgagctctgg

SEQ ID NO: 3560565 - DNA, 20 bp, Homo sapiens
ctccgatgcccgcccgggga

SEQ ID NO: 3560566 - DNA, 20 bp, Homo sapiens
ctccgcagggcgcccagcgc

SEQ ID NO: 3560567 - DNA, 14 bp, Homo sapiens
ctccgccttccggg

SEQ ID NO: 3560568 - DNA, 17 bp, Homo sapiens
ctccggagcgccctgca

SEQ ID NO: 3560569 - DNA, 16 bp, Homo sapiens
ctccgtagctctgctg

SEQ ID NO: 3560570 - DNA, 19 bp, Homo sapiens
ctccgtagctctgctgctg

SEQ ID NO: 3560571 - DNA, 20 bp, Homo sapiens
ctctgttgcccaggctggag

SEQ ID NO: 3560572 - DNA, 12 bp, Homo sapiens
ctcttaagagaa

SEQ ID NO: 3560573 - DNA, 15 bp, Homo sapiens
ctcttaagcagcatg

SEQ ID NO: 3560574 - DNA, 17 bp, Homo sapiens
ctcttactaatgtaaaa

SEQ ID NO: 3560575 - DNA, 22 bp, Homo sapiens
ctcttagctcagctgagcatgg

SEQ ID NO: 3560576 - DNA, 16 bp, Homo sapiens
ctcttatgtgtgcctt

SEQ ID NO: 3560577 - DNA, 21 bp, Homo sapiens
ctcttcaaccccgaggtccct

SEQ ID NO: 3560578 - DNA, 23 bp, Homo sapiens
ctcttcaaccccgaggtccctgt

SEQ ID NO: 3560579 - DNA, 20 bp, Homo sapiens
ctcttcagtgactcctgctg

SEQ ID NO: 3560580 - DNA, 21 bp, Homo sapiens
ctcttcagtgactcctgctgg

SEQ ID NO: 3560581 - DNA, 22 bp, Homo sapiens
ctcttcagtgactcctgctggt

SEQ ID NO: 3560582 - DNA, 22 bp, Homo sapiens
ctcttcattccattgacttaga

SEQ ID NO: 3560583 - DNA, 18 bp, Homo sapiens
ctcttccagggcagcggc

SEQ ID NO: 3560584 - DNA, 22 bp, Homo sapiens
ctcttccagggcagcggctcca

SEQ ID NO: 3560585 - DNA, 17 bp, Homo sapiens
ctcttcccactccagct

SEQ ID NO: 3560586 - DNA, 15 bp, Homo sapiens
ctcttccccttccct

SEQ ID NO: 3560587 - DNA, 16 bp, Homo sapiens
ctcttccccttccctt

SEQ ID NO: 3560588 - DNA, 15 bp, Homo sapiens
ctcttccccttcctg

SEQ ID NO: 3560589 - DNA, 16 bp, Homo sapiens
ctcttccccttcctgt

SEQ ID NO: 3560590 - DNA, 23 bp, Homo sapiens
ctcttcccgccgcccagcccacc

SEQ ID NO: 3560591 - DNA, 16 bp, Homo sapiens
ctcttcgaagccttgc

SEQ ID NO: 3560592 - DNA, 16 bp, Homo sapiens
ctcttctaacatctta

SEQ ID NO: 3560593 - DNA, 13 bp, Homo sapiens
ctcttctcctttc

SEQ ID NO: 3560594 - DNA, 15 bp, Homo sapiens
ctcttctcctttcac

SEQ ID NO: 3560595 - DNA, 14 bp, Homo sapiens
ctcttctctccagc

SEQ ID NO: 3560596 - DNA, 15 bp, Homo sapiens
ctcttctctccagct

SEQ ID NO: 3560597 - DNA, 16 bp, Homo sapiens
ctcttctgaataaagc

SEQ ID NO: 3560598 - DNA, 19 bp, Homo sapiens
ctcttctgaataaagcaat

SEQ ID NO: 3560599 - DNA, 14 bp, Homo sapiens
ctcttctgcaagcc

SEQ ID NO: 3560600 - DNA, 19 bp, Homo sapiens
ctcttctgcaagcctcatg

SEQ ID NO: 3560601 - DNA, 20 bp, Homo sapiens
ctcttctggagatggaagct

SEQ ID NO: 3560602 - DNA, 22 bp, Homo sapiens
ctcttctggagatggaagcttg

SEQ ID NO: 3560603 - DNA, 12 bp, Homo sapiens
ctcttctggtgt

SEQ ID NO: 3560604 - DNA, 14 bp, Homo sapiens
ctcttcttctgaag

SEQ ID NO: 3560605 - DNA, 16 bp, Homo sapiens
ctcttctttgtgcctt

SEQ ID NO: 3560606 - DNA, 17 bp, Homo sapiens
ctcttctttgtgccttt

SEQ ID NO: 3560607 - DNA, 20 bp, Homo sapiens
ctcttctttgtgcctttggc

SEQ ID NO: 3560608 - DNA, 23 bp, Homo sapiens
ctcttctttgtgcctttggcctg

SEQ ID NO: 3560609 - DNA, 22 bp, Homo sapiens
ctcttgaataaagtattctagt

SEQ ID NO: 3560610 - DNA, 23 bp, Homo sapiens
ctcttgatctctcttgtcctctt

SEQ ID NO: 3560611 - DNA, 14 bp, Homo sapiens
ctcttgctttctat

SEQ ID NO: 3560612 - DNA, 13 bp, Homo sapiens
ctcttggctgacc

SEQ ID NO: 3560613 - DNA, 17 bp, Homo sapiens
ctcttggctgacccctc

SEQ ID NO: 3560614 - DNA, 18 bp, Homo sapiens
ctcttggctgacccctct

SEQ ID NO: 3560615 - DNA, 19 bp, Homo sapiens
ctcttggctgacccctctg

SEQ ID NO: 3560616 - DNA, 21 bp, Homo sapiens
ctcttggttcgatacctggag

SEQ ID NO: 3560617 - DNA, 21 bp, Homo sapiens
ctcttgtccctttccctacct

SEQ ID NO: 3560618 - DNA, 14 bp, Homo sapiens
ctcttgtcctcttc

SEQ ID NO: 3560619 - DNA, 20 bp, Homo sapiens
ctcttgtcctcttctgctct

SEQ ID NO: 3560620 - DNA, 14 bp, Homo sapiens
ctcttgtgttcaga

SEQ ID NO: 3560621 - DNA, 16 bp, Homo sapiens
ctcttgttcctgaaat

SEQ ID NO: 3560622 - DNA, 18 bp, Homo sapiens
ctctttagtgttctgttt

SEQ ID NO: 3560623 - DNA, 18 bp, Homo sapiens
ctctttatcaagcaacat

SEQ ID NO: 3560624 - DNA, 15 bp, Homo sapiens
ctctttccctgcgag

SEQ ID NO: 3560625 - DNA, 16 bp, Homo sapiens
ctctttcgtctactgc

SEQ ID NO: 3560626 - DNA, 16 bp, Homo sapiens
ctctttctaatgctga

SEQ ID NO: 3560627 - DNA, 22 bp, Homo sapiens
ctctttcttattttgtaataaa

SEQ ID NO: 3560628 - DNA, 14 bp, Homo sapiens
ctctttgacatttt

SEQ ID NO: 3560629 - DNA, 19 bp, Homo sapiens
ctctttgactgtcagcaag

SEQ ID NO: 3560630 - DNA, 16 bp, Homo sapiens
ctctttgctttgcttt

SEQ ID NO: 3560631 - DNA, 20 bp, Homo sapiens
ctctttgttctaaagatgga

SEQ ID NO: 3560632 - DNA, 16 bp, Homo sapiens
ctcttttcctggcagc

SEQ ID NO: 3560633 - DNA, 18 bp, Homo sapiens
ctctttttgatcttgtgc

SEQ ID NO: 3560634 - DNA, 20 bp, Homo sapiens
ctctttttgatcttgtgcta

SEQ ID NO: 3560635 - DNA, 19 bp, Homo sapiens
ctgaaaaatctaagtgata

SEQ ID NO: 3560636 - DNA, 17 bp, Homo sapiens
ctgaaaacctctcctca

SEQ ID NO: 3560637 - DNA, 17 bp, Homo sapiens
ctgaaaatattgtttta

SEQ ID NO: 3560638 - DNA, 21 bp, Homo sapiens
ctgaaaatcctcgcacacact

SEQ ID NO: 3560639 - DNA, 13 bp, Homo sapiens
ctgaaaatttaac

SEQ ID NO: 3560640 - DNA, 16 bp, Homo sapiens
ctgaaaatttaacagt

SEQ ID NO: 3560641 - DNA, 20 bp, Homo sapiens
ctgaaacaacttggaaagat

SEQ ID NO: 3560642 - DNA, 19 bp, Homo sapiens
ctgaaaggccagcagctga

SEQ ID NO: 3560643 - DNA, 13 bp, Homo sapiens
ctgaaatttcaga

SEQ ID NO: 3560644 - DNA, 13 bp, Homo sapiens
ctgaacaggttct

SEQ ID NO: 3560645 - DNA, 19 bp, Homo sapiens
ctgaaccacattcagggaa

SEQ ID NO: 3560646 - DNA, 16 bp, Homo sapiens
ctgaacccctccctcc

SEQ ID NO: 3560647 - DNA, 16 bp, Homo sapiens
ctgaactcgcagggaa

SEQ ID NO: 3560648 - DNA, 16 bp, Homo sapiens
ctgaacttcagagcat

SEQ ID NO: 3560649 - DNA, 16 bp, Homo sapiens
ctgaactttctccctc

SEQ ID NO: 3560650 - DNA, 17 bp, Homo sapiens
ctgaactttctccctca

SEQ ID NO: 3560651 - DNA, 19 bp, Homo sapiens
ctgaactttctccctcatc

SEQ ID NO: 3560652 - DNA, 20 bp, Homo sapiens
ctgaagagagggacaggcac

SEQ ID NO: 3560653 - DNA, 18 bp, Homo sapiens
ctgaagctgctgcagctc

SEQ ID NO: 3560654 - DNA, 17 bp, Homo sapiens
ctgaagctgctgtgtcc

SEQ ID NO: 3560655 - DNA, 18 bp, Homo sapiens
ctgaagcttcggccgcgc

SEQ ID NO: 3560656 - DNA, 17 bp, Homo sapiens
ctgaaggcagtggcagg

SEQ ID NO: 3560657 - DNA, 22 bp, Homo sapiens
ctgaaggcagtggcaggggagc

SEQ ID NO: 3560658 - DNA, 15 bp, Homo sapiens
ctgaaggggccatga

SEQ ID NO: 3560659 - DNA, 23 bp, Homo sapiens
ctgaaggggccatgatggcaaca

SEQ ID NO: 3560660 - DNA, 20 bp, Homo sapiens
ctgaaggggcgtctgttccc

SEQ ID NO: 3560661 - DNA, 20 bp, Homo sapiens
ctgaaggggttttcttgata

SEQ ID NO: 3560662 - DNA, 14 bp, Homo sapiens
ctgaagtcactgca

SEQ ID NO: 3560663 - DNA, 16 bp, Homo sapiens
ctgaagtcactgcaca

SEQ ID NO: 3560664 - DNA, 22 bp, Homo sapiens
ctgaagtctgagcccatttctg

SEQ ID NO: 3560665 - DNA, 21 bp, Homo sapiens
ctgaagtgtttcacgagagcc

SEQ ID NO: 3560666 - DNA, 15 bp, Homo sapiens
ctgaagttgaacatg

SEQ ID NO: 3560667 - DNA, 14 bp, Homo sapiens
ctgaagtttttgaa

SEQ ID NO: 3560668 - DNA, 19 bp, Homo sapiens
ctgaagtttttgaaatacc

SEQ ID NO: 3560669 - DNA, 21 bp, Homo sapiens
ctgaatattgccattatgctt

SEQ ID NO: 3560670 - DNA, 22 bp, Homo sapiens
ctgaatattttttatttctaag

SEQ ID NO: 3560671 - DNA, 13 bp, Homo sapiens
ctgaatcagctgg

SEQ ID NO: 3560672 - DNA, 18 bp, Homo sapiens
ctgaatctgtgcaaacag

SEQ ID NO: 3560673 - DNA, 15 bp, Homo sapiens
ctgaatgaaaataac

SEQ ID NO: 3560674 - DNA, 22 bp, Homo sapiens
ctgaatgaaaataactgaacca

SEQ ID NO: 3560675 - DNA, 22 bp, Homo sapiens
ctgaatgctgttaatatttcta

SEQ ID NO: 3560676 - DNA, 23 bp, Homo sapiens
ctgaatgtggtttcaatctaatt

SEQ ID NO: 3560677 - DNA, 20 bp, Homo sapiens
ctgaattcaccacagacttt

SEQ ID NO: 3560678 - DNA, 15 bp, Homo sapiens
ctgaattcacctgtg

SEQ ID NO: 3560679 - DNA, 23 bp, Homo sapiens
ctgaattcctttacaactaaata

SEQ ID NO: 3560680 - DNA, 22 bp, Homo sapiens
ctgacaattttacctattctga

SEQ ID NO: 3560681 - DNA, 19 bp, Homo sapiens
ctgacacaccaggcgctaa

SEQ ID NO: 3560682 - DNA, 13 bp, Homo sapiens
ctgacaccccctc

SEQ ID NO: 3560683 - DNA, 14 bp, Homo sapiens
ctgacacctttcat

SEQ ID NO: 3560684 - DNA, 17 bp, Homo sapiens
ctgacagctcttcacag

SEQ ID NO: 3560685 - DNA, 13 bp, Homo sapiens
ctgacagctgctc

SEQ ID NO: 3560686 - DNA, 15 bp, Homo sapiens
ctgacagctgctcct

SEQ ID NO: 3560687 - DNA, 12 bp, Homo sapiens
ctgacagggagc

SEQ ID NO: 3560688 - DNA, 16 bp, Homo sapiens
ctgacagggagcagcc

SEQ ID NO: 3560689 - DNA, 17 bp, Homo sapiens
ctgacagggagcagccc

SEQ ID NO: 3560690 - DNA, 12 bp, Homo sapiens
ctgacagggcca

SEQ ID NO: 3560691 - DNA, 17 bp, Homo sapiens
ctgacagggccagtgca

SEQ ID NO: 3560692 - DNA, 15 bp, Homo sapiens
ctgacagtcagctgt

SEQ ID NO: 3560693 - DNA, 22 bp, Homo sapiens
ctgacatattatgcctgaatga

SEQ ID NO: 3560694 - DNA, 13 bp, Homo sapiens
ctgacatcccttc

SEQ ID NO: 3560695 - DNA, 17 bp, Homo sapiens
ctgacatcccttcctgg

SEQ ID NO: 3560696 - DNA, 13 bp, Homo sapiens
ctgacatgctcac

SEQ ID NO: 3560697 - DNA, 17 bp, Homo sapiens
ctgacatgctcacacat

SEQ ID NO: 3560698 - DNA, 13 bp, Homo sapiens
ctgaccagaacta

SEQ ID NO: 3560699 - DNA, 16 bp, Homo sapiens
ctgaccagcagcgcct

SEQ ID NO: 3560700 - DNA, 20 bp, Homo sapiens
ctgaccagcagcgcctttcc

SEQ ID NO: 3560701 - DNA, 23 bp, Homo sapiens
ctgaccagcctccatgctgcctc

SEQ ID NO: 3560702 - DNA, 23 bp, Homo sapiens
ctgaccatgcgtcaggggcctag

SEQ ID NO: 3560703 - DNA, 12 bp, Homo sapiens
ctggacagacag

SEQ ID NO: 3560704 - DNA, 21 bp, Homo sapiens
ctggactagagggacctctcc

SEQ ID NO: 3560705 - DNA, 19 bp, Homo sapiens
ctggactattgtgccaact

SEQ ID NO: 3560706 - DNA, 18 bp, Homo sapiens
ctggactcctctgtccag

SEQ ID NO: 3560707 - DNA, 20 bp, Homo sapiens
ctggactcctctgtccaggc

SEQ ID NO: 3560708 - DNA, 13 bp, Homo sapiens
ctggactgcttgg

SEQ ID NO: 3560709 - DNA, 22 bp, Homo sapiens
ctggacttaagcatctggctct

SEQ ID NO: 3560710 - DNA, 18 bp, Homo sapiens
ctggagaaagagctgcct

SEQ ID NO: 3560711 - DNA, 20 bp, Homo sapiens
ctggagaaagagctgcctgg

SEQ ID NO: 3560712 - DNA, 23 bp, Homo sapiens
ctggagaaagatgcagtcctcag

SEQ ID NO: 3560713 - DNA, 14 bp, Homo sapiens
ctggagaactagag

SEQ ID NO: 3560714 - DNA, 15 bp, Homo sapiens
ctggagaactagaga

SEQ ID NO: 3560715 - DNA, 19 bp, Homo sapiens
ctggagaagaccctccccg

SEQ ID NO: 3560716 - DNA, 20 bp, Homo sapiens
ctggagaagtagtatttgcc

SEQ ID NO: 3560717 - DNA, 17 bp, Homo sapiens
ctggagacaaggtgcta

SEQ ID NO: 3560718 - DNA, 14 bp, Homo sapiens
ctggagagccccat

SEQ ID NO: 3560719 - DNA, 16 bp, Homo sapiens
ctggagatggaagctt

SEQ ID NO: 3560720 - DNA, 23 bp, Homo sapiens
ctggagatggaagcttgttgaaa

SEQ ID NO: 3560721 - DNA, 15 bp, Homo sapiens
ctggagcaggcccaa

SEQ ID NO: 3560722 - DNA, 21 bp, Homo sapiens
ctggagcaggcccaatgctgc

SEQ ID NO: 3560723 - DNA, 14 bp, Homo sapiens
ctggagcctggggt

SEQ ID NO: 3560724 - DNA, 13 bp, Homo sapiens
ctggagcttcagc

SEQ ID NO: 3560725 - DNA, 20 bp, Homo sapiens
ctggagcttcagccaggtct

SEQ ID NO: 3560726 - DNA, 22 bp, Homo sapiens
ctggagcttcagccaggtctga

SEQ ID NO: 3560727 - DNA, 20 bp, Homo sapiens
ctggaggaggcctgtcccaa

SEQ ID NO: 3560728 - DNA, 17 bp, Homo sapiens
ctggaggcaaaggcctg

SEQ ID NO: 3560729 - DNA, 15 bp, Homo sapiens
ctggaggctcctcta

SEQ ID NO: 3560730 - DNA, 22 bp, Homo sapiens
ctggaggctcctctaggccctg

SEQ ID NO: 3560731 - DNA, 11 bp, Homo sapiens
ctggaggctgc

SEQ ID NO: 3560732 - DNA, 18 bp, Homo sapiens
ctggaggtaaacaaagac

SEQ ID NO: 3560733 - DNA, 19 bp, Homo sapiens
ctggaggtaaacaaagact

SEQ ID NO: 3560734 - DNA, 24 bp, Homo sapiens
ctggaggtctccaggggcctgcag

SEQ ID NO: 3560735 - DNA, 15 bp, Homo sapiens
ctggaggtctggctg

SEQ ID NO: 3560736 - DNA, 14 bp, Homo sapiens
ctggagtcaggtgt

SEQ ID NO: 3560737 - DNA, 22 bp, Homo sapiens
ctggagtcaggtgtcgaggcca

SEQ ID NO: 3560738 - DNA, 15 bp, Homo sapiens
ctggagtgaggaaaa

SEQ ID NO: 3560739 - DNA, 23 bp, Homo sapiens
ctggagtggccactaagcagagg

SEQ ID NO: 3560740 - DNA, 21 bp, Homo sapiens
ctggagttccttatccctctc

SEQ ID NO: 3560741 - DNA, 24 bp, Homo sapiens
ctggagttccttatccctctcttc

SEQ ID NO: 3560742 - DNA, 14 bp, Homo sapiens
ctggatatttcaat

SEQ ID NO: 3560743 - DNA, 15 bp, Homo sapiens
ctggatatttcaatc

SEQ ID NO: 3560744 - DNA, 16 bp, Homo sapiens
ctggatatttcaatct

SEQ ID NO: 3560745 - DNA, 22 bp, Homo sapiens
ctggatatttcaatcttttaaa

SEQ ID NO: 3560746 - DNA, 21 bp, Homo sapiens
ctggatccatcttgagccaca

SEQ ID NO: 3560747 - DNA, 23 bp, Homo sapiens
ctggatctatccctgcggcctcc

SEQ ID NO: 3560748 - DNA, 15 bp, Homo sapiens
ctggatgagaaacag

SEQ ID NO: 3560749 - DNA, 14 bp, Homo sapiens
ctggatgcccagga

SEQ ID NO: 3560750 - DNA, 21 bp, Homo sapiens
ctggattataagttctatttt

SEQ ID NO: 3560751 - DNA, 20 bp, Homo sapiens
ctggattgcgcctaatgtgt

SEQ ID NO: 3560752 - DNA, 12 bp, Homo sapiens
ctggattttcag

SEQ ID NO: 3560753 - DNA, 20 bp, Homo sapiens
ctggcaaaaggatctttgtg

SEQ ID NO: 3560754 - DNA, 17 bp, Homo sapiens
ctggcaaacgtttctca

SEQ ID NO: 3560755 - DNA, 22 bp, Homo sapiens
ctggcaaaggacccttgagtaa

SEQ ID NO: 3560756 - DNA, 14 bp, Homo sapiens
ctggcacaaaagac

SEQ ID NO: 3560757 - DNA, 19 bp, Homo sapiens
ctggcacaaaagacagctg

SEQ ID NO: 3560758 - DNA, 18 bp, Homo sapiens
ctggcacaatgttggagc

SEQ ID NO: 3560759 - DNA, 22 bp, Homo sapiens
ctggcacaatgttggagcagca

SEQ ID NO: 3560760 - DNA, 14 bp, Homo sapiens
ctggcacagaccag

SEQ ID NO: 3560761 - DNA, 17 bp, Homo sapiens
ctggcaccatcagcctg

SEQ ID NO: 3560762 - DNA, 14 bp, Homo sapiens
ctggcacttggaga

SEQ ID NO: 3560763 - DNA, 18 bp, Homo sapiens
ctggcacttttttaaata

SEQ ID NO: 3560764 - DNA, 15 bp, Homo sapiens
ctggcagcaccgcct

SEQ ID NO: 3560765 - DNA, 21 bp, Homo sapiens
ctggcagcaccgcctcttccc

SEQ ID NO: 3560766 - DNA, 17 bp, Homo sapiens
ctggcagccgtgccttc

SEQ ID NO: 3560767 - DNA, 20 bp, Homo sapiens
ctggcagccgtgccttcagc

SEQ ID NO: 3560768 - DNA, 18 bp, Homo sapiens
ctggcagctctggacagc

SEQ ID NO: 3560769 - DNA, 20 bp, Homo sapiens
ctggcagctctggacagccc

SEQ ID NO: 3560770 - DNA, 12 bp, Homo sapiens
ctggcagctgct

SEQ ID NO: 3560771 - DNA, 17 bp, Homo sapiens
ctggcagggccacctgc

SEQ ID NO: 3560772 - DNA, 20 bp, Homo sapiens
ctggcaggggagacaggagc

SEQ ID NO: 3560773 - DNA, 23 bp, Homo sapiens
ctggcaggggagacaggagccta

SEQ ID NO: 3560774 - DNA, 16 bp, Homo sapiens
ctggcatcaagggaga

SEQ ID NO: 3560775 - DNA, 18 bp, Homo sapiens
ctggcatcaagggagaca

SEQ ID NO: 3560776 - DNA, 15 bp, Homo sapiens
ctggcattacagctg

SEQ ID NO: 3560777 - DNA, 15 bp, Homo sapiens
ctggccactaaagct

SEQ ID NO: 3560778 - DNA, 18 bp, Homo sapiens
ctggccactaaagcttca

SEQ ID NO: 3560779 - DNA, 19 bp, Homo sapiens
ctggccactaaagcttcag

SEQ ID NO: 3560780 - DNA, 21 bp, Homo sapiens
ctggccactaaagcttcagac

SEQ ID NO: 3560781 - DNA, 18 bp, Homo sapiens
ctggccagacacaggccc

SEQ ID NO: 3560782 - DNA, 13 bp, Homo sapiens
ctggccaggcagg

SEQ ID NO: 3560783 - DNA, 17 bp, Homo sapiens
ctggccaggcagggaga

SEQ ID NO: 3560784 - DNA, 18 bp, Homo sapiens
ctggccatcccacaagtg

SEQ ID NO: 3560785 - DNA, 22 bp, Homo sapiens
ctggcccagggcccagagccca

SEQ ID NO: 3560786 - DNA, 23 bp, Homo sapiens
ctggcccagggcccagagcccag

SEQ ID NO: 3560787 - DNA, 16 bp, Homo sapiens
ctggcccagtgccagc

SEQ ID NO: 3560788 - DNA, 17 bp, Homo sapiens
ctggcccccagccctgg

SEQ ID NO: 3560789 - DNA, 19 bp, Homo sapiens
ctggcccccagccctgggg

SEQ ID NO: 3560790 - DNA, 12 bp, Homo sapiens
ctggccctgggg

SEQ ID NO: 3560791 - DNA, 14 bp, Homo sapiens
ctggccctgggggt

SEQ ID NO: 3560792 - DNA, 19 bp, Homo sapiens
ctggccctgggggtctggg

SEQ ID NO: 3560793 - DNA, 13 bp, Homo sapiens
ctggccgcagggc

SEQ ID NO: 3560794 - DNA, 21 bp, Homo sapiens
ctggccggggctctgggtgct

SEQ ID NO: 3560795 - DNA, 15 bp, Homo sapiens
ctggccgtcacacgt

SEQ ID NO: 3560796 - DNA, 17 bp, Homo sapiens
ctggcctcccacagact

SEQ ID NO: 3560797 - DNA, 18 bp, Homo sapiens
ctggcctgaactgaggag

SEQ ID NO: 3560798 - DNA, 22 bp, Homo sapiens
ctggcctgccatgccagtaact

SEQ ID NO: 3560799 - DNA, 19 bp, Homo sapiens
ctggccttaaagagggaca

SEQ ID NO: 3560800 - DNA, 22 bp, Homo sapiens
ctggccttgggatccaggcccc

SEQ ID NO: 3560801 - DNA, 17 bp, Homo sapiens
ctggcctttttcattta

SEQ ID NO: 3560802 - DNA, 21 bp, Homo sapiens
ctggcctttttcatttatcta

SEQ ID NO: 3560803 - DNA, 13 bp, Homo sapiens
ctggcgacacact

SEQ ID NO: 3560804 - DNA, 20 bp, Homo sapiens
ctggcgcccctgcctgtgcc

SEQ ID NO: 3560805 - DNA, 16 bp, Homo sapiens
ctggctcactggcagg

SEQ ID NO: 3560806 - DNA, 14 bp, Homo sapiens
ctggctccactctt

SEQ ID NO: 3560807 - DNA, 23 bp, Homo sapiens
ctggctccactcttgatctctct

SEQ ID NO: 3560808 - DNA, 15 bp, Homo sapiens
ctggctcccacaggc

SEQ ID NO: 3560809 - DNA, 19 bp, Homo sapiens
ctggctcccacaggccctt

SEQ ID NO: 3560810 - DNA, 22 bp, Homo sapiens
ctggctcccacaggcccttcct

SEQ ID NO: 3560811 - DNA, 19 bp, Homo sapiens
ctggctctaattcacagtg

SEQ ID NO: 3560812 - DNA, 14 bp, Homo sapiens
ctggctctgccccc

SEQ ID NO: 3560813 - DNA, 21 bp, Homo sapiens
ctggctctgccccctccccca

SEQ ID NO: 3560814 - DNA, 15 bp, Homo sapiens
ctggctgagcccctg

SEQ ID NO: 3560815 - DNA, 20 bp, Homo sapiens
ctggctgagcccctggggaa

SEQ ID NO: 3560816 - DNA, 19 bp, Homo sapiens
ctggctgccttagaacctt

SEQ ID NO: 3560817 - DNA, 12 bp, Homo sapiens
ctggctgcgggg

SEQ ID NO: 3560818 - DNA, 18 bp, Homo sapiens
ctggctgcggggcgggca

SEQ ID NO: 3560819 - DNA, 14 bp, Homo sapiens
ctggctggaaagca

SEQ ID NO: 3560820 - DNA, 21 bp, Homo sapiens
ctggctggaaagcagagcctc

SEQ ID NO: 3560821 - DNA, 12 bp, Homo sapiens
ctggctgggcct

SEQ ID NO: 3560822 - DNA, 23 bp, Homo sapiens
ctggctggtgggaaggccggcag

SEQ ID NO: 3560823 - DNA, 18 bp, Homo sapiens
ctggctggtgggccccca

SEQ ID NO: 3560824 - DNA, 19 bp, Homo sapiens
ctggctggtgggcccccaa

SEQ ID NO: 3560825 - DNA, 16 bp, Homo sapiens
ctggctgtaaatccta

SEQ ID NO: 3560826 - DNA, 15 bp, Homo sapiens
ctggctgtacctgtt

SEQ ID NO: 3560827 - DNA, 18 bp, Homo sapiens
ctggctgtacctgttcct

SEQ ID NO: 3560828 - DNA, 21 bp, Homo sapiens
ctggctgtacctgttcctccc

SEQ ID NO: 3560829 - DNA, 23 bp, Homo sapiens
ctggcttcaaaaagccacagcag

SEQ ID NO: 3560830 - DNA, 19 bp, Homo sapiens
ctggcttccctaaactgca

SEQ ID NO: 3560831 - DNA, 22 bp, Homo sapiens
ctggcttccctaaactgcagcc

SEQ ID NO: 3560832 - DNA, 17 bp, Homo sapiens
ctggcttccctggaagc

SEQ ID NO: 3560833 - DNA, 12 bp, Homo sapiens
ctggctttgcct

SEQ ID NO: 3560834 - DNA, 21 bp, Homo sapiens
cttaagcaaattttgtattat

SEQ ID NO: 3560835 - DNA, 21 bp, Homo sapiens
cttaagcaacaatggatattg

SEQ ID NO: 3560836 - DNA, 13 bp, Homo sapiens
cttaagcagcatg

SEQ ID NO: 3560837 - DNA, 23 bp, Homo sapiens
cttaagcatctggctctaattca

SEQ ID NO: 3560838 - DNA, 20 bp, Homo sapiens
cttaagccaaactcaggccc

SEQ ID NO: 3560839 - DNA, 21 bp, Homo sapiens
cttaagccaaactcaggccca

SEQ ID NO: 3560840 - DNA, 22 bp, Homo sapiens
cttaatcaagatttttttcctg

SEQ ID NO: 3560841 - DNA, 22 bp, Homo sapiens
cttaatctaatctaaaagctct

SEQ ID NO: 3560842 - DNA, 14 bp, Homo sapiens
cttaatgacaacac

SEQ ID NO: 3560843 - DNA, 16 bp, Homo sapiens
cttaatgtatcaaact

SEQ ID NO: 3560844 - DNA, 20 bp, Homo sapiens
cttaatgtctggtgtttgtc

SEQ ID NO: 3560845 - DNA, 22 bp, Homo sapiens
cttaatgtctggtgtttgtcat

SEQ ID NO: 3560846 - DNA, 14 bp, Homo sapiens
cttaatgttcttat

SEQ ID NO: 3560847 - DNA, 20 bp, Homo sapiens
cttaattaaaagaatatttt

SEQ ID NO: 3560848 - DNA, 17 bp, Homo sapiens
cttaattgccagcaaat

SEQ ID NO: 3560849 - DNA, 21 bp, Homo sapiens
cttaattgccagcaaataaat

SEQ ID NO: 3560850 - DNA, 16 bp, Homo sapiens
cttacaagaaaggcct

SEQ ID NO: 3560851 - DNA, 16 bp, Homo sapiens
cttacaagccagctgg

SEQ ID NO: 3560852 - DNA, 22 bp, Homo sapiens
cttacagccctaagtggctgcc

SEQ ID NO: 3560853 - DNA, 23 bp, Homo sapiens
cttacagccctaagtggctgcct

SEQ ID NO: 3560854 - DNA, 23 bp, Homo sapiens
cttaccagggtctttgcagatgt

SEQ ID NO: 3560855 - DNA, 19 bp, Homo sapiens
cttaccctcctctgctggg

SEQ ID NO: 3560856 - DNA, 16 bp, Homo sapiens
cttacctgggcacaaa

SEQ ID NO: 3560857 - DNA, 22 bp, Homo sapiens
cttacctgggcacaaacagaat

SEQ ID NO: 3560858 - DNA, 18 bp, Homo sapiens
cttacggccatctctttg

SEQ ID NO: 3560859 - DNA, 21 bp, Homo sapiens
cttactaaaaagtataaaata

SEQ ID NO: 3560860 - DNA, 18 bp, Homo sapiens
cttactaatgtaaaatga

SEQ ID NO: 3560861 - DNA, 23 bp, Homo sapiens
cttactcccccaccactcaggcc

SEQ ID NO: 3560862 - DNA, 22 bp, Homo sapiens
cttactgcgactaaacttaatt

SEQ ID NO: 3560863 - DNA, 17 bp, Homo sapiens
cttacttcaaagtgcct

SEQ ID NO: 3560864 - DNA, 20 bp, Homo sapiens
cttagaaacactgcaaattt

SEQ ID NO: 3560865 - DNA, 16 bp, Homo sapiens
cttagaaattgcattt

SEQ ID NO: 3560866 - DNA, 13 bp, Homo sapiens
cttagagaagcta

SEQ ID NO: 3560867 - DNA, 18 bp, Homo sapiens
cttagaggcaacaggatt

SEQ ID NO: 3560868 - DNA, 23 bp, Homo sapiens
cttagagtttctgtttgattctt

SEQ ID NO: 3560869 - DNA, 20 bp, Homo sapiens
cttagccctcaccacagcct

SEQ ID NO: 3560870 - DNA, 12 bp, Homo sapiens
cttagcgggaca

SEQ ID NO: 3560871 - DNA, 16 bp, Homo sapiens
cttagctatccttggc

SEQ ID NO: 3560872 - DNA, 17 bp, Homo sapiens
cttagctatccttggct

SEQ ID NO: 3560873 - DNA, 20 bp, Homo sapiens
cttagctatccttggctttc

SEQ ID NO: 3560874 - DNA, 14 bp, Homo sapiens
cttagctctttctc

SEQ ID NO: 3560875 - DNA, 14 bp, Homo sapiens
cttagctgtctgct

SEQ ID NO: 3560876 - DNA, 23 bp, Homo sapiens
cttaggagacagatcactcctgg

SEQ ID NO: 3560877 - DNA, 13 bp, Homo sapiens
cttaggctactgt

SEQ ID NO: 3560878 - DNA, 20 bp, Homo sapiens
cttagggacaggaccccagc

SEQ ID NO: 3560879 - DNA, 11 bp, Homo sapiens
cttagtgtatg

SEQ ID NO: 3560880 - DNA, 11 bp, Homo sapiens
cttagtgttca

SEQ ID NO: 3560881 - DNA, 12 bp, Homo sapiens
cttagtgttcaa

SEQ ID NO: 3560882 - DNA, 14 bp, Homo sapiens
cttagtgttcaaaa

SEQ ID NO: 3560883 - DNA, 17 bp, Homo sapiens
cttagttggctttgccc

SEQ ID NO: 3560884 - DNA, 20 bp, Homo sapiens
cttagttggctttgcccacc

SEQ ID NO: 3560885 - DNA, 22 bp, Homo sapiens
cttataaaataacttgcatcta

SEQ ID NO: 3560886 - DNA, 19 bp, Homo sapiens
cttataaaccaatcttaaa

SEQ ID NO: 3560887 - DNA, 22 bp, Homo sapiens
cttataagaagaagagaggcat

SEQ ID NO: 3560888 - DNA, 14 bp, Homo sapiens
cttataataaagga

SEQ ID NO: 3560889 - DNA, 20 bp, Homo sapiens
cttataataaaggactgtaa

SEQ ID NO: 3560890 - DNA, 21 bp, Homo sapiens
cttatacaattatgaagattt

SEQ ID NO: 3560891 - DNA, 17 bp, Homo sapiens
cttatacttttctcaat

SEQ ID NO: 3560892 - DNA, 22 bp, Homo sapiens
cttatagtgtttggacagctga

SEQ ID NO: 3560893 - DNA, 21 bp, Homo sapiens
cttatagttactgtgtaatta

SEQ ID NO: 3560894 - DNA, 17 bp, Homo sapiens
cttatcaactggttgta

SEQ ID NO: 3560895 - DNA, 20 bp, Homo sapiens
cttatcaactggttgtatat

SEQ ID NO: 3560896 - DNA, 18 bp, Homo sapiens
cttatccaggttggtttt

SEQ ID NO: 3560897 - DNA, 22 bp, Homo sapiens
cttatccaggttggttttgctg

SEQ ID NO: 3560898 - DNA, 13 bp, Homo sapiens
cttatccctctct

SEQ ID NO: 3560899 - DNA, 15 bp, Homo sapiens
cttatccctctcttc

SEQ ID NO: 3560900 - DNA, 17 bp, Homo sapiens
cttatccctctcttccc

SEQ ID NO: 3560901 - DNA, 18 bp, Homo sapiens
cttatccctctcttcccc

SEQ ID NO: 3560902 - DNA, 17 bp, Homo sapiens
cttatctgaaaggccag

SEQ ID NO: 3560903 - DNA, 20 bp, Homo sapiens
cttatctgaaaggccagcag

SEQ ID NO: 3560904 - DNA, 13 bp, Homo sapiens
cttatgaaatgtg

SEQ ID NO: 3560905 - DNA, 21 bp, Homo sapiens
cttatgacatcacttgtacaa

SEQ ID NO: 3560906 - DNA, 23 bp, Homo sapiens
cttatgatagcaaatggcctcat

SEQ ID NO: 3560907 - DNA, 18 bp, Homo sapiens
cttatgcggttaattttg

SEQ ID NO: 3560908 - DNA, 16 bp, Homo sapiens
cttatggcatgactct

SEQ ID NO: 3560909 - DNA, 21 bp, Homo sapiens
cttatggtatgtagccagctg

SEQ ID NO: 3560910 - DNA, 21 bp, Homo sapiens
cttatgtagaaactgaggccc

SEQ ID NO: 3560911 - DNA, 22 bp, Homo sapiens
cttatgtagaaactgaggccca

SEQ ID NO: 3560912 - DNA, 19 bp, Homo sapiens
cttatgtatcagtgtcctt

SEQ ID NO: 3560913 - DNA, 21 bp, Homo sapiens
cttatgtatcagtgtcctttc

SEQ ID NO: 3560914 - DNA, 12 bp, Homo sapiens
cttattgtttaa

SEQ ID NO: 3560915 - DNA, 16 bp, Homo sapiens
cttatttacccttttc

SEQ ID NO: 3560916 - DNA, 23 bp, Homo sapiens
cttatttagattcacttaacaaa

SEQ ID NO: 3560917 - DNA, 14 bp, Homo sapiens
cttatttcatttct

SEQ ID NO: 3560918 - DNA, 16 bp, Homo sapiens
cttatttctcagctgt

SEQ ID NO: 3560919 - DNA, 20 bp, Homo sapiens
cttatttctcagctgtgcct

SEQ ID NO: 3560920 - DNA, 18 bp, Homo sapiens
cttatttctgctctggaa

SEQ ID NO: 3560921 - DNA, 19 bp, Homo sapiens
cttattttgtaataaactc

SEQ ID NO: 3560922 - DNA, 20 bp, Homo sapiens
cttattttgtaataaactct

SEQ ID NO: 3560923 - DNA, 22 bp, Homo sapiens
cttatttttctgaggtccttat

SEQ ID NO: 3560924 - DNA, 14 bp, Homo sapiens
cttcaaaaagccac

SEQ ID NO: 3560925 - DNA, 22 bp, Homo sapiens
cttcaaaaagccacagcagagc

SEQ ID NO: 3560926 - DNA, 14 bp, Homo sapiens
cttcaacccagtgg

SEQ ID NO: 3560927 - DNA, 17 bp, Homo sapiens
cttcaactgaccagcct

SEQ ID NO: 3560928 - DNA, 16 bp, Homo sapiens
cttcaacttttctctt

SEQ ID NO: 3560929 - DNA, 19 bp, Homo sapiens
cttcaagacgaggggcagg

SEQ ID NO: 3560930 - DNA, 12 bp, Homo sapiens
cttcacaacaga

SEQ ID NO: 3560931 - DNA, 15 bp, Homo sapiens
cttcacgcccttggc

SEQ ID NO: 3560932 - DNA, 15 bp, Homo sapiens
cttcactctggcttc

SEQ ID NO: 3560933 - DNA, 16 bp, Homo sapiens
cttcacttcaagctgt

SEQ ID NO: 3560934 - DNA, 18 bp, Homo sapiens
cttcactttcctcagttg

SEQ ID NO: 3560935 - DNA, 21 bp, Homo sapiens
cttcagaactgcccttgctgc

SEQ ID NO: 3560936 - DNA, 23 bp, Homo sapiens
cttcagaactgcccttgctgccc

SEQ ID NO: 3560937 - DNA, 15 bp, Homo sapiens
cttcagactggccct

SEQ ID NO: 3560938 - DNA, 13 bp, Homo sapiens
cttcagcaaccct

SEQ ID NO: 3560939 - DNA, 21 bp, Homo sapiens
cttcagcaaccctacagtata

SEQ ID NO: 3560940 - DNA, 14 bp, Homo sapiens
cttcagcacggcgt

SEQ ID NO: 3560941 - DNA, 22 bp, Homo sapiens
cttcagccaggtctgactccaa

SEQ ID NO: 3560942 - DNA, 17 bp, Homo sapiens
cttcagcgtaaaatggt

SEQ ID NO: 3560943 - DNA, 19 bp, Homo sapiens
cttcaggagcctggccagg

SEQ ID NO: 3560944 - DNA, 18 bp, Homo sapiens
cttcaggcagctgaaatt

SEQ ID NO: 3560945 - DNA, 17 bp, Homo sapiens
cttcaggctcttctcct

SEQ ID NO: 3560946 - DNA, 18 bp, Homo sapiens
cttcaggctcttctcctt

SEQ ID NO: 3560947 - DNA, 15 bp, Homo sapiens
cttcaggtcaggtgg

SEQ ID NO: 3560948 - DNA, 14 bp, Homo sapiens
cttcagtcctttgt

SEQ ID NO: 3560949 - DNA, 15 bp, Homo sapiens
cttcagtcctttgtc

SEQ ID NO: 3560950 - DNA, 20 bp, Homo sapiens
cttcagtgactcctgctggt

SEQ ID NO: 3560951 - DNA, 16 bp, Homo sapiens
cttcagtgagcccctc

SEQ ID NO: 3560952 - DNA, 17 bp, Homo sapiens
cttcagtgagcccctcc

SEQ ID NO: 3560953 - DNA, 20 bp, Homo sapiens
cttcatcagaactcttcctc

SEQ ID NO: 3560954 - DNA, 14 bp, Homo sapiens
cttcatccatcctg

SEQ ID NO: 3560955 - DNA, 16 bp, Homo sapiens
cttcatccgcctgtgg

SEQ ID NO: 3560956 - DNA, 17 bp, Homo sapiens
cttcatccgcctgtggg

SEQ ID NO: 3560957 - DNA, 21 bp, Homo sapiens
cttcattccattgacttagag

SEQ ID NO: 3560958 - DNA, 21 bp, Homo sapiens
cttcattttattaatattttt

SEQ ID NO: 3560959 - DNA, 15 bp, Homo sapiens
cttccaaataaataa

SEQ ID NO: 3560960 - DNA, 13 bp, Homo sapiens
cttccacccacaa

SEQ ID NO: 3560961 - DNA, 12 bp, Homo sapiens
cttccacctgcc

SEQ ID NO: 3560962 - DNA, 19 bp, Homo sapiens
cttccactaccaaaagaca

SEQ ID NO: 3560963 - DNA, 20 bp, Homo sapiens
cttccactaccaaaagacat

SEQ ID NO: 3560964 - DNA, 19 bp, Homo sapiens
cttccaggaaagtgtgaag

SEQ ID NO: 3560965 - DNA, 20 bp, Homo sapiens
ctttaaaacgcgtctgcctg

SEQ ID NO: 3560966 - DNA, 23 bp, Homo sapiens
ctttaaaacgcgtctgcctgggc

SEQ ID NO: 3560967 - DNA, 21 bp, Homo sapiens
ctttaaaattgggttcacagc

SEQ ID NO: 3560968 - DNA, 20 bp, Homo sapiens
ctttaacttttttttctctc

SEQ ID NO: 3560969 - DNA, 19 bp, Homo sapiens
ctttaagaaccttaatgac

SEQ ID NO: 3560970 - DNA, 15 bp, Homo sapiens
ctttaagaactaaaa

SEQ ID NO: 3560971 - DNA, 15 bp, Homo sapiens
ctttaagccaaagaa

SEQ ID NO: 3560972 - DNA, 17 bp, Homo sapiens
ctttaattactggaatt

SEQ ID NO: 3560973 - DNA, 14 bp, Homo sapiens
ctttacacctcgct

SEQ ID NO: 3560974 - DNA, 14 bp, Homo sapiens
ctttacttttaaac

SEQ ID NO: 3560975 - DNA, 20 bp, Homo sapiens
ctttagaccctcgggcccca

SEQ ID NO: 3560976 - DNA, 15 bp, Homo sapiens
ctttagagataattg

SEQ ID NO: 3560977 - DNA, 16 bp, Homo sapiens
ctttagatatttgcct

SEQ ID NO: 3560978 - DNA, 18 bp, Homo sapiens
ctttagcaaaactggaca

SEQ ID NO: 3560979 - DNA, 22 bp, Homo sapiens
ctttagcagtttcctcagtgat

SEQ ID NO: 3560980 - DNA, 14 bp, Homo sapiens
ctttagcctgggca

SEQ ID NO: 3560981 - DNA, 15 bp, Homo sapiens
ctttatgcaaataca

SEQ ID NO: 3560982 - DNA, 17 bp, Homo sapiens
ctttatgtttttggtta

SEQ ID NO: 3560983 - DNA, 13 bp, Homo sapiens
ctttattaccagt

SEQ ID NO: 3560984 - DNA, 14 bp, Homo sapiens
ctttatttatttct

SEQ ID NO: 3560985 - DNA, 15 bp, Homo sapiens
ctttatttatttcta

SEQ ID NO: 3560986 - DNA, 21 bp, Homo sapiens
ctttcaaaagaagagttttag

SEQ ID NO: 3560987 - DNA, 14 bp, Homo sapiens
ctttcacaaccttc

SEQ ID NO: 3560988 - DNA, 16 bp, Homo sapiens
ctttcacaaccttctg

SEQ ID NO: 3560989 - DNA, 15 bp, Homo sapiens
ctttcacatttaaat

SEQ ID NO: 3560990 - DNA, 14 bp, Homo sapiens
ctttcacccatcct

SEQ ID NO: 3560991 - DNA, 15 bp, Homo sapiens
ctttcacccatccta

SEQ ID NO: 3560992 - DNA, 14 bp, Homo sapiens
ctttcagaatcttt

SEQ ID NO: 3560993 - DNA, 15 bp, Homo sapiens
ctttcagagccagcc

SEQ ID NO: 3560994 - DNA, 18 bp, Homo sapiens
ctttcagagccagcctgg

SEQ ID NO: 3560995 - DNA, 21 bp, Homo sapiens
ctttcagcaagataaacatta

SEQ ID NO: 3560996 - DNA, 19 bp, Homo sapiens
ctttcaggagctccataca

SEQ ID NO: 3560997 - DNA, 21 bp, Homo sapiens
ctttcagtgcagtttcttttc

SEQ ID NO: 3560998 - DNA, 17 bp, Homo sapiens
ctttcataatctttgct

SEQ ID NO: 3560999 - DNA, 18 bp, Homo sapiens
ctttcataatctttgctt

SEQ ID NO: 3561000 - DNA, 16 bp, Homo sapiens
ctttcatattttaaac

SEQ ID NO: 3561001 - DNA, 22 bp, Homo sapiens
ctttcatgagtttttcccagct

SEQ ID NO: 3561002 - DNA, 16 bp, Homo sapiens
ctttcatgtcttgtca

SEQ ID NO: 3561003 - DNA, 22 bp, Homo sapiens
ctttcattaccctacagacagc

SEQ ID NO: 3561004 - DNA, 16 bp, Homo sapiens
ctttccaccatacctt

SEQ ID NO: 3561005 - DNA, 13 bp, Homo sapiens
ctttccatcaact

SEQ ID NO: 3561006 - DNA, 21 bp, Homo sapiens
ctttcccaccattcctgcctt

SEQ ID NO: 3561007 - DNA, 22 bp, Homo sapiens
ctttcccaccattcctgccttt

SEQ ID NO: 3561008 - DNA, 13 bp, Homo sapiens
ctttccctcttcc

SEQ ID NO: 3561009 - DNA, 12 bp, Homo sapiens
ctttcccttggt

SEQ ID NO: 3561010 - DNA, 20 bp, Homo sapiens
ctttcctaaggctgcaaggt

SEQ ID NO: 3561011 - DNA, 13 bp, Homo sapiens
ctttcctcacatt

SEQ ID NO: 3561012 - DNA, 17 bp, Homo sapiens
ctttcctccccctgcaa

SEQ ID NO: 3561013 - DNA, 19 bp, Homo sapiens
ctttcctgcatctctgtga

SEQ ID NO: 3561014 - DNA, 17 bp, Homo sapiens
ctttctagttcagctgc

SEQ ID NO: 3561015 - DNA, 16 bp, Homo sapiens
ctttctatctcatctg

SEQ ID NO: 3561016 - DNA, 20 bp, Homo sapiens
ctttctatctcatctgtctc

SEQ ID NO: 3561017 - DNA, 21 bp, Homo sapiens
ctttctatctcatctgtctcg

SEQ ID NO: 3561018 - DNA, 17 bp, Homo sapiens
ctttctccatggagcct

SEQ ID NO: 3561019 - DNA, 15 bp, Homo sapiens
ctttctccttgaata

SEQ ID NO: 3561020 - DNA, 20 bp, Homo sapiens
ctttctctctcctctctgct

SEQ ID NO: 3561021 - DNA, 10 bp, Homo sapiens
ctttctctga

SEQ ID NO: 3561022 - DNA, 14 bp, Homo sapiens
ctttctctgggctt

SEQ ID NO: 3561023 - DNA, 20 bp, Homo sapiens
ctttctcttccttttatata

SEQ ID NO: 3561024 - DNA, 20 bp, Homo sapiens
ctttctcttttcctctacca

SEQ ID NO: 3561025 - DNA, 14 bp, Homo sapiens
ctttctgccttagc

SEQ ID NO: 3561026 - DNA, 13 bp, Homo sapiens
ctttctgctcagc

SEQ ID NO: 3561027 - DNA, 19 bp, Homo sapiens
ctttctgctcagcttctcc

SEQ ID NO: 3561028 - DNA, 20 bp, Homo sapiens
ctttctgctctatactgtgg

SEQ ID NO: 3561029 - DNA, 13 bp, Homo sapiens
ctttctgtcttgt

SEQ ID NO: 3561030 - DNA, 23 bp, Homo sapiens
ctttcttacctactattggccct

SEQ ID NO: 3561031 - DNA, 17 bp, Homo sapiens
ctttcttattttgtaat

SEQ ID NO: 3561032 - DNA, 21 bp, Homo sapiens
ctttcttattttgtaataaac

SEQ ID NO: 3561033 - DNA, 22 bp, Homo sapiens
ctttcttattttgtaataaact

SEQ ID NO: 3561034 - DNA, 15 bp, Homo sapiens
ctttcttccattcct

SEQ ID NO: 3561035 - DNA, 11 bp, Homo sapiens
ctttcttcctc

SEQ ID NO: 3561036 - DNA, 19 bp, Homo sapiens
ctttcttgtaaggcatact

SEQ ID NO: 3561037 - DNA, 18 bp, Homo sapiens
ctttctttgcaccaaaga

SEQ ID NO: 3561038 - DNA, 13 bp, Homo sapiens
ctttctttgtcat

SEQ ID NO: 3561039 - DNA, 14 bp, Homo sapiens
ctttctttgtcatt

SEQ ID NO: 3561040 - DNA, 14 bp, Homo sapiens
ctttcttttctctg

SEQ ID NO: 3561041 - DNA, 14 bp, Homo sapiens
ctttgaaagaagca

SEQ ID NO: 3561042 - DNA, 16 bp, Homo sapiens
ctttgaagtgcagctc

SEQ ID NO: 3561043 - DNA, 18 bp, Homo sapiens
ctttgaagtgcagctcat

SEQ ID NO: 3561044 - DNA, 11 bp, Homo sapiens
ctttgaataaa

SEQ ID NO: 3561045 - DNA, 18 bp, Homo sapiens
ctttgaataaatgtcact

SEQ ID NO: 3561046 - DNA, 19 bp, Homo sapiens
ctttgaataaatgtcactt

SEQ ID NO: 3561047 - DNA, 16 bp, Homo sapiens
ctttgatactaccagg

SEQ ID NO: 3561048 - DNA, 22 bp, Homo sapiens
ctttgatattttcaacgcagcc

SEQ ID NO: 3561049 - DNA, 20 bp, Homo sapiens
ctttgatcgcctctttgaca

SEQ ID NO: 3561050 - DNA, 13 bp, Homo sapiens
ctttgcaccaaag

SEQ ID NO: 3561051 - DNA, 14 bp, Homo sapiens
ctttgcaccaaaga

SEQ ID NO: 3561052 - DNA, 17 bp, Homo sapiens
ctttgcaccaaagacat

SEQ ID NO: 3561053 - DNA, 16 bp, Homo sapiens
ctttgcactgatatat

SEQ ID NO: 3561054 - DNA, 13 bp, Homo sapiens
ctttgcagatgta

SEQ ID NO: 3561055 - DNA, 12 bp, Homo sapiens
ctttgccatctc

SEQ ID NO: 3561056 - DNA, 16 bp, Homo sapiens
ctttgcccacccctca

SEQ ID NO: 3561057 - DNA, 11 bp, Homo sapiens
ctttgcctctt

SEQ ID NO: 3561058 - DNA, 16 bp, Homo sapiens
ctttgcctcttctttg

SEQ ID NO: 3561059 - DNA, 17 bp, Homo sapiens
ctttgcctcttctttgt

SEQ ID NO: 3561060 - DNA, 11 bp, Homo sapiens
ctttgctgcag

SEQ ID NO: 3561061 - DNA, 22 bp, Homo sapiens
ctttgctgcagagatcaagggt

SEQ ID NO: 3561062 - DNA, 16 bp, Homo sapiens
ctttgctgcccctgtc

SEQ ID NO: 3561063 - DNA, 22 bp, Homo sapiens
ctttgctgcccctgtctggaag

SEQ ID NO: 3561064 - DNA, 14 bp, Homo sapiens
ctttgctgccttaa

SEQ ID NO: 3561065 - DNA, 16 bp, Homo sapiens
ctttgctttctgctca

SEQ ID NO: 3561066 - DNA, 17 bp, Homo sapiens
ctttgctttctgctcag

SEQ ID NO: 3561067 - DNA, 19 bp, Homo sapiens
ctttgctttctgctcagct

SEQ ID NO: 3561068 - DNA, 11 bp, Homo sapiens
ctttgctttgc

SEQ ID NO: 3561069 - DNA, 23 bp, Homo sapiens
ctttggaagggtctctctccagg

SEQ ID NO: 3561070 - DNA, 17 bp, Homo sapiens
ctttggacagtggcctc

SEQ ID NO: 3561071 - DNA, 18 bp, Homo sapiens
ctttggacagtggcctct

SEQ ID NO: 3561072 - DNA, 18 bp, Homo sapiens
ctttggcatgatttaaag

SEQ ID NO: 3561073 - DNA, 21 bp, Homo sapiens
ctttggcctggggtgcatctc

SEQ ID NO: 3561074 - DNA, 22 bp, Homo sapiens
ctttggcctggggtgcatctcc

SEQ ID NO: 3561075 - DNA, 12 bp, Homo sapiens
ctttggctgcag

SEQ ID NO: 3561076 - DNA, 21 bp, Homo sapiens
ctttggctggtagcagcaggc

SEQ ID NO: 3561077 - DNA, 21 bp, Homo sapiens
ctttgggaagtttgctgtgct

SEQ ID NO: 3561078 - DNA, 22 bp, Homo sapiens
ctttgggaagtttgctgtgctt

SEQ ID NO: 3561079 - DNA, 14 bp, Homo sapiens
ctttgggctgccct

SEQ ID NO: 3561080 - DNA, 22 bp, Homo sapiens
ctttgggggagtgggcgcagtg

SEQ ID NO: 3561081 - DNA, 14 bp, Homo sapiens
ctttgggtgctgtt

SEQ ID NO: 3561082 - DNA, 18 bp, Homo sapiens
ctttggttccttctctgg

SEQ ID NO: 3561083 - DNA, 23 bp, Homo sapiens
ctttggtttatggttttcattca

SEQ ID NO: 3561084 - DNA, 20 bp, Homo sapiens
ctttgtaccttttgtagttt

SEQ ID NO: 3561085 - DNA, 14 bp, Homo sapiens
ctttgtactttgtg

SEQ ID NO: 3561086 - DNA, 16 bp, Homo sapiens
ctttgtagaaattaaa

SEQ ID NO: 3561087 - DNA, 19 bp, Homo sapiens
ctttgtatataggcttctc

SEQ ID NO: 3561088 - DNA, 10 bp, Homo sapiens
ctttgtcatt

SEQ ID NO: 3561089 - DNA, 23 bp, Homo sapiens
ctttgtctacttcaaaagtttgt

SEQ ID NO: 3561090 - DNA, 13 bp, Homo sapiens
ctttgtctccaaa

SEQ ID NO: 3561091 - DNA, 17 bp, Homo sapiens
ctttgtctccaaagaag

SEQ ID NO: 3561092 - DNA, 13 bp, Homo sapiens
ctttgtctttctt

SEQ ID NO: 3561093 - DNA, 18 bp, Homo sapiens
ctttgtctttctttgtca

SEQ ID NO: 3561094 - DNA, 19 bp, Homo sapiens
ctttgtctttctttgtcat

SEQ ID NO: 3561095 - DNA, 17 bp, Homo sapiens
ctttgtgctcataaatt

SEQ ID NO: 3561096 - DNA, 19 bp, Homo sapiens
ctttgtgctttttgtcatg

SEQ ID NO: 3561097 - DNA, 18 bp, Homo sapiens
ctttgtggccaaggagct

SEQ ID NO: 3561098 - DNA, 16 bp, Homo sapiens
gaatctagcccaacct

SEQ ID NO: 3561099 - DNA, 16 bp, Homo sapiens
gaatctgtgcaaacag

SEQ ID NO: 3561100 - DNA, 14 bp, Homo sapiens
gaatgaaaataact

SEQ ID NO: 3561101 - DNA, 14 bp, Homo sapiens
gaatgatttcatgc

SEQ ID NO: 3561102 - DNA, 16 bp, Homo sapiens
gaatgccgctgtctct

SEQ ID NO: 3561103 - DNA, 16 bp, Homo sapiens
gaatgcctcgctccct

SEQ ID NO: 3561104 - DNA, 16 bp, Homo sapiens
gaatggcatggcagga

SEQ ID NO: 3561105 - DNA, 16 bp, Homo sapiens
gaatggccacaaacct

SEQ ID NO: 3561106 - DNA, 17 bp, Homo sapiens
gaatggccacaaacctg

SEQ ID NO: 3561107 - DNA, 12 bp, Homo sapiens
gaatggcctgga

SEQ ID NO: 3561108 - DNA, 16 bp, Homo sapiens
gaatggcctggagcag

SEQ ID NO: 3561109 - DNA, 18 bp, Homo sapiens
gaatggcctggagcaggc

SEQ ID NO: 3561110 - DNA, 20 bp, Homo sapiens
gaatggcctggagcaggccc

SEQ ID NO: 3561111 - DNA, 13 bp, Homo sapiens
gaatgtaaagcaa

SEQ ID NO: 3561112 - DNA, 13 bp, Homo sapiens
gaatgtcagtatg

SEQ ID NO: 3561113 - DNA, 16 bp, Homo sapiens
gaatgtcagtatgtgg

SEQ ID NO: 3561114 - DNA, 23 bp, Homo sapiens
gaatgtgtgtgtgtggcaggggg

SEQ ID NO: 3561115 - DNA, 14 bp, Homo sapiens
gaatgttctttctg

SEQ ID NO: 3561116 - DNA, 16 bp, Homo sapiens
gaatgttgaaaagtaa

SEQ ID NO: 3561117 - DNA, 22 bp, Homo sapiens
gaattaatatccctacatgtat

SEQ ID NO: 3561118 - DNA, 15 bp, Homo sapiens
gaattacgtgctctg

SEQ ID NO: 3561119 - DNA, 16 bp, Homo sapiens
gaattaggctgtaact

SEQ ID NO: 3561120 - DNA, 17 bp, Homo sapiens
gaattaggctgtaacta

SEQ ID NO: 3561121 - DNA, 14 bp, Homo sapiens
gaattagtatttca

SEQ ID NO: 3561122 - DNA, 20 bp, Homo sapiens
gaattagtatttcagtgttt

SEQ ID NO: 3561123 - DNA, 17 bp, Homo sapiens
gaattagttttaaaatg

SEQ ID NO: 3561124 - DNA, 18 bp, Homo sapiens
gaattatctcaagtaaaa

SEQ ID NO: 3561125 - DNA, 19 bp, Homo sapiens
gaattcaccacagacttta

SEQ ID NO: 3561126 - DNA, 17 bp, Homo sapiens
gaattcattctggaggg

SEQ ID NO: 3561127 - DNA, 14 bp, Homo sapiens
gaattcatttcact

SEQ ID NO: 3561128 - DNA, 16 bp, Homo sapiens
gaattccctccccctc

SEQ ID NO: 3561129 - DNA, 18 bp, Homo sapiens
gaattggaaagacttctc

SEQ ID NO: 3561130 - DNA, 19 bp, Homo sapiens
gaattggaaagacttctca

SEQ ID NO: 3561131 - DNA, 13 bp, Homo sapiens
gaatttatacctc

SEQ ID NO: 3561132 - DNA, 17 bp, Homo sapiens
gaatttcccacataccc

SEQ ID NO: 3561133 - DNA, 14 bp, Homo sapiens
gaatttcccaggac

SEQ ID NO: 3561134 - DNA, 15 bp, Homo sapiens
gaatttcttaacttc

SEQ ID NO: 3561135 - DNA, 16 bp, Homo sapiens
gaatttcttaacttct

SEQ ID NO: 3561136 - DNA, 22 bp, Homo sapiens
gacaaacacctcccaggagaca

SEQ ID NO: 3561137 - DNA, 15 bp, Homo sapiens
gacaaagcaatttac

SEQ ID NO: 3561138 - DNA, 16 bp, Homo sapiens
gacaaagccttaagca

SEQ ID NO: 3561139 - DNA, 18 bp, Homo sapiens
gacaaaggttttcctctt

SEQ ID NO: 3561140 - DNA, 20 bp, Homo sapiens
gacaactgtgaagccaccct

SEQ ID NO: 3561141 - DNA, 16 bp, Homo sapiens
gacaagagctgttatg

SEQ ID NO: 3561142 - DNA, 15 bp, Homo sapiens
gacaagcagcccttg

SEQ ID NO: 3561143 - DNA, 15 bp, Homo sapiens
gacaaggcctgcttg

SEQ ID NO: 3561144 - DNA, 14 bp, Homo sapiens
gacaaggtgctaac

SEQ ID NO: 3561145 - DNA, 22 bp, Homo sapiens
gacaattgaggtaagttttttg

SEQ ID NO: 3561146 - DNA, 15 bp, Homo sapiens
gacaatttgtgatat

SEQ ID NO: 3561147 - DNA, 14 bp, Homo sapiens
gacacacatacata

SEQ ID NO: 3561148 - DNA, 22 bp, Homo sapiens
gacacacatacataatggtact

SEQ ID NO: 3561149 - DNA, 15 bp, Homo sapiens
gacacaccaggcgct

SEQ ID NO: 3561150 - DNA, 18 bp, Homo sapiens
gacacaccaggcgctaat

SEQ ID NO: 3561151 - DNA, 13 bp, Homo sapiens
gacacacggggct

SEQ ID NO: 3561152 - DNA, 15 bp, Homo sapiens
gacacagctcttcat

SEQ ID NO: 3561153 - DNA, 20 bp, Homo sapiens
gacacagctcttcattccat

SEQ ID NO: 3561154 - DNA, 19 bp, Homo sapiens
gacacagctcttccagggc

SEQ ID NO: 3561155 - DNA, 21 bp, Homo sapiens
gacacagctcttccagggcag

SEQ ID NO: 3561156 - DNA, 13 bp, Homo sapiens
gacacaggccctc

SEQ ID NO: 3561157 - DNA, 17 bp, Homo sapiens
gacacaggtctttccta

SEQ ID NO: 3561158 - DNA, 22 bp, Homo sapiens
gacacaggtctttcctaaggct

SEQ ID NO: 3561159 - DNA, 16 bp, Homo sapiens
gacacatatgaggggg

SEQ ID NO: 3561160 - DNA, 17 bp, Homo sapiens
gacacccatgccagaga

SEQ ID NO: 3561161 - DNA, 18 bp, Homo sapiens
gacaccttagagaagcta

SEQ ID NO: 3561162 - DNA, 17 bp, Homo sapiens
gacacgtggcctcgtga

SEQ ID NO: 3561163 - DNA, 17 bp, Homo sapiens
gacactccttccccaag

SEQ ID NO: 3561164 - DNA, 20 bp, Homo sapiens
gacactgctctaacagccct

SEQ ID NO: 3561165 - DNA, 18 bp, Homo sapiens
gacactgttgataaaaac

SEQ ID NO: 3561166 - DNA, 21 bp, Homo sapiens
gacactttgccaaggctctcc

SEQ ID NO: 3561167 - DNA, 21 bp, Homo sapiens
gacagaaaagtgcctgagctg

SEQ ID NO: 3561168 - DNA, 20 bp, Homo sapiens
gacagaacccctacatgaaa

SEQ ID NO: 3561169 - DNA, 15 bp, Homo sapiens
gacagaccacttgcc

SEQ ID NO: 3561170 - DNA, 16 bp, Homo sapiens
gacagaccacttgcca

SEQ ID NO: 3561171 - DNA, 19 bp, Homo sapiens
gacagaccacttgccacgc

SEQ ID NO: 3561172 - DNA, 15 bp, Homo sapiens
gacagactttggaca

SEQ ID NO: 3561173 - DNA, 18 bp, Homo sapiens
gacagactttggacagtg

SEQ ID NO: 3561174 - DNA, 18 bp, Homo sapiens
gacagaggccccagcctc

SEQ ID NO: 3561175 - DNA, 15 bp, Homo sapiens
gacagatattttatc

SEQ ID NO: 3561176 - DNA, 14 bp, Homo sapiens
gacagatcactcct

SEQ ID NO: 3561177 - DNA, 17 bp, Homo sapiens
gacagatcactcctgga

SEQ ID NO: 3561178 - DNA, 18 bp, Homo sapiens
gacagatcactcctggag

SEQ ID NO: 3561179 - DNA, 20 bp, Homo sapiens
gacagatcactcctggaggc

SEQ ID NO: 3561180 - DNA, 22 bp, Homo sapiens
gacagcaattcatggttcaagt

SEQ ID NO: 3561181 - DNA, 11 bp, Homo sapiens
gacagccacac

SEQ ID NO: 3561182 - DNA, 14 bp, Homo sapiens
gacagccccaccct

SEQ ID NO: 3561183 - DNA, 20 bp, Homo sapiens
gacagcctccccctgtcccc

SEQ ID NO: 3561184 - DNA, 11 bp, Homo sapiens
gacagcctggc

SEQ ID NO: 3561185 - DNA, 11 bp, Homo sapiens
gacagctgctc

SEQ ID NO: 3561186 - DNA, 14 bp, Homo sapiens
gacagctgctccta

SEQ ID NO: 3561187 - DNA, 21 bp, Homo sapiens
gacagctgctcctagagggag

SEQ ID NO: 3561188 - DNA, 23 bp, Homo sapiens
gacagcttacaggagccagcctg

SEQ ID NO: 3561189 - DNA, 13 bp, Homo sapiens
gacagcttcctca

SEQ ID NO: 3561190 - DNA, 20 bp, Homo sapiens
gacagcttcctcacacccct

SEQ ID NO: 3561191 - DNA, 12 bp, Homo sapiens
gacagctttgct

SEQ ID NO: 3561192 - DNA, 15 bp, Homo sapiens
gacagctttgctgct

SEQ ID NO: 3561193 - DNA, 16 bp, Homo sapiens
gacagctttgctgctg

SEQ ID NO: 3561194 - DNA, 15 bp, Homo sapiens
gacaggaccccagct

SEQ ID NO: 3561195 - DNA, 16 bp, Homo sapiens
gacaggaccccagctc

SEQ ID NO: 3561196 - DNA, 18 bp, Homo sapiens
gacaggaccccagctctg

SEQ ID NO: 3561197 - DNA, 20 bp, Homo sapiens
gacaggaccccagctctgcg

SEQ ID NO: 3561198 - DNA, 17 bp, Homo sapiens
gacaggaccctcaggaa

SEQ ID NO: 3561199 - DNA, 22 bp, Homo sapiens
gacaggaccctcaggaattcag

SEQ ID NO: 3561200 - DNA, 22 bp, Homo sapiens
gacaggagatgctgtgcccctg

SEQ ID NO: 3561201 - DNA, 11 bp, Homo sapiens
gacaggagcct

SEQ ID NO: 3561202 - DNA, 19 bp, Homo sapiens
gacaggagcctagcggagc

SEQ ID NO: 3561203 - DNA, 13 bp, Homo sapiens
gacaggcactcca

SEQ ID NO: 3561204 - DNA, 15 bp, Homo sapiens
gacaggccctccctg

SEQ ID NO: 3561205 - DNA, 18 bp, Homo sapiens
gacaggctcgtcagccac

SEQ ID NO: 3561206 - DNA, 22 bp, Homo sapiens
gacaggctcgtcagccacctgg

SEQ ID NO: 3561207 - DNA, 20 bp, Homo sapiens
gacaggtgcctaacctggga

SEQ ID NO: 3561208 - DNA, 15 bp, Homo sapiens
gacagtcagctgtgg

SEQ ID NO: 3561209 - DNA, 20 bp, Homo sapiens
gacagtcagctgtggggaac

SEQ ID NO: 3561210 - DNA, 15 bp, Homo sapiens
gacagtcctttccca

SEQ ID NO: 3561211 - DNA, 14 bp, Homo sapiens
gacagtgccatccc

SEQ ID NO: 3561212 - DNA, 21 bp, Homo sapiens
gacagtgccatccccaccttc

SEQ ID NO: 3561213 - DNA, 23 bp, Homo sapiens
gacagtgttgaaaatgttcagaa

SEQ ID NO: 3561214 - DNA, 14 bp, Homo sapiens
gacagttcaagaaa

SEQ ID NO: 3561215 - DNA, 17 bp, Homo sapiens
gacataaacaaagacat

SEQ ID NO: 3561216 - DNA, 14 bp, Homo sapiens
gacatactgctgga

SEQ ID NO: 3561217 - DNA, 23 bp, Homo sapiens
gacatacttgaagggccagagcc

SEQ ID NO: 3561218 - DNA, 17 bp, Homo sapiens
gacatatcacatgtcag

SEQ ID NO: 3561219 - DNA, 18 bp, Homo sapiens
gacatatcacatgtcagc

SEQ ID NO: 3561220 - DNA, 21 bp, Homo sapiens
gacatatgggatattcccaag

SEQ ID NO: 3561221 - DNA, 22 bp, Homo sapiens
gacatcacttgtacaaaataaa

SEQ ID NO: 3561222 - DNA, 22 bp, Homo sapiens
gacatccagcagatttccagcc

SEQ ID NO: 3561223 - DNA, 23 bp, Homo sapiens
gacatccatgttccgagaagaac

SEQ ID NO: 3561224 - DNA, 23 bp, Homo sapiens
gacatccccccgccaaaagctgc

SEQ ID NO: 3561225 - DNA, 13 bp, Homo sapiens
gacatcccttcct

SEQ ID NO: 3561226 - DNA, 14 bp, Homo sapiens
gacatcccttcctg

SEQ ID NO: 3561227 - DNA, 16 bp, Homo sapiens
gacatcccttcctgga

SEQ ID NO: 3561228 - DNA, 22 bp, Homo sapiens
gacatcccttcctggaaacagc

SEQ ID NO: 3561229 - DNA, 14 bp, Homo sapiens
gacatgcactcagc

SEQ ID NO: 3561230 - DNA, 22 bp, Homo sapiens
gacatgcagttatatattttgt

SEQ ID NO: 3561231 - DNA, 13 bp, Homo sapiens
gaggaccaatgct

SEQ ID NO: 3561232 - DNA, 20 bp, Homo sapiens
gaggaccaatgcttgcatgg

SEQ ID NO: 3561233 - DNA, 18 bp, Homo sapiens
gaggactcacttgcccac

SEQ ID NO: 3561234 - DNA, 15 bp, Homo sapiens
gaggactgtgacaga

SEQ ID NO: 3561235 - DNA, 16 bp, Homo sapiens
gaggacttgtgtctct

SEQ ID NO: 3561236 - DNA, 18 bp, Homo sapiens
gaggacttgtgtctctgt

SEQ ID NO: 3561237 - DNA, 22 bp, Homo sapiens
gaggacttgtgtctctgtgctt

SEQ ID NO: 3561238 - DNA, 13 bp, Homo sapiens
gaggagagaggag

SEQ ID NO: 3561239 - DNA, 20 bp, Homo sapiens
gaggagagaggaggaaaagt

SEQ ID NO: 3561240 - DNA, 17 bp, Homo sapiens
gaggagataaggtggct

SEQ ID NO: 3561241 - DNA, 13 bp, Homo sapiens
gaggagcctctgg

SEQ ID NO: 3561242 - DNA, 16 bp, Homo sapiens
gaggagcgcaggcagc

SEQ ID NO: 3561243 - DNA, 16 bp, Homo sapiens
gaggagcttctcccag

SEQ ID NO: 3561244 - DNA, 22 bp, Homo sapiens
gaggagcttctcccagtgtgag

SEQ ID NO: 3561245 - DNA, 16 bp, Homo sapiens
gaggaggcctgtccca

SEQ ID NO: 3561246 - DNA, 17 bp, Homo sapiens
gaggaggggccgctgcc

SEQ ID NO: 3561247 - DNA, 13 bp, Homo sapiens
gaggatacagagg

SEQ ID NO: 3561248 - DNA, 13 bp, Homo sapiens
gaggataggacag

SEQ ID NO: 3561249 - DNA, 16 bp, Homo sapiens
gaggatccagggcagc

SEQ ID NO: 3561250 - DNA, 13 bp, Homo sapiens
gaggcaaaagaag

SEQ ID NO: 3561251 - DNA, 15 bp, Homo sapiens
gaggcaaaggcctgg

SEQ ID NO: 3561252 - DNA, 14 bp, Homo sapiens
gaggcaacaggatt

SEQ ID NO: 3561253 - DNA, 13 bp, Homo sapiens
gaggcaagccctg

SEQ ID NO: 3561254 - DNA, 14 bp, Homo sapiens
gaggccaaccagcc

SEQ ID NO: 3561255 - DNA, 14 bp, Homo sapiens
gaggccaccccaaa

SEQ ID NO: 3561256 - DNA, 16 bp, Homo sapiens
gaggccatctcaggag

SEQ ID NO: 3561257 - DNA, 17 bp, Homo sapiens
gaggccatctcaggaga

SEQ ID NO: 3561258 - DNA, 18 bp, Homo sapiens
gaggccatctcaggagat

SEQ ID NO: 3561259 - DNA, 14 bp, Homo sapiens
gaggccatctggag

SEQ ID NO: 3561260 - DNA, 18 bp, Homo sapiens
gaggccatctggagagcc

SEQ ID NO: 3561261 - DNA, 22 bp, Homo sapiens
gaggccatctggagagcccaga

SEQ ID NO: 3561262 - DNA, 17 bp, Homo sapiens
gaggcccagagagggaa

SEQ ID NO: 3561263 - DNA, 20 bp, Homo sapiens
gaggcccagttcaccctgat

SEQ ID NO: 3561264 - DNA, 13 bp, Homo sapiens
gaggcccctaggt

SEQ ID NO: 3561265 - DNA, 20 bp, Homo sapiens
gaggcccctaggtgcccagg

SEQ ID NO: 3561266 - DNA, 22 bp, Homo sapiens
gaggcccctatgtagtccgtgc

SEQ ID NO: 3561267 - DNA, 12 bp, Homo sapiens
gaggccctggag

SEQ ID NO: 3561268 - DNA, 13 bp, Homo sapiens
gaggccctggagg

SEQ ID NO: 3561269 - DNA, 18 bp, Homo sapiens
gaggccgaggtgggcaga

SEQ ID NO: 3561270 - DNA, 22 bp, Homo sapiens
gaggcctctcattccagaggaa

SEQ ID NO: 3561271 - DNA, 20 bp, Homo sapiens
gaggcctgctgccagtgcag

SEQ ID NO: 3561272 - DNA, 22 bp, Homo sapiens
gaggcgtactacccagctctgt

SEQ ID NO: 3561273 - DNA, 13 bp, Homo sapiens
gaggctcagagag

SEQ ID NO: 3561274 - DNA, 16 bp, Homo sapiens
gaggctcctctaggcc

SEQ ID NO: 3561275 - DNA, 21 bp, Homo sapiens
gaggctcctctaggccctgtg

SEQ ID NO: 3561276 - DNA, 17 bp, Homo sapiens
gaggctgacatgctcac

SEQ ID NO: 3561277 - DNA, 13 bp, Homo sapiens
gaggctgaggcag

SEQ ID NO: 3561278 - DNA, 15 bp, Homo sapiens
gaggctgaggcagga

SEQ ID NO: 3561279 - DNA, 19 bp, Homo sapiens
gaggctggagttggggcag

SEQ ID NO: 3561280 - DNA, 19 bp, Homo sapiens
gagggaaaaggcaggtgct

SEQ ID NO: 3561281 - DNA, 23 bp, Homo sapiens
gagggaagacctgaaagagagga

SEQ ID NO: 3561282 - DNA, 19 bp, Homo sapiens
gagggaagatgacctgccc

SEQ ID NO: 3561283 - DNA, 15 bp, Homo sapiens
gagggaagggagcca

SEQ ID NO: 3561284 - DNA, 17 bp, Homo sapiens
gagggaatctagcccaa

SEQ ID NO: 3561285 - DNA, 16 bp, Homo sapiens
gagggacaggctgaag

SEQ ID NO: 3561286 - DNA, 15 bp, Homo sapiens
gagggacatagaatc

SEQ ID NO: 3561287 - DNA, 20 bp, Homo sapiens
gagggacatagaatctgtga

SEQ ID NO: 3561288 - DNA, 14 bp, Homo sapiens
gagggacctctccc

SEQ ID NO: 3561289 - DNA, 15 bp, Homo sapiens
gagggaggcggcctc

SEQ ID NO: 3561290 - DNA, 14 bp, Homo sapiens
gagggatgaccttc

SEQ ID NO: 3561291 - DNA, 12 bp, Homo sapiens
gagggatgatga

SEQ ID NO: 3561292 - DNA, 23 bp, Homo sapiens
gagggattttgttcaagtttgct

SEQ ID NO: 3561293 - DNA, 13 bp, Homo sapiens
gagggcagctggc

SEQ ID NO: 3561294 - DNA, 15 bp, Homo sapiens
gagggcagctggccc

SEQ ID NO: 3561295 - DNA, 13 bp, Homo sapiens
gagggcaggaccc

SEQ ID NO: 3561296 - DNA, 19 bp, Homo sapiens
gagggccaccggtgggcag

SEQ ID NO: 3561297 - DNA, 13 bp, Homo sapiens
gagggcccagccc

SEQ ID NO: 3561298 - DNA, 19 bp, Homo sapiens
gagggcccagcccagagcc

SEQ ID NO: 3561299 - DNA, 17 bp, Homo sapiens
gagggccctgagctgag

SEQ ID NO: 3561300 - DNA, 20 bp, Homo sapiens
gagggccggttctaaggctc

SEQ ID NO: 3561301 - DNA, 23 bp, Homo sapiens
gagggcgaccccgtcacagcctc

SEQ ID NO: 3561302 - DNA, 17 bp, Homo sapiens
gagggctcagggcagtg

SEQ ID NO: 3561303 - DNA, 16 bp, Homo sapiens
gagggcttggggctgc

SEQ ID NO: 3561304 - DNA, 21 bp, Homo sapiens
gaggggaccaattctggacag

SEQ ID NO: 3561305 - DNA, 13 bp, Homo sapiens
gaggggatccagc

SEQ ID NO: 3561306 - DNA, 17 bp, Homo sapiens
gaggggatgataaagga

SEQ ID NO: 3561307 - DNA, 13 bp, Homo sapiens
gaggggccctggc

SEQ ID NO: 3561308 - DNA, 14 bp, Homo sapiens
gaggggcctggcag

SEQ ID NO: 3561309 - DNA, 20 bp, Homo sapiens
gagggggactaaactcaacc

SEQ ID NO: 3561310 - DNA, 16 bp, Homo sapiens
gagggtccacctggag

SEQ ID NO: 3561311 - DNA, 17 bp, Homo sapiens
gagggtccacctggaga

SEQ ID NO: 3561312 - DNA, 18 bp, Homo sapiens
gagggtcgtgggaaaggg

SEQ ID NO: 3561313 - DNA, 15 bp, Homo sapiens
gagggtctcccctcc

SEQ ID NO: 3561314 - DNA, 13 bp, Homo sapiens
gagggttgctggt

SEQ ID NO: 3561315 - DNA, 16 bp, Homo sapiens
gagggttggagtgctc

SEQ ID NO: 3561316 - DNA, 17 bp, Homo sapiens
gagggttggagtgctct

SEQ ID NO: 3561317 - DNA, 17 bp, Homo sapiens
gaggtagcactctcaga

SEQ ID NO: 3561318 - DNA, 22 bp, Homo sapiens
gaggtattcaatatcctttgcc

SEQ ID NO: 3561319 - DNA, 12 bp, Homo sapiens
gaggtcactgct

SEQ ID NO: 3561320 - DNA, 22 bp, Homo sapiens
gaggtcatctggcggaggtctc

SEQ ID NO: 3561321 - DNA, 14 bp, Homo sapiens
gaggtccaagcaga

SEQ ID NO: 3561322 - DNA, 23 bp, Homo sapiens
gaggtcctccgtagggtctttct

SEQ ID NO: 3561323 - DNA, 21 bp, Homo sapiens
gaggtctccaggggcctgcag

SEQ ID NO: 3561324 - DNA, 21 bp, Homo sapiens
gaggtctgattggctgcttaa

SEQ ID NO: 3561325 - DNA, 13 bp, Homo sapiens
gaggtctgtttaa

SEQ ID NO: 3561326 - DNA, 23 bp, Homo sapiens
gaggtcttggccgactcagggac

SEQ ID NO: 3561327 - DNA, 15 bp, Homo sapiens
gaggtgaactccagg

SEQ ID NO: 3561328 - DNA, 19 bp, Homo sapiens
gaggtgcaaggagtgtaaa

SEQ ID NO: 3561329 - DNA, 20 bp, Homo sapiens
gaggtggctgagcccctgtc

SEQ ID NO: 3561330 - DNA, 11 bp, Homo sapiens
gaggtttgaag

SEQ ID NO: 3561331 - DNA, 19 bp, Homo sapiens
gaggtttgaaggagaatgg

SEQ ID NO: 3561332 - DNA, 20 bp, Homo sapiens
gaggtttgaaggagaatggc

SEQ ID NO: 3561333 - DNA, 14 bp, Homo sapiens
gagtagctgcagcc

SEQ ID NO: 3561334 - DNA, 15 bp, Homo sapiens
gagtagctgcagcct

SEQ ID NO: 3561335 - DNA, 12 bp, Homo sapiens
gagtagctggat

SEQ ID NO: 3561336 - DNA, 15 bp, Homo sapiens
gagtcaaaacaaagc

SEQ ID NO: 3561337 - DNA, 15 bp, Homo sapiens
gagtcaaatccagtg

SEQ ID NO: 3561338 - DNA, 13 bp, Homo sapiens
gagtcacctgctc

SEQ ID NO: 3561339 - DNA, 22 bp, Homo sapiens
gagtcagacatttctttggaaa

SEQ ID NO: 3561340 - DNA, 18 bp, Homo sapiens
gagtcagtgccaggtcct

SEQ ID NO: 3561341 - DNA, 20 bp, Homo sapiens
gagtcattatgtagctgtcg

SEQ ID NO: 3561342 - DNA, 14 bp, Homo sapiens
gagtcatttaaatg

SEQ ID NO: 3561343 - DNA, 16 bp, Homo sapiens
gagtccaatttaagga

SEQ ID NO: 3561344 - DNA, 11 bp, Homo sapiens
gagtccactcc

SEQ ID NO: 3561345 - DNA, 14 bp, Homo sapiens
gagtccctgccatc

SEQ ID NO: 3561346 - DNA, 14 bp, Homo sapiens
gagtctctgccagt

SEQ ID NO: 3561347 - DNA, 14 bp, Homo sapiens
gagtctcttctcca

SEQ ID NO: 3561348 - DNA, 15 bp, Homo sapiens
gagtctcttctccac

SEQ ID NO: 3561349 - DNA, 11 bp, Homo sapiens
gagtctgggat

SEQ ID NO: 3561350 - DNA, 21 bp, Homo sapiens
gagtgagcacacccgtgtgca

SEQ ID NO: 3561351 - DNA, 19 bp, Homo sapiens
gagtgagggggtaaagcag

SEQ ID NO: 3561352 - DNA, 16 bp, Homo sapiens
gagtgagtcacctgct

SEQ ID NO: 3561353 - DNA, 14 bp, Homo sapiens
gagtgcacctgcct

SEQ ID NO: 3561354 - DNA, 17 bp, Homo sapiens
gagtgcacctgcctcca

SEQ ID NO: 3561355 - DNA, 15 bp, Homo sapiens
gagtgctcttcccac

SEQ ID NO: 3561356 - DNA, 22 bp, Homo sapiens
gagtgctcttcccactccagct

SEQ ID NO: 3561357 - DNA, 20 bp, Homo sapiens
gagtggaatagtatcctcca

SEQ ID NO: 3561358 - DNA, 22 bp, Homo sapiens
gagtggaatagtatcctccagg

SEQ ID NO: 3561359 - DNA, 14 bp, Homo sapiens
gagtggcagcagcc

SEQ ID NO: 3561360 - DNA, 11 bp, Homo sapiens
gagtggcctcc

SEQ ID NO: 3561361 - DNA, 14 bp, Homo sapiens
gagtggcctccctg

SEQ ID NO: 3561362 - DNA, 19 bp, Homo sapiens
gagtggcgtggcctcccca

SEQ ID NO: 3561363 - DNA, 21 bp, Homo sapiens
gagtgggaagggagcattgca

SEQ ID NO: 3561364 - DNA, 20 bp, Homo sapiens
gagtgggccccgggctggag

SEQ ID NO: 3561365 - DNA, 19 bp, Homo sapiens
gcaccagacacccaggact

SEQ ID NO: 3561366 - DNA, 20 bp, Homo sapiens
gcaccagacacccaggactt

SEQ ID NO: 3561367 - DNA, 21 bp, Homo sapiens
gcaccaggggccaacctcagg

SEQ ID NO: 3561368 - DNA, 20 bp, Homo sapiens
gcaccatctctgattttcaa

SEQ ID NO: 3561369 - DNA, 12 bp, Homo sapiens
gcacccagagca

SEQ ID NO: 3561370 - DNA, 22 bp, Homo sapiens
gcacccagagcaccccctgctc

SEQ ID NO: 3561371 - DNA, 21 bp, Homo sapiens
gcaccccctgctccaccagca

SEQ ID NO: 3561372 - DNA, 14 bp, Homo sapiens
gcaccccttcctgg

SEQ ID NO: 3561373 - DNA, 23 bp, Homo sapiens
gcaccccttcctgggcacacgct

SEQ ID NO: 3561374 - DNA, 18 bp, Homo sapiens
gcaccctgcgcctccaga

SEQ ID NO: 3561375 - DNA, 20 bp, Homo sapiens
gcaccctgcgcctccagagg

SEQ ID NO: 3561376 - DNA, 18 bp, Homo sapiens
gcaccgccacgtcccagc

SEQ ID NO: 3561377 - DNA, 13 bp, Homo sapiens
gcaccgtccaggc

SEQ ID NO: 3561378 - DNA, 16 bp, Homo sapiens
gcacctaatccaggca

SEQ ID NO: 3561379 - DNA, 14 bp, Homo sapiens
gcacctcctaccct

SEQ ID NO: 3561380 - DNA, 21 bp, Homo sapiens
gcacctcctaccctcccacca

SEQ ID NO: 3561381 - DNA, 14 bp, Homo sapiens
gcaccttccccctc

SEQ ID NO: 3561382 - DNA, 16 bp, Homo sapiens
gcacgcaggcacagca

SEQ ID NO: 3561383 - DNA, 18 bp, Homo sapiens
gcacgctcaatgcccagt

SEQ ID NO: 3561384 - DNA, 23 bp, Homo sapiens
gcacgctcaatgcccagtaaaat

SEQ ID NO: 3561385 - DNA, 14 bp, Homo sapiens
gcacgtggggccca

SEQ ID NO: 3561386 - DNA, 17 bp, Homo sapiens
gcacgtggggcccactg

SEQ ID NO: 3561387 - DNA, 18 bp, Homo sapiens
gcacgtggggcccactgc

SEQ ID NO: 3561388 - DNA, 22 bp, Homo sapiens
gcactaaaatgaggatccaggg

SEQ ID NO: 3561389 - DNA, 23 bp, Homo sapiens
gcactaaaatgaggatccagggc

SEQ ID NO: 3561390 - DNA, 14 bp, Homo sapiens
gcactaaggggccc

SEQ ID NO: 3561391 - DNA, 14 bp, Homo sapiens
gcactccaaacctg

SEQ ID NO: 3561392 - DNA, 11 bp, Homo sapiens
gcactccagac

SEQ ID NO: 3561393 - DNA, 12 bp, Homo sapiens
gcactccagact

SEQ ID NO: 3561394 - DNA, 18 bp, Homo sapiens
gcactcccacctgacaca

SEQ ID NO: 3561395 - DNA, 21 bp, Homo sapiens
gcactccccagagctgtgcca

SEQ ID NO: 3561396 - DNA, 22 bp, Homo sapiens
gcactccccagagctgtgccag

SEQ ID NO: 3561397 - DNA, 19 bp, Homo sapiens
gcactcctttatctgtaat

SEQ ID NO: 3561398 - DNA, 20 bp, Homo sapiens
gcactctccccgctcagggg

SEQ ID NO: 3561399 - DNA, 22 bp, Homo sapiens
gcactgaaccacattcagggaa

SEQ ID NO: 3561400 - DNA, 16 bp, Homo sapiens
gcactgaagtttttga

SEQ ID NO: 3561401 - DNA, 18 bp, Homo sapiens
gcactgaagtttttgaaa

SEQ ID NO: 3561402 - DNA, 15 bp, Homo sapiens
gcactgagcagggat

SEQ ID NO: 3561403 - DNA, 16 bp, Homo sapiens
gcactgaggatttctt

SEQ ID NO: 3561404 - DNA, 13 bp, Homo sapiens
gcactgatgctgc

SEQ ID NO: 3561405 - DNA, 19 bp, Homo sapiens
gcactgatgctgcccctca

SEQ ID NO: 3561406 - DNA, 22 bp, Homo sapiens
gcactgatgctgcccctcatct

SEQ ID NO: 3561407 - DNA, 19 bp, Homo sapiens
gcactgcattcctgtgccc

SEQ ID NO: 3561408 - DNA, 21 bp, Homo sapiens
gcactgcctgcatgagctggc

SEQ ID NO: 3561409 - DNA, 22 bp, Homo sapiens
gcactgcctgcatgagctggca

SEQ ID NO: 3561410 - DNA, 12 bp, Homo sapiens
gcactgctgccc

SEQ ID NO: 3561411 - DNA, 15 bp, Homo sapiens
gcactgctgcccagc

SEQ ID NO: 3561412 - DNA, 20 bp, Homo sapiens
gcactgctgcccagcctcca

SEQ ID NO: 3561413 - DNA, 19 bp, Homo sapiens
gcactggtggcccgacagc

SEQ ID NO: 3561414 - DNA, 23 bp, Homo sapiens
gcactggtggcccgacagcctgg

SEQ ID NO: 3561415 - DNA, 24 bp, Homo sapiens
gcactggtggcccgacagcctggc

SEQ ID NO: 3561416 - DNA, 11 bp, Homo sapiens
gcactgtgaag

SEQ ID NO: 3561417 - DNA, 14 bp, Homo sapiens
gcactgtgaaggac

SEQ ID NO: 3561418 - DNA, 22 bp, Homo sapiens
gcacttacacttataaaataac

SEQ ID NO: 3561419 - DNA, 15 bp, Homo sapiens
gcacttagcaggcac

SEQ ID NO: 3561420 - DNA, 23 bp, Homo sapiens
gcacttgagaaccagtctcctca

SEQ ID NO: 3561421 - DNA, 15 bp, Homo sapiens
gcacttttttaaata

SEQ ID NO: 3561422 - DNA, 20 bp, Homo sapiens
gcagaaaccaacaagaacca

SEQ ID NO: 3561423 - DNA, 19 bp, Homo sapiens
gcagaaagcatccctcacc

SEQ ID NO: 3561424 - DNA, 19 bp, Homo sapiens
gcagaacccaccaaccaga

SEQ ID NO: 3561425 - DNA, 23 bp, Homo sapiens
gcagaaggaaagaagggggccct

SEQ ID NO: 3561426 - DNA, 23 bp, Homo sapiens
gcagaatcctaggctccacccca

SEQ ID NO: 3561427 - DNA, 13 bp, Homo sapiens
gcagacagacaat

SEQ ID NO: 3561428 - DNA, 20 bp, Homo sapiens
gcagacatggtggggtctcc

SEQ ID NO: 3561429 - DNA, 19 bp, Homo sapiens
gcagacccagtcccacact

SEQ ID NO: 3561430 - DNA, 14 bp, Homo sapiens
gcagacctggagct

SEQ ID NO: 3561431 - DNA, 21 bp, Homo sapiens
gcagacggtctgtgtgctgtt

SEQ ID NO: 3561432 - DNA, 23 bp, Homo sapiens
gcagactagagtctgagatgccc

SEQ ID NO: 3561433 - DNA, 20 bp, Homo sapiens
gcagagaccataagagaaac

SEQ ID NO: 3561434 - DNA, 22 bp, Homo sapiens
gcagagaccataagagaaacct

SEQ ID NO: 3561435 - DNA, 13 bp, Homo sapiens
gcagagaggctgt

SEQ ID NO: 3561436 - DNA, 12 bp, Homo sapiens
gcagagcctcct

SEQ ID NO: 3561437 - DNA, 13 bp, Homo sapiens
gcagagcctcctg

SEQ ID NO: 3561438 - DNA, 17 bp, Homo sapiens
gcagagcctcctgggaa

SEQ ID NO: 3561439 - DNA, 20 bp, Homo sapiens
gcagagcctttttacctggc

SEQ ID NO: 3561440 - DNA, 12 bp, Homo sapiens
gcagaggagggg

SEQ ID NO: 3561441 - DNA, 23 bp, Homo sapiens
gcagaggggcgttctcccaaaga

SEQ ID NO: 3561442 - DNA, 23 bp, Homo sapiens
gcagagggggagtagccaagctg

SEQ ID NO: 3561443 - DNA, 20 bp, Homo sapiens
gcagagtggcgtggcctccc

SEQ ID NO: 3561444 - DNA, 17 bp, Homo sapiens
gcagagttacagttctg

SEQ ID NO: 3561445 - DNA, 22 bp, Homo sapiens
gcagatattctctagtcatttg

SEQ ID NO: 3561446 - DNA, 21 bp, Homo sapiens
gcagatgctgttgtgaagcta

SEQ ID NO: 3561447 - DNA, 19 bp, Homo sapiens
gcagatttctctttagcct

SEQ ID NO: 3561448 - DNA, 17 bp, Homo sapiens
gcagatttgatatttgc

SEQ ID NO: 3561449 - DNA, 17 bp, Homo sapiens
gcagcaataatttctgt

SEQ ID NO: 3561450 - DNA, 17 bp, Homo sapiens
gcagcaatttaaatgtt

SEQ ID NO: 3561451 - DNA, 16 bp, Homo sapiens
gcagcaccgcctcttc

SEQ ID NO: 3561452 - DNA, 13 bp, Homo sapiens
gcagcactcccca

SEQ ID NO: 3561453 - DNA, 16 bp, Homo sapiens
gcagcactccccagag

SEQ ID NO: 3561454 - DNA, 13 bp, Homo sapiens
gcagcagcaccaa

SEQ ID NO: 3561455 - DNA, 16 bp, Homo sapiens
gcagcaggaaggaaca

SEQ ID NO: 3561456 - DNA, 19 bp, Homo sapiens
gcagcaggaggggggaggg

SEQ ID NO: 3561457 - DNA, 13 bp, Homo sapiens
gcagcaggcctct

SEQ ID NO: 3561458 - DNA, 17 bp, Homo sapiens
gcagcaggcctctggga

SEQ ID NO: 3561459 - DNA, 17 bp, Homo sapiens
gcagcaggctcaggcac

SEQ ID NO: 3561460 - DNA, 19 bp, Homo sapiens
gcagcagtcgcccaagcag

SEQ ID NO: 3561461 - DNA, 23 bp, Homo sapiens
gcagcatgcttgggctgacccag

SEQ ID NO: 3561462 - DNA, 12 bp, Homo sapiens
gcagcatggaaa

SEQ ID NO: 3561463 - DNA, 17 bp, Homo sapiens
gcagcatggaaaaatgg

SEQ ID NO: 3561464 - DNA, 23 bp, Homo sapiens
gcagcatggaaaaatggttgatg

SEQ ID NO: 3561465 - DNA, 16 bp, Homo sapiens
gcagcatggcatagcc

SEQ ID NO: 3561466 - DNA, 19 bp, Homo sapiens
gcagcatttactatgcaca

SEQ ID NO: 3561467 - DNA, 20 bp, Homo sapiens
gcagcatttactatgcacaa

SEQ ID NO: 3561468 - DNA, 12 bp, Homo sapiens
gcagccagcaga

SEQ ID NO: 3561469 - DNA, 12 bp, Homo sapiens
gcagcccaggcc

SEQ ID NO: 3561470 - DNA, 13 bp, Homo sapiens
gcagcccaggcca

SEQ ID NO: 3561471 - DNA, 12 bp, Homo sapiens
gcagcccagggc

SEQ ID NO: 3561472 - DNA, 14 bp, Homo sapiens
gcagccccaggaga

SEQ ID NO: 3561473 - DNA, 16 bp, Homo sapiens
gcagccccagggcctg

SEQ ID NO: 3561474 - DNA, 18 bp, Homo sapiens
gcagccccagggcctgcg

SEQ ID NO: 3561475 - DNA, 14 bp, Homo sapiens
gcagccccccttgc

SEQ ID NO: 3561476 - DNA, 24 bp, Homo sapiens
gcagccctgctttgggctgccctg

SEQ ID NO: 3561477 - DNA, 21 bp, Homo sapiens
gcagcccttgctttcggagct

SEQ ID NO: 3561478 - DNA, 18 bp, Homo sapiens
gcagccgcagagaaatgc

SEQ ID NO: 3561479 - DNA, 22 bp, Homo sapiens
gcagccgcagagaaatgcccca

SEQ ID NO: 3561480 - DNA, 18 bp, Homo sapiens
gcagccgtgccttcagct

SEQ ID NO: 3561481 - DNA, 21 bp, Homo sapiens
gcagcctaagaagaaggccag

SEQ ID NO: 3561482 - DNA, 22 bp, Homo sapiens
gcagcctaagaagaaggccaga

SEQ ID NO: 3561483 - DNA, 23 bp, Homo sapiens
gcagcctaagaagaaggccagag

SEQ ID NO: 3561484 - DNA, 21 bp, Homo sapiens
gcagcctccgggcgtgtgaag

SEQ ID NO: 3561485 - DNA, 20 bp, Homo sapiens
gcagcctctccgactctgca

SEQ ID NO: 3561486 - DNA, 18 bp, Homo sapiens
gcagccttcatcagaact

SEQ ID NO: 3561487 - DNA, 13 bp, Homo sapiens
gcagcgaccccag

SEQ ID NO: 3561488 - DNA, 14 bp, Homo sapiens
gcagcgaccccagg

SEQ ID NO: 3561489 - DNA, 15 bp, Homo sapiens
gcagcgaccccagga

SEQ ID NO: 3561490 - DNA, 19 bp, Homo sapiens
gcagcgcagggctggcacg

SEQ ID NO: 3561491 - DNA, 15 bp, Homo sapiens
gcagctagtgccttt

SEQ ID NO: 3561492 - DNA, 20 bp, Homo sapiens
gcagctcaagggctggcact

SEQ ID NO: 3561493 - DNA, 12 bp, Homo sapiens
gcagctcctcag

SEQ ID NO: 3561494 - DNA, 14 bp, Homo sapiens
gcagctcctcagcg

SEQ ID NO: 3561495 - DNA, 13 bp, Homo sapiens
gcagctgcctagg

SEQ ID NO: 3561496 - DNA, 23 bp, Homo sapiens
gcccttgctttcggagctcctgt

SEQ ID NO: 3561497 - DNA, 17 bp, Homo sapiens
gcccttggaacaccctg

SEQ ID NO: 3561498 - DNA, 19 bp, Homo sapiens
gcccttggaacaccctgga

SEQ ID NO: 3561499 - DNA, 21 bp, Homo sapiens
gcccttggaacaccctggatg

SEQ ID NO: 3561500 - DNA, 16 bp, Homo sapiens
gcccttggccatgggt

SEQ ID NO: 3561501 - DNA, 13 bp, Homo sapiens
gccgaagcccagg

SEQ ID NO: 3561502 - DNA, 13 bp, Homo sapiens
gccgaccttccct

SEQ ID NO: 3561503 - DNA, 13 bp, Homo sapiens
gccgactcaggga

SEQ ID NO: 3561504 - DNA, 15 bp, Homo sapiens
gccgaggtgggcaga

SEQ ID NO: 3561505 - DNA, 16 bp, Homo sapiens
gccgcagacctggagc

SEQ ID NO: 3561506 - DNA, 17 bp, Homo sapiens
gccgcagacctggagct

SEQ ID NO: 3561507 - DNA, 14 bp, Homo sapiens
gccgcagagaaatg

SEQ ID NO: 3561508 - DNA, 21 bp, Homo sapiens
gccgcagagaaatgccccagt

SEQ ID NO: 3561509 - DNA, 18 bp, Homo sapiens
gccgccacggcctggctg

SEQ ID NO: 3561510 - DNA, 15 bp, Homo sapiens
gccgccgccgccgcc

SEQ ID NO: 3561511 - DNA, 15 bp, Homo sapiens
gccgccgccgctgcc

SEQ ID NO: 3561512 - DNA, 19 bp, Homo sapiens
gccgcctgcagcccgtgtc

SEQ ID NO: 3561513 - DNA, 14 bp, Homo sapiens
gccgctgccaccca

SEQ ID NO: 3561514 - DNA, 13 bp, Homo sapiens
gccgctggctggt

SEQ ID NO: 3561515 - DNA, 19 bp, Homo sapiens
gccggagtccactcccagt

SEQ ID NO: 3561516 - DNA, 22 bp, Homo sapiens
gccggcagcgggcggaggggat

SEQ ID NO: 3561517 - DNA, 18 bp, Homo sapiens
gccggctctgggcctgag

SEQ ID NO: 3561518 - DNA, 19 bp, Homo sapiens
gccggctctgggcctgagg

SEQ ID NO: 3561519 - DNA, 14 bp, Homo sapiens
gccggctgagtggc

SEQ ID NO: 3561520 - DNA, 16 bp, Homo sapiens
gccggctgagtggcag

SEQ ID NO: 3561521 - DNA, 13 bp, Homo sapiens
gccgggagcgagt

SEQ ID NO: 3561522 - DNA, 23 bp, Homo sapiens
gccgggagcgagtaaagtctggg

SEQ ID NO: 3561523 - DNA, 17 bp, Homo sapiens
gccgggcagggtgtggg

SEQ ID NO: 3561524 - DNA, 20 bp, Homo sapiens
gccggggctctgggtgctgc

SEQ ID NO: 3561525 - DNA, 22 bp, Homo sapiens
gccggggtgtaacttcctgctg

SEQ ID NO: 3561526 - DNA, 24 bp, Homo sapiens
gccggggtgtaacttcctgctgca

SEQ ID NO: 3561527 - DNA, 18 bp, Homo sapiens
gccggtcgggcagccagc

SEQ ID NO: 3561528 - DNA, 15 bp, Homo sapiens
gccgtaggggctcct

SEQ ID NO: 3561529 - DNA, 17 bp, Homo sapiens
gccgtaggggctcctga

SEQ ID NO: 3561530 - DNA, 19 bp, Homo sapiens
gccgtaggggctcctgagt

SEQ ID NO: 3561531 - DNA, 13 bp, Homo sapiens
gccgtcacacgta

SEQ ID NO: 3561532 - DNA, 18 bp, Homo sapiens
gccgtccggcggccccgc

SEQ ID NO: 3561533 - DNA, 17 bp, Homo sapiens
gccgtgccttcagctct

SEQ ID NO: 3561534 - DNA, 19 bp, Homo sapiens
gccgtgccttcagctctac

SEQ ID NO: 3561535 - DNA, 11 bp, Homo sapiens
gccgtggcttc

SEQ ID NO: 3561536 - DNA, 13 bp, Homo sapiens
gccgtggcttccc

SEQ ID NO: 3561537 - DNA, 21 bp, Homo sapiens
gccgtggcttcccgctcagcc

SEQ ID NO: 3561538 - DNA, 15 bp, Homo sapiens
gccgtgtctcagcct

SEQ ID NO: 3561539 - DNA, 18 bp, Homo sapiens
gcctaactaactggcagg

SEQ ID NO: 3561540 - DNA, 21 bp, Homo sapiens
gcctaagaagaaggccagaga

SEQ ID NO: 3561541 - DNA, 17 bp, Homo sapiens
gcctaagaccctgaatc

SEQ ID NO: 3561542 - DNA, 23 bp, Homo sapiens
gcctacctctgtctgagacaggt

SEQ ID NO: 3561543 - DNA, 16 bp, Homo sapiens
gcctagagtgtagcct

SEQ ID NO: 3561544 - DNA, 17 bp, Homo sapiens
gcctagcggagcccagc

SEQ ID NO: 3561545 - DNA, 21 bp, Homo sapiens
gcctagcggagcccagcctgg

SEQ ID NO: 3561546 - DNA, 15 bp, Homo sapiens
gcctagctcctgcca

SEQ ID NO: 3561547 - DNA, 20 bp, Homo sapiens
gcctagctcctgccacatgg

SEQ ID NO: 3561548 - DNA, 23 bp, Homo sapiens
gcctagctcctgccacatggagc

SEQ ID NO: 3561549 - DNA, 16 bp, Homo sapiens
gcctaggtgcagctcc

SEQ ID NO: 3561550 - DNA, 18 bp, Homo sapiens
gcctatgaaactggttta

SEQ ID NO: 3561551 - DNA, 22 bp, Homo sapiens
gcctatgatactgtctctccag

SEQ ID NO: 3561552 - DNA, 23 bp, Homo sapiens
gcctatgcaaaaagaggatccgt

SEQ ID NO: 3561553 - DNA, 15 bp, Homo sapiens
gcctattgatacttg

SEQ ID NO: 3561554 - DNA, 21 bp, Homo sapiens
gcctcaaaacgggtcagtatt

SEQ ID NO: 3561555 - DNA, 12 bp, Homo sapiens
gcctcaaaatgt

SEQ ID NO: 3561556 - DNA, 14 bp, Homo sapiens
gcctcaaaatgtgt

SEQ ID NO: 3561557 - DNA, 14 bp, Homo sapiens
gcctcaacctcctg

SEQ ID NO: 3561558 - DNA, 18 bp, Homo sapiens
gcctcaagtcactcccaa

SEQ ID NO: 3561559 - DNA, 24 bp, Homo sapiens
gcctcaccagccccccgcgcgccc

SEQ ID NO: 3561560 - DNA, 22 bp, Homo sapiens
gcctcacctggtcgccaatcca

SEQ ID NO: 3561561 - DNA, 23 bp, Homo sapiens
gcctcagaaggccccagagagac

SEQ ID NO: 3561562 - DNA, 14 bp, Homo sapiens
gcctcagccagaga

SEQ ID NO: 3561563 - DNA, 15 bp, Homo sapiens
gcctcagccagagaa

SEQ ID NO: 3561564 - DNA, 18 bp, Homo sapiens
gcctcagcctcctgagta

SEQ ID NO: 3561565 - DNA, 23 bp, Homo sapiens
gcctcaggacccatccctgcctg

SEQ ID NO: 3561566 - DNA, 12 bp, Homo sapiens
gcctcaggctct

SEQ ID NO: 3561567 - DNA, 13 bp, Homo sapiens
gcctcaggctctg

SEQ ID NO: 3561568 - DNA, 15 bp, Homo sapiens
gcctcaggctctgca

SEQ ID NO: 3561569 - DNA, 21 bp, Homo sapiens
gcctcaggctctgcacagaca

SEQ ID NO: 3561570 - DNA, 21 bp, Homo sapiens
gcctccaacgcccctgtggcc

SEQ ID NO: 3561571 - DNA, 19 bp, Homo sapiens
gcctccacatgctgcctgg

SEQ ID NO: 3561572 - DNA, 12 bp, Homo sapiens
gcctccaccagc

SEQ ID NO: 3561573 - DNA, 21 bp, Homo sapiens
gcctccagtccaaagccggct

SEQ ID NO: 3561574 - DNA, 15 bp, Homo sapiens
gcctccagtgcagtc

SEQ ID NO: 3561575 - DNA, 18 bp, Homo sapiens
gcctcccaaagtgctggg

SEQ ID NO: 3561576 - DNA, 12 bp, Homo sapiens
gcctcccaccag

SEQ ID NO: 3561577 - DNA, 13 bp, Homo sapiens
gcctcccaccaga

SEQ ID NO: 3561578 - DNA, 16 bp, Homo sapiens
gcctcccaccagagcc

SEQ ID NO: 3561579 - DNA, 22 bp, Homo sapiens
gcctcccaccagagccgggagg

SEQ ID NO: 3561580 - DNA, 21 bp, Homo sapiens
gcctccccctcccccattccc

SEQ ID NO: 3561581 - DNA, 17 bp, Homo sapiens
gcctcccctcccctggg

SEQ ID NO: 3561582 - DNA, 21 bp, Homo sapiens
gcctcccctctccttcctgtg

SEQ ID NO: 3561583 - DNA, 23 bp, Homo sapiens
gcctccctgctgtgccatgctgg

SEQ ID NO: 3561584 - DNA, 18 bp, Homo sapiens
gcctccctgtctccagct

SEQ ID NO: 3561585 - DNA, 21 bp, Homo sapiens
gcctccctgtctccagctgcc

SEQ ID NO: 3561586 - DNA, 23 bp, Homo sapiens
gcctccctgtctccagctgcctg

SEQ ID NO: 3561587 - DNA, 14 bp, Homo sapiens
gcctcctcaccccc

SEQ ID NO: 3561588 - DNA, 19 bp, Homo sapiens
gcctcctcacccccagctt

SEQ ID NO: 3561589 - DNA, 21 bp, Homo sapiens
gcctcctcacccccagctttg

SEQ ID NO: 3561590 - DNA, 23 bp, Homo sapiens
gcctcctcatctgggggagtgga

SEQ ID NO: 3561591 - DNA, 22 bp, Homo sapiens
gcctcctcggagagcagcagca

SEQ ID NO: 3561592 - DNA, 21 bp, Homo sapiens
gcctcctgcgccctgtgcccg

SEQ ID NO: 3561593 - DNA, 13 bp, Homo sapiens
gcctcgctccctt

SEQ ID NO: 3561594 - DNA, 15 bp, Homo sapiens
gcctcgctcccttca

SEQ ID NO: 3561595 - DNA, 17 bp, Homo sapiens
gcctcggtatctggctt

SEQ ID NO: 3561596 - DNA, 19 bp, Homo sapiens
gcctcggtatctggcttcc

SEQ ID NO: 3561597 - DNA, 12 bp, Homo sapiens
gcctctccctgg

SEQ ID NO: 3561598 - DNA, 23 bp, Homo sapiens
gcctctccgactctgcacccgcc

SEQ ID NO: 3561599 - DNA, 22 bp, Homo sapiens
gcctctctccttggccacagac

SEQ ID NO: 3561600 - DNA, 15 bp, Homo sapiens
gcctctgacagtcca

SEQ ID NO: 3561601 - DNA, 17 bp, Homo sapiens
gcctctgcagtctcatt

SEQ ID NO: 3561602 - DNA, 21 bp, Homo sapiens
gcctctgcagtctcatttctc

SEQ ID NO: 3561603 - DNA, 12 bp, Homo sapiens
gcctctgcattc

SEQ ID NO: 3561604 - DNA, 13 bp, Homo sapiens
gcctctggcttcc

SEQ ID NO: 3561605 - DNA, 23 bp, Homo sapiens
gcctctgtccgtgccccttccct

SEQ ID NO: 3561606 - DNA, 21 bp, Homo sapiens
gcctctgttcctttctctggg

SEQ ID NO: 3561607 - DNA, 19 bp, Homo sapiens
gcctcttactaatgtaaaa

SEQ ID NO: 3561608 - DNA, 22 bp, Homo sapiens
gcctcttcctccctcattccac

SEQ ID NO: 3561609 - DNA, 13 bp, Homo sapiens
gcctcttctttgt

SEQ ID NO: 3561610 - DNA, 14 bp, Homo sapiens
gcctcttctttgtg

SEQ ID NO: 3561611 - DNA, 16 bp, Homo sapiens
gcctcttctttgtgcc

SEQ ID NO: 3561612 - DNA, 17 bp, Homo sapiens
gcctcttctttgtgcct

SEQ ID NO: 3561613 - DNA, 20 bp, Homo sapiens
gcctcttctttgtgcctttg

SEQ ID NO: 3561614 - DNA, 14 bp, Homo sapiens
gcctgaactgagga

SEQ ID NO: 3561615 - DNA, 20 bp, Homo sapiens
gcctgaagcttcggccgcgc

SEQ ID NO: 3561616 - DNA, 15 bp, Homo sapiens
gcctgacaccccctc

SEQ ID NO: 3561617 - DNA, 14 bp, Homo sapiens
gcctgactagaact

SEQ ID NO: 3561618 - DNA, 18 bp, Homo sapiens
gcctgagaagccccgaca

SEQ ID NO: 3561619 - DNA, 13 bp, Homo sapiens
gcctgagaagggg

SEQ ID NO: 3561620 - DNA, 16 bp, Homo sapiens
gcctgatttcattcct

SEQ ID NO: 3561621 - DNA, 23 bp, Homo sapiens
gcctgcagcccgtgtccaggagc

SEQ ID NO: 3561622 - DNA, 24 bp, Homo sapiens
gcctgcagcccgtgtccaggagcc

SEQ ID NO: 3561623 - DNA, 17 bp, Homo sapiens
gcctgcaggacctcgtg

SEQ ID NO: 3561624 - DNA, 14 bp, Homo sapiens
gcctgcatgagctg

SEQ ID NO: 3561625 - DNA, 17 bp, Homo sapiens
gcctgcatgagctggca

SEQ ID NO: 3561626 - DNA, 18 bp, Homo sapiens
gcctgcatgagctggcaa

SEQ ID NO: 3561627 - DNA, 14 bp, Homo sapiens
gcctgccagctgca

SEQ ID NO: 3561628 - DNA, 17 bp, Homo sapiens
gctgctatagcctgggg

SEQ ID NO: 3561629 - DNA, 20 bp, Homo sapiens
gctgctcagggaaaagcagc

SEQ ID NO: 3561630 - DNA, 15 bp, Homo sapiens
gctgctcatttcact

SEQ ID NO: 3561631 - DNA, 21 bp, Homo sapiens
gctgctcccctaaagccaggc

SEQ ID NO: 3561632 - DNA, 12 bp, Homo sapiens
gctgctctgccc

SEQ ID NO: 3561633 - DNA, 13 bp, Homo sapiens
gctgctgaaacaa

SEQ ID NO: 3561634 - DNA, 16 bp, Homo sapiens
gctgctgccagggctt

SEQ ID NO: 3561635 - DNA, 14 bp, Homo sapiens
gctgctgccttcac

SEQ ID NO: 3561636 - DNA, 15 bp, Homo sapiens
gctgctgctactgct

SEQ ID NO: 3561637 - DNA, 18 bp, Homo sapiens
gctgctggggaagacagt

SEQ ID NO: 3561638 - DNA, 23 bp, Homo sapiens
gctgctggtcagtcgtggagcgc

SEQ ID NO: 3561639 - DNA, 14 bp, Homo sapiens
gctgcttgtcctgg

SEQ ID NO: 3561640 - DNA, 22 bp, Homo sapiens
gctggaaagcagagcctcctgg

SEQ ID NO: 3561641 - DNA, 17 bp, Homo sapiens
gctggaagtacttggcc

SEQ ID NO: 3561642 - DNA, 17 bp, Homo sapiens
gctggaatccagaagga

SEQ ID NO: 3561643 - DNA, 20 bp, Homo sapiens
gctggaatccagaaggaagc

SEQ ID NO: 3561644 - DNA, 13 bp, Homo sapiens
gctggacatactg

SEQ ID NO: 3561645 - DNA, 21 bp, Homo sapiens
gctggacatactgctggagtc

SEQ ID NO: 3561646 - DNA, 17 bp, Homo sapiens
gctggactattgtgcca

SEQ ID NO: 3561647 - DNA, 13 bp, Homo sapiens
gctggagaaagag

SEQ ID NO: 3561648 - DNA, 13 bp, Homo sapiens
gctggagaaagat

SEQ ID NO: 3561649 - DNA, 16 bp, Homo sapiens
gctggagcctggggtg

SEQ ID NO: 3561650 - DNA, 13 bp, Homo sapiens
gctggagtccagt

SEQ ID NO: 3561651 - DNA, 20 bp, Homo sapiens
gctggagttggggcagagga

SEQ ID NO: 3561652 - DNA, 17 bp, Homo sapiens
gctggcaaatccaggct

SEQ ID NO: 3561653 - DNA, 19 bp, Homo sapiens
gctggcaaatccaggctgg

SEQ ID NO: 3561654 - DNA, 12 bp, Homo sapiens
gctggcaaccag

SEQ ID NO: 3561655 - DNA, 22 bp, Homo sapiens
gctggcacaaaagacagctggc

SEQ ID NO: 3561656 - DNA, 18 bp, Homo sapiens
gctggcacgtgacaggct

SEQ ID NO: 3561657 - DNA, 20 bp, Homo sapiens
gctggcacgtgacaggctcg

SEQ ID NO: 3561658 - DNA, 21 bp, Homo sapiens
gctggcatcaagggagacacc

SEQ ID NO: 3561659 - DNA, 13 bp, Homo sapiens
gctggcccagggc

SEQ ID NO: 3561660 - DNA, 20 bp, Homo sapiens
gctggcccagggcccagagc

SEQ ID NO: 3561661 - DNA, 13 bp, Homo sapiens
gctggcccccagc

SEQ ID NO: 3561662 - DNA, 18 bp, Homo sapiens
gctggcccccagccctgg

SEQ ID NO: 3561663 - DNA, 22 bp, Homo sapiens
gctggccggggctctgggtgct

SEQ ID NO: 3561664 - DNA, 16 bp, Homo sapiens
gctggcggaggctgct

SEQ ID NO: 3561665 - DNA, 20 bp, Homo sapiens
gctggctgccttagaacctt

SEQ ID NO: 3561666 - DNA, 21 bp, Homo sapiens
gctgggattataggcatgagc

SEQ ID NO: 3561667 - DNA, 22 bp, Homo sapiens
gctgggattataggcatgagcc

SEQ ID NO: 3561668 - DNA, 17 bp, Homo sapiens
gctgggccctctttccc

SEQ ID NO: 3561669 - DNA, 18 bp, Homo sapiens
gctgggctgggccctctt

SEQ ID NO: 3561670 - DNA, 14 bp, Homo sapiens
gctggggaagacag

SEQ ID NO: 3561671 - DNA, 21 bp, Homo sapiens
gctggggaagacagtggcccc

SEQ ID NO: 3561672 - DNA, 16 bp, Homo sapiens
gctggggacagagggt

SEQ ID NO: 3561673 - DNA, 15 bp, Homo sapiens
gctggggactcaggg

SEQ ID NO: 3561674 - DNA, 16 bp, Homo sapiens
gctggggactcaggga

SEQ ID NO: 3561675 - DNA, 17 bp, Homo sapiens
gctggggactcagggac

SEQ ID NO: 3561676 - DNA, 14 bp, Homo sapiens
gctggggatgtctc

SEQ ID NO: 3561677 - DNA, 14 bp, Homo sapiens
gctggggccgccac

SEQ ID NO: 3561678 - DNA, 18 bp, Homo sapiens
gctggggccgccacggcc

SEQ ID NO: 3561679 - DNA, 16 bp, Homo sapiens
gctggggcctcagacc

SEQ ID NO: 3561680 - DNA, 24 bp, Homo sapiens
gctgggggctgccgagccaccatg

SEQ ID NO: 3561681 - DNA, 18 bp, Homo sapiens
gctgggggtgggccaggc

SEQ ID NO: 3561682 - DNA, 15 bp, Homo sapiens
gctggtaagagaagt

SEQ ID NO: 3561683 - DNA, 17 bp, Homo sapiens
gctggtagatgctgagg

SEQ ID NO: 3561684 - DNA, 15 bp, Homo sapiens
gctggtagcagcagg

SEQ ID NO: 3561685 - DNA, 16 bp, Homo sapiens
gctggtagcagcaggc

SEQ ID NO: 3561686 - DNA, 16 bp, Homo sapiens
gctggtcctgcacatg

SEQ ID NO: 3561687 - DNA, 18 bp, Homo sapiens
gctggtcctgcacatgag

SEQ ID NO: 3561688 - DNA, 19 bp, Homo sapiens
gctggtctcaaactcctga

SEQ ID NO: 3561689 - DNA, 12 bp, Homo sapiens
gctggtggccca

SEQ ID NO: 3561690 - DNA, 15 bp, Homo sapiens
gctggtggcccagga

SEQ ID NO: 3561691 - DNA, 15 bp, Homo sapiens
gctggtggctcccgg

SEQ ID NO: 3561692 - DNA, 12 bp, Homo sapiens
gctggtgggaag

SEQ ID NO: 3561693 - DNA, 21 bp, Homo sapiens
gctggtgggaaggccggcagc

SEQ ID NO: 3561694 - DNA, 23 bp, Homo sapiens
gctggtttctgagagagtgccat

SEQ ID NO: 3561695 - DNA, 22 bp, Homo sapiens
gctgtaaatcctagacttgaaa

SEQ ID NO: 3561696 - DNA, 12 bp, Homo sapiens
gctgtaagggca

SEQ ID NO: 3561697 - DNA, 14 bp, Homo sapiens
gctgtaagggcagt

SEQ ID NO: 3561698 - DNA, 17 bp, Homo sapiens
gctgtaatgacaaaaga

SEQ ID NO: 3561699 - DNA, 19 bp, Homo sapiens
gctgtaatgacaaaagata

SEQ ID NO: 3561700 - DNA, 18 bp, Homo sapiens
gctgtactaacccagtct

SEQ ID NO: 3561701 - DNA, 21 bp, Homo sapiens
gctgtcaagccatttttacat

SEQ ID NO: 3561702 - DNA, 20 bp, Homo sapiens
gctgtccttaacccacctct

SEQ ID NO: 3561703 - DNA, 18 bp, Homo sapiens
gctgtctctgaggggtgg

SEQ ID NO: 3561704 - DNA, 19 bp, Homo sapiens
gctgtctctgaggggtggg

SEQ ID NO: 3561705 - DNA, 15 bp, Homo sapiens
gctgtctggccctgg

SEQ ID NO: 3561706 - DNA, 12 bp, Homo sapiens
gctgtctgtctc

SEQ ID NO: 3561707 - DNA, 14 bp, Homo sapiens
gctgtctgtctcta

SEQ ID NO: 3561708 - DNA, 16 bp, Homo sapiens
gctgtctttcttgctc

SEQ ID NO: 3561709 - DNA, 18 bp, Homo sapiens
gctgtcttttctttgcca

SEQ ID NO: 3561710 - DNA, 15 bp, Homo sapiens
gctgtgccacaggct

SEQ ID NO: 3561711 - DNA, 19 bp, Homo sapiens
gctgtgccacaggcttagg

SEQ ID NO: 3561712 - DNA, 12 bp, Homo sapiens
gctgtgcctctg

SEQ ID NO: 3561713 - DNA, 15 bp, Homo sapiens
gctgtgcctctgcct

SEQ ID NO: 3561714 - DNA, 16 bp, Homo sapiens
gctgtgcctctgcctg

SEQ ID NO: 3561715 - DNA, 15 bp, Homo sapiens
gctgtgccttccctt

SEQ ID NO: 3561716 - DNA, 19 bp, Homo sapiens
gctgtgctccacactcaga

SEQ ID NO: 3561717 - DNA, 12 bp, Homo sapiens
gctgtgctttgg

SEQ ID NO: 3561718 - DNA, 17 bp, Homo sapiens
gctgtgtacaatgtgag

SEQ ID NO: 3561719 - DNA, 23 bp, Homo sapiens
gctgtgtgagtgagcacacccgt

SEQ ID NO: 3561720 - DNA, 15 bp, Homo sapiens
gctgttatgctgttt

SEQ ID NO: 3561721 - DNA, 16 bp, Homo sapiens
gctgttatgctgtttc

SEQ ID NO: 3561722 - DNA, 22 bp, Homo sapiens
gctgttatttcttccctgcttt

SEQ ID NO: 3561723 - DNA, 15 bp, Homo sapiens
gctgttcttcagtcc

SEQ ID NO: 3561724 - DNA, 16 bp, Homo sapiens
gctgttcttcagtcct

SEQ ID NO: 3561725 - DNA, 20 bp, Homo sapiens
gctgttcttcagtcctttgt

SEQ ID NO: 3561726 - DNA, 15 bp, Homo sapiens
gctgttttcctccct

SEQ ID NO: 3561727 - DNA, 18 bp, Homo sapiens
gctgttttcctcccttct

SEQ ID NO: 3561728 - DNA, 21 bp, Homo sapiens
gctgttttcctcccttctgct

SEQ ID NO: 3561729 - DNA, 22 bp, Homo sapiens
gcttacaagccagctggagaaa

SEQ ID NO: 3561730 - DNA, 13 bp, Homo sapiens
gcttacaggagcc

SEQ ID NO: 3561731 - DNA, 15 bp, Homo sapiens
gcttacaggagccag

SEQ ID NO: 3561732 - DNA, 16 bp, Homo sapiens
gcttacaggagccagc

SEQ ID NO: 3561733 - DNA, 22 bp, Homo sapiens
gcttacaggagccagcctgctt

SEQ ID NO: 3561734 - DNA, 17 bp, Homo sapiens
gcttacctgggcacaaa

SEQ ID NO: 3561735 - DNA, 21 bp, Homo sapiens
gcttaggagaagtcttctatt

SEQ ID NO: 3561736 - DNA, 22 bp, Homo sapiens
gcttatatgtacttttattttt

SEQ ID NO: 3561737 - DNA, 17 bp, Homo sapiens
gcttatgaatatattta

SEQ ID NO: 3561738 - DNA, 18 bp, Homo sapiens
gcttatgacatcacttgt

SEQ ID NO: 3561739 - DNA, 22 bp, Homo sapiens
gcttatgacatcacttgtacaa

SEQ ID NO: 3561740 - DNA, 23 bp, Homo sapiens
gcttatgacatcacttgtacaaa

SEQ ID NO: 3561741 - DNA, 23 bp, Homo sapiens
gcttatgatagcaaatggcctca

SEQ ID NO: 3561742 - DNA, 17 bp, Homo sapiens
gcttcaaaaagccacag

SEQ ID NO: 3561743 - DNA, 20 bp, Homo sapiens
gcttcaaaaagccacagcag

SEQ ID NO: 3561744 - DNA, 23 bp, Homo sapiens
gcttcaacagccaagctggcaca

SEQ ID NO: 3561745 - DNA, 16 bp, Homo sapiens
gcttccaattttcctt

SEQ ID NO: 3561746 - DNA, 20 bp, Homo sapiens
gcttccactaccaaaagaca

SEQ ID NO: 3561747 - DNA, 22 bp, Homo sapiens
gcttccactaccaaaagacatt

SEQ ID NO: 3561748 - DNA, 17 bp, Homo sapiens
gcttccatgatgcacag

SEQ ID NO: 3561749 - DNA, 18 bp, Homo sapiens
gcttcccgctcagccctc

SEQ ID NO: 3561750 - DNA, 23 bp, Homo sapiens
gcttcccgctcagccctccctgc

SEQ ID NO: 3561751 - DNA, 19 bp, Homo sapiens
gcttccctaaactgcagcc

SEQ ID NO: 3561752 - DNA, 22 bp, Homo sapiens
gcttccgctttgaaagaagcaa

SEQ ID NO: 3561753 - DNA, 13 bp, Homo sapiens
gcttcctcacacc

SEQ ID NO: 3561754 - DNA, 21 bp, Homo sapiens
gcttcctcttccgggcagaaa

SEQ ID NO: 3561755 - DNA, 13 bp, Homo sapiens
gcttcctgagggc

SEQ ID NO: 3561756 - DNA, 13 bp, Homo sapiens
gcttcctgctgta

SEQ ID NO: 3561757 - DNA, 16 bp, Homo sapiens
gcttcgcgctggaatc

SEQ ID NO: 3561758 - DNA, 17 bp, Homo sapiens
gcttcggccgcgccacc

SEQ ID NO: 3561759 - DNA, 21 bp, Homo sapiens
gcttctcagatttctgaggaa

SEQ ID NO: 3561760 - DNA, 22 bp, Homo sapiens
ggccactttcagagcccccagc

SEQ ID NO: 3561761 - DNA, 18 bp, Homo sapiens
ggccagacacaggccctc

SEQ ID NO: 3561762 - DNA, 14 bp, Homo sapiens
ggccagagaaagca

SEQ ID NO: 3561763 - DNA, 22 bp, Homo sapiens
ggccagagagggaaaaggcagg

SEQ ID NO: 3561764 - DNA, 13 bp, Homo sapiens
ggccagcccagcc

SEQ ID NO: 3561765 - DNA, 22 bp, Homo sapiens
ggccagccttgtacagtctgct

SEQ ID NO: 3561766 - DNA, 20 bp, Homo sapiens
ggccagctctggagttctct

SEQ ID NO: 3561767 - DNA, 20 bp, Homo sapiens
ggccaggacgggccacacgt

SEQ ID NO: 3561768 - DNA, 18 bp, Homo sapiens
ggccaggccgcgcccagc

SEQ ID NO: 3561769 - DNA, 18 bp, Homo sapiens
ggccagggagaagctcct

SEQ ID NO: 3561770 - DNA, 15 bp, Homo sapiens
ggccagtcagacgcc

SEQ ID NO: 3561771 - DNA, 18 bp, Homo sapiens
ggccagtgagatcaatgt

SEQ ID NO: 3561772 - DNA, 19 bp, Homo sapiens
ggccagtggctggatctgt

SEQ ID NO: 3561773 - DNA, 19 bp, Homo sapiens
ggccataaacggttcctgg

SEQ ID NO: 3561774 - DNA, 14 bp, Homo sapiens
ggccatcccacaag

SEQ ID NO: 3561775 - DNA, 20 bp, Homo sapiens
ggccatccttccctgtctgc

SEQ ID NO: 3561776 - DNA, 14 bp, Homo sapiens
ggccatctcaggag

SEQ ID NO: 3561777 - DNA, 15 bp, Homo sapiens
ggccatgatggcaac

SEQ ID NO: 3561778 - DNA, 22 bp, Homo sapiens
ggccatgatggcaacagatctg

SEQ ID NO: 3561779 - DNA, 21 bp, Homo sapiens
ggccatgatgtccttggactc

SEQ ID NO: 3561780 - DNA, 16 bp, Homo sapiens
ggccatgctcaacccc

SEQ ID NO: 3561781 - DNA, 18 bp, Homo sapiens
ggccatgctcaacccccc

SEQ ID NO: 3561782 - DNA, 20 bp, Homo sapiens
ggccatgctcaacccccctc

SEQ ID NO: 3561783 - DNA, 12 bp, Homo sapiens
ggcccacacctg

SEQ ID NO: 3561784 - DNA, 17 bp, Homo sapiens
ggcccacacctggtgga

SEQ ID NO: 3561785 - DNA, 15 bp, Homo sapiens
ggcccaccagggtcc

SEQ ID NO: 3561786 - DNA, 15 bp, Homo sapiens
ggcccagagagggaa

SEQ ID NO: 3561787 - DNA, 20 bp, Homo sapiens
ggcccagagagggaagatga

SEQ ID NO: 3561788 - DNA, 13 bp, Homo sapiens
ggcccagagccca

SEQ ID NO: 3561789 - DNA, 16 bp, Homo sapiens
ggcccagagcccagct

SEQ ID NO: 3561790 - DNA, 14 bp, Homo sapiens
ggcccagcccagag

SEQ ID NO: 3561791 - DNA, 22 bp, Homo sapiens
ggcccagctttccctgccaggc

SEQ ID NO: 3561792 - DNA, 15 bp, Homo sapiens
ggcccagggcccaga

SEQ ID NO: 3561793 - DNA, 18 bp, Homo sapiens
ggcccagggcccagagcc

SEQ ID NO: 3561794 - DNA, 23 bp, Homo sapiens
ggccccacctcggcacacactgt

SEQ ID NO: 3561795 - DNA, 15 bp, Homo sapiens
ggccccagaggccct

SEQ ID NO: 3561796 - DNA, 17 bp, Homo sapiens
ggccccagaggccctgg

SEQ ID NO: 3561797 - DNA, 19 bp, Homo sapiens
ggccccagaggccctggag

SEQ ID NO: 3561798 - DNA, 13 bp, Homo sapiens
ggccccagcctcc

SEQ ID NO: 3561799 - DNA, 23 bp, Homo sapiens
ggccccagtgcggttcctcatct

SEQ ID NO: 3561800 - DNA, 11 bp, Homo sapiens
ggccccatggc

SEQ ID NO: 3561801 - DNA, 22 bp, Homo sapiens
ggccccccgcgctcgcccagca

SEQ ID NO: 3561802 - DNA, 23 bp, Homo sapiens
ggccccccgcgctcgcccagcag

SEQ ID NO: 3561803 - DNA, 14 bp, Homo sapiens
ggccccctcctcac

SEQ ID NO: 3561804 - DNA, 19 bp, Homo sapiens
ggcccccttcaggagcctg

SEQ ID NO: 3561805 - DNA, 20 bp, Homo sapiens
ggccccgccagggctgggga

SEQ ID NO: 3561806 - DNA, 16 bp, Homo sapiens
ggccccgccctcaggc

SEQ ID NO: 3561807 - DNA, 22 bp, Homo sapiens
ggcccctatgtagtccgtgctg

SEQ ID NO: 3561808 - DNA, 17 bp, Homo sapiens
ggcccctccatccaccc

SEQ ID NO: 3561809 - DNA, 23 bp, Homo sapiens
ggcccctccctctccagcaggcc

SEQ ID NO: 3561810 - DNA, 16 bp, Homo sapiens
ggcccgacagcctggc

SEQ ID NO: 3561811 - DNA, 17 bp, Homo sapiens
ggcccgacagcctggca

SEQ ID NO: 3561812 - DNA, 15 bp, Homo sapiens
ggcccgacaggtggg

SEQ ID NO: 3561813 - DNA, 22 bp, Homo sapiens
ggcccgacaggtgggcctggga

SEQ ID NO: 3561814 - DNA, 13 bp, Homo sapiens
ggcccgcgcagct

SEQ ID NO: 3561815 - DNA, 15 bp, Homo sapiens
ggcccgcgcagctgc

SEQ ID NO: 3561816 - DNA, 21 bp, Homo sapiens
ggccctcagtcttcctgccgg

SEQ ID NO: 3561817 - DNA, 19 bp, Homo sapiens
ggccctccctgttccccag

SEQ ID NO: 3561818 - DNA, 22 bp, Homo sapiens
ggccctccctgttccccagaga

SEQ ID NO: 3561819 - DNA, 13 bp, Homo sapiens
ggccctcctcagc

SEQ ID NO: 3561820 - DNA, 15 bp, Homo sapiens
ggccctctttccctg

SEQ ID NO: 3561821 - DNA, 20 bp, Homo sapiens
ggccctctttccctgcgaga

SEQ ID NO: 3561822 - DNA, 19 bp, Homo sapiens
ggccctgacattggagcct

SEQ ID NO: 3561823 - DNA, 16 bp, Homo sapiens
ggccctgccccacccc

SEQ ID NO: 3561824 - DNA, 17 bp, Homo sapiens
ggccctgccccacccca

SEQ ID NO: 3561825 - DNA, 14 bp, Homo sapiens
ggccctgctacctg

SEQ ID NO: 3561826 - DNA, 19 bp, Homo sapiens
ggccctggaggtctccagg

SEQ ID NO: 3561827 - DNA, 15 bp, Homo sapiens
ggccctggcaccccc

SEQ ID NO: 3561828 - DNA, 22 bp, Homo sapiens
ggccctggcacccccacaagct

SEQ ID NO: 3561829 - DNA, 12 bp, Homo sapiens
ggccctggccag

SEQ ID NO: 3561830 - DNA, 15 bp, Homo sapiens
ggccctggccaggac

SEQ ID NO: 3561831 - DNA, 13 bp, Homo sapiens
ggccctggctccc

SEQ ID NO: 3561832 - DNA, 15 bp, Homo sapiens
ggccctgggggtctg

SEQ ID NO: 3561833 - DNA, 17 bp, Homo sapiens
ggccctgggggtctggg

SEQ ID NO: 3561834 - DNA, 22 bp, Homo sapiens
ggccctgtgagcacaaagaaga

SEQ ID NO: 3561835 - DNA, 17 bp, Homo sapiens
ggccctgtgccttggtg

SEQ ID NO: 3561836 - DNA, 18 bp, Homo sapiens
ggcccttcctctccactg

SEQ ID NO: 3561837 - DNA, 23 bp, Homo sapiens
ggcccttcctctccactgccttc

SEQ ID NO: 3561838 - DNA, 19 bp, Homo sapiens
ggccgccccgccccagagc

SEQ ID NO: 3561839 - DNA, 20 bp, Homo sapiens
ggccgccccgccccagagct

SEQ ID NO: 3561840 - DNA, 21 bp, Homo sapiens
ggccgcgccacccgggcaagg

SEQ ID NO: 3561841 - DNA, 16 bp, Homo sapiens
ggccgcgggggcaggg

SEQ ID NO: 3561842 - DNA, 12 bp, Homo sapiens
ggccgctgccac

SEQ ID NO: 3561843 - DNA, 13 bp, Homo sapiens
ggccgctgccacc

SEQ ID NO: 3561844 - DNA, 19 bp, Homo sapiens
ggccgctgccacccacctc

SEQ ID NO: 3561845 - DNA, 14 bp, Homo sapiens
ggccgctggctggt

SEQ ID NO: 3561846 - DNA, 14 bp, Homo sapiens
ggccggagggcagg

SEQ ID NO: 3561847 - DNA, 15 bp, Homo sapiens
ggccggagggcagga

SEQ ID NO: 3561848 - DNA, 20 bp, Homo sapiens
ggccggagtcagtgccaggt

SEQ ID NO: 3561849 - DNA, 14 bp, Homo sapiens
ggccggctgagtgg

SEQ ID NO: 3561850 - DNA, 12 bp, Homo sapiens
ggccgggcaggg

SEQ ID NO: 3561851 - DNA, 19 bp, Homo sapiens
ggccgtaggggctcctgag

SEQ ID NO: 3561852 - DNA, 20 bp, Homo sapiens
ggccgtaggggctcctgagt

SEQ ID NO: 3561853 - DNA, 18 bp, Homo sapiens
ggcctagaaagggcaagg

SEQ ID NO: 3561854 - DNA, 14 bp, Homo sapiens
ggcctaggcctcag

SEQ ID NO: 3561855 - DNA, 20 bp, Homo sapiens
ggcctaggcctcagccagag

SEQ ID NO: 3561856 - DNA, 16 bp, Homo sapiens
ggcctaggtgcagctc

SEQ ID NO: 3561857 - DNA, 15 bp, Homo sapiens
ggcctcaggctctgc

SEQ ID NO: 3561858 - DNA, 17 bp, Homo sapiens
ggcctcaggctctgcac

SEQ ID NO: 3561859 - DNA, 13 bp, Homo sapiens
ggcctccagggcc

SEQ ID NO: 3561860 - DNA, 15 bp, Homo sapiens
ggcctccagggccca

SEQ ID NO: 3561861 - DNA, 14 bp, Homo sapiens
ggcctcccacagac

SEQ ID NO: 3561862 - DNA, 21 bp, Homo sapiens
ggcctccgtcactacctggct

SEQ ID NO: 3561863 - DNA, 18 bp, Homo sapiens
ggcctcctcggagagcag

SEQ ID NO: 3561864 - DNA, 20 bp, Homo sapiens
ggcctcctcggagagcagca

SEQ ID NO: 3561865 - DNA, 22 bp, Homo sapiens
ggcctcctcggagagcagcagc

SEQ ID NO: 3561866 - DNA, 21 bp, Homo sapiens
ggcctcgtgctccgcagggcg

SEQ ID NO: 3561867 - DNA, 12 bp, Homo sapiens
ggcctctgggac

SEQ ID NO: 3561868 - DNA, 16 bp, Homo sapiens
ggcctctgggacccac

SEQ ID NO: 3561869 - DNA, 20 bp, Homo sapiens
ggcctctgggacccacagaa

SEQ ID NO: 3561870 - DNA, 16 bp, Homo sapiens
ggcctgactctcagca

SEQ ID NO: 3561871 - DNA, 22 bp, Homo sapiens
ggcctgagggtccacctggaga

SEQ ID NO: 3561872 - DNA, 14 bp, Homo sapiens
ggcctgcagaagga

SEQ ID NO: 3561873 - DNA, 20 bp, Homo sapiens
ggcctgcagaaggaaagaag

SEQ ID NO: 3561874 - DNA, 18 bp, Homo sapiens
ggcctgcccagtcgaccc

SEQ ID NO: 3561875 - DNA, 11 bp, Homo sapiens
ggcctgcctgt

SEQ ID NO: 3561876 - DNA, 14 bp, Homo sapiens
ggcctgctccagac

SEQ ID NO: 3561877 - DNA, 15 bp, Homo sapiens
ggcctgctccagacc

SEQ ID NO: 3561878 - DNA, 16 bp, Homo sapiens
ggcctgctccagacct

SEQ ID NO: 3561879 - DNA, 18 bp, Homo sapiens
ggcctgctccagacctga

SEQ ID NO: 3561880 - DNA, 21 bp, Homo sapiens
ggcctgctgccagtgcagcca

SEQ ID NO: 3561881 - DNA, 23 bp, Homo sapiens
ggcctggagccccatcggccaag

SEQ ID NO: 3561882 - DNA, 14 bp, Homo sapiens
ggcctggaggtctg

SEQ ID NO: 3561883 - DNA, 19 bp, Homo sapiens
ggcctggaggtctggctga

SEQ ID NO: 3561884 - DNA, 16 bp, Homo sapiens
ggcctggctggtggga

SEQ ID NO: 3561885 - DNA, 19 bp, Homo sapiens
ggcctgggtgatctgctgc

SEQ ID NO: 3561886 - DNA, 21 bp, Homo sapiens
ggcctgggtgatctgctgctg

SEQ ID NO: 3561887 - DNA, 16 bp, Homo sapiens
ggcctgtatgcctggg

SEQ ID NO: 3561888 - DNA, 18 bp, Homo sapiens
ggcctgtccaacacatct

SEQ ID NO: 3561889 - DNA, 21 bp, Homo sapiens
ggcctgtcccttgcctctgcc

SEQ ID NO: 3561890 - DNA, 23 bp, Homo sapiens
ggcctgttccccaaatggccatt

SEQ ID NO: 3561891 - DNA, 19 bp, Homo sapiens
ggccttaaagagggacagg

SEQ ID NO: 3561892 - DNA, 15 bp, Homo sapiens
gggttgtgtgtctgt

SEQ ID NO: 3561893 - DNA, 17 bp, Homo sapiens
gggtttcgactggtcca

SEQ ID NO: 3561894 - DNA, 20 bp, Homo sapiens
gggtttcgactggtccagct

SEQ ID NO: 3561895 - DNA, 24 bp, Homo sapiens
gggtttgggagccaggactcccag

SEQ ID NO: 3561896 - DNA, 23 bp, Homo sapiens
gggtttgtgtttgattggctttc

SEQ ID NO: 3561897 - DNA, 20 bp, Homo sapiens
gggttttattgtttaaaatc

SEQ ID NO: 3561898 - DNA, 11 bp, Homo sapiens
ggtaaatgtta

SEQ ID NO: 3561899 - DNA, 20 bp, Homo sapiens
ggtaaatttttaggcaaaga

SEQ ID NO: 3561900 - DNA, 19 bp, Homo sapiens
ggtaacttgagattcaaga

SEQ ID NO: 3561901 - DNA, 24 bp, Homo sapiens
ggtaacttttgtgaattaggctgt

SEQ ID NO: 3561902 - DNA, 16 bp, Homo sapiens
ggtaattgtacaataa

SEQ ID NO: 3561903 - DNA, 18 bp, Homo sapiens
ggtaattgtacaataaat

SEQ ID NO: 3561904 - DNA, 13 bp, Homo sapiens
ggtacatttctga

SEQ ID NO: 3561905 - DNA, 16 bp, Homo sapiens
ggtacctcaagcccca

SEQ ID NO: 3561906 - DNA, 13 bp, Homo sapiens
ggtacctgccctc

SEQ ID NO: 3561907 - DNA, 17 bp, Homo sapiens
ggtacctgccctctatt

SEQ ID NO: 3561908 - DNA, 14 bp, Homo sapiens
ggtactctgtgaaa

SEQ ID NO: 3561909 - DNA, 22 bp, Homo sapiens
ggtactgcattctctcccatcc

SEQ ID NO: 3561910 - DNA, 14 bp, Homo sapiens
ggtactgtagcagg

SEQ ID NO: 3561911 - DNA, 16 bp, Homo sapiens
ggtacttcttgaaggt

SEQ ID NO: 3561912 - DNA, 20 bp, Homo sapiens
ggtagaaagagatacagagg

SEQ ID NO: 3561913 - DNA, 15 bp, Homo sapiens
ggtagcactctcaga

SEQ ID NO: 3561914 - DNA, 16 bp, Homo sapiens
ggtagctggggagccc

SEQ ID NO: 3561915 - DNA, 14 bp, Homo sapiens
ggtagcttttccct

SEQ ID NO: 3561916 - DNA, 12 bp, Homo sapiens
ggtaggaccctc

SEQ ID NO: 3561917 - DNA, 20 bp, Homo sapiens
ggtaggaccctcgagagcct

SEQ ID NO: 3561918 - DNA, 14 bp, Homo sapiens
ggtatctggcttcc

SEQ ID NO: 3561919 - DNA, 18 bp, Homo sapiens
ggtatctggcttccctgg

SEQ ID NO: 3561920 - DNA, 19 bp, Homo sapiens
ggtatctggcttccctgga

SEQ ID NO: 3561921 - DNA, 16 bp, Homo sapiens
ggtatgtagccagctg

SEQ ID NO: 3561922 - DNA, 21 bp, Homo sapiens
ggtattaatcttattgtttaa

SEQ ID NO: 3561923 - DNA, 14 bp, Homo sapiens
ggtattttcagaga

SEQ ID NO: 3561924 - DNA, 16 bp, Homo sapiens
ggtcacaggactctgc

SEQ ID NO: 3561925 - DNA, 13 bp, Homo sapiens
ggtcatctggcgg

SEQ ID NO: 3561926 - DNA, 15 bp, Homo sapiens
ggtcatctggcggag

SEQ ID NO: 3561927 - DNA, 15 bp, Homo sapiens
ggtcatgccctcctc

SEQ ID NO: 3561928 - DNA, 19 bp, Homo sapiens
ggtcatgtgagtctgggat

SEQ ID NO: 3561929 - DNA, 14 bp, Homo sapiens
ggtccacagctgga

SEQ ID NO: 3561930 - DNA, 17 bp, Homo sapiens
ggtccacagctggaaag

SEQ ID NO: 3561931 - DNA, 15 bp, Homo sapiens
ggtccacctggagag

SEQ ID NO: 3561932 - DNA, 20 bp, Homo sapiens
ggtccagctctgacatccct

SEQ ID NO: 3561933 - DNA, 23 bp, Homo sapiens
ggtccagctctgacatcccttcc

SEQ ID NO: 3561934 - DNA, 14 bp, Homo sapiens
ggtccagggcctga

SEQ ID NO: 3561935 - DNA, 15 bp, Homo sapiens
ggtccagggcctgac

SEQ ID NO: 3561936 - DNA, 22 bp, Homo sapiens
ggtccagggcctgacaccccct

SEQ ID NO: 3561937 - DNA, 19 bp, Homo sapiens
ggtccatgtaaatactttc

SEQ ID NO: 3561938 - DNA, 14 bp, Homo sapiens
ggtcccagctccct

SEQ ID NO: 3561939 - DNA, 15 bp, Homo sapiens
ggtcccagctccctg

SEQ ID NO: 3561940 - DNA, 20 bp, Homo sapiens
ggtcccagctccctggctcc

SEQ ID NO: 3561941 - DNA, 20 bp, Homo sapiens
ggtccccactgctgagctgg

SEQ ID NO: 3561942 - DNA, 18 bp, Homo sapiens
ggtccctgaacgccctgg

SEQ ID NO: 3561943 - DNA, 16 bp, Homo sapiens
ggtccctgttgtcaga

SEQ ID NO: 3561944 - DNA, 17 bp, Homo sapiens
ggtcctacccatccccg

SEQ ID NO: 3561945 - DNA, 14 bp, Homo sapiens
ggtcctcagagaat

SEQ ID NO: 3561946 - DNA, 19 bp, Homo sapiens
ggtcctcctatctccctgg

SEQ ID NO: 3561947 - DNA, 19 bp, Homo sapiens
ggtcctctctgagtcaaat

SEQ ID NO: 3561948 - DNA, 22 bp, Homo sapiens
ggtcctctctgagtcaaatcca

SEQ ID NO: 3561949 - DNA, 23 bp, Homo sapiens
ggtcctcttttcctggcagctgc

SEQ ID NO: 3561950 - DNA, 21 bp, Homo sapiens
ggtcctgaagtgacctcactg

SEQ ID NO: 3561951 - DNA, 12 bp, Homo sapiens
ggtcctgcacat

SEQ ID NO: 3561952 - DNA, 15 bp, Homo sapiens
ggtcctgcacatgag

SEQ ID NO: 3561953 - DNA, 16 bp, Homo sapiens
ggtcctgcacatgagt

SEQ ID NO: 3561954 - DNA, 14 bp, Homo sapiens
ggtcctggccatcc

SEQ ID NO: 3561955 - DNA, 13 bp, Homo sapiens
ggtcctggtgccc

SEQ ID NO: 3561956 - DNA, 18 bp, Homo sapiens
ggtccttttgacactgct

SEQ ID NO: 3561957 - DNA, 18 bp, Homo sapiens
ggtcggagtgcctggagt

SEQ ID NO: 3561958 - DNA, 16 bp, Homo sapiens
ggtcgggtgggggagg

SEQ ID NO: 3561959 - DNA, 14 bp, Homo sapiens
ggtcgttttccaaa

SEQ ID NO: 3561960 - DNA, 14 bp, Homo sapiens
ggtctagagagaac

SEQ ID NO: 3561961 - DNA, 19 bp, Homo sapiens
ggtctcattgcttctgact

SEQ ID NO: 3561962 - DNA, 15 bp, Homo sapiens
ggtctcccctcctgc

SEQ ID NO: 3561963 - DNA, 13 bp, Homo sapiens
ggtctctcaggga

SEQ ID NO: 3561964 - DNA, 15 bp, Homo sapiens
ggtctctctccaggt

SEQ ID NO: 3561965 - DNA, 22 bp, Homo sapiens
ggtctctctccaggtcagcctg

SEQ ID NO: 3561966 - DNA, 15 bp, Homo sapiens
ggtctctgccccagc

SEQ ID NO: 3561967 - DNA, 18 bp, Homo sapiens
ggtctctgccccagcctg

SEQ ID NO: 3561968 - DNA, 19 bp, Homo sapiens
ggtctctgccccagcctgt

SEQ ID NO: 3561969 - DNA, 13 bp, Homo sapiens
ggtctgactccaa

SEQ ID NO: 3561970 - DNA, 16 bp, Homo sapiens
ggtctgattggctgct

SEQ ID NO: 3561971 - DNA, 18 bp, Homo sapiens
ggtctggctgagcccctg

SEQ ID NO: 3561972 - DNA, 18 bp, Homo sapiens
ggtctggggacaggcccg

SEQ ID NO: 3561973 - DNA, 15 bp, Homo sapiens
ggtctggttcctgtg

SEQ ID NO: 3561974 - DNA, 18 bp, Homo sapiens
ggtctgtgtgctgtttga

SEQ ID NO: 3561975 - DNA, 20 bp, Homo sapiens
ggtctgtgtgtgtgtatgtg

SEQ ID NO: 3561976 - DNA, 15 bp, Homo sapiens
ggtctgtttaaagtg

SEQ ID NO: 3561977 - DNA, 16 bp, Homo sapiens
ggtcttagctctttct

SEQ ID NO: 3561978 - DNA, 20 bp, Homo sapiens
ggtcttggccgactcaggga

SEQ ID NO: 3561979 - DNA, 22 bp, Homo sapiens
ggtctttttctagggtccctga

SEQ ID NO: 3561980 - DNA, 15 bp, Homo sapiens
ggtgaagtaaattag

SEQ ID NO: 3561981 - DNA, 22 bp, Homo sapiens
ggtgacagtgaagatagaagaa

SEQ ID NO: 3561982 - DNA, 14 bp, Homo sapiens
ggtgaggataggac

SEQ ID NO: 3561983 - DNA, 16 bp, Homo sapiens
ggtgaggtgaactcca

SEQ ID NO: 3561984 - DNA, 19 bp, Homo sapiens
ggtgaggtgaactccaggc

SEQ ID NO: 3561985 - DNA, 16 bp, Homo sapiens
ggtgataggtaaattt

SEQ ID NO: 3561986 - DNA, 19 bp, Homo sapiens
ggtgatcctgttctgcgct

SEQ ID NO: 3561987 - DNA, 20 bp, Homo sapiens
ggtgatcctgttctgcgctg

SEQ ID NO: 3561988 - DNA, 21 bp, Homo sapiens
ggtgatcctgttctgcgctgt

SEQ ID NO: 3561989 - DNA, 22 bp, Homo sapiens
ggtgattgtatgaagtttgaat

SEQ ID NO: 3561990 - DNA, 16 bp, Homo sapiens
ggtgcacgcaggcaca

SEQ ID NO: 3561991 - DNA, 13 bp, Homo sapiens
ggtgcactccaga

SEQ ID NO: 3561992 - DNA, 15 bp, Homo sapiens
ggtgcactccagact

SEQ ID NO: 3561993 - DNA, 21 bp, Homo sapiens
ggtgcactccagactctgggg

SEQ ID NO: 3561994 - DNA, 18 bp, Homo sapiens
ggtgcagacgcggcgggg

SEQ ID NO: 3561995 - DNA, 15 bp, Homo sapiens
ggtgcagccccaggg

SEQ ID NO: 3561996 - DNA, 15 bp, Homo sapiens
ggtgcatctcctccc

SEQ ID NO: 3561997 - DNA, 15 bp, Homo sapiens
ggtgccaccaccctg

SEQ ID NO: 3561998 - DNA, 12 bp, Homo sapiens
ggtgcccagggc

SEQ ID NO: 3561999 - DNA, 14 bp, Homo sapiens
ggtgcccagggcca

SEQ ID NO: 3562000 - DNA, 15 bp, Homo sapiens
ggtgccctggatgcc

SEQ ID NO: 3562001 - DNA, 19 bp, Homo sapiens
ggtgccgctgtctctgagg

SEQ ID NO: 3562002 - DNA, 23 bp, Homo sapiens
ggtgccgctgtctctgaggggtg

SEQ ID NO: 3562003 - DNA, 19 bp, Homo sapiens
ggtgccgtgcgggcgaggc

SEQ ID NO: 3562004 - DNA, 20 bp, Homo sapiens
ggtgctaatgtcaaaccact

SEQ ID NO: 3562005 - DNA, 15 bp, Homo sapiens
ggtgctcatgctgct

SEQ ID NO: 3562006 - DNA, 16 bp, Homo sapiens
ggtgctctctctgagg

SEQ ID NO: 3562007 - DNA, 20 bp, Homo sapiens
ggtgctgacggccagggaga

SEQ ID NO: 3562008 - DNA, 12 bp, Homo sapiens
ggtgctgcagga

SEQ ID NO: 3562009 - DNA, 18 bp, Homo sapiens
ggtgcttttggcagagac

SEQ ID NO: 3562010 - DNA, 22 bp, Homo sapiens
ggtggaagtgtgtgccaagagc

SEQ ID NO: 3562011 - DNA, 15 bp, Homo sapiens
ggtggaatgccgctg

SEQ ID NO: 3562012 - DNA, 21 bp, Homo sapiens
ggtggaatgccgctgtctctg

SEQ ID NO: 3562013 - DNA, 18 bp, Homo sapiens
ggtggacacaacagcagt

SEQ ID NO: 3562014 - DNA, 14 bp, Homo sapiens
ggtggcacctgttt

SEQ ID NO: 3562015 - DNA, 18 bp, Homo sapiens
ggtggcccgacagcctgg

SEQ ID NO: 3562016 - DNA, 19 bp, Homo sapiens
ggtggcccgacagcctggc

SEQ ID NO: 3562017 - DNA, 20 bp, Homo sapiens
ggtggcccgacagcctggca

SEQ ID NO: 3562018 - DNA, 16 bp, Homo sapiens
ggtggctgccccggcc

SEQ ID NO: 3562019 - DNA, 20 bp, Homo sapiens
ggtgggcggcacagccttct

SEQ ID NO: 3562020 - DNA, 23 bp, Homo sapiens
ggtggggccataaacggttcctg

SEQ ID NO: 3562021 - DNA, 19 bp, Homo sapiens
ggtgggggaggagcctctg

SEQ ID NO: 3562022 - DNA, 22 bp, Homo sapiens
ggtgggggtgccgctgtctctg

SEQ ID NO: 3562023 - DNA, 23 bp, Homo sapiens
ggtggggtcatgccctcctctcc

SEQ ID NO: 3562024 - DNA, 17 bp, Homo sapiens
gtcgttatatttgactt

SEQ ID NO: 3562025 - DNA, 16 bp, Homo sapiens
gtcgttttccaaagag

SEQ ID NO: 3562026 - DNA, 22 bp, Homo sapiens
gtctaaataggatcctggaggc

SEQ ID NO: 3562027 - DNA, 16 bp, Homo sapiens
gtctaatcagtgatta

SEQ ID NO: 3562028 - DNA, 17 bp, Homo sapiens
gtctaatcagtgattat

SEQ ID NO: 3562029 - DNA, 22 bp, Homo sapiens
gtctaatcagtgattatttttc

SEQ ID NO: 3562030 - DNA, 22 bp, Homo sapiens
gtctaatgattcaaatgtttta

SEQ ID NO: 3562031 - DNA, 12 bp, Homo sapiens
gtctactgcaag

SEQ ID NO: 3562032 - DNA, 22 bp, Homo sapiens
gtctaggataacttgctttctt

SEQ ID NO: 3562033 - DNA, 18 bp, Homo sapiens
gtctaggcactgagcagg

SEQ ID NO: 3562034 - DNA, 20 bp, Homo sapiens
gtctaggcactgagcaggga

SEQ ID NO: 3562035 - DNA, 20 bp, Homo sapiens
gtctcaagagggcactggtg

SEQ ID NO: 3562036 - DNA, 16 bp, Homo sapiens
gtctcagcctctgcca

SEQ ID NO: 3562037 - DNA, 16 bp, Homo sapiens
gtctcaggtccctgca

SEQ ID NO: 3562038 - DNA, 16 bp, Homo sapiens
gtctcattgcttctga

SEQ ID NO: 3562039 - DNA, 18 bp, Homo sapiens
gtctcattgcttctgact

SEQ ID NO: 3562040 - DNA, 15 bp, Homo sapiens
gtctccaaagaagat

SEQ ID NO: 3562041 - DNA, 16 bp, Homo sapiens
gtctccaaagaagata

SEQ ID NO: 3562042 - DNA, 20 bp, Homo sapiens
gtctccacacacagctgggc

SEQ ID NO: 3562043 - DNA, 14 bp, Homo sapiens
gtctccagctgcct

SEQ ID NO: 3562044 - DNA, 15 bp, Homo sapiens
gtctccagctgcctg

SEQ ID NO: 3562045 - DNA, 23 bp, Homo sapiens
gtctccagctgcctgggcccgga

SEQ ID NO: 3562046 - DNA, 21 bp, Homo sapiens
gtctcccctcctgcacacagg

SEQ ID NO: 3562047 - DNA, 20 bp, Homo sapiens
gtctccccttctctgcctca

SEQ ID NO: 3562048 - DNA, 18 bp, Homo sapiens
gtctcctcactctgtccc

SEQ ID NO: 3562049 - DNA, 17 bp, Homo sapiens
gtctcctcagcctcctc

SEQ ID NO: 3562050 - DNA, 12 bp, Homo sapiens
gtctcctcccct

SEQ ID NO: 3562051 - DNA, 20 bp, Homo sapiens
gtctcctcccctactctgcc

SEQ ID NO: 3562052 - DNA, 15 bp, Homo sapiens
gtctccttcagcacg

SEQ ID NO: 3562053 - DNA, 16 bp, Homo sapiens
gtctccttcagcacgg

SEQ ID NO: 3562054 - DNA, 18 bp, Homo sapiens
gtctccttcagcacggcg

SEQ ID NO: 3562055 - DNA, 20 bp, Homo sapiens
gtctccttcagcacggcgtg

SEQ ID NO: 3562056 - DNA, 22 bp, Homo sapiens
gtctcgaactcctgacctcaag

SEQ ID NO: 3562057 - DNA, 16 bp, Homo sapiens
gtctcggctctgcatg

SEQ ID NO: 3562058 - DNA, 20 bp, Homo sapiens
gtctctaatgtctgcagctc

SEQ ID NO: 3562059 - DNA, 15 bp, Homo sapiens
gtctctaatttaact

SEQ ID NO: 3562060 - DNA, 20 bp, Homo sapiens
gtctctcagggatggaggga

SEQ ID NO: 3562061 - DNA, 14 bp, Homo sapiens
gtctctctccaggt

SEQ ID NO: 3562062 - DNA, 16 bp, Homo sapiens
gtctctctccaggtca

SEQ ID NO: 3562063 - DNA, 19 bp, Homo sapiens
gtctctctctctctacaaa

SEQ ID NO: 3562064 - DNA, 18 bp, Homo sapiens
gtctctgattagttgaca

SEQ ID NO: 3562065 - DNA, 23 bp, Homo sapiens
gtctctgattagttgacagtatt

SEQ ID NO: 3562066 - DNA, 21 bp, Homo sapiens
gtctctgccagttacttgggc

SEQ ID NO: 3562067 - DNA, 12 bp, Homo sapiens
gtctctgcccca

SEQ ID NO: 3562068 - DNA, 16 bp, Homo sapiens
gtctctgccccagcct

SEQ ID NO: 3562069 - DNA, 13 bp, Homo sapiens
gtctctgccctgg

SEQ ID NO: 3562070 - DNA, 15 bp, Homo sapiens
gtctcttctccactg

SEQ ID NO: 3562071 - DNA, 19 bp, Homo sapiens
gtctcttctgaataaagca

SEQ ID NO: 3562072 - DNA, 22 bp, Homo sapiens
gtctctttcatgagtttttccc

SEQ ID NO: 3562073 - DNA, 16 bp, Homo sapiens
gtctgaggcctgcccc

SEQ ID NO: 3562074 - DNA, 17 bp, Homo sapiens
gtctgaggcctgccccc

SEQ ID NO: 3562075 - DNA, 20 bp, Homo sapiens
gtctgaggcctgccccctgg

SEQ ID NO: 3562076 - DNA, 13 bp, Homo sapiens
gtctgattggctg

SEQ ID NO: 3562077 - DNA, 14 bp, Homo sapiens
gtctgattggctgc

SEQ ID NO: 3562078 - DNA, 16 bp, Homo sapiens
gtctgattggctgctt

SEQ ID NO: 3562079 - DNA, 20 bp, Homo sapiens
gtctgcatttcggtggctag

SEQ ID NO: 3562080 - DNA, 11 bp, Homo sapiens
gtctgcctggg

SEQ ID NO: 3562081 - DNA, 16 bp, Homo sapiens
gtctgccttctgctga

SEQ ID NO: 3562082 - DNA, 23 bp, Homo sapiens
gtctgccttctgctgaaagactc

SEQ ID NO: 3562083 - DNA, 22 bp, Homo sapiens
gtctgcgatgcagcggcgtgag

SEQ ID NO: 3562084 - DNA, 23 bp, Homo sapiens
gtctgctcagacagaacccctac

SEQ ID NO: 3562085 - DNA, 15 bp, Homo sapiens
gtctgctgccagcac

SEQ ID NO: 3562086 - DNA, 17 bp, Homo sapiens
gtctgctgccagcacag

SEQ ID NO: 3562087 - DNA, 21 bp, Homo sapiens
gtctggagttgatctggaacc

SEQ ID NO: 3562088 - DNA, 13 bp, Homo sapiens
gtctggctgagcc

SEQ ID NO: 3562089 - DNA, 14 bp, Homo sapiens
gtctggctgagccc

SEQ ID NO: 3562090 - DNA, 17 bp, Homo sapiens
gtctggctgagcccctg

SEQ ID NO: 3562091 - DNA, 20 bp, Homo sapiens
gtctggctgagcccctgggg

SEQ ID NO: 3562092 - DNA, 17 bp, Homo sapiens
gtctgggatattcttta

SEQ ID NO: 3562093 - DNA, 16 bp, Homo sapiens
gtctggtgtttgtcat

SEQ ID NO: 3562094 - DNA, 23 bp, Homo sapiens
gtctggttcctgtgtgaccctgg

SEQ ID NO: 3562095 - DNA, 14 bp, Homo sapiens
gtctgtatgtcatg

SEQ ID NO: 3562096 - DNA, 20 bp, Homo sapiens
gtctgtggctttcagcctct

SEQ ID NO: 3562097 - DNA, 21 bp, Homo sapiens
gtctgtggctttcagcctctg

SEQ ID NO: 3562098 - DNA, 17 bp, Homo sapiens
gtctgtggtgcagtgtg

SEQ ID NO: 3562099 - DNA, 18 bp, Homo sapiens
gtctgtgtcatttcttca

SEQ ID NO: 3562100 - DNA, 20 bp, Homo sapiens
gtctgtgtgtgtgtatgtgg

SEQ ID NO: 3562101 - DNA, 11 bp, Homo sapiens
gtctgtgtgtt

SEQ ID NO: 3562102 - DNA, 16 bp, Homo sapiens
gtctgttgattaaaga

SEQ ID NO: 3562103 - DNA, 21 bp, Homo sapiens
gtctgtttgctcaaaattgct

SEQ ID NO: 3562104 - DNA, 14 bp, Homo sapiens
gtcttaaaaaatgt

SEQ ID NO: 3562105 - DNA, 13 bp, Homo sapiens
gtcttaaaacctg

SEQ ID NO: 3562106 - DNA, 20 bp, Homo sapiens
gtcttaaaacctgcttttca

SEQ ID NO: 3562107 - DNA, 14 bp, Homo sapiens
gtcttaattaaaag

SEQ ID NO: 3562108 - DNA, 22 bp, Homo sapiens
gtcttaattaaaagaatatttt

SEQ ID NO: 3562109 - DNA, 22 bp, Homo sapiens
gtcttaatttttgaaaaaagta

SEQ ID NO: 3562110 - DNA, 15 bp, Homo sapiens
gtcttagctctttct

SEQ ID NO: 3562111 - DNA, 16 bp, Homo sapiens
gtcttattaagactgg

SEQ ID NO: 3562112 - DNA, 17 bp, Homo sapiens
gtcttcactttcctcag

SEQ ID NO: 3562113 - DNA, 12 bp, Homo sapiens
gtcttctattta

SEQ ID NO: 3562114 - DNA, 12 bp, Homo sapiens
gtcttctttctc

SEQ ID NO: 3562115 - DNA, 13 bp, Homo sapiens
gtcttctttctcc

SEQ ID NO: 3562116 - DNA, 19 bp, Homo sapiens
gtcttgctatattgcccag

SEQ ID NO: 3562117 - DNA, 15 bp, Homo sapiens
gtcttggatatatag

SEQ ID NO: 3562118 - DNA, 12 bp, Homo sapiens
gtcttggccatg

SEQ ID NO: 3562119 - DNA, 22 bp, Homo sapiens
gtcttgttttttttttccactt

SEQ ID NO: 3562120 - DNA, 12 bp, Homo sapiens
gtctttaatcat

SEQ ID NO: 3562121 - DNA, 19 bp, Homo sapiens
gtctttatttttttcccat

SEQ ID NO: 3562122 - DNA, 23 bp, Homo sapiens
gtctttcttgggatagtgttctg

SEQ ID NO: 3562123 - DNA, 19 bp, Homo sapiens
gtctttctttgtcattcag

SEQ ID NO: 3562124 - DNA, 19 bp, Homo sapiens
gtcttttctttgccatctc

SEQ ID NO: 3562125 - DNA, 16 bp, Homo sapiens
gtcttttggttatgaa

SEQ ID NO: 3562126 - DNA, 13 bp, Homo sapiens
gtctttttctagg

SEQ ID NO: 3562127 - DNA, 17 bp, Homo sapiens
gtgaaacgccacaaaaa

SEQ ID NO: 3562128 - DNA, 18 bp, Homo sapiens
gtgaaagaagagaaaagg

SEQ ID NO: 3562129 - DNA, 17 bp, Homo sapiens
gtgaaataacaaaatgg

SEQ ID NO: 3562130 - DNA, 23 bp, Homo sapiens
gtgaactcaccctgggagccagt

SEQ ID NO: 3562131 - DNA, 12 bp, Homo sapiens
gtgaactccagg

SEQ ID NO: 3562132 - DNA, 13 bp, Homo sapiens
gtgaactccaggc

SEQ ID NO: 3562133 - DNA, 16 bp, Homo sapiens
gtgaagagtttcacaa

SEQ ID NO: 3562134 - DNA, 14 bp, Homo sapiens
gtgaagctaatgtc

SEQ ID NO: 3562135 - DNA, 13 bp, Homo sapiens
gtgaaggaccctt

SEQ ID NO: 3562136 - DNA, 13 bp, Homo sapiens
gtgaataaaggat

SEQ ID NO: 3562137 - DNA, 13 bp, Homo sapiens
gtgaatctgtcta

SEQ ID NO: 3562138 - DNA, 16 bp, Homo sapiens
gtgaattagttttaaa

SEQ ID NO: 3562139 - DNA, 14 bp, Homo sapiens
gtgacacctccccc

SEQ ID NO: 3562140 - DNA, 15 bp, Homo sapiens
gtgacacctccccct

SEQ ID NO: 3562141 - DNA, 17 bp, Homo sapiens
gtgacattttacattaa

SEQ ID NO: 3562142 - DNA, 15 bp, Homo sapiens
gtgaccagaaagctt

SEQ ID NO: 3562143 - DNA, 12 bp, Homo sapiens
gtgactccaggg

SEQ ID NO: 3562144 - DNA, 14 bp, Homo sapiens
gtgactcctgctgg

SEQ ID NO: 3562145 - DNA, 14 bp, Homo sapiens
gtgactcctgttgc

SEQ ID NO: 3562146 - DNA, 17 bp, Homo sapiens
gtgactccttatctctt

SEQ ID NO: 3562147 - DNA, 21 bp, Homo sapiens
gtgactccttatctctttcca

SEQ ID NO: 3562148 - DNA, 21 bp, Homo sapiens
gtgactctcctgcctcagcct

SEQ ID NO: 3562149 - DNA, 17 bp, Homo sapiens
gtgagaatggcctggag

SEQ ID NO: 3562150 - DNA, 20 bp, Homo sapiens
gtgagaatggcctggagcag

SEQ ID NO: 3562151 - DNA, 23 bp, Homo sapiens
gtgagaatggcctggagcaggcc

SEQ ID NO: 3562152 - DNA, 23 bp, Homo sapiens
gtgagacgtgatgggctaggcct

SEQ ID NO: 3562153 - DNA, 17 bp, Homo sapiens
gtgagagaaagagagaa

SEQ ID NO: 3562154 - DNA, 18 bp, Homo sapiens
gtgagagaaagagagaag

SEQ ID NO: 3562155 - DNA, 19 bp, Homo sapiens
gtgagagaaagagagaagc

SEQ ID NO: 3562156 - DNA, 16 bp, Homo sapiens
gtgagagtcaaagctg

SEQ ID NO: 3562157 - DNA, 14 bp, Homo sapiens
gtttaaagaaagtg

SEQ ID NO: 3562158 - DNA, 15 bp, Homo sapiens
gtttaaagaaagtgt

SEQ ID NO: 3562159 - DNA, 17 bp, Homo sapiens
gtttaaagaaagtgtat

SEQ ID NO: 3562160 - DNA, 19 bp, Homo sapiens
gtttaatcttttttttaaa

SEQ ID NO: 3562161 - DNA, 20 bp, Homo sapiens
gtttaatggtagttttacag

SEQ ID NO: 3562162 - DNA, 21 bp, Homo sapiens
gtttaatgttaattatgcagt

SEQ ID NO: 3562163 - DNA, 24 bp, Homo sapiens
gtttaatgttaattatgcagtgtt

SEQ ID NO: 3562164 - DNA, 23 bp, Homo sapiens
gtttaattgaaagaatgtaaagc

SEQ ID NO: 3562165 - DNA, 15 bp, Homo sapiens
gtttacactgcacat

SEQ ID NO: 3562166 - DNA, 11 bp, Homo sapiens
gtttacagtat

SEQ ID NO: 3562167 - DNA, 12 bp, Homo sapiens
gtttaccttgta

SEQ ID NO: 3562168 - DNA, 22 bp, Homo sapiens
gtttacgtgtaaaggaaaataa

SEQ ID NO: 3562169 - DNA, 14 bp, Homo sapiens
gtttactgaaattt

SEQ ID NO: 3562170 - DNA, 16 bp, Homo sapiens
gtttagaaaaaacaat

SEQ ID NO: 3562171 - DNA, 16 bp, Homo sapiens
gtttagaagaagtgtg

SEQ ID NO: 3562172 - DNA, 19 bp, Homo sapiens
gtttagaggaacccaagat

SEQ ID NO: 3562173 - DNA, 17 bp, Homo sapiens
gtttagatgaatgtcag

SEQ ID NO: 3562174 - DNA, 18 bp, Homo sapiens
gtttagatgaatgtcagt

SEQ ID NO: 3562175 - DNA, 21 bp, Homo sapiens
gtttaggccttgccagttttc

SEQ ID NO: 3562176 - DNA, 13 bp, Homo sapiens
gtttataataaac

SEQ ID NO: 3562177 - DNA, 21 bp, Homo sapiens
gtttatattgtttttatatat

SEQ ID NO: 3562178 - DNA, 22 bp, Homo sapiens
gtttattaatcttagtgtatga

SEQ ID NO: 3562179 - DNA, 21 bp, Homo sapiens
gtttcactgcaaacacacctt

SEQ ID NO: 3562180 - DNA, 17 bp, Homo sapiens
gtttcatgttagttacc

SEQ ID NO: 3562181 - DNA, 21 bp, Homo sapiens
gtttcatttagtcatgtgacc

SEQ ID NO: 3562182 - DNA, 16 bp, Homo sapiens
gtttccagcttgcatt

SEQ ID NO: 3562183 - DNA, 21 bp, Homo sapiens
gtttccccacaaaacaaagca

SEQ ID NO: 3562184 - DNA, 15 bp, Homo sapiens
gtttccctctgtgtt

SEQ ID NO: 3562185 - DNA, 14 bp, Homo sapiens
gtttccctgcctct

SEQ ID NO: 3562186 - DNA, 13 bp, Homo sapiens
gtttccctgctga

SEQ ID NO: 3562187 - DNA, 14 bp, Homo sapiens
gtttccctgctgaa

SEQ ID NO: 3562188 - DNA, 14 bp, Homo sapiens
gtttccgcggcggc

SEQ ID NO: 3562189 - DNA, 19 bp, Homo sapiens
gtttcctcagtgatggaat

SEQ ID NO: 3562190 - DNA, 22 bp, Homo sapiens
gtttcctcagtgatggaatatc

SEQ ID NO: 3562191 - DNA, 16 bp, Homo sapiens
gtttcctgcaggccag

SEQ ID NO: 3562192 - DNA, 18 bp, Homo sapiens
gtttccttttcaggagat

SEQ ID NO: 3562193 - DNA, 16 bp, Homo sapiens
gtttcgactggtccag

SEQ ID NO: 3562194 - DNA, 19 bp, Homo sapiens
gtttcgactggtccagctc

SEQ ID NO: 3562195 - DNA, 21 bp, Homo sapiens
gtttcgactggtccagctctg

SEQ ID NO: 3562196 - DNA, 15 bp, Homo sapiens
gtttctagctctcac

SEQ ID NO: 3562197 - DNA, 20 bp, Homo sapiens
gtttctagctctcacagaca

SEQ ID NO: 3562198 - DNA, 14 bp, Homo sapiens
gtttctcagctccc

SEQ ID NO: 3562199 - DNA, 14 bp, Homo sapiens
gtttctccttttcc

SEQ ID NO: 3562200 - DNA, 15 bp, Homo sapiens
gtttctccttttcct

SEQ ID NO: 3562201 - DNA, 11 bp, Homo sapiens
gtttctctaag

SEQ ID NO: 3562202 - DNA, 14 bp, Homo sapiens
gtttctctaaggaa

SEQ ID NO: 3562203 - DNA, 18 bp, Homo sapiens
gtttctgtttgattcttt

SEQ ID NO: 3562204 - DNA, 23 bp, Homo sapiens
gtttcttttcacattaggctgtt

SEQ ID NO: 3562205 - DNA, 22 bp, Homo sapiens
gtttgaaatgaggtctgtttaa

SEQ ID NO: 3562206 - DNA, 21 bp, Homo sapiens
gtttgaagaccaatcaaatat

SEQ ID NO: 3562207 - DNA, 17 bp, Homo sapiens
gtttgaaggagaatggc

SEQ ID NO: 3562208 - DNA, 22 bp, Homo sapiens
gtttgacaccttagagaagcta

SEQ ID NO: 3562209 - DNA, 22 bp, Homo sapiens
gtttgagttaatgtgctgagca

SEQ ID NO: 3562210 - DNA, 20 bp, Homo sapiens
gtttgatagtaaatgtccac

SEQ ID NO: 3562211 - DNA, 21 bp, Homo sapiens
gtttgcaggttaacttagcta

SEQ ID NO: 3562212 - DNA, 21 bp, Homo sapiens
gtttgccttttatgtaaattt

SEQ ID NO: 3562213 - DNA, 14 bp, Homo sapiens
gtttgctgaaattt

SEQ ID NO: 3562214 - DNA, 19 bp, Homo sapiens
gtttgctgtgctttggaac

SEQ ID NO: 3562215 - DNA, 14 bp, Homo sapiens
gtttgggagccagg

SEQ ID NO: 3562216 - DNA, 15 bp, Homo sapiens
gtttgtaacaagaaa

SEQ ID NO: 3562217 - DNA, 14 bp, Homo sapiens
gtttgtagccaggt

SEQ ID NO: 3562218 - DNA, 15 bp, Homo sapiens
gtttgtagccaggta

SEQ ID NO: 3562219 - DNA, 22 bp, Homo sapiens
gtttgtcctgatgcttttgtct

SEQ ID NO: 3562220 - DNA, 20 bp, Homo sapiens
gttttaacaatccattcaca

SEQ ID NO: 3562221 - DNA, 16 bp, Homo sapiens
gttttaagtactacac

SEQ ID NO: 3562222 - DNA, 11 bp, Homo sapiens
gttttacaata

SEQ ID NO: 3562223 - DNA, 16 bp, Homo sapiens
gttttacaatagttct

SEQ ID NO: 3562224 - DNA, 14 bp, Homo sapiens
gttttacagtgttt

SEQ ID NO: 3562225 - DNA, 16 bp, Homo sapiens
gttttagcatttgtat

SEQ ID NO: 3562226 - DNA, 18 bp, Homo sapiens
gttttagcatttgtataa

SEQ ID NO: 3562227 - DNA, 17 bp, Homo sapiens
gttttagtgtaaaattg

SEQ ID NO: 3562228 - DNA, 21 bp, Homo sapiens
gttttatagaaaacctgactt

SEQ ID NO: 3562229 - DNA, 20 bp, Homo sapiens
gttttcattttagacattca

SEQ ID NO: 3562230 - DNA, 14 bp, Homo sapiens
gttttcctcccttc

SEQ ID NO: 3562231 - DNA, 16 bp, Homo sapiens
gttttccttcttccca

SEQ ID NO: 3562232 - DNA, 18 bp, Homo sapiens
gttttctcctcccaggaa

SEQ ID NO: 3562233 - DNA, 16 bp, Homo sapiens
gttttcttgataattt

SEQ ID NO: 3562234 - DNA, 19 bp, Homo sapiens
gttttgatttgtactgaaa

SEQ ID NO: 3562235 - DNA, 19 bp, Homo sapiens
gttttgtatcttaaatttg

SEQ ID NO: 3562236 - DNA, 19 bp, Homo sapiens
gttttgttttcgtttttca

SEQ ID NO: 3562237 - DNA, 16 bp, Homo sapiens
gtttttaatttaaact

SEQ ID NO: 3562238 - DNA, 13 bp, Homo sapiens
gtttttcaattaa

SEQ ID NO: 3562239 - DNA, 14 bp, Homo sapiens
gtttttcaattaaa

SEQ ID NO: 3562240 - DNA, 15 bp, Homo sapiens
gtttttcaattaaac

SEQ ID NO: 3562241 - DNA, 18 bp, Homo sapiens
gtttttcaattaaacgga

SEQ ID NO: 3562242 - DNA, 21 bp, Homo sapiens
gtttttcaattaaacggatta

SEQ ID NO: 3562243 - DNA, 15 bp, Homo sapiens
gtttttcatgtttta

SEQ ID NO: 3562244 - DNA, 16 bp, Homo sapiens
gtttttttctttggct

SEQ ID NO: 3562245 - DNA, 18 bp, Homo sapiens
gtttttttctttggctgc

SEQ ID NO: 3562246 - DNA, 12 bp, Homo sapiens
taaaaaaactgg

SEQ ID NO: 3562247 - DNA, 18 bp, Homo sapiens
taaaaaacactaaacatt

SEQ ID NO: 3562248 - DNA, 16 bp, Homo sapiens
taaaaaagcaaggcac

SEQ ID NO: 3562249 - DNA, 12 bp, Homo sapiens
taaaaaatgaat

SEQ ID NO: 3562250 - DNA, 14 bp, Homo sapiens
taaaaaatggtcac

SEQ ID NO: 3562251 - DNA, 18 bp, Homo sapiens
taaaaagatgaaaaagaa

SEQ ID NO: 3562252 - DNA, 19 bp, Homo sapiens
taaaaaggacatcagcaaa

SEQ ID NO: 3562253 - DNA, 16 bp, Homo sapiens
taaaaaggcccttaga

SEQ ID NO: 3562254 - DNA, 16 bp, Homo sapiens
taaaaaggtaaatggt

SEQ ID NO: 3562255 - DNA, 21 bp, Homo sapiens
taaaaagtaatgacttagaaa

SEQ ID NO: 3562256 - DNA, 17 bp, Homo sapiens
taaaaagtgtttaaatg

SEQ ID NO: 3562257 - DNA, 23 bp, Homo sapiens
taaaaagttgttctttgtttcca

SEQ ID NO: 3562258 - DNA, 14 bp, Homo sapiens
taaaaataaggtct

SEQ ID NO: 3562259 - DNA, 23 bp, Homo sapiens
taaaaatcatatagaccaattga

SEQ ID NO: 3562260 - DNA, 18 bp, Homo sapiens
taaaaatgagtcatttgt

SEQ ID NO: 3562261 - DNA, 20 bp, Homo sapiens
taaaaatgggtgttattttt

SEQ ID NO: 3562262 - DNA, 13 bp, Homo sapiens
taaaaatgtcttt

SEQ ID NO: 3562263 - DNA, 16 bp, Homo sapiens
taaaaatgtctttcat

SEQ ID NO: 3562264 - DNA, 12 bp, Homo sapiens
taaaaatgttac

SEQ ID NO: 3562265 - DNA, 13 bp, Homo sapiens
taaaaattaaatg

SEQ ID NO: 3562266 - DNA, 12 bp, Homo sapiens
taaaaattgtta

SEQ ID NO: 3562267 - DNA, 13 bp, Homo sapiens
taaaacaaaggga

SEQ ID NO: 3562268 - DNA, 15 bp, Homo sapiens
taaaacaaatgaaat

SEQ ID NO: 3562269 - DNA, 17 bp, Homo sapiens
taaaacataaacacatt

SEQ ID NO: 3562270 - DNA, 19 bp, Homo sapiens
taaaacataaacacatttc

SEQ ID NO: 3562271 - DNA, 16 bp, Homo sapiens
taaaacattaaaatat

SEQ ID NO: 3562272 - DNA, 19 bp, Homo sapiens
taaaacattacttatttaa

SEQ ID NO: 3562273 - DNA, 14 bp, Homo sapiens
taaaaccacagcag

SEQ ID NO: 3562274 - DNA, 21 bp, Homo sapiens
taaaacccaaaggtggcagct

SEQ ID NO: 3562275 - DNA, 19 bp, Homo sapiens
taaaacgcgtctgcctggg

SEQ ID NO: 3562276 - DNA, 13 bp, Homo sapiens
taaaacttctgct

SEQ ID NO: 3562277 - DNA, 14 bp, Homo sapiens
taaaagaaataaac

SEQ ID NO: 3562278 - DNA, 16 bp, Homo sapiens
taaaagaaataaacca

SEQ ID NO: 3562279 - DNA, 16 bp, Homo sapiens
taaaagaatattttaa

SEQ ID NO: 3562280 - DNA, 23 bp, Homo sapiens
taaaagaatattttaacttcctt

SEQ ID NO: 3562281 - DNA, 11 bp, Homo sapiens
taaaagatatg

SEQ ID NO: 3562282 - DNA, 13 bp, Homo sapiens
taaaagatatgtt

SEQ ID NO: 3562283 - DNA, 19 bp, Homo sapiens
taaaagcacaaaggaatga

SEQ ID NO: 3562284 - DNA, 21 bp, Homo sapiens
taaaagcattttaatactaag

SEQ ID NO: 3562285 - DNA, 18 bp, Homo sapiens
taaaagcattttgtaata

SEQ ID NO: 3562286 - DNA, 15 bp, Homo sapiens
taaaaggatgtataa

SEQ ID NO: 3562287 - DNA, 20 bp, Homo sapiens
taaaagtaataaagagaaat

SEQ ID NO: 3562288 - DNA, 12 bp, Homo sapiens
taaaagtattca

SEQ ID NO: 3562289 - DNA, 15 bp, Homo sapiens
taaaagtattcatac

SEQ ID NO: 3562290 - DNA, 23 bp, Homo sapiens
tacaactggagtttttttataca

SEQ ID NO: 3562291 - DNA, 22 bp, Homo sapiens
tacaaggtggggattgcccctg

SEQ ID NO: 3562292 - DNA, 15 bp, Homo sapiens
tacaagtataacagt

SEQ ID NO: 3562293 - DNA, 13 bp, Homo sapiens
tacaataaactgg

SEQ ID NO: 3562294 - DNA, 15 bp, Homo sapiens
tacaataaactggta

SEQ ID NO: 3562295 - DNA, 12 bp, Homo sapiens
tacaataaattt

SEQ ID NO: 3562296 - DNA, 15 bp, Homo sapiens
tacacacccgcctga

SEQ ID NO: 3562297 - DNA, 17 bp, Homo sapiens
tacacacccgcctgaca

SEQ ID NO: 3562298 - DNA, 14 bp, Homo sapiens
tacacacgctgcct

SEQ ID NO: 3562299 - DNA, 23 bp, Homo sapiens
tacacacgctgccttcggtaccc

SEQ ID NO: 3562300 - DNA, 16 bp, Homo sapiens
tacacatttttaaatt

SEQ ID NO: 3562301 - DNA, 12 bp, Homo sapiens
tacaccctttcc

SEQ ID NO: 3562302 - DNA, 15 bp, Homo sapiens
tacactgatgcaagg

SEQ ID NO: 3562303 - DNA, 22 bp, Homo sapiens
tacactggtatttatatttcaa

SEQ ID NO: 3562304 - DNA, 21 bp, Homo sapiens
tacactgtaagctttgttctg

SEQ ID NO: 3562305 - DNA, 16 bp, Homo sapiens
tacacttacactttat

SEQ ID NO: 3562306 - DNA, 19 bp, Homo sapiens
tacagacatggaacagtgt

SEQ ID NO: 3562307 - DNA, 17 bp, Homo sapiens
tacagactccatctctt

SEQ ID NO: 3562308 - DNA, 19 bp, Homo sapiens
tacagactccatctcttct

SEQ ID NO: 3562309 - DNA, 23 bp, Homo sapiens
tacagactccatctcttctgcaa

SEQ ID NO: 3562310 - DNA, 14 bp, Homo sapiens
tacagagaagaaaa

SEQ ID NO: 3562311 - DNA, 18 bp, Homo sapiens
tacagaggaaatctgtaa

SEQ ID NO: 3562312 - DNA, 18 bp, Homo sapiens
tacagaggacagtatttg

SEQ ID NO: 3562313 - DNA, 13 bp, Homo sapiens
tacagagtgggcc

SEQ ID NO: 3562314 - DNA, 19 bp, Homo sapiens
tacagatttattcctttgt

SEQ ID NO: 3562315 - DNA, 19 bp, Homo sapiens
tacagcaaaagatgtgcaa

SEQ ID NO: 3562316 - DNA, 21 bp, Homo sapiens
tacagccaagtgccaaatgct

SEQ ID NO: 3562317 - DNA, 16 bp, Homo sapiens
tacagctaatcagcat

SEQ ID NO: 3562318 - DNA, 14 bp, Homo sapiens
tacagctgcctgca

SEQ ID NO: 3562319 - DNA, 15 bp, Homo sapiens
tacaggagaggcagc

SEQ ID NO: 3562320 - DNA, 13 bp, Homo sapiens
tacaggagccagc

SEQ ID NO: 3562321 - DNA, 17 bp, Homo sapiens
tacaggagccagcctgc

SEQ ID NO: 3562322 - DNA, 23 bp, Homo sapiens
tacaggagccagcctgcttccca

SEQ ID NO: 3562323 - DNA, 16 bp, Homo sapiens
tacaggtaactaattg

SEQ ID NO: 3562324 - DNA, 19 bp, Homo sapiens
tacaggtaactaattggaa

SEQ ID NO: 3562325 - DNA, 16 bp, Homo sapiens
tacaggtgacagtgaa

SEQ ID NO: 3562326 - DNA, 17 bp, Homo sapiens
tacagtagcttgaaatt

SEQ ID NO: 3562327 - DNA, 16 bp, Homo sapiens
tacagtatataagctt

SEQ ID NO: 3562328 - DNA, 17 bp, Homo sapiens
tacagtatataagcttt

SEQ ID NO: 3562329 - DNA, 12 bp, Homo sapiens
tacagtatttct

SEQ ID NO: 3562330 - DNA, 14 bp, Homo sapiens
tacagttctgtggt

SEQ ID NO: 3562331 - DNA, 20 bp, Homo sapiens
tacataacggaaagttttta

SEQ ID NO: 3562332 - DNA, 19 bp, Homo sapiens
tacataactcctgtccctt

SEQ ID NO: 3562333 - DNA, 15 bp, Homo sapiens
tacatacaccagcat

SEQ ID NO: 3562334 - DNA, 17 bp, Homo sapiens
tacatactatgaaatat

SEQ ID NO: 3562335 - DNA, 20 bp, Homo sapiens
tacatactatgaaatatgta

SEQ ID NO: 3562336 - DNA, 14 bp, Homo sapiens
tacatatattttta

SEQ ID NO: 3562337 - DNA, 15 bp, Homo sapiens
tacatatcaaaacat

SEQ ID NO: 3562338 - DNA, 21 bp, Homo sapiens
tacatccctcagtttcttaaa

SEQ ID NO: 3562339 - DNA, 22 bp, Homo sapiens
tacatccctcagtttcttaaaa

SEQ ID NO: 3562340 - DNA, 22 bp, Homo sapiens
tacatccttgattacttccact

SEQ ID NO: 3562341 - DNA, 13 bp, Homo sapiens
tacatctggctgg

SEQ ID NO: 3562342 - DNA, 12 bp, Homo sapiens
tacatgaaacag

SEQ ID NO: 3562343 - DNA, 13 bp, Homo sapiens
tacatgaaacaga

SEQ ID NO: 3562344 - DNA, 20 bp, Homo sapiens
tacatgaatgggcatttcta

SEQ ID NO: 3562345 - DNA, 20 bp, Homo sapiens
tacatgacagatattttatc

SEQ ID NO: 3562346 - DNA, 15 bp, Homo sapiens
tacatgcagaaattg

SEQ ID NO: 3562347 - DNA, 12 bp, Homo sapiens
tacatgttcttt

SEQ ID NO: 3562348 - DNA, 15 bp, Homo sapiens
tacatgttctttgta

SEQ ID NO: 3562349 - DNA, 18 bp, Homo sapiens
tacatgttggaaatgtgt

SEQ ID NO: 3562350 - DNA, 21 bp, Homo sapiens
tacatgttttttcatttgtaa

SEQ ID NO: 3562351 - DNA, 20 bp, Homo sapiens
tacattaaaataaaccaaat

SEQ ID NO: 3562352 - DNA, 15 bp, Homo sapiens
tacattaacggtgct

SEQ ID NO: 3562353 - DNA, 18 bp, Homo sapiens
tacattaacggtgctaaa

SEQ ID NO: 3562354 - DNA, 19 bp, Homo sapiens
tacattaacggtgctaaaa

SEQ ID NO: 3562355 - DNA, 12 bp, Homo sapiens
tacattactaaa

SEQ ID NO: 3562356 - DNA, 19 bp, Homo sapiens
tacattagcagtttgcttt

SEQ ID NO: 3562357 - DNA, 19 bp, Homo sapiens
tacatttaaaacattaaaa

SEQ ID NO: 3562358 - DNA, 15 bp, Homo sapiens
tacatttaataatat

SEQ ID NO: 3562359 - DNA, 18 bp, Homo sapiens
tacatttcatacaacaga

SEQ ID NO: 3562360 - DNA, 14 bp, Homo sapiens
tacatttctgattc

SEQ ID NO: 3562361 - DNA, 16 bp, Homo sapiens
tacattttatatgtga

SEQ ID NO: 3562362 - DNA, 14 bp, Homo sapiens
taccaaaagacatt

SEQ ID NO: 3562363 - DNA, 21 bp, Homo sapiens
taccaaatagtgattgtaaca

SEQ ID NO: 3562364 - DNA, 20 bp, Homo sapiens
taccagataacaaacactga

SEQ ID NO: 3562365 - DNA, 16 bp, Homo sapiens
taccagcttaaaacac

SEQ ID NO: 3562366 - DNA, 15 bp, Homo sapiens
taccagggtctctca

SEQ ID NO: 3562367 - DNA, 19 bp, Homo sapiens
taccagggtctctcaggga

SEQ ID NO: 3562368 - DNA, 12 bp, Homo sapiens
taccagtattta

SEQ ID NO: 3562369 - DNA, 18 bp, Homo sapiens
taccagtatttagaagcc

SEQ ID NO: 3562370 - DNA, 19 bp, Homo sapiens
taccagtatttagaagcca

SEQ ID NO: 3562371 - DNA, 19 bp, Homo sapiens
taccattctattctccaga

SEQ ID NO: 3562372 - DNA, 20 bp, Homo sapiens
taccattctattctccagac

SEQ ID NO: 3562373 - DNA, 22 bp, Homo sapiens
taccattctattctccagacat

SEQ ID NO: 3562374 - DNA, 23 bp, Homo sapiens
taccattctattctccagacatg

SEQ ID NO: 3562375 - DNA, 14 bp, Homo sapiens
taccattgtggaat

SEQ ID NO: 3562376 - DNA, 16 bp, Homo sapiens
taccatttcagagagg

SEQ ID NO: 3562377 - DNA, 14 bp, Homo sapiens
tacccaaccctgcc

SEQ ID NO: 3562378 - DNA, 12 bp, Homo sapiens
tacccacccaga

SEQ ID NO: 3562379 - DNA, 22 bp, Homo sapiens
tacccagcatgactttccttag

SEQ ID NO: 3562380 - DNA, 17 bp, Homo sapiens
taccccagccaggctcc

SEQ ID NO: 3562381 - DNA, 16 bp, Homo sapiens
taccctcctctgctgg

SEQ ID NO: 3562382 - DNA, 17 bp, Homo sapiens
taccctcctctgctggg

SEQ ID NO: 3562383 - DNA, 18 bp, Homo sapiens
taccctcctctgctggga

SEQ ID NO: 3562384 - DNA, 22 bp, Homo sapiens
taccctcttcatggatggggga

SEQ ID NO: 3562385 - DNA, 17 bp, Homo sapiens
taccctgaggtcactgc

SEQ ID NO: 3562386 - DNA, 14 bp, Homo sapiens
taccctggcaggga

SEQ ID NO: 3562387 - DNA, 22 bp, Homo sapiens
taccctggcagggacctgagag

SEQ ID NO: 3562388 - DNA, 19 bp, Homo sapiens
tacccttggaaagaaatgt

SEQ ID NO: 3562389 - DNA, 20 bp, Homo sapiens
tacccttttcccccttccca

SEQ ID NO: 3562390 - DNA, 17 bp, Homo sapiens
taccgagtctcttctcc

SEQ ID NO: 3562391 - DNA, 18 bp, Homo sapiens
taccggattctctcttta

SEQ ID NO: 3562392 - DNA, 16 bp, Homo sapiens
taccgtggatttgtac

SEQ ID NO: 3562393 - DNA, 22 bp, Homo sapiens
tacctaagattacaaatcagaa

SEQ ID NO: 3562394 - DNA, 17 bp, Homo sapiens
tacctactattggccct

SEQ ID NO: 3562395 - DNA, 18 bp, Homo sapiens
tacctagctaattattta

SEQ ID NO: 3562396 - DNA, 14 bp, Homo sapiens
tacctattctgaaa

SEQ ID NO: 3562397 - DNA, 22 bp, Homo sapiens
tacctattctgaaaaagacata

SEQ ID NO: 3562398 - DNA, 21 bp, Homo sapiens
tacctcaagccccatttcctc

SEQ ID NO: 3562399 - DNA, 17 bp, Homo sapiens
tacctcagcctcctggg

SEQ ID NO: 3562400 - DNA, 18 bp, Homo sapiens
tacctctaataaacactg

SEQ ID NO: 3562401 - DNA, 15 bp, Homo sapiens
tacctctgtctgaga

SEQ ID NO: 3562402 - DNA, 17 bp, Homo sapiens
tacctctgtctgagaca

SEQ ID NO: 3562403 - DNA, 12 bp, Homo sapiens
tacctctgtgcc

SEQ ID NO: 3562404 - DNA, 13 bp, Homo sapiens
tacctcttggctg

SEQ ID NO: 3562405 - DNA, 13 bp, Homo sapiens
tacctggcctaga

SEQ ID NO: 3562406 - DNA, 15 bp, Homo sapiens
tacctggcctagaaa

SEQ ID NO: 3562407 - DNA, 15 bp, Homo sapiens
tacctgtattcccag

SEQ ID NO: 3562408 - DNA, 15 bp, Homo sapiens
tacctgtctgctgcc

SEQ ID NO: 3562409 - DNA, 17 bp, Homo sapiens
tacctgtctgctgccag

SEQ ID NO: 3562410 - DNA, 20 bp, Homo sapiens
tacctgtctgctgccagcac

SEQ ID NO: 3562411 - DNA, 20 bp, Homo sapiens
tacctgtgtttttttctaaa

SEQ ID NO: 3562412 - DNA, 18 bp, Homo sapiens
taccttatcactgcatta

SEQ ID NO: 3562413 - DNA, 15 bp, Homo sapiens
taccttctttctaat

SEQ ID NO: 3562414 - DNA, 14 bp, Homo sapiens
taccttgtatactg

SEQ ID NO: 3562415 - DNA, 23 bp, Homo sapiens
tacctttgttcccaaatttcata

SEQ ID NO: 3562416 - DNA, 18 bp, Homo sapiens
taccttttctcttttctt

SEQ ID NO: 3562417 - DNA, 16 bp, Homo sapiens
tacctttttttagtta

SEQ ID NO: 3562418 - DNA, 19 bp, Homo sapiens
tacgtgaagaaataaatga

SEQ ID NO: 3562419 - DNA, 19 bp, Homo sapiens
tacgtgtaaaggaaaataa

SEQ ID NO: 3562420 - DNA, 16 bp, Homo sapiens
tactaaaaagtataaa

SEQ ID NO: 3562421 - DNA, 21 bp, Homo sapiens
tactaaaaagtataaaatagt

SEQ ID NO: 3562422 - DNA, 11 bp, Homo sapiens
tactaaaatta

SEQ ID NO: 3562423 - DNA, 12 bp, Homo sapiens
tatctcaagtaa

SEQ ID NO: 3562424 - DNA, 15 bp, Homo sapiens
tatctcaagtaaaac

SEQ ID NO: 3562425 - DNA, 20 bp, Homo sapiens
tatctcaagtaaaacaaatg

SEQ ID NO: 3562426 - DNA, 21 bp, Homo sapiens
tatctcaagtaaaacaaatga

SEQ ID NO: 3562427 - DNA, 22 bp, Homo sapiens
tatctcaagtaaaacaaatgaa

SEQ ID NO: 3562428 - DNA, 12 bp, Homo sapiens
tatctcagccat

SEQ ID NO: 3562429 - DNA, 13 bp, Homo sapiens
tatctcagccata

SEQ ID NO: 3562430 - DNA, 16 bp, Homo sapiens
tatctcatctgtctcg

SEQ ID NO: 3562431 - DNA, 20 bp, Homo sapiens
tatctcctttgaagaaggca

SEQ ID NO: 3562432 - DNA, 23 bp, Homo sapiens
tatctctgtgtgcacaaatattt

SEQ ID NO: 3562433 - DNA, 19 bp, Homo sapiens
tatctgaaaggccagcagc

SEQ ID NO: 3562434 - DNA, 14 bp, Homo sapiens
tatctgctgttctt

SEQ ID NO: 3562435 - DNA, 13 bp, Homo sapiens
tatctggttctat

SEQ ID NO: 3562436 - DNA, 16 bp, Homo sapiens
tatctggttctatatg

SEQ ID NO: 3562437 - DNA, 19 bp, Homo sapiens
tatctgtgcttctaatatt

SEQ ID NO: 3562438 - DNA, 18 bp, Homo sapiens
tatctgttggagaaagaa

SEQ ID NO: 3562439 - DNA, 15 bp, Homo sapiens
tatcttaatccatta

SEQ ID NO: 3562440 - DNA, 17 bp, Homo sapiens
tatctttagatatttgc

SEQ ID NO: 3562441 - DNA, 19 bp, Homo sapiens
tatctttagatatttgcct

SEQ ID NO: 3562442 - DNA, 17 bp, Homo sapiens
tatgaaaatatagacat

SEQ ID NO: 3562443 - DNA, 21 bp, Homo sapiens
tatgaaactggtttataataa

SEQ ID NO: 3562444 - DNA, 22 bp, Homo sapiens
tatgaaactggtttataataaa

SEQ ID NO: 3562445 - DNA, 20 bp, Homo sapiens
tatgaaagatggctgtgcct

SEQ ID NO: 3562446 - DNA, 22 bp, Homo sapiens
tatgaaagatggctgtgcctct

SEQ ID NO: 3562447 - DNA, 23 bp, Homo sapiens
tatgaaagatggctgtgcctctg

SEQ ID NO: 3562448 - DNA, 20 bp, Homo sapiens
tatgaaatatgtataacttt

SEQ ID NO: 3562449 - DNA, 17 bp, Homo sapiens
tatgaaatgtgcacttt

SEQ ID NO: 3562450 - DNA, 20 bp, Homo sapiens
tatgaaattttttttcatgc

SEQ ID NO: 3562451 - DNA, 15 bp, Homo sapiens
tatgaataattgcat

SEQ ID NO: 3562452 - DNA, 22 bp, Homo sapiens
tatgaatgctattttttccctt

SEQ ID NO: 3562453 - DNA, 19 bp, Homo sapiens
tatgacatcacttgtacaa

SEQ ID NO: 3562454 - DNA, 23 bp, Homo sapiens
tatgacatcacttgtacaaaata

SEQ ID NO: 3562455 - DNA, 17 bp, Homo sapiens
tatgactatgtaaacta

SEQ ID NO: 3562456 - DNA, 18 bp, Homo sapiens
tatgactatgtaaactac

SEQ ID NO: 3562457 - DNA, 23 bp, Homo sapiens
tatgaggacttgtgtctctgtgc

SEQ ID NO: 3562458 - DNA, 18 bp, Homo sapiens
tatgagtgtatgtgttta

SEQ ID NO: 3562459 - DNA, 24 bp, Homo sapiens
tatgataggttattttgatgtaaa

SEQ ID NO: 3562460 - DNA, 18 bp, Homo sapiens
tatgatctcttctggtgt

SEQ ID NO: 3562461 - DNA, 21 bp, Homo sapiens
tatgatggatggcagactctt

SEQ ID NO: 3562462 - DNA, 22 bp, Homo sapiens
tatgattactggcctttttcat

SEQ ID NO: 3562463 - DNA, 21 bp, Homo sapiens
tatgattattaacgatgtcca

SEQ ID NO: 3562464 - DNA, 18 bp, Homo sapiens
tatgatttaatttgaaat

SEQ ID NO: 3562465 - DNA, 15 bp, Homo sapiens
tatgcaaagcactga

SEQ ID NO: 3562466 - DNA, 13 bp, Homo sapiens
tatgcaaatacaa

SEQ ID NO: 3562467 - DNA, 14 bp, Homo sapiens
tatgcaagcagctt

SEQ ID NO: 3562468 - DNA, 15 bp, Homo sapiens
tatgcaagcagcttt

SEQ ID NO: 3562469 - DNA, 17 bp, Homo sapiens
tatgcaatggattttca

SEQ ID NO: 3562470 - DNA, 18 bp, Homo sapiens
tatgcagtactaaaatta

SEQ ID NO: 3562471 - DNA, 13 bp, Homo sapiens
tatgcagtgaact

SEQ ID NO: 3562472 - DNA, 16 bp, Homo sapiens
tatgcagtgaactatt

SEQ ID NO: 3562473 - DNA, 21 bp, Homo sapiens
tatgcatggtgccccaggacc

SEQ ID NO: 3562474 - DNA, 17 bp, Homo sapiens
tatgcattagtatcaca

SEQ ID NO: 3562475 - DNA, 17 bp, Homo sapiens
tatgccacacctggcct

SEQ ID NO: 3562476 - DNA, 18 bp, Homo sapiens
tatgccacacctggcctt

SEQ ID NO: 3562477 - DNA, 20 bp, Homo sapiens
tatgccacttccttttaact

SEQ ID NO: 3562478 - DNA, 23 bp, Homo sapiens
tatgccctcaagtaaaagaaaag

SEQ ID NO: 3562479 - DNA, 22 bp, Homo sapiens
tatgcctctgacagtccacagg

SEQ ID NO: 3562480 - DNA, 15 bp, Homo sapiens
tatgctgtttcctag

SEQ ID NO: 3562481 - DNA, 18 bp, Homo sapiens
tatgcttgtaactaaaat

SEQ ID NO: 3562482 - DNA, 17 bp, Homo sapiens
tatggaaataaatgtat

SEQ ID NO: 3562483 - DNA, 13 bp, Homo sapiens
tatggaaggattt

SEQ ID NO: 3562484 - DNA, 19 bp, Homo sapiens
tatggagaacatgttttat

SEQ ID NO: 3562485 - DNA, 18 bp, Homo sapiens
tatggataatctgagcag

SEQ ID NO: 3562486 - DNA, 17 bp, Homo sapiens
tatggcaggactcctgg

SEQ ID NO: 3562487 - DNA, 21 bp, Homo sapiens
tatggcaggactcctggcagg

SEQ ID NO: 3562488 - DNA, 22 bp, Homo sapiens
tatggcaggactcctggcaggg

SEQ ID NO: 3562489 - DNA, 15 bp, Homo sapiens
tatggcatgactctt

SEQ ID NO: 3562490 - DNA, 17 bp, Homo sapiens
tatggcatgactcttca

SEQ ID NO: 3562491 - DNA, 16 bp, Homo sapiens
tatggctataggtgct

SEQ ID NO: 3562492 - DNA, 20 bp, Homo sapiens
tatggggatagatgtgtgga

SEQ ID NO: 3562493 - DNA, 15 bp, Homo sapiens
tatggtaggaccctc

SEQ ID NO: 3562494 - DNA, 20 bp, Homo sapiens
tatgtaaatggtatgtcatt

SEQ ID NO: 3562495 - DNA, 21 bp, Homo sapiens
tatgtaaatggtatgtcattc

SEQ ID NO: 3562496 - DNA, 20 bp, Homo sapiens
tatgtagctgtcgtacattg

SEQ ID NO: 3562497 - DNA, 19 bp, Homo sapiens
tatgtagtatctatatgac

SEQ ID NO: 3562498 - DNA, 19 bp, Homo sapiens
tatgtattttccaagtaaa

SEQ ID NO: 3562499 - DNA, 21 bp, Homo sapiens
tatgtcagaggaacagtcctg

SEQ ID NO: 3562500 - DNA, 20 bp, Homo sapiens
tatgtcagtccaataaatta

SEQ ID NO: 3562501 - DNA, 15 bp, Homo sapiens
tatgtcatcactcta

SEQ ID NO: 3562502 - DNA, 22 bp, Homo sapiens
tatgtctgctgagttggcctgg

SEQ ID NO: 3562503 - DNA, 14 bp, Homo sapiens
tatgtcttaaaacc

SEQ ID NO: 3562504 - DNA, 18 bp, Homo sapiens
tatgtgaaatgctttctg

SEQ ID NO: 3562505 - DNA, 21 bp, Homo sapiens
tatgtgacattttacattaaa

SEQ ID NO: 3562506 - DNA, 18 bp, Homo sapiens
tatgtgagctgtaaaaat

SEQ ID NO: 3562507 - DNA, 12 bp, Homo sapiens
tatgtggaagtg

SEQ ID NO: 3562508 - DNA, 16 bp, Homo sapiens
tatgtggaagtgtggg

SEQ ID NO: 3562509 - DNA, 23 bp, Homo sapiens
tatgtgtaacaggatacaggtga

SEQ ID NO: 3562510 - DNA, 15 bp, Homo sapiens
tatgtgtagttataa

SEQ ID NO: 3562511 - DNA, 20 bp, Homo sapiens
tatgtgtagttataaaccaa

SEQ ID NO: 3562512 - DNA, 22 bp, Homo sapiens
tatgtgtagttataaaccaatg

SEQ ID NO: 3562513 - DNA, 16 bp, Homo sapiens
tatgtgtttactttaa

SEQ ID NO: 3562514 - DNA, 22 bp, Homo sapiens
tatgttaagcagctaaattttc

SEQ ID NO: 3562515 - DNA, 16 bp, Homo sapiens
tatgttaatatttctg

SEQ ID NO: 3562516 - DNA, 14 bp, Homo sapiens
tatgttaatatttt

SEQ ID NO: 3562517 - DNA, 20 bp, Homo sapiens
tatgttaatattttatgtgt

SEQ ID NO: 3562518 - DNA, 22 bp, Homo sapiens
tatgttaatattttatgtgtaa

SEQ ID NO: 3562519 - DNA, 17 bp, Homo sapiens
tatgttctctgaatgag

SEQ ID NO: 3562520 - DNA, 18 bp, Homo sapiens
tatgttgtttataataaa

SEQ ID NO: 3562521 - DNA, 20 bp, Homo sapiens
tatgttgtttataataaaaa

SEQ ID NO: 3562522 - DNA, 19 bp, Homo sapiens
tatgtttggaatattccac

SEQ ID NO: 3562523 - DNA, 12 bp, Homo sapiens
tattaaaactca

SEQ ID NO: 3562524 - DNA, 16 bp, Homo sapiens
tattaaaactcatttt

SEQ ID NO: 3562525 - DNA, 17 bp, Homo sapiens
tattaaaatatttcagg

SEQ ID NO: 3562526 - DNA, 19 bp, Homo sapiens
tattaaaattgttaatatg

SEQ ID NO: 3562527 - DNA, 20 bp, Homo sapiens
tattaacatattatttcatt

SEQ ID NO: 3562528 - DNA, 12 bp, Homo sapiens
tattaagactgg

SEQ ID NO: 3562529 - DNA, 19 bp, Homo sapiens
tattaagcagtacaaatgt

SEQ ID NO: 3562530 - DNA, 17 bp, Homo sapiens
tattaagcagttcattc

SEQ ID NO: 3562531 - DNA, 22 bp, Homo sapiens
tattaagcagttcattctacca

SEQ ID NO: 3562532 - DNA, 21 bp, Homo sapiens
tattaatataataatgatgat

SEQ ID NO: 3562533 - DNA, 18 bp, Homo sapiens
tattaatcaagagaaact

SEQ ID NO: 3562534 - DNA, 14 bp, Homo sapiens
tattaatcttagtg

SEQ ID NO: 3562535 - DNA, 17 bp, Homo sapiens
tattaatcttagtgtat

SEQ ID NO: 3562536 - DNA, 17 bp, Homo sapiens
tattaatcttattgttt

SEQ ID NO: 3562537 - DNA, 20 bp, Homo sapiens
tattaatcttattgtttaat

SEQ ID NO: 3562538 - DNA, 22 bp, Homo sapiens
tattaattcaggttttttagtt

SEQ ID NO: 3562539 - DNA, 16 bp, Homo sapiens
tattaatttgaaacca

SEQ ID NO: 3562540 - DNA, 14 bp, Homo sapiens
tattacaatgatca

SEQ ID NO: 3562541 - DNA, 19 bp, Homo sapiens
tattacagataaaatgtaa

SEQ ID NO: 3562542 - DNA, 16 bp, Homo sapiens
tattaccttctttcta

SEQ ID NO: 3562543 - DNA, 23 bp, Homo sapiens
tattacttatttttgacagtgtt

SEQ ID NO: 3562544 - DNA, 17 bp, Homo sapiens
tattacttgcctatctg

SEQ ID NO: 3562545 - DNA, 13 bp, Homo sapiens
tattagccaactg

SEQ ID NO: 3562546 - DNA, 13 bp, Homo sapiens
tattataaattct

SEQ ID NO: 3562547 - DNA, 17 bp, Homo sapiens
tattatattcattcttt

SEQ ID NO: 3562548 - DNA, 12 bp, Homo sapiens
tattatccagag

SEQ ID NO: 3562549 - DNA, 15 bp, Homo sapiens
tattatcgctttatg

SEQ ID NO: 3562550 - DNA, 16 bp, Homo sapiens
tattattaataatgaa

SEQ ID NO: 3562551 - DNA, 15 bp, Homo sapiens
tattattatgttctt

SEQ ID NO: 3562552 - DNA, 15 bp, Homo sapiens
tattatttatttctg

SEQ ID NO: 3562553 - DNA, 22 bp, Homo sapiens
tattatttgggggaactggaca

SEQ ID NO: 3562554 - DNA, 20 bp, Homo sapiens
tcaggacccatccctgcctg

SEQ ID NO: 3562555 - DNA, 22 bp, Homo sapiens
tcaggacccatccctgcctgga

SEQ ID NO: 3562556 - DNA, 23 bp, Homo sapiens
tcaggacccatccctgcctggag

SEQ ID NO: 3562557 - DNA, 20 bp, Homo sapiens
tcaggactctctccaggagg

SEQ ID NO: 3562558 - DNA, 14 bp, Homo sapiens
tcaggagaagccag

SEQ ID NO: 3562559 - DNA, 10 bp, Homo sapiens
tcaggagatg

SEQ ID NO: 3562560 - DNA, 18 bp, Homo sapiens
tcaggagatggagggctt

SEQ ID NO: 3562561 - DNA, 23 bp, Homo sapiens
tcaggagatggagggcttggccc

SEQ ID NO: 3562562 - DNA, 15 bp, Homo sapiens
tcaggagatggggaa

SEQ ID NO: 3562563 - DNA, 18 bp, Homo sapiens
tcaggagcctggccaggc

SEQ ID NO: 3562564 - DNA, 22 bp, Homo sapiens
tcaggagcctggccaggcaggg

SEQ ID NO: 3562565 - DNA, 18 bp, Homo sapiens
tcaggagctccatacaca

SEQ ID NO: 3562566 - DNA, 22 bp, Homo sapiens
tcaggagctccatacacacgct

SEQ ID NO: 3562567 - DNA, 17 bp, Homo sapiens
tcaggaggggcagcgca

SEQ ID NO: 3562568 - DNA, 19 bp, Homo sapiens
tcaggatccagtgacatga

SEQ ID NO: 3562569 - DNA, 16 bp, Homo sapiens
tcaggcagctgaaatt

SEQ ID NO: 3562570 - DNA, 14 bp, Homo sapiens
tcaggccagcccag

SEQ ID NO: 3562571 - DNA, 18 bp, Homo sapiens
tcaggccagcccagccag

SEQ ID NO: 3562572 - DNA, 19 bp, Homo sapiens
tcaggccagcccagccagg

SEQ ID NO: 3562573 - DNA, 16 bp, Homo sapiens
tcaggctaagaccctg

SEQ ID NO: 3562574 - DNA, 15 bp, Homo sapiens
tcaggctagctgtgc

SEQ ID NO: 3562575 - DNA, 22 bp, Homo sapiens
tcaggctccgggcaccaggggc

SEQ ID NO: 3562576 - DNA, 17 bp, Homo sapiens
tcaggctctgcacagac

SEQ ID NO: 3562577 - DNA, 18 bp, Homo sapiens
tcaggctctgcacagaca

SEQ ID NO: 3562578 - DNA, 18 bp, Homo sapiens
tcagggaaaagcagctct

SEQ ID NO: 3562579 - DNA, 16 bp, Homo sapiens
tcagggaactgaccct

SEQ ID NO: 3562580 - DNA, 20 bp, Homo sapiens
tcagggaactgaccctcagg

SEQ ID NO: 3562581 - DNA, 18 bp, Homo sapiens
tcagggaccgtccagggg

SEQ ID NO: 3562582 - DNA, 20 bp, Homo sapiens
tcagggatcacactgccgtc

SEQ ID NO: 3562583 - DNA, 22 bp, Homo sapiens
tcagggatggagggaagacctg

SEQ ID NO: 3562584 - DNA, 17 bp, Homo sapiens
tcagggccaggtgcaga

SEQ ID NO: 3562585 - DNA, 20 bp, Homo sapiens
tcagggccaggtgcagacct

SEQ ID NO: 3562586 - DNA, 23 bp, Homo sapiens
tcagggccaggtgcagaccttgg

SEQ ID NO: 3562587 - DNA, 14 bp, Homo sapiens
tcagggctggagcc

SEQ ID NO: 3562588 - DNA, 17 bp, Homo sapiens
tcagggctggagcctgg

SEQ ID NO: 3562589 - DNA, 22 bp, Homo sapiens
tcagggcttctagtttctctta

SEQ ID NO: 3562590 - DNA, 15 bp, Homo sapiens
tcaggggcctggagg

SEQ ID NO: 3562591 - DNA, 18 bp, Homo sapiens
tcaggtctgtatgtcatg

SEQ ID NO: 3562592 - DNA, 19 bp, Homo sapiens
tcaggtgggagatttggaa

SEQ ID NO: 3562593 - DNA, 16 bp, Homo sapiens
tcaggtgtataaatgt

SEQ ID NO: 3562594 - DNA, 14 bp, Homo sapiens
tcagtaagttctgt

SEQ ID NO: 3562595 - DNA, 14 bp, Homo sapiens
tcagtaatttgagg

SEQ ID NO: 3562596 - DNA, 12 bp, Homo sapiens
tcagtatgtgga

SEQ ID NO: 3562597 - DNA, 17 bp, Homo sapiens
tcagtgactcctgctgg

SEQ ID NO: 3562598 - DNA, 22 bp, Homo sapiens
tcagtgactcctgctggtacct

SEQ ID NO: 3562599 - DNA, 16 bp, Homo sapiens
tcagtgagcccctccc

SEQ ID NO: 3562600 - DNA, 20 bp, Homo sapiens
tcagtgagcccctccccagc

SEQ ID NO: 3562601 - DNA, 14 bp, Homo sapiens
tcagtgatggaata

SEQ ID NO: 3562602 - DNA, 15 bp, Homo sapiens
tcagtgatggaatat

SEQ ID NO: 3562603 - DNA, 12 bp, Homo sapiens
tcagtgcatcat

SEQ ID NO: 3562604 - DNA, 15 bp, Homo sapiens
tcagtggggcagcct

SEQ ID NO: 3562605 - DNA, 14 bp, Homo sapiens
tcagtggggctggc

SEQ ID NO: 3562606 - DNA, 16 bp, Homo sapiens
tcagtggggctggcat

SEQ ID NO: 3562607 - DNA, 21 bp, Homo sapiens
tcagtgtatggaaataaatgt

SEQ ID NO: 3562608 - DNA, 16 bp, Homo sapiens
tcagtgtgtcagtttt

SEQ ID NO: 3562609 - DNA, 17 bp, Homo sapiens
tcagtgtgtcagttttt

SEQ ID NO: 3562610 - DNA, 13 bp, Homo sapiens
tcagtgttttcat

SEQ ID NO: 3562611 - DNA, 18 bp, Homo sapiens
tcagtgttttcattttag

SEQ ID NO: 3562612 - DNA, 19 bp, Homo sapiens
tcagttctaggcctttcct

SEQ ID NO: 3562613 - DNA, 22 bp, Homo sapiens
tcagttctaggcctttcctctg

SEQ ID NO: 3562614 - DNA, 24 bp, Homo sapiens
tcagttctaggcctttcctctgca

SEQ ID NO: 3562615 - DNA, 15 bp, Homo sapiens
tcagttctctgggaa

SEQ ID NO: 3562616 - DNA, 22 bp, Homo sapiens
tcataaattatttgattattta

SEQ ID NO: 3562617 - DNA, 16 bp, Homo sapiens
tcataaatttacttta

SEQ ID NO: 3562618 - DNA, 16 bp, Homo sapiens
tcataaatttatggtt

SEQ ID NO: 3562619 - DNA, 13 bp, Homo sapiens
tcatagaaatgta

SEQ ID NO: 3562620 - DNA, 16 bp, Homo sapiens
tcatagcattgtctat

SEQ ID NO: 3562621 - DNA, 11 bp, Homo sapiens
tcatatagacc

SEQ ID NO: 3562622 - DNA, 19 bp, Homo sapiens
tcatatctcttgcccttcc

SEQ ID NO: 3562623 - DNA, 23 bp, Homo sapiens
tcatatggtaggaccctcgagag

SEQ ID NO: 3562624 - DNA, 15 bp, Homo sapiens
tcatatttacttctt

SEQ ID NO: 3562625 - DNA, 20 bp, Homo sapiens
tcatatttacttcttataca

SEQ ID NO: 3562626 - DNA, 22 bp, Homo sapiens
tcatatttacttcttatacatt

SEQ ID NO: 3562627 - DNA, 14 bp, Homo sapiens
tcatcaccatttcc

SEQ ID NO: 3562628 - DNA, 16 bp, Homo sapiens
tcatcatttcagccaa

SEQ ID NO: 3562629 - DNA, 14 bp, Homo sapiens
tcatccaatgtgaa

SEQ ID NO: 3562630 - DNA, 13 bp, Homo sapiens
tcatccatcctga

SEQ ID NO: 3562631 - DNA, 16 bp, Homo sapiens
tcatccatcctgagcc

SEQ ID NO: 3562632 - DNA, 12 bp, Homo sapiens
tcatccattcct

SEQ ID NO: 3562633 - DNA, 18 bp, Homo sapiens
tcatccgcctgtgggcgc

SEQ ID NO: 3562634 - DNA, 14 bp, Homo sapiens
tcatcctcaaagaa

SEQ ID NO: 3562635 - DNA, 21 bp, Homo sapiens
tcatctccctcctccaggtcg

SEQ ID NO: 3562636 - DNA, 14 bp, Homo sapiens
tcatctctctgccc

SEQ ID NO: 3562637 - DNA, 22 bp, Homo sapiens
tcatctggcggaggtctctggg

SEQ ID NO: 3562638 - DNA, 23 bp, Homo sapiens
tcatctggcggaggtctctggga

SEQ ID NO: 3562639 - DNA, 16 bp, Homo sapiens
tcatctgggggagtgg

SEQ ID NO: 3562640 - DNA, 18 bp, Homo sapiens
tcatctgggggagtggaa

SEQ ID NO: 3562641 - DNA, 14 bp, Homo sapiens
tcatctgtggagct

SEQ ID NO: 3562642 - DNA, 15 bp, Homo sapiens
tcatctgtggagctg

SEQ ID NO: 3562643 - DNA, 22 bp, Homo sapiens
tcatctgtggagctgccacaga

SEQ ID NO: 3562644 - DNA, 17 bp, Homo sapiens
tcatcttgctaccagta

SEQ ID NO: 3562645 - DNA, 22 bp, Homo sapiens
tcatcttgctaccagtatttag

SEQ ID NO: 3562646 - DNA, 19 bp, Homo sapiens
tcatgaatgtgagtcatta

SEQ ID NO: 3562647 - DNA, 16 bp, Homo sapiens
tcatgacaagcatttt

SEQ ID NO: 3562648 - DNA, 14 bp, Homo sapiens
tcatgactgcatga

SEQ ID NO: 3562649 - DNA, 14 bp, Homo sapiens
tcatgcaagtggag

SEQ ID NO: 3562650 - DNA, 22 bp, Homo sapiens
tcatgcaagtggagctgtctgt

SEQ ID NO: 3562651 - DNA, 23 bp, Homo sapiens
tcatgcaagtggagctgtctgtc

SEQ ID NO: 3562652 - DNA, 24 bp, Homo sapiens
tcatgccaaccctgggctattgct

SEQ ID NO: 3562653 - DNA, 13 bp, Homo sapiens
tcatgccctcctc

SEQ ID NO: 3562654 - DNA, 14 bp, Homo sapiens
tcatgccctcctct

SEQ ID NO: 3562655 - DNA, 15 bp, Homo sapiens
tcatgccctcctctc

SEQ ID NO: 3562656 - DNA, 20 bp, Homo sapiens
tcatggatcgtgttggtatt

SEQ ID NO: 3562657 - DNA, 19 bp, Homo sapiens
tcatggggaagcttccatg

SEQ ID NO: 3562658 - DNA, 19 bp, Homo sapiens
tcatgtaaagaaatgtctt

SEQ ID NO: 3562659 - DNA, 22 bp, Homo sapiens
tcatgtccagtgagcagtgttg

SEQ ID NO: 3562660 - DNA, 15 bp, Homo sapiens
tcatgtcttgtcata

SEQ ID NO: 3562661 - DNA, 19 bp, Homo sapiens
tcatgttagttaccttata

SEQ ID NO: 3562662 - DNA, 23 bp, Homo sapiens
tcatgttagttaccttatagtta

SEQ ID NO: 3562663 - DNA, 15 bp, Homo sapiens
tcatgttatgcagtg

SEQ ID NO: 3562664 - DNA, 23 bp, Homo sapiens
tcatgttatgcagtgaactattt

SEQ ID NO: 3562665 - DNA, 19 bp, Homo sapiens
tcatgttgttgtgtgtata

SEQ ID NO: 3562666 - DNA, 13 bp, Homo sapiens
tcatgtttggaaa

SEQ ID NO: 3562667 - DNA, 15 bp, Homo sapiens
tcatgtttttaactt

SEQ ID NO: 3562668 - DNA, 15 bp, Homo sapiens
tcattaaatggggct

SEQ ID NO: 3562669 - DNA, 19 bp, Homo sapiens
tcattatctcaaaactgca

SEQ ID NO: 3562670 - DNA, 15 bp, Homo sapiens
tcattcagttctagg

SEQ ID NO: 3562671 - DNA, 20 bp, Homo sapiens
tcattcagttctaggccttt

SEQ ID NO: 3562672 - DNA, 20 bp, Homo sapiens
tcattctaccaagctgtcac

SEQ ID NO: 3562673 - DNA, 20 bp, Homo sapiens
tcattcttactaaaaagtat

SEQ ID NO: 3562674 - DNA, 17 bp, Homo sapiens
tcattctttactgcact

SEQ ID NO: 3562675 - DNA, 20 bp, Homo sapiens
tcattgcacctatctcagcc

SEQ ID NO: 3562676 - DNA, 21 bp, Homo sapiens
tcattgcacctatctcagcca

SEQ ID NO: 3562677 - DNA, 13 bp, Homo sapiens
tcattgcttacaa

SEQ ID NO: 3562678 - DNA, 18 bp, Homo sapiens
tcatttatctataattta

SEQ ID NO: 3562679 - DNA, 20 bp, Homo sapiens
tcatttctatattcctccag

SEQ ID NO: 3562680 - DNA, 18 bp, Homo sapiens
tcatttctcataattttg

SEQ ID NO: 3562681 - DNA, 16 bp, Homo sapiens
tcatttctgcatcagc

SEQ ID NO: 3562682 - DNA, 22 bp, Homo sapiens
tcatttctgcatcagctgctga

SEQ ID NO: 3562683 - DNA, 20 bp, Homo sapiens
tcatttgcttgcaatctaat

SEQ ID NO: 3562684 - DNA, 19 bp, Homo sapiens
tcatttgttaatatttctt

SEQ ID NO: 3562685 - DNA, 16 bp, Homo sapiens
tcattttaaattccac

SEQ ID NO: 3562686 - DNA, 13 bp, Homo sapiens
tcctcatccctga

SEQ ID NO: 3562687 - DNA, 17 bp, Homo sapiens
tcctccacctcaactcc

SEQ ID NO: 3562688 - DNA, 16 bp, Homo sapiens
tcctccactcgaccca

SEQ ID NO: 3562689 - DNA, 13 bp, Homo sapiens
tcctccagcctcc

SEQ ID NO: 3562690 - DNA, 22 bp, Homo sapiens
tcctccagcctcccctcccctg

SEQ ID NO: 3562691 - DNA, 23 bp, Homo sapiens
tcctccaggtcggagtgcctgga

SEQ ID NO: 3562692 - DNA, 14 bp, Homo sapiens
tcctccaggttttt

SEQ ID NO: 3562693 - DNA, 17 bp, Homo sapiens
tcctccaggtttttcaa

SEQ ID NO: 3562694 - DNA, 18 bp, Homo sapiens
tcctccaggtttttcaat

SEQ ID NO: 3562695 - DNA, 17 bp, Homo sapiens
tcctccatcgcagtgtt

SEQ ID NO: 3562696 - DNA, 13 bp, Homo sapiens
tcctccatgcctg

SEQ ID NO: 3562697 - DNA, 14 bp, Homo sapiens
tcctccatgcctga

SEQ ID NO: 3562698 - DNA, 17 bp, Homo sapiens
tcctccatgcctgacca

SEQ ID NO: 3562699 - DNA, 21 bp, Homo sapiens
tcctcccaaggcattctccca

SEQ ID NO: 3562700 - DNA, 14 bp, Homo sapiens
tcctccccctgcaa

SEQ ID NO: 3562701 - DNA, 16 bp, Homo sapiens
tcctcccgccccgccc

SEQ ID NO: 3562702 - DNA, 14 bp, Homo sapiens
tcctccctgcatct

SEQ ID NO: 3562703 - DNA, 19 bp, Homo sapiens
tcctcccttaccctcctct

SEQ ID NO: 3562704 - DNA, 17 bp, Homo sapiens
tcctcccttctgctact

SEQ ID NO: 3562705 - DNA, 19 bp, Homo sapiens
tcctccgtagggtctttct

SEQ ID NO: 3562706 - DNA, 22 bp, Homo sapiens
tcctcctcacccacctctgggt

SEQ ID NO: 3562707 - DNA, 13 bp, Homo sapiens
tcctcctccctgc

SEQ ID NO: 3562708 - DNA, 17 bp, Homo sapiens
tcctcctccctgcatct

SEQ ID NO: 3562709 - DNA, 17 bp, Homo sapiens
tcctcggagagcagcag

SEQ ID NO: 3562710 - DNA, 14 bp, Homo sapiens
tcctctccactgcc

SEQ ID NO: 3562711 - DNA, 16 bp, Homo sapiens
tcctctccactgcctt

SEQ ID NO: 3562712 - DNA, 20 bp, Homo sapiens
tcctctcccattgtccctct

SEQ ID NO: 3562713 - DNA, 21 bp, Homo sapiens
tcctctcggctgccaggggct

SEQ ID NO: 3562714 - DNA, 16 bp, Homo sapiens
tcctctctgagtcaaa

SEQ ID NO: 3562715 - DNA, 23 bp, Homo sapiens
tcctctctgagtcaaatccagtg

SEQ ID NO: 3562716 - DNA, 23 bp, Homo sapiens
tcctctgcacgctcaatgcccag

SEQ ID NO: 3562717 - DNA, 14 bp, Homo sapiens
tcctctgcagtttt

SEQ ID NO: 3562718 - DNA, 16 bp, Homo sapiens
tcctctgcagttttga

SEQ ID NO: 3562719 - DNA, 17 bp, Homo sapiens
tcctctgcctgggctct

SEQ ID NO: 3562720 - DNA, 15 bp, Homo sapiens
tcctctggctcccca

SEQ ID NO: 3562721 - DNA, 17 bp, Homo sapiens
tcctctggctccccaag

SEQ ID NO: 3562722 - DNA, 19 bp, Homo sapiens
tcctctggctccccaaggc

SEQ ID NO: 3562723 - DNA, 15 bp, Homo sapiens
tcctctggtaaacat

SEQ ID NO: 3562724 - DNA, 16 bp, Homo sapiens
tcctcttagctcagct

SEQ ID NO: 3562725 - DNA, 15 bp, Homo sapiens
tcctcttctgctctt

SEQ ID NO: 3562726 - DNA, 19 bp, Homo sapiens
tcctcttctgctcttttcc

SEQ ID NO: 3562727 - DNA, 19 bp, Homo sapiens
tcctcttgccactgcctct

SEQ ID NO: 3562728 - DNA, 16 bp, Homo sapiens
tcctcttgttcctgaa

SEQ ID NO: 3562729 - DNA, 14 bp, Homo sapiens
tcctgaaatttcag

SEQ ID NO: 3562730 - DNA, 18 bp, Homo sapiens
tcctgaactttctccctc

SEQ ID NO: 3562731 - DNA, 19 bp, Homo sapiens
tcctgaactttctccctca

SEQ ID NO: 3562732 - DNA, 13 bp, Homo sapiens
tcctgaagaacca

SEQ ID NO: 3562733 - DNA, 18 bp, Homo sapiens
tcctgaagaaccagtccc

SEQ ID NO: 3562734 - DNA, 14 bp, Homo sapiens
tcctgaagctgctg

SEQ ID NO: 3562735 - DNA, 17 bp, Homo sapiens
tcctgaagctgctgtgt

SEQ ID NO: 3562736 - DNA, 14 bp, Homo sapiens
tcctgaatctgtgc

SEQ ID NO: 3562737 - DNA, 23 bp, Homo sapiens
tcctgaccccgccatgcatgcag

SEQ ID NO: 3562738 - DNA, 15 bp, Homo sapiens
tcctgacccctgcct

SEQ ID NO: 3562739 - DNA, 24 bp, Homo sapiens
tcctgagggctaattctgggaagg

SEQ ID NO: 3562740 - DNA, 19 bp, Homo sapiens
tcctgagtagctggattac

SEQ ID NO: 3562741 - DNA, 19 bp, Homo sapiens
tcctgataccattctattc

SEQ ID NO: 3562742 - DNA, 14 bp, Homo sapiens
tcctgcacacaggg

SEQ ID NO: 3562743 - DNA, 11 bp, Homo sapiens
tcctgcacatg

SEQ ID NO: 3562744 - DNA, 12 bp, Homo sapiens
tcctgcacatga

SEQ ID NO: 3562745 - DNA, 20 bp, Homo sapiens
tcctgcacatgagtggaaat

SEQ ID NO: 3562746 - DNA, 17 bp, Homo sapiens
tcctgcagtcccacact

SEQ ID NO: 3562747 - DNA, 14 bp, Homo sapiens
tcctgcatctctgt

SEQ ID NO: 3562748 - DNA, 16 bp, Homo sapiens
tcctgcatttgtgaaa

SEQ ID NO: 3562749 - DNA, 18 bp, Homo sapiens
tcctgccacatggagccc

SEQ ID NO: 3562750 - DNA, 16 bp, Homo sapiens
tcctgccacccagccc

SEQ ID NO: 3562751 - DNA, 21 bp, Homo sapiens
tcctgccccctgccagtgaag

SEQ ID NO: 3562752 - DNA, 22 bp, Homo sapiens
tcctgccctgtgatatgtctgc

SEQ ID NO: 3562753 - DNA, 13 bp, Homo sapiens
tcctgcctaaggt

SEQ ID NO: 3562754 - DNA, 19 bp, Homo sapiens
tcctgcctttaagccaaag

SEQ ID NO: 3562755 - DNA, 20 bp, Homo sapiens
tcctgcctttaagccaaaga

SEQ ID NO: 3562756 - DNA, 13 bp, Homo sapiens
tcctgcgccctgt

SEQ ID NO: 3562757 - DNA, 22 bp, Homo sapiens
tcctgctcattatgccacttcc

SEQ ID NO: 3562758 - DNA, 10 bp, Homo sapiens
tcctgctggg

SEQ ID NO: 3562759 - DNA, 13 bp, Homo sapiens
tcctgctggtacc

SEQ ID NO: 3562760 - DNA, 23 bp, Homo sapiens
tcctgctggtacctgccctctat

SEQ ID NO: 3562761 - DNA, 16 bp, Homo sapiens
tcctggaaacagcatg

SEQ ID NO: 3562762 - DNA, 15 bp, Homo sapiens
tcctggaggcagggg

SEQ ID NO: 3562763 - DNA, 15 bp, Homo sapiens
tcctggaggcccagt

SEQ ID NO: 3562764 - DNA, 18 bp, Homo sapiens
tcctggaggcccagttca

SEQ ID NO: 3562765 - DNA, 21 bp, Homo sapiens
tcctggcacaatgttggagca

SEQ ID NO: 3562766 - DNA, 14 bp, Homo sapiens
tcctggcagctgct

SEQ ID NO: 3562767 - DNA, 15 bp, Homo sapiens
tcctggcagctgctg

SEQ ID NO: 3562768 - DNA, 18 bp, Homo sapiens
tcctggcagctgctgtgg

SEQ ID NO: 3562769 - DNA, 11 bp, Homo sapiens
tcctggccatc

SEQ ID NO: 3562770 - DNA, 22 bp, Homo sapiens
tcctgggaacacatctggctgc

SEQ ID NO: 3562771 - DNA, 15 bp, Homo sapiens
tcctgggcacacgct

SEQ ID NO: 3562772 - DNA, 18 bp, Homo sapiens
tcctgggcacacgctgct

SEQ ID NO: 3562773 - DNA, 19 bp, Homo sapiens
tcctgggcatgggtccagg

SEQ ID NO: 3562774 - DNA, 20 bp, Homo sapiens
tcctgggcatgggtccaggg

SEQ ID NO: 3562775 - DNA, 19 bp, Homo sapiens
tcctgggcattagcaaggc

SEQ ID NO: 3562776 - DNA, 22 bp, Homo sapiens
tcctgggcattagcaaggcaga

SEQ ID NO: 3562777 - DNA, 12 bp, Homo sapiens
tcctgggcctgc

SEQ ID NO: 3562778 - DNA, 16 bp, Homo sapiens
tcctgggcctgcagaa

SEQ ID NO: 3562779 - DNA, 13 bp, Homo sapiens
tcctgggcctgcc

SEQ ID NO: 3562780 - DNA, 15 bp, Homo sapiens
tcctgggcctgcccc

SEQ ID NO: 3562781 - DNA, 18 bp, Homo sapiens
tcctgggcctttgcaaga

SEQ ID NO: 3562782 - DNA, 23 bp, Homo sapiens
tcctgggggttctttcttcctct

SEQ ID NO: 3562783 - DNA, 14 bp, Homo sapiens
tcctggtgactcct

SEQ ID NO: 3562784 - DNA, 12 bp, Homo sapiens
tcctggtgccct

SEQ ID NO: 3562785 - DNA, 19 bp, Homo sapiens
tcctggtgcctatctgcct

SEQ ID NO: 3562786 - DNA, 21 bp, Homo sapiens
tcctggtttaattcagcagag

SEQ ID NO: 3562787 - DNA, 15 bp, Homo sapiens
tcctggtttcgtgtg

SEQ ID NO: 3562788 - DNA, 21 bp, Homo sapiens
tcctggtttcgtgtgctgccc

SEQ ID NO: 3562789 - DNA, 17 bp, Homo sapiens
tcctgtacctcagtgga

SEQ ID NO: 3562790 - DNA, 16 bp, Homo sapiens
tcctgtagctctccct

SEQ ID NO: 3562791 - DNA, 16 bp, Homo sapiens
tcctgtccagctccaa

SEQ ID NO: 3562792 - DNA, 17 bp, Homo sapiens
tcctgtccagctccaac

SEQ ID NO: 3562793 - DNA, 13 bp, Homo sapiens
tcctgtctttgat

SEQ ID NO: 3562794 - DNA, 19 bp, Homo sapiens
tcctgtgtgattgacagct

SEQ ID NO: 3562795 - DNA, 22 bp, Homo sapiens
tcctgtgtgtccaaaactgcct

SEQ ID NO: 3562796 - DNA, 22 bp, Homo sapiens
tcctgttctgcgctgtgtacaa

SEQ ID NO: 3562797 - DNA, 22 bp, Homo sapiens
tccttaacccacctctcctgcc

SEQ ID NO: 3562798 - DNA, 19 bp, Homo sapiens
tccttactcccccaccact

SEQ ID NO: 3562799 - DNA, 20 bp, Homo sapiens
tccttactcccccaccactc

SEQ ID NO: 3562800 - DNA, 14 bp, Homo sapiens
tccttaggctactg

SEQ ID NO: 3562801 - DNA, 13 bp, Homo sapiens
tccttatccctct

SEQ ID NO: 3562802 - DNA, 14 bp, Homo sapiens
tccttatccctctc

SEQ ID NO: 3562803 - DNA, 18 bp, Homo sapiens
tccttatccctctcttcc

SEQ ID NO: 3562804 - DNA, 19 bp, Homo sapiens
tccttatccctctcttccc

SEQ ID NO: 3562805 - DNA, 21 bp, Homo sapiens
tccttatccctctcttcccct

SEQ ID NO: 3562806 - DNA, 22 bp, Homo sapiens
tccttatccctctcttcccctt

SEQ ID NO: 3562807 - DNA, 13 bp, Homo sapiens
tccttcactgctc

SEQ ID NO: 3562808 - DNA, 12 bp, Homo sapiens
tccttcagcacg

SEQ ID NO: 3562809 - DNA, 17 bp, Homo sapiens
tccttcaggcagctgaa

SEQ ID NO: 3562810 - DNA, 18 bp, Homo sapiens
tccttcagtgagcccctc

SEQ ID NO: 3562811 - DNA, 19 bp, Homo sapiens
tccttcagtgagcccctcc

SEQ ID NO: 3562812 - DNA, 17 bp, Homo sapiens
tccttcatgtttggaaa

SEQ ID NO: 3562813 - DNA, 18 bp, Homo sapiens
tccttcccatttctctac

SEQ ID NO: 3562814 - DNA, 13 bp, Homo sapiens
tccttctctgggt

SEQ ID NO: 3562815 - DNA, 21 bp, Homo sapiens
tccttctctgggtctgatttt

SEQ ID NO: 3562816 - DNA, 15 bp, Homo sapiens
tccttctgaagtgtt

SEQ ID NO: 3562817 - DNA, 15 bp, Homo sapiens
tccttgcatcaattt

SEQ ID NO: 3562818 - DNA, 17 bp, Homo sapiens
tccttgcatcaattttt

SEQ ID NO: 3562819 - DNA, 22 bp, Homo sapiens
tctgctcccctaaagcctcaaa

SEQ ID NO: 3562820 - DNA, 17 bp, Homo sapiens
tctgctcctgcttttct

SEQ ID NO: 3562821 - DNA, 23 bp, Homo sapiens
tctgctcctgcttttctgtcctg

SEQ ID NO: 3562822 - DNA, 15 bp, Homo sapiens
tctgctctatactgt

SEQ ID NO: 3562823 - DNA, 16 bp, Homo sapiens
tctgctgagttggcct

SEQ ID NO: 3562824 - DNA, 17 bp, Homo sapiens
tctgctgagttggcctg

SEQ ID NO: 3562825 - DNA, 23 bp, Homo sapiens
tctgctgcagttaccacagcaac

SEQ ID NO: 3562826 - DNA, 16 bp, Homo sapiens
tctgctgccggctctg

SEQ ID NO: 3562827 - DNA, 16 bp, Homo sapiens
tctgctgtccttgcct

SEQ ID NO: 3562828 - DNA, 22 bp, Homo sapiens
tctggaacccagactcagacat

SEQ ID NO: 3562829 - DNA, 18 bp, Homo sapiens
tctggaacctcagcctgg

SEQ ID NO: 3562830 - DNA, 19 bp, Homo sapiens
tctggaagacgtggctctg

SEQ ID NO: 3562831 - DNA, 18 bp, Homo sapiens
tctggaataaagttgcag

SEQ ID NO: 3562832 - DNA, 15 bp, Homo sapiens
tctggactcctctgt

SEQ ID NO: 3562833 - DNA, 22 bp, Homo sapiens
tctggactggaaagcacaagac

SEQ ID NO: 3562834 - DNA, 23 bp, Homo sapiens
tctggactggaaagcacaagact

SEQ ID NO: 3562835 - DNA, 16 bp, Homo sapiens
tctggagaaggcctgg

SEQ ID NO: 3562836 - DNA, 18 bp, Homo sapiens
tctggagaaggcctggaa

SEQ ID NO: 3562837 - DNA, 13 bp, Homo sapiens
tctggaggggcag

SEQ ID NO: 3562838 - DNA, 14 bp, Homo sapiens
tctggagtggccac

SEQ ID NO: 3562839 - DNA, 16 bp, Homo sapiens
tctggagttgatctgg

SEQ ID NO: 3562840 - DNA, 22 bp, Homo sapiens
tctggcaaaaaggagccttttg

SEQ ID NO: 3562841 - DNA, 18 bp, Homo sapiens
tctggcaccatcagcctg

SEQ ID NO: 3562842 - DNA, 22 bp, Homo sapiens
tctggcagcaccgcctcttccc

SEQ ID NO: 3562843 - DNA, 17 bp, Homo sapiens
tctggccacatcagccc

SEQ ID NO: 3562844 - DNA, 14 bp, Homo sapiens
tctggcccaccagg

SEQ ID NO: 3562845 - DNA, 16 bp, Homo sapiens
tctggcccaccagggt

SEQ ID NO: 3562846 - DNA, 18 bp, Homo sapiens
tctggcggaggtctctgg

SEQ ID NO: 3562847 - DNA, 20 bp, Homo sapiens
tctggcggaggtctctggga

SEQ ID NO: 3562848 - DNA, 22 bp, Homo sapiens
tctggctccccaaggctgcaaa

SEQ ID NO: 3562849 - DNA, 19 bp, Homo sapiens
tctggctgagcccctgggg

SEQ ID NO: 3562850 - DNA, 15 bp, Homo sapiens
tctggctgagccctg

SEQ ID NO: 3562851 - DNA, 22 bp, Homo sapiens
tctggctggaaagcagagcctc

SEQ ID NO: 3562852 - DNA, 22 bp, Homo sapiens
tctggcttcaaaaagccacagc

SEQ ID NO: 3562853 - DNA, 19 bp, Homo sapiens
tctggcttccctaaactgc

SEQ ID NO: 3562854 - DNA, 14 bp, Homo sapiens
tctggcttccctgg

SEQ ID NO: 3562855 - DNA, 17 bp, Homo sapiens
tctggcttccctggaag

SEQ ID NO: 3562856 - DNA, 13 bp, Homo sapiens
tctgggaagggag

SEQ ID NO: 3562857 - DNA, 14 bp, Homo sapiens
tctgggacccacag

SEQ ID NO: 3562858 - DNA, 15 bp, Homo sapiens
tctgggacccacaga

SEQ ID NO: 3562859 - DNA, 15 bp, Homo sapiens
tctgggagcccagaa

SEQ ID NO: 3562860 - DNA, 23 bp, Homo sapiens
tctgggcaccacctctgtgggca

SEQ ID NO: 3562861 - DNA, 18 bp, Homo sapiens
tctgggccccctcctccc

SEQ ID NO: 3562862 - DNA, 17 bp, Homo sapiens
tctgggcgtccagctca

SEQ ID NO: 3562863 - DNA, 19 bp, Homo sapiens
tctgggctcagacatccac

SEQ ID NO: 3562864 - DNA, 23 bp, Homo sapiens
tctggggacagcttcctcacacc

SEQ ID NO: 3562865 - DNA, 22 bp, Homo sapiens
tctggggagagcggctggagaa

SEQ ID NO: 3562866 - DNA, 19 bp, Homo sapiens
tctgggggctgaggagcag

SEQ ID NO: 3562867 - DNA, 15 bp, Homo sapiens
tctgggggtcctctc

SEQ ID NO: 3562868 - DNA, 17 bp, Homo sapiens
tctgggggtcctctctg

SEQ ID NO: 3562869 - DNA, 19 bp, Homo sapiens
tctgggtgctagatccagc

SEQ ID NO: 3562870 - DNA, 15 bp, Homo sapiens
tctgggtgctgccct

SEQ ID NO: 3562871 - DNA, 16 bp, Homo sapiens
tctggtactctgtgaa

SEQ ID NO: 3562872 - DNA, 17 bp, Homo sapiens
tctggtctcctcagcct

SEQ ID NO: 3562873 - DNA, 15 bp, Homo sapiens
tctggtgctcctgca

SEQ ID NO: 3562874 - DNA, 16 bp, Homo sapiens
tctggtgtgtggtgag

SEQ ID NO: 3562875 - DNA, 13 bp, Homo sapiens
tctggtgttgact

SEQ ID NO: 3562876 - DNA, 16 bp, Homo sapiens
tctggtgtttgtcatg

SEQ ID NO: 3562877 - DNA, 19 bp, Homo sapiens
tctggttccctgctgcgct

SEQ ID NO: 3562878 - DNA, 15 bp, Homo sapiens
tctggttctgtgtcc

SEQ ID NO: 3562879 - DNA, 20 bp, Homo sapiens
tctgtaacatcgcacagttt

SEQ ID NO: 3562880 - DNA, 13 bp, Homo sapiens
tctgtaataatag

SEQ ID NO: 3562881 - DNA, 12 bp, Homo sapiens
tctgtaccagtt

SEQ ID NO: 3562882 - DNA, 13 bp, Homo sapiens
tctgtaccagtta

SEQ ID NO: 3562883 - DNA, 19 bp, Homo sapiens
tctgtattgaaaatggctt

SEQ ID NO: 3562884 - DNA, 13 bp, Homo sapiens
tctgtcagctgca

SEQ ID NO: 3562885 - DNA, 14 bp, Homo sapiens
tctgtcagctgcaa

SEQ ID NO: 3562886 - DNA, 13 bp, Homo sapiens
tctgtccacctcg

SEQ ID NO: 3562887 - DNA, 21 bp, Homo sapiens
tctgtccacctcggcctccca

SEQ ID NO: 3562888 - DNA, 23 bp, Homo sapiens
tctgtccacctcggcctcccaga

SEQ ID NO: 3562889 - DNA, 24 bp, Homo sapiens
tctgtccaggcactgctgcccagc

SEQ ID NO: 3562890 - DNA, 19 bp, Homo sapiens
tctgtcctcagccttgcca

SEQ ID NO: 3562891 - DNA, 18 bp, Homo sapiens
tctgtctcggctctgcat

SEQ ID NO: 3562892 - DNA, 19 bp, Homo sapiens
tctgtctgagacaggtgcc

SEQ ID NO: 3562893 - DNA, 20 bp, Homo sapiens
tctgtctgagacaggtgcct

SEQ ID NO: 3562894 - DNA, 15 bp, Homo sapiens
tctgtcttcacaaca

SEQ ID NO: 3562895 - DNA, 19 bp, Homo sapiens
tctgtcttgttaatgcttt

SEQ ID NO: 3562896 - DNA, 18 bp, Homo sapiens
tctgtgaacgtggcccgc

SEQ ID NO: 3562897 - DNA, 20 bp, Homo sapiens
tctgtgatctgggtctctaa

SEQ ID NO: 3562898 - DNA, 20 bp, Homo sapiens
tctgtgatgacattccctgc

SEQ ID NO: 3562899 - DNA, 16 bp, Homo sapiens
tctgtgattggctggt

SEQ ID NO: 3562900 - DNA, 14 bp, Homo sapiens
tctgtgctcctcct

SEQ ID NO: 3562901 - DNA, 23 bp, Homo sapiens
tctgtggagctgccacagagaag

SEQ ID NO: 3562902 - DNA, 20 bp, Homo sapiens
tctgtggagggagggcagct

SEQ ID NO: 3562903 - DNA, 12 bp, Homo sapiens
tctgtggcaaaa

SEQ ID NO: 3562904 - DNA, 15 bp, Homo sapiens
tctgtggtgcagtgt

SEQ ID NO: 3562905 - DNA, 16 bp, Homo sapiens
tctgtggtgcagtgtg

SEQ ID NO: 3562906 - DNA, 18 bp, Homo sapiens
tctgtggtgcagtgtgtg

SEQ ID NO: 3562907 - DNA, 15 bp, Homo sapiens
tctgtgtcatttctt

SEQ ID NO: 3562908 - DNA, 15 bp, Homo sapiens
tctgtgtcctctgcc

SEQ ID NO: 3562909 - DNA, 12 bp, Homo sapiens
tctgtgtggctc

SEQ ID NO: 3562910 - DNA, 13 bp, Homo sapiens
tctgtgtgtgtgt

SEQ ID NO: 3562911 - DNA, 19 bp, Homo sapiens
tctgtgtgtgtgtatgtgg

SEQ ID NO: 3562912 - DNA, 22 bp, Homo sapiens
tctgtgtgtgtgtatgtggggg

SEQ ID NO: 3562913 - DNA, 16 bp, Homo sapiens
tctgtgtgtttatgtg

SEQ ID NO: 3562914 - DNA, 19 bp, Homo sapiens
tctgttccatgcaactgga

SEQ ID NO: 3562915 - DNA, 20 bp, Homo sapiens
tctgttcccccttcacaaag

SEQ ID NO: 3562916 - DNA, 12 bp, Homo sapiens
tctgttgcccag

SEQ ID NO: 3562917 - DNA, 16 bp, Homo sapiens
tctgttggtctgcctt

SEQ ID NO: 3562918 - DNA, 14 bp, Homo sapiens
tctgtttaaagtgg

SEQ ID NO: 3562919 - DNA, 18 bp, Homo sapiens
tctgtttaattttcactt

SEQ ID NO: 3562920 - DNA, 14 bp, Homo sapiens
tctgtttgattctt

SEQ ID NO: 3562921 - DNA, 14 bp, Homo sapiens
tctgttttccccca

SEQ ID NO: 3562922 - DNA, 16 bp, Homo sapiens
tcttaaaaaatgtgaa

SEQ ID NO: 3562923 - DNA, 21 bp, Homo sapiens
tcttaaaaaatgtgaaatgct

SEQ ID NO: 3562924 - DNA, 22 bp, Homo sapiens
tcttaaaaaatgtgaaatgctt

SEQ ID NO: 3562925 - DNA, 15 bp, Homo sapiens
tcttaaaagtttcta

SEQ ID NO: 3562926 - DNA, 23 bp, Homo sapiens
tcttaaaatggcaagttttccat

SEQ ID NO: 3562927 - DNA, 12 bp, Homo sapiens
tcttaacttctt

SEQ ID NO: 3562928 - DNA, 15 bp, Homo sapiens
tcttaagcagcatgg

SEQ ID NO: 3562929 - DNA, 21 bp, Homo sapiens
tcttaagcagcatggaaaaat

SEQ ID NO: 3562930 - DNA, 15 bp, Homo sapiens
tcttaagtggtctag

SEQ ID NO: 3562931 - DNA, 22 bp, Homo sapiens
tcttaatccattaaaaagttgt

SEQ ID NO: 3562932 - DNA, 15 bp, Homo sapiens
tcttaatgtatcaaa

SEQ ID NO: 3562933 - DNA, 14 bp, Homo sapiens
tcttacacattcca

SEQ ID NO: 3562934 - DNA, 17 bp, Homo sapiens
tcttactaaaaagtata

SEQ ID NO: 3562935 - DNA, 14 bp, Homo sapiens
tcttactaatgtaa

SEQ ID NO: 3562936 - DNA, 20 bp, Homo sapiens
tcttactaatgtaaaatgat

SEQ ID NO: 3562937 - DNA, 21 bp, Homo sapiens
tcttagccctcaccacagcct

SEQ ID NO: 3562938 - DNA, 24 bp, Homo sapiens
tcttataatgatttttttactaat

SEQ ID NO: 3562939 - DNA, 22 bp, Homo sapiens
tcttatccaacatcaacatctt

SEQ ID NO: 3562940 - DNA, 15 bp, Homo sapiens
tcttatgcaaaatgg

SEQ ID NO: 3562941 - DNA, 14 bp, Homo sapiens
tcttatgcaatttc

SEQ ID NO: 3562942 - DNA, 20 bp, Homo sapiens
tcttattaatcatacaaact

SEQ ID NO: 3562943 - DNA, 22 bp, Homo sapiens
tcttattaatcatacaaactct

SEQ ID NO: 3562944 - DNA, 16 bp, Homo sapiens
tcttatttcatttctt

SEQ ID NO: 3562945 - DNA, 13 bp, Homo sapiens
tcttattttgtaa

SEQ ID NO: 3562946 - DNA, 16 bp, Homo sapiens
tcttattttgtaataa

SEQ ID NO: 3562947 - DNA, 17 bp, Homo sapiens
tcttcacttacaagaaa

SEQ ID NO: 3562948 - DNA, 17 bp, Homo sapiens
tcttcacttcaagctgt

SEQ ID NO: 3562949 - DNA, 17 bp, Homo sapiens
tcttcactttcctcagt

SEQ ID NO: 3562950 - DNA, 19 bp, Homo sapiens
tcttcagcgtaaaatggtg

SEQ ID NO: 3562951 - DNA, 18 bp, Homo sapiens
tgaatctgtgcaaacagt

SEQ ID NO: 3562952 - DNA, 20 bp, Homo sapiens
tgaatctgtgcaaacagtaa

SEQ ID NO: 3562953 - DNA, 19 bp, Homo sapiens
tgaatgaaaataactgaac

SEQ ID NO: 3562954 - DNA, 22 bp, Homo sapiens
tgaatgactccactgtttttct

SEQ ID NO: 3562955 - DNA, 21 bp, Homo sapiens
tgaatgagcctttgtgctttt

SEQ ID NO: 3562956 - DNA, 20 bp, Homo sapiens
tgaatgcccagtgagactgt

SEQ ID NO: 3562957 - DNA, 22 bp, Homo sapiens
tgaatgctgttaatatttctaa

SEQ ID NO: 3562958 - DNA, 22 bp, Homo sapiens
tgaatgggcatttctaaaatgt

SEQ ID NO: 3562959 - DNA, 18 bp, Homo sapiens
tgaatgtagaataggcag

SEQ ID NO: 3562960 - DNA, 19 bp, Homo sapiens
tgaatgtagaataggcagg

SEQ ID NO: 3562961 - DNA, 17 bp, Homo sapiens
tgaatgtcagttgttat

SEQ ID NO: 3562962 - DNA, 15 bp, Homo sapiens
tgaatgtgagtcatt

SEQ ID NO: 3562963 - DNA, 17 bp, Homo sapiens
tgaattaaataaaccct

SEQ ID NO: 3562964 - DNA, 17 bp, Homo sapiens
tgaattaggctgtaact

SEQ ID NO: 3562965 - DNA, 22 bp, Homo sapiens
tgaattaggctgtaactacttt

SEQ ID NO: 3562966 - DNA, 18 bp, Homo sapiens
tgaattcattctggaggg

SEQ ID NO: 3562967 - DNA, 16 bp, Homo sapiens
tgaattcatttcactg

SEQ ID NO: 3562968 - DNA, 16 bp, Homo sapiens
tgaattggaaagactt

SEQ ID NO: 3562969 - DNA, 18 bp, Homo sapiens
tgaatttcttcttttcct

SEQ ID NO: 3562970 - DNA, 21 bp, Homo sapiens
tgaatttcttcttttcctgca

SEQ ID NO: 3562971 - DNA, 20 bp, Homo sapiens
tgacaacacttaatagcaac

SEQ ID NO: 3562972 - DNA, 21 bp, Homo sapiens
tgacaacctccattctatttt

SEQ ID NO: 3562973 - DNA, 19 bp, Homo sapiens
tgacaaggcctgcttgact

SEQ ID NO: 3562974 - DNA, 22 bp, Homo sapiens
tgacaataaaggaactaatcct

SEQ ID NO: 3562975 - DNA, 22 bp, Homo sapiens
tgacaattttacctattctgaa

SEQ ID NO: 3562976 - DNA, 12 bp, Homo sapiens
tgacaccccctc

SEQ ID NO: 3562977 - DNA, 13 bp, Homo sapiens
tgacaccccctcc

SEQ ID NO: 3562978 - DNA, 22 bp, Homo sapiens
tgacaccccctccccgcccctg

SEQ ID NO: 3562979 - DNA, 16 bp, Homo sapiens
tgacaccctggcctga

SEQ ID NO: 3562980 - DNA, 15 bp, Homo sapiens
tgacacctgctgaga

SEQ ID NO: 3562981 - DNA, 20 bp, Homo sapiens
tgacacctttcataatcttt

SEQ ID NO: 3562982 - DNA, 13 bp, Homo sapiens
tgacactgctcta

SEQ ID NO: 3562983 - DNA, 15 bp, Homo sapiens
tgacactgctctaac

SEQ ID NO: 3562984 - DNA, 22 bp, Homo sapiens
tgacactgctctaacagccctc

SEQ ID NO: 3562985 - DNA, 23 bp, Homo sapiens
tgacagaggtttgaaggagaatg

SEQ ID NO: 3562986 - DNA, 21 bp, Homo sapiens
tgacagatatatttaagcctt

SEQ ID NO: 3562987 - DNA, 19 bp, Homo sapiens
tgacagatgcttttgctaa

SEQ ID NO: 3562988 - DNA, 20 bp, Homo sapiens
tgacagatgcttttgctaat

SEQ ID NO: 3562989 - DNA, 19 bp, Homo sapiens
tgacagcaattcatggttc

SEQ ID NO: 3562990 - DNA, 21 bp, Homo sapiens
tgacagcaattcatggttcaa

SEQ ID NO: 3562991 - DNA, 20 bp, Homo sapiens
tgacagccacaccgtggcag

SEQ ID NO: 3562992 - DNA, 20 bp, Homo sapiens
tgacagccttccccagctcc

SEQ ID NO: 3562993 - DNA, 14 bp, Homo sapiens
tgacagctgctcct

SEQ ID NO: 3562994 - DNA, 16 bp, Homo sapiens
tgacagctttgctgct

SEQ ID NO: 3562995 - DNA, 17 bp, Homo sapiens
tgacagctttgctgctg

SEQ ID NO: 3562996 - DNA, 20 bp, Homo sapiens
tgacagctttgctgctgaag

SEQ ID NO: 3562997 - DNA, 21 bp, Homo sapiens
tgacagctttgctgctgaagg

SEQ ID NO: 3562998 - DNA, 18 bp, Homo sapiens
tgacaggctcgtcagcca

SEQ ID NO: 3562999 - DNA, 14 bp, Homo sapiens
tgacagtcagctgt

SEQ ID NO: 3563000 - DNA, 21 bp, Homo sapiens
tgacagtggccgcccaaggcc

SEQ ID NO: 3563001 - DNA, 15 bp, Homo sapiens
tgacatatcacatgt

SEQ ID NO: 3563002 - DNA, 16 bp, Homo sapiens
tgacatatcacatgtc

SEQ ID NO: 3563003 - DNA, 20 bp, Homo sapiens
tgacatattatgcctgaatg

SEQ ID NO: 3563004 - DNA, 17 bp, Homo sapiens
tgacatcacttgtacaa

SEQ ID NO: 3563005 - DNA, 20 bp, Homo sapiens
tgacatcacttgtacaaaat

SEQ ID NO: 3563006 - DNA, 23 bp, Homo sapiens
tgacatcacttgtacaaaataaa

SEQ ID NO: 3563007 - DNA, 11 bp, Homo sapiens
tgacatccctt

SEQ ID NO: 3563008 - DNA, 13 bp, Homo sapiens
tgacatcccttcc

SEQ ID NO: 3563009 - DNA, 14 bp, Homo sapiens
tgacatcccttcct

SEQ ID NO: 3563010 - DNA, 18 bp, Homo sapiens
tgacatcccttcctggaa

SEQ ID NO: 3563011 - DNA, 22 bp, Homo sapiens
tgacatcccttcctggaaacag

SEQ ID NO: 3563012 - DNA, 23 bp, Homo sapiens
tgacatcccttcctggaaacagc

SEQ ID NO: 3563013 - DNA, 13 bp, Homo sapiens
tgacatgctcaca

SEQ ID NO: 3563014 - DNA, 13 bp, Homo sapiens
tgacattcccctc

SEQ ID NO: 3563015 - DNA, 15 bp, Homo sapiens
tgacattcggggtga

SEQ ID NO: 3563016 - DNA, 17 bp, Homo sapiens
tgacattgcacctggat

SEQ ID NO: 3563017 - DNA, 20 bp, Homo sapiens
tgacattgctccaagatgtt

SEQ ID NO: 3563018 - DNA, 20 bp, Homo sapiens
tgacatttatatattgaatt

SEQ ID NO: 3563019 - DNA, 21 bp, Homo sapiens
tgacatttgggagacatgtga

SEQ ID NO: 3563020 - DNA, 14 bp, Homo sapiens
tgacattttacatt

SEQ ID NO: 3563021 - DNA, 15 bp, Homo sapiens
tgacattttacatta

SEQ ID NO: 3563022 - DNA, 22 bp, Homo sapiens
tgacattttagaatgtcaataa

SEQ ID NO: 3563023 - DNA, 11 bp, Homo sapiens
tgaccagcagc

SEQ ID NO: 3563024 - DNA, 19 bp, Homo sapiens
tgaccagggatgctgggct

SEQ ID NO: 3563025 - DNA, 21 bp, Homo sapiens
tgaccagggatgctgggctgg

SEQ ID NO: 3563026 - DNA, 15 bp, Homo sapiens
tgaccagtctgaccc

SEQ ID NO: 3563027 - DNA, 20 bp, Homo sapiens
tgacccagcatctcccagca

SEQ ID NO: 3563028 - DNA, 18 bp, Homo sapiens
tgacccagtgcccccact

SEQ ID NO: 3563029 - DNA, 23 bp, Homo sapiens
tgacccagtgcccccactgacca

SEQ ID NO: 3563030 - DNA, 17 bp, Homo sapiens
tgacccccatctgagct

SEQ ID NO: 3563031 - DNA, 21 bp, Homo sapiens
tgacccccatctgagctgggg

SEQ ID NO: 3563032 - DNA, 17 bp, Homo sapiens
tgaccccgagaagtgct

SEQ ID NO: 3563033 - DNA, 12 bp, Homo sapiens
tgacccctctgg

SEQ ID NO: 3563034 - DNA, 20 bp, Homo sapiens
tgacccctgcctgttggcag

SEQ ID NO: 3563035 - DNA, 17 bp, Homo sapiens
tgaccgagccctggaga

SEQ ID NO: 3563036 - DNA, 23 bp, Homo sapiens
tgaccgagccctggagagcccca

SEQ ID NO: 3563037 - DNA, 14 bp, Homo sapiens
tgacctaccccagc

SEQ ID NO: 3563038 - DNA, 19 bp, Homo sapiens
tgacctaccccagccaggc

SEQ ID NO: 3563039 - DNA, 22 bp, Homo sapiens
tgacctaccccagccaggctcc

SEQ ID NO: 3563040 - DNA, 14 bp, Homo sapiens
tgacctcaaggaag

SEQ ID NO: 3563041 - DNA, 14 bp, Homo sapiens
tgacctcactggcc

SEQ ID NO: 3563042 - DNA, 12 bp, Homo sapiens
tgacctccagaa

SEQ ID NO: 3563043 - DNA, 22 bp, Homo sapiens
tgacctccagaagtcccttcaa

SEQ ID NO: 3563044 - DNA, 14 bp, Homo sapiens
tgaccttaaatgca

SEQ ID NO: 3563045 - DNA, 16 bp, Homo sapiens
tgaccttaaatgcaac

SEQ ID NO: 3563046 - DNA, 18 bp, Homo sapiens
tgacctttatttattaaa

SEQ ID NO: 3563047 - DNA, 12 bp, Homo sapiens
tgacgctgctga

SEQ ID NO: 3563048 - DNA, 20 bp, Homo sapiens
tgacggtgttaattttgcta

SEQ ID NO: 3563049 - DNA, 22 bp, Homo sapiens
tgacggtgttaattttgctaac

SEQ ID NO: 3563050 - DNA, 18 bp, Homo sapiens
tgactaaactttttttct

SEQ ID NO: 3563051 - DNA, 17 bp, Homo sapiens
tgactagaactcctgtc

SEQ ID NO: 3563052 - DNA, 22 bp, Homo sapiens
tgactagaactcctgtcttctt

SEQ ID NO: 3563053 - DNA, 23 bp, Homo sapiens
tgactagaactcctgtcttcttt

SEQ ID NO: 3563054 - DNA, 13 bp, Homo sapiens
tgactatgtaaac

SEQ ID NO: 3563055 - DNA, 13 bp, Homo sapiens
tgactccagggtg

SEQ ID NO: 3563056 - DNA, 18 bp, Homo sapiens
tgactccagggtgacaag

SEQ ID NO: 3563057 - DNA, 16 bp, Homo sapiens
tgactccccagcccag

SEQ ID NO: 3563058 - DNA, 23 bp, Homo sapiens
tgactccccagcccagcacccct

SEQ ID NO: 3563059 - DNA, 21 bp, Homo sapiens
tgactccctgggagccgcctg

SEQ ID NO: 3563060 - DNA, 23 bp, Homo sapiens
tgactcctgctggtacctgccct

SEQ ID NO: 3563061 - DNA, 17 bp, Homo sapiens
tgactccttatctcttt

SEQ ID NO: 3563062 - DNA, 21 bp, Homo sapiens
tgactcgtatatgtctcaggt

SEQ ID NO: 3563063 - DNA, 16 bp, Homo sapiens
tgactctgtctcattg

SEQ ID NO: 3563064 - DNA, 15 bp, Homo sapiens
tgactcttactcctt

SEQ ID NO: 3563065 - DNA, 22 bp, Homo sapiens
tgactcttagccctcaccacag

SEQ ID NO: 3563066 - DNA, 14 bp, Homo sapiens
tgactgaactgtaa

SEQ ID NO: 3563067 - DNA, 15 bp, Homo sapiens
tgactgccaagccag

SEQ ID NO: 3563068 - DNA, 17 bp, Homo sapiens
tgactgccaagccagat

SEQ ID NO: 3563069 - DNA, 18 bp, Homo sapiens
tgactgtactcctcccag

SEQ ID NO: 3563070 - DNA, 17 bp, Homo sapiens
tgactgtcactgttcct

SEQ ID NO: 3563071 - DNA, 15 bp, Homo sapiens
tgactgttgttctta

SEQ ID NO: 3563072 - DNA, 23 bp, Homo sapiens
tgacttactttaattactggaat

SEQ ID NO: 3563073 - DNA, 13 bp, Homo sapiens
tgacttagaaact

SEQ ID NO: 3563074 - DNA, 14 bp, Homo sapiens
tgacttagaaactg

SEQ ID NO: 3563075 - DNA, 14 bp, Homo sapiens
tgacttagtacaaa

SEQ ID NO: 3563076 - DNA, 19 bp, Homo sapiens
tgacttagtacaaagtttc

SEQ ID NO: 3563077 - DNA, 17 bp, Homo sapiens
tgacttatagtacatga

SEQ ID NO: 3563078 - DNA, 19 bp, Homo sapiens
tgacttatagtacatgata

SEQ ID NO: 3563079 - DNA, 13 bp, Homo sapiens
tgacttatttctg

SEQ ID NO: 3563080 - DNA, 18 bp, Homo sapiens
tgacttatttctgctctg

SEQ ID NO: 3563081 - DNA, 21 bp, Homo sapiens
tgacttatttctgctctggaa

SEQ ID NO: 3563082 - DNA, 16 bp, Homo sapiens
tgcagatttgatattt

SEQ ID NO: 3563083 - DNA, 20 bp, Homo sapiens
tgcagatttgatatttgcat

SEQ ID NO: 3563084 - DNA, 22 bp, Homo sapiens
tgcagcaggaaggaacaaagac

SEQ ID NO: 3563085 - DNA, 16 bp, Homo sapiens
tgcagcagggatgccc

SEQ ID NO: 3563086 - DNA, 18 bp, Homo sapiens
tgcagcagggatgccctg

SEQ ID NO: 3563087 - DNA, 23 bp, Homo sapiens
tgcagcagtcgcccaagcagaca

SEQ ID NO: 3563088 - DNA, 17 bp, Homo sapiens
tgcagccgcagagaaat

SEQ ID NO: 3563089 - DNA, 18 bp, Homo sapiens
tgcagccgcagagaaatg

SEQ ID NO: 3563090 - DNA, 15 bp, Homo sapiens
tgcagcctaagaaga

SEQ ID NO: 3563091 - DNA, 19 bp, Homo sapiens
tgcagcctaagaagaaggc

SEQ ID NO: 3563092 - DNA, 22 bp, Homo sapiens
tgcagcctaagaagaaggccag

SEQ ID NO: 3563093 - DNA, 17 bp, Homo sapiens
tgcagcctctctggctg

SEQ ID NO: 3563094 - DNA, 22 bp, Homo sapiens
tgcagcctctctggctggtctt

SEQ ID NO: 3563095 - DNA, 19 bp, Homo sapiens
tgcagccttcccctccctg

SEQ ID NO: 3563096 - DNA, 20 bp, Homo sapiens
tgcagccttcccctccctgt

SEQ ID NO: 3563097 - DNA, 17 bp, Homo sapiens
tgcagcggcgtgaggcc

SEQ ID NO: 3563098 - DNA, 21 bp, Homo sapiens
tgcagctcaagggctggcact

SEQ ID NO: 3563099 - DNA, 20 bp, Homo sapiens
tgcagctcctcagcggctcc

SEQ ID NO: 3563100 - DNA, 20 bp, Homo sapiens
tgcagcttcaacttttctct

SEQ ID NO: 3563101 - DNA, 14 bp, Homo sapiens
tgcagcttgagttt

SEQ ID NO: 3563102 - DNA, 19 bp, Homo sapiens
tgcaggaccctgtcctgca

SEQ ID NO: 3563103 - DNA, 19 bp, Homo sapiens
tgcaggagtttgtggtaac

SEQ ID NO: 3563104 - DNA, 17 bp, Homo sapiens
tgcaggcaggcggctcc

SEQ ID NO: 3563105 - DNA, 19 bp, Homo sapiens
tgcaggcaggcggctcctc

SEQ ID NO: 3563106 - DNA, 23 bp, Homo sapiens
tgcaggcaggcggctcctcctca

SEQ ID NO: 3563107 - DNA, 17 bp, Homo sapiens
tgcaggcctaggtgcag

SEQ ID NO: 3563108 - DNA, 15 bp, Homo sapiens
tgcagggcttctcct

SEQ ID NO: 3563109 - DNA, 19 bp, Homo sapiens
tgcagggggtgtgtctgct

SEQ ID NO: 3563110 - DNA, 22 bp, Homo sapiens
tgcagggggtgtgtctgctcag

SEQ ID NO: 3563111 - DNA, 17 bp, Homo sapiens
tgcagtccatttcctaa

SEQ ID NO: 3563112 - DNA, 21 bp, Homo sapiens
tgcagtcccacactgtgcaga

SEQ ID NO: 3563113 - DNA, 14 bp, Homo sapiens
tgcagtctcatttc

SEQ ID NO: 3563114 - DNA, 23 bp, Homo sapiens
tgcagtctttatttttttcccat

SEQ ID NO: 3563115 - DNA, 16 bp, Homo sapiens
tgcagtttcttttcac

SEQ ID NO: 3563116 - DNA, 22 bp, Homo sapiens
tgcataagtgaaaatcttacaa

SEQ ID NO: 3563117 - DNA, 14 bp, Homo sapiens
tgcataccaacctg

SEQ ID NO: 3563118 - DNA, 14 bp, Homo sapiens
tgcataggattcca

SEQ ID NO: 3563119 - DNA, 14 bp, Homo sapiens
tgcatatagacaca

SEQ ID NO: 3563120 - DNA, 21 bp, Homo sapiens
tgcatatgtcactagaatgga

SEQ ID NO: 3563121 - DNA, 23 bp, Homo sapiens
tgcatattataaaggataaagaa

SEQ ID NO: 3563122 - DNA, 22 bp, Homo sapiens
tgcatcaatttttcttatttca

SEQ ID NO: 3563123 - DNA, 21 bp, Homo sapiens
tgcatccagcctggggctgag

SEQ ID NO: 3563124 - DNA, 14 bp, Homo sapiens
tgcatctcagccca

SEQ ID NO: 3563125 - DNA, 19 bp, Homo sapiens
tgcatctcctcccgccctt

SEQ ID NO: 3563126 - DNA, 13 bp, Homo sapiens
tgcatctctgtga

SEQ ID NO: 3563127 - DNA, 18 bp, Homo sapiens
tgcatctgaccagcagcg

SEQ ID NO: 3563128 - DNA, 20 bp, Homo sapiens
tgcatgagctggcaaccagc

SEQ ID NO: 3563129 - DNA, 24 bp, Homo sapiens
tgcatgagctggcaaccagccagc

SEQ ID NO: 3563130 - DNA, 15 bp, Homo sapiens
tgcatgctagcatgg

SEQ ID NO: 3563131 - DNA, 15 bp, Homo sapiens
tgcatgctagtgttg

SEQ ID NO: 3563132 - DNA, 14 bp, Homo sapiens
tgcatggagaatgg

SEQ ID NO: 3563133 - DNA, 17 bp, Homo sapiens
tgcatgggaggaattca

SEQ ID NO: 3563134 - DNA, 13 bp, Homo sapiens
tgcatgggctcgc

SEQ ID NO: 3563135 - DNA, 19 bp, Homo sapiens
tgcatggtgccccaggacc

SEQ ID NO: 3563136 - DNA, 20 bp, Homo sapiens
tgcatggtgccccaggacca

SEQ ID NO: 3563137 - DNA, 18 bp, Homo sapiens
tgcatgtagcatataaat

SEQ ID NO: 3563138 - DNA, 13 bp, Homo sapiens
tgcatgttttcca

SEQ ID NO: 3563139 - DNA, 15 bp, Homo sapiens
tgcattcctgtgccc

SEQ ID NO: 3563140 - DNA, 20 bp, Homo sapiens
tgcattcctttttcttcact

SEQ ID NO: 3563141 - DNA, 15 bp, Homo sapiens
tgcattctctcccat

SEQ ID NO: 3563142 - DNA, 13 bp, Homo sapiens
tgcattctttttt

SEQ ID NO: 3563143 - DNA, 14 bp, Homo sapiens
tgcattgcctgtaa

SEQ ID NO: 3563144 - DNA, 16 bp, Homo sapiens
tgcattgcctgtaaca

SEQ ID NO: 3563145 - DNA, 18 bp, Homo sapiens
tgcattgcctgtaacaat

SEQ ID NO: 3563146 - DNA, 23 bp, Homo sapiens
tgcattttggagagtttcctgaa

SEQ ID NO: 3563147 - DNA, 21 bp, Homo sapiens
tgccaaaacccagctgcaccc

SEQ ID NO: 3563148 - DNA, 19 bp, Homo sapiens
tgccaaaggatgtgatata

SEQ ID NO: 3563149 - DNA, 21 bp, Homo sapiens
tgccaagagctactcccacag

SEQ ID NO: 3563150 - DNA, 18 bp, Homo sapiens
tgccaaggctctcccctc

SEQ ID NO: 3563151 - DNA, 11 bp, Homo sapiens
tgccaataaag

SEQ ID NO: 3563152 - DNA, 13 bp, Homo sapiens
tgccaataaagct

SEQ ID NO: 3563153 - DNA, 15 bp, Homo sapiens
tgccaataaagcttt

SEQ ID NO: 3563154 - DNA, 21 bp, Homo sapiens
tgccaataaagcttttggaag

SEQ ID NO: 3563155 - DNA, 14 bp, Homo sapiens
tgccaataaattct

SEQ ID NO: 3563156 - DNA, 17 bp, Homo sapiens
tgccaatctaaaatggc

SEQ ID NO: 3563157 - DNA, 18 bp, Homo sapiens
tgccaatctaaaatggca

SEQ ID NO: 3563158 - DNA, 15 bp, Homo sapiens
tgccaattagcaatt

SEQ ID NO: 3563159 - DNA, 16 bp, Homo sapiens
tgccacaaggacttcc

SEQ ID NO: 3563160 - DNA, 22 bp, Homo sapiens
tgccacacaaggatagatgctg

SEQ ID NO: 3563161 - DNA, 13 bp, Homo sapiens
tgccacacttcag

SEQ ID NO: 3563162 - DNA, 16 bp, Homo sapiens
tgccacacttcaggct

SEQ ID NO: 3563163 - DNA, 22 bp, Homo sapiens
tgccacacttcaggctcttctc

SEQ ID NO: 3563164 - DNA, 23 bp, Homo sapiens
tgccacacttcaggctcttctcc

SEQ ID NO: 3563165 - DNA, 21 bp, Homo sapiens
tgccacaggcttagggacagg

SEQ ID NO: 3563166 - DNA, 15 bp, Homo sapiens
tgccaccaccctgcc

SEQ ID NO: 3563167 - DNA, 17 bp, Homo sapiens
tgccaccaccctgcccc

SEQ ID NO: 3563168 - DNA, 18 bp, Homo sapiens
tgccacccacctccctgc

SEQ ID NO: 3563169 - DNA, 21 bp, Homo sapiens
tgccacccagccccagccagg

SEQ ID NO: 3563170 - DNA, 22 bp, Homo sapiens
tgccacccagccccagccaggg

SEQ ID NO: 3563171 - DNA, 16 bp, Homo sapiens
tgccacccccttccct

SEQ ID NO: 3563172 - DNA, 21 bp, Homo sapiens
tgccacccccttccctgggag

SEQ ID NO: 3563173 - DNA, 18 bp, Homo sapiens
tgccaccccgagggctga

SEQ ID NO: 3563174 - DNA, 13 bp, Homo sapiens
tgccactgcctct

SEQ ID NO: 3563175 - DNA, 19 bp, Homo sapiens
tgccactgcctcttcctcc

SEQ ID NO: 3563176 - DNA, 15 bp, Homo sapiens
tgccactgtgtttcc

SEQ ID NO: 3563177 - DNA, 14 bp, Homo sapiens
tgccacttaatgta

SEQ ID NO: 3563178 - DNA, 20 bp, Homo sapiens
tgccacttaatgtatgttac

SEQ ID NO: 3563179 - DNA, 15 bp, Homo sapiens
tgccacttcctttta

SEQ ID NO: 3563180 - DNA, 16 bp, Homo sapiens
tgccacttctcactca

SEQ ID NO: 3563181 - DNA, 22 bp, Homo sapiens
tgccagagaggtggggatcctg

SEQ ID NO: 3563182 - DNA, 13 bp, Homo sapiens
tgccagaggacca

SEQ ID NO: 3563183 - DNA, 17 bp, Homo sapiens
tgccagcaaataaatac

SEQ ID NO: 3563184 - DNA, 14 bp, Homo sapiens
tgccagcaccacag

SEQ ID NO: 3563185 - DNA, 19 bp, Homo sapiens
tgccagcaccacagccggt

SEQ ID NO: 3563186 - DNA, 19 bp, Homo sapiens
tgccagcaggggggctgtg

SEQ ID NO: 3563187 - DNA, 21 bp, Homo sapiens
tgccagcaggggggctgtgcc

SEQ ID NO: 3563188 - DNA, 21 bp, Homo sapiens
tgccagcgccaaaacaagcca

SEQ ID NO: 3563189 - DNA, 15 bp, Homo sapiens
tgccagcttctctct

SEQ ID NO: 3563190 - DNA, 18 bp, Homo sapiens
tgccaggatggaatgatg

SEQ ID NO: 3563191 - DNA, 14 bp, Homo sapiens
tgccaggctgcctc

SEQ ID NO: 3563192 - DNA, 17 bp, Homo sapiens
tgccaggctgcctcctg

SEQ ID NO: 3563193 - DNA, 19 bp, Homo sapiens
tgccaggctgcctcctgcc

SEQ ID NO: 3563194 - DNA, 21 bp, Homo sapiens
tgccaggctgcctcctgccct

SEQ ID NO: 3563195 - DNA, 18 bp, Homo sapiens
tgccagggcttcctcttc

SEQ ID NO: 3563196 - DNA, 18 bp, Homo sapiens
tgccaggggcatccaagg

SEQ ID NO: 3563197 - DNA, 20 bp, Homo sapiens
tgccaggggctctgtggcaa

SEQ ID NO: 3563198 - DNA, 16 bp, Homo sapiens
tgccagtgaagtcctt

SEQ ID NO: 3563199 - DNA, 22 bp, Homo sapiens
tgccagtgaagtccttcagtga

SEQ ID NO: 3563200 - DNA, 14 bp, Homo sapiens
tgccagtgcagcca

SEQ ID NO: 3563201 - DNA, 15 bp, Homo sapiens
tgccagtgcagccac

SEQ ID NO: 3563202 - DNA, 17 bp, Homo sapiens
tgccagttacttgggct

SEQ ID NO: 3563203 - DNA, 18 bp, Homo sapiens
tgccagttacttgggctt

SEQ ID NO: 3563204 - DNA, 23 bp, Homo sapiens
tgccagttttccgaagtctctga

SEQ ID NO: 3563205 - DNA, 18 bp, Homo sapiens
tgccatatggaggactgt

SEQ ID NO: 3563206 - DNA, 22 bp, Homo sapiens
tgccatatggaggactgtgaca

SEQ ID NO: 3563207 - DNA, 14 bp, Homo sapiens
tgccatgctgggcc

SEQ ID NO: 3563208 - DNA, 22 bp, Homo sapiens
tgccatgctgggccactgggga

SEQ ID NO: 3563209 - DNA, 13 bp, Homo sapiens
tgccatttccctt

SEQ ID NO: 3563210 - DNA, 22 bp, Homo sapiens
tgccatttgcttgtactgggac

SEQ ID NO: 3563211 - DNA, 18 bp, Homo sapiens
tgcccaaacccttaactg

SEQ ID NO: 3563212 - DNA, 19 bp, Homo sapiens
tgcccaaacccttaactga

SEQ ID NO: 3563213 - DNA, 14 bp, Homo sapiens
tggagaactagaga

SEQ ID NO: 3563214 - DNA, 13 bp, Homo sapiens
tggagaaggcctg

SEQ ID NO: 3563215 - DNA, 14 bp, Homo sapiens
tggagaaggcctgg

SEQ ID NO: 3563216 - DNA, 20 bp, Homo sapiens
tggagaatgggacgaggaca

SEQ ID NO: 3563217 - DNA, 14 bp, Homo sapiens
tggagacaaggtgc

SEQ ID NO: 3563218 - DNA, 17 bp, Homo sapiens
tggagacagcagtttcc

SEQ ID NO: 3563219 - DNA, 13 bp, Homo sapiens
tggagaccaggct

SEQ ID NO: 3563220 - DNA, 17 bp, Homo sapiens
tggagactgtctcaaga

SEQ ID NO: 3563221 - DNA, 15 bp, Homo sapiens
tggagacttcctctg

SEQ ID NO: 3563222 - DNA, 18 bp, Homo sapiens
tggagaggccctctggag

SEQ ID NO: 3563223 - DNA, 16 bp, Homo sapiens
tggagagtttcctgaa

SEQ ID NO: 3563224 - DNA, 16 bp, Homo sapiens
tggagatactggtgga

SEQ ID NO: 3563225 - DNA, 18 bp, Homo sapiens
tggagatcaggagtgaca

SEQ ID NO: 3563226 - DNA, 15 bp, Homo sapiens
tggagatggaagctt

SEQ ID NO: 3563227 - DNA, 16 bp, Homo sapiens
tggagatggaagcttg

SEQ ID NO: 3563228 - DNA, 13 bp, Homo sapiens
tggagatggactc

SEQ ID NO: 3563229 - DNA, 14 bp, Homo sapiens
tggagatggactca

SEQ ID NO: 3563230 - DNA, 22 bp, Homo sapiens
tggagcagcaggcctctgggac

SEQ ID NO: 3563231 - DNA, 18 bp, Homo sapiens
tggagcaggagccccgcc

SEQ ID NO: 3563232 - DNA, 12 bp, Homo sapiens
tggagcaggccc

SEQ ID NO: 3563233 - DNA, 13 bp, Homo sapiens
tggagcctggggt

SEQ ID NO: 3563234 - DNA, 14 bp, Homo sapiens
tggagcctggggtg

SEQ ID NO: 3563235 - DNA, 16 bp, Homo sapiens
tggagctgccacagag

SEQ ID NO: 3563236 - DNA, 14 bp, Homo sapiens
tggagctgtctgtc

SEQ ID NO: 3563237 - DNA, 16 bp, Homo sapiens
tggagcttcagccagg

SEQ ID NO: 3563238 - DNA, 18 bp, Homo sapiens
tggaggcaaaggcctgga

SEQ ID NO: 3563239 - DNA, 15 bp, Homo sapiens
tggaggcccagttca

SEQ ID NO: 3563240 - DNA, 17 bp, Homo sapiens
tggaggctcctctaggc

SEQ ID NO: 3563241 - DNA, 21 bp, Homo sapiens
tggaggctcctctaggccctg

SEQ ID NO: 3563242 - DNA, 15 bp, Homo sapiens
tggagggaagacctg

SEQ ID NO: 3563243 - DNA, 16 bp, Homo sapiens
tggagggaagacctga

SEQ ID NO: 3563244 - DNA, 17 bp, Homo sapiens
tggagggagggcagctg

SEQ ID NO: 3563245 - DNA, 21 bp, Homo sapiens
tggaggggatgataaaggaaa

SEQ ID NO: 3563246 - DNA, 16 bp, Homo sapiens
tggaggtcatctggcg

SEQ ID NO: 3563247 - DNA, 23 bp, Homo sapiens
tggaggtccctggtcggagaggg

SEQ ID NO: 3563248 - DNA, 14 bp, Homo sapiens
tggaggtctggctg

SEQ ID NO: 3563249 - DNA, 12 bp, Homo sapiens
tggagtgaccaa

SEQ ID NO: 3563250 - DNA, 19 bp, Homo sapiens
tggagtgagtcacctgctc

SEQ ID NO: 3563251 - DNA, 23 bp, Homo sapiens
tggagtgctcttcccactccagc

SEQ ID NO: 3563252 - DNA, 13 bp, Homo sapiens
tggagtggccact

SEQ ID NO: 3563253 - DNA, 19 bp, Homo sapiens
tggagtgggaagggagcat

SEQ ID NO: 3563254 - DNA, 19 bp, Homo sapiens
tggagttcttagctatcct

SEQ ID NO: 3563255 - DNA, 19 bp, Homo sapiens
tggagttgatctggaaccc

SEQ ID NO: 3563256 - DNA, 22 bp, Homo sapiens
tggagttgatctggaacccaga

SEQ ID NO: 3563257 - DNA, 19 bp, Homo sapiens
tggagttggggcagaggag

SEQ ID NO: 3563258 - DNA, 16 bp, Homo sapiens
tggagtttctctcttg

SEQ ID NO: 3563259 - DNA, 12 bp, Homo sapiens
tggagttttata

SEQ ID NO: 3563260 - DNA, 17 bp, Homo sapiens
tggagttttataaatta

SEQ ID NO: 3563261 - DNA, 19 bp, Homo sapiens
tggataagtttctattctg

SEQ ID NO: 3563262 - DNA, 22 bp, Homo sapiens
tggatatttcaatcttttaaat

SEQ ID NO: 3563263 - DNA, 14 bp, Homo sapiens
tggatccagcactg

SEQ ID NO: 3563264 - DNA, 15 bp, Homo sapiens
tggatcttcagaact

SEQ ID NO: 3563265 - DNA, 21 bp, Homo sapiens
tggatcttcagaactgccctt

SEQ ID NO: 3563266 - DNA, 23 bp, Homo sapiens
tggatcttcagaactgcccttgc

SEQ ID NO: 3563267 - DNA, 18 bp, Homo sapiens
tggatgagaaacagctca

SEQ ID NO: 3563268 - DNA, 14 bp, Homo sapiens
tggatgcccaggaa

SEQ ID NO: 3563269 - DNA, 13 bp, Homo sapiens
tggatgttgctat

SEQ ID NO: 3563270 - DNA, 14 bp, Homo sapiens
tggatgttgctata

SEQ ID NO: 3563271 - DNA, 20 bp, Homo sapiens
tggattataagttctatttt

SEQ ID NO: 3563272 - DNA, 22 bp, Homo sapiens
tggattataagttctattttac

SEQ ID NO: 3563273 - DNA, 15 bp, Homo sapiens
tggattgtatttaag

SEQ ID NO: 3563274 - DNA, 16 bp, Homo sapiens
tggattgtatttaaga

SEQ ID NO: 3563275 - DNA, 19 bp, Homo sapiens
tggattgtgcctaatgtgt

SEQ ID NO: 3563276 - DNA, 15 bp, Homo sapiens
tggatttcctaatac

SEQ ID NO: 3563277 - DNA, 21 bp, Homo sapiens
tggatttcctaatactgtcat

SEQ ID NO: 3563278 - DNA, 21 bp, Homo sapiens
tggcaaaaagagtcagacatt

SEQ ID NO: 3563279 - DNA, 17 bp, Homo sapiens
tggcaaacgtttctcaa

SEQ ID NO: 3563280 - DNA, 20 bp, Homo sapiens
tggcaaagtgacaaagcaat

SEQ ID NO: 3563281 - DNA, 19 bp, Homo sapiens
tggcaaagtttaaatgtat

SEQ ID NO: 3563282 - DNA, 16 bp, Homo sapiens
tggcaaatccaggctg

SEQ ID NO: 3563283 - DNA, 14 bp, Homo sapiens
tggcaaccagccag

SEQ ID NO: 3563284 - DNA, 19 bp, Homo sapiens
tggcaatctcagatgcagt

SEQ ID NO: 3563285 - DNA, 19 bp, Homo sapiens
tggcaatgactcaaagtct

SEQ ID NO: 3563286 - DNA, 19 bp, Homo sapiens
tggcaattttgtaaattga

SEQ ID NO: 3563287 - DNA, 15 bp, Homo sapiens
tggcaattttgtaac

SEQ ID NO: 3563288 - DNA, 22 bp, Homo sapiens
tggcacaatgttggagcagcag

SEQ ID NO: 3563289 - DNA, 17 bp, Homo sapiens
tggcacacgcctgtagt

SEQ ID NO: 3563290 - DNA, 16 bp, Homo sapiens
tggcacagctgggagc

SEQ ID NO: 3563291 - DNA, 20 bp, Homo sapiens
tggcacagctgggagcctgg

SEQ ID NO: 3563292 - DNA, 19 bp, Homo sapiens
tggcacagttttctgagaa

SEQ ID NO: 3563293 - DNA, 14 bp, Homo sapiens
tggcacctgtttcc

SEQ ID NO: 3563294 - DNA, 13 bp, Homo sapiens
tggcaccttcccc

SEQ ID NO: 3563295 - DNA, 21 bp, Homo sapiens
tggcaccttccccctccccca

SEQ ID NO: 3563296 - DNA, 17 bp, Homo sapiens
tggcacgtgacaggctc

SEQ ID NO: 3563297 - DNA, 20 bp, Homo sapiens
tggcagagaccataagagaa

SEQ ID NO: 3563298 - DNA, 20 bp, Homo sapiens
tggcagcaccgcctcttccc

SEQ ID NO: 3563299 - DNA, 20 bp, Homo sapiens
tggcagcagccccccttgcc

SEQ ID NO: 3563300 - DNA, 22 bp, Homo sapiens
tggcagcagccccccttgcccc

SEQ ID NO: 3563301 - DNA, 17 bp, Homo sapiens
tggcagccgtgccttca

SEQ ID NO: 3563302 - DNA, 20 bp, Homo sapiens
tggcagccgtgccttcagct

SEQ ID NO: 3563303 - DNA, 22 bp, Homo sapiens
tggcagccgtgccttcagctct

SEQ ID NO: 3563304 - DNA, 14 bp, Homo sapiens
tggcagcctgattc

SEQ ID NO: 3563305 - DNA, 16 bp, Homo sapiens
tggcagctagtgcctt

SEQ ID NO: 3563306 - DNA, 21 bp, Homo sapiens
tggcagctctggacagcccca

SEQ ID NO: 3563307 - DNA, 22 bp, Homo sapiens
tggcagctctggacagccccac

SEQ ID NO: 3563308 - DNA, 12 bp, Homo sapiens
tggcagctgctg

SEQ ID NO: 3563309 - DNA, 14 bp, Homo sapiens
tggcagctgggcag

SEQ ID NO: 3563310 - DNA, 14 bp, Homo sapiens
tggcagcttgctgg

SEQ ID NO: 3563311 - DNA, 18 bp, Homo sapiens
tggcagcttgctgggctt

SEQ ID NO: 3563312 - DNA, 19 bp, Homo sapiens
tggcaggactcctggcagg

SEQ ID NO: 3563313 - DNA, 12 bp, Homo sapiens
tggcaggcccac

SEQ ID NO: 3563314 - DNA, 16 bp, Homo sapiens
tggcaggcccactccc

SEQ ID NO: 3563315 - DNA, 18 bp, Homo sapiens
tggcaggcccactcccca

SEQ ID NO: 3563316 - DNA, 24 bp, Homo sapiens
tggcaggggagacaggagcctagc

SEQ ID NO: 3563317 - DNA, 14 bp, Homo sapiens
tggcaggtgagcaa

SEQ ID NO: 3563318 - DNA, 18 bp, Homo sapiens
tggcagtcctggaggcag

SEQ ID NO: 3563319 - DNA, 14 bp, Homo sapiens
tggcagtgggaatg

SEQ ID NO: 3563320 - DNA, 16 bp, Homo sapiens
tggcatagctctgggg

SEQ ID NO: 3563321 - DNA, 21 bp, Homo sapiens
tggcatataattttcacttct

SEQ ID NO: 3563322 - DNA, 19 bp, Homo sapiens
tggcattacagctggagaa

SEQ ID NO: 3563323 - DNA, 13 bp, Homo sapiens
tggccaactgcaa

SEQ ID NO: 3563324 - DNA, 17 bp, Homo sapiens
tggccaaggagctgcta

SEQ ID NO: 3563325 - DNA, 17 bp, Homo sapiens
tggccactccagacccc

SEQ ID NO: 3563326 - DNA, 12 bp, Homo sapiens
tggccagacaca

SEQ ID NO: 3563327 - DNA, 12 bp, Homo sapiens
tggccaggcagg

SEQ ID NO: 3563328 - DNA, 13 bp, Homo sapiens
tggccaggcaggg

SEQ ID NO: 3563329 - DNA, 13 bp, Homo sapiens
tggccaggctggt

SEQ ID NO: 3563330 - DNA, 17 bp, Homo sapiens
tggccaggtggccactc

SEQ ID NO: 3563331 - DNA, 18 bp, Homo sapiens
tggccatcttctttcttc

SEQ ID NO: 3563332 - DNA, 19 bp, Homo sapiens
tggccatcttctttcttcc

SEQ ID NO: 3563333 - DNA, 15 bp, Homo sapiens
tggccatttgctttt

SEQ ID NO: 3563334 - DNA, 16 bp, Homo sapiens
tggccattttaaaatg

SEQ ID NO: 3563335 - DNA, 14 bp, Homo sapiens
tggcccagggccca

SEQ ID NO: 3563336 - DNA, 15 bp, Homo sapiens
tggcccagtgccagc

SEQ ID NO: 3563337 - DNA, 18 bp, Homo sapiens
tggccccatccaaccact

SEQ ID NO: 3563338 - DNA, 19 bp, Homo sapiens
tggcccccagccctggggg

SEQ ID NO: 3563339 - DNA, 21 bp, Homo sapiens
tggcccccttcaggagcctgg

SEQ ID NO: 3563340 - DNA, 22 bp, Homo sapiens
tggcccccttcaggagcctggc

SEQ ID NO: 3563341 - DNA, 15 bp, Homo sapiens
tggccccgccctcag

SEQ ID NO: 3563342 - DNA, 14 bp, Homo sapiens
tggcccctgaacaa

SEQ ID NO: 3563343 - DNA, 16 bp, Homo sapiens
tggcccgacagcctgg

SEQ ID NO: 3563344 - DNA, 17 bp, Homo sapiens
tggcccgacagcctggc

SEQ ID NO: 3563345 - DNA, 19 bp, Homo sapiens
tggcccgacagcctggcac

SEQ ID NO: 3563346 - DNA, 14 bp, Homo sapiens
tgtagcatataaat

SEQ ID NO: 3563347 - DNA, 20 bp, Homo sapiens
tgtagccaggtactgcattc

SEQ ID NO: 3563348 - DNA, 15 bp, Homo sapiens
tgtagcctaaagggc

SEQ ID NO: 3563349 - DNA, 19 bp, Homo sapiens
tgtagcctaaagggcaggg

SEQ ID NO: 3563350 - DNA, 22 bp, Homo sapiens
tgtagcctaaagggcagggccc

SEQ ID NO: 3563351 - DNA, 19 bp, Homo sapiens
tgtagcctacagacatgga

SEQ ID NO: 3563352 - DNA, 16 bp, Homo sapiens
tgtagctgtaagggca

SEQ ID NO: 3563353 - DNA, 17 bp, Homo sapiens
tgtagctgtaagggcag

SEQ ID NO: 3563354 - DNA, 20 bp, Homo sapiens
tgtagctgtaagggcagtgc

SEQ ID NO: 3563355 - DNA, 15 bp, Homo sapiens
tgtagctttgctctt

SEQ ID NO: 3563356 - DNA, 16 bp, Homo sapiens
tgtagggttataataa

SEQ ID NO: 3563357 - DNA, 16 bp, Homo sapiens
tgtaggtgttatgtat

SEQ ID NO: 3563358 - DNA, 19 bp, Homo sapiens
tgtaggtgttatgtattcc

SEQ ID NO: 3563359 - DNA, 18 bp, Homo sapiens
tgtagtaattgttacaat

SEQ ID NO: 3563360 - DNA, 23 bp, Homo sapiens
tgtagtagcgttttttaaatgta

SEQ ID NO: 3563361 - DNA, 18 bp, Homo sapiens
tgtagtattttttgtata

SEQ ID NO: 3563362 - DNA, 20 bp, Homo sapiens
tgtagtccgtgctgacagct

SEQ ID NO: 3563363 - DNA, 17 bp, Homo sapiens
tgtagttttatttgtat

SEQ ID NO: 3563364 - DNA, 11 bp, Homo sapiens
tgtataaatgt

SEQ ID NO: 3563365 - DNA, 18 bp, Homo sapiens
tgtatagctcttttccta

SEQ ID NO: 3563366 - DNA, 17 bp, Homo sapiens
tgtatagtatctgtata

SEQ ID NO: 3563367 - DNA, 18 bp, Homo sapiens
tgtatagttatatgtaca

SEQ ID NO: 3563368 - DNA, 12 bp, Homo sapiens
tgtatatcttct

SEQ ID NO: 3563369 - DNA, 14 bp, Homo sapiens
tgtatatgtattta

SEQ ID NO: 3563370 - DNA, 14 bp, Homo sapiens
tgtatattacaatg

SEQ ID NO: 3563371 - DNA, 19 bp, Homo sapiens
tgtatattacaatgatcac

SEQ ID NO: 3563372 - DNA, 20 bp, Homo sapiens
tgtatatttttaaagaatgt

SEQ ID NO: 3563373 - DNA, 21 bp, Homo sapiens
tgtatcaaatacatttaaaac

SEQ ID NO: 3563374 - DNA, 18 bp, Homo sapiens
tgtatcacaaatcttaac

SEQ ID NO: 3563375 - DNA, 17 bp, Homo sapiens
tgtatcatagaaatgta

SEQ ID NO: 3563376 - DNA, 17 bp, Homo sapiens
tgtatcctggccctggg

SEQ ID NO: 3563377 - DNA, 13 bp, Homo sapiens
tgtatctgagcag

SEQ ID NO: 3563378 - DNA, 17 bp, Homo sapiens
tgtatgagtgtatgtgt

SEQ ID NO: 3563379 - DNA, 14 bp, Homo sapiens
tgtatgcactttgt

SEQ ID NO: 3563380 - DNA, 19 bp, Homo sapiens
tgtatgccacacctggcct

SEQ ID NO: 3563381 - DNA, 19 bp, Homo sapiens
tgtatggaaacactgattt

SEQ ID NO: 3563382 - DNA, 19 bp, Homo sapiens
tgtatgtaacgatgttgta

SEQ ID NO: 3563383 - DNA, 12 bp, Homo sapiens
tgtatgtggggg

SEQ ID NO: 3563384 - DNA, 20 bp, Homo sapiens
tgtatgtgggggtctgtgtg

SEQ ID NO: 3563385 - DNA, 22 bp, Homo sapiens
tgtatgtgtgtctattttgtaa

SEQ ID NO: 3563386 - DNA, 21 bp, Homo sapiens
tgtattcaagcaaacatcaaa

SEQ ID NO: 3563387 - DNA, 13 bp, Homo sapiens
tgtattctgtaaa

SEQ ID NO: 3563388 - DNA, 19 bp, Homo sapiens
tgtattgcacattgtaaaa

SEQ ID NO: 3563389 - DNA, 19 bp, Homo sapiens
tgtattggatatataagag

SEQ ID NO: 3563390 - DNA, 18 bp, Homo sapiens
tgtattggtgttgcagcc

SEQ ID NO: 3563391 - DNA, 14 bp, Homo sapiens
tgtatttaagacat

SEQ ID NO: 3563392 - DNA, 14 bp, Homo sapiens
tgtatttattaatt

SEQ ID NO: 3563393 - DNA, 12 bp, Homo sapiens
tgtatttctata

SEQ ID NO: 3563394 - DNA, 21 bp, Homo sapiens
tgtatttctccatcctgcaga

SEQ ID NO: 3563395 - DNA, 13 bp, Homo sapiens
tgtatttggaaat

SEQ ID NO: 3563396 - DNA, 13 bp, Homo sapiens
tgtattttacatg

SEQ ID NO: 3563397 - DNA, 18 bp, Homo sapiens
tgtattttattattttct

SEQ ID NO: 3563398 - DNA, 18 bp, Homo sapiens
tgtattttgatgagatat

SEQ ID NO: 3563399 - DNA, 23 bp, Homo sapiens
tgtcaaaaaagaatctgtattca

SEQ ID NO: 3563400 - DNA, 17 bp, Homo sapiens
tgtcaagagtcgctgtg

SEQ ID NO: 3563401 - DNA, 19 bp, Homo sapiens
tgtcaagagtcgctgtgcc

SEQ ID NO: 3563402 - DNA, 16 bp, Homo sapiens
tgtcaaggaagacttt

SEQ ID NO: 3563403 - DNA, 17 bp, Homo sapiens
tgtcaatgagagcataa

SEQ ID NO: 3563404 - DNA, 15 bp, Homo sapiens
tgtcacatctcaggg

SEQ ID NO: 3563405 - DNA, 18 bp, Homo sapiens
tgtcacgatcacaggcct

SEQ ID NO: 3563406 - DNA, 16 bp, Homo sapiens
tgtcactttttctgat

SEQ ID NO: 3563407 - DNA, 15 bp, Homo sapiens
tgtcactttttgagg

SEQ ID NO: 3563408 - DNA, 18 bp, Homo sapiens
tgtcactttttgaggcaa

SEQ ID NO: 3563409 - DNA, 21 bp, Homo sapiens
tgtcactttttgaggcaaaag

SEQ ID NO: 3563410 - DNA, 21 bp, Homo sapiens
tgtcagctcccctcggagaag

SEQ ID NO: 3563411 - DNA, 22 bp, Homo sapiens
tgtcagctgcaaggtactctgg

SEQ ID NO: 3563412 - DNA, 23 bp, Homo sapiens
tgtcagctgcaaggtactctggt

SEQ ID NO: 3563413 - DNA, 18 bp, Homo sapiens
tgtcagtatgtggaagtg

SEQ ID NO: 3563414 - DNA, 19 bp, Homo sapiens
tgtcagtatgtggaagtgt

SEQ ID NO: 3563415 - DNA, 20 bp, Homo sapiens
tgtcagttctctgggaagtg

SEQ ID NO: 3563416 - DNA, 17 bp, Homo sapiens
tgtcagttgttatttat

SEQ ID NO: 3563417 - DNA, 22 bp, Homo sapiens
tgtcagttgttatttattgaaa

SEQ ID NO: 3563418 - DNA, 14 bp, Homo sapiens
tgtcagtttttcct

SEQ ID NO: 3563419 - DNA, 15 bp, Homo sapiens
tgtcagtttttcctc

SEQ ID NO: 3563420 - DNA, 19 bp, Homo sapiens
tgtcatcctcaaagaaagt

SEQ ID NO: 3563421 - DNA, 20 bp, Homo sapiens
tgtcatcctcaaagaaagtg

SEQ ID NO: 3563422 - DNA, 15 bp, Homo sapiens
tgtcatggtgaaatt

SEQ ID NO: 3563423 - DNA, 22 bp, Homo sapiens
tgtcatggtgaaattataacta

SEQ ID NO: 3563424 - DNA, 17 bp, Homo sapiens
tgtcatgttatgcagtg

SEQ ID NO: 3563425 - DNA, 18 bp, Homo sapiens
tgtcatgttatgcagtga

SEQ ID NO: 3563426 - DNA, 19 bp, Homo sapiens
tgtcatgttatgcagtgaa

SEQ ID NO: 3563427 - DNA, 20 bp, Homo sapiens
tgtcatgttatgcagtgaac

SEQ ID NO: 3563428 - DNA, 22 bp, Homo sapiens
tgtcatgttatgcagtgaacta

SEQ ID NO: 3563429 - DNA, 23 bp, Homo sapiens
tgtcattatttttgttagcaaag

SEQ ID NO: 3563430 - DNA, 14 bp, Homo sapiens
tgtcattcagttct

SEQ ID NO: 3563431 - DNA, 17 bp, Homo sapiens
tgtcattcagttctagg

SEQ ID NO: 3563432 - DNA, 23 bp, Homo sapiens
tgtcattcagttctaggcctttc

SEQ ID NO: 3563433 - DNA, 13 bp, Homo sapiens
tgtcattggaagc

SEQ ID NO: 3563434 - DNA, 18 bp, Homo sapiens
tgtccacttaaaatacat

SEQ ID NO: 3563435 - DNA, 22 bp, Homo sapiens
tgtccagagataaaaatcatat

SEQ ID NO: 3563436 - DNA, 11 bp, Homo sapiens
tgtccagctcc

SEQ ID NO: 3563437 - DNA, 19 bp, Homo sapiens
tgtccaggcactgctgccc

SEQ ID NO: 3563438 - DNA, 13 bp, Homo sapiens
tgtccagtgagca

SEQ ID NO: 3563439 - DNA, 15 bp, Homo sapiens
tgtccataaataaag

SEQ ID NO: 3563440 - DNA, 19 bp, Homo sapiens
tgtcccaattctgcccgct

SEQ ID NO: 3563441 - DNA, 15 bp, Homo sapiens
tgtcccacatggcca

SEQ ID NO: 3563442 - DNA, 11 bp, Homo sapiens
tgtcccaccca

SEQ ID NO: 3563443 - DNA, 18 bp, Homo sapiens
tgtcccacccacacagct

SEQ ID NO: 3563444 - DNA, 19 bp, Homo sapiens
tgtcccacccacacagctg

SEQ ID NO: 3563445 - DNA, 22 bp, Homo sapiens
tgtcccacccacacagctgccc

SEQ ID NO: 3563446 - DNA, 14 bp, Homo sapiens
tgtcccaggtcctc

SEQ ID NO: 3563447 - DNA, 17 bp, Homo sapiens
tgtcccaggtcctcact

SEQ ID NO: 3563448 - DNA, 12 bp, Homo sapiens
tgtccccaccat

SEQ ID NO: 3563449 - DNA, 17 bp, Homo sapiens
tgtccccaccatctgct

SEQ ID NO: 3563450 - DNA, 21 bp, Homo sapiens
tgtccccaccatctgctgtct

SEQ ID NO: 3563451 - DNA, 22 bp, Homo sapiens
tgtccctaccgagtctcttctc

SEQ ID NO: 3563452 - DNA, 22 bp, Homo sapiens
tgtccctctagtgccttcttta

SEQ ID NO: 3563453 - DNA, 15 bp, Homo sapiens
tgtccctctgcccca

SEQ ID NO: 3563454 - DNA, 16 bp, Homo sapiens
tgtccctctgccccat

SEQ ID NO: 3563455 - DNA, 15 bp, Homo sapiens
tgtccctgcagggcc

SEQ ID NO: 3563456 - DNA, 14 bp, Homo sapiens
tgtccctggacaca

SEQ ID NO: 3563457 - DNA, 17 bp, Homo sapiens
tgtccctggacacagct

SEQ ID NO: 3563458 - DNA, 23 bp, Homo sapiens
tgtccctggacacagctcttcat

SEQ ID NO: 3563459 - DNA, 13 bp, Homo sapiens
tgtcccttgcctc

SEQ ID NO: 3563460 - DNA, 14 bp, Homo sapiens
tgtcccttgcctct

SEQ ID NO: 3563461 - DNA, 17 bp, Homo sapiens
tgtccctttccctacct

SEQ ID NO: 3563462 - DNA, 15 bp, Homo sapiens
tgtcctaaggcccat

SEQ ID NO: 3563463 - DNA, 15 bp, Homo sapiens
tgtcctattatattc

SEQ ID NO: 3563464 - DNA, 13 bp, Homo sapiens
tgtcctcagcctt

SEQ ID NO: 3563465 - DNA, 17 bp, Homo sapiens
tgtcctcagccttgcca

SEQ ID NO: 3563466 - DNA, 21 bp, Homo sapiens
tgtcctcagccttgccagaga

SEQ ID NO: 3563467 - DNA, 17 bp, Homo sapiens
tgtcctccaagccagcg

SEQ ID NO: 3563468 - DNA, 15 bp, Homo sapiens
tgtcctccaccatgc

SEQ ID NO: 3563469 - DNA, 19 bp, Homo sapiens
tgtcctctctggctgggga

SEQ ID NO: 3563470 - DNA, 14 bp, Homo sapiens
tgtcctctgcctgg

SEQ ID NO: 3563471 - DNA, 14 bp, Homo sapiens
tgtcctcttctgct

SEQ ID NO: 3563472 - DNA, 22 bp, Homo sapiens
tgtcctcttctgctcttttcct

SEQ ID NO: 3563473 - DNA, 14 bp, Homo sapiens
tgtcctcttggcca

SEQ ID NO: 3563474 - DNA, 15 bp, Homo sapiens
tgtcctgatgctttt

SEQ ID NO: 3563475 - DNA, 15 bp, Homo sapiens
tgtcctgatttctac

SEQ ID NO: 3563476 - DNA, 18 bp, Homo sapiens
tgtcctgccacccagccc

SEQ ID NO: 3563477 - DNA, 24 bp, Homo sapiens
tgtcctgccacccagccccagcca

SEQ ID NO: 3563478 - DNA, 14 bp, Homo sapiens
ttaaagaatgttag

SEQ ID NO: 3563479 - DNA, 18 bp, Homo sapiens
ttaaagacaggagacaaa

SEQ ID NO: 3563480 - DNA, 23 bp, Homo sapiens
ttaaagaggaatggccctcattc

SEQ ID NO: 3563481 - DNA, 22 bp, Homo sapiens
ttaaagctgagagaccctggcc

SEQ ID NO: 3563482 - DNA, 16 bp, Homo sapiens
ttaaaggtttttgaaa

SEQ ID NO: 3563483 - DNA, 19 bp, Homo sapiens
ttaaaggtttttgaaatcc

SEQ ID NO: 3563484 - DNA, 14 bp, Homo sapiens
ttaaagttcaaact

SEQ ID NO: 3563485 - DNA, 12 bp, Homo sapiens
ttaaagttctag

SEQ ID NO: 3563486 - DNA, 16 bp, Homo sapiens
ttaaataaaagcacaa

SEQ ID NO: 3563487 - DNA, 13 bp, Homo sapiens
ttaaataaatcat

SEQ ID NO: 3563488 - DNA, 19 bp, Homo sapiens
ttaaatatagatgtaattt

SEQ ID NO: 3563489 - DNA, 20 bp, Homo sapiens
ttaaatgcaaccatttgaaa

SEQ ID NO: 3563490 - DNA, 16 bp, Homo sapiens
ttaaatgtattttaca

SEQ ID NO: 3563491 - DNA, 18 bp, Homo sapiens
ttaaatgtattttacata

SEQ ID NO: 3563492 - DNA, 17 bp, Homo sapiens
ttaaatgtgtacaatgt

SEQ ID NO: 3563493 - DNA, 23 bp, Homo sapiens
ttaaatgttctaacagatcagaa

SEQ ID NO: 3563494 - DNA, 14 bp, Homo sapiens
ttaaattatatgat

SEQ ID NO: 3563495 - DNA, 15 bp, Homo sapiens
ttaaattatatgata

SEQ ID NO: 3563496 - DNA, 15 bp, Homo sapiens
ttaaccttttcaaat

SEQ ID NO: 3563497 - DNA, 19 bp, Homo sapiens
ttaaccttttcaaattaat

SEQ ID NO: 3563498 - DNA, 14 bp, Homo sapiens
ttaacgatgtccaa

SEQ ID NO: 3563499 - DNA, 18 bp, Homo sapiens
ttaacgatgtccaacccg

SEQ ID NO: 3563500 - DNA, 13 bp, Homo sapiens
ttaacggtgctaa

SEQ ID NO: 3563501 - DNA, 14 bp, Homo sapiens
ttaacggtgctaaa

SEQ ID NO: 3563502 - DNA, 15 bp, Homo sapiens
ttaactaaagaagag

SEQ ID NO: 3563503 - DNA, 21 bp, Homo sapiens
ttaactatgacagatatattt

SEQ ID NO: 3563504 - DNA, 21 bp, Homo sapiens
ttaactattgcatttatatgt

SEQ ID NO: 3563505 - DNA, 12 bp, Homo sapiens
ttaactatttca

SEQ ID NO: 3563506 - DNA, 14 bp, Homo sapiens
ttaactatttcaca

SEQ ID NO: 3563507 - DNA, 13 bp, Homo sapiens
ttaactgacatgg

SEQ ID NO: 3563508 - DNA, 15 bp, Homo sapiens
ttaacttctgtttta

SEQ ID NO: 3563509 - DNA, 22 bp, Homo sapiens
ttaactttttttcttctacttt

SEQ ID NO: 3563510 - DNA, 12 bp, Homo sapiens
ttaagaaacctt

SEQ ID NO: 3563511 - DNA, 22 bp, Homo sapiens
ttaagaaatagacagcatgaga

SEQ ID NO: 3563512 - DNA, 16 bp, Homo sapiens
ttaagaactaaaatgt

SEQ ID NO: 3563513 - DNA, 19 bp, Homo sapiens
ttaagaactaaaatgttct

SEQ ID NO: 3563514 - DNA, 20 bp, Homo sapiens
ttaagaactaaaatgttcta

SEQ ID NO: 3563515 - DNA, 20 bp, Homo sapiens
ttaagacactgaaaaatcta

SEQ ID NO: 3563516 - DNA, 15 bp, Homo sapiens
ttaagacataaacaa

SEQ ID NO: 3563517 - DNA, 21 bp, Homo sapiens
ttaagacataaacaaagacat

SEQ ID NO: 3563518 - DNA, 14 bp, Homo sapiens
ttaagacctggcag

SEQ ID NO: 3563519 - DNA, 22 bp, Homo sapiens
ttaagagtggcatataattttc

SEQ ID NO: 3563520 - DNA, 17 bp, Homo sapiens
ttaagatgtacatttaa

SEQ ID NO: 3563521 - DNA, 21 bp, Homo sapiens
ttaagcaaattttgtattatt

SEQ ID NO: 3563522 - DNA, 19 bp, Homo sapiens
ttaagcaacaatggatatt

SEQ ID NO: 3563523 - DNA, 22 bp, Homo sapiens
ttaagcagctaaattttctgaa

SEQ ID NO: 3563524 - DNA, 16 bp, Homo sapiens
ttaagccaaagaaaca

SEQ ID NO: 3563525 - DNA, 21 bp, Homo sapiens
ttaagccttataaaccaatct

SEQ ID NO: 3563526 - DNA, 20 bp, Homo sapiens
ttaaggtatatttagttgca

SEQ ID NO: 3563527 - DNA, 19 bp, Homo sapiens
ttaaggtctaatcagtgat

SEQ ID NO: 3563528 - DNA, 14 bp, Homo sapiens
ttaagtatatcatg

SEQ ID NO: 3563529 - DNA, 23 bp, Homo sapiens
ttaagtctcagactgatttcttg

SEQ ID NO: 3563530 - DNA, 17 bp, Homo sapiens
ttaagtgaaaatatagc

SEQ ID NO: 3563531 - DNA, 14 bp, Homo sapiens
ttaataaactactc

SEQ ID NO: 3563532 - DNA, 13 bp, Homo sapiens
ttaataaagacag

SEQ ID NO: 3563533 - DNA, 14 bp, Homo sapiens
ttaataaagacagg

SEQ ID NO: 3563534 - DNA, 20 bp, Homo sapiens
ttaataatctcacatataca

SEQ ID NO: 3563535 - DNA, 19 bp, Homo sapiens
ttaatagcaacagagcact

SEQ ID NO: 3563536 - DNA, 13 bp, Homo sapiens
ttaatatgaaatt

SEQ ID NO: 3563537 - DNA, 18 bp, Homo sapiens
ttaatatttaccaaagta

SEQ ID NO: 3563538 - DNA, 15 bp, Homo sapiens
ttaatatttctaaaa

SEQ ID NO: 3563539 - DNA, 12 bp, Homo sapiens
ttaatatttctt

SEQ ID NO: 3563540 - DNA, 15 bp, Homo sapiens
ttaatattttatgtg

SEQ ID NO: 3563541 - DNA, 18 bp, Homo sapiens
ttaatattttatgtgtaa

SEQ ID NO: 3563542 - DNA, 19 bp, Homo sapiens
ttaatcaagagaaacttca

SEQ ID NO: 3563543 - DNA, 21 bp, Homo sapiens
ttaatcacaaatttcacttat

SEQ ID NO: 3563544 - DNA, 13 bp, Homo sapiens
ttaatcatatttg

SEQ ID NO: 3563545 - DNA, 17 bp, Homo sapiens
ttaatccatttcaggac

SEQ ID NO: 3563546 - DNA, 13 bp, Homo sapiens
ttaatcctgtacc

SEQ ID NO: 3563547 - DNA, 17 bp, Homo sapiens
ttaatctctaacagtgg

SEQ ID NO: 3563548 - DNA, 15 bp, Homo sapiens
ttaatctgatgtata

SEQ ID NO: 3563549 - DNA, 21 bp, Homo sapiens
ttaatctgatgtataatgtaa

SEQ ID NO: 3563550 - DNA, 13 bp, Homo sapiens
ttaatcttaatgt

SEQ ID NO: 3563551 - DNA, 22 bp, Homo sapiens
ttaatgaaaaaagcataggaat

SEQ ID NO: 3563552 - DNA, 16 bp, Homo sapiens
ttaatgacaacactta

SEQ ID NO: 3563553 - DNA, 11 bp, Homo sapiens
ttaatgtagta

SEQ ID NO: 3563554 - DNA, 13 bp, Homo sapiens
ttaatgtatgtta

SEQ ID NO: 3563555 - DNA, 15 bp, Homo sapiens
ttaatgtatgttacc

SEQ ID NO: 3563556 - DNA, 17 bp, Homo sapiens
ttaatgtatgttaccaa

SEQ ID NO: 3563557 - DNA, 21 bp, Homo sapiens
ttaatgtctggtgtttgtcat

SEQ ID NO: 3563558 - DNA, 12 bp, Homo sapiens
ttaattaaagaa

SEQ ID NO: 3563559 - DNA, 15 bp, Homo sapiens
ttaattacaaacaat

SEQ ID NO: 3563560 - DNA, 19 bp, Homo sapiens
ttaattacaaacaataaga

SEQ ID NO: 3563561 - DNA, 14 bp, Homo sapiens
ttaattactggaat

SEQ ID NO: 3563562 - DNA, 15 bp, Homo sapiens
ttaattatgcagtgt

SEQ ID NO: 3563563 - DNA, 13 bp, Homo sapiens
ttaattgctttga

SEQ ID NO: 3563564 - DNA, 13 bp, Homo sapiens
ttaattggccatg

SEQ ID NO: 3563565 - DNA, 16 bp, Homo sapiens
ttaatttaaatagcat

SEQ ID NO: 3563566 - DNA, 16 bp, Homo sapiens
ttaatttgtaaaactt

SEQ ID NO: 3563567 - DNA, 20 bp, Homo sapiens
ttaattttgaagtgctgttt

SEQ ID NO: 3563568 - DNA, 13 bp, Homo sapiens
ttaattttgctaa

SEQ ID NO: 3563569 - DNA, 13 bp, Homo sapiens
ttaatttttccaa

SEQ ID NO: 3563570 - DNA, 15 bp, Homo sapiens
ttaatttttccaact

SEQ ID NO: 3563571 - DNA, 13 bp, Homo sapiens
ttaatttttcctt

SEQ ID NO: 3563572 - DNA, 13 bp, Homo sapiens
ttacaaaacctat

SEQ ID NO: 3563573 - DNA, 15 bp, Homo sapiens
ttacaaaacctattt

SEQ ID NO: 3563574 - DNA, 23 bp, Homo sapiens
ttacaataaaatcttgaaaatgc

SEQ ID NO: 3563575 - DNA, 23 bp, Homo sapiens
ttacacaaagaacttgctgctgc

SEQ ID NO: 3563576 - DNA, 19 bp, Homo sapiens
ttacacttataaaataact

SEQ ID NO: 3563577 - DNA, 16 bp, Homo sapiens
ttacagaaactgatgc

SEQ ID NO: 3563578 - DNA, 18 bp, Homo sapiens
ttacagaaactgatgcca

SEQ ID NO: 3563579 - DNA, 20 bp, Homo sapiens
ttacagacctcagttttatg

SEQ ID NO: 3563580 - DNA, 14 bp, Homo sapiens
ttacagctgcctgc

SEQ ID NO: 3563581 - DNA, 14 bp, Homo sapiens
ttacagctgtgctc

SEQ ID NO: 3563582 - DNA, 12 bp, Homo sapiens
ttacaggagcca

SEQ ID NO: 3563583 - DNA, 17 bp, Homo sapiens
ttacaggagccagcctg

SEQ ID NO: 3563584 - DNA, 11 bp, Homo sapiens
ttacagttctg

SEQ ID NO: 3563585 - DNA, 12 bp, Homo sapiens
ttacatatctga

SEQ ID NO: 3563586 - DNA, 16 bp, Homo sapiens
ttacatgctgtatatg

SEQ ID NO: 3563587 - DNA, 11 bp, Homo sapiens
ttacatttcac

SEQ ID NO: 3563588 - DNA, 21 bp, Homo sapiens
ttaccaaaaataaatatatct

SEQ ID NO: 3563589 - DNA, 20 bp, Homo sapiens
ttaccaaagagatattgata

SEQ ID NO: 3563590 - DNA, 20 bp, Homo sapiens
ttaccaaagcatcaatacaa

SEQ ID NO: 3563591 - DNA, 18 bp, Homo sapiens
ttaccacagcaactgacc

SEQ ID NO: 3563592 - DNA, 19 bp, Homo sapiens
ttaccagcttaaaacactt

SEQ ID NO: 3563593 - DNA, 21 bp, Homo sapiens
ttaccagggtctttgcagatg

SEQ ID NO: 3563594 - DNA, 21 bp, Homo sapiens
ttaccagtatttaacttctga

SEQ ID NO: 3563595 - DNA, 24 bp, Homo sapiens
ttaccagtggcgttgttgcatgtt

SEQ ID NO: 3563596 - DNA, 21 bp, Homo sapiens
ttaccattttaacgctgccta

SEQ ID NO: 3563597 - DNA, 14 bp, Homo sapiens
ttacccagactggt

SEQ ID NO: 3563598 - DNA, 22 bp, Homo sapiens
ttacccagcatgactttcctta

SEQ ID NO: 3563599 - DNA, 16 bp, Homo sapiens
ttaccctacagacagc

SEQ ID NO: 3563600 - DNA, 16 bp, Homo sapiens
ttaccctcctctgctg

SEQ ID NO: 3563601 - DNA, 23 bp, Homo sapiens
ttaccctgtacatatgtaaacat

SEQ ID NO: 3563602 - DNA, 22 bp, Homo sapiens
ttaccgtcacactcttcagtga

SEQ ID NO: 3563603 - DNA, 17 bp, Homo sapiens
ttacctactattggccc

SEQ ID NO: 3563604 - DNA, 21 bp, Homo sapiens
ttacctagctaattatttaat

SEQ ID NO: 3563605 - DNA, 13 bp, Homo sapiens
ttacctattctga

SEQ ID NO: 3563606 - DNA, 15 bp, Homo sapiens
ttacctattctgaaa

SEQ ID NO: 3563607 - DNA, 21 bp, Homo sapiens
ttacctattctgaaaaagaca

SEQ ID NO: 3563608 - DNA, 18 bp, Homo sapiens
ttaccttctttctaatac

SEQ ID NO: 3563609 - DNA, 22 bp, Homo sapiens
ttacgtgaagaaataaatgaaa

SEQ ID NO: 3563610 - DNA, 21 bp, Homo sapiens
ttacgtgtaaaggaaaataat

SEQ ID NO: 3563611 - DNA, 22 bp, Homo sapiens
ttctaacagatcagaacatgaa

SEQ ID NO: 3563612 - DNA, 19 bp, Homo sapiens
ttctaagtaaaaccacagc

SEQ ID NO: 3563613 - DNA, 24 bp, Homo sapiens
ttctaagtaaaaccacagcagttg

SEQ ID NO: 3563614 - DNA, 19 bp, Homo sapiens
ttctaatccttttccttat

SEQ ID NO: 3563615 - DNA, 16 bp, Homo sapiens
ttctaatgctgatatg

SEQ ID NO: 3563616 - DNA, 23 bp, Homo sapiens
ttctaatgtgtgaatcagagcac

SEQ ID NO: 3563617 - DNA, 22 bp, Homo sapiens
ttctaatgttattttccttctg

SEQ ID NO: 3563618 - DNA, 18 bp, Homo sapiens
ttctacaactttaaaact

SEQ ID NO: 3563619 - DNA, 15 bp, Homo sapiens
ttctaccaagctgtc

SEQ ID NO: 3563620 - DNA, 14 bp, Homo sapiens
ttctaccatttcag

SEQ ID NO: 3563621 - DNA, 21 bp, Homo sapiens
ttctaccgtggatttgtactt

SEQ ID NO: 3563622 - DNA, 15 bp, Homo sapiens
ttctactaagttatt

SEQ ID NO: 3563623 - DNA, 13 bp, Homo sapiens
ttctactcccctt

SEQ ID NO: 3563624 - DNA, 20 bp, Homo sapiens
ttctactgctctcctccacc

SEQ ID NO: 3563625 - DNA, 14 bp, Homo sapiens
ttctagctctcaca

SEQ ID NO: 3563626 - DNA, 14 bp, Homo sapiens
ttctaggcctttcc

SEQ ID NO: 3563627 - DNA, 18 bp, Homo sapiens
ttctaggcctttcctctg

SEQ ID NO: 3563628 - DNA, 21 bp, Homo sapiens
ttctaggcctttcctctgcac

SEQ ID NO: 3563629 - DNA, 12 bp, Homo sapiens
ttctagttcaat

SEQ ID NO: 3563630 - DNA, 17 bp, Homo sapiens
ttctatattcctccagc

SEQ ID NO: 3563631 - DNA, 19 bp, Homo sapiens
ttctatctcatctgtctcg

SEQ ID NO: 3563632 - DNA, 15 bp, Homo sapiens
ttctattctccagac

SEQ ID NO: 3563633 - DNA, 16 bp, Homo sapiens
ttctattctccagaca

SEQ ID NO: 3563634 - DNA, 17 bp, Homo sapiens
ttctattctccagacat

SEQ ID NO: 3563635 - DNA, 14 bp, Homo sapiens
ttctatttcttgaa

SEQ ID NO: 3563636 - DNA, 12 bp, Homo sapiens
ttctcaaagttt

SEQ ID NO: 3563637 - DNA, 13 bp, Homo sapiens
ttctcaaagtttt

SEQ ID NO: 3563638 - DNA, 23 bp, Homo sapiens
ttctcaagctggtggcctctgca

SEQ ID NO: 3563639 - DNA, 14 bp, Homo sapiens
ttctcactgaactc

SEQ ID NO: 3563640 - DNA, 16 bp, Homo sapiens
ttctcagatttctgag

SEQ ID NO: 3563641 - DNA, 23 bp, Homo sapiens
ttctcagggctggagcctggggt

SEQ ID NO: 3563642 - DNA, 17 bp, Homo sapiens
ttctccagtcattatgt

SEQ ID NO: 3563643 - DNA, 19 bp, Homo sapiens
ttctccagtcattatgtta

SEQ ID NO: 3563644 - DNA, 13 bp, Homo sapiens
ttctccatggagc

SEQ ID NO: 3563645 - DNA, 22 bp, Homo sapiens
ttctccatggagcctacctctg

SEQ ID NO: 3563646 - DNA, 21 bp, Homo sapiens
ttctcccagctctagcctctg

SEQ ID NO: 3563647 - DNA, 14 bp, Homo sapiens
ttctcccagtgtga

SEQ ID NO: 3563648 - DNA, 18 bp, Homo sapiens
ttctccctttctctctcc

SEQ ID NO: 3563649 - DNA, 21 bp, Homo sapiens
ttctcctgatgttttgccgtg

SEQ ID NO: 3563650 - DNA, 18 bp, Homo sapiens
ttctcctttcacaacctt

SEQ ID NO: 3563651 - DNA, 12 bp, Homo sapiens
ttctcctttgta

SEQ ID NO: 3563652 - DNA, 18 bp, Homo sapiens
ttctccttttcctatcct

SEQ ID NO: 3563653 - DNA, 23 bp, Homo sapiens
ttctctagtcatttgttaatatt

SEQ ID NO: 3563654 - DNA, 15 bp, Homo sapiens
ttctctcccatcctg

SEQ ID NO: 3563655 - DNA, 10 bp, Homo sapiens
ttctctctcc

SEQ ID NO: 3563656 - DNA, 18 bp, Homo sapiens
ttctctctccagggtgct

SEQ ID NO: 3563657 - DNA, 13 bp, Homo sapiens
ttctctgaggaca

SEQ ID NO: 3563658 - DNA, 11 bp, Homo sapiens
ttctctgcagt

SEQ ID NO: 3563659 - DNA, 14 bp, Homo sapiens
ttctctgcagtaaa

SEQ ID NO: 3563660 - DNA, 16 bp, Homo sapiens
ttctctgggtctgatt

SEQ ID NO: 3563661 - DNA, 19 bp, Homo sapiens
ttctctgttggtctgcctt

SEQ ID NO: 3563662 - DNA, 15 bp, Homo sapiens
ttctcttaagtggtc

SEQ ID NO: 3563663 - DNA, 21 bp, Homo sapiens
ttctcttccccttagaaacac

SEQ ID NO: 3563664 - DNA, 17 bp, Homo sapiens
ttctcttccccttcctg

SEQ ID NO: 3563665 - DNA, 22 bp, Homo sapiens
ttctcttccccttcctgtttca

SEQ ID NO: 3563666 - DNA, 13 bp, Homo sapiens
ttctcttctaaca

SEQ ID NO: 3563667 - DNA, 15 bp, Homo sapiens
ttctcttgaataaag

SEQ ID NO: 3563668 - DNA, 21 bp, Homo sapiens
ttctctttcttattttgtaat

SEQ ID NO: 3563669 - DNA, 23 bp, Homo sapiens
ttctctttcttattttgtaataa

SEQ ID NO: 3563670 - DNA, 16 bp, Homo sapiens
ttctcttttctttctg

SEQ ID NO: 3563671 - DNA, 18 bp, Homo sapiens
ttctctttttgatcttgt

SEQ ID NO: 3563672 - DNA, 15 bp, Homo sapiens
ttctgaaaaagacat

SEQ ID NO: 3563673 - DNA, 17 bp, Homo sapiens
ttctgaaaaagacataa

SEQ ID NO: 3563674 - DNA, 17 bp, Homo sapiens
ttctgaagctgctgcag

SEQ ID NO: 3563675 - DNA, 20 bp, Homo sapiens
ttctgaagctgctgcagctc

SEQ ID NO: 3563676 - DNA, 14 bp, Homo sapiens
ttctgaataaagca

SEQ ID NO: 3563677 - DNA, 15 bp, Homo sapiens
ttctgagaaagacta

SEQ ID NO: 3563678 - DNA, 18 bp, Homo sapiens
ttctgataaaagatggcc

SEQ ID NO: 3563679 - DNA, 19 bp, Homo sapiens
ttctgattctgattgctat

SEQ ID NO: 3563680 - DNA, 19 bp, Homo sapiens
ttctgattgctatcagcaa

SEQ ID NO: 3563681 - DNA, 15 bp, Homo sapiens
ttctgcctagagtgt

SEQ ID NO: 3563682 - DNA, 22 bp, Homo sapiens
ttctgcctagagtgtagcctaa

SEQ ID NO: 3563683 - DNA, 16 bp, Homo sapiens
ttctgccttttcactg

SEQ ID NO: 3563684 - DNA, 12 bp, Homo sapiens
ttctgctcagct

SEQ ID NO: 3563685 - DNA, 20 bp, Homo sapiens
ttctgctccataccttttct

SEQ ID NO: 3563686 - DNA, 13 bp, Homo sapiens
ttctgctcctgct

SEQ ID NO: 3563687 - DNA, 18 bp, Homo sapiens
ttctgctcctgcttttct

SEQ ID NO: 3563688 - DNA, 20 bp, Homo sapiens
ttctgctcctgcttttctgt

SEQ ID NO: 3563689 - DNA, 15 bp, Homo sapiens
ttctgctcttttcct

SEQ ID NO: 3563690 - DNA, 23 bp, Homo sapiens
ttctggagatggaagcttgttga

SEQ ID NO: 3563691 - DNA, 14 bp, Homo sapiens
ttctggaggggcag

SEQ ID NO: 3563692 - DNA, 17 bp, Homo sapiens
ttctggccacatcagcc

SEQ ID NO: 3563693 - DNA, 17 bp, Homo sapiens
ttctggcgcccctgcct

SEQ ID NO: 3563694 - DNA, 13 bp, Homo sapiens
ttctgggaaggga

SEQ ID NO: 3563695 - DNA, 19 bp, Homo sapiens
ttctggggggagaaaaaaa

SEQ ID NO: 3563696 - DNA, 16 bp, Homo sapiens
ttctggttccctgctg

SEQ ID NO: 3563697 - DNA, 23 bp, Homo sapiens
ttctgtaattatatctaaaatat

SEQ ID NO: 3563698 - DNA, 17 bp, Homo sapiens
ttctgtaccaaagtgtt

SEQ ID NO: 3563699 - DNA, 16 bp, Homo sapiens
ttctgtggctcacaga

SEQ ID NO: 3563700 - DNA, 17 bp, Homo sapiens
ttctgttttcccccagc

SEQ ID NO: 3563701 - DNA, 18 bp, Homo sapiens
ttctgttttcccccagca

SEQ ID NO: 3563702 - DNA, 14 bp, Homo sapiens
ttcttacaaaccat

SEQ ID NO: 3563703 - DNA, 12 bp, Homo sapiens
ttcttaccagtc

SEQ ID NO: 3563704 - DNA, 15 bp, Homo sapiens
ttcttacctgtatgt

SEQ ID NO: 3563705 - DNA, 18 bp, Homo sapiens
ttcttactaaaaagtata

SEQ ID NO: 3563706 - DNA, 17 bp, Homo sapiens
ttcttatttaccctttt

SEQ ID NO: 3563707 - DNA, 15 bp, Homo sapiens
ttcttattttgtaat

SEQ ID NO: 3563708 - DNA, 16 bp, Homo sapiens
ttcttattttgtaata

SEQ ID NO: 3563709 - DNA, 17 bp, Homo sapiens
ttcttattttgtaataa

SEQ ID NO: 3563710 - DNA, 18 bp, Homo sapiens
ttcttcacacagacacta

SEQ ID NO: 3563711 - DNA, 22 bp, Homo sapiens
ttcttcagcgtaaaatggtgaa

SEQ ID NO: 3563712 - DNA, 11 bp, Homo sapiens
ttcttcctctg

SEQ ID NO: 3563713 - DNA, 13 bp, Homo sapiens
ttcttcctctgct

SEQ ID NO: 3563714 - DNA, 23 bp, Homo sapiens
ttcttcgctggactattgtgcca

SEQ ID NO: 3563715 - DNA, 20 bp, Homo sapiens
ttcttctgcaacatttgaca

SEQ ID NO: 3563716 - DNA, 19 bp, Homo sapiens
ttcttcttaaaagtttcta

SEQ ID NO: 3563717 - DNA, 15 bp, Homo sapiens
ttcttctttctttct

SEQ ID NO: 3563718 - DNA, 21 bp, Homo sapiens
ttcttctttttgcttcaaaaa

SEQ ID NO: 3563719 - DNA, 23 bp, Homo sapiens
ttcttgcataggctcttaagcag

SEQ ID NO: 3563720 - DNA, 11 bp, Homo sapiens
ttcttgctgct

SEQ ID NO: 3563721 - DNA, 17 bp, Homo sapiens
ttcttgcttggaagcca

SEQ ID NO: 3563722 - DNA, 22 bp, Homo sapiens
ttcttgggatagtgttctgctc

SEQ ID NO: 3563723 - DNA, 22 bp, Homo sapiens
ttcttgggcctcaggctctgca

SEQ ID NO: 3563724 - DNA, 15 bp, Homo sapiens
ttctttactgcactc

SEQ ID NO: 3563725 - DNA, 18 bp, Homo sapiens
ttctttcacccatcctag

SEQ ID NO: 3563726 - DNA, 21 bp, Homo sapiens
ttctttcctccccctgcaact

SEQ ID NO: 3563727 - DNA, 16 bp, Homo sapiens
ttctttctaatacaag

SEQ ID NO: 3563728 - DNA, 19 bp, Homo sapiens
ttctttctagttcagctgc

SEQ ID NO: 3563729 - DNA, 12 bp, Homo sapiens
ttctttcttcca

SEQ ID NO: 3563730 - DNA, 13 bp, Homo sapiens
ttctttcttttgc

SEQ ID NO: 3563731 - DNA, 19 bp, Homo sapiens
ttctttgaataaatgtcac

SEQ ID NO: 3563732 - DNA, 16 bp, Homo sapiens
ttctttgcaccaaaga

SEQ ID NO: 3563733 - DNA, 21 bp, Homo sapiens
ttctttgcaccaaagacatca

SEQ ID NO: 3563734 - DNA, 15 bp, Homo sapiens
ttctttgccatctct

SEQ ID NO: 3563735 - DNA, 19 bp, Homo sapiens
ttctttgccatctctgctc

SEQ ID NO: 3563736 - DNA, 21 bp, Homo sapiens
ttctttgccatctctgctcca

SEQ ID NO: 3563737 - DNA, 12 bp, Homo sapiens
ttctttgcctct

SEQ ID NO: 3563738 - DNA, 13 bp, Homo sapiens
ttctttggctgca

SEQ ID NO: 3563739 - DNA, 19 bp, Homo sapiens
ttctttgtgtagctttgct

SEQ ID NO: 3563740 - DNA, 12 bp, Homo sapiens
ttctttgtttct

SEQ ID NO: 3563741 - DNA, 13 bp, Homo sapiens
ttcttttagagag

SEQ ID NO: 3563742 - DNA, 21 bp, Homo sapiens
ttcttttgctgaacaggaaag

SEQ ID NO: 3563743 - DNA, 14 bp, Homo sapiens
ttctttttttgtga

SEQ ID NO: 3563744 - DNA, 18 bp, Homo sapiens
ttgtaagacaaaggtttt

SEQ ID NO: 3563745 - DNA, 20 bp, Homo sapiens
ttgtaagatggataatgtgt

SEQ ID NO: 3563746 - DNA, 14 bp, Homo sapiens
ttgtaatattttta

SEQ ID NO: 3563747 - DNA, 23 bp, Homo sapiens
ttgtaatctagttgtcaataaat

SEQ ID NO: 3563748 - DNA, 12 bp, Homo sapiens
ttgtaattgctt

SEQ ID NO: 3563749 - DNA, 23 bp, Homo sapiens
ttgtacaaaataaacaaataaca

SEQ ID NO: 3563750 - DNA, 12 bp, Homo sapiens
ttgtacaataaa

SEQ ID NO: 3563751 - DNA, 18 bp, Homo sapiens
ttgtacagattctttatt

SEQ ID NO: 3563752 - DNA, 18 bp, Homo sapiens
ttgtagaaattaaacata

SEQ ID NO: 3563753 - DNA, 18 bp, Homo sapiens
ttgtagccaggtactgca

SEQ ID NO: 3563754 - DNA, 23 bp, Homo sapiens
ttgtaggaagataaaaaaactgt

SEQ ID NO: 3563755 - DNA, 15 bp, Homo sapiens
ttgtataaagaaact

SEQ ID NO: 3563756 - DNA, 16 bp, Homo sapiens
ttgtatagaccaaagc

SEQ ID NO: 3563757 - DNA, 17 bp, Homo sapiens
ttgtatagaccaaagca

SEQ ID NO: 3563758 - DNA, 20 bp, Homo sapiens
ttgtatagcatgaaataaaa

SEQ ID NO: 3563759 - DNA, 18 bp, Homo sapiens
ttgtatagttatatgtac

SEQ ID NO: 3563760 - DNA, 16 bp, Homo sapiens
ttgtatattacaatga

SEQ ID NO: 3563761 - DNA, 14 bp, Homo sapiens
ttgtatattctatt

SEQ ID NO: 3563762 - DNA, 19 bp, Homo sapiens
ttgtatcacaaatcttaac

SEQ ID NO: 3563763 - DNA, 14 bp, Homo sapiens
ttgtatcttaaatt

SEQ ID NO: 3563764 - DNA, 14 bp, Homo sapiens
ttgtatcttttatc

SEQ ID NO: 3563765 - DNA, 23 bp, Homo sapiens
ttgtattgatttttaagaaagta

SEQ ID NO: 3563766 - DNA, 19 bp, Homo sapiens
ttgtattgtatattacaat

SEQ ID NO: 3563767 - DNA, 14 bp, Homo sapiens
ttgtatttaagaca

SEQ ID NO: 3563768 - DNA, 23 bp, Homo sapiens
ttgtcaccagttaaaagcatttt

SEQ ID NO: 3563769 - DNA, 18 bp, Homo sapiens
ttgtcacgatcacaggcc

SEQ ID NO: 3563770 - DNA, 14 bp, Homo sapiens
ttgtcactttttct

SEQ ID NO: 3563771 - DNA, 16 bp, Homo sapiens
ttgtcactttttctga

SEQ ID NO: 3563772 - DNA, 17 bp, Homo sapiens
ttgtcacttttttataa

SEQ ID NO: 3563773 - DNA, 15 bp, Homo sapiens
ttgtcaggtgggaga

SEQ ID NO: 3563774 - DNA, 13 bp, Homo sapiens
ttgtcatggtgaa

SEQ ID NO: 3563775 - DNA, 15 bp, Homo sapiens
ttgtcatggtgaaat

SEQ ID NO: 3563776 - DNA, 21 bp, Homo sapiens
ttgtcatgttatgcagtgaac

SEQ ID NO: 3563777 - DNA, 19 bp, Homo sapiens
ttgtcattttttttctttg

SEQ ID NO: 3563778 - DNA, 15 bp, Homo sapiens
ttgtccctctgcccc

SEQ ID NO: 3563779 - DNA, 17 bp, Homo sapiens
ttgtccctctgccccat

SEQ ID NO: 3563780 - DNA, 18 bp, Homo sapiens
ttgtccctgaagagaagg

SEQ ID NO: 3563781 - DNA, 23 bp, Homo sapiens
ttgtcctgatgcttttgtctaat

SEQ ID NO: 3563782 - DNA, 20 bp, Homo sapiens
ttgtctcaacgcctccccct

SEQ ID NO: 3563783 - DNA, 15 bp, Homo sapiens
ttgtctccaaagaag

SEQ ID NO: 3563784 - DNA, 18 bp, Homo sapiens
ttgtctccaaagaagata

SEQ ID NO: 3563785 - DNA, 12 bp, Homo sapiens
ttgtctgcagct

SEQ ID NO: 3563786 - DNA, 16 bp, Homo sapiens
ttgtcttaaaaattta

SEQ ID NO: 3563787 - DNA, 23 bp, Homo sapiens
ttgtcttaaaaatttatacacca

SEQ ID NO: 3563788 - DNA, 21 bp, Homo sapiens
ttgtcttttaatccatttcag

SEQ ID NO: 3563789 - DNA, 18 bp, Homo sapiens
ttgtgaattaggctgtaa

SEQ ID NO: 3563790 - DNA, 9 bp, Homo sapiens
ttgtgagaa

SEQ ID NO: 3563791 - DNA, 18 bp, Homo sapiens
ttgtgatgtcccaacttg

SEQ ID NO: 3563792 - DNA, 13 bp, Homo sapiens
ttgtgattggctg

SEQ ID NO: 3563793 - DNA, 11 bp, Homo sapiens
ttgtgcagaga

SEQ ID NO: 3563794 - DNA, 22 bp, Homo sapiens
ttgtgcatgctagtgttgtatt

SEQ ID NO: 3563795 - DNA, 14 bp, Homo sapiens
ttgtgcctttggcc

SEQ ID NO: 3563796 - DNA, 18 bp, Homo sapiens
ttgtgctttttgtcatgt

SEQ ID NO: 3563797 - DNA, 20 bp, Homo sapiens
ttgtggggcctcaggctccg

SEQ ID NO: 3563798 - DNA, 14 bp, Homo sapiens
ttgtgtaagaaata

SEQ ID NO: 3563799 - DNA, 18 bp, Homo sapiens
ttgtgtaagaaatacaga

SEQ ID NO: 3563800 - DNA, 17 bp, Homo sapiens
ttgtgtattaaatggtt

SEQ ID NO: 3563801 - DNA, 19 bp, Homo sapiens
ttgtgtggtctggttcctg

SEQ ID NO: 3563802 - DNA, 16 bp, Homo sapiens
ttgtgtgtatatgtat

SEQ ID NO: 3563803 - DNA, 13 bp, Homo sapiens
ttgtgtgtgggag

SEQ ID NO: 3563804 - DNA, 16 bp, Homo sapiens
ttgtgtgtgggagtgt

SEQ ID NO: 3563805 - DNA, 17 bp, Homo sapiens
ttgtgttgcactgaaca

SEQ ID NO: 3563806 - DNA, 16 bp, Homo sapiens
ttgtgtttgattggct

SEQ ID NO: 3563807 - DNA, 16 bp, Homo sapiens
ttgtgtttggttcaat

SEQ ID NO: 3563808 - DNA, 13 bp, Homo sapiens
ttgttaatgcttt

SEQ ID NO: 3563809 - DNA, 15 bp, Homo sapiens
ttgttactgtatcct

SEQ ID NO: 3563810 - DNA, 20 bp, Homo sapiens
ttgttacttctctaattctt

SEQ ID NO: 3563811 - DNA, 14 bp, Homo sapiens
ttgttataaataaa

SEQ ID NO: 3563812 - DNA, 16 bp, Homo sapiens
ttgttatacttcaaaa

SEQ ID NO: 3563813 - DNA, 15 bp, Homo sapiens
ttgttattaaacaaa

SEQ ID NO: 3563814 - DNA, 14 bp, Homo sapiens
ttgttatttattga

SEQ ID NO: 3563815 - DNA, 14 bp, Homo sapiens
ttgttcctgaaatg

SEQ ID NO: 3563816 - DNA, 16 bp, Homo sapiens
ttgttctgcctggaga

SEQ ID NO: 3563817 - DNA, 16 bp, Homo sapiens
ttgttctttgtttcca

SEQ ID NO: 3563818 - DNA, 13 bp, Homo sapiens
ttgttggaatgaa

SEQ ID NO: 3563819 - DNA, 20 bp, Homo sapiens
ttgttggtttttaaagattt

SEQ ID NO: 3563820 - DNA, 12 bp, Homo sapiens
ttgtttaatggt

SEQ ID NO: 3563821 - DNA, 23 bp, Homo sapiens
ttgtttagtctttatactgcaaa

SEQ ID NO: 3563822 - DNA, 9 bp, Homo sapiens
ttgtttata

SEQ ID NO: 3563823 - DNA, 22 bp, Homo sapiens
ttgtttatatggataatctgag

SEQ ID NO: 3563824 - DNA, 23 bp, Homo sapiens
ttgtttattgaattcatttcact

SEQ ID NO: 3563825 - DNA, 20 bp, Homo sapiens
ttgtttctttctctgaggac

SEQ ID NO: 3563826 - DNA, 14 bp, Homo sapiens
ttgtttgttttaga

SEQ ID NO: 3563827 - DNA, 16 bp, Homo sapiens
ttgttttgtgcagaga

SEQ ID NO: 3563828 - DNA, 22 bp, Homo sapiens
ttgtttttatatattataagtt

SEQ ID NO: 3563829 - DNA, 15 bp, Homo sapiens
tttaaaaaaaagaaa

SEQ ID NO: 3563830 - DNA, 20 bp, Homo sapiens
tttaaaaaatgaaatccttt

SEQ ID NO: 3563831 - DNA, 18 bp, Homo sapiens
tttaaaaaggtaaatggt

SEQ ID NO: 3563832 - DNA, 16 bp, Homo sapiens
tttaaaaagtgtttaa

SEQ ID NO: 3563833 - DNA, 20 bp, Homo sapiens
tttaaaaagtgtttaaatgt

SEQ ID NO: 3563834 - DNA, 15 bp, Homo sapiens
tttaaaactgttatt

SEQ ID NO: 3563835 - DNA, 19 bp, Homo sapiens
tttaaaatacacactcaaa

SEQ ID NO: 3563836 - DNA, 21 bp, Homo sapiens
tttaaaatatattgaatattt

SEQ ID NO: 3563837 - DNA, 19 bp, Homo sapiens
tttaaaatgcttgggtaca

SEQ ID NO: 3563838 - DNA, 23 bp, Homo sapiens
tttaaacaatctttcatgtcttg

SEQ ID NO: 3563839 - DNA, 12 bp, Homo sapiens
tttaaagaaagt

SEQ ID NO: 3563840 - DNA, 12 bp, Homo sapiens
tttaaagatttt

SEQ ID NO: 3563841 - DNA, 18 bp, Homo sapiens
tttaaagtggcaatctca

SEQ ID NO: 3563842 - DNA, 15 bp, Homo sapiens
tttaaagttcaaact

SEQ ID NO: 3563843 - DNA, 15 bp, Homo sapiens
tttaaataaaattta

SEQ ID NO: 3563844 - DNA, 22 bp, Homo sapiens
tttaaatagcattatcttatca

SEQ ID NO: 3563845 - DNA, 18 bp, Homo sapiens
tttaaatggttctgtgct

SEQ ID NO: 3563846 - DNA, 14 bp, Homo sapiens
tttaaatgtatact

SEQ ID NO: 3563847 - DNA, 14 bp, Homo sapiens
tttaaatgtgtaca

SEQ ID NO: 3563848 - DNA, 18 bp, Homo sapiens
tttaaatgtgtacaatgt

SEQ ID NO: 3563849 - DNA, 19 bp, Homo sapiens
tttaaattccactgaaaat

SEQ ID NO: 3563850 - DNA, 20 bp, Homo sapiens
tttaaattccactgaaaatt

SEQ ID NO: 3563851 - DNA, 21 bp, Homo sapiens
tttaacaatccattcacaagc

SEQ ID NO: 3563852 - DNA, 14 bp, Homo sapiens
tttaacagtgcaaa

SEQ ID NO: 3563853 - DNA, 14 bp, Homo sapiens
tttaacgctgccta

SEQ ID NO: 3563854 - DNA, 14 bp, Homo sapiens
tttaactgattaaa

SEQ ID NO: 3563855 - DNA, 19 bp, Homo sapiens
tttaactttttttcttcta

SEQ ID NO: 3563856 - DNA, 17 bp, Homo sapiens
tttaagaactaaaatgt

SEQ ID NO: 3563857 - DNA, 20 bp, Homo sapiens
tttaagaatagttctaaaat

SEQ ID NO: 3563858 - DNA, 11 bp, Homo sapiens
tttaagacata

SEQ ID NO: 3563859 - DNA, 17 bp, Homo sapiens
tttaagacataaacaaa

SEQ ID NO: 3563860 - DNA, 15 bp, Homo sapiens
tttaagatgtacatt

SEQ ID NO: 3563861 - DNA, 19 bp, Homo sapiens
tttaagatgtacatttaat

SEQ ID NO: 3563862 - DNA, 13 bp, Homo sapiens
tttaagccgcaga

SEQ ID NO: 3563863 - DNA, 21 bp, Homo sapiens
tttaagccgcagacctggagc

SEQ ID NO: 3563864 - DNA, 15 bp, Homo sapiens
tttaagccttacaaa

SEQ ID NO: 3563865 - DNA, 16 bp, Homo sapiens
tttaagccttacaaag

SEQ ID NO: 3563866 - DNA, 12 bp, Homo sapiens
tttaagccttat

SEQ ID NO: 3563867 - DNA, 23 bp, Homo sapiens
tttaaggatagtgtgaagatctt

SEQ ID NO: 3563868 - DNA, 20 bp, Homo sapiens
tttaagggtttgtggaaaat

SEQ ID NO: 3563869 - DNA, 21 bp, Homo sapiens
tttaagtactacacattttta

SEQ ID NO: 3563870 - DNA, 13 bp, Homo sapiens
tttaagtatttag

SEQ ID NO: 3563871 - DNA, 18 bp, Homo sapiens
tttaagtatttaggtttt

SEQ ID NO: 3563872 - DNA, 14 bp, Homo sapiens
tttaataaactact

SEQ ID NO: 3563873 - DNA, 19 bp, Homo sapiens
tttaataaactactctttg

SEQ ID NO: 3563874 - DNA, 21 bp, Homo sapiens
tttaataaactactctttgat

SEQ ID NO: 3563875 - DNA, 12 bp, Homo sapiens
tttaataaactg

SEQ ID NO: 3563876 - DNA, 22 bp, Homo sapiens
tttaatcctgtaccaaatctga

SEQ ID NO: 3563877 - DNA, 19 bp, Homo sapiens
aactatgacagatatattt

SEQ ID NO: 3563878 - DNA, 23 bp, Homo sapiens
aactatgagcttgctcattaatt

SEQ ID NO: 3563879 - DNA, 16 bp, Homo sapiens
aactatgattattaac

SEQ ID NO: 3563880 - DNA, 23 bp, Homo sapiens
aactatgcatggtgccccaggac

SEQ ID NO: 3563881 - DNA, 13 bp, Homo sapiens
aactattcacaaa

SEQ ID NO: 3563882 - DNA, 13 bp, Homo sapiens
aactatttcacat

SEQ ID NO: 3563883 - DNA, 22 bp, Homo sapiens
aactcaaatggggccagatcca

SEQ ID NO: 3563884 - DNA, 13 bp, Homo sapiens
aactcagatccag

SEQ ID NO: 3563885 - DNA, 14 bp, Homo sapiens
aactcagatccagg

SEQ ID NO: 3563886 - DNA, 14 bp, Homo sapiens
aactcaggcaaaga

SEQ ID NO: 3563887 - DNA, 17 bp, Homo sapiens
aactcaggcaaagaaaa

SEQ ID NO: 3563888 - DNA, 18 bp, Homo sapiens
aactcaggcaaagaaaat

SEQ ID NO: 3563889 - DNA, 21 bp, Homo sapiens
aactcatttttgttttcatta

SEQ ID NO: 3563890 - DNA, 23 bp, Homo sapiens
aactccaccgaccaactgcccta

SEQ ID NO: 3563891 - DNA, 12 bp, Homo sapiens
aactccaggcat

SEQ ID NO: 3563892 - DNA, 15 bp, Homo sapiens
aactccaggggcacc

SEQ ID NO: 3563893 - DNA, 16 bp, Homo sapiens
aactccatgatattta

SEQ ID NO: 3563894 - DNA, 21 bp, Homo sapiens
aactcctataaagtgcctcgg

SEQ ID NO: 3563895 - DNA, 11 bp, Homo sapiens
aactcctgacc

SEQ ID NO: 3563896 - DNA, 18 bp, Homo sapiens
aactcggtgtccccacca

SEQ ID NO: 3563897 - DNA, 14 bp, Homo sapiens
aactctcagaaata

SEQ ID NO: 3563898 - DNA, 21 bp, Homo sapiens
aactctcagaaataaatcaca

SEQ ID NO: 3563899 - DNA, 22 bp, Homo sapiens
aactctcagaaataaatcacag

SEQ ID NO: 3563900 - DNA, 11 bp, Homo sapiens
aactctgctgt

SEQ ID NO: 3563901 - DNA, 18 bp, Homo sapiens
aactctggtgctcctgca

SEQ ID NO: 3563902 - DNA, 23 bp, Homo sapiens
aactctgttacactttttggaag

SEQ ID NO: 3563903 - DNA, 18 bp, Homo sapiens
aactgaaccaaattgcac

SEQ ID NO: 3563904 - DNA, 19 bp, Homo sapiens
aactgaagcataaagaatt

SEQ ID NO: 3563905 - DNA, 18 bp, Homo sapiens
aactgaagttctatttat

SEQ ID NO: 3563906 - DNA, 20 bp, Homo sapiens
aactgacagatgcttttgct

SEQ ID NO: 3563907 - DNA, 21 bp, Homo sapiens
aactgaccctcaggcacacct

SEQ ID NO: 3563908 - DNA, 18 bp, Homo sapiens
aactgactatcataaaat

SEQ ID NO: 3563909 - DNA, 13 bp, Homo sapiens
aactgagagaaag

SEQ ID NO: 3563910 - DNA, 20 bp, Homo sapiens
aactgagctgggcaggaagg

SEQ ID NO: 3563911 - DNA, 16 bp, Homo sapiens
aactgaggaattttct

SEQ ID NO: 3563912 - DNA, 19 bp, Homo sapiens
aactgaggagatgaccagg

SEQ ID NO: 3563913 - DNA, 14 bp, Homo sapiens
aactgaggcccaga

SEQ ID NO: 3563914 - DNA, 17 bp, Homo sapiens
aactgaggcccagagag

SEQ ID NO: 3563915 - DNA, 15 bp, Homo sapiens
aactgattaaaaata

SEQ ID NO: 3563916 - DNA, 16 bp, Homo sapiens
aactgattaaaaatac

SEQ ID NO: 3563917 - DNA, 15 bp, Homo sapiens
aactgcagctctcca

SEQ ID NO: 3563918 - DNA, 18 bp, Homo sapiens
aactgccaaaatgctcta

SEQ ID NO: 3563919 - DNA, 16 bp, Homo sapiens
aactgccaggctgcct

SEQ ID NO: 3563920 - DNA, 18 bp, Homo sapiens
aactgccaggctgcctcc

SEQ ID NO: 3563921 - DNA, 14 bp, Homo sapiens
aactgccctaagcc

SEQ ID NO: 3563922 - DNA, 17 bp, Homo sapiens
aactgccctaagccccc

SEQ ID NO: 3563923 - DNA, 22 bp, Homo sapiens
aactgccctaagcccccagggc

SEQ ID NO: 3563924 - DNA, 19 bp, Homo sapiens
aactgcttcctttcttgat

SEQ ID NO: 3563925 - DNA, 19 bp, Homo sapiens
aactggactggttcaaatg

SEQ ID NO: 3563926 - DNA, 16 bp, Homo sapiens
aactggagttccttat

SEQ ID NO: 3563927 - DNA, 17 bp, Homo sapiens
aactggatatttcaatc

SEQ ID NO: 3563928 - DNA, 22 bp, Homo sapiens
aactggcaggggagacaggagc

SEQ ID NO: 3563929 - DNA, 19 bp, Homo sapiens
aactgggcatatttctaat

SEQ ID NO: 3563930 - DNA, 17 bp, Homo sapiens
aactgggttaaatattt

SEQ ID NO: 3563931 - DNA, 21 bp, Homo sapiens
aactgggttaaatattttgct

SEQ ID NO: 3563932 - DNA, 23 bp, Homo sapiens
aactgggttaaatattttgctaa

SEQ ID NO: 3563933 - DNA, 18 bp, Homo sapiens
aactggtatgaataattg

SEQ ID NO: 3563934 - DNA, 16 bp, Homo sapiens
aactggttgtatattt

SEQ ID NO: 3563935 - DNA, 15 bp, Homo sapiens
aactggtttataata

SEQ ID NO: 3563936 - DNA, 15 bp, Homo sapiens
aactgtaaagatgaa

SEQ ID NO: 3563937 - DNA, 19 bp, Homo sapiens
aactgtaggtatgatctct

SEQ ID NO: 3563938 - DNA, 14 bp, Homo sapiens
aactgtagtaattg

SEQ ID NO: 3563939 - DNA, 18 bp, Homo sapiens
aactgtattttctttcac

SEQ ID NO: 3563940 - DNA, 13 bp, Homo sapiens
aactgtcctgtcc

SEQ ID NO: 3563941 - DNA, 16 bp, Homo sapiens
aactgtcctgtcctgc

SEQ ID NO: 3563942 - DNA, 15 bp, Homo sapiens
aactgttcccacctg

SEQ ID NO: 3563943 - DNA, 18 bp, Homo sapiens
aactgttcccacctgctg

SEQ ID NO: 3563944 - DNA, 13 bp, Homo sapiens
aacttaaacaaaa

SEQ ID NO: 3563945 - DNA, 11 bp, Homo sapiens
aacttaagaat

SEQ ID NO: 3563946 - DNA, 13 bp, Homo sapiens
aacttaagaattg

SEQ ID NO: 3563947 - DNA, 20 bp, Homo sapiens
aacttacatatttattttta

SEQ ID NO: 3563948 - DNA, 20 bp, Homo sapiens
aacttagatcatcagtcacc

SEQ ID NO: 3563949 - DNA, 19 bp, Homo sapiens
aacttagtgtaatatacca

SEQ ID NO: 3563950 - DNA, 22 bp, Homo sapiens
aacttcagcaaccctacagtat

SEQ ID NO: 3563951 - DNA, 16 bp, Homo sapiens
aacttccaaataaata

SEQ ID NO: 3563952 - DNA, 23 bp, Homo sapiens
aacttccaaataaataattttca

SEQ ID NO: 3563953 - DNA, 14 bp, Homo sapiens
aacttccaggaaag

SEQ ID NO: 3563954 - DNA, 22 bp, Homo sapiens
aacttccaggaaagtgtgaaga

SEQ ID NO: 3563955 - DNA, 15 bp, Homo sapiens
aacttccgctgaggg

SEQ ID NO: 3563956 - DNA, 19 bp, Homo sapiens
aacttcctgctgcaccctg

SEQ ID NO: 3563957 - DNA, 18 bp, Homo sapiens
aacttcctgtgcctttcc

SEQ ID NO: 3563958 - DNA, 13 bp, Homo sapiens
aacttcctgtgga

SEQ ID NO: 3563959 - DNA, 17 bp, Homo sapiens
aacttcctgtggatgca

SEQ ID NO: 3563960 - DNA, 22 bp, Homo sapiens
aacttccttggactcattttaa

SEQ ID NO: 3563961 - DNA, 18 bp, Homo sapiens
aacttcttcctgtgaagt

SEQ ID NO: 3563962 - DNA, 15 bp, Homo sapiens
aacttctttgaattt

SEQ ID NO: 3563963 - DNA, 18 bp, Homo sapiens
aacttgccccaagggttt

SEQ ID NO: 3563964 - DNA, 12 bp, Homo sapiens
aacttgctgcct

SEQ ID NO: 3563965 - DNA, 15 bp, Homo sapiens
aacttgctttcttct

SEQ ID NO: 3563966 - DNA, 19 bp, Homo sapiens
aacttgctttcttctttcc

SEQ ID NO: 3563967 - DNA, 21 bp, Homo sapiens
aacttggggagttaagacctg

SEQ ID NO: 3563968 - DNA, 22 bp, Homo sapiens
aacttggggagttaagacctgg

SEQ ID NO: 3563969 - DNA, 14 bp, Homo sapiens
aacttgtcttttca

SEQ ID NO: 3563970 - DNA, 20 bp, Homo sapiens
aactttaacttctgttttac

SEQ ID NO: 3563971 - DNA, 20 bp, Homo sapiens
aactttcagcagtctaaatt

SEQ ID NO: 3563972 - DNA, 12 bp, Homo sapiens
aactttctccct

SEQ ID NO: 3563973 - DNA, 17 bp, Homo sapiens
aacttttaaaatttgtc

SEQ ID NO: 3563974 - DNA, 12 bp, Homo sapiens
aactttttcctc

SEQ ID NO: 3563975 - DNA, 18 bp, Homo sapiens
aacttttttggtgtgtgt

SEQ ID NO: 3563976 - DNA, 22 bp, Homo sapiens
aactttttttctgtaccagtta

SEQ ID NO: 3563977 - DNA, 13 bp, Homo sapiens
aagaaaatgtctt

SEQ ID NO: 3563978 - DNA, 22 bp, Homo sapiens
aagaaaatttttgtagtagcgt

SEQ ID NO: 3563979 - DNA, 13 bp, Homo sapiens
aagaaacaagctg

SEQ ID NO: 3563980 - DNA, 15 bp, Homo sapiens
aagaaaccttgctct

SEQ ID NO: 3563981 - DNA, 16 bp, Homo sapiens
aagaaactgaggaatt

SEQ ID NO: 3563982 - DNA, 15 bp, Homo sapiens
aagaaactggtccat

SEQ ID NO: 3563983 - DNA, 18 bp, Homo sapiens
aagaaactggtccatgta

SEQ ID NO: 3563984 - DNA, 10 bp, Homo sapiens
aagaaacttt

SEQ ID NO: 3563985 - DNA, 17 bp, Homo sapiens
aagaaagaggaaaagaa

SEQ ID NO: 3563986 - DNA, 22 bp, Homo sapiens
aagaaagcttcaaactgcatga

SEQ ID NO: 3563987 - DNA, 13 bp, Homo sapiens
aagaaataaatga

SEQ ID NO: 3563988 - DNA, 18 bp, Homo sapiens
aagaaatggctatgaaca

SEQ ID NO: 3563989 - DNA, 14 bp, Homo sapiens
aagaacaaacaaaa

SEQ ID NO: 3563990 - DNA, 21 bp, Homo sapiens
aagaacaatattgactttgtc

SEQ ID NO: 3563991 - DNA, 22 bp, Homo sapiens
aagaaccactccttcatgtttg

SEQ ID NO: 3563992 - DNA, 15 bp, Homo sapiens
aagaaccatgcagga

SEQ ID NO: 3563993 - DNA, 21 bp, Homo sapiens
aagaaccatgcaggaaggaaa

SEQ ID NO: 3563994 - DNA, 22 bp, Homo sapiens
aagaaccatgcaggaaggaaaa

SEQ ID NO: 3563995 - DNA, 22 bp, Homo sapiens
aagaacctacagactccatctc

SEQ ID NO: 3563996 - DNA, 19 bp, Homo sapiens
aagaaccttaatgacaaca

SEQ ID NO: 3563997 - DNA, 14 bp, Homo sapiens
aagaacttgctgct

SEQ ID NO: 3563998 - DNA, 14 bp, Homo sapiens
aagaagaaaggact

SEQ ID NO: 3563999 - DNA, 16 bp, Homo sapiens
aagaagagaggcatag

SEQ ID NO: 3564000 - DNA, 15 bp, Homo sapiens
aagaagagctatcag

SEQ ID NO: 3564001 - DNA, 21 bp, Homo sapiens
aagaagaggagaaaaagaaga

SEQ ID NO: 3564002 - DNA, 18 bp, Homo sapiens
aagaagatagctctctga

SEQ ID NO: 3564003 - DNA, 20 bp, Homo sapiens
aagaagatagctctctgact

SEQ ID NO: 3564004 - DNA, 20 bp, Homo sapiens
aagtattaagcagttcattc

SEQ ID NO: 3564005 - DNA, 13 bp, Homo sapiens
aagtattcataca

SEQ ID NO: 3564006 - DNA, 17 bp, Homo sapiens
aagtattgtacaaataa

SEQ ID NO: 3564007 - DNA, 16 bp, Homo sapiens
aagtatttaaatgttc

SEQ ID NO: 3564008 - DNA, 18 bp, Homo sapiens
aagtattttgtgtttgga

SEQ ID NO: 3564009 - DNA, 13 bp, Homo sapiens
aagtcaaaaggaa

SEQ ID NO: 3564010 - DNA, 17 bp, Homo sapiens
aagtcaaaaggaacaaa

SEQ ID NO: 3564011 - DNA, 19 bp, Homo sapiens
aagtcaaaaggaacaaaaa

SEQ ID NO: 3564012 - DNA, 18 bp, Homo sapiens
aagtcaaagtgttgctgt

SEQ ID NO: 3564013 - DNA, 14 bp, Homo sapiens
aagtcaatgtactt

SEQ ID NO: 3564014 - DNA, 18 bp, Homo sapiens
aagtcaatgtacttgttt

SEQ ID NO: 3564015 - DNA, 17 bp, Homo sapiens
aagtcacccctttctgt

SEQ ID NO: 3564016 - DNA, 22 bp, Homo sapiens
aagtcacccctttctgtcccac

SEQ ID NO: 3564017 - DNA, 20 bp, Homo sapiens
aagtcacttactattgttgc

SEQ ID NO: 3564018 - DNA, 20 bp, Homo sapiens
aagtcaggctagctgtgctg

SEQ ID NO: 3564019 - DNA, 15 bp, Homo sapiens
aagtctacctgtgtt

SEQ ID NO: 3564020 - DNA, 22 bp, Homo sapiens
aagtctctgattagttgacagt

SEQ ID NO: 3564021 - DNA, 15 bp, Homo sapiens
aagtctgagcccatt

SEQ ID NO: 3564022 - DNA, 19 bp, Homo sapiens
aagtctgagcccatttctg

SEQ ID NO: 3564023 - DNA, 22 bp, Homo sapiens
aagtctgctctcatataagaca

SEQ ID NO: 3564024 - DNA, 22 bp, Homo sapiens
aagtcttcctaattgtgcccct

SEQ ID NO: 3564025 - DNA, 13 bp, Homo sapiens
aagtgaaaaacat

SEQ ID NO: 3564026 - DNA, 13 bp, Homo sapiens
aagtgaaaatctt

SEQ ID NO: 3564027 - DNA, 10 bp, Homo sapiens
aagtgatctt

SEQ ID NO: 3564028 - DNA, 14 bp, Homo sapiens
aagtgcagctcatg

SEQ ID NO: 3564029 - DNA, 23 bp, Homo sapiens
aagtgcagtcagcagatgctgtt

SEQ ID NO: 3564030 - DNA, 14 bp, Homo sapiens
aagtgcctgggctc

SEQ ID NO: 3564031 - DNA, 14 bp, Homo sapiens
aagtgcgctttgca

SEQ ID NO: 3564032 - DNA, 22 bp, Homo sapiens
aagtgcggggtaggggaagaag

SEQ ID NO: 3564033 - DNA, 19 bp, Homo sapiens
aagtgctcttggctgaccc

SEQ ID NO: 3564034 - DNA, 16 bp, Homo sapiens
aagtgctgctgtggag

SEQ ID NO: 3564035 - DNA, 16 bp, Homo sapiens
aagtgctgtttattaa

SEQ ID NO: 3564036 - DNA, 13 bp, Homo sapiens
aagtgtatttgga

SEQ ID NO: 3564037 - DNA, 21 bp, Homo sapiens
aagtgtatttggaaataaagt

SEQ ID NO: 3564038 - DNA, 16 bp, Homo sapiens
aagtgtgctgggcaga

SEQ ID NO: 3564039 - DNA, 20 bp, Homo sapiens
aagtgtgctgggcagaggga

SEQ ID NO: 3564040 - DNA, 17 bp, Homo sapiens
aagtgtgggtctgtgtg

SEQ ID NO: 3564041 - DNA, 20 bp, Homo sapiens
aagtgtgggtctgtgtgtgt

SEQ ID NO: 3564042 - DNA, 23 bp, Homo sapiens
aagttacttaattgccagcaaat

SEQ ID NO: 3564043 - DNA, 22 bp, Homo sapiens
aagttatctttgaatatgtagt

SEQ ID NO: 3564044 - DNA, 15 bp, Homo sapiens
aagttattaacattt

SEQ ID NO: 3564045 - DNA, 12 bp, Homo sapiens
aagttatttatg

SEQ ID NO: 3564046 - DNA, 23 bp, Homo sapiens
aagttcagcccaccatctgtttg

SEQ ID NO: 3564047 - DNA, 22 bp, Homo sapiens
aagttcatcttgcagcatttac

SEQ ID NO: 3564048 - DNA, 21 bp, Homo sapiens
aagttctaggcatacttttca

SEQ ID NO: 3564049 - DNA, 19 bp, Homo sapiens
aagttgacttatagtacat

SEQ ID NO: 3564050 - DNA, 18 bp, Homo sapiens
aagttgggcccctgagga

SEQ ID NO: 3564051 - DNA, 15 bp, Homo sapiens
aagttgtaaaataga

SEQ ID NO: 3564052 - DNA, 15 bp, Homo sapiens
aagtttaaatgtatt

SEQ ID NO: 3564053 - DNA, 17 bp, Homo sapiens
aagtttaaatgtatttt

SEQ ID NO: 3564054 - DNA, 20 bp, Homo sapiens
aagtttaaatgtattttaca

SEQ ID NO: 3564055 - DNA, 17 bp, Homo sapiens
aagtttaagtgtgcagc

SEQ ID NO: 3564056 - DNA, 19 bp, Homo sapiens
aagtttaagtgtgcagcca

SEQ ID NO: 3564057 - DNA, 18 bp, Homo sapiens
aagtttatccaaatcttg

SEQ ID NO: 3564058 - DNA, 15 bp, Homo sapiens
aagtttattgtttga

SEQ ID NO: 3564059 - DNA, 13 bp, Homo sapiens
aagtttgctgtgc

SEQ ID NO: 3564060 - DNA, 20 bp, Homo sapiens
aagtttgctgtgctttggaa

SEQ ID NO: 3564061 - DNA, 13 bp, Homo sapiens
aagtttgtagcca

SEQ ID NO: 3564062 - DNA, 15 bp, Homo sapiens
aagttttccagtatt

SEQ ID NO: 3564063 - DNA, 22 bp, Homo sapiens
aagttttcccttgaggaaacaa

SEQ ID NO: 3564064 - DNA, 17 bp, Homo sapiens
aagttttggcagccatg

SEQ ID NO: 3564065 - DNA, 23 bp, Homo sapiens
aagttttggcagccatgataata

SEQ ID NO: 3564066 - DNA, 15 bp, Homo sapiens
aagtttttgaaatac

SEQ ID NO: 3564067 - DNA, 16 bp, Homo sapiens
aataaaaacttttgag

SEQ ID NO: 3564068 - DNA, 15 bp, Homo sapiens
aataaaaatatattt

SEQ ID NO: 3564069 - DNA, 13 bp, Homo sapiens
aataaaaccagct

SEQ ID NO: 3564070 - DNA, 15 bp, Homo sapiens
aataaaactggcttt

SEQ ID NO: 3564071 - DNA, 11 bp, Homo sapiens
aataaaagcac

SEQ ID NO: 3564072 - DNA, 13 bp, Homo sapiens
aataaaagcacaa

SEQ ID NO: 3564073 - DNA, 19 bp, Homo sapiens
aataaactactctttgatt

SEQ ID NO: 3564074 - DNA, 12 bp, Homo sapiens
aataaactctct

SEQ ID NO: 3564075 - DNA, 14 bp, Homo sapiens
aataaactctctag

SEQ ID NO: 3564076 - DNA, 11 bp, Homo sapiens
aataaactggt

SEQ ID NO: 3564077 - DNA, 24 bp, Homo sapiens
aataaactggtatgaataattgca

SEQ ID NO: 3564078 - DNA, 12 bp, Homo sapiens
aataaagagaaa

SEQ ID NO: 3564079 - DNA, 12 bp, Homo sapiens
aataaagcaatt

SEQ ID NO: 3564080 - DNA, 15 bp, Homo sapiens
aataaagcttttgga

SEQ ID NO: 3564081 - DNA, 17 bp, Homo sapiens
aataaagcttttggaag

SEQ ID NO: 3564082 - DNA, 11 bp, Homo sapiens
aataaaggact

SEQ ID NO: 3564083 - DNA, 19 bp, Homo sapiens
aataaaggcagttttctaa

SEQ ID NO: 3564084 - DNA, 23 bp, Homo sapiens
aataaatactgcagcttgagttt

SEQ ID NO: 3564085 - DNA, 15 bp, Homo sapiens
aataaatatatctac

SEQ ID NO: 3564086 - DNA, 14 bp, Homo sapiens
aataaatcacacat

SEQ ID NO: 3564087 - DNA, 16 bp, Homo sapiens
aataaatcacagatgc

SEQ ID NO: 3564088 - DNA, 19 bp, Homo sapiens
aagacccaaaacagctttg

SEQ ID NO: 3564089 - DNA, 12 bp, Homo sapiens
aagaccctgtgt

SEQ ID NO: 3564090 - DNA, 13 bp, Homo sapiens
aagaccctgtgtc

SEQ ID NO: 3564091 - DNA, 21 bp, Homo sapiens
aagacctgaaagagaggactg

SEQ ID NO: 3564092 - DNA, 22 bp, Homo sapiens
aagacctgaaagagaggactgg

SEQ ID NO: 3564093 - DNA, 21 bp, Homo sapiens
aagactagactactcaatatt

SEQ ID NO: 3564094 - DNA, 23 bp, Homo sapiens
aagactagactactcaatattaa

SEQ ID NO: 3564095 - DNA, 16 bp, Homo sapiens
aagactccaaagaaat

SEQ ID NO: 3564096 - DNA, 19 bp, Homo sapiens
aagacttgtaatattttta

SEQ ID NO: 3564097 - DNA, 16 bp, Homo sapiens
aagacttgtttctgat

SEQ ID NO: 3564098 - DNA, 17 bp, Homo sapiens
aagactttgatccatgt

SEQ ID NO: 3564099 - DNA, 21 bp, Homo sapiens
aagacttttggtagagaagga

SEQ ID NO: 3564100 - DNA, 20 bp, Homo sapiens
aagagaaacagttggtaact

SEQ ID NO: 3564101 - DNA, 20 bp, Homo sapiens
aagagaaacctgccaaggag

SEQ ID NO: 3564102 - DNA, 20 bp, Homo sapiens
aagagaagagggcccagccc

SEQ ID NO: 3564103 - DNA, 16 bp, Homo sapiens
aagagaagatgcctgt

SEQ ID NO: 3564104 - DNA, 18 bp, Homo sapiens
aagagaagggcagggctg

SEQ ID NO: 3564105 - DNA, 20 bp, Homo sapiens
aagagagaagccagccacag

SEQ ID NO: 3564106 - DNA, 13 bp, Homo sapiens
aagagagggacag

SEQ ID NO: 3564107 - DNA, 18 bp, Homo sapiens
aagagagggacaggcact

SEQ ID NO: 3564108 - DNA, 18 bp, Homo sapiens
aagagatcgagaccatcc

SEQ ID NO: 3564109 - DNA, 20 bp, Homo sapiens
aagagatctgtgtggctcct

SEQ ID NO: 3564110 - DNA, 20 bp, Homo sapiens
aagagatctttctttccaaa

SEQ ID NO: 3564111 - DNA, 13 bp, Homo sapiens
aagagcatcctga

SEQ ID NO: 3564112 - DNA, 16 bp, Homo sapiens
aagagccaagttccaa

SEQ ID NO: 3564113 - DNA, 13 bp, Homo sapiens
aagagctgcctgg

SEQ ID NO: 3564114 - DNA, 21 bp, Homo sapiens
aagagctgcctggatgagaaa

SEQ ID NO: 3564115 - DNA, 21 bp, Homo sapiens
aagagctgttatgctgtttcc

SEQ ID NO: 3564116 - DNA, 21 bp, Homo sapiens
aagaggaatggccctcattca

SEQ ID NO: 3564117 - DNA, 19 bp, Homo sapiens
aagaggaattacgtgctct

SEQ ID NO: 3564118 - DNA, 19 bp, Homo sapiens
aagaggagataaggtggct

SEQ ID NO: 3564119 - DNA, 15 bp, Homo sapiens
aagaggcagggacct

SEQ ID NO: 3564120 - DNA, 15 bp, Homo sapiens
aagagggcccagccc

SEQ ID NO: 3564121 - DNA, 19 bp, Homo sapiens
aagaggtgaaaatgaagaa

SEQ ID NO: 3564122 - DNA, 19 bp, Homo sapiens
aagagtcagacatttcttt

SEQ ID NO: 3564123 - DNA, 21 bp, Homo sapiens
aagagtccattgtttaaaaat

SEQ ID NO: 3564124 - DNA, 19 bp, Homo sapiens
aagagtggcatataatttt

SEQ ID NO: 3564125 - DNA, 18 bp, Homo sapiens
aagagtttaaacaaaaaa

SEQ ID NO: 3564126 - DNA, 19 bp, Homo sapiens
aagagtttaaacaaaaaac

SEQ ID NO: 3564127 - DNA, 19 bp, Homo sapiens
aagataatttatttcaata

SEQ ID NO: 3564128 - DNA, 14 bp, Homo sapiens
aagatagctctctg

SEQ ID NO: 3564129 - DNA, 20 bp, Homo sapiens
aagatattatttgtcttaaa

SEQ ID NO: 3564130 - DNA, 12 bp, Homo sapiens
aagatattttat

SEQ ID NO: 3564131 - DNA, 16 bp, Homo sapiens
aagatcgcccccacct

SEQ ID NO: 3564132 - DNA, 16 bp, Homo sapiens
aagatcgttctctgcc

SEQ ID NO: 3564133 - DNA, 19 bp, Homo sapiens
aagatctgtcctcagcctt

SEQ ID NO: 3564134 - DNA, 14 bp, Homo sapiens
aagatgaaaatatt

SEQ ID NO: 3564135 - DNA, 20 bp, Homo sapiens
aagatgatttaatgttgatt

SEQ ID NO: 3564136 - DNA, 15 bp, Homo sapiens
aagatgccagcttct

SEQ ID NO: 3564137 - DNA, 20 bp, Homo sapiens
aagatggagacaccctctgg

SEQ ID NO: 3564138 - DNA, 22 bp, Homo sapiens
aagatggagacaccctctgggg

SEQ ID NO: 3564139 - DNA, 19 bp, Homo sapiens
aagatggcataacctgtct

SEQ ID NO: 3564140 - DNA, 16 bp, Homo sapiens
aagatggctgtgcctc

SEQ ID NO: 3564141 - DNA, 23 bp, Homo sapiens
aagatggctgtgcctctgcctgt

SEQ ID NO: 3564142 - DNA, 12 bp, Homo sapiens
aagatggtggcc

SEQ ID NO: 3564143 - DNA, 14 bp, Homo sapiens
aagatgtacattta

SEQ ID NO: 3564144 - DNA, 20 bp, Homo sapiens
aagatgtacatttaataata

SEQ ID NO: 3564145 - DNA, 19 bp, Homo sapiens
aagatgtgcaaaatcactg

SEQ ID NO: 3564146 - DNA, 17 bp, Homo sapiens
aagatgtttacattttt

SEQ ID NO: 3564147 - DNA, 16 bp, Homo sapiens
aagattatatgaagtt

SEQ ID NO: 3564148 - DNA, 22 bp, Homo sapiens
aagattatatgaagtttaaatt

SEQ ID NO: 3564149 - DNA, 16 bp, Homo sapiens
aagattattttttaaa

SEQ ID NO: 3564150 - DNA, 18 bp, Homo sapiens
aagattattttttaaaaa

SEQ ID NO: 3564151 - DNA, 21 bp, Homo sapiens
aagattctatgttaatatttt

SEQ ID NO: 3564152 - DNA, 23 bp, Homo sapiens
aagattctatgttaatattttat

SEQ ID NO: 3564153 - DNA, 12 bp, Homo sapiens
aagattcttctt

SEQ ID NO: 3564154 - DNA, 20 bp, Homo sapiens
aagattcttcttaaaagttt

SEQ ID NO: 3564155 - DNA, 15 bp, Homo sapiens
aagatttttttcctg

SEQ ID NO: 3564156 - DNA, 14 bp, Homo sapiens
aagcaaacatcaaa

SEQ ID NO: 3564157 - DNA, 19 bp, Homo sapiens
aagcaaaggtgcactccag

SEQ ID NO: 3564158 - DNA, 23 bp, Homo sapiens
aagcaaaggtgcactccagactc

SEQ ID NO: 3564159 - DNA, 19 bp, Homo sapiens
aagcaaatcagaaaaccca

SEQ ID NO: 3564160 - DNA, 18 bp, Homo sapiens
aagcaaccacactgcttg

SEQ ID NO: 3564161 - DNA, 15 bp, Homo sapiens
aagcaagacacgtgg

SEQ ID NO: 3564162 - DNA, 17 bp, Homo sapiens
aagcaatactgtttcca

SEQ ID NO: 3564163 - DNA, 13 bp, Homo sapiens
aagcaatgtgttt

SEQ ID NO: 3564164 - DNA, 23 bp, Homo sapiens
aagcaattagtctgaaactggct

SEQ ID NO: 3564165 - DNA, 21 bp, Homo sapiens
aagcaatttactgatgagaga

SEQ ID NO: 3564166 - DNA, 19 bp, Homo sapiens
aagcacactcatcccctca

SEQ ID NO: 3564167 - DNA, 17 bp, Homo sapiens
aagcacatggttcaaat

SEQ ID NO: 3564168 - DNA, 18 bp, Homo sapiens
aagcacatggttcaaatc

SEQ ID NO: 3564169 - DNA, 20 bp, Homo sapiens
aagcaccaacctccagactc

SEQ ID NO: 3564170 - DNA, 20 bp, Homo sapiens
aagcacctaaaacccaaagg

SEQ ID NO: 3564171 - DNA, 21 bp, Homo sapiens
aagcacctaaaacccaaaggt

SEQ ID NO: 3564172 - DNA, 19 bp, Homo sapiens
aagcaccttagctggcatt

SEQ ID NO: 3564173 - DNA, 19 bp, Homo sapiens
aagcactgacttctaagta

SEQ ID NO: 3564174 - DNA, 16 bp, Homo sapiens
aagcagagcctcctgg

SEQ ID NO: 3564175 - DNA, 12 bp, Homo sapiens
aagcagaggagg

SEQ ID NO: 3564176 - DNA, 11 bp, Homo sapiens
aagcagatgac

SEQ ID NO: 3564177 - DNA, 14 bp, Homo sapiens
aagcagatgacaga

SEQ ID NO: 3564178 - DNA, 16 bp, Homo sapiens
aagcagcaactattca

SEQ ID NO: 3564179 - DNA, 14 bp, Homo sapiens
aagcagcatggaaa

SEQ ID NO: 3564180 - DNA, 17 bp, Homo sapiens
aagcagcatggaaaaat

SEQ ID NO: 3564181 - DNA, 19 bp, Homo sapiens
aagcagcatggaaaaatgg

SEQ ID NO: 3564182 - DNA, 19 bp, Homo sapiens
aagcagctgcattttttat

SEQ ID NO: 3564183 - DNA, 22 bp, Homo sapiens
aagcagctttttattccctgcc

SEQ ID NO: 3564184 - DNA, 22 bp, Homo sapiens
aagcagttcattctaccaagct

SEQ ID NO: 3564185 - DNA, 16 bp, Homo sapiens
aagcatatagagatga

SEQ ID NO: 3564186 - DNA, 14 bp, Homo sapiens
aagcatccctcacc

SEQ ID NO: 3564187 - DNA, 22 bp, Homo sapiens
aatttatgtgaaatgctttctg

SEQ ID NO: 3564188 - DNA, 14 bp, Homo sapiens
aatttatgtgatgg

SEQ ID NO: 3564189 - DNA, 17 bp, Homo sapiens
aatttattaattgcttt

SEQ ID NO: 3564190 - DNA, 12 bp, Homo sapiens
aatttatttcaa

SEQ ID NO: 3564191 - DNA, 19 bp, Homo sapiens
aatttatttttaagaaaga

SEQ ID NO: 3564192 - DNA, 16 bp, Homo sapiens
aatttcacttatacct

SEQ ID NO: 3564193 - DNA, 18 bp, Homo sapiens
aatttcataattctgaaa

SEQ ID NO: 3564194 - DNA, 15 bp, Homo sapiens
aatttcccaggaccc

SEQ ID NO: 3564195 - DNA, 16 bp, Homo sapiens
aatttccttcaggcag

SEQ ID NO: 3564196 - DNA, 16 bp, Homo sapiens
aatttctaccatttca

SEQ ID NO: 3564197 - DNA, 14 bp, Homo sapiens
aatttctcatcaca

SEQ ID NO: 3564198 - DNA, 20 bp, Homo sapiens
aatttctcccagtcatttaa

SEQ ID NO: 3564199 - DNA, 12 bp, Homo sapiens
aatttctcttgt

SEQ ID NO: 3564200 - DNA, 19 bp, Homo sapiens
aatttctgccaataaattc

SEQ ID NO: 3564201 - DNA, 23 bp, Homo sapiens
aatttctgccaataaattctaaa

SEQ ID NO: 3564202 - DNA, 20 bp, Homo sapiens
aatttctgggatatttaact

SEQ ID NO: 3564203 - DNA, 15 bp, Homo sapiens
aatttcttaacttct

SEQ ID NO: 3564204 - DNA, 15 bp, Homo sapiens
aatttcttatttacc

SEQ ID NO: 3564205 - DNA, 15 bp, Homo sapiens
aatttcttttgctga

SEQ ID NO: 3564206 - DNA, 18 bp, Homo sapiens
aatttgaaaccaggacat

SEQ ID NO: 3564207 - DNA, 21 bp, Homo sapiens
aatttgaggtctagagagaac

SEQ ID NO: 3564208 - DNA, 23 bp, Homo sapiens
aatttgccagaggaccaatgctt

SEQ ID NO: 3564209 - DNA, 13 bp, Homo sapiens
aatttgtcttaaa

SEQ ID NO: 3564210 - DNA, 23 bp, Homo sapiens
aattttaccctgaggtcactgct

SEQ ID NO: 3564211 - DNA, 17 bp, Homo sapiens
aattttacctattctga

SEQ ID NO: 3564212 - DNA, 14 bp, Homo sapiens
aattttatccctca

SEQ ID NO: 3564213 - DNA, 14 bp, Homo sapiens
aattttcacttctg

SEQ ID NO: 3564214 - DNA, 19 bp, Homo sapiens
aattttcattttgcactga

SEQ ID NO: 3564215 - DNA, 15 bp, Homo sapiens
aattttccatttatt

SEQ ID NO: 3564216 - DNA, 20 bp, Homo sapiens
aattttccttcagatatttt

SEQ ID NO: 3564217 - DNA, 11 bp, Homo sapiens
aattttccttt

SEQ ID NO: 3564218 - DNA, 19 bp, Homo sapiens
aattttgaagtgctgttta

SEQ ID NO: 3564219 - DNA, 23 bp, Homo sapiens
aattttgctaactgggttaaata

SEQ ID NO: 3564220 - DNA, 14 bp, Homo sapiens
aattttgtgtaaga

SEQ ID NO: 3564221 - DNA, 18 bp, Homo sapiens
aattttgtgtaagaaata

SEQ ID NO: 3564222 - DNA, 11 bp, Homo sapiens
aatttttcctt

SEQ ID NO: 3564223 - DNA, 13 bp, Homo sapiens
aatttttcctttt

SEQ ID NO: 3564224 - DNA, 12 bp, Homo sapiens
aattttttgaaa

SEQ ID NO: 3564225 - DNA, 13 bp, Homo sapiens
aatttttttcacc

SEQ ID NO: 3564226 - DNA, 19 bp, Homo sapiens
aatttttttttcctagccc

SEQ ID NO: 3564227 - DNA, 19 bp, Homo sapiens
acaaaacaaagcaattctt

SEQ ID NO: 3564228 - DNA, 17 bp, Homo sapiens
acaaaacccatgcattt

SEQ ID NO: 3564229 - DNA, 17 bp, Homo sapiens
acaaaacctatttttcc

SEQ ID NO: 3564230 - DNA, 18 bp, Homo sapiens
acaaaacctatttttcct

SEQ ID NO: 3564231 - DNA, 20 bp, Homo sapiens
acaaaactacttttctaaaa

SEQ ID NO: 3564232 - DNA, 19 bp, Homo sapiens
acaaaacttaaaagtattc

SEQ ID NO: 3564233 - DNA, 15 bp, Homo sapiens
acaaaacttgcatct

SEQ ID NO: 3564234 - DNA, 12 bp, Homo sapiens
acaaaataaaca

SEQ ID NO: 3564235 - DNA, 14 bp, Homo sapiens
acaaaataaacaaa

SEQ ID NO: 3564236 - DNA, 23 bp, Homo sapiens
acaaaatcttgtaggtcattgca

SEQ ID NO: 3564237 - DNA, 11 bp, Homo sapiens
acaaaatggac

SEQ ID NO: 3564238 - DNA, 16 bp, Homo sapiens
acaaaattctttctgg

SEQ ID NO: 3564239 - DNA, 14 bp, Homo sapiens
acaaacaaaactta

SEQ ID NO: 3564240 - DNA, 15 bp, Homo sapiens
acaaacaaaacttaa

SEQ ID NO: 3564241 - DNA, 16 bp, Homo sapiens
acaaacaaacaaaact

SEQ ID NO: 3564242 - DNA, 16 bp, Homo sapiens
acaaacaaacaatgca

SEQ ID NO: 3564243 - DNA, 12 bp, Homo sapiens
acaaacaaattt

SEQ ID NO: 3564244 - DNA, 22 bp, Homo sapiens
acaaactctctgaacccctccc

SEQ ID NO: 3564245 - DNA, 14 bp, Homo sapiens
acaaagaaaatgtt

SEQ ID NO: 3564246 - DNA, 23 bp, Homo sapiens
acaaagaaccatgcaggaaggaa

SEQ ID NO: 3564247 - DNA, 14 bp, Homo sapiens
acaaagaagaaagc

SEQ ID NO: 3564248 - DNA, 14 bp, Homo sapiens
acaaagacaggcaa

SEQ ID NO: 3564249 - DNA, 18 bp, Homo sapiens
acaaagacattgacagca

SEQ ID NO: 3564250 - DNA, 21 bp, Homo sapiens
acaaagacattgacagcaatt

SEQ ID NO: 3564251 - DNA, 17 bp, Homo sapiens
acaaagcagctttaaaa

SEQ ID NO: 3564252 - DNA, 13 bp, Homo sapiens
acaaagcccaagg

SEQ ID NO: 3564253 - DNA, 15 bp, Homo sapiens
acaaagggaaagcct

SEQ ID NO: 3564254 - DNA, 20 bp, Homo sapiens
acaaagggaaagcctctggc

SEQ ID NO: 3564255 - DNA, 16 bp, Homo sapiens
acaaaggtaagagaaa

SEQ ID NO: 3564256 - DNA, 19 bp, Homo sapiens
acaaaggtttaaagtttga

SEQ ID NO: 3564257 - DNA, 11 bp, Homo sapiens
acaaataagaa

SEQ ID NO: 3564258 - DNA, 17 bp, Homo sapiens
acaaatatgttctctga

SEQ ID NO: 3564259 - DNA, 12 bp, Homo sapiens
acaaatatttat

SEQ ID NO: 3564260 - DNA, 18 bp, Homo sapiens
acaaatatttattttctt

SEQ ID NO: 3564261 - DNA, 14 bp, Homo sapiens
acaaatctttaaga

SEQ ID NO: 3564262 - DNA, 19 bp, Homo sapiens
acaaatgccttaaaatgga

SEQ ID NO: 3564263 - DNA, 13 bp, Homo sapiens
acaacagcagtct

SEQ ID NO: 3564264 - DNA, 16 bp, Homo sapiens
acaacagccctgcctg

SEQ ID NO: 3564265 - DNA, 15 bp, Homo sapiens
acaaccctaccctgg

SEQ ID NO: 3564266 - DNA, 16 bp, Homo sapiens
acaaccctaccctggc

SEQ ID NO: 3564267 - DNA, 19 bp, Homo sapiens
acaacctgtgtgagagaat

SEQ ID NO: 3564268 - DNA, 21 bp, Homo sapiens
acaactactagtgtgactcct

SEQ ID NO: 3564269 - DNA, 14 bp, Homo sapiens
acaactggaagctt

SEQ ID NO: 3564270 - DNA, 17 bp, Homo sapiens
acaactggagttttttt

SEQ ID NO: 3564271 - DNA, 14 bp, Homo sapiens
acaacttagtgtaa

SEQ ID NO: 3564272 - DNA, 21 bp, Homo sapiens
acaagactggcccagtgccag

SEQ ID NO: 3564273 - DNA, 18 bp, Homo sapiens
acaagattataatatttt

SEQ ID NO: 3564274 - DNA, 20 bp, Homo sapiens
acaagcatttcccccaggga

SEQ ID NO: 3564275 - DNA, 13 bp, Homo sapiens
acaagccagctgg

SEQ ID NO: 3564276 - DNA, 15 bp, Homo sapiens
acaagccagctggag

SEQ ID NO: 3564277 - DNA, 17 bp, Homo sapiens
acaagctgtccctgcag

SEQ ID NO: 3564278 - DNA, 16 bp, Homo sapiens
acaagcttcagtaagt

SEQ ID NO: 3564279 - DNA, 17 bp, Homo sapiens
acaaggatagatgctgg

SEQ ID NO: 3564280 - DNA, 21 bp, Homo sapiens
acaaggatagatgctggccca

SEQ ID NO: 3564281 - DNA, 15 bp, Homo sapiens
acaaggcctgcttga

SEQ ID NO: 3564282 - DNA, 22 bp, Homo sapiens
acaaggcctgcttgactttcca

SEQ ID NO: 3564283 - DNA, 15 bp, Homo sapiens
acaaggtgctaacat

SEQ ID NO: 3564284 - DNA, 19 bp, Homo sapiens
acaaggtgctaacatagat

SEQ ID NO: 3564285 - DNA, 14 bp, Homo sapiens
acaagtaatattat

SEQ ID NO: 3564286 - DNA, 15 bp, Homo sapiens
acaagtaatattatt

SEQ ID NO: 3564287 - DNA, 23 bp, Homo sapiens
acaagtatgaataaagacaccta

SEQ ID NO: 3564288 - DNA, 15 bp, Homo sapiens
acaagttccaacatg

SEQ ID NO: 3564289 - DNA, 15 bp, Homo sapiens
acaagttttggcagc

SEQ ID NO: 3564290 - DNA, 12 bp, Homo sapiens
acaataaactgg

SEQ ID NO: 3564291 - DNA, 13 bp, Homo sapiens
acaataaactggt

SEQ ID NO: 3564292 - DNA, 14 bp, Homo sapiens
acaataaatttttt

SEQ ID NO: 3564293 - DNA, 15 bp, Homo sapiens
acaataagcaaaaac

SEQ ID NO: 3564294 - DNA, 21 bp, Homo sapiens
acaataattctggagatactg

SEQ ID NO: 3564295 - DNA, 22 bp, Homo sapiens
acaatacctacaataaactggt

SEQ ID NO: 3564296 - DNA, 13 bp, Homo sapiens
acaataggtcttt

SEQ ID NO: 3564297 - DNA, 19 bp, Homo sapiens
acaataggtctttctctca

SEQ ID NO: 3564298 - DNA, 20 bp, Homo sapiens
acaataggtctttctctcag

SEQ ID NO: 3564299 - DNA, 19 bp, Homo sapiens
acaatattaattcaggttt

SEQ ID NO: 3564300 - DNA, 15 bp, Homo sapiens
acaatattgactttg

SEQ ID NO: 3564301 - DNA, 18 bp, Homo sapiens
acaatattgactttgtct

SEQ ID NO: 3564302 - DNA, 18 bp, Homo sapiens
acaatcacagggaatggc

SEQ ID NO: 3564303 - DNA, 15 bp, Homo sapiens
acaatccattcacaa

SEQ ID NO: 3564304 - DNA, 18 bp, Homo sapiens
acaatcccaatctttcta

SEQ ID NO: 3564305 - DNA, 20 bp, Homo sapiens
acaatcccaatctttctata

SEQ ID NO: 3564306 - DNA, 13 bp, Homo sapiens
acaatctttcatg

SEQ ID NO: 3564307 - DNA, 14 bp, Homo sapiens
acaatctttcatgt

SEQ ID NO: 3564308 - DNA, 13 bp, Homo sapiens
acaatgaatcaga

SEQ ID NO: 3564309 - DNA, 21 bp, Homo sapiens
acaatgatcaccgactgaaaa

SEQ ID NO: 3564310 - DNA, 15 bp, Homo sapiens
acaatggatattgcc

SEQ ID NO: 3564311 - DNA, 19 bp, Homo sapiens
acaatgtaataaaaagcct

SEQ ID NO: 3564312 - DNA, 18 bp, Homo sapiens
acaatgttggagcagcag

SEQ ID NO: 3564313 - DNA, 19 bp, Homo sapiens
acaatgttggagcagcagg

SEQ ID NO: 3564314 - DNA, 14 bp, Homo sapiens
acaattattggcaa

SEQ ID NO: 3564315 - DNA, 18 bp, Homo sapiens
acaattattggcaaagtt

SEQ ID NO: 3564316 - DNA, 22 bp, Homo sapiens
acaattgaacttccaggaaagt

SEQ ID NO: 3564317 - DNA, 20 bp, Homo sapiens
acaatttgtgatatctaata

SEQ ID NO: 3564318 - DNA, 21 bp, Homo sapiens
acaattttctatttaaaaaat

SEQ ID NO: 3564319 - DNA, 21 bp, Homo sapiens
acacaacagcagtctccttca

SEQ ID NO: 3564320 - DNA, 15 bp, Homo sapiens
acacaataggtcttt

SEQ ID NO: 3564321 - DNA, 21 bp, Homo sapiens
acacaataggtctttctctca

SEQ ID NO: 3564322 - DNA, 15 bp, Homo sapiens
acacacacagacata

SEQ ID NO: 3564323 - DNA, 14 bp, Homo sapiens
acacacccccccac

SEQ ID NO: 3564324 - DNA, 15 bp, Homo sapiens
acacactcaaatcaa

SEQ ID NO: 3564325 - DNA, 22 bp, Homo sapiens
aatgtaaagcaaccaaaaagaa

SEQ ID NO: 3564326 - DNA, 13 bp, Homo sapiens
aatgtaacttact

SEQ ID NO: 3564327 - DNA, 19 bp, Homo sapiens
aatgtaatgtttttatttc

SEQ ID NO: 3564328 - DNA, 14 bp, Homo sapiens
aatgtacttgtttg

SEQ ID NO: 3564329 - DNA, 19 bp, Homo sapiens
aatgtatactatagtacca

SEQ ID NO: 3564330 - DNA, 19 bp, Homo sapiens
aatgtatatttttaaagaa

SEQ ID NO: 3564331 - DNA, 22 bp, Homo sapiens
aatgtatcatagaaatgtaact

SEQ ID NO: 3564332 - DNA, 13 bp, Homo sapiens
aatgtcagtatgt

SEQ ID NO: 3564333 - DNA, 18 bp, Homo sapiens
aatgtccacttaaaatac

SEQ ID NO: 3564334 - DNA, 20 bp, Homo sapiens
aatgtccacttaaaatacat

SEQ ID NO: 3564335 - DNA, 23 bp, Homo sapiens
aatgtctcttctaacatcttaga

SEQ ID NO: 3564336 - DNA, 13 bp, Homo sapiens
aatgtctgcagct

SEQ ID NO: 3564337 - DNA, 16 bp, Homo sapiens
aatgtctggtgtttgt

SEQ ID NO: 3564338 - DNA, 23 bp, Homo sapiens
aatgtctgtaataatagactgta

SEQ ID NO: 3564339 - DNA, 18 bp, Homo sapiens
aatgtcttaatttttgaa

SEQ ID NO: 3564340 - DNA, 14 bp, Homo sapiens
aatgtctttcatgt

SEQ ID NO: 3564341 - DNA, 15 bp, Homo sapiens
aatgtgaaatgcttt

SEQ ID NO: 3564342 - DNA, 16 bp, Homo sapiens
aatgtgaagttcatct

SEQ ID NO: 3564343 - DNA, 15 bp, Homo sapiens
aatgtgagaagccag

SEQ ID NO: 3564344 - DNA, 16 bp, Homo sapiens
aatgtggctgaagttg

SEQ ID NO: 3564345 - DNA, 14 bp, Homo sapiens
aatgtgtcattgga

SEQ ID NO: 3564346 - DNA, 23 bp, Homo sapiens
aatgtgtttccttttcaggagat

SEQ ID NO: 3564347 - DNA, 22 bp, Homo sapiens
aatgtgtttcttgctgccatga

SEQ ID NO: 3564348 - DNA, 14 bp, Homo sapiens
aatgtgtttttccc

SEQ ID NO: 3564349 - DNA, 12 bp, Homo sapiens
aatgttaaaaca

SEQ ID NO: 3564350 - DNA, 13 bp, Homo sapiens
aatgttaaaacat

SEQ ID NO: 3564351 - DNA, 22 bp, Homo sapiens
aatgttaaaacataaacacatt

SEQ ID NO: 3564352 - DNA, 17 bp, Homo sapiens
aatgttaattatgcagt

SEQ ID NO: 3564353 - DNA, 22 bp, Homo sapiens
aatgttatgactatgtaaacta

SEQ ID NO: 3564354 - DNA, 13 bp, Homo sapiens
aatgttattttcc

SEQ ID NO: 3564355 - DNA, 21 bp, Homo sapiens
aatgttattttccttctgaag

SEQ ID NO: 3564356 - DNA, 18 bp, Homo sapiens
aatgttccagtttgaaga

SEQ ID NO: 3564357 - DNA, 22 bp, Homo sapiens
aatgttcttatgcaaaatggaa

SEQ ID NO: 3564358 - DNA, 13 bp, Homo sapiens
aatgttctttctg

SEQ ID NO: 3564359 - DNA, 21 bp, Homo sapiens
aatgttggagcagcaggcctc

SEQ ID NO: 3564360 - DNA, 12 bp, Homo sapiens
aatgtttccttt

SEQ ID NO: 3564361 - DNA, 15 bp, Homo sapiens
aatgtttggatggtt

SEQ ID NO: 3564362 - DNA, 13 bp, Homo sapiens
aatgttttaaagt

SEQ ID NO: 3564363 - DNA, 18 bp, Homo sapiens
aatgttttgggaaacact

SEQ ID NO: 3564364 - DNA, 17 bp, Homo sapiens
aatgtttttatttcaat

SEQ ID NO: 3564365 - DNA, 22 bp, Homo sapiens
aatgtttttatttcaattgttt

SEQ ID NO: 3564366 - DNA, 17 bp, Homo sapiens
aattaaacggattattt

SEQ ID NO: 3564367 - DNA, 23 bp, Homo sapiens
aattaaacggattattttttcag

SEQ ID NO: 3564368 - DNA, 19 bp, Homo sapiens
aattaatatccctacatgt

SEQ ID NO: 3564369 - DNA, 21 bp, Homo sapiens
aattacaaaacctatttttcc

SEQ ID NO: 3564370 - DNA, 12 bp, Homo sapiens
aattactggaat

SEQ ID NO: 3564371 - DNA, 15 bp, Homo sapiens
aattaggctgtaact

SEQ ID NO: 3564372 - DNA, 19 bp, Homo sapiens
aattaggctgtaactactt

SEQ ID NO: 3564373 - DNA, 21 bp, Homo sapiens
aattaggctgtaactacttta

SEQ ID NO: 3564374 - DNA, 15 bp, Homo sapiens
aattagtgccactta

SEQ ID NO: 3564375 - DNA, 17 bp, Homo sapiens
aattagtgccacttaat

SEQ ID NO: 3564376 - DNA, 20 bp, Homo sapiens
aattagtgccacttaatgta

SEQ ID NO: 3564377 - DNA, 15 bp, Homo sapiens
aattatatgatatgc

SEQ ID NO: 3564378 - DNA, 17 bp, Homo sapiens
aattatatgatatgcat

SEQ ID NO: 3564379 - DNA, 20 bp, Homo sapiens
aattatatgatatgcatgta

SEQ ID NO: 3564380 - DNA, 14 bp, Homo sapiens
aattatctcaagta

SEQ ID NO: 3564381 - DNA, 22 bp, Homo sapiens
aattatctcaagtaaaacaaat

SEQ ID NO: 3564382 - DNA, 17 bp, Homo sapiens
aattatgtgacatttta

SEQ ID NO: 3564383 - DNA, 23 bp, Homo sapiens
aattattactttaaattatatga

SEQ ID NO: 3564384 - DNA, 17 bp, Homo sapiens
aattatttaactaatta

SEQ ID NO: 3564385 - DNA, 23 bp, Homo sapiens
aattatttaactaattaaaaaat

SEQ ID NO: 3564386 - DNA, 20 bp, Homo sapiens
aattatttgattatttaaga

SEQ ID NO: 3564387 - DNA, 21 bp, Homo sapiens
aattatttgcatattttgaga

SEQ ID NO: 3564388 - DNA, 15 bp, Homo sapiens
aattcacgtgctttg

SEQ ID NO: 3564389 - DNA, 20 bp, Homo sapiens
aattcattctggaggggcag

SEQ ID NO: 3564390 - DNA, 18 bp, Homo sapiens
aattcattttttaaattc

SEQ ID NO: 3564391 - DNA, 16 bp, Homo sapiens
aattccacaccctcac

SEQ ID NO: 3564392 - DNA, 17 bp, Homo sapiens
aattccactgaaaattt

SEQ ID NO: 3564393 - DNA, 16 bp, Homo sapiens
aattccctccccctcc

SEQ ID NO: 3564394 - DNA, 17 bp, Homo sapiens
aattccctccccctcct

SEQ ID NO: 3564395 - DNA, 19 bp, Homo sapiens
aattcctctttgctttgct

SEQ ID NO: 3564396 - DNA, 17 bp, Homo sapiens
aattctacctccttgtg

SEQ ID NO: 3564397 - DNA, 14 bp, Homo sapiens
aattctactaagtt

SEQ ID NO: 3564398 - DNA, 20 bp, Homo sapiens
aattctagtgtccataaata

SEQ ID NO: 3564399 - DNA, 15 bp, Homo sapiens
aattctatgcctgtc

SEQ ID NO: 3564400 - DNA, 15 bp, Homo sapiens
aattctcaaagtttt

SEQ ID NO: 3564401 - DNA, 21 bp, Homo sapiens
aattctcccctccctccagta

SEQ ID NO: 3564402 - DNA, 11 bp, Homo sapiens
aattctgaaac

SEQ ID NO: 3564403 - DNA, 15 bp, Homo sapiens
aattctgggaaggga

SEQ ID NO: 3564404 - DNA, 19 bp, Homo sapiens
aattcttcagcgtaaaatg

SEQ ID NO: 3564405 - DNA, 20 bp, Homo sapiens
aattcttcagcgtaaaatgg

SEQ ID NO: 3564406 - DNA, 15 bp, Homo sapiens
aattcttcctttgta

SEQ ID NO: 3564407 - DNA, 18 bp, Homo sapiens
aattctttgacctgttgg

SEQ ID NO: 3564408 - DNA, 23 bp, Homo sapiens
aattgaattggaaagacttctca

SEQ ID NO: 3564409 - DNA, 17 bp, Homo sapiens
aattgaccctagccaga

SEQ ID NO: 3564410 - DNA, 16 bp, Homo sapiens
aattgattaacttata

SEQ ID NO: 3564411 - DNA, 20 bp, Homo sapiens
aattgattaacttatactgt

SEQ ID NO: 3564412 - DNA, 18 bp, Homo sapiens
aattgcaatatataagac

SEQ ID NO: 3564413 - DNA, 13 bp, Homo sapiens
aattgcactgaag

SEQ ID NO: 3564414 - DNA, 23 bp, Homo sapiens
aattgcactgaagtttttgaaat

SEQ ID NO: 3564415 - DNA, 20 bp, Homo sapiens
aattgcagataactttgact

SEQ ID NO: 3564416 - DNA, 17 bp, Homo sapiens
aattgcatttttacctt

SEQ ID NO: 3564417 - DNA, 18 bp, Homo sapiens
aattgcatttttaccttt

SEQ ID NO: 3564418 - DNA, 13 bp, Homo sapiens
aattgccagcaaa

SEQ ID NO: 3564419 - DNA, 14 bp, Homo sapiens
aattgccagcaaat

SEQ ID NO: 3564420 - DNA, 14 bp, Homo sapiens
aattgcttctaaaa

SEQ ID NO: 3564421 - DNA, 17 bp, Homo sapiens
aattgcttttttaaata

SEQ ID NO: 3564422 - DNA, 22 bp, Homo sapiens
aattggagattggcttgtctca

SEQ ID NO: 3564423 - DNA, 21 bp, Homo sapiens
aattggcagccctatttcagt

SEQ ID NO: 3564424 - DNA, 11 bp, Homo sapiens
aattggccatg

SEQ ID NO: 3564425 - DNA, 15 bp, Homo sapiens
aattgggttcacagc

SEQ ID NO: 3564426 - DNA, 18 bp, Homo sapiens
aattgtagtaattgctct

SEQ ID NO: 3564427 - DNA, 19 bp, Homo sapiens
aattgtcattatttttgtt

SEQ ID NO: 3564428 - DNA, 18 bp, Homo sapiens
aattgtctcaacgcctcc

SEQ ID NO: 3564429 - DNA, 20 bp, Homo sapiens
aattgtctcaacgcctcccc

SEQ ID NO: 3564430 - DNA, 11 bp, Homo sapiens
aattgtgatgt

SEQ ID NO: 3564431 - DNA, 14 bp, Homo sapiens
aattgtgatgtgtc

SEQ ID NO: 3564432 - DNA, 16 bp, Homo sapiens
aattgtgtatttaaaa

SEQ ID NO: 3564433 - DNA, 22 bp, Homo sapiens
aattgtgtatttaaaaaaaaga

SEQ ID NO: 3564434 - DNA, 14 bp, Homo sapiens
aattgttacaattt

SEQ ID NO: 3564435 - DNA, 17 bp, Homo sapiens
aattgtttatatggata

SEQ ID NO: 3564436 - DNA, 13 bp, Homo sapiens
aatttaaaactgt

SEQ ID NO: 3564437 - DNA, 18 bp, Homo sapiens
aatttaaaactgttattt

SEQ ID NO: 3564438 - DNA, 19 bp, Homo sapiens
aatttaaaactgttatttt

SEQ ID NO: 3564439 - DNA, 13 bp, Homo sapiens
aatttaaactgtg

SEQ ID NO: 3564440 - DNA, 13 bp, Homo sapiens
aatttaaatagca

SEQ ID NO: 3564441 - DNA, 15 bp, Homo sapiens
aatttaaatagcatt

SEQ ID NO: 3564442 - DNA, 22 bp, Homo sapiens
aatttaaatagcattatcttat

SEQ ID NO: 3564443 - DNA, 21 bp, Homo sapiens
aatttaactagacacagataa

SEQ ID NO: 3564444 - DNA, 17 bp, Homo sapiens
aatttaaggaacacaga

SEQ ID NO: 3564445 - DNA, 20 bp, Homo sapiens
aatttaatccttctttgtaa

SEQ ID NO: 3564446 - DNA, 14 bp, Homo sapiens
aatttaatgctgcc

SEQ ID NO: 3564447 - DNA, 21 bp, Homo sapiens
aatttaatttgtaaaacttct

SEQ ID NO: 3564448 - DNA, 24 bp, Homo sapiens
aatttaatttgtaaaacttctgct

SEQ ID NO: 3564449 - DNA, 14 bp, Homo sapiens
aatttaatttttcc

SEQ ID NO: 3564450 - DNA, 18 bp, Homo sapiens
aatttaatttttcctttt

SEQ ID NO: 3564451 - DNA, 15 bp, Homo sapiens
aatttacatactctg

SEQ ID NO: 3564452 - DNA, 19 bp, Homo sapiens
aatttacatactctgctta

SEQ ID NO: 3564453 - DNA, 13 bp, Homo sapiens
aatttacctaaga

SEQ ID NO: 3564454 - DNA, 14 bp, Homo sapiens
aatttacctaagat

SEQ ID NO: 3564455 - DNA, 16 bp, Homo sapiens
aatttacctaagatta

SEQ ID NO: 3564456 - DNA, 15 bp, Homo sapiens
aatttactttacaca

SEQ ID NO: 3564457 - DNA, 15 bp, Homo sapiens
aatttagaaaaagtc

SEQ ID NO: 3564458 - DNA, 16 bp, Homo sapiens
aatttagaaaaagtca

SEQ ID NO: 3564459 - DNA, 21 bp, Homo sapiens
aatttagagataggaaactga

SEQ ID NO: 3564460 - DNA, 18 bp, Homo sapiens
aatttatcctgaaatttc

SEQ ID NO: 3564461 - DNA, 16 bp, Homo sapiens
accatgcttgcctgaa

SEQ ID NO: 3564462 - DNA, 14 bp, Homo sapiens
accatgctttgttt

SEQ ID NO: 3564463 - DNA, 15 bp, Homo sapiens
accattccccatggg

SEQ ID NO: 3564464 - DNA, 13 bp, Homo sapiens
accattcctgcct

SEQ ID NO: 3564465 - DNA, 20 bp, Homo sapiens
accattctattctccagaca

SEQ ID NO: 3564466 - DNA, 22 bp, Homo sapiens
accattctattctccagacatg

SEQ ID NO: 3564467 - DNA, 22 bp, Homo sapiens
accattttgtaaatgaaactta

SEQ ID NO: 3564468 - DNA, 21 bp, Homo sapiens
acccaaaccccctgcagccca

SEQ ID NO: 3564469 - DNA, 23 bp, Homo sapiens
acccaaaccccctgcagcccagg

SEQ ID NO: 3564470 - DNA, 16 bp, Homo sapiens
acccaaccctgccctg

SEQ ID NO: 3564471 - DNA, 22 bp, Homo sapiens
acccaagtggacgttaggccag

SEQ ID NO: 3564472 - DNA, 16 bp, Homo sapiens
acccacaaactccagg

SEQ ID NO: 3564473 - DNA, 18 bp, Homo sapiens
acccacacaaataacaag

SEQ ID NO: 3564474 - DNA, 13 bp, Homo sapiens
acccacacagctg

SEQ ID NO: 3564475 - DNA, 15 bp, Homo sapiens
acccacacagctgcc

SEQ ID NO: 3564476 - DNA, 17 bp, Homo sapiens
acccacacagctgccct

SEQ ID NO: 3564477 - DNA, 23 bp, Homo sapiens
acccacataaaagccccagcttg

SEQ ID NO: 3564478 - DNA, 17 bp, Homo sapiens
acccacgacctgtcctg

SEQ ID NO: 3564479 - DNA, 22 bp, Homo sapiens
acccacgacctgtcctgtcttt

SEQ ID NO: 3564480 - DNA, 15 bp, Homo sapiens
acccactcatgactg

SEQ ID NO: 3564481 - DNA, 13 bp, Homo sapiens
acccactctgcac

SEQ ID NO: 3564482 - DNA, 19 bp, Homo sapiens
acccagaatgagacatcca

SEQ ID NO: 3564483 - DNA, 15 bp, Homo sapiens
acccagagatgcctg

SEQ ID NO: 3564484 - DNA, 15 bp, Homo sapiens
acccagattcccttc

SEQ ID NO: 3564485 - DNA, 14 bp, Homo sapiens
acccagcaggcaga

SEQ ID NO: 3564486 - DNA, 15 bp, Homo sapiens
acccagcaggcagag

SEQ ID NO: 3564487 - DNA, 14 bp, Homo sapiens
acccagctgcaccc

SEQ ID NO: 3564488 - DNA, 20 bp, Homo sapiens
acccagctgcaccccttcct

SEQ ID NO: 3564489 - DNA, 23 bp, Homo sapiens
acccaggaagggaaagcgggcag

SEQ ID NO: 3564490 - DNA, 23 bp, Homo sapiens
acccaggacttatttaaactctg

SEQ ID NO: 3564491 - DNA, 15 bp, Homo sapiens
acccagtcccacact

SEQ ID NO: 3564492 - DNA, 18 bp, Homo sapiens
acccagtctttcttcact

SEQ ID NO: 3564493 - DNA, 21 bp, Homo sapiens
acccagtctttcttcactctg

SEQ ID NO: 3564494 - DNA, 15 bp, Homo sapiens
acccagtgcccccac

SEQ ID NO: 3564495 - DNA, 18 bp, Homo sapiens
acccagtgcccccactga

SEQ ID NO: 3564496 - DNA, 22 bp, Homo sapiens
acccagtgcccccactgaccag

SEQ ID NO: 3564497 - DNA, 18 bp, Homo sapiens
acccagtgggtctgggat

SEQ ID NO: 3564498 - DNA, 15 bp, Homo sapiens
acccagttctgaata

SEQ ID NO: 3564499 - DNA, 15 bp, Homo sapiens
acccatccctgcctg

SEQ ID NO: 3564500 - DNA, 22 bp, Homo sapiens
acccatcttccacctcacctct

SEQ ID NO: 3564501 - DNA, 16 bp, Homo sapiens
acccatgaaagaaaac

SEQ ID NO: 3564502 - DNA, 18 bp, Homo sapiens
acccatgcatcttccact

SEQ ID NO: 3564503 - DNA, 16 bp, Homo sapiens
acccatgccagagagg

SEQ ID NO: 3564504 - DNA, 15 bp, Homo sapiens
acccattctgttttc

SEQ ID NO: 3564505 - DNA, 15 bp, Homo sapiens
acccatttgttttcg

SEQ ID NO: 3564506 - DNA, 20 bp, Homo sapiens
accccaaaccccagccccaa

SEQ ID NO: 3564507 - DNA, 18 bp, Homo sapiens
accccaaagactctggag

SEQ ID NO: 3564508 - DNA, 11 bp, Homo sapiens
accccaagctt

SEQ ID NO: 3564509 - DNA, 16 bp, Homo sapiens
accccaagcttcccaa

SEQ ID NO: 3564510 - DNA, 17 bp, Homo sapiens
accccacatccttctca

SEQ ID NO: 3564511 - DNA, 21 bp, Homo sapiens
accccacatccttctcactgc

SEQ ID NO: 3564512 - DNA, 23 bp, Homo sapiens
accccacatccttctcactgcca

SEQ ID NO: 3564513 - DNA, 14 bp, Homo sapiens
accccactgggaga

SEQ ID NO: 3564514 - DNA, 19 bp, Homo sapiens
accccagactagatgtagt

SEQ ID NO: 3564515 - DNA, 16 bp, Homo sapiens
accccatccagccaga

SEQ ID NO: 3564516 - DNA, 19 bp, Homo sapiens
accccatggagctgggcta

SEQ ID NO: 3564517 - DNA, 20 bp, Homo sapiens
acccccaaaatccaaaactt

SEQ ID NO: 3564518 - DNA, 15 bp, Homo sapiens
acccccactccagct

SEQ ID NO: 3564519 - DNA, 14 bp, Homo sapiens
acccccagctttgc

SEQ ID NO: 3564520 - DNA, 13 bp, Homo sapiens
acccccaggtgca

SEQ ID NO: 3564521 - DNA, 17 bp, Homo sapiens
acccccatgctgccttc

SEQ ID NO: 3564522 - DNA, 23 bp, Homo sapiens
acccccccacaaggaaccctcag

SEQ ID NO: 3564523 - DNA, 14 bp, Homo sapiens
acccccctcccaga

SEQ ID NO: 3564524 - DNA, 18 bp, Homo sapiens
acccccctcccagacagg

SEQ ID NO: 3564525 - DNA, 13 bp, Homo sapiens
accccctcagcct

SEQ ID NO: 3564526 - DNA, 23 bp, Homo sapiens
accccctctggagaaggcctgga

SEQ ID NO: 3564527 - DNA, 13 bp, Homo sapiens
accccctgcagcc

SEQ ID NO: 3564528 - DNA, 18 bp, Homo sapiens
accccctgctccaccagc

SEQ ID NO: 3564529 - DNA, 21 bp, Homo sapiens
accccctgctccaccagcagc

SEQ ID NO: 3564530 - DNA, 18 bp, Homo sapiens
accccgagaaccctgagc

SEQ ID NO: 3564531 - DNA, 19 bp, Homo sapiens
accccgccatgcatgcagc

SEQ ID NO: 3564532 - DNA, 17 bp, Homo sapiens
acccctaaaaagattgc

SEQ ID NO: 3564533 - DNA, 14 bp, Homo sapiens
acccctagccctgg

SEQ ID NO: 3564534 - DNA, 14 bp, Homo sapiens
acccctcaaactgc

SEQ ID NO: 3564535 - DNA, 21 bp, Homo sapiens
acccctcaaactgcacatcta

SEQ ID NO: 3564536 - DNA, 17 bp, Homo sapiens
acccctcactccccagg

SEQ ID NO: 3564537 - DNA, 22 bp, Homo sapiens
acccctccagttttgcctgaga

SEQ ID NO: 3564538 - DNA, 14 bp, Homo sapiens
acccctctccaggc

SEQ ID NO: 3564539 - DNA, 22 bp, Homo sapiens
acccctgacctaccccagccag

SEQ ID NO: 3564540 - DNA, 18 bp, Homo sapiens
acccctgcctgttggcag

SEQ ID NO: 3564541 - DNA, 12 bp, Homo sapiens
acccctggcttt

SEQ ID NO: 3564542 - DNA, 17 bp, Homo sapiens
acccctggcttttcact

SEQ ID NO: 3564543 - DNA, 15 bp, Homo sapiens
acccctgggggctct

SEQ ID NO: 3564544 - DNA, 16 bp, Homo sapiens
acccctgggggctctc

SEQ ID NO: 3564545 - DNA, 17 bp, Homo sapiens
acccctgggggctctca

SEQ ID NO: 3564546 - DNA, 15 bp, Homo sapiens
acccctgtaggcctc

SEQ ID NO: 3564547 - DNA, 16 bp, Homo sapiens
acccctgtcccaccca

SEQ ID NO: 3564548 - DNA, 21 bp, Homo sapiens
acccgcctcgacctccccacc

SEQ ID NO: 3564549 - DNA, 22 bp, Homo sapiens
acccggctcgtgtatttattac

SEQ ID NO: 3564550 - DNA, 16 bp, Homo sapiens
acccgggggagcccag

SEQ ID NO: 3564551 - DNA, 17 bp, Homo sapiens
acccgggggagcccagt

SEQ ID NO: 3564552 - DNA, 19 bp, Homo sapiens
acccgggggagcccagtga

SEQ ID NO: 3564553 - DNA, 20 bp, Homo sapiens
acccgggggagcccagtgaa

SEQ ID NO: 3564554 - DNA, 21 bp, Homo sapiens
acccgtcctctcggctgccag

SEQ ID NO: 3564555 - DNA, 13 bp, Homo sapiens
accctaaccaagt

SEQ ID NO: 3564556 - DNA, 13 bp, Homo sapiens
accctacagacag

SEQ ID NO: 3564557 - DNA, 22 bp, Homo sapiens
accctacagacagcttacagga

SEQ ID NO: 3564558 - DNA, 22 bp, Homo sapiens
accctacagtatataagctttt

SEQ ID NO: 3564559 - DNA, 13 bp, Homo sapiens
accctaccctggc

SEQ ID NO: 3564560 - DNA, 14 bp, Homo sapiens
accctaccctggca

SEQ ID NO: 3564561 - DNA, 15 bp, Homo sapiens
accctaccctggcag

SEQ ID NO: 3564562 - DNA, 17 bp, Homo sapiens
accctaccctggcaggg

SEQ ID NO: 3564563 - DNA, 16 bp, Homo sapiens
accctacctgtgcctg

SEQ ID NO: 3564564 - DNA, 18 bp, Homo sapiens
accctcagagccacccct

SEQ ID NO: 3564565 - DNA, 11 bp, Homo sapiens
accctcaggaa

SEQ ID NO: 3564566 - DNA, 18 bp, Homo sapiens
accctcaggccaccctcc

SEQ ID NO: 3564567 - DNA, 20 bp, Homo sapiens
accctcaggccaccctccac

SEQ ID NO: 3564568 - DNA, 23 bp, Homo sapiens
accctccccgcaccccccaagct

SEQ ID NO: 3564569 - DNA, 17 bp, Homo sapiens
accctccctccctaccc

SEQ ID NO: 3564570 - DNA, 15 bp, Homo sapiens
accctctgggggtcc

SEQ ID NO: 3564571 - DNA, 22 bp, Homo sapiens
accctctgggggtcctctctga

SEQ ID NO: 3564572 - DNA, 21 bp, Homo sapiens
accctgacctccgcccctgcc

SEQ ID NO: 3564573 - DNA, 17 bp, Homo sapiens
accctgagcagggtcca

SEQ ID NO: 3564574 - DNA, 17 bp, Homo sapiens
accctgaggtcactgct

SEQ ID NO: 3564575 - DNA, 13 bp, Homo sapiens
accctgcaagacc

SEQ ID NO: 3564576 - DNA, 22 bp, Homo sapiens
accctgccccccctaagagaca

SEQ ID NO: 3564577 - DNA, 15 bp, Homo sapiens
accctgcgcctccag

SEQ ID NO: 3564578 - DNA, 18 bp, Homo sapiens
accctgcgcctccagagg

SEQ ID NO: 3564579 - DNA, 12 bp, Homo sapiens
accctggatgct

SEQ ID NO: 3564580 - DNA, 22 bp, Homo sapiens
accctggcagggacctgagagc

SEQ ID NO: 3564581 - DNA, 11 bp, Homo sapiens
accctggcctg

SEQ ID NO: 3564582 - DNA, 20 bp, Homo sapiens
accctggcctgaactgagga

SEQ ID NO: 3564583 - DNA, 22 bp, Homo sapiens
accctgggagccagtcctccac

SEQ ID NO: 3564584 - DNA, 21 bp, Homo sapiens
accctgggctattgctgctgc

SEQ ID NO: 3564585 - DNA, 18 bp, Homo sapiens
accctggtggttgctgtt

SEQ ID NO: 3564586 - DNA, 13 bp, Homo sapiens
accctgtcaccca

SEQ ID NO: 3564587 - DNA, 14 bp, Homo sapiens
accctgtcctgcag

SEQ ID NO: 3564588 - DNA, 23 bp, Homo sapiens
accctgtcctgcagtcccacact

SEQ ID NO: 3564589 - DNA, 14 bp, Homo sapiens
accctgttacttat

SEQ ID NO: 3564590 - DNA, 21 bp, Homo sapiens
accctgttacttatgtagaaa

SEQ ID NO: 3564591 - DNA, 19 bp, Homo sapiens
acccttacagcctctgact

SEQ ID NO: 3564592 - DNA, 14 bp, Homo sapiens
acccttcctgctgc

SEQ ID NO: 3564593 - DNA, 23 bp, Homo sapiens
acccttcctgctgctgctactgc

SEQ ID NO: 3564594 - DNA, 19 bp, Homo sapiens
acccttctctgttggtctg

SEQ ID NO: 3564595 - DNA, 20 bp, Homo sapiens
acccttctctgttggtctgc

SEQ ID NO: 3564596 - DNA, 14 bp, Homo sapiens
acccttctgggtcc

SEQ ID NO: 3564597 - DNA, 13 bp, Homo sapiens
acatgctgttatt

SEQ ID NO: 3564598 - DNA, 20 bp, Homo sapiens
acatgcttttctgccactcc

SEQ ID NO: 3564599 - DNA, 20 bp, Homo sapiens
acatggccatcttctttctt

SEQ ID NO: 3564600 - DNA, 21 bp, Homo sapiens
acatgggagcttattgctaat

SEQ ID NO: 3564601 - DNA, 18 bp, Homo sapiens
acatgggccagtttatat

SEQ ID NO: 3564602 - DNA, 15 bp, Homo sapiens
acatgggttcaattg

SEQ ID NO: 3564603 - DNA, 17 bp, Homo sapiens
acatggtctgtcaatga

SEQ ID NO: 3564604 - DNA, 23 bp, Homo sapiens
acatggtggggtctcctcaggac

SEQ ID NO: 3564605 - DNA, 14 bp, Homo sapiens
acatgtgaaaagaa

SEQ ID NO: 3564606 - DNA, 13 bp, Homo sapiens
acatgtgacattt

SEQ ID NO: 3564607 - DNA, 17 bp, Homo sapiens
acatgttggaaatgtgt

SEQ ID NO: 3564608 - DNA, 21 bp, Homo sapiens
acatgtttaataaataaaaat

SEQ ID NO: 3564609 - DNA, 21 bp, Homo sapiens
acatgtttccatcatttctgt

SEQ ID NO: 3564610 - DNA, 17 bp, Homo sapiens
acatgtttctgttttgt

SEQ ID NO: 3564611 - DNA, 22 bp, Homo sapiens
acatgtttctgttttgttgttt

SEQ ID NO: 3564612 - DNA, 15 bp, Homo sapiens
acattaaaataaacc

SEQ ID NO: 3564613 - DNA, 22 bp, Homo sapiens
acattaaattttttttacattt

SEQ ID NO: 3564614 - DNA, 16 bp, Homo sapiens
acattaacggtgctaa

SEQ ID NO: 3564615 - DNA, 17 bp, Homo sapiens
acattaacggtgctaaa

SEQ ID NO: 3564616 - DNA, 17 bp, Homo sapiens
acattagagaaaacctt

SEQ ID NO: 3564617 - DNA, 22 bp, Homo sapiens
acattagagaaaaccttaaaag

SEQ ID NO: 3564618 - DNA, 15 bp, Homo sapiens
acattagtgattcca

SEQ ID NO: 3564619 - DNA, 21 bp, Homo sapiens
acattatctcacttagtcctt

SEQ ID NO: 3564620 - DNA, 15 bp, Homo sapiens
acattcagattatat

SEQ ID NO: 3564621 - DNA, 15 bp, Homo sapiens
acattcagctctgga

SEQ ID NO: 3564622 - DNA, 17 bp, Homo sapiens
acattcagctctggaga

SEQ ID NO: 3564623 - DNA, 11 bp, Homo sapiens
acattccctgc

SEQ ID NO: 3564624 - DNA, 18 bp, Homo sapiens
acattctgcctagagtgt

SEQ ID NO: 3564625 - DNA, 12 bp, Homo sapiens
acattgaagaat

SEQ ID NO: 3564626 - DNA, 18 bp, Homo sapiens
acattgacagcaattcat

SEQ ID NO: 3564627 - DNA, 20 bp, Homo sapiens
acattgctccaagatgttct

SEQ ID NO: 3564628 - DNA, 14 bp, Homo sapiens
acatttaaaacatt

SEQ ID NO: 3564629 - DNA, 22 bp, Homo sapiens
acatttaaaacattaaaatata

SEQ ID NO: 3564630 - DNA, 14 bp, Homo sapiens
acatttagtcctgt

SEQ ID NO: 3564631 - DNA, 14 bp, Homo sapiens
acatttcacctact

SEQ ID NO: 3564632 - DNA, 18 bp, Homo sapiens
acatttcatacaacagaa

SEQ ID NO: 3564633 - DNA, 13 bp, Homo sapiens
acatttccaaatg

SEQ ID NO: 3564634 - DNA, 16 bp, Homo sapiens
acatttcctctgttct

SEQ ID NO: 3564635 - DNA, 20 bp, Homo sapiens
acatttctcttccccttaga

SEQ ID NO: 3564636 - DNA, 21 bp, Homo sapiens
acatttctcttccccttagaa

SEQ ID NO: 3564637 - DNA, 22 bp, Homo sapiens
acatttctcttccccttagaaa

SEQ ID NO: 3564638 - DNA, 13 bp, Homo sapiens
acatttctgattc

SEQ ID NO: 3564639 - DNA, 14 bp, Homo sapiens
acatttctgattct

SEQ ID NO: 3564640 - DNA, 16 bp, Homo sapiens
acatttcttgttgata

SEQ ID NO: 3564641 - DNA, 14 bp, Homo sapiens
acatttgtatttat

SEQ ID NO: 3564642 - DNA, 18 bp, Homo sapiens
acattttacattaaattt

SEQ ID NO: 3564643 - DNA, 18 bp, Homo sapiens
acattttagaatgtcaat

SEQ ID NO: 3564644 - DNA, 15 bp, Homo sapiens
acattttatatgtga

SEQ ID NO: 3564645 - DNA, 13 bp, Homo sapiens
acattttatgtct

SEQ ID NO: 3564646 - DNA, 14 bp, Homo sapiens
acatttttgccaaa

SEQ ID NO: 3564647 - DNA, 19 bp, Homo sapiens
acattttttcttctgaaga

SEQ ID NO: 3564648 - DNA, 14 bp, Homo sapiens
accaaaccttctga

SEQ ID NO: 3564649 - DNA, 24 bp, Homo sapiens
accaaagcatcaatacaaccagcc

SEQ ID NO: 3564650 - DNA, 15 bp, Homo sapiens
accaaatagtgattg

SEQ ID NO: 3564651 - DNA, 19 bp, Homo sapiens
accaaatagtgattgtaac

SEQ ID NO: 3564652 - DNA, 19 bp, Homo sapiens
accaaatatgttaaagttt

SEQ ID NO: 3564653 - DNA, 20 bp, Homo sapiens
accaaatctctcaaatctgt

SEQ ID NO: 3564654 - DNA, 14 bp, Homo sapiens
accaaatctgacat

SEQ ID NO: 3564655 - DNA, 18 bp, Homo sapiens
accaaatctgacatatta

SEQ ID NO: 3564656 - DNA, 17 bp, Homo sapiens
accaaattgcactgaag

SEQ ID NO: 3564657 - DNA, 14 bp, Homo sapiens
accaacacgagcag

SEQ ID NO: 3564658 - DNA, 19 bp, Homo sapiens
accaacacgagcaggctac

SEQ ID NO: 3564659 - DNA, 21 bp, Homo sapiens
accaacatctacaaaacatta

SEQ ID NO: 3564660 - DNA, 13 bp, Homo sapiens
accaacccctgac

SEQ ID NO: 3564661 - DNA, 15 bp, Homo sapiens
accaaccctcagagc

SEQ ID NO: 3564662 - DNA, 13 bp, Homo sapiens
accaacctccaga

SEQ ID NO: 3564663 - DNA, 15 bp, Homo sapiens
accaacctccagact

SEQ ID NO: 3564664 - DNA, 21 bp, Homo sapiens
accaacctccagactcagcag

SEQ ID NO: 3564665 - DNA, 23 bp, Homo sapiens
accaacctccagtgtcagggtcc

SEQ ID NO: 3564666 - DNA, 19 bp, Homo sapiens
accaacctgaagacaccgt

SEQ ID NO: 3564667 - DNA, 13 bp, Homo sapiens
accaactgcccta

SEQ ID NO: 3564668 - DNA, 21 bp, Homo sapiens
accaactgccctaagccccca

SEQ ID NO: 3564669 - DNA, 23 bp, Homo sapiens
accaagcaagtcccttcagactg

SEQ ID NO: 3564670 - DNA, 16 bp, Homo sapiens
accaaggaatttaaaa

SEQ ID NO: 3564671 - DNA, 23 bp, Homo sapiens
accaagttggaacatccttggaa

SEQ ID NO: 3564672 - DNA, 13 bp, Homo sapiens
accaatcaaatat

SEQ ID NO: 3564673 - DNA, 20 bp, Homo sapiens
accaatcttaaacataataa

SEQ ID NO: 3564674 - DNA, 14 bp, Homo sapiens
accaatgcttgcat

SEQ ID NO: 3564675 - DNA, 18 bp, Homo sapiens
accaattctggacagaca

SEQ ID NO: 3564676 - DNA, 12 bp, Homo sapiens
accacagacttt

SEQ ID NO: 3564677 - DNA, 16 bp, Homo sapiens
accacagcaactgacc

SEQ ID NO: 3564678 - DNA, 18 bp, Homo sapiens
accacagcaactgacctg

SEQ ID NO: 3564679 - DNA, 12 bp, Homo sapiens
accacagcctcc

SEQ ID NO: 3564680 - DNA, 13 bp, Homo sapiens
accacagcctcca

SEQ ID NO: 3564681 - DNA, 23 bp, Homo sapiens
accacagccttctaaattcccaa

SEQ ID NO: 3564682 - DNA, 22 bp, Homo sapiens
accacatttcctctgttctttt

SEQ ID NO: 3564683 - DNA, 15 bp, Homo sapiens
accaccgttcagtca

SEQ ID NO: 3564684 - DNA, 18 bp, Homo sapiens
accacctttggctggtag

SEQ ID NO: 3564685 - DNA, 18 bp, Homo sapiens
accacggagggagcgaca

SEQ ID NO: 3564686 - DNA, 14 bp, Homo sapiens
accagaaaagcaat

SEQ ID NO: 3564687 - DNA, 19 bp, Homo sapiens
accagaacgcaccccactg

SEQ ID NO: 3564688 - DNA, 21 bp, Homo sapiens
accagaacgtggtttgcctga

SEQ ID NO: 3564689 - DNA, 19 bp, Homo sapiens
accagaactttttcctctc

SEQ ID NO: 3564690 - DNA, 16 bp, Homo sapiens
accagacggggctgga

SEQ ID NO: 3564691 - DNA, 16 bp, Homo sapiens
accagagccgggagga

SEQ ID NO: 3564692 - DNA, 17 bp, Homo sapiens
accagagccgggaggaa

SEQ ID NO: 3564693 - DNA, 17 bp, Homo sapiens
accagcagcgcctttcc

SEQ ID NO: 3564694 - DNA, 18 bp, Homo sapiens
accagcagcgcctttccc

SEQ ID NO: 3564695 - DNA, 15 bp, Homo sapiens
accagccgtatttta

SEQ ID NO: 3564696 - DNA, 21 bp, Homo sapiens
accagcctccatgctgcctcc

SEQ ID NO: 3564697 - DNA, 12 bp, Homo sapiens
accagcctggcc

SEQ ID NO: 3564698 - DNA, 23 bp, Homo sapiens
accagcgaactctcagaaataaa

SEQ ID NO: 3564699 - DNA, 15 bp, Homo sapiens
accagctcaggacag

SEQ ID NO: 3564700 - DNA, 22 bp, Homo sapiens
accagctggcgggtgtggagac

SEQ ID NO: 3564701 - DNA, 22 bp, Homo sapiens
accagcttgtatgcaatggatt

SEQ ID NO: 3564702 - DNA, 19 bp, Homo sapiens
accagggatgctgggctgg

SEQ ID NO: 3564703 - DNA, 21 bp, Homo sapiens
accagggatgctgggctgggc

SEQ ID NO: 3564704 - DNA, 15 bp, Homo sapiens
accaggggaggagcc

SEQ ID NO: 3564705 - DNA, 19 bp, Homo sapiens
accaggggaggagcctgtg

SEQ ID NO: 3564706 - DNA, 20 bp, Homo sapiens
accaggggccaacctcaggc

SEQ ID NO: 3564707 - DNA, 17 bp, Homo sapiens
accagggtctctcaggg

SEQ ID NO: 3564708 - DNA, 11 bp, Homo sapiens
accagtattta

SEQ ID NO: 3564709 - DNA, 14 bp, Homo sapiens
accagtctcctcac

SEQ ID NO: 3564710 - DNA, 19 bp, Homo sapiens
accagtctcctcactctgt

SEQ ID NO: 3564711 - DNA, 14 bp, Homo sapiens
accagtgcctgtga

SEQ ID NO: 3564712 - DNA, 13 bp, Homo sapiens
accagtgttagct

SEQ ID NO: 3564713 - DNA, 17 bp, Homo sapiens
accagtgttcctgaagc

SEQ ID NO: 3564714 - DNA, 21 bp, Homo sapiens
accagtgttcctgaagctgct

SEQ ID NO: 3564715 - DNA, 19 bp, Homo sapiens
accagttgtatttaatttt

SEQ ID NO: 3564716 - DNA, 21 bp, Homo sapiens
accagtttaagccgcagacct

SEQ ID NO: 3564717 - DNA, 18 bp, Homo sapiens
accataaaataaataatc

SEQ ID NO: 3564718 - DNA, 15 bp, Homo sapiens
accataagagaaacc

SEQ ID NO: 3564719 - DNA, 19 bp, Homo sapiens
accatagtgttcattgata

SEQ ID NO: 3564720 - DNA, 12 bp, Homo sapiens
accatattttat

SEQ ID NO: 3564721 - DNA, 15 bp, Homo sapiens
accatcaagaaccta

SEQ ID NO: 3564722 - DNA, 15 bp, Homo sapiens
accatcatgccctct

SEQ ID NO: 3564723 - DNA, 19 bp, Homo sapiens
accatcatgccctctctcg

SEQ ID NO: 3564724 - DNA, 17 bp, Homo sapiens
accatctgctgcagtta

SEQ ID NO: 3564725 - DNA, 13 bp, Homo sapiens
accatctgctgtc

SEQ ID NO: 3564726 - DNA, 14 bp, Homo sapiens
accatctgctgtct

SEQ ID NO: 3564727 - DNA, 16 bp, Homo sapiens
accatctgtttgaaga

SEQ ID NO: 3564728 - DNA, 23 bp, Homo sapiens
accatgcactcacccctagccct

SEQ ID NO: 3564729 - DNA, 15 bp, Homo sapiens
accatgcaggaagga

SEQ ID NO: 3564730 - DNA, 17 bp, Homo sapiens
accatgcaggaaggaaa

SEQ ID NO: 3564731 - DNA, 20 bp, Homo sapiens
accatgcgtcaggggcctag

SEQ ID NO: 3564732 - DNA, 18 bp, Homo sapiens
accatgctgctggggaag

SEQ ID NO: 3564733 - DNA, 23 bp, Homo sapiens
accatgctgctggggaagacagt

SEQ ID NO: 3564734 - DNA, 12 bp, Homo sapiens
acagctggctgg

SEQ ID NO: 3564735 - DNA, 19 bp, Homo sapiens
acagctggctgggccttca

SEQ ID NO: 3564736 - DNA, 13 bp, Homo sapiens
acagctgggctgt

SEQ ID NO: 3564737 - DNA, 12 bp, Homo sapiens
acagctgtgctc

SEQ ID NO: 3564738 - DNA, 15 bp, Homo sapiens
acagctgtgctccac

SEQ ID NO: 3564739 - DNA, 23 bp, Homo sapiens
acagctgttcagttgcacttcta

SEQ ID NO: 3564740 - DNA, 17 bp, Homo sapiens
acagcttacaggagcca

SEQ ID NO: 3564741 - DNA, 13 bp, Homo sapiens
acagcttcctcac

SEQ ID NO: 3564742 - DNA, 11 bp, Homo sapiens
acagcttctct

SEQ ID NO: 3564743 - DNA, 15 bp, Homo sapiens
acagcttctctgcag

SEQ ID NO: 3564744 - DNA, 16 bp, Homo sapiens
acagcttctctgcagt

SEQ ID NO: 3564745 - DNA, 21 bp, Homo sapiens
acagctttgctgctgaaggct

SEQ ID NO: 3564746 - DNA, 12 bp, Homo sapiens
acagctttgtct

SEQ ID NO: 3564747 - DNA, 19 bp, Homo sapiens
acagctttgtctccaaaga

SEQ ID NO: 3564748 - DNA, 21 bp, Homo sapiens
acagctttgtctccaaagaag

SEQ ID NO: 3564749 - DNA, 21 bp, Homo sapiens
acaggacagttgatggagccc

SEQ ID NO: 3564750 - DNA, 17 bp, Homo sapiens
acaggaccctcaggaat

SEQ ID NO: 3564751 - DNA, 14 bp, Homo sapiens
acaggactctgcct

SEQ ID NO: 3564752 - DNA, 18 bp, Homo sapiens
acaggagacaaaagagca

SEQ ID NO: 3564753 - DNA, 14 bp, Homo sapiens
acaggagcctagcg

SEQ ID NO: 3564754 - DNA, 23 bp, Homo sapiens
acaggattgatcattcttttata

SEQ ID NO: 3564755 - DNA, 19 bp, Homo sapiens
acaggcaaaatccttgctt

SEQ ID NO: 3564756 - DNA, 12 bp, Homo sapiens
acaggcactcca

SEQ ID NO: 3564757 - DNA, 21 bp, Homo sapiens
acaggcactccaaacctgtct

SEQ ID NO: 3564758 - DNA, 23 bp, Homo sapiens
acaggccctccctgttccccaga

SEQ ID NO: 3564759 - DNA, 15 bp, Homo sapiens
acaggcccttcctct

SEQ ID NO: 3564760 - DNA, 22 bp, Homo sapiens
acaggcccttcctctccactgc

SEQ ID NO: 3564761 - DNA, 15 bp, Homo sapiens
acaggcgtgagccac

SEQ ID NO: 3564762 - DNA, 23 bp, Homo sapiens
acaggctcgtcagccacctggga

SEQ ID NO: 3564763 - DNA, 22 bp, Homo sapiens
acaggctgaaatatccacccag

SEQ ID NO: 3564764 - DNA, 14 bp, Homo sapiens
acaggctgaagaga

SEQ ID NO: 3564765 - DNA, 16 bp, Homo sapiens
acaggcttagggacag

SEQ ID NO: 3564766 - DNA, 17 bp, Homo sapiens
acagggaatggccacaa

SEQ ID NO: 3564767 - DNA, 21 bp, Homo sapiens
acagggcagtccttactcccc

SEQ ID NO: 3564768 - DNA, 23 bp, Homo sapiens
acagggcagtccttactccccca

SEQ ID NO: 3564769 - DNA, 17 bp, Homo sapiens
acaggggtagtttgttt

SEQ ID NO: 3564770 - DNA, 15 bp, Homo sapiens
acagggtacctcaag

SEQ ID NO: 3564771 - DNA, 15 bp, Homo sapiens
acaggtaactaattg

SEQ ID NO: 3564772 - DNA, 21 bp, Homo sapiens
acaggtctttcctaaggctgc

SEQ ID NO: 3564773 - DNA, 15 bp, Homo sapiens
acaggtgggcctggg

SEQ ID NO: 3564774 - DNA, 13 bp, Homo sapiens
acaggttttcaga

SEQ ID NO: 3564775 - DNA, 14 bp, Homo sapiens
acaggttttcagag

SEQ ID NO: 3564776 - DNA, 17 bp, Homo sapiens
acagtacctgattgtat

SEQ ID NO: 3564777 - DNA, 14 bp, Homo sapiens
acagtatataagct

SEQ ID NO: 3564778 - DNA, 18 bp, Homo sapiens
acagtatataagcttttt

SEQ ID NO: 3564779 - DNA, 20 bp, Homo sapiens
acagtatctgctgttcttca

SEQ ID NO: 3564780 - DNA, 22 bp, Homo sapiens
acagtatctgctgttcttcagt

SEQ ID NO: 3564781 - DNA, 17 bp, Homo sapiens
acagtccacaggggcca

SEQ ID NO: 3564782 - DNA, 22 bp, Homo sapiens
acagtccacaggggccaccacc

SEQ ID NO: 3564783 - DNA, 22 bp, Homo sapiens
acagtcctttcccaccattcct

SEQ ID NO: 3564784 - DNA, 18 bp, Homo sapiens
acagtcttatcaactggt

SEQ ID NO: 3564785 - DNA, 19 bp, Homo sapiens
acagtgactccctgggagc

SEQ ID NO: 3564786 - DNA, 12 bp, Homo sapiens
acagtgagcctg

SEQ ID NO: 3564787 - DNA, 18 bp, Homo sapiens
acagtgagcctgaatttt

SEQ ID NO: 3564788 - DNA, 21 bp, Homo sapiens
acagtgagcctgaattttgtt

SEQ ID NO: 3564789 - DNA, 15 bp, Homo sapiens
acagtgcatctcagc

SEQ ID NO: 3564790 - DNA, 18 bp, Homo sapiens
acagtgcatctcagccca

SEQ ID NO: 3564791 - DNA, 14 bp, Homo sapiens
acagtgggagctga

SEQ ID NO: 3564792 - DNA, 17 bp, Homo sapiens
acagtgggagctgagct

SEQ ID NO: 3564793 - DNA, 23 bp, Homo sapiens
acagtgggagctgagctggaagg

SEQ ID NO: 3564794 - DNA, 16 bp, Homo sapiens
acagtggttgcctggg

SEQ ID NO: 3564795 - DNA, 21 bp, Homo sapiens
acagtgtgtggtcaacatttc

SEQ ID NO: 3564796 - DNA, 22 bp, Homo sapiens
acagtgtgtggtcaacatttct

SEQ ID NO: 3564797 - DNA, 12 bp, Homo sapiens
acagttcaagaa

SEQ ID NO: 3564798 - DNA, 20 bp, Homo sapiens
acagttcaagaaagcttcaa

SEQ ID NO: 3564799 - DNA, 20 bp, Homo sapiens
acagttctttgggccagaca

SEQ ID NO: 3564800 - DNA, 15 bp, Homo sapiens
acagttgatggagcc

SEQ ID NO: 3564801 - DNA, 17 bp, Homo sapiens
acagttgatggagcccc

SEQ ID NO: 3564802 - DNA, 14 bp, Homo sapiens
acagttggtaactt

SEQ ID NO: 3564803 - DNA, 14 bp, Homo sapiens
acataaaagaaata

SEQ ID NO: 3564804 - DNA, 15 bp, Homo sapiens
acataaaagaaataa

SEQ ID NO: 3564805 - DNA, 17 bp, Homo sapiens
acataaaagaaataaac

SEQ ID NO: 3564806 - DNA, 18 bp, Homo sapiens
acataaaagccccagctt

SEQ ID NO: 3564807 - DNA, 23 bp, Homo sapiens
acataagtaacttttaaaatttg

SEQ ID NO: 3564808 - DNA, 19 bp, Homo sapiens
acataagtttaggataaaa

SEQ ID NO: 3564809 - DNA, 21 bp, Homo sapiens
acataataaatcacacattca

SEQ ID NO: 3564810 - DNA, 19 bp, Homo sapiens
acataatgaaaatattttt

SEQ ID NO: 3564811 - DNA, 17 bp, Homo sapiens
acataatggggtcctgg

SEQ ID NO: 3564812 - DNA, 21 bp, Homo sapiens
acatacaaaaattagccgggc

SEQ ID NO: 3564813 - DNA, 13 bp, Homo sapiens
acatacagagtgg

SEQ ID NO: 3564814 - DNA, 15 bp, Homo sapiens
acatactgctggagt

SEQ ID NO: 3564815 - DNA, 16 bp, Homo sapiens
acatactgctggagtc

SEQ ID NO: 3564816 - DNA, 15 bp, Homo sapiens
acatacttgaagggc

SEQ ID NO: 3564817 - DNA, 17 bp, Homo sapiens
acatacttgaagggcca

SEQ ID NO: 3564818 - DNA, 19 bp, Homo sapiens
acatacttgaagggccaga

SEQ ID NO: 3564819 - DNA, 22 bp, Homo sapiens
acatacttgaagggccagagcc

SEQ ID NO: 3564820 - DNA, 21 bp, Homo sapiens
acataggaagttaaaagcaca

SEQ ID NO: 3564821 - DNA, 21 bp, Homo sapiens
acatagtgatggttcccctgt

SEQ ID NO: 3564822 - DNA, 15 bp, Homo sapiens
acatagttatttatt

SEQ ID NO: 3564823 - DNA, 16 bp, Homo sapiens
acatatattatttatt

SEQ ID NO: 3564824 - DNA, 21 bp, Homo sapiens
acatatatttttaaaaaatga

SEQ ID NO: 3564825 - DNA, 22 bp, Homo sapiens
acatatatttttaaaaaatgaa

SEQ ID NO: 3564826 - DNA, 21 bp, Homo sapiens
acatatgtgctggaattctaa

SEQ ID NO: 3564827 - DNA, 17 bp, Homo sapiens
acatattatgcctgaat

SEQ ID NO: 3564828 - DNA, 19 bp, Homo sapiens
acatcaaataaatttctgg

SEQ ID NO: 3564829 - DNA, 15 bp, Homo sapiens
acatcacttgtacaa

SEQ ID NO: 3564830 - DNA, 19 bp, Homo sapiens
acatcacttgtacaaaata

SEQ ID NO: 3564831 - DNA, 17 bp, Homo sapiens
acatcagccccacagga

SEQ ID NO: 3564832 - DNA, 22 bp, Homo sapiens
acatcagctggtcaaacaaact

SEQ ID NO: 3564833 - DNA, 18 bp, Homo sapiens
acatccatcagcacccca

SEQ ID NO: 3564834 - DNA, 13 bp, Homo sapiens
acatcccttcctg

SEQ ID NO: 3564835 - DNA, 14 bp, Homo sapiens
acatcccttcctgg

SEQ ID NO: 3564836 - DNA, 17 bp, Homo sapiens
acatcccttcctggaaa

SEQ ID NO: 3564837 - DNA, 20 bp, Homo sapiens
acatcccttcctggaaacag

SEQ ID NO: 3564838 - DNA, 23 bp, Homo sapiens
acatcccttcctggaaacagcat

SEQ ID NO: 3564839 - DNA, 18 bp, Homo sapiens
acatcctaagacagagga

SEQ ID NO: 3564840 - DNA, 18 bp, Homo sapiens
acatccttctcactgcca

SEQ ID NO: 3564841 - DNA, 20 bp, Homo sapiens
acatccttgattacttccac

SEQ ID NO: 3564842 - DNA, 15 bp, Homo sapiens
acatcgcacagttta

SEQ ID NO: 3564843 - DNA, 15 bp, Homo sapiens
acatctaagcctgaa

SEQ ID NO: 3564844 - DNA, 21 bp, Homo sapiens
acatctaagcctgaaggggcg

SEQ ID NO: 3564845 - DNA, 16 bp, Homo sapiens
acatctacaaaacatt

SEQ ID NO: 3564846 - DNA, 18 bp, Homo sapiens
acatctggctgcacaggc

SEQ ID NO: 3564847 - DNA, 20 bp, Homo sapiens
acatctggctgcacaggctg

SEQ ID NO: 3564848 - DNA, 22 bp, Homo sapiens
acatctgttatcaaactgctgt

SEQ ID NO: 3564849 - DNA, 14 bp, Homo sapiens
acatgaaaagttat

SEQ ID NO: 3564850 - DNA, 13 bp, Homo sapiens
acatgaaatatat

SEQ ID NO: 3564851 - DNA, 18 bp, Homo sapiens
acatgaaatatattttct

SEQ ID NO: 3564852 - DNA, 23 bp, Homo sapiens
acatgaagcaattagtctgaaac

SEQ ID NO: 3564853 - DNA, 19 bp, Homo sapiens
acatgacagatattttatc

SEQ ID NO: 3564854 - DNA, 19 bp, Homo sapiens
acatgaggccatctcagga

SEQ ID NO: 3564855 - DNA, 21 bp, Homo sapiens
acatgaggccatctcaggaga

SEQ ID NO: 3564856 - DNA, 22 bp, Homo sapiens
acatgaggccatctcaggagat

SEQ ID NO: 3564857 - DNA, 18 bp, Homo sapiens
acatgagtcaaaacaaag

SEQ ID NO: 3564858 - DNA, 18 bp, Homo sapiens
acatgatccccgtctctg

SEQ ID NO: 3564859 - DNA, 18 bp, Homo sapiens
acatgcactcagctcttg

SEQ ID NO: 3564860 - DNA, 20 bp, Homo sapiens
acatgcagaaattgacctga

SEQ ID NO: 3564861 - DNA, 18 bp, Homo sapiens
acatgcatataatgaata

SEQ ID NO: 3564862 - DNA, 15 bp, Homo sapiens
acatgccacctggca

SEQ ID NO: 3564863 - DNA, 14 bp, Homo sapiens
acatgctgcctggc

SEQ ID NO: 3564864 - DNA, 22 bp, Homo sapiens
acatgctgcctggcacagacca

SEQ ID NO: 3564865 - DNA, 21 bp, Homo sapiens
acatgctgtatatgcaatgtc

SEQ ID NO: 3564866 - DNA, 15 bp, Homo sapiens
acatgctgtctggcc

SEQ ID NO: 3564867 - DNA, 18 bp, Homo sapiens
acatgctgtctggccctg

SEQ ID NO: 3564868 - DNA, 19 bp, Homo sapiens
acatgctgtctggccctgg

SEQ ID NO: 3564869 - DNA, 16 bp, Homo sapiens
acacactggtacttag

SEQ ID NO: 3564870 - DNA, 17 bp, Homo sapiens
acacactgtgccccaca

SEQ ID NO: 3564871 - DNA, 11 bp, Homo sapiens
acacagctctt

SEQ ID NO: 3564872 - DNA, 12 bp, Homo sapiens
acacagctcttc

SEQ ID NO: 3564873 - DNA, 22 bp, Homo sapiens
acacagctcttccagggcagcg

SEQ ID NO: 3564874 - DNA, 14 bp, Homo sapiens
acacagctgagcac

SEQ ID NO: 3564875 - DNA, 11 bp, Homo sapiens
acacagctgcc

SEQ ID NO: 3564876 - DNA, 16 bp, Homo sapiens
acacaggccctccctg

SEQ ID NO: 3564877 - DNA, 19 bp, Homo sapiens
acacaggtctcattgcttc

SEQ ID NO: 3564878 - DNA, 14 bp, Homo sapiens
acacaggtctttcc

SEQ ID NO: 3564879 - DNA, 19 bp, Homo sapiens
acacagtcttggctcactg

SEQ ID NO: 3564880 - DNA, 22 bp, Homo sapiens
acacagtgctgaccagacagcc

SEQ ID NO: 3564881 - DNA, 18 bp, Homo sapiens
acacatagtggcttctcc

SEQ ID NO: 3564882 - DNA, 15 bp, Homo sapiens
acacatatataggca

SEQ ID NO: 3564883 - DNA, 18 bp, Homo sapiens
acacattacaaagttaaa

SEQ ID NO: 3564884 - DNA, 23 bp, Homo sapiens
acacatttccattcatggatatt

SEQ ID NO: 3564885 - DNA, 23 bp, Homo sapiens
acacatttgggatgttccttttt

SEQ ID NO: 3564886 - DNA, 14 bp, Homo sapiens
acaccaacccctga

SEQ ID NO: 3564887 - DNA, 18 bp, Homo sapiens
acaccaacccctgaccta

SEQ ID NO: 3564888 - DNA, 16 bp, Homo sapiens
acaccaagctcaccct

SEQ ID NO: 3564889 - DNA, 17 bp, Homo sapiens
acaccaagctcaccctt

SEQ ID NO: 3564890 - DNA, 20 bp, Homo sapiens
acaccattttgtaaatgaaa

SEQ ID NO: 3564891 - DNA, 13 bp, Homo sapiens
acacccatttaaa

SEQ ID NO: 3564892 - DNA, 22 bp, Homo sapiens
acaccccctccccgcccctgtg

SEQ ID NO: 3564893 - DNA, 18 bp, Homo sapiens
acaccctggatgctgttg

SEQ ID NO: 3564894 - DNA, 13 bp, Homo sapiens
acaccctggcctg

SEQ ID NO: 3564895 - DNA, 15 bp, Homo sapiens
acaccgagggcgacc

SEQ ID NO: 3564896 - DNA, 14 bp, Homo sapiens
acaccgggcctgga

SEQ ID NO: 3564897 - DNA, 22 bp, Homo sapiens
acaccgtggcagcttgctgggc

SEQ ID NO: 3564898 - DNA, 22 bp, Homo sapiens
acacctcctcccactgcccact

SEQ ID NO: 3564899 - DNA, 19 bp, Homo sapiens
acaccttggggtccctcca

SEQ ID NO: 3564900 - DNA, 22 bp, Homo sapiens
acacctttctcctttgtacttt

SEQ ID NO: 3564901 - DNA, 19 bp, Homo sapiens
acacgagcaggctactgtc

SEQ ID NO: 3564902 - DNA, 23 bp, Homo sapiens
acacgcactctccccgctcaggg

SEQ ID NO: 3564903 - DNA, 22 bp, Homo sapiens
acacgctgctctgccccagctt

SEQ ID NO: 3564904 - DNA, 19 bp, Homo sapiens
acacggatctgctgggctc

SEQ ID NO: 3564905 - DNA, 17 bp, Homo sapiens
acacggggctcgggcct

SEQ ID NO: 3564906 - DNA, 23 bp, Homo sapiens
acacgtggcctcgtgaggggcaa

SEQ ID NO: 3564907 - DNA, 14 bp, Homo sapiens
acactaaaaataaa

SEQ ID NO: 3564908 - DNA, 13 bp, Homo sapiens
acactaaacattc

SEQ ID NO: 3564909 - DNA, 18 bp, Homo sapiens
acactaaattgcagttta

SEQ ID NO: 3564910 - DNA, 17 bp, Homo sapiens
acactcaaatcaagaaa

SEQ ID NO: 3564911 - DNA, 19 bp, Homo sapiens
acactcaaatcaagaaact

SEQ ID NO: 3564912 - DNA, 22 bp, Homo sapiens
acactcagaaaattccctgggg

SEQ ID NO: 3564913 - DNA, 23 bp, Homo sapiens
acactcagaaaattccctggggt

SEQ ID NO: 3564914 - DNA, 18 bp, Homo sapiens
acactcatattgccctaa

SEQ ID NO: 3564915 - DNA, 23 bp, Homo sapiens
acactcatattgccctaattaaa

SEQ ID NO: 3564916 - DNA, 13 bp, Homo sapiens
acactcttcagtg

SEQ ID NO: 3564917 - DNA, 22 bp, Homo sapiens
acactcttcagtgactcctgct

SEQ ID NO: 3564918 - DNA, 23 bp, Homo sapiens
acactcttcagtgactcctgctg

SEQ ID NO: 3564919 - DNA, 22 bp, Homo sapiens
acactgaaatgaaatcttccca

SEQ ID NO: 3564920 - DNA, 23 bp, Homo sapiens
acactgatgcaaggattacagaa

SEQ ID NO: 3564921 - DNA, 13 bp, Homo sapiens
acactgattttgt

SEQ ID NO: 3564922 - DNA, 11 bp, Homo sapiens
acactgcttgg

SEQ ID NO: 3564923 - DNA, 21 bp, Homo sapiens
acactggatccatcttgagcc

SEQ ID NO: 3564924 - DNA, 20 bp, Homo sapiens
acactggcgtctggactgtt

SEQ ID NO: 3564925 - DNA, 23 bp, Homo sapiens
acactggcgtctggactgttctg

SEQ ID NO: 3564926 - DNA, 14 bp, Homo sapiens
acactgggaaacag

SEQ ID NO: 3564927 - DNA, 16 bp, Homo sapiens
acactggtaaatgtta

SEQ ID NO: 3564928 - DNA, 17 bp, Homo sapiens
acactggtatttatatt

SEQ ID NO: 3564929 - DNA, 19 bp, Homo sapiens
acactgtaagctttgttct

SEQ ID NO: 3564930 - DNA, 15 bp, Homo sapiens
acactgtgccccaca

SEQ ID NO: 3564931 - DNA, 12 bp, Homo sapiens
acactgtggcca

SEQ ID NO: 3564932 - DNA, 17 bp, Homo sapiens
acactgtggccaggcct

SEQ ID NO: 3564933 - DNA, 23 bp, Homo sapiens
acactttgagcatttttaaggga

SEQ ID NO: 3564934 - DNA, 17 bp, Homo sapiens
acactttgccaaggctc

SEQ ID NO: 3564935 - DNA, 20 bp, Homo sapiens
acactttgccaaggctctcc

SEQ ID NO: 3564936 - DNA, 22 bp, Homo sapiens
acactttgccatttgcttgtac

SEQ ID NO: 3564937 - DNA, 16 bp, Homo sapiens
acagaaaaataagtca

SEQ ID NO: 3564938 - DNA, 23 bp, Homo sapiens
acagaaaaataagtcaaaaggaa

SEQ ID NO: 3564939 - DNA, 17 bp, Homo sapiens
acagaaacaaaaacact

SEQ ID NO: 3564940 - DNA, 16 bp, Homo sapiens
acagaaaccagaaaag

SEQ ID NO: 3564941 - DNA, 19 bp, Homo sapiens
acagaaaccttttattttt

SEQ ID NO: 3564942 - DNA, 19 bp, Homo sapiens
acagaactcggtgtcccca

SEQ ID NO: 3564943 - DNA, 21 bp, Homo sapiens
acagacactcccacttggcat

SEQ ID NO: 3564944 - DNA, 13 bp, Homo sapiens
acagacagcttac

SEQ ID NO: 3564945 - DNA, 14 bp, Homo sapiens
acagaccacttgcc

SEQ ID NO: 3564946 - DNA, 14 bp, Homo sapiens
acagacccctggga

SEQ ID NO: 3564947 - DNA, 16 bp, Homo sapiens
acagacctcagtttta

SEQ ID NO: 3564948 - DNA, 20 bp, Homo sapiens
acagactcaaatgctcagac

SEQ ID NO: 3564949 - DNA, 23 bp, Homo sapiens
acagactgcgatttgtcccaggt

SEQ ID NO: 3564950 - DNA, 14 bp, Homo sapiens
acagacttgtatat

SEQ ID NO: 3564951 - DNA, 20 bp, Homo sapiens
acagagaggggcagggaagg

SEQ ID NO: 3564952 - DNA, 12 bp, Homo sapiens
acagagcacttg

SEQ ID NO: 3564953 - DNA, 19 bp, Homo sapiens
acagagtccaatttaagga

SEQ ID NO: 3564954 - DNA, 13 bp, Homo sapiens
acagataaaatgt

SEQ ID NO: 3564955 - DNA, 19 bp, Homo sapiens
acagatattgttataaata

SEQ ID NO: 3564956 - DNA, 14 bp, Homo sapiens
acagatattttatc

SEQ ID NO: 3564957 - DNA, 12 bp, Homo sapiens
acagatctggaa

SEQ ID NO: 3564958 - DNA, 15 bp, Homo sapiens
acagatgcatataga

SEQ ID NO: 3564959 - DNA, 18 bp, Homo sapiens
acagatgccacacaagga

SEQ ID NO: 3564960 - DNA, 20 bp, Homo sapiens
acagatgccatatagtgtta

SEQ ID NO: 3564961 - DNA, 15 bp, Homo sapiens
acagattcaggccag

SEQ ID NO: 3564962 - DNA, 19 bp, Homo sapiens
acagattcaggccagccca

SEQ ID NO: 3564963 - DNA, 14 bp, Homo sapiens
acagatttggaaag

SEQ ID NO: 3564964 - DNA, 21 bp, Homo sapiens
acagatttggaaagactggac

SEQ ID NO: 3564965 - DNA, 13 bp, Homo sapiens
acagcaactgacc

SEQ ID NO: 3564966 - DNA, 15 bp, Homo sapiens
acagcaactgacctg

SEQ ID NO: 3564967 - DNA, 21 bp, Homo sapiens
acagcaattcatggttcaagt

SEQ ID NO: 3564968 - DNA, 19 bp, Homo sapiens
acagcagccccaggagaag

SEQ ID NO: 3564969 - DNA, 14 bp, Homo sapiens
acagcagtctcctt

SEQ ID NO: 3564970 - DNA, 22 bp, Homo sapiens
acagcagttgaaaagactccaa

SEQ ID NO: 3564971 - DNA, 18 bp, Homo sapiens
acagcatcgggagcaccc

SEQ ID NO: 3564972 - DNA, 13 bp, Homo sapiens
acagcatgaataa

SEQ ID NO: 3564973 - DNA, 15 bp, Homo sapiens
acagcattgtgtgga

SEQ ID NO: 3564974 - DNA, 16 bp, Homo sapiens
acagcattgtgtggaa

SEQ ID NO: 3564975 - DNA, 18 bp, Homo sapiens
acagccaagtgccaaatg

SEQ ID NO: 3564976 - DNA, 16 bp, Homo sapiens
acagccagactggcac

SEQ ID NO: 3564977 - DNA, 14 bp, Homo sapiens
acagccattttcca

SEQ ID NO: 3564978 - DNA, 12 bp, Homo sapiens
acagccccaccc

SEQ ID NO: 3564979 - DNA, 13 bp, Homo sapiens
acagccccaccct

SEQ ID NO: 3564980 - DNA, 14 bp, Homo sapiens
acagccccaccctg

SEQ ID NO: 3564981 - DNA, 18 bp, Homo sapiens
acagccctatttcttgat

SEQ ID NO: 3564982 - DNA, 15 bp, Homo sapiens
acagccgccggaagt

SEQ ID NO: 3564983 - DNA, 18 bp, Homo sapiens
acagcctatagtaaatgt

SEQ ID NO: 3564984 - DNA, 19 bp, Homo sapiens
acagcctatagtaaatgtg

SEQ ID NO: 3564985 - DNA, 15 bp, Homo sapiens
acagccttccccagc

SEQ ID NO: 3564986 - DNA, 17 bp, Homo sapiens
acagccttcttgatgta

SEQ ID NO: 3564987 - DNA, 12 bp, Homo sapiens
acagccttgcaa

SEQ ID NO: 3564988 - DNA, 21 bp, Homo sapiens
acagccttgcaacccaaggtg

SEQ ID NO: 3564989 - DNA, 22 bp, Homo sapiens
acagccttgcaacccaaggtga

SEQ ID NO: 3564990 - DNA, 19 bp, Homo sapiens
acagccttgcagcggctcc

SEQ ID NO: 3564991 - DNA, 23 bp, Homo sapiens
acagccttgcagcggctcctgca

SEQ ID NO: 3564992 - DNA, 15 bp, Homo sapiens
acagcgaacagcctt

SEQ ID NO: 3564993 - DNA, 19 bp, Homo sapiens
acagcgaacagccttagag

SEQ ID NO: 3564994 - DNA, 19 bp, Homo sapiens
acagctacaaccctaccct

SEQ ID NO: 3564995 - DNA, 21 bp, Homo sapiens
acagctacaaccctaccctgg

SEQ ID NO: 3564996 - DNA, 22 bp, Homo sapiens
acagctacaaccctaccctggc

SEQ ID NO: 3564997 - DNA, 22 bp, Homo sapiens
acagctactcagtggggctggc

SEQ ID NO: 3564998 - DNA, 13 bp, Homo sapiens
acagctatttaga

SEQ ID NO: 3564999 - DNA, 14 bp, Homo sapiens
acagctgagcactt

SEQ ID NO: 3565000 - DNA, 17 bp, Homo sapiens
acagctgataaatttaa

SEQ ID NO: 3565001 - DNA, 15 bp, Homo sapiens
acagctgccctagct

SEQ ID NO: 3565002 - DNA, 20 bp, Homo sapiens
acagctgctcctagagggag

SEQ ID NO: 3565003 - DNA, 21 bp, Homo sapiens
acagctggcggaggctgctcg

SEQ ID NO: 3565004 - DNA, 24 bp, Homo sapiens
acagctggcggaggctgctcggct

SEQ ID NO: 3565005 - DNA, 13 bp, Homo sapiens
ataaatgtacatt

SEQ ID NO: 3565006 - DNA, 15 bp, Homo sapiens
ataaatgtacatttc

SEQ ID NO: 3565007 - DNA, 13 bp, Homo sapiens
ataaatgtatcat

SEQ ID NO: 3565008 - DNA, 17 bp, Homo sapiens
cccacactgtggccagg

SEQ ID NO: 3565009 - DNA, 18 bp, Homo sapiens
cccacagcttcctgaggg

SEQ ID NO: 3565010 - DNA, 19 bp, Homo sapiens
cccacagcttcctgagggc

SEQ ID NO: 3565011 - DNA, 16 bp, Homo sapiens
cccacaggcccttcct

SEQ ID NO: 3565012 - DNA, 18 bp, Homo sapiens
cccacaggcccttcctct

SEQ ID NO: 3565013 - DNA, 18 bp, Homo sapiens
cccacataaaagccccag

SEQ ID NO: 3565014 - DNA, 19 bp, Homo sapiens
cccacatagtgatggttcc

SEQ ID NO: 3565015 - DNA, 20 bp, Homo sapiens
cccacatgaggccatctcag

SEQ ID NO: 3565016 - DNA, 12 bp, Homo sapiens
cccacatgccag

SEQ ID NO: 3565017 - DNA, 16 bp, Homo sapiens
cccaccaacctccagt

SEQ ID NO: 3565018 - DNA, 12 bp, Homo sapiens
cccaccactccc

SEQ ID NO: 3565019 - DNA, 21 bp, Homo sapiens
cccaccagaacgcaccccact

SEQ ID NO: 3565020 - DNA, 12 bp, Homo sapiens
cccaccatctgc

SEQ ID NO: 3565021 - DNA, 14 bp, Homo sapiens
cccaccatctgctg

SEQ ID NO: 3565022 - DNA, 17 bp, Homo sapiens
cccaccatctgctgtct

SEQ ID NO: 3565023 - DNA, 18 bp, Homo sapiens
cccaccattcctgccttt

SEQ ID NO: 3565024 - DNA, 23 bp, Homo sapiens
cccaccccactcaggggacccca

SEQ ID NO: 3565025 - DNA, 18 bp, Homo sapiens
cccaccccatccagccag

SEQ ID NO: 3565026 - DNA, 15 bp, Homo sapiens
cccaccccctctgga

SEQ ID NO: 3565027 - DNA, 12 bp, Homo sapiens
cccacccctggg

SEQ ID NO: 3565028 - DNA, 23 bp, Homo sapiens
cccaccccttggaggagagagac

SEQ ID NO: 3565029 - DNA, 14 bp, Homo sapiens
cccaccctccggcg

SEQ ID NO: 3565030 - DNA, 21 bp, Homo sapiens
cccaccctccggcgggtgaca

SEQ ID NO: 3565031 - DNA, 13 bp, Homo sapiens
cccaccggccagg

SEQ ID NO: 3565032 - DNA, 11 bp, Homo sapiens
cccacctccac

SEQ ID NO: 3565033 - DNA, 16 bp, Homo sapiens
cccacctctcctgccc

SEQ ID NO: 3565034 - DNA, 18 bp, Homo sapiens
cccacctgacacaccagg

SEQ ID NO: 3565035 - DNA, 22 bp, Homo sapiens
cccacgagggtctcccctcctg

SEQ ID NO: 3565036 - DNA, 17 bp, Homo sapiens
cccacgagggtgccgtg

SEQ ID NO: 3565037 - DNA, 24 bp, Homo sapiens
cccacgctgaccatgcgtcagggg

SEQ ID NO: 3565038 - DNA, 12 bp, Homo sapiens
cccactccagct

SEQ ID NO: 3565039 - DNA, 24 bp, Homo sapiens
cccactcccccgtttctccttttc

SEQ ID NO: 3565040 - DNA, 19 bp, Homo sapiens
cccactctgggcaaagccc

SEQ ID NO: 3565041 - DNA, 20 bp, Homo sapiens
ccagtggcgttgttgcatgt

SEQ ID NO: 3565042 - DNA, 15 bp, Homo sapiens
ccagtggtgggtaat

SEQ ID NO: 3565043 - DNA, 16 bp, Homo sapiens
ccagtggtgggtaatt

SEQ ID NO: 3565044 - DNA, 22 bp, Homo sapiens
ccagtggtgggtaattgtacaa

SEQ ID NO: 3565045 - DNA, 15 bp, Homo sapiens
ccagtgtcccctttc

SEQ ID NO: 3565046 - DNA, 23 bp, Homo sapiens
ccagtgtctaggcactgagcagg

SEQ ID NO: 3565047 - DNA, 23 bp, Homo sapiens
ccagtgttatttattccccagtg

SEQ ID NO: 3565048 - DNA, 17 bp, Homo sapiens
ccagtgttcctgaagct

SEQ ID NO: 3565049 - DNA, 14 bp, Homo sapiens
ccagttacttgggc

SEQ ID NO: 3565050 - DNA, 15 bp, Homo sapiens
ccagttttccctgga

SEQ ID NO: 3565051 - DNA, 15 bp, Homo sapiens
ccagttttgcctgag

SEQ ID NO: 3565052 - DNA, 13 bp, Homo sapiens
ccataaaataaat

SEQ ID NO: 3565053 - DNA, 17 bp, Homo sapiens
ccataaaatgatcctgc

SEQ ID NO: 3565054 - DNA, 21 bp, Homo sapiens
ccataaagacaatcactgcca

SEQ ID NO: 3565055 - DNA, 15 bp, Homo sapiens
ccataagagaaacct

SEQ ID NO: 3565056 - DNA, 20 bp, Homo sapiens
ccataagagaaacctgccaa

SEQ ID NO: 3565057 - DNA, 14 bp, Homo sapiens
ccataatctggact

SEQ ID NO: 3565058 - DNA, 12 bp, Homo sapiens
ccatacacacgc

SEQ ID NO: 3565059 - DNA, 18 bp, Homo sapiens
ccatacacacgctgcctt

SEQ ID NO: 3565060 - DNA, 20 bp, Homo sapiens
ccatacacacgctgccttcg

SEQ ID NO: 3565061 - DNA, 15 bp, Homo sapiens
ccataccttttctct

SEQ ID NO: 3565062 - DNA, 17 bp, Homo sapiens
ccatactccactccaag

SEQ ID NO: 3565063 - DNA, 16 bp, Homo sapiens
ccatatataaattatt

SEQ ID NO: 3565064 - DNA, 21 bp, Homo sapiens
ccatcaactcccaacttcttc

SEQ ID NO: 3565065 - DNA, 23 bp, Homo sapiens
ccatcaactcccaacttcttcct

SEQ ID NO: 3565066 - DNA, 20 bp, Homo sapiens
ccatcaagaacctacagact

SEQ ID NO: 3565067 - DNA, 14 bp, Homo sapiens
ccatcagcacccca

SEQ ID NO: 3565068 - DNA, 20 bp, Homo sapiens
ccatcagcctgttccagaag

SEQ ID NO: 3565069 - DNA, 13 bp, Homo sapiens
ccatcatttctgt

SEQ ID NO: 3565070 - DNA, 20 bp, Homo sapiens
ccatccagccagaccccacg

SEQ ID NO: 3565071 - DNA, 20 bp, Homo sapiens
ccatcccactgctcccccaa

SEQ ID NO: 3565072 - DNA, 15 bp, Homo sapiens
ccatccccaccttca

SEQ ID NO: 3565073 - DNA, 19 bp, Homo sapiens
ccatcccctccctgcctgc

SEQ ID NO: 3565074 - DNA, 15 bp, Homo sapiens
ccatccctgcctgga

SEQ ID NO: 3565075 - DNA, 16 bp, Homo sapiens
ccatccgactgcccct

SEQ ID NO: 3565076 - DNA, 20 bp, Homo sapiens
ccatccgactgcccctgctg

SEQ ID NO: 3565077 - DNA, 21 bp, Homo sapiens
ccatcctaggaaccagccaac

SEQ ID NO: 3565078 - DNA, 15 bp, Homo sapiens
ccatcctccagcagg

SEQ ID NO: 3565079 - DNA, 21 bp, Homo sapiens
ccatcctgcagatactttgaa

SEQ ID NO: 3565080 - DNA, 16 bp, Homo sapiens
ccatcctggggcagca

SEQ ID NO: 3565081 - DNA, 15 bp, Homo sapiens
cccctcggagaagag

SEQ ID NO: 3565082 - DNA, 16 bp, Homo sapiens
cccctctccaggcctg

SEQ ID NO: 3565083 - DNA, 13 bp, Homo sapiens
cccctctcgcccc

SEQ ID NO: 3565084 - DNA, 18 bp, Homo sapiens
cccctctgcacccagaac

SEQ ID NO: 3565085 - DNA, 21 bp, Homo sapiens
cccctctgccggtcgggcagc

SEQ ID NO: 3565086 - DNA, 13 bp, Homo sapiens
cccctctgctgcc

SEQ ID NO: 3565087 - DNA, 18 bp, Homo sapiens
cccctctggagaaggcct

SEQ ID NO: 3565088 - DNA, 21 bp, Homo sapiens
cccctctggagaaggcctgga

SEQ ID NO: 3565089 - DNA, 23 bp, Homo sapiens
cccctcttcttctgaagatcaga

SEQ ID NO: 3565090 - DNA, 17 bp, Homo sapiens
cccctgagccagcaggg

SEQ ID NO: 3565091 - DNA, 19 bp, Homo sapiens
cccctgaggagctttgtgt

SEQ ID NO: 3565092 - DNA, 16 bp, Homo sapiens
cccctgcagcccaggc

SEQ ID NO: 3565093 - DNA, 18 bp, Homo sapiens
cccctgcagcccaggcca

SEQ ID NO: 3565094 - DNA, 12 bp, Homo sapiens
cccctgcctgac

SEQ ID NO: 3565095 - DNA, 15 bp, Homo sapiens
cccctgcctgacagc

SEQ ID NO: 3565096 - DNA, 15 bp, Homo sapiens
cccctgctgtgctgc

SEQ ID NO: 3565097 - DNA, 12 bp, Homo sapiens
ccctgcagccca

SEQ ID NO: 3565098 - DNA, 17 bp, Homo sapiens
ccctgcagcccaggcca

SEQ ID NO: 3565099 - DNA, 13 bp, Homo sapiens
ccctgcagggcca

SEQ ID NO: 3565100 - DNA, 20 bp, Homo sapiens
ccctgcagggccgggcaggg

SEQ ID NO: 3565101 - DNA, 17 bp, Homo sapiens
ccctgcccaaaccctta

SEQ ID NO: 3565102 - DNA, 22 bp, Homo sapiens
ccctgccccaccccatccagcc

SEQ ID NO: 3565103 - DNA, 21 bp, Homo sapiens
ccctgccccccctaagagaca

SEQ ID NO: 3565104 - DNA, 19 bp, Homo sapiens
ccctgcccctcccttcaac

SEQ ID NO: 3565105 - DNA, 23 bp, Homo sapiens
ccctgcccctcccttcaaccatt

SEQ ID NO: 3565106 - DNA, 14 bp, Homo sapiens
ccctgccgtttccc

SEQ ID NO: 3565107 - DNA, 13 bp, Homo sapiens
ccctgcgcctcca

SEQ ID NO: 3565108 - DNA, 14 bp, Homo sapiens
ccctgcgcctccag

SEQ ID NO: 3565109 - DNA, 17 bp, Homo sapiens
ccctgcgcctccagagg

SEQ ID NO: 3565110 - DNA, 13 bp, Homo sapiens
ccctgcggcctcc

SEQ ID NO: 3565111 - DNA, 20 bp, Homo sapiens
ccctgcggcctccacacctg

SEQ ID NO: 3565112 - DNA, 11 bp, Homo sapiens
ccctgctacct

SEQ ID NO: 3565113 - DNA, 16 bp, Homo sapiens
ccctgctccaccagca

SEQ ID NO: 3565114 - DNA, 17 bp, Homo sapiens
ccctgctccaccagcag

SEQ ID NO: 3565115 - DNA, 19 bp, Homo sapiens
ccctgctccaccagcagca

SEQ ID NO: 3565116 - DNA, 21 bp, Homo sapiens
ccctgctccacgtctgcgccg

SEQ ID NO: 3565117 - DNA, 19 bp, Homo sapiens
ccctgctccagaagatagc

SEQ ID NO: 3565118 - DNA, 11 bp, Homo sapiens
ccctgctgaat

SEQ ID NO: 3565119 - DNA, 15 bp, Homo sapiens
ccctgctgcgctgct

SEQ ID NO: 3565120 - DNA, 20 bp, Homo sapiens
ccctgctgctgccagggctt

SEQ ID NO: 3565121 - DNA, 13 bp, Homo sapiens
ccctgctgtgcca

SEQ ID NO: 3565122 - DNA, 14 bp, Homo sapiens
ccctgctgtgctgc

SEQ ID NO: 3565123 - DNA, 22 bp, Homo sapiens
ccctgctttgggctgccctggt

SEQ ID NO: 3565124 - DNA, 16 bp, Homo sapiens
ccctggaaaccttcca

SEQ ID NO: 3565125 - DNA, 21 bp, Homo sapiens
ccctggaaaccttccacccag

SEQ ID NO: 3565126 - DNA, 18 bp, Homo sapiens
ccctggaactcctggcct

SEQ ID NO: 3565127 - DNA, 19 bp, Homo sapiens
ccctggaactcctggcctt

SEQ ID NO: 3565128 - DNA, 15 bp, Homo sapiens
ccctggacacagctc

SEQ ID NO: 3565129 - DNA, 20 bp, Homo sapiens
ccctggagagccccatggtg

SEQ ID NO: 3565130 - DNA, 15 bp, Homo sapiens
ccctggagcaggagc

SEQ ID NO: 3565131 - DNA, 19 bp, Homo sapiens
ccctggaggtaaacaaaga

SEQ ID NO: 3565132 - DNA, 16 bp, Homo sapiens
ccctggatgcccagga

SEQ ID NO: 3565133 - DNA, 21 bp, Homo sapiens
ccctggcacccccacaagctg

SEQ ID NO: 3565134 - DNA, 13 bp, Homo sapiens
ccctggcagggac

SEQ ID NO: 3565135 - DNA, 22 bp, Homo sapiens
ccctggcagggacctgagagca

SEQ ID NO: 3565136 - DNA, 18 bp, Homo sapiens
ccctggccactaaagctt

SEQ ID NO: 3565137 - DNA, 14 bp, Homo sapiens
ccctggcctgaact

SEQ ID NO: 3565138 - DNA, 12 bp, Homo sapiens
ccctggcctggc

SEQ ID NO: 3565139 - DNA, 15 bp, Homo sapiens
ccctggctcactggc

SEQ ID NO: 3565140 - DNA, 17 bp, Homo sapiens
ccctggctcactggcag

SEQ ID NO: 3565141 - DNA, 14 bp, Homo sapiens
ccctggctttgcct

SEQ ID NO: 3565142 - DNA, 15 bp, Homo sapiens
ccctggctttgcctc

SEQ ID NO: 3565143 - DNA, 18 bp, Homo sapiens
ccctggctttgcctcttc

SEQ ID NO: 3565144 - DNA, 19 bp, Homo sapiens
ccctggctttgcctcttct

SEQ ID NO: 3565145 - DNA, 20 bp, Homo sapiens
ccctggctttgcctcttctt

SEQ ID NO: 3565146 - DNA, 22 bp, Homo sapiens
ccctggctttgcctcttctttg

SEQ ID NO: 3565147 - DNA, 22 bp, Homo sapiens
ccctggcttttcactgctggct

SEQ ID NO: 3565148 - DNA, 21 bp, Homo sapiens
ccctgggctattgctgctgcc

SEQ ID NO: 3565149 - DNA, 12 bp, Homo sapiens
ccctgggctcct

SEQ ID NO: 3565150 - DNA, 13 bp, Homo sapiens
ccctgggctcctc

SEQ ID NO: 3565151 - DNA, 23 bp, Homo sapiens
ccctggggatcttcccacaggag

SEQ ID NO: 3565152 - DNA, 19 bp, Homo sapiens
ccctgggggattcctgagc

SEQ ID NO: 3565153 - DNA, 16 bp, Homo sapiens
ccctgggtctggggac

SEQ ID NO: 3565154 - DNA, 22 bp, Homo sapiens
ccctgggtctggggacaggccc

SEQ ID NO: 3565155 - DNA, 23 bp, Homo sapiens
ccctgggtttgggagccaggact

SEQ ID NO: 3565156 - DNA, 18 bp, Homo sapiens
ccctggtaaggctggtga

SEQ ID NO: 3565157 - DNA, 15 bp, Homo sapiens
ccctggtctgtggag

SEQ ID NO: 3565158 - DNA, 13 bp, Homo sapiens
ccctggtgctgcc

SEQ ID NO: 3565159 - DNA, 18 bp, Homo sapiens
ccctggttagctgacagt

SEQ ID NO: 3565160 - DNA, 15 bp, Homo sapiens
ccctgtaggcctcag

SEQ ID NO: 3565161 - DNA, 13 bp, Homo sapiens
ccctgtcacccac

SEQ ID NO: 3565162 - DNA, 14 bp, Homo sapiens
ccctgtcccaccca

SEQ ID NO: 3565163 - DNA, 13 bp, Homo sapiens
ccctgtcctgcag

SEQ ID NO: 3565164 - DNA, 18 bp, Homo sapiens
ccctgtccttccctgttc

SEQ ID NO: 3565165 - DNA, 13 bp, Homo sapiens
ccctgtctccagc

SEQ ID NO: 3565166 - DNA, 17 bp, Homo sapiens
ccctgtctccagctgcc

SEQ ID NO: 3565167 - DNA, 13 bp, Homo sapiens
ccctgtctggaag

SEQ ID NO: 3565168 - DNA, 18 bp, Homo sapiens
ccctgtggccaactgcaa

SEQ ID NO: 3565169 - DNA, 14 bp, Homo sapiens
ccctgtggccctgg

SEQ ID NO: 3565170 - DNA, 16 bp, Homo sapiens
ccctgtgtcatttcaa

SEQ ID NO: 3565171 - DNA, 21 bp, Homo sapiens
ccctgtgtcctccaccatgca

SEQ ID NO: 3565172 - DNA, 23 bp, Homo sapiens
ccctgttacttatgtagaaactg

SEQ ID NO: 3565173 - DNA, 17 bp, Homo sapiens
ccctgttccccagagaa

SEQ ID NO: 3565174 - DNA, 19 bp, Homo sapiens
ccctgtttcagaggctcag

SEQ ID NO: 3565175 - DNA, 14 bp, Homo sapiens
cccttaactgacat

SEQ ID NO: 3565176 - DNA, 23 bp, Homo sapiens
cccttaagccaaactcaggccca

SEQ ID NO: 3565177 - DNA, 21 bp, Homo sapiens
cccttacagccctaagtggct

SEQ ID NO: 3565178 - DNA, 15 bp, Homo sapiens
cccttacagcctctg

SEQ ID NO: 3565179 - DNA, 19 bp, Homo sapiens
cccttacagcctctgactt

SEQ ID NO: 3565180 - DNA, 18 bp, Homo sapiens
cccttattcctaatggct

SEQ ID NO: 3565181 - DNA, 18 bp, Homo sapiens
cccttcaaccattcccca

SEQ ID NO: 3565182 - DNA, 13 bp, Homo sapiens
cccttcacaaagc

SEQ ID NO: 3565183 - DNA, 20 bp, Homo sapiens
cccttcacaaagcccaaggg

SEQ ID NO: 3565184 - DNA, 23 bp, Homo sapiens
cccttcaggagcctggccaggca

SEQ ID NO: 3565185 - DNA, 20 bp, Homo sapiens
cccttcatccgcctgtgggc

SEQ ID NO: 3565186 - DNA, 20 bp, Homo sapiens
cccttccatgtcgcctctgc

SEQ ID NO: 3565187 - DNA, 16 bp, Homo sapiens
cccttccatgtgcctt

SEQ ID NO: 3565188 - DNA, 19 bp, Homo sapiens
cccttcccatttcttccca

SEQ ID NO: 3565189 - DNA, 13 bp, Homo sapiens
cccttccctcacc

SEQ ID NO: 3565190 - DNA, 12 bp, Homo sapiens
cccttccctggg

SEQ ID NO: 3565191 - DNA, 13 bp, Homo sapiens
cccttccctgggt

SEQ ID NO: 3565192 - DNA, 13 bp, Homo sapiens
cccttcctctcca

SEQ ID NO: 3565193 - DNA, 16 bp, Homo sapiens
cccttcctctccactg

SEQ ID NO: 3565194 - DNA, 23 bp, Homo sapiens
cccttcctgggcacacgctgctc

SEQ ID NO: 3565195 - DNA, 16 bp, Homo sapiens
cccttctctgcctcac

SEQ ID NO: 3565196 - DNA, 13 bp, Homo sapiens
cccttctctgttg

SEQ ID NO: 3565197 - DNA, 15 bp, Homo sapiens
cccttgacacctgct

SEQ ID NO: 3565198 - DNA, 19 bp, Homo sapiens
cccttgattcccaccgtac

SEQ ID NO: 3565199 - DNA, 12 bp, Homo sapiens
cccttgcctctg

SEQ ID NO: 3565200 - DNA, 22 bp, Homo sapiens
cccttgcctctgccctggattg

SEQ ID NO: 3565201 - DNA, 13 bp, Homo sapiens
cccttgccttcct

SEQ ID NO: 3565202 - DNA, 20 bp, Homo sapiens
cccttgctttcctgggcctt

SEQ ID NO: 3565203 - DNA, 22 bp, Homo sapiens
cccttgctttcctgggcctttg

SEQ ID NO: 3565204 - DNA, 14 bp, Homo sapiens
cccttggacatttt

SEQ ID NO: 3565205 - DNA, 21 bp, Homo sapiens
cccttgttgtaaaaagcccag

SEQ ID NO: 3565206 - DNA, 15 bp, Homo sapiens
ccctttccctacctt

SEQ ID NO: 3565207 - DNA, 15 bp, Homo sapiens
ccctttctgtcccac

SEQ ID NO: 3565208 - DNA, 18 bp, Homo sapiens
ccgacacacggggctcgg

SEQ ID NO: 3565209 - DNA, 23 bp, Homo sapiens
ccgacacacggggctcgggcctt

SEQ ID NO: 3565210 - DNA, 13 bp, Homo sapiens
ccgacagcctggc

SEQ ID NO: 3565211 - DNA, 14 bp, Homo sapiens
ccgacagcctggca

SEQ ID NO: 3565212 - DNA, 15 bp, Homo sapiens
ccgacagcctggcac

SEQ ID NO: 3565213 - DNA, 12 bp, Homo sapiens
ccgacaggtggg

SEQ ID NO: 3565214 - DNA, 14 bp, Homo sapiens
ccgactcagggacc

SEQ ID NO: 3565215 - DNA, 18 bp, Homo sapiens
ccgactctgcacccgcct

SEQ ID NO: 3565216 - DNA, 18 bp, Homo sapiens
ccgactgcccctgctgtg

SEQ ID NO: 3565217 - DNA, 15 bp, Homo sapiens
ccgagaaccctgagc

SEQ ID NO: 3565218 - DNA, 17 bp, Homo sapiens
ccgagccatgtgtcttt

SEQ ID NO: 3565219 - DNA, 23 bp, Homo sapiens
ccgagccatgtgtctttacacct

SEQ ID NO: 3565220 - DNA, 12 bp, Homo sapiens
ccgagccctgga

SEQ ID NO: 3565221 - DNA, 15 bp, Homo sapiens
ccgagccctggagag

SEQ ID NO: 3565222 - DNA, 21 bp, Homo sapiens
ccgagccctggagagccccat

SEQ ID NO: 3565223 - DNA, 13 bp, Homo sapiens
ccgagggctgagc

SEQ ID NO: 3565224 - DNA, 21 bp, Homo sapiens
ccgaggggtggaatgccgctg

SEQ ID NO: 3565225 - DNA, 18 bp, Homo sapiens
ccgaggtcactctgggcc

SEQ ID NO: 3565226 - DNA, 16 bp, Homo sapiens
ccgaggttcccactct

SEQ ID NO: 3565227 - DNA, 13 bp, Homo sapiens
cagcttgggcaga

SEQ ID NO: 3565228 - DNA, 15 bp, Homo sapiens
cagctttaaaaaaat

SEQ ID NO: 3565229 - DNA, 11 bp, Homo sapiens
cagctttgcta

SEQ ID NO: 3565230 - DNA, 14 bp, Homo sapiens
cagctttgctgctg

SEQ ID NO: 3565231 - DNA, 19 bp, Homo sapiens
cagctttgtctccaaagaa

SEQ ID NO: 3565232 - DNA, 22 bp, Homo sapiens
cagctttgtctccaaagaagat

SEQ ID NO: 3565233 - DNA, 23 bp, Homo sapiens
cagctttgtctccaaagaagata

SEQ ID NO: 3565234 - DNA, 21 bp, Homo sapiens
cagctttttattccctgccca

SEQ ID NO: 3565235 - DNA, 21 bp, Homo sapiens
caggaaagagctaggaaccct

SEQ ID NO: 3565236 - DNA, 22 bp, Homo sapiens
caggaaagagctaggaaccctg

SEQ ID NO: 3565237 - DNA, 14 bp, Homo sapiens
caggaaagccacat

SEQ ID NO: 3565238 - DNA, 15 bp, Homo sapiens
caggaaagccacatc

SEQ ID NO: 3565239 - DNA, 17 bp, Homo sapiens
caggaaagccacatctt

SEQ ID NO: 3565240 - DNA, 21 bp, Homo sapiens
caggaaagccacatcttgctc

SEQ ID NO: 3565241 - DNA, 19 bp, Homo sapiens
caggaaatcaaatatgcaa

SEQ ID NO: 3565242 - DNA, 23 bp, Homo sapiens
caggaaatcaaatatgcaaagca

SEQ ID NO: 3565243 - DNA, 20 bp, Homo sapiens
caggaaggaaaactatgtat

SEQ ID NO: 3565244 - DNA, 15 bp, Homo sapiens
caggaaggaccccac

SEQ ID NO: 3565245 - DNA, 18 bp, Homo sapiens
caggaatttcccaggacc

SEQ ID NO: 3565246 - DNA, 21 bp, Homo sapiens
caggaatttcccaggaccctg

SEQ ID NO: 3565247 - DNA, 17 bp, Homo sapiens
caggacagttgatggag

SEQ ID NO: 3565248 - DNA, 22 bp, Homo sapiens
caggacagttgatggagcccca

SEQ ID NO: 3565249 - DNA, 15 bp, Homo sapiens
caggacattaaaaat

SEQ ID NO: 3565250 - DNA, 16 bp, Homo sapiens
caggaccagctcagga

SEQ ID NO: 3565251 - DNA, 19 bp, Homo sapiens
caggacccatccctgcctg

SEQ ID NO: 3565252 - DNA, 12 bp, Homo sapiens
caggaccccagc

SEQ ID NO: 3565253 - DNA, 15 bp, Homo sapiens
caggaccccagctct

SEQ ID NO: 3565254 - DNA, 17 bp, Homo sapiens
caggaccccagctctgc

SEQ ID NO: 3565255 - DNA, 20 bp, Homo sapiens
caggaccctgacctccgccc

SEQ ID NO: 3565256 - DNA, 13 bp, Homo sapiens
caggacctccgga

SEQ ID NO: 3565257 - DNA, 20 bp, Homo sapiens
caggacctccggagcgccct

SEQ ID NO: 3565258 - DNA, 22 bp, Homo sapiens
caggacctccggagcgccctgc

SEQ ID NO: 3565259 - DNA, 20 bp, Homo sapiens
caggaccttcgggctgtgcc

SEQ ID NO: 3565260 - DNA, 22 bp, Homo sapiens
caggaccttcgggctgtgcccg

SEQ ID NO: 3565261 - DNA, 22 bp, Homo sapiens
caggacgggccacacgtggctg

SEQ ID NO: 3565262 - DNA, 20 bp, Homo sapiens
caggactatatttgggcctg

SEQ ID NO: 3565263 - DNA, 17 bp, Homo sapiens
caggactcccagaacct

SEQ ID NO: 3565264 - DNA, 20 bp, Homo sapiens
caggactcccagaacctcta

SEQ ID NO: 3565265 - DNA, 21 bp, Homo sapiens
caggactcccagaacctctaa

SEQ ID NO: 3565266 - DNA, 16 bp, Homo sapiens
caggactcctggcagg

SEQ ID NO: 3565267 - DNA, 20 bp, Homo sapiens
caggactcctggcagggcca

SEQ ID NO: 3565268 - DNA, 16 bp, Homo sapiens
caggactctctccagg

SEQ ID NO: 3565269 - DNA, 13 bp, Homo sapiens
caggactctgcct

SEQ ID NO: 3565270 - DNA, 16 bp, Homo sapiens
caggacttctcaccag

SEQ ID NO: 3565271 - DNA, 17 bp, Homo sapiens
caggagaagccagtgtc

SEQ ID NO: 3565272 - DNA, 23 bp, Homo sapiens
caggagaaggggctttgtgacca

SEQ ID NO: 3565273 - DNA, 19 bp, Homo sapiens
caggagagactgagcagcc

SEQ ID NO: 3565274 - DNA, 15 bp, Homo sapiens
caggagagagccagg

SEQ ID NO: 3565275 - DNA, 13 bp, Homo sapiens
caggagagcctgg

SEQ ID NO: 3565276 - DNA, 14 bp, Homo sapiens
caggagagcctggg

SEQ ID NO: 3565277 - DNA, 13 bp, Homo sapiens
caggagaggcagc

SEQ ID NO: 3565278 - DNA, 21 bp, Homo sapiens
caggagatggagggcttggcc

SEQ ID NO: 3565279 - DNA, 22 bp, Homo sapiens
caggagccaaatgaccgagccc

SEQ ID NO: 3565280 - DNA, 15 bp, Homo sapiens
caggagccagcctgc

SEQ ID NO: 3565281 - DNA, 21 bp, Homo sapiens
caggagccagcctgcttccca

SEQ ID NO: 3565282 - DNA, 14 bp, Homo sapiens
caggagccccccta

SEQ ID NO: 3565283 - DNA, 18 bp, Homo sapiens
caggagccccgccaggtg

SEQ ID NO: 3565284 - DNA, 21 bp, Homo sapiens
caggagccccgccaggtgccc

SEQ ID NO: 3565285 - DNA, 20 bp, Homo sapiens
caggagcctagcggagccca

SEQ ID NO: 3565286 - DNA, 22 bp, Homo sapiens
caggagcctagcggagcccagc

SEQ ID NO: 3565287 - DNA, 23 bp, Homo sapiens
caggagcctagcggagcccagcc

SEQ ID NO: 3565288 - DNA, 11 bp, Homo sapiens
caggagcctgg

SEQ ID NO: 3565289 - DNA, 22 bp, Homo sapiens
caggagcctggccaggcaggga

SEQ ID NO: 3565290 - DNA, 19 bp, Homo sapiens
caggagctccatacacacg

SEQ ID NO: 3565291 - DNA, 19 bp, Homo sapiens
caggagggccagcgctgtg

SEQ ID NO: 3565292 - DNA, 21 bp, Homo sapiens
caggaggggcagcgcatgtgt

SEQ ID NO: 3565293 - DNA, 15 bp, Homo sapiens
caggaggggggaggg

SEQ ID NO: 3565294 - DNA, 20 bp, Homo sapiens
caggagggttggagtgctct

SEQ ID NO: 3565295 - DNA, 14 bp, Homo sapiens
caggaggtggaggc

SEQ ID NO: 3565296 - DNA, 14 bp, Homo sapiens
caggagtccctgcc

SEQ ID NO: 3565297 - DNA, 12 bp, Homo sapiens
caggagtctctg

SEQ ID NO: 3565298 - DNA, 14 bp, Homo sapiens
caggagtgtcctgc

SEQ ID NO: 3565299 - DNA, 13 bp, Homo sapiens
caggagtgtgcgg

SEQ ID NO: 3565300 - DNA, 15 bp, Homo sapiens
caggagtttgtggta

SEQ ID NO: 3565301 - DNA, 18 bp, Homo sapiens
caggatacaggtgacagt

SEQ ID NO: 3565302 - DNA, 23 bp, Homo sapiens
caggatatgggctaccaggaaga

SEQ ID NO: 3565303 - DNA, 16 bp, Homo sapiens
caggatccagtgacat

SEQ ID NO: 3565304 - DNA, 17 bp, Homo sapiens
caggatccagtgacatg

SEQ ID NO: 3565305 - DNA, 15 bp, Homo sapiens
caggattctctgcag

SEQ ID NO: 3565306 - DNA, 17 bp, Homo sapiens
caggattctctgcagcc

SEQ ID NO: 3565307 - DNA, 19 bp, Homo sapiens
caggcacagcagctgcagg

SEQ ID NO: 3565308 - DNA, 17 bp, Homo sapiens
caggcaccacagcctcc

SEQ ID NO: 3565309 - DNA, 18 bp, Homo sapiens
caggcaccacagcctcca

SEQ ID NO: 3565310 - DNA, 12 bp, Homo sapiens
caggcagagtgg

SEQ ID NO: 3565311 - DNA, 15 bp, Homo sapiens
caggcagatccagga

SEQ ID NO: 3565312 - DNA, 16 bp, Homo sapiens
caggcagcgcagggct

SEQ ID NO: 3565313 - DNA, 18 bp, Homo sapiens
caggcagcgcagggctgg

SEQ ID NO: 3565314 - DNA, 19 bp, Homo sapiens
caggcagcgcagggctggc

SEQ ID NO: 3565315 - DNA, 22 bp, Homo sapiens
caggcagcgcagggctggcacg

SEQ ID NO: 3565316 - DNA, 22 bp, Homo sapiens
caggcagctatttcagcctcct

SEQ ID NO: 3565317 - DNA, 14 bp, Homo sapiens
caggcagctgaaat

SEQ ID NO: 3565318 - DNA, 15 bp, Homo sapiens
caggcaggcggctcc

SEQ ID NO: 3565319 - DNA, 21 bp, Homo sapiens
caggcaggcggctcctcctca

SEQ ID NO: 3565320 - DNA, 23 bp, Homo sapiens
caggcagggagagagtagctgca

SEQ ID NO: 3565321 - DNA, 14 bp, Homo sapiens
caggggggctgtgc

SEQ ID NO: 3565322 - DNA, 15 bp, Homo sapiens
caggggggtgaggag

SEQ ID NO: 3565323 - DNA, 17 bp, Homo sapiens
cagggggtgaggggcag

SEQ ID NO: 3565324 - DNA, 16 bp, Homo sapiens
cagggggtgtgtctgc

SEQ ID NO: 3565325 - DNA, 13 bp, Homo sapiens
cagggtccacagc

SEQ ID NO: 3565326 - DNA, 14 bp, Homo sapiens
cagggtccacagct

SEQ ID NO: 3565327 - DNA, 15 bp, Homo sapiens
cagggtccacagctg

SEQ ID NO: 3565328 - DNA, 21 bp, Homo sapiens
cagggtccaggagagcctggg

SEQ ID NO: 3565329 - DNA, 18 bp, Homo sapiens
cagggtctctcagggatg

SEQ ID NO: 3565330 - DNA, 22 bp, Homo sapiens
cagggtcttggctgcctgtggg

SEQ ID NO: 3565331 - DNA, 17 bp, Homo sapiens
cagggtgacaaggcctg

SEQ ID NO: 3565332 - DNA, 21 bp, Homo sapiens
cagggtgacaaggcctgcttg

SEQ ID NO: 3565333 - DNA, 13 bp, Homo sapiens
cagggttggcacc

SEQ ID NO: 3565334 - DNA, 15 bp, Homo sapiens
caggtacaggagagg

SEQ ID NO: 3565335 - DNA, 17 bp, Homo sapiens
caggtacaggagaggca

SEQ ID NO: 3565336 - DNA, 17 bp, Homo sapiens
caggtacatttctgatt

SEQ ID NO: 3565337 - DNA, 18 bp, Homo sapiens
caggtattattatcttta

SEQ ID NO: 3565338 - DNA, 20 bp, Homo sapiens
caggtattttgtttctttta

SEQ ID NO: 3565339 - DNA, 14 bp, Homo sapiens
caggtcagcctgga

SEQ ID NO: 3565340 - DNA, 15 bp, Homo sapiens
caggtcagcctggaa

SEQ ID NO: 3565341 - DNA, 16 bp, Homo sapiens
caggtcagcctggaag

SEQ ID NO: 3565342 - DNA, 21 bp, Homo sapiens
caggtcagcctggaagggaca

SEQ ID NO: 3565343 - DNA, 17 bp, Homo sapiens
caggtcaggtggctgtg

SEQ ID NO: 3565344 - DNA, 20 bp, Homo sapiens
caggtcggagtgcctggagt

SEQ ID NO: 3565345 - DNA, 22 bp, Homo sapiens
caggtcggagtgcctggagtca

SEQ ID NO: 3565346 - DNA, 15 bp, Homo sapiens
caggtctgactccaa

SEQ ID NO: 3565347 - DNA, 20 bp, Homo sapiens
caggtctgactccaaagctg

SEQ ID NO: 3565348 - DNA, 18 bp, Homo sapiens
caggtctgtatgtcatgg

SEQ ID NO: 3565349 - DNA, 13 bp, Homo sapiens
caggtctttccta

SEQ ID NO: 3565350 - DNA, 19 bp, Homo sapiens
caggtctttcctaaggctg

SEQ ID NO: 3565351 - DNA, 13 bp, Homo sapiens
caggtgaataaag

SEQ ID NO: 3565352 - DNA, 18 bp, Homo sapiens
caggtgcagccccagggc

SEQ ID NO: 3565353 - DNA, 21 bp, Homo sapiens
caggtgcagccccagggcctg

SEQ ID NO: 3565354 - DNA, 22 bp, Homo sapiens
caggtgcagccccagggcctgc

SEQ ID NO: 3565355 - DNA, 21 bp, Homo sapiens
caggtgcccgcgccaggccct

SEQ ID NO: 3565356 - DNA, 23 bp, Homo sapiens
caggtgcccgcgccaggccctca

SEQ ID NO: 3565357 - DNA, 18 bp, Homo sapiens
caggtgcctaacctggga

SEQ ID NO: 3565358 - DNA, 19 bp, Homo sapiens
caggtgcctaacctgggac

SEQ ID NO: 3565359 - DNA, 19 bp, Homo sapiens
caggtgctcatgctgctcc

SEQ ID NO: 3565360 - DNA, 15 bp, Homo sapiens
caggtgcttttggca

SEQ ID NO: 3565361 - DNA, 18 bp, Homo sapiens
caggtgcttttggcagag

SEQ ID NO: 3565362 - DNA, 22 bp, Homo sapiens
caggtgcttttggcagagacca

SEQ ID NO: 3565363 - DNA, 19 bp, Homo sapiens
caggtggccactccagacc

SEQ ID NO: 3565364 - DNA, 13 bp, Homo sapiens
caggtgggcctgg

SEQ ID NO: 3565365 - DNA, 15 bp, Homo sapiens
caggtgtataaatgt

SEQ ID NO: 3565366 - DNA, 14 bp, Homo sapiens
caggtgtcgaggcc

SEQ ID NO: 3565367 - DNA, 23 bp, Homo sapiens
cagatctggaacctcagcctggc

SEQ ID NO: 3565368 - DNA, 18 bp, Homo sapiens
cagatctttctccttgaa

SEQ ID NO: 3565369 - DNA, 18 bp, Homo sapiens
cagatgatcaactcttcg

SEQ ID NO: 3565370 - DNA, 17 bp, Homo sapiens
cagatgctgagccatag

SEQ ID NO: 3565371 - DNA, 18 bp, Homo sapiens
cagatgctgttgtgaagc

SEQ ID NO: 3565372 - DNA, 22 bp, Homo sapiens
cagatgctgttgtgaagctaat

SEQ ID NO: 3565373 - DNA, 21 bp, Homo sapiens
cagatggaaaattcatttttt

SEQ ID NO: 3565374 - DNA, 15 bp, Homo sapiens
cagatgttcccggag

SEQ ID NO: 3565375 - DNA, 17 bp, Homo sapiens
cagatgttcccggagca

SEQ ID NO: 3565376 - DNA, 18 bp, Homo sapiens
cagattcaggccagccca

SEQ ID NO: 3565377 - DNA, 14 bp, Homo sapiens
cagattcccagagc

SEQ ID NO: 3565378 - DNA, 18 bp, Homo sapiens
cagattcccagagcaaaa

SEQ ID NO: 3565379 - DNA, 21 bp, Homo sapiens
cagattcccagagcaaaataa

SEQ ID NO: 3565380 - DNA, 18 bp, Homo sapiens
cagattcctatgatggat

SEQ ID NO: 3565381 - DNA, 14 bp, Homo sapiens
cagattctcttgaa

SEQ ID NO: 3565382 - DNA, 20 bp, Homo sapiens
cagattggcacccctttcta

SEQ ID NO: 3565383 - DNA, 19 bp, Homo sapiens
cagatttaagccttacaaa

SEQ ID NO: 3565384 - DNA, 20 bp, Homo sapiens
cagatttaagccttacaaag

SEQ ID NO: 3565385 - DNA, 22 bp, Homo sapiens
cagatttattcctttgttactt

SEQ ID NO: 3565386 - DNA, 19 bp, Homo sapiens
cagatttgaactcttcaat

SEQ ID NO: 3565387 - DNA, 20 bp, Homo sapiens
cagatttgctaatttatcct

SEQ ID NO: 3565388 - DNA, 13 bp, Homo sapiens
cagcaaataaata

SEQ ID NO: 3565389 - DNA, 16 bp, Homo sapiens
cagcaacgcccctcca

SEQ ID NO: 3565390 - DNA, 13 bp, Homo sapiens
cagcaagacctca

SEQ ID NO: 3565391 - DNA, 23 bp, Homo sapiens
cagcaagacctcatctgtggagc

SEQ ID NO: 3565392 - DNA, 17 bp, Homo sapiens
cagcaatgccccaaact

SEQ ID NO: 3565393 - DNA, 19 bp, Homo sapiens
cagcaatgccccaaacttt

SEQ ID NO: 3565394 - DNA, 14 bp, Homo sapiens
cagcaatttaaatg

SEQ ID NO: 3565395 - DNA, 17 bp, Homo sapiens
cagcaccaaccacagca

SEQ ID NO: 3565396 - DNA, 13 bp, Homo sapiens
cagcaccgcctct

SEQ ID NO: 3565397 - DNA, 12 bp, Homo sapiens
cagcactcccca

SEQ ID NO: 3565398 - DNA, 18 bp, Homo sapiens
cagcactccccagagctg

SEQ ID NO: 3565399 - DNA, 22 bp, Homo sapiens
cagcagaggcgtactacccagc

SEQ ID NO: 3565400 - DNA, 17 bp, Homo sapiens
cagcagatgctgttgtg

SEQ ID NO: 3565401 - DNA, 22 bp, Homo sapiens
cagcagatgctgttgtgaagct

SEQ ID NO: 3565402 - DNA, 16 bp, Homo sapiens
cagcagccccaggaga

SEQ ID NO: 3565403 - DNA, 18 bp, Homo sapiens
cagcagccccaggagaag

SEQ ID NO: 3565404 - DNA, 16 bp, Homo sapiens
cagcagctgatgctgt

SEQ ID NO: 3565405 - DNA, 17 bp, Homo sapiens
cagcagctgatgctgta

SEQ ID NO: 3565406 - DNA, 19 bp, Homo sapiens
cagcagctgatgctgtact

SEQ ID NO: 3565407 - DNA, 12 bp, Homo sapiens
cagcagctgcag

SEQ ID NO: 3565408 - DNA, 17 bp, Homo sapiens
cagcagctgcaggggcc

SEQ ID NO: 3565409 - DNA, 22 bp, Homo sapiens
cagcaggaaggaacaaagacag

SEQ ID NO: 3565410 - DNA, 20 bp, Homo sapiens
cagcaggaaggaccccacat

SEQ ID NO: 3565411 - DNA, 15 bp, Homo sapiens
cagcaggcctctggg

SEQ ID NO: 3565412 - DNA, 17 bp, Homo sapiens
cagcaggcctctgggac

SEQ ID NO: 3565413 - DNA, 21 bp, Homo sapiens
cagcaggcctctgggacccac

SEQ ID NO: 3565414 - DNA, 23 bp, Homo sapiens
cagcaggcctctgggacccacag

SEQ ID NO: 3565415 - DNA, 13 bp, Homo sapiens
cagcaggctcagg

SEQ ID NO: 3565416 - DNA, 17 bp, Homo sapiens
cagcaggctcaggcaca

SEQ ID NO: 3565417 - DNA, 22 bp, Homo sapiens
cagcagggaaaatgcagcaggg

SEQ ID NO: 3565418 - DNA, 19 bp, Homo sapiens
cagcagggacaagatacat

SEQ ID NO: 3565419 - DNA, 19 bp, Homo sapiens
cagcagggaccgggcgcag

SEQ ID NO: 3565420 - DNA, 23 bp, Homo sapiens
cagcagggaccgggcgcagccct

SEQ ID NO: 3565421 - DNA, 15 bp, Homo sapiens
cagcagggatgccct

SEQ ID NO: 3565422 - DNA, 21 bp, Homo sapiens
cagcagggcatcttggaaaag

SEQ ID NO: 3565423 - DNA, 15 bp, Homo sapiens
cagcaggggggctgt

SEQ ID NO: 3565424 - DNA, 18 bp, Homo sapiens
cagcagtcgcccaagcag

SEQ ID NO: 3565425 - DNA, 19 bp, Homo sapiens
cagcagtctccttcagcac

SEQ ID NO: 3565426 - DNA, 20 bp, Homo sapiens
cagcagtttccagagagtgg

SEQ ID NO: 3565427 - DNA, 17 bp, Homo sapiens
cagcatccaccccaccc

SEQ ID NO: 3565428 - DNA, 14 bp, Homo sapiens
cagcatccagtgtg

SEQ ID NO: 3565429 - DNA, 18 bp, Homo sapiens
cagcatccagtgtgagat

SEQ ID NO: 3565430 - DNA, 14 bp, Homo sapiens
cagcatccctggag

SEQ ID NO: 3565431 - DNA, 15 bp, Homo sapiens
cagcatccctggagc

SEQ ID NO: 3565432 - DNA, 16 bp, Homo sapiens
cagcatccctggagca

SEQ ID NO: 3565433 - DNA, 19 bp, Homo sapiens
cagcatccctggagcagga

SEQ ID NO: 3565434 - DNA, 22 bp, Homo sapiens
cagcatccctggagcaggagcc

SEQ ID NO: 3565435 - DNA, 18 bp, Homo sapiens
cagcatcgcactctggca

SEQ ID NO: 3565436 - DNA, 21 bp, Homo sapiens
cagcatcgcactctggcagca

SEQ ID NO: 3565437 - DNA, 15 bp, Homo sapiens
cagcatcgggagcac

SEQ ID NO: 3565438 - DNA, 20 bp, Homo sapiens
cagcatcgggagcacccaga

SEQ ID NO: 3565439 - DNA, 23 bp, Homo sapiens
cagcatcgggagcacccagagca

SEQ ID NO: 3565440 - DNA, 23 bp, Homo sapiens
cagcatctcccagcaagacctca

SEQ ID NO: 3565441 - DNA, 13 bp, Homo sapiens
cagcatgaataaa

SEQ ID NO: 3565442 - DNA, 15 bp, Homo sapiens
cagcatgaataaaac

SEQ ID NO: 3565443 - DNA, 22 bp, Homo sapiens
cagcatgaataaaacactcatc

SEQ ID NO: 3565444 - DNA, 17 bp, Homo sapiens
cagcatgcttgggctga

SEQ ID NO: 3565445 - DNA, 23 bp, Homo sapiens
cagcatgcttgggctgacccagc

SEQ ID NO: 3565446 - DNA, 14 bp, Homo sapiens
cagcatggaaaaat

SEQ ID NO: 3565447 - DNA, 23 bp, Homo sapiens
cagcattgtgtggaatttgaggt

SEQ ID NO: 3565448 - DNA, 23 bp, Homo sapiens
cagcatttactatgcacaacaga

SEQ ID NO: 3565449 - DNA, 13 bp, Homo sapiens
cagcatttcactt

SEQ ID NO: 3565450 - DNA, 18 bp, Homo sapiens
cagcatttccttgtcccg

SEQ ID NO: 3565451 - DNA, 13 bp, Homo sapiens
cagcattttagaa

SEQ ID NO: 3565452 - DNA, 16 bp, Homo sapiens
cagccaagctggcaca

SEQ ID NO: 3565453 - DNA, 23 bp, Homo sapiens
cagccacaccgtggcagcttgct

SEQ ID NO: 3565454 - DNA, 15 bp, Homo sapiens
cagccacagacccct

SEQ ID NO: 3565455 - DNA, 21 bp, Homo sapiens
cagccacagacccctgggagc

SEQ ID NO: 3565456 - DNA, 13 bp, Homo sapiens
cagccacctggga

SEQ ID NO: 3565457 - DNA, 18 bp, Homo sapiens
cagccacttccccctctt

SEQ ID NO: 3565458 - DNA, 22 bp, Homo sapiens
cagccagaacgtggctctgctg

SEQ ID NO: 3565459 - DNA, 18 bp, Homo sapiens
cagccagaccccacgctg

SEQ ID NO: 3565460 - DNA, 18 bp, Homo sapiens
cagccagactggcacagt

SEQ ID NO: 3565461 - DNA, 14 bp, Homo sapiens
cagccagcccttcc

SEQ ID NO: 3565462 - DNA, 15 bp, Homo sapiens
cagccagcctggctg

SEQ ID NO: 3565463 - DNA, 18 bp, Homo sapiens
cagccagcgtcccttggt

SEQ ID NO: 3565464 - DNA, 13 bp, Homo sapiens
cagccaggctcct

SEQ ID NO: 3565465 - DNA, 24 bp, Homo sapiens
cagccaggctcctacctgtctgct

SEQ ID NO: 3565466 - DNA, 19 bp, Homo sapiens
cagccaggtctgactccaa

SEQ ID NO: 3565467 - DNA, 18 bp, Homo sapiens
cagccatatgtaacatca

SEQ ID NO: 3565468 - DNA, 13 bp, Homo sapiens
cagccattttcca

SEQ ID NO: 3565469 - DNA, 16 bp, Homo sapiens
cagcccaaacctggga

SEQ ID NO: 3565470 - DNA, 19 bp, Homo sapiens
cagcccaaacctgggaagg

SEQ ID NO: 3565471 - DNA, 17 bp, Homo sapiens
cagcccaccccatggcc

SEQ ID NO: 3565472 - DNA, 11 bp, Homo sapiens
cagcccagagc

SEQ ID NO: 3565473 - DNA, 12 bp, Homo sapiens
cagcccagagcc

SEQ ID NO: 3565474 - DNA, 15 bp, Homo sapiens
cagcccagcacccct

SEQ ID NO: 3565475 - DNA, 18 bp, Homo sapiens
cagcccagcaccccttcc

SEQ ID NO: 3565476 - DNA, 12 bp, Homo sapiens
cagcccagggcc

SEQ ID NO: 3565477 - DNA, 17 bp, Homo sapiens
cagcccatttgggcaga

SEQ ID NO: 3565478 - DNA, 22 bp, Homo sapiens
cagcccatttgggcagagaggc

SEQ ID NO: 3565479 - DNA, 21 bp, Homo sapiens
cagccccaactccaggggcac

SEQ ID NO: 3565480 - DNA, 23 bp, Homo sapiens
cagccccaactccaggggcacct

SEQ ID NO: 3565481 - DNA, 22 bp, Homo sapiens
cagcccccgggccgctggctgg

SEQ ID NO: 3565482 - DNA, 17 bp, Homo sapiens
catatatgaggacttgt

SEQ ID NO: 3565483 - DNA, 14 bp, Homo sapiens
catatcatttgagt

SEQ ID NO: 3565484 - DNA, 12 bp, Homo sapiens
catatctgactt

SEQ ID NO: 3565485 - DNA, 22 bp, Homo sapiens
catatgaccattgagtccctgc

SEQ ID NO: 3565486 - DNA, 16 bp, Homo sapiens
catatggaggactgtg

SEQ ID NO: 3565487 - DNA, 22 bp, Homo sapiens
catatgggtgggattttgcaaa

SEQ ID NO: 3565488 - DNA, 16 bp, Homo sapiens
catatggtaggaccct

SEQ ID NO: 3565489 - DNA, 14 bp, Homo sapiens
catatgtaaacata

SEQ ID NO: 3565490 - DNA, 15 bp, Homo sapiens
catatgtaacatcaa

SEQ ID NO: 3565491 - DNA, 13 bp, Homo sapiens
catatgttaagca

SEQ ID NO: 3565492 - DNA, 21 bp, Homo sapiens
catattataaaggataaagaa

SEQ ID NO: 3565493 - DNA, 15 bp, Homo sapiens
catatttaatttgaa

SEQ ID NO: 3565494 - DNA, 17 bp, Homo sapiens
catatttaatttgaagg

SEQ ID NO: 3565495 - DNA, 13 bp, Homo sapiens
catatttactacc

SEQ ID NO: 3565496 - DNA, 16 bp, Homo sapiens
catatttactacctta

SEQ ID NO: 3565497 - DNA, 18 bp, Homo sapiens
catatttattttcttttg

SEQ ID NO: 3565498 - DNA, 12 bp, Homo sapiens
catatttgaaaa

SEQ ID NO: 3565499 - DNA, 16 bp, Homo sapiens
catattttaaacagag

SEQ ID NO: 3565500 - DNA, 17 bp, Homo sapiens
catattttaaacagagg

SEQ ID NO: 3565501 - DNA, 23 bp, Homo sapiens
catattttattgtattttgatga

SEQ ID NO: 3565502 - DNA, 16 bp, Homo sapiens
catattttgagaaact

SEQ ID NO: 3565503 - DNA, 13 bp, Homo sapiens
catcaaataaatt

SEQ ID NO: 3565504 - DNA, 21 bp, Homo sapiens
catcaaataaatttctgggat

SEQ ID NO: 3565505 - DNA, 14 bp, Homo sapiens
catcaaatatttct

SEQ ID NO: 3565506 - DNA, 22 bp, Homo sapiens
catcaactcccaacttcttcct

SEQ ID NO: 3565507 - DNA, 13 bp, Homo sapiens
catcacacccatt

SEQ ID NO: 3565508 - DNA, 14 bp, Homo sapiens
catcacttgtacaa

SEQ ID NO: 3565509 - DNA, 19 bp, Homo sapiens
catcacttgtacaaaataa

SEQ ID NO: 3565510 - DNA, 19 bp, Homo sapiens
catcagaactcttcctcct

SEQ ID NO: 3565511 - DNA, 15 bp, Homo sapiens
catcagcaccccagt

SEQ ID NO: 3565512 - DNA, 16 bp, Homo sapiens
catcagcaccccagtg

SEQ ID NO: 3565513 - DNA, 18 bp, Homo sapiens
catcagctgctgaaacaa

SEQ ID NO: 3565514 - DNA, 20 bp, Homo sapiens
catcagcttgccctgttaaa

SEQ ID NO: 3565515 - DNA, 14 bp, Homo sapiens
catcagtcaacaga

SEQ ID NO: 3565516 - DNA, 17 bp, Homo sapiens
catcagtcaacagagag

SEQ ID NO: 3565517 - DNA, 13 bp, Homo sapiens
catcatgccctct

SEQ ID NO: 3565518 - DNA, 17 bp, Homo sapiens
catcatgccctctctcg

SEQ ID NO: 3565519 - DNA, 19 bp, Homo sapiens
catcattactgttccagat

SEQ ID NO: 3565520 - DNA, 20 bp, Homo sapiens
catcattactgttccagatt

SEQ ID NO: 3565521 - DNA, 12 bp, Homo sapiens
catcatttcagc

SEQ ID NO: 3565522 - DNA, 12 bp, Homo sapiens
catcatttctgt

SEQ ID NO: 3565523 - DNA, 17 bp, Homo sapiens
catccaaccactgtaca

SEQ ID NO: 3565524 - DNA, 17 bp, Homo sapiens
catccaaggcaaacaat

SEQ ID NO: 3565525 - DNA, 20 bp, Homo sapiens
catccaaggcactgtcacta

SEQ ID NO: 3565526 - DNA, 16 bp, Homo sapiens
catccaatgtgaagtt

SEQ ID NO: 3565527 - DNA, 22 bp, Homo sapiens
catccaatgtgaagttcatctt

SEQ ID NO: 3565528 - DNA, 21 bp, Homo sapiens
catccacataaccctgtcacc

SEQ ID NO: 3565529 - DNA, 21 bp, Homo sapiens
catccacttacatatattttt

SEQ ID NO: 3565530 - DNA, 16 bp, Homo sapiens
catccagacctggctc

SEQ ID NO: 3565531 - DNA, 16 bp, Homo sapiens
catccagccagacccc

SEQ ID NO: 3565532 - DNA, 22 bp, Homo sapiens
catccagccagaccccacgctg

SEQ ID NO: 3565533 - DNA, 12 bp, Homo sapiens
catccatcctga

SEQ ID NO: 3565534 - DNA, 14 bp, Homo sapiens
catcccctccctgc

SEQ ID NO: 3565535 - DNA, 18 bp, Homo sapiens
catcccgcttctgaagct

SEQ ID NO: 3565536 - DNA, 21 bp, Homo sapiens
catccctcagtttcttaaaat

SEQ ID NO: 3565537 - DNA, 23 bp, Homo sapiens
catccctcagtttcttaaaatgt

SEQ ID NO: 3565538 - DNA, 18 bp, Homo sapiens
catccctgcctggaggct

SEQ ID NO: 3565539 - DNA, 20 bp, Homo sapiens
catccctgcctggaggctcc

SEQ ID NO: 3565540 - DNA, 18 bp, Homo sapiens
catccctgcttgcccgct

SEQ ID NO: 3565541 - DNA, 19 bp, Homo sapiens
catccctgcttgcccgctc

SEQ ID NO: 3565542 - DNA, 13 bp, Homo sapiens
catccctggagca

SEQ ID NO: 3565543 - DNA, 19 bp, Homo sapiens
catccctggagcaggagcc

SEQ ID NO: 3565544 - DNA, 14 bp, Homo sapiens
catccctttccctt

SEQ ID NO: 3565545 - DNA, 18 bp, Homo sapiens
catccctttttttacatt

SEQ ID NO: 3565546 - DNA, 12 bp, Homo sapiens
catcctaggaac

SEQ ID NO: 3565547 - DNA, 14 bp, Homo sapiens
catcctcaaagaaa

SEQ ID NO: 3565548 - DNA, 23 bp, Homo sapiens
catcctgcagatactttgaagtg

SEQ ID NO: 3565549 - DNA, 21 bp, Homo sapiens
catcctgcagggcttctcctc

SEQ ID NO: 3565550 - DNA, 18 bp, Homo sapiens
catcctggggcagcactc

SEQ ID NO: 3565551 - DNA, 23 bp, Homo sapiens
catccttctgtgtaccacttcct

SEQ ID NO: 3565552 - DNA, 19 bp, Homo sapiens
catccttgattacttccac

SEQ ID NO: 3565553 - DNA, 20 bp, Homo sapiens
catccttgattacttccact

SEQ ID NO: 3565554 - DNA, 22 bp, Homo sapiens
catcgattgtgtacttttcctt

SEQ ID NO: 3565555 - DNA, 23 bp, Homo sapiens
catcgcgggatggtgcagacgcg

SEQ ID NO: 3565556 - DNA, 22 bp, Homo sapiens
catcgtggtgggggaggagcct

SEQ ID NO: 3565557 - DNA, 23 bp, Homo sapiens
catctaaaaatagacttaaatct

SEQ ID NO: 3565558 - DNA, 17 bp, Homo sapiens
catctaaactaagatgt

SEQ ID NO: 3565559 - DNA, 18 bp, Homo sapiens
catctaaactaagatgtg

SEQ ID NO: 3565560 - DNA, 14 bp, Homo sapiens
catctaaccaaaaa

SEQ ID NO: 3565561 - DNA, 14 bp, Homo sapiens
catctacaaaacat

SEQ ID NO: 3565562 - DNA, 13 bp, Homo sapiens
catctcaggagat

SEQ ID NO: 3565563 - DNA, 17 bp, Homo sapiens
catctcaggagatggag

SEQ ID NO: 3565564 - DNA, 23 bp, Homo sapiens
catctcaggagatggagggcttg

SEQ ID NO: 3565565 - DNA, 13 bp, Homo sapiens
catctcaggaggg

SEQ ID NO: 3565566 - DNA, 20 bp, Homo sapiens
catctcagggaactgaccct

SEQ ID NO: 3565567 - DNA, 20 bp, Homo sapiens
catctctccccatatataaa

SEQ ID NO: 3565568 - DNA, 15 bp, Homo sapiens
catctctctgcccaa

SEQ ID NO: 3565569 - DNA, 19 bp, Homo sapiens
catctctgtgaagcctctc

SEQ ID NO: 3565570 - DNA, 22 bp, Homo sapiens
catctgaatgaaaataactgaa

SEQ ID NO: 3565571 - DNA, 15 bp, Homo sapiens
catctgaccagcagc

SEQ ID NO: 3565572 - DNA, 12 bp, Homo sapiens
catctgactgcc

SEQ ID NO: 3565573 - DNA, 13 bp, Homo sapiens
catctgactgcca

SEQ ID NO: 3565574 - DNA, 21 bp, Homo sapiens
catctgactgccaagccagat

SEQ ID NO: 3565575 - DNA, 13 bp, Homo sapiens
catctgagaggct

SEQ ID NO: 3565576 - DNA, 21 bp, Homo sapiens
catctgctgcagttaccacag

SEQ ID NO: 3565577 - DNA, 21 bp, Homo sapiens
catctgctgtcttttctttgc

SEQ ID NO: 3565578 - DNA, 12 bp, Homo sapiens
catctggagagc

SEQ ID NO: 3565579 - DNA, 18 bp, Homo sapiens
catctggcggaggtctct

SEQ ID NO: 3565580 - DNA, 20 bp, Homo sapiens
catctggcggaggtctctgg

SEQ ID NO: 3565581 - DNA, 22 bp, Homo sapiens
catctggcggaggtctctggga

SEQ ID NO: 3565582 - DNA, 20 bp, Homo sapiens
catctggctgcacaggctga

SEQ ID NO: 3565583 - DNA, 15 bp, Homo sapiens
catctggctggaaag

SEQ ID NO: 3565584 - DNA, 21 bp, Homo sapiens
catctgggaacttgtcacaga

SEQ ID NO: 3565585 - DNA, 20 bp, Homo sapiens
catctgtataccctctgttt

SEQ ID NO: 3565586 - DNA, 20 bp, Homo sapiens
catctgtctcggctctgcat

SEQ ID NO: 3565587 - DNA, 13 bp, Homo sapiens
catctgtggagct

SEQ ID NO: 3565588 - DNA, 15 bp, Homo sapiens
catctgtttgataca

SEQ ID NO: 3565589 - DNA, 23 bp, Homo sapiens
catcttccacctcacctctttgt

SEQ ID NO: 3565590 - DNA, 14 bp, Homo sapiens
catcttctgaagag

SEQ ID NO: 3565591 - DNA, 14 bp, Homo sapiens
catcttgcagcatt

SEQ ID NO: 3565592 - DNA, 15 bp, Homo sapiens
catcttgcagcattt

SEQ ID NO: 3565593 - DNA, 19 bp, Homo sapiens
catcttgcagcatttacta

SEQ ID NO: 3565594 - DNA, 21 bp, Homo sapiens
catcttgcagcatttactatg

SEQ ID NO: 3565595 - DNA, 14 bp, Homo sapiens
catcttgctctgca

SEQ ID NO: 3565596 - DNA, 18 bp, Homo sapiens
catcttggccctcctcag

SEQ ID NO: 3565597 - DNA, 18 bp, Homo sapiens
catctttagcagtttcct

SEQ ID NO: 3565598 - DNA, 21 bp, Homo sapiens
catctttgccatatggaggac

SEQ ID NO: 3565599 - DNA, 14 bp, Homo sapiens
catctttgtcaaac

SEQ ID NO: 3565600 - DNA, 20 bp, Homo sapiens
catctttgttacttccttat

SEQ ID NO: 3565601 - DNA, 14 bp, Homo sapiens
catcttttgaagag

SEQ ID NO: 3565602 - DNA, 15 bp, Homo sapiens
catgaaacagaaaca

SEQ ID NO: 3565603 - DNA, 19 bp, Homo sapiens
catgaaacagaaacaaaaa

SEQ ID NO: 3565604 - DNA, 18 bp, Homo sapiens
catgaaataaaatatatc

SEQ ID NO: 3565605 - DNA, 21 bp, Homo sapiens
catgaaataaaatatatctta

SEQ ID NO: 3565606 - DNA, 13 bp, Homo sapiens
catgaaatatatt

SEQ ID NO: 3565607 - DNA, 16 bp, Homo sapiens
catgaacgtggattgt

SEQ ID NO: 3565608 - DNA, 19 bp, Homo sapiens
catgaagaatgcattcaaa

SEQ ID NO: 3565609 - DNA, 20 bp, Homo sapiens
catgaagaatgcattcaaaa

SEQ ID NO: 3565610 - DNA, 14 bp, Homo sapiens
catgaagcagaacc

SEQ ID NO: 3565611 - DNA, 18 bp, Homo sapiens
catgaagcagaaccttct

SEQ ID NO: 3565612 - DNA, 23 bp, Homo sapiens
catgaatgtgagtcattatgtag

SEQ ID NO: 3565613 - DNA, 16 bp, Homo sapiens
catgacagatatttta

SEQ ID NO: 3565614 - DNA, 19 bp, Homo sapiens
catgttttagcatttgtat

SEQ ID NO: 3565615 - DNA, 17 bp, Homo sapiens
catgttttcaactgcca

SEQ ID NO: 3565616 - DNA, 18 bp, Homo sapiens
catgtttttaacttttaa

SEQ ID NO: 3565617 - DNA, 18 bp, Homo sapiens
catgttttttcttcaaat

SEQ ID NO: 3565618 - DNA, 15 bp, Homo sapiens
cattaaaaagttgtt

SEQ ID NO: 3565619 - DNA, 19 bp, Homo sapiens
cattaaaaagttgttcttt

SEQ ID NO: 3565620 - DNA, 11 bp, Homo sapiens
cattaaaataa

SEQ ID NO: 3565621 - DNA, 21 bp, Homo sapiens
cattaaaatttcttatttacc

SEQ ID NO: 3565622 - DNA, 15 bp, Homo sapiens
cattaacggtgctaa

SEQ ID NO: 3565623 - DNA, 19 bp, Homo sapiens
cattagcaaggcagagcct

SEQ ID NO: 3565624 - DNA, 17 bp, Homo sapiens
cattagcagtttgcttt

SEQ ID NO: 3565625 - DNA, 14 bp, Homo sapiens
cattagttttgaag

SEQ ID NO: 3565626 - DNA, 15 bp, Homo sapiens
cattagttttgaaga

SEQ ID NO: 3565627 - DNA, 14 bp, Homo sapiens
cattatatttattg

SEQ ID NO: 3565628 - DNA, 15 bp, Homo sapiens
cattatatttattgt

SEQ ID NO: 3565629 - DNA, 15 bp, Homo sapiens
cattatcttatcatt

SEQ ID NO: 3565630 - DNA, 17 bp, Homo sapiens
cattatgttaatatttc

SEQ ID NO: 3565631 - DNA, 12 bp, Homo sapiens
cattattctctt

SEQ ID NO: 3565632 - DNA, 18 bp, Homo sapiens
cattattctcttttatct

SEQ ID NO: 3565633 - DNA, 21 bp, Homo sapiens
cattatttttgttagcaaaga

SEQ ID NO: 3565634 - DNA, 23 bp, Homo sapiens
cattcaaaaagacagcagacaaa

SEQ ID NO: 3565635 - DNA, 17 bp, Homo sapiens
cattcaatctttggagg

SEQ ID NO: 3565636 - DNA, 18 bp, Homo sapiens
cattcaattccagagaac

SEQ ID NO: 3565637 - DNA, 15 bp, Homo sapiens
cattcacaagcctcc

SEQ ID NO: 3565638 - DNA, 23 bp, Homo sapiens
cattcacagttctttgggccaga

SEQ ID NO: 3565639 - DNA, 15 bp, Homo sapiens
cattcactagaaaat

SEQ ID NO: 3565640 - DNA, 13 bp, Homo sapiens
cattcagaaaaaa

SEQ ID NO: 3565641 - DNA, 14 bp, Homo sapiens
cattcagactaaaa

SEQ ID NO: 3565642 - DNA, 19 bp, Homo sapiens
cattcagactaaaaataca

SEQ ID NO: 3565643 - DNA, 21 bp, Homo sapiens
cattcagactaaaaatacacc

SEQ ID NO: 3565644 - DNA, 14 bp, Homo sapiens
cattcagctctgga

SEQ ID NO: 3565645 - DNA, 17 bp, Homo sapiens
cattccaaagctttatt

SEQ ID NO: 3565646 - DNA, 14 bp, Homo sapiens
cattccagaggaag

SEQ ID NO: 3565647 - DNA, 17 bp, Homo sapiens
cattccatattgggaat

SEQ ID NO: 3565648 - DNA, 13 bp, Homo sapiens
cattcccagcctg

SEQ ID NO: 3565649 - DNA, 16 bp, Homo sapiens
cattcccagcctgact

SEQ ID NO: 3565650 - DNA, 22 bp, Homo sapiens
cattcctaatcaaattctgtct

SEQ ID NO: 3565651 - DNA, 23 bp, Homo sapiens
cattcctaatcaaattctgtctg

SEQ ID NO: 3565652 - DNA, 22 bp, Homo sapiens
cattcctgcctttaagccaaag

SEQ ID NO: 3565653 - DNA, 22 bp, Homo sapiens
cattcgctactatgatttaatt

SEQ ID NO: 3565654 - DNA, 18 bp, Homo sapiens
cattcgtgagctggggac

SEQ ID NO: 3565655 - DNA, 17 bp, Homo sapiens
cattctattctccagac

SEQ ID NO: 3565656 - DNA, 16 bp, Homo sapiens
cattctcactcctacc

SEQ ID NO: 3565657 - DNA, 17 bp, Homo sapiens
cattctcactcctacct

SEQ ID NO: 3565658 - DNA, 13 bp, Homo sapiens
cattctcccagct

SEQ ID NO: 3565659 - DNA, 17 bp, Homo sapiens
cattctctcccatcctg

SEQ ID NO: 3565660 - DNA, 17 bp, Homo sapiens
cattctgcctagagtgt

SEQ ID NO: 3565661 - DNA, 16 bp, Homo sapiens
cattctggaggggcag

SEQ ID NO: 3565662 - DNA, 13 bp, Homo sapiens
cattctgttttcc

SEQ ID NO: 3565663 - DNA, 21 bp, Homo sapiens
cattctgttttcccccagcaa

SEQ ID NO: 3565664 - DNA, 18 bp, Homo sapiens
cattcttactaaaaagta

SEQ ID NO: 3565665 - DNA, 18 bp, Homo sapiens
cattcttcctagttttct

SEQ ID NO: 3565666 - DNA, 21 bp, Homo sapiens
cattcttctcttttctatgaa

SEQ ID NO: 3565667 - DNA, 17 bp, Homo sapiens
cattctttactgcactc

SEQ ID NO: 3565668 - DNA, 17 bp, Homo sapiens
cattcttttatagagca

SEQ ID NO: 3565669 - DNA, 13 bp, Homo sapiens
cattctttttgaa

SEQ ID NO: 3565670 - DNA, 16 bp, Homo sapiens
cattctttttgaaatg

SEQ ID NO: 3565671 - DNA, 14 bp, Homo sapiens
cattgaaagaatta

SEQ ID NO: 3565672 - DNA, 21 bp, Homo sapiens
cattgaagaatgttagagtaa

SEQ ID NO: 3565673 - DNA, 13 bp, Homo sapiens
cattgacagcaat

SEQ ID NO: 3565674 - DNA, 22 bp, Homo sapiens
cattgactttcagtaaacataa

SEQ ID NO: 3565675 - DNA, 23 bp, Homo sapiens
cattgcactctagcctggcaaca

SEQ ID NO: 3565676 - DNA, 11 bp, Homo sapiens
cattgcagcct

SEQ ID NO: 3565677 - DNA, 18 bp, Homo sapiens
cattgcagcctaagaaga

SEQ ID NO: 3565678 - DNA, 17 bp, Homo sapiens
cattgctccaagatgtt

SEQ ID NO: 3565679 - DNA, 13 bp, Homo sapiens
cattgctggctgc

SEQ ID NO: 3565680 - DNA, 14 bp, Homo sapiens
cattgctggctgcc

SEQ ID NO: 3565681 - DNA, 12 bp, Homo sapiens
cattggcaaagt

SEQ ID NO: 3565682 - DNA, 20 bp, Homo sapiens
cattggcacctaatccaggc

SEQ ID NO: 3565683 - DNA, 23 bp, Homo sapiens
cattgtaaaagcattttgtaata

SEQ ID NO: 3565684 - DNA, 16 bp, Homo sapiens
cattgtagagcttctg

SEQ ID NO: 3565685 - DNA, 19 bp, Homo sapiens
cattgtcaccgcaggtgct

SEQ ID NO: 3565686 - DNA, 13 bp, Homo sapiens
cattgtgtcctgc

SEQ ID NO: 3565687 - DNA, 18 bp, Homo sapiens
cattgtgtcctgcttata

SEQ ID NO: 3565688 - DNA, 14 bp, Homo sapiens
cattgtttaaaaat

SEQ ID NO: 3565689 - DNA, 18 bp, Homo sapiens
cattgtttagatgaggct

SEQ ID NO: 3565690 - DNA, 22 bp, Homo sapiens
cattgtttagatgaggctcaga

SEQ ID NO: 3565691 - DNA, 19 bp, Homo sapiens
catttaaaacattaaaata

SEQ ID NO: 3565692 - DNA, 20 bp, Homo sapiens
catttaaaacattaaaatat

SEQ ID NO: 3565693 - DNA, 16 bp, Homo sapiens
catttaaatgtgtaca

SEQ ID NO: 3565694 - DNA, 13 bp, Homo sapiens
catttaataatat

SEQ ID NO: 3565695 - DNA, 19 bp, Homo sapiens
catttaataatatcaaaga

SEQ ID NO: 3565696 - DNA, 22 bp, Homo sapiens
catttaatggcagctagtgcct

SEQ ID NO: 3565697 - DNA, 16 bp, Homo sapiens
catttactatgcacaa

SEQ ID NO: 3565698 - DNA, 12 bp, Homo sapiens
catttagaaaat

SEQ ID NO: 3565699 - DNA, 15 bp, Homo sapiens
catttagaaaataga

SEQ ID NO: 3565700 - DNA, 21 bp, Homo sapiens
catttagcttttttattttaa

SEQ ID NO: 3565701 - DNA, 15 bp, Homo sapiens
catttagtcctgtac

SEQ ID NO: 3565702 - DNA, 12 bp, Homo sapiens
catttatatatt

SEQ ID NO: 3565703 - DNA, 15 bp, Homo sapiens
catttatatttttat

SEQ ID NO: 3565704 - DNA, 20 bp, Homo sapiens
catttatcagccttttatgt

SEQ ID NO: 3565705 - DNA, 14 bp, Homo sapiens
catttatctataat

SEQ ID NO: 3565706 - DNA, 16 bp, Homo sapiens
catttatctataattt

SEQ ID NO: 3565707 - DNA, 21 bp, Homo sapiens
catttatctataatttaccta

SEQ ID NO: 3565708 - DNA, 22 bp, Homo sapiens
catttatctataatttacctaa

SEQ ID NO: 3565709 - DNA, 11 bp, Homo sapiens
catttcaatcc

SEQ ID NO: 3565710 - DNA, 15 bp, Homo sapiens
catttcacttattta

SEQ ID NO: 3565711 - DNA, 14 bp, Homo sapiens
catttcagccaaag

SEQ ID NO: 3565712 - DNA, 17 bp, Homo sapiens
catttcagccaaagtcc

SEQ ID NO: 3565713 - DNA, 15 bp, Homo sapiens
catttcaggactctc

SEQ ID NO: 3565714 - DNA, 15 bp, Homo sapiens
catttcatacaacag

SEQ ID NO: 3565715 - DNA, 21 bp, Homo sapiens
catttcatgaaaaagctgctt

SEQ ID NO: 3565716 - DNA, 12 bp, Homo sapiens
catttccagcct

SEQ ID NO: 3565717 - DNA, 18 bp, Homo sapiens
catttcccaacacaaaga

SEQ ID NO: 3565718 - DNA, 15 bp, Homo sapiens
catttccttgtcccg

SEQ ID NO: 3565719 - DNA, 15 bp, Homo sapiens
catttcggtggctag

SEQ ID NO: 3565720 - DNA, 17 bp, Homo sapiens
catttctcatgttgaaa

SEQ ID NO: 3565721 - DNA, 19 bp, Homo sapiens
catttctcatgttgaagct

SEQ ID NO: 3565722 - DNA, 12 bp, Homo sapiens
catttctttctt

SEQ ID NO: 3565723 - DNA, 19 bp, Homo sapiens
catttctttcttccattcc

SEQ ID NO: 3565724 - DNA, 24 bp, Homo sapiens
catttctttcttccattccttcat

SEQ ID NO: 3565725 - DNA, 22 bp, Homo sapiens
catttgaacctggatccagcac

SEQ ID NO: 3565726 - DNA, 23 bp, Homo sapiens
catttgaacctggatccagcact

SEQ ID NO: 3565727 - DNA, 17 bp, Homo sapiens
catttggaattgacgga

SEQ ID NO: 3565728 - DNA, 23 bp, Homo sapiens
catttggattggggtccctctaa

SEQ ID NO: 3565729 - DNA, 20 bp, Homo sapiens
catttgggagacatgtgaca

SEQ ID NO: 3565730 - DNA, 21 bp, Homo sapiens
catttgtattattttttaata

SEQ ID NO: 3565731 - DNA, 21 bp, Homo sapiens
catttgtgggcaagcagatga

SEQ ID NO: 3565732 - DNA, 13 bp, Homo sapiens
catttgttaaaat

SEQ ID NO: 3565733 - DNA, 17 bp, Homo sapiens
catttgttggtttatca

SEQ ID NO: 3565734 - DNA, 18 bp, Homo sapiens
catttgtttaaacaatct

SEQ ID NO: 3565735 - DNA, 20 bp, Homo sapiens
catttgttttcggcagcctt

SEQ ID NO: 3565736 - DNA, 23 bp, Homo sapiens
cattttaaattccactgaaaatt

SEQ ID NO: 3565737 - DNA, 17 bp, Homo sapiens
cattttaacgctgccta

SEQ ID NO: 3565738 - DNA, 23 bp, Homo sapiens
cattttaatagttggttaggcta

SEQ ID NO: 3565739 - DNA, 23 bp, Homo sapiens
cattttaatttattaattgcttt

SEQ ID NO: 3565740 - DNA, 17 bp, Homo sapiens
cattttactttttcctg

SEQ ID NO: 3565741 - DNA, 20 bp, Homo sapiens
cattttactttttcctggct

SEQ ID NO: 3565742 - DNA, 23 bp, Homo sapiens
cattttagaaactacaaatatag

SEQ ID NO: 3565743 - DNA, 20 bp, Homo sapiens
cattttatgtctttcttgta

SEQ ID NO: 3565744 - DNA, 23 bp, Homo sapiens
cattttcgttacattgtgtcctg

SEQ ID NO: 3565745 - DNA, 14 bp, Homo sapiens
cattttgcctctgt

SEQ ID NO: 3565746 - DNA, 14 bp, Homo sapiens
ccacagtcactgga

SEQ ID NO: 3565747 - DNA, 19 bp, Homo sapiens
ccacatagtgatggttccc

SEQ ID NO: 3565748 - DNA, 22 bp, Homo sapiens
ccacatagtgatggttcccctg

SEQ ID NO: 3565749 - DNA, 17 bp, Homo sapiens
ccacatcagccccacag

SEQ ID NO: 3565750 - DNA, 18 bp, Homo sapiens
ccacatcagccccacagg

SEQ ID NO: 3565751 - DNA, 15 bp, Homo sapiens
ccacatccttctcac

SEQ ID NO: 3565752 - DNA, 15 bp, Homo sapiens
ccacatctaagcctg

SEQ ID NO: 3565753 - DNA, 22 bp, Homo sapiens
ccacatctaagcctgaaggggc

SEQ ID NO: 3565754 - DNA, 14 bp, Homo sapiens
ccacatcttgctct

SEQ ID NO: 3565755 - DNA, 13 bp, Homo sapiens
ccacatgaggcca

SEQ ID NO: 3565756 - DNA, 15 bp, Homo sapiens
ccacattgctggctg

SEQ ID NO: 3565757 - DNA, 19 bp, Homo sapiens
ccacatttagtcctgtact

SEQ ID NO: 3565758 - DNA, 15 bp, Homo sapiens
ccaccacctttggct

SEQ ID NO: 3565759 - DNA, 11 bp, Homo sapiens
ccaccactcag

SEQ ID NO: 3565760 - DNA, 12 bp, Homo sapiens
ccaccactcagg

SEQ ID NO: 3565761 - DNA, 19 bp, Homo sapiens
ccaccactcaggccacagt

SEQ ID NO: 3565762 - DNA, 14 bp, Homo sapiens
ccaccagagccggg

SEQ ID NO: 3565763 - DNA, 12 bp, Homo sapiens
ccaccagcaagg

SEQ ID NO: 3565764 - DNA, 20 bp, Homo sapiens
ccaccagcaaggggaccccg

SEQ ID NO: 3565765 - DNA, 12 bp, Homo sapiens
ccaccagcagca

SEQ ID NO: 3565766 - DNA, 22 bp, Homo sapiens
ccaccagcgaactctcagaaat

SEQ ID NO: 3565767 - DNA, 15 bp, Homo sapiens
ccaccatctgctgtc

SEQ ID NO: 3565768 - DNA, 13 bp, Homo sapiens
ccacccacaaact

SEQ ID NO: 3565769 - DNA, 18 bp, Homo sapiens
ccacccacaaactccagg

SEQ ID NO: 3565770 - DNA, 17 bp, Homo sapiens
ccacccacacagctgcc

SEQ ID NO: 3565771 - DNA, 18 bp, Homo sapiens
ccacccacacagctgccc

SEQ ID NO: 3565772 - DNA, 19 bp, Homo sapiens
ccacccacctccctgcctc

SEQ ID NO: 3565773 - DNA, 13 bp, Homo sapiens
ccacccagcaggc

SEQ ID NO: 3565774 - DNA, 17 bp, Homo sapiens
ccacccatttgttttcg

SEQ ID NO: 3565775 - DNA, 18 bp, Homo sapiens
ccaccccaaaccccagcc

SEQ ID NO: 3565776 - DNA, 18 bp, Homo sapiens
ccaccccctcctccccca

SEQ ID NO: 3565777 - DNA, 16 bp, Homo sapiens
ccaccccctctggaga

SEQ ID NO: 3565778 - DNA, 20 bp, Homo sapiens
ccacccccttccctgggagg

SEQ ID NO: 3565779 - DNA, 13 bp, Homo sapiens
ccacccctcactc

SEQ ID NO: 3565780 - DNA, 15 bp, Homo sapiens
ccacccctcactccc

SEQ ID NO: 3565781 - DNA, 20 bp, Homo sapiens
ccacccctcactccccaggg

SEQ ID NO: 3565782 - DNA, 21 bp, Homo sapiens
ccacccctcactccccaggga

SEQ ID NO: 3565783 - DNA, 17 bp, Homo sapiens
ccacccctgggggctct

SEQ ID NO: 3565784 - DNA, 19 bp, Homo sapiens
ccaccccttggaggagaga

SEQ ID NO: 3565785 - DNA, 18 bp, Homo sapiens
ccacccgggggagcccag

SEQ ID NO: 3565786 - DNA, 21 bp, Homo sapiens
ccacccgggggagcccagtga

SEQ ID NO: 3565787 - DNA, 12 bp, Homo sapiens
ccaccctcccct

SEQ ID NO: 3565788 - DNA, 17 bp, Homo sapiens
ccaccgaccaactgccc

SEQ ID NO: 3565789 - DNA, 13 bp, Homo sapiens
ccaccgcccagag

SEQ ID NO: 3565790 - DNA, 13 bp, Homo sapiens
ccaccggccaggc

SEQ ID NO: 3565791 - DNA, 19 bp, Homo sapiens
ccaccgggctgggagctct

SEQ ID NO: 3565792 - DNA, 23 bp, Homo sapiens
ccaccgggctgggagctctgcag

SEQ ID NO: 3565793 - DNA, 15 bp, Homo sapiens
ccaccggtgggcagt

SEQ ID NO: 3565794 - DNA, 14 bp, Homo sapiens
ccaccgttcagtca

SEQ ID NO: 3565795 - DNA, 15 bp, Homo sapiens
ccaccgttcagtcat

SEQ ID NO: 3565796 - DNA, 12 bp, Homo sapiens
ccacctcacagc

SEQ ID NO: 3565797 - DNA, 14 bp, Homo sapiens
ccacctcacagcta

SEQ ID NO: 3565798 - DNA, 17 bp, Homo sapiens
ccacctcggcacacact

SEQ ID NO: 3565799 - DNA, 18 bp, Homo sapiens
ccacctcggcctcccaga

SEQ ID NO: 3565800 - DNA, 22 bp, Homo sapiens
ccacctctgggtccttggctcc

SEQ ID NO: 3565801 - DNA, 20 bp, Homo sapiens
ccacctgacacaccaggcgc

SEQ ID NO: 3565802 - DNA, 12 bp, Homo sapiens
ccacctgcagga

SEQ ID NO: 3565803 - DNA, 18 bp, Homo sapiens
ccacctgcaggaccctgt

SEQ ID NO: 3565804 - DNA, 21 bp, Homo sapiens
ccacctgccacccccttccct

SEQ ID NO: 3565805 - DNA, 14 bp, Homo sapiens
ccacctgcccaacc

SEQ ID NO: 3565806 - DNA, 23 bp, Homo sapiens
ccacctggatctatccctgcggc

SEQ ID NO: 3565807 - DNA, 11 bp, Homo sapiens
ccacctggctg

SEQ ID NO: 3565808 - DNA, 14 bp, Homo sapiens
ccacctggctgcca

SEQ ID NO: 3565809 - DNA, 11 bp, Homo sapiens
ccaccttccca

SEQ ID NO: 3565810 - DNA, 14 bp, Homo sapiens
ccaccttcccatgc

SEQ ID NO: 3565811 - DNA, 16 bp, Homo sapiens
ccacgacctgtcctgt

SEQ ID NO: 3565812 - DNA, 19 bp, Homo sapiens
ccacgaggaaaagaacaaa

SEQ ID NO: 3565813 - DNA, 13 bp, Homo sapiens
ccacgagggtctc

SEQ ID NO: 3565814 - DNA, 22 bp, Homo sapiens
ccacgagggtctcccctcctgc

SEQ ID NO: 3565815 - DNA, 13 bp, Homo sapiens
ccacgtcccagca

SEQ ID NO: 3565816 - DNA, 14 bp, Homo sapiens
ccacgtcccagcat

SEQ ID NO: 3565817 - DNA, 22 bp, Homo sapiens
ccacgtcccagcatccctggag

SEQ ID NO: 3565818 - DNA, 22 bp, Homo sapiens
ccacgtctgcgccgccgccgga

SEQ ID NO: 3565819 - DNA, 23 bp, Homo sapiens
ccacgtgtatagtatctgtatat

SEQ ID NO: 3565820 - DNA, 13 bp, Homo sapiens
ccactaaagcttc

SEQ ID NO: 3565821 - DNA, 15 bp, Homo sapiens
ccactaaagcttcag

SEQ ID NO: 3565822 - DNA, 20 bp, Homo sapiens
ccactaaagcttcagactca

SEQ ID NO: 3565823 - DNA, 18 bp, Homo sapiens
ccactaagcagaggaggg

SEQ ID NO: 3565824 - DNA, 19 bp, Homo sapiens
ccactaccaaaagacatta

SEQ ID NO: 3565825 - DNA, 20 bp, Homo sapiens
cagaagaatcttcctggcac

SEQ ID NO: 3565826 - DNA, 21 bp, Homo sapiens
cagaagaatcttcctggcaca

SEQ ID NO: 3565827 - DNA, 16 bp, Homo sapiens
cagaagatgccagctt

SEQ ID NO: 3565828 - DNA, 21 bp, Homo sapiens
cagaaggaggattcgagcatc

SEQ ID NO: 3565829 - DNA, 16 bp, Homo sapiens
cagaaggcaaggccct

SEQ ID NO: 3565830 - DNA, 22 bp, Homo sapiens
cagaaggcaaggccctgccctg

SEQ ID NO: 3565831 - DNA, 12 bp, Homo sapiens
cagaaggcccca

SEQ ID NO: 3565832 - DNA, 14 bp, Homo sapiens
cagaagtcatcttg

SEQ ID NO: 3565833 - DNA, 13 bp, Homo sapiens
cagaagtctttca

SEQ ID NO: 3565834 - DNA, 19 bp, Homo sapiens
cagaagttttaacttccag

SEQ ID NO: 3565835 - DNA, 21 bp, Homo sapiens
cagaagttttaacttccagtg

SEQ ID NO: 3565836 - DNA, 17 bp, Homo sapiens
cagaatggcagtcctgg

SEQ ID NO: 3565837 - DNA, 20 bp, Homo sapiens
cagaatggcagtcctggagg

SEQ ID NO: 3565838 - DNA, 23 bp, Homo sapiens
cagaattggatacatacaccagc

SEQ ID NO: 3565839 - DNA, 14 bp, Homo sapiens
cagacaaaatgaaa

SEQ ID NO: 3565840 - DNA, 20 bp, Homo sapiens
cagacaaaatgaaagaaaat

SEQ ID NO: 3565841 - DNA, 16 bp, Homo sapiens
cagacaagcagccctt

SEQ ID NO: 3565842 - DNA, 20 bp, Homo sapiens
cagacaagcagcccttgctt

SEQ ID NO: 3565843 - DNA, 13 bp, Homo sapiens
cagacacagctct

SEQ ID NO: 3565844 - DNA, 14 bp, Homo sapiens
cagacacagctctt

SEQ ID NO: 3565845 - DNA, 15 bp, Homo sapiens
cagacacagctcttc

SEQ ID NO: 3565846 - DNA, 17 bp, Homo sapiens
cagacacagctcttcca

SEQ ID NO: 3565847 - DNA, 14 bp, Homo sapiens
cagacacaggccct

SEQ ID NO: 3565848 - DNA, 18 bp, Homo sapiens
cagacacaggccctccct

SEQ ID NO: 3565849 - DNA, 19 bp, Homo sapiens
cagacagatgttgggagga

SEQ ID NO: 3565850 - DNA, 21 bp, Homo sapiens
cagacagatgttgggaggata

SEQ ID NO: 3565851 - DNA, 21 bp, Homo sapiens
cagacagcttacaggagccag

SEQ ID NO: 3565852 - DNA, 18 bp, Homo sapiens
cagacaggccctccctgt

SEQ ID NO: 3565853 - DNA, 18 bp, Homo sapiens
cagacatatgggatattc

SEQ ID NO: 3565854 - DNA, 22 bp, Homo sapiens
cagacatggtggggtctcctca

SEQ ID NO: 3565855 - DNA, 13 bp, Homo sapiens
cagaccacttgcc

SEQ ID NO: 3565856 - DNA, 18 bp, Homo sapiens
cagaccacttgccacgct

SEQ ID NO: 3565857 - DNA, 15 bp, Homo sapiens
cagaccagctggcgg

SEQ ID NO: 3565858 - DNA, 12 bp, Homo sapiens
cagaccaggcct

SEQ ID NO: 3565859 - DNA, 14 bp, Homo sapiens
cagaccaggccttt

SEQ ID NO: 3565860 - DNA, 20 bp, Homo sapiens
cagaccatattacctggatt

SEQ ID NO: 3565861 - DNA, 19 bp, Homo sapiens
cagacccacgggctcatgc

SEQ ID NO: 3565862 - DNA, 13 bp, Homo sapiens
cagacccagtccc

SEQ ID NO: 3565863 - DNA, 22 bp, Homo sapiens
cagacccccccatttcccgcac

SEQ ID NO: 3565864 - DNA, 16 bp, Homo sapiens
cagaccccctcagcct

SEQ ID NO: 3565865 - DNA, 13 bp, Homo sapiens
cagacccctggct

SEQ ID NO: 3565866 - DNA, 18 bp, Homo sapiens
cagacccctggcttttca

SEQ ID NO: 3565867 - DNA, 16 bp, Homo sapiens
cagacccctgggagct

SEQ ID NO: 3565868 - DNA, 15 bp, Homo sapiens
cagacctgcattgaa

SEQ ID NO: 3565869 - DNA, 15 bp, Homo sapiens
cagacctggagcttc

SEQ ID NO: 3565870 - DNA, 23 bp, Homo sapiens
cagacctggagcttcagccaggt

SEQ ID NO: 3565871 - DNA, 23 bp, Homo sapiens
cagacgccaggcaccacagcctc

SEQ ID NO: 3565872 - DNA, 19 bp, Homo sapiens
cagacggtctgtgtgctgt

SEQ ID NO: 3565873 - DNA, 20 bp, Homo sapiens
cagactactattttcttttt

SEQ ID NO: 3565874 - DNA, 14 bp, Homo sapiens
cagactagatgtag

SEQ ID NO: 3565875 - DNA, 20 bp, Homo sapiens
cagactagatgtagtatttt

SEQ ID NO: 3565876 - DNA, 18 bp, Homo sapiens
cagactcaagtacccatt

SEQ ID NO: 3565877 - DNA, 14 bp, Homo sapiens
cagactcagacatt

SEQ ID NO: 3565878 - DNA, 13 bp, Homo sapiens
cagactcagcaga

SEQ ID NO: 3565879 - DNA, 13 bp, Homo sapiens
cagactccatctc

SEQ ID NO: 3565880 - DNA, 20 bp, Homo sapiens
cagactccatctcttctgca

SEQ ID NO: 3565881 - DNA, 22 bp, Homo sapiens
cagactccatctcttctgcaag

SEQ ID NO: 3565882 - DNA, 19 bp, Homo sapiens
cagactcccattcctgaag

SEQ ID NO: 3565883 - DNA, 23 bp, Homo sapiens
cagactgacccccatctgagctg

SEQ ID NO: 3565884 - DNA, 18 bp, Homo sapiens
cagactgatagacaccat

SEQ ID NO: 3565885 - DNA, 11 bp, Homo sapiens
cagactgtctc

SEQ ID NO: 3565886 - DNA, 16 bp, Homo sapiens
cagacttctctttctt

SEQ ID NO: 3565887 - DNA, 17 bp, Homo sapiens
cagacttctctttctta

SEQ ID NO: 3565888 - DNA, 18 bp, Homo sapiens
cagagaaaacccggagca

SEQ ID NO: 3565889 - DNA, 13 bp, Homo sapiens
cagagaaagcaaa

SEQ ID NO: 3565890 - DNA, 24 bp, Homo sapiens
cagagaaagcaaaggtgcactcca

SEQ ID NO: 3565891 - DNA, 18 bp, Homo sapiens
cagagaaaggggagccca

SEQ ID NO: 3565892 - DNA, 17 bp, Homo sapiens
cagagaaatgccccagt

SEQ ID NO: 3565893 - DNA, 20 bp, Homo sapiens
cagagaaatgccccagtgtt

SEQ ID NO: 3565894 - DNA, 21 bp, Homo sapiens
cagagaagattcttgtattta

SEQ ID NO: 3565895 - DNA, 19 bp, Homo sapiens
cagagaattatctcaagta

SEQ ID NO: 3565896 - DNA, 15 bp, Homo sapiens
cagagacatacttga

SEQ ID NO: 3565897 - DNA, 16 bp, Homo sapiens
cagagacatacttgaa

SEQ ID NO: 3565898 - DNA, 20 bp, Homo sapiens
cagagacatacttgaagggc

SEQ ID NO: 3565899 - DNA, 11 bp, Homo sapiens
cagagacctca

SEQ ID NO: 3565900 - DNA, 18 bp, Homo sapiens
cagagacctcatcagcct

SEQ ID NO: 3565901 - DNA, 20 bp, Homo sapiens
cagagaggccttttggaatg

SEQ ID NO: 3565902 - DNA, 15 bp, Homo sapiens
cagagaggctgtggt

SEQ ID NO: 3565903 - DNA, 17 bp, Homo sapiens
cagagagggaaaaggca

SEQ ID NO: 3565904 - DNA, 22 bp, Homo sapiens
cagagagggaaaaggcaggtgc

SEQ ID NO: 3565905 - DNA, 17 bp, Homo sapiens
cagagaggggcagggaa

SEQ ID NO: 3565906 - DNA, 23 bp, Homo sapiens
cagagaggggcagggaaggagac

SEQ ID NO: 3565907 - DNA, 16 bp, Homo sapiens
cagagaggtagcactc

SEQ ID NO: 3565908 - DNA, 22 bp, Homo sapiens
cagagaggtagcactctcagag

SEQ ID NO: 3565909 - DNA, 12 bp, Homo sapiens
cagagagtggag

SEQ ID NO: 3565910 - DNA, 19 bp, Homo sapiens
cagagagtggagagagcag

SEQ ID NO: 3565911 - DNA, 16 bp, Homo sapiens
cagagataaaaatcat

SEQ ID NO: 3565912 - DNA, 19 bp, Homo sapiens
cagagatgagtgtctggag

SEQ ID NO: 3565913 - DNA, 18 bp, Homo sapiens
cagagcacagcagcccct

SEQ ID NO: 3565914 - DNA, 13 bp, Homo sapiens
cagagcaccccct

SEQ ID NO: 3565915 - DNA, 16 bp, Homo sapiens
cagagcaccccctgct

SEQ ID NO: 3565916 - DNA, 20 bp, Homo sapiens
cagagcaccccctgctccac

SEQ ID NO: 3565917 - DNA, 23 bp, Homo sapiens
cagagccaggggggtgaggagct

SEQ ID NO: 3565918 - DNA, 15 bp, Homo sapiens
cagagcccccagccc

SEQ ID NO: 3565919 - DNA, 14 bp, Homo sapiens
cagagcctcctggg

SEQ ID NO: 3565920 - DNA, 21 bp, Homo sapiens
cagagcctttttacctggcct

SEQ ID NO: 3565921 - DNA, 20 bp, Homo sapiens
cagagctccgatgcccgccc

SEQ ID NO: 3565922 - DNA, 13 bp, Homo sapiens
cagagctgtgcca

SEQ ID NO: 3565923 - DNA, 17 bp, Homo sapiens
cagaggacacagagaag

SEQ ID NO: 3565924 - DNA, 22 bp, Homo sapiens
cagaggactcacttgcccacac

SEQ ID NO: 3565925 - DNA, 22 bp, Homo sapiens
cagaggagatgccacttctcac

SEQ ID NO: 3565926 - DNA, 19 bp, Homo sapiens
cagaggagccaccagttct

SEQ ID NO: 3565927 - DNA, 15 bp, Homo sapiens
cagaggagcgcaggc

SEQ ID NO: 3565928 - DNA, 16 bp, Homo sapiens
cagaggagcgcaggca

SEQ ID NO: 3565929 - DNA, 15 bp, Homo sapiens
cagaggccagaccca

SEQ ID NO: 3565930 - DNA, 17 bp, Homo sapiens
cagaggccccagcctcc

SEQ ID NO: 3565931 - DNA, 14 bp, Homo sapiens
cagaggccctggag

SEQ ID NO: 3565932 - DNA, 22 bp, Homo sapiens
cagaggcctgctgccagtgcag

SEQ ID NO: 3565933 - DNA, 23 bp, Homo sapiens
cagaggcgtactacccagctctg

SEQ ID NO: 3565934 - DNA, 16 bp, Homo sapiens
cagagggaagccatgt

SEQ ID NO: 3565935 - DNA, 22 bp, Homo sapiens
cagagggttgctggtcctgcac

SEQ ID NO: 3565936 - DNA, 21 bp, Homo sapiens
cagagtatgtcagtccaataa

SEQ ID NO: 3565937 - DNA, 14 bp, Homo sapiens
cagagtccccccac

SEQ ID NO: 3565938 - DNA, 21 bp, Homo sapiens
cagagtgagggggtaaagcag

SEQ ID NO: 3565939 - DNA, 18 bp, Homo sapiens
cagagtgcaagcccctgc

SEQ ID NO: 3565940 - DNA, 15 bp, Homo sapiens
cagagtgggccccgg

SEQ ID NO: 3565941 - DNA, 18 bp, Homo sapiens
cagagtgggccccgggct

SEQ ID NO: 3565942 - DNA, 22 bp, Homo sapiens
cagagtgggccccgggctggag

SEQ ID NO: 3565943 - DNA, 12 bp, Homo sapiens
cagagttacagt

SEQ ID NO: 3565944 - DNA, 18 bp, Homo sapiens
cagagttacagttctgtg

SEQ ID NO: 3565945 - DNA, 19 bp, Homo sapiens
cagagttacagttctgtgg

SEQ ID NO: 3565946 - DNA, 18 bp, Homo sapiens
cagatatatttaagcctt

SEQ ID NO: 3565947 - DNA, 23 bp, Homo sapiens
cagatatatttaagccttataaa

SEQ ID NO: 3565948 - DNA, 20 bp, Homo sapiens
cagatattgttataaataaa

SEQ ID NO: 3565949 - DNA, 12 bp, Homo sapiens
cactccagctga

SEQ ID NO: 3565950 - DNA, 17 bp, Homo sapiens
cactcccacctgacaca

SEQ ID NO: 3565951 - DNA, 17 bp, Homo sapiens
cactccccaacccctct

SEQ ID NO: 3565952 - DNA, 19 bp, Homo sapiens
cactccccaacccctctcc

SEQ ID NO: 3565953 - DNA, 18 bp, Homo sapiens
cactccccagagctgtgc

SEQ ID NO: 3565954 - DNA, 19 bp, Homo sapiens
cactccccagagctgtgcc

SEQ ID NO: 3565955 - DNA, 20 bp, Homo sapiens
cactccccagagctgtgcca

SEQ ID NO: 3565956 - DNA, 17 bp, Homo sapiens
cactccccagccccagc

SEQ ID NO: 3565957 - DNA, 18 bp, Homo sapiens
cactccccagccccagcc

SEQ ID NO: 3565958 - DNA, 14 bp, Homo sapiens
cactccccagggag

SEQ ID NO: 3565959 - DNA, 21 bp, Homo sapiens
cactccccagggagctctggg

SEQ ID NO: 3565960 - DNA, 22 bp, Homo sapiens
cactccccagggagctctgggg

SEQ ID NO: 3565961 - DNA, 12 bp, Homo sapiens
cactcccctcac

SEQ ID NO: 3565962 - DNA, 14 bp, Homo sapiens
cactcccctcacac

SEQ ID NO: 3565963 - DNA, 14 bp, Homo sapiens
cactcctacctggt

SEQ ID NO: 3565964 - DNA, 11 bp, Homo sapiens
cactcctggag

SEQ ID NO: 3565965 - DNA, 18 bp, Homo sapiens
cactcctttatctgtaat

SEQ ID NO: 3565966 - DNA, 19 bp, Homo sapiens
cactcctttatctgtaatt

SEQ ID NO: 3565967 - DNA, 14 bp, Homo sapiens
cactcgacccagaa

SEQ ID NO: 3565968 - DNA, 21 bp, Homo sapiens
cactcgacccagaatggagcc

SEQ ID NO: 3565969 - DNA, 15 bp, Homo sapiens
cactcgtgtgtttct

SEQ ID NO: 3565970 - DNA, 16 bp, Homo sapiens
cactcgtgtgtttcta

SEQ ID NO: 3565971 - DNA, 16 bp, Homo sapiens
cactctagcctggcaa

SEQ ID NO: 3565972 - DNA, 18 bp, Homo sapiens
cactctccccgctcaggg

SEQ ID NO: 3565973 - DNA, 13 bp, Homo sapiens
cactctggcagca

SEQ ID NO: 3565974 - DNA, 14 bp, Homo sapiens
cactctggcagcac

SEQ ID NO: 3565975 - DNA, 16 bp, Homo sapiens
cactctggcagcaccg

SEQ ID NO: 3565976 - DNA, 23 bp, Homo sapiens
cactctggcttcaaaaagccaca

SEQ ID NO: 3565977 - DNA, 15 bp, Homo sapiens
cactctgggcctggg

SEQ ID NO: 3565978 - DNA, 16 bp, Homo sapiens
cactctgggcctgggg

SEQ ID NO: 3565979 - DNA, 20 bp, Homo sapiens
cactctgggcctggggaccc

SEQ ID NO: 3565980 - DNA, 20 bp, Homo sapiens
cactctgtccctgtccttcc

SEQ ID NO: 3565981 - DNA, 22 bp, Homo sapiens
cactctgtccctgtccttccct

SEQ ID NO: 3565982 - DNA, 20 bp, Homo sapiens
cactgaaaaatctaagtgat

SEQ ID NO: 3565983 - DNA, 23 bp, Homo sapiens
cactgaaaaatctaagtgatata

SEQ ID NO: 3565984 - DNA, 17 bp, Homo sapiens
cactgaagtttttgaaa

SEQ ID NO: 3565985 - DNA, 23 bp, Homo sapiens
cactgacatcaattttaccctga

SEQ ID NO: 3565986 - DNA, 14 bp, Homo sapiens
cactgaccagaact

SEQ ID NO: 3565987 - DNA, 22 bp, Homo sapiens
cactgactgaatgctgttaata

SEQ ID NO: 3565988 - DNA, 17 bp, Homo sapiens
cactgagaaagaggcag

SEQ ID NO: 3565989 - DNA, 23 bp, Homo sapiens
cactgagaccccaggctgttagg

SEQ ID NO: 3565990 - DNA, 22 bp, Homo sapiens
cactgatgcaaggattacagaa

SEQ ID NO: 3565991 - DNA, 12 bp, Homo sapiens
cactgatgctgc

SEQ ID NO: 3565992 - DNA, 17 bp, Homo sapiens
cactgcaaacacacctt

SEQ ID NO: 3565993 - DNA, 16 bp, Homo sapiens
cactgcaaattttaac

SEQ ID NO: 3565994 - DNA, 14 bp, Homo sapiens
cactgcaacctccg

SEQ ID NO: 3565995 - DNA, 16 bp, Homo sapiens
cactgcaacttctgcc

SEQ ID NO: 3565996 - DNA, 18 bp, Homo sapiens
cactgcacagtgcatctc

SEQ ID NO: 3565997 - DNA, 19 bp, Homo sapiens
cactgcacagtgcatctca

SEQ ID NO: 3565998 - DNA, 19 bp, Homo sapiens
cactgcagcctcaacctcc

SEQ ID NO: 3565999 - DNA, 16 bp, Homo sapiens
cactgcataccaacct

SEQ ID NO: 3566000 - DNA, 22 bp, Homo sapiens
cactgcattcctgtgccctaga

SEQ ID NO: 3566001 - DNA, 23 bp, Homo sapiens
cactgccatggaattccctcctg

SEQ ID NO: 3566002 - DNA, 23 bp, Homo sapiens
cactgccgtcacccactctgcac

SEQ ID NO: 3566003 - DNA, 17 bp, Homo sapiens
cactgcctgcatgagct

SEQ ID NO: 3566004 - DNA, 20 bp, Homo sapiens
cactgctcgtggactgtgct

SEQ ID NO: 3566005 - DNA, 21 bp, Homo sapiens
cactgctcgtggactgtgctg

SEQ ID NO: 3566006 - DNA, 13 bp, Homo sapiens
cactgctgagctg

SEQ ID NO: 3566007 - DNA, 17 bp, Homo sapiens
cactgctgagctggccc

SEQ ID NO: 3566008 - DNA, 17 bp, Homo sapiens
cactgctgcccagcctc

SEQ ID NO: 3566009 - DNA, 16 bp, Homo sapiens
cactgctggctgcctt

SEQ ID NO: 3566010 - DNA, 21 bp, Homo sapiens
cactgctgttatatttcatca

SEQ ID NO: 3566011 - DNA, 18 bp, Homo sapiens
cactggacccttgattca

SEQ ID NO: 3566012 - DNA, 22 bp, Homo sapiens
cactggcaggtgtgggatctgg

SEQ ID NO: 3566013 - DNA, 18 bp, Homo sapiens
cactgggaagctcccacc

SEQ ID NO: 3566014 - DNA, 20 bp, Homo sapiens
cactgggaagctcccacccc

SEQ ID NO: 3566015 - DNA, 18 bp, Homo sapiens
cactggggactttattta

SEQ ID NO: 3566016 - DNA, 21 bp, Homo sapiens
cactggtacttagagtttctg

SEQ ID NO: 3566017 - DNA, 20 bp, Homo sapiens
cactggtagaccaaaataaa

SEQ ID NO: 3566018 - DNA, 22 bp, Homo sapiens
cactggtggcccgacagcctgg

SEQ ID NO: 3566019 - DNA, 19 bp, Homo sapiens
cactgtaagctttgttctg

SEQ ID NO: 3566020 - DNA, 18 bp, Homo sapiens
cactgtacacacccgcct

SEQ ID NO: 3566021 - DNA, 18 bp, Homo sapiens
cactgtagaatgatttca

SEQ ID NO: 3566022 - DNA, 19 bp, Homo sapiens
cactgtagctctaaaatct

SEQ ID NO: 3566023 - DNA, 14 bp, Homo sapiens
cactgtatccaggt

SEQ ID NO: 3566024 - DNA, 16 bp, Homo sapiens
cactgtcctattatat

SEQ ID NO: 3566025 - DNA, 17 bp, Homo sapiens
cactgtcctccaagcca

SEQ ID NO: 3566026 - DNA, 22 bp, Homo sapiens
cactgtgcagacccagtcccac

SEQ ID NO: 3566027 - DNA, 15 bp, Homo sapiens
cactgtgcttggcca

SEQ ID NO: 3566028 - DNA, 13 bp, Homo sapiens
cactgttgataaa

SEQ ID NO: 3566029 - DNA, 16 bp, Homo sapiens
cactgttgataaaaac

SEQ ID NO: 3566030 - DNA, 17 bp, Homo sapiens
cactgttgataaaaact

SEQ ID NO: 3566031 - DNA, 16 bp, Homo sapiens
cactgttttatagaaa

SEQ ID NO: 3566032 - DNA, 17 bp, Homo sapiens
cacttaaaatacatgaa

SEQ ID NO: 3566033 - DNA, 13 bp, Homo sapiens
cacttaatagcaa

SEQ ID NO: 3566034 - DNA, 16 bp, Homo sapiens
cacttaatagcaacag

SEQ ID NO: 3566035 - DNA, 21 bp, Homo sapiens
cacttaatagcaacagagcac

SEQ ID NO: 3566036 - DNA, 12 bp, Homo sapiens
cacttaatgtat

SEQ ID NO: 3566037 - DNA, 14 bp, Homo sapiens
cacttaatgtatgt

SEQ ID NO: 3566038 - DNA, 17 bp, Homo sapiens
cacttagaaattgcatt

SEQ ID NO: 3566039 - DNA, 19 bp, Homo sapiens
cacttagaaattgcatttc

SEQ ID NO: 3566040 - DNA, 16 bp, Homo sapiens
cacttattattaataa

SEQ ID NO: 3566041 - DNA, 20 bp, Homo sapiens
cacttattccccattcttcc

SEQ ID NO: 3566042 - DNA, 17 bp, Homo sapiens
cacttattgaatatatg

SEQ ID NO: 3566043 - DNA, 23 bp, Homo sapiens
cacttcaagctgttatttcttcc

SEQ ID NO: 3566044 - DNA, 21 bp, Homo sapiens
cacttccccctcttcttctga

SEQ ID NO: 3566045 - DNA, 17 bp, Homo sapiens
cacttcctgaggcctca

SEQ ID NO: 3566046 - DNA, 15 bp, Homo sapiens
cacttccttttaact

SEQ ID NO: 3566047 - DNA, 22 bp, Homo sapiens
cacttgagaaccagtctcctca

SEQ ID NO: 3566048 - DNA, 12 bp, Homo sapiens
cacttgtacaaa

SEQ ID NO: 3566049 - DNA, 16 bp, Homo sapiens
cacttgttatattata

SEQ ID NO: 3566050 - DNA, 21 bp, Homo sapiens
cactttcagagcccccagccc

SEQ ID NO: 3566051 - DNA, 24 bp, Homo sapiens
cactttcagagcccccagccctgg

SEQ ID NO: 3566052 - DNA, 15 bp, Homo sapiens
cactttcctcagttg

SEQ ID NO: 3566053 - DNA, 16 bp, Homo sapiens
cacttttcctccctca

SEQ ID NO: 3566054 - DNA, 14 bp, Homo sapiens
cacttttttaaata

SEQ ID NO: 3566055 - DNA, 22 bp, Homo sapiens
cagaaaaaccaacatctacaaa

SEQ ID NO: 3566056 - DNA, 15 bp, Homo sapiens
cagaaaattccctgg

SEQ ID NO: 3566057 - DNA, 16 bp, Homo sapiens
cagaaaattccctggg

SEQ ID NO: 3566058 - DNA, 20 bp, Homo sapiens
cagaaacaaaaacactaaaa

SEQ ID NO: 3566059 - DNA, 18 bp, Homo sapiens
cagaaaccaacaagaacc

SEQ ID NO: 3566060 - DNA, 21 bp, Homo sapiens
cagaaaccacagtcttcccag

SEQ ID NO: 3566061 - DNA, 17 bp, Homo sapiens
cagaaaccttttatttt

SEQ ID NO: 3566062 - DNA, 12 bp, Homo sapiens
cagaaactgatg

SEQ ID NO: 3566063 - DNA, 14 bp, Homo sapiens
cagaaactgatgcc

SEQ ID NO: 3566064 - DNA, 17 bp, Homo sapiens
cagaaagcctcctgccc

SEQ ID NO: 3566065 - DNA, 19 bp, Homo sapiens
cagaaagcctgggtgacat

SEQ ID NO: 3566066 - DNA, 19 bp, Homo sapiens
cagaaaggtgtgaggagag

SEQ ID NO: 3566067 - DNA, 23 bp, Homo sapiens
cagaaaggtgtgaggagagagga

SEQ ID NO: 3566068 - DNA, 20 bp, Homo sapiens
cagaaaggttttcttctttt

SEQ ID NO: 3566069 - DNA, 11 bp, Homo sapiens
cagaaatacaa

SEQ ID NO: 3566070 - DNA, 14 bp, Homo sapiens
cagaaatacaaaaa

SEQ ID NO: 3566071 - DNA, 18 bp, Homo sapiens
cagaaatacaaaaaatta

SEQ ID NO: 3566072 - DNA, 22 bp, Homo sapiens
cagaacattcagctctggagaa

SEQ ID NO: 3566073 - DNA, 23 bp, Homo sapiens
cagaacccctacatgaaacagaa

SEQ ID NO: 3566074 - DNA, 17 bp, Homo sapiens
cagaacctctaagtgct

SEQ ID NO: 3566075 - DNA, 12 bp, Homo sapiens
cagaaccttctt

SEQ ID NO: 3566076 - DNA, 14 bp, Homo sapiens
cagaacgcacccca

SEQ ID NO: 3566077 - DNA, 15 bp, Homo sapiens
cagaacgtggctctg

SEQ ID NO: 3566078 - DNA, 18 bp, Homo sapiens
cagaacgtggctctgctg

SEQ ID NO: 3566079 - DNA, 21 bp, Homo sapiens
cagaactcggtgtccccacca

SEQ ID NO: 3566080 - DNA, 17 bp, Homo sapiens
cagaactcttcctcctc

SEQ ID NO: 3566081 - DNA, 17 bp, Homo sapiens
caccccaaaccccagcc

SEQ ID NO: 3566082 - DNA, 15 bp, Homo sapiens
caccccacagaacct

SEQ ID NO: 3566083 - DNA, 20 bp, Homo sapiens
cacccccaggtgcagcccca

SEQ ID NO: 3566084 - DNA, 22 bp, Homo sapiens
cacccccaggtgcagccccagg

SEQ ID NO: 3566085 - DNA, 22 bp, Homo sapiens
cacccccatgctgccttcaggg

SEQ ID NO: 3566086 - DNA, 19 bp, Homo sapiens
caccccctccccgcccctg

SEQ ID NO: 3566087 - DNA, 13 bp, Homo sapiens
cacccccttccct

SEQ ID NO: 3566088 - DNA, 16 bp, Homo sapiens
cacccccttccctggg

SEQ ID NO: 3566089 - DNA, 14 bp, Homo sapiens
cacccctaaagaga

SEQ ID NO: 3566090 - DNA, 20 bp, Homo sapiens
cacccctcactccccaggga

SEQ ID NO: 3566091 - DNA, 23 bp, Homo sapiens
cacccctgtcccacccacacagc

SEQ ID NO: 3566092 - DNA, 15 bp, Homo sapiens
caccccttcctgggc

SEQ ID NO: 3566093 - DNA, 19 bp, Homo sapiens
caccccttggaggagagag

SEQ ID NO: 3566094 - DNA, 15 bp, Homo sapiens
cacccctttctagtt

SEQ ID NO: 3566095 - DNA, 18 bp, Homo sapiens
cacccctttctgtcccac

SEQ ID NO: 3566096 - DNA, 16 bp, Homo sapiens
caccctacctgtgcct

SEQ ID NO: 3566097 - DNA, 18 bp, Homo sapiens
caccctcccctatgctgg

SEQ ID NO: 3566098 - DNA, 21 bp, Homo sapiens
caccctccggcgggtgacagc

SEQ ID NO: 3566099 - DNA, 12 bp, Homo sapiens
caccctgccccc

SEQ ID NO: 3566100 - DNA, 20 bp, Homo sapiens
caccctgcgcctccagaggt

SEQ ID NO: 3566101 - DNA, 22 bp, Homo sapiens
caccctgctttggcggcccggc

SEQ ID NO: 3566102 - DNA, 19 bp, Homo sapiens
caccctggatgctgttgag

SEQ ID NO: 3566103 - DNA, 16 bp, Homo sapiens
caccctggtctgtgga

SEQ ID NO: 3566104 - DNA, 17 bp, Homo sapiens
caccctggtctgtggag

SEQ ID NO: 3566105 - DNA, 15 bp, Homo sapiens
caccctggtgggcca

SEQ ID NO: 3566106 - DNA, 22 bp, Homo sapiens
caccctgttacttatgtagaaa

SEQ ID NO: 3566107 - DNA, 16 bp, Homo sapiens
caccctttccaggaat

SEQ ID NO: 3566108 - DNA, 17 bp, Homo sapiens
caccgaccaactgccct

SEQ ID NO: 3566109 - DNA, 19 bp, Homo sapiens
caccgaggttcccagggct

SEQ ID NO: 3566110 - DNA, 22 bp, Homo sapiens
caccgcaggtgctcatgctgct

SEQ ID NO: 3566111 - DNA, 23 bp, Homo sapiens
caccgcaggtgctcatgctgctc

SEQ ID NO: 3566112 - DNA, 16 bp, Homo sapiens
caccgccacgtcccag

SEQ ID NO: 3566113 - DNA, 16 bp, Homo sapiens
caccgcctcttcccgc

SEQ ID NO: 3566114 - DNA, 17 bp, Homo sapiens
caccgcctcttcccgcc

SEQ ID NO: 3566115 - DNA, 22 bp, Homo sapiens
caccggccaggccgcgcccagc

SEQ ID NO: 3566116 - DNA, 19 bp, Homo sapiens
caccgtggcagcttgctgg

SEQ ID NO: 3566117 - DNA, 13 bp, Homo sapiens
caccgttcagtca

SEQ ID NO: 3566118 - DNA, 17 bp, Homo sapiens
cacctaatccaggcaga

SEQ ID NO: 3566119 - DNA, 14 bp, Homo sapiens
cacctagcagcctc

SEQ ID NO: 3566120 - DNA, 17 bp, Homo sapiens
cacctatctcagccata

SEQ ID NO: 3566121 - DNA, 18 bp, Homo sapiens
cacctatctcagccatag

SEQ ID NO: 3566122 - DNA, 20 bp, Homo sapiens
cacctatgagatggccatgc

SEQ ID NO: 3566123 - DNA, 22 bp, Homo sapiens
cacctatgagatggccatgctc

SEQ ID NO: 3566124 - DNA, 19 bp, Homo sapiens
cacctccaagcatttcatg

SEQ ID NO: 3566125 - DNA, 10 bp, Homo sapiens
cacctcccag

SEQ ID NO: 3566126 - DNA, 15 bp, Homo sapiens
cacctccccctttca

SEQ ID NO: 3566127 - DNA, 23 bp, Homo sapiens
cacctccccctttcacactggat

SEQ ID NO: 3566128 - DNA, 10 bp, Homo sapiens
cacctccctg

SEQ ID NO: 3566129 - DNA, 13 bp, Homo sapiens
cacctcctaccct

SEQ ID NO: 3566130 - DNA, 15 bp, Homo sapiens
cacctcgagaagtaa

SEQ ID NO: 3566131 - DNA, 21 bp, Homo sapiens
cacctcgctgttgtcacatct

SEQ ID NO: 3566132 - DNA, 13 bp, Homo sapiens
cacctcggcacac

SEQ ID NO: 3566133 - DNA, 23 bp, Homo sapiens
cacctctgtgggcactggtgggc

SEQ ID NO: 3566134 - DNA, 18 bp, Homo sapiens
cacctgaatcagctggac

SEQ ID NO: 3566135 - DNA, 20 bp, Homo sapiens
cacctgaatcagctggacat

SEQ ID NO: 3566136 - DNA, 16 bp, Homo sapiens
cacctgacacaccagg

SEQ ID NO: 3566137 - DNA, 20 bp, Homo sapiens
cacctgacacaccaggcgct

SEQ ID NO: 3566138 - DNA, 12 bp, Homo sapiens
cacctgcctcca

SEQ ID NO: 3566139 - DNA, 23 bp, Homo sapiens
cacctgcctcggcctcccaaagt

SEQ ID NO: 3566140 - DNA, 11 bp, Homo sapiens
cacctgctcca

SEQ ID NO: 3566141 - DNA, 12 bp, Homo sapiens
cacctgctccag

SEQ ID NO: 3566142 - DNA, 14 bp, Homo sapiens
cacctgctccagaa

SEQ ID NO: 3566143 - DNA, 23 bp, Homo sapiens
cacctgctgagaaaacatgcctc

SEQ ID NO: 3566144 - DNA, 15 bp, Homo sapiens
cacctgctggagtga

SEQ ID NO: 3566145 - DNA, 11 bp, Homo sapiens
cacctggagag

SEQ ID NO: 3566146 - DNA, 16 bp, Homo sapiens
cacctggcaaaggacc

SEQ ID NO: 3566147 - DNA, 20 bp, Homo sapiens
cacctggccttaaagaggga

SEQ ID NO: 3566148 - DNA, 23 bp, Homo sapiens
cacctggccttaaagagggacag

SEQ ID NO: 3566149 - DNA, 20 bp, Homo sapiens
cacctgggaacacagttctg

SEQ ID NO: 3566150 - DNA, 23 bp, Homo sapiens
cacctgggaacacagttctgggc

SEQ ID NO: 3566151 - DNA, 23 bp, Homo sapiens
cacctggtggatacctggttgag

SEQ ID NO: 3566152 - DNA, 11 bp, Homo sapiens
cacctgtttcc

SEQ ID NO: 3566153 - DNA, 16 bp, Homo sapiens
caccttagagaagcta

SEQ ID NO: 3566154 - DNA, 16 bp, Homo sapiens
caccttcacctcggag

SEQ ID NO: 3566155 - DNA, 20 bp, Homo sapiens
caccttcccctaaaccccaa

SEQ ID NO: 3566156 - DNA, 22 bp, Homo sapiens
caccttgcagaaggcaaggccc

SEQ ID NO: 3566157 - DNA, 21 bp, Homo sapiens
caccttgctaacctaaaagac

SEQ ID NO: 3566158 - DNA, 17 bp, Homo sapiens
cacgagcaggctactgt

SEQ ID NO: 3566159 - DNA, 19 bp, Homo sapiens
cacgagcaggctactgtca

SEQ ID NO: 3566160 - DNA, 21 bp, Homo sapiens
cacgagggtctcccctcctgc

SEQ ID NO: 3566161 - DNA, 13 bp, Homo sapiens
cacgccccaggac

SEQ ID NO: 3566162 - DNA, 14 bp, Homo sapiens
cacgcctcaccagc

SEQ ID NO: 3566163 - DNA, 18 bp, Homo sapiens
cacgcctcaccagccccc

SEQ ID NO: 3566164 - DNA, 20 bp, Homo sapiens
cacgctcaatgcccagtaaa

SEQ ID NO: 3566165 - DNA, 22 bp, Homo sapiens
cacgctcaatgcccagtaaaat

SEQ ID NO: 3566166 - DNA, 22 bp, Homo sapiens
cacgctgccttcggtacccacc

SEQ ID NO: 3566167 - DNA, 16 bp, Homo sapiens
cacggagggagcgaca

SEQ ID NO: 3566168 - DNA, 18 bp, Homo sapiens
cacggatggtgcatgggc

SEQ ID NO: 3566169 - DNA, 18 bp, Homo sapiens
cacggcgggatcctccac

SEQ ID NO: 3566170 - DNA, 20 bp, Homo sapiens
cacggcgggatcctccacag

SEQ ID NO: 3566171 - DNA, 23 bp, Homo sapiens
cacggcgggatcctccacagaga

SEQ ID NO: 3566172 - DNA, 14 bp, Homo sapiens
cacgtcccagcatc

SEQ ID NO: 3566173 - DNA, 22 bp, Homo sapiens
cacgtcccagcatccctggagc

SEQ ID NO: 3566174 - DNA, 14 bp, Homo sapiens
cacgtccttgggcg

SEQ ID NO: 3566175 - DNA, 13 bp, Homo sapiens
cacgtggggccca

SEQ ID NO: 3566176 - DNA, 14 bp, Homo sapiens
cacgtggggcccac

SEQ ID NO: 3566177 - DNA, 19 bp, Homo sapiens
cacgtgtatagtatctgta

SEQ ID NO: 3566178 - DNA, 23 bp, Homo sapiens
cacgtgtatagtatctgtatata

SEQ ID NO: 3566179 - DNA, 16 bp, Homo sapiens
cacgttgcctctactt

SEQ ID NO: 3566180 - DNA, 18 bp, Homo sapiens
cactaaagcttcagactc

SEQ ID NO: 3566181 - DNA, 16 bp, Homo sapiens
cactaacgaaatatca

SEQ ID NO: 3566182 - DNA, 14 bp, Homo sapiens
cactaagcagagga

SEQ ID NO: 3566183 - DNA, 16 bp, Homo sapiens
cactaagcagaggagg

SEQ ID NO: 3566184 - DNA, 17 bp, Homo sapiens
cactaagcagaggaggg

SEQ ID NO: 3566185 - DNA, 15 bp, Homo sapiens
cactaaggacttaaa

SEQ ID NO: 3566186 - DNA, 17 bp, Homo sapiens
cactaccaaaagacatt

SEQ ID NO: 3566187 - DNA, 19 bp, Homo sapiens
cactagaatggataaaata

SEQ ID NO: 3566188 - DNA, 22 bp, Homo sapiens
cactagtggaaagtcaggctag

SEQ ID NO: 3566189 - DNA, 15 bp, Homo sapiens
cactagtttatgcta

SEQ ID NO: 3566190 - DNA, 16 bp, Homo sapiens
cactcaaatcaagaaa

SEQ ID NO: 3566191 - DNA, 20 bp, Homo sapiens
cactcaccactaccagccag

SEQ ID NO: 3566192 - DNA, 20 bp, Homo sapiens
cactcacccctagccctggt

SEQ ID NO: 3566193 - DNA, 12 bp, Homo sapiens
cactcagaaaat

SEQ ID NO: 3566194 - DNA, 16 bp, Homo sapiens
cactcagaaaattccc

SEQ ID NO: 3566195 - DNA, 18 bp, Homo sapiens
cactcagaaaattccctg

SEQ ID NO: 3566196 - DNA, 19 bp, Homo sapiens
cactcagaaaattccctgg

SEQ ID NO: 3566197 - DNA, 22 bp, Homo sapiens
cactcagaaaattccctggggt

SEQ ID NO: 3566198 - DNA, 12 bp, Homo sapiens
cactcaggccac

SEQ ID NO: 3566199 - DNA, 20 bp, Homo sapiens
cactcaggccacagtggggc

SEQ ID NO: 3566200 - DNA, 13 bp, Homo sapiens
cactcagtgcctc

SEQ ID NO: 3566201 - DNA, 15 bp, Homo sapiens
cactcagtgcctcca

SEQ ID NO: 3566202 - DNA, 17 bp, Homo sapiens
cactcatgactgcatga

SEQ ID NO: 3566203 - DNA, 23 bp, Homo sapiens
cactccactactctcttcctcca

SEQ ID NO: 3566204 - DNA, 10 bp, Homo sapiens
cactccagac

SEQ ID NO: 3566205 - DNA, 14 bp, Homo sapiens
cactccagactctg

SEQ ID NO: 3566206 - DNA, 16 bp, Homo sapiens
cactccagactctggg

SEQ ID NO: 3566207 - DNA, 19 bp, Homo sapiens
caagtgatctgtccacctc

SEQ ID NO: 3566208 - DNA, 15 bp, Homo sapiens
caagtgccaaatgct

SEQ ID NO: 3566209 - DNA, 16 bp, Homo sapiens
caagtgccaaatgctc

SEQ ID NO: 3566210 - DNA, 21 bp, Homo sapiens
caagtgccccaccactcccca

SEQ ID NO: 3566211 - DNA, 16 bp, Homo sapiens
caagtggagctgtctg

SEQ ID NO: 3566212 - DNA, 17 bp, Homo sapiens
caagtggagctgtctgt

SEQ ID NO: 3566213 - DNA, 20 bp, Homo sapiens
caagtggagctgtctgtctc

SEQ ID NO: 3566214 - DNA, 18 bp, Homo sapiens
caagtggcataaagcata

SEQ ID NO: 3566215 - DNA, 22 bp, Homo sapiens
caagtggtggtaaccctggtgg

SEQ ID NO: 3566216 - DNA, 14 bp, Homo sapiens
caagttaaataaat

SEQ ID NO: 3566217 - DNA, 21 bp, Homo sapiens
caagttccaacatgcaatact

SEQ ID NO: 3566218 - DNA, 22 bp, Homo sapiens
caagtttgctgcaacccaagtg

SEQ ID NO: 3566219 - DNA, 19 bp, Homo sapiens
caataaacatttcatttcc

SEQ ID NO: 3566220 - DNA, 17 bp, Homo sapiens
caataaagcaataagaa

SEQ ID NO: 3566221 - DNA, 22 bp, Homo sapiens
caataaagcagttaatttatat

SEQ ID NO: 3566222 - DNA, 18 bp, Homo sapiens
caatacctacaataaact

SEQ ID NO: 3566223 - DNA, 17 bp, Homo sapiens
caataggtctttctctc

SEQ ID NO: 3566224 - DNA, 19 bp, Homo sapiens
caatataactgagttatat

SEQ ID NO: 3566225 - DNA, 21 bp, Homo sapiens
caatatataagactattccaa

SEQ ID NO: 3566226 - DNA, 12 bp, Homo sapiens
caatatcctttg

SEQ ID NO: 3566227 - DNA, 15 bp, Homo sapiens
caatatgcaagcagc

SEQ ID NO: 3566228 - DNA, 19 bp, Homo sapiens
caatatgcaagcagctttt

SEQ ID NO: 3566229 - DNA, 20 bp, Homo sapiens
caatatgcaagcagcttttt

SEQ ID NO: 3566230 - DNA, 16 bp, Homo sapiens
caatattgactttgtc

SEQ ID NO: 3566231 - DNA, 17 bp, Homo sapiens
caatattgactttgtct

SEQ ID NO: 3566232 - DNA, 21 bp, Homo sapiens
caatatttactatttcaatac

SEQ ID NO: 3566233 - DNA, 14 bp, Homo sapiens
caatcaaatatatt

SEQ ID NO: 3566234 - DNA, 16 bp, Homo sapiens
caatcacagctcactg

SEQ ID NO: 3566235 - DNA, 18 bp, Homo sapiens
caatcagcccagtgcaaa

SEQ ID NO: 3566236 - DNA, 17 bp, Homo sapiens
caatccatgctctcttt

SEQ ID NO: 3566237 - DNA, 23 bp, Homo sapiens
caatccattcacaagcctcctgt

SEQ ID NO: 3566238 - DNA, 16 bp, Homo sapiens
caatcccaccaaccct

SEQ ID NO: 3566239 - DNA, 20 bp, Homo sapiens
caatctggattcatatttaa

SEQ ID NO: 3566240 - DNA, 16 bp, Homo sapiens
caatcttaaacataat

SEQ ID NO: 3566241 - DNA, 12 bp, Homo sapiens
caatcttccaaa

SEQ ID NO: 3566242 - DNA, 16 bp, Homo sapiens
caatctttcatgtctt

SEQ ID NO: 3566243 - DNA, 22 bp, Homo sapiens
caatctttcatgtcttgtcata

SEQ ID NO: 3566244 - DNA, 12 bp, Homo sapiens
caatctttctat

SEQ ID NO: 3566245 - DNA, 19 bp, Homo sapiens
caatctttgcctttatctc

SEQ ID NO: 3566246 - DNA, 14 bp, Homo sapiens
caatgacacagtct

SEQ ID NO: 3566247 - DNA, 19 bp, Homo sapiens
caatgacacagtcttggct

SEQ ID NO: 3566248 - DNA, 21 bp, Homo sapiens
caatgacacagtcttggctca

SEQ ID NO: 3566249 - DNA, 23 bp, Homo sapiens
caatgacacccatgccagagagg

SEQ ID NO: 3566250 - DNA, 19 bp, Homo sapiens
caatgagagcataatttaa

SEQ ID NO: 3566251 - DNA, 21 bp, Homo sapiens
caatgatggcaattttgtaac

SEQ ID NO: 3566252 - DNA, 22 bp, Homo sapiens
caatgccaaaaaaagacagggc

SEQ ID NO: 3566253 - DNA, 15 bp, Homo sapiens
caatgcccagtaaaa

SEQ ID NO: 3566254 - DNA, 14 bp, Homo sapiens
caatgccccaaact

SEQ ID NO: 3566255 - DNA, 13 bp, Homo sapiens
caatgctgctttt

SEQ ID NO: 3566256 - DNA, 16 bp, Homo sapiens
caatgcttgcatggag

SEQ ID NO: 3566257 - DNA, 17 bp, Homo sapiens
caatgggtcttagctct

SEQ ID NO: 3566258 - DNA, 20 bp, Homo sapiens
caatgtaataaaaagcctct

SEQ ID NO: 3566259 - DNA, 14 bp, Homo sapiens
caatgtccaaaccc

SEQ ID NO: 3566260 - DNA, 20 bp, Homo sapiens
caatgtggtgacacctcccc

SEQ ID NO: 3566261 - DNA, 21 bp, Homo sapiens
caatgtggtgacacctccccc

SEQ ID NO: 3566262 - DNA, 22 bp, Homo sapiens
caatgtggtgacacctccccct

SEQ ID NO: 3566263 - DNA, 20 bp, Homo sapiens
caatgtgttgatacattccc

SEQ ID NO: 3566264 - DNA, 19 bp, Homo sapiens
caatgttggagcagcaggc

SEQ ID NO: 3566265 - DNA, 18 bp, Homo sapiens
caattaaacggattattt

SEQ ID NO: 3566266 - DNA, 20 bp, Homo sapiens
caattaaacggattattttt

SEQ ID NO: 3566267 - DNA, 16 bp, Homo sapiens
caattagggcctagcc

SEQ ID NO: 3566268 - DNA, 21 bp, Homo sapiens
caattagtctgaaactggctt

SEQ ID NO: 3566269 - DNA, 15 bp, Homo sapiens
caattcagtaacaaa

SEQ ID NO: 3566270 - DNA, 19 bp, Homo sapiens
caattcatggttcaagtat

SEQ ID NO: 3566271 - DNA, 22 bp, Homo sapiens
caattcatggttcaagtattaa

SEQ ID NO: 3566272 - DNA, 14 bp, Homo sapiens
caattgagaaaaat

SEQ ID NO: 3566273 - DNA, 17 bp, Homo sapiens
caattggacaattattt

SEQ ID NO: 3566274 - DNA, 11 bp, Homo sapiens
caatttaaatg

SEQ ID NO: 3566275 - DNA, 14 bp, Homo sapiens
caatttaaatgtta

SEQ ID NO: 3566276 - DNA, 12 bp, Homo sapiens
caatttaaggaa

SEQ ID NO: 3566277 - DNA, 22 bp, Homo sapiens
caatttaaggaacacagagcag

SEQ ID NO: 3566278 - DNA, 13 bp, Homo sapiens
caatttagacaaa

SEQ ID NO: 3566279 - DNA, 22 bp, Homo sapiens
caatttcgggagccttgtcagt

SEQ ID NO: 3566280 - DNA, 22 bp, Homo sapiens
caatttctagtacctgtgactc

SEQ ID NO: 3566281 - DNA, 21 bp, Homo sapiens
caattttccttcagatatttt

SEQ ID NO: 3566282 - DNA, 11 bp, Homo sapiens
caattttgtaa

SEQ ID NO: 3566283 - DNA, 22 bp, Homo sapiens
caatttttcttatttcatttct

SEQ ID NO: 3566284 - DNA, 15 bp, Homo sapiens
caattttttttaatt

SEQ ID NO: 3566285 - DNA, 20 bp, Homo sapiens
caattttttttccgtaaatg

SEQ ID NO: 3566286 - DNA, 21 bp, Homo sapiens
caattttttttccgtaaatgt

SEQ ID NO: 3566287 - DNA, 22 bp, Homo sapiens
cacaaaactacttttctaaaat

SEQ ID NO: 3566288 - DNA, 15 bp, Homo sapiens
cacaaaccatgcaaa

SEQ ID NO: 3566289 - DNA, 15 bp, Homo sapiens
cacaaactccaggct

SEQ ID NO: 3566290 - DNA, 16 bp, Homo sapiens
cacaaactccaggctg

SEQ ID NO: 3566291 - DNA, 17 bp, Homo sapiens
cacaaactccaggctgg

SEQ ID NO: 3566292 - DNA, 19 bp, Homo sapiens
cacaaagaacttgctgctg

SEQ ID NO: 3566293 - DNA, 22 bp, Homo sapiens
cacaaagaacttgctgctgcct

SEQ ID NO: 3566294 - DNA, 12 bp, Homo sapiens
cacaaagcccaa

SEQ ID NO: 3566295 - DNA, 18 bp, Homo sapiens
cacaaagcccttccatgt

SEQ ID NO: 3566296 - DNA, 13 bp, Homo sapiens
cacaaatatttat

SEQ ID NO: 3566297 - DNA, 16 bp, Homo sapiens
cacaaatccttcaaaa

SEQ ID NO: 3566298 - DNA, 17 bp, Homo sapiens
cacaacagcagtctcct

SEQ ID NO: 3566299 - DNA, 19 bp, Homo sapiens
cacaacagccctgcctgag

SEQ ID NO: 3566300 - DNA, 17 bp, Homo sapiens
cacaaccttctgtggct

SEQ ID NO: 3566301 - DNA, 19 bp, Homo sapiens
cacaaccttctgtggctca

SEQ ID NO: 3566302 - DNA, 23 bp, Homo sapiens
cacaaccttctgtggctcacaga

SEQ ID NO: 3566303 - DNA, 15 bp, Homo sapiens
cacaactactagtgt

SEQ ID NO: 3566304 - DNA, 16 bp, Homo sapiens
cacaactggaagcttt

SEQ ID NO: 3566305 - DNA, 15 bp, Homo sapiens
cacaagactggccca

SEQ ID NO: 3566306 - DNA, 19 bp, Homo sapiens
cacaagactggcccagtgc

SEQ ID NO: 3566307 - DNA, 21 bp, Homo sapiens
cacaagactggcccagtgcca

SEQ ID NO: 3566308 - DNA, 15 bp, Homo sapiens
cacaagcctcctgta

SEQ ID NO: 3566309 - DNA, 16 bp, Homo sapiens
cacaagcctcctgtac

SEQ ID NO: 3566310 - DNA, 16 bp, Homo sapiens
cacaaggacttcctgt

SEQ ID NO: 3566311 - DNA, 22 bp, Homo sapiens
cacaaggacttcctgtccagct

SEQ ID NO: 3566312 - DNA, 18 bp, Homo sapiens
cacaaggatagatgctgg

SEQ ID NO: 3566313 - DNA, 22 bp, Homo sapiens
cacaaggatagatgctggccca

SEQ ID NO: 3566314 - DNA, 14 bp, Homo sapiens
cacaaggcccagga

SEQ ID NO: 3566315 - DNA, 13 bp, Homo sapiens
atatttgtacata

SEQ ID NO: 3566316 - DNA, 17 bp, Homo sapiens
atatttgtcaacagatt

SEQ ID NO: 3566317 - DNA, 16 bp, Homo sapiens
atatttgttttaatac

SEQ ID NO: 3566318 - DNA, 13 bp, Homo sapiens
atattttatgtgt

SEQ ID NO: 3566319 - DNA, 14 bp, Homo sapiens
atattttattttta

SEQ ID NO: 3566320 - DNA, 19 bp, Homo sapiens
atattttcaacgcagccct

SEQ ID NO: 3566321 - DNA, 22 bp, Homo sapiens
atattttcacactggtaaatgt

SEQ ID NO: 3566322 - DNA, 20 bp, Homo sapiens
atattttccgtcacttaaat

SEQ ID NO: 3566323 - DNA, 14 bp, Homo sapiens
atattttcctctta

SEQ ID NO: 3566324 - DNA, 13 bp, Homo sapiens
atattttgctaac

SEQ ID NO: 3566325 - DNA, 19 bp, Homo sapiens
atattttgctaactggtta

SEQ ID NO: 3566326 - DNA, 21 bp, Homo sapiens
atattttgctaactggttaaa

SEQ ID NO: 3566327 - DNA, 23 bp, Homo sapiens
atattttgctaactggttaaaca

SEQ ID NO: 3566328 - DNA, 17 bp, Homo sapiens
atatttttaaaaaatga

SEQ ID NO: 3566329 - DNA, 20 bp, Homo sapiens
atatttttataataaacata

SEQ ID NO: 3566330 - DNA, 13 bp, Homo sapiens
atatttttgtatt

SEQ ID NO: 3566331 - DNA, 15 bp, Homo sapiens
atatttttgtatttt

SEQ ID NO: 3566332 - DNA, 15 bp, Homo sapiens
atcaaagagaagatg

SEQ ID NO: 3566333 - DNA, 17 bp, Homo sapiens
atcaaataaatttctgg

SEQ ID NO: 3566334 - DNA, 13 bp, Homo sapiens
atcaaatacattt

SEQ ID NO: 3566335 - DNA, 18 bp, Homo sapiens
atcaaatatgcaaagcac

SEQ ID NO: 3566336 - DNA, 14 bp, Homo sapiens
atcaaatgtaaagt

SEQ ID NO: 3566337 - DNA, 17 bp, Homo sapiens
atcaaattctgtctggg

SEQ ID NO: 3566338 - DNA, 15 bp, Homo sapiens
atcaacagcttccct

SEQ ID NO: 3566339 - DNA, 13 bp, Homo sapiens
atcaagagaaact

SEQ ID NO: 3566340 - DNA, 16 bp, Homo sapiens
atcaaggataaatatc

SEQ ID NO: 3566341 - DNA, 14 bp, Homo sapiens
atcaatgagtgtga

SEQ ID NO: 3566342 - DNA, 19 bp, Homo sapiens
atcacagatgcatatagac

SEQ ID NO: 3566343 - DNA, 21 bp, Homo sapiens
atcacgacacatttgccttca

SEQ ID NO: 3566344 - DNA, 12 bp, Homo sapiens
atcactcctgga

SEQ ID NO: 3566345 - DNA, 18 bp, Homo sapiens
atcactctaggttttaca

SEQ ID NO: 3566346 - DNA, 23 bp, Homo sapiens
atcactgtgcttaatttaaatag

SEQ ID NO: 3566347 - DNA, 16 bp, Homo sapiens
atcacttgtacaaaat

SEQ ID NO: 3566348 - DNA, 17 bp, Homo sapiens
atcacttgtacaaaata

SEQ ID NO: 3566349 - DNA, 23 bp, Homo sapiens
atcagaaaacccacggtttttct

SEQ ID NO: 3566350 - DNA, 17 bp, Homo sapiens
atcagaacaaaacttct

SEQ ID NO: 3566351 - DNA, 21 bp, Homo sapiens
atcagaacattcagctctgga

SEQ ID NO: 3566352 - DNA, 20 bp, Homo sapiens
atcagaactcttcctcctcc

SEQ ID NO: 3566353 - DNA, 18 bp, Homo sapiens
atcagaagtcatcttgct

SEQ ID NO: 3566354 - DNA, 19 bp, Homo sapiens
atcagaagtcatcttgcta

SEQ ID NO: 3566355 - DNA, 18 bp, Homo sapiens
atcagaagtttctcagct

SEQ ID NO: 3566356 - DNA, 15 bp, Homo sapiens
atcagaatctgaaaa

SEQ ID NO: 3566357 - DNA, 16 bp, Homo sapiens
atcagcaatgccccaa

SEQ ID NO: 3566358 - DNA, 14 bp, Homo sapiens
atcagcaccccagt

SEQ ID NO: 3566359 - DNA, 17 bp, Homo sapiens
atcagcccagtgcaaac

SEQ ID NO: 3566360 - DNA, 17 bp, Homo sapiens
atcagctgctgaaacaa

SEQ ID NO: 3566361 - DNA, 17 bp, Homo sapiens
atcagctggacatactg

SEQ ID NO: 3566362 - DNA, 14 bp, Homo sapiens
atcaggagtgacag

SEQ ID NO: 3566363 - DNA, 16 bp, Homo sapiens
atcaggtcctcagaga

SEQ ID NO: 3566364 - DNA, 12 bp, Homo sapiens
atcagttaacta

SEQ ID NO: 3566365 - DNA, 15 bp, Homo sapiens
atcataaaacttgat

SEQ ID NO: 3566366 - DNA, 22 bp, Homo sapiens
atcataagttatgcctctgaca

SEQ ID NO: 3566367 - DNA, 19 bp, Homo sapiens
atcatatagaccaattgaa

SEQ ID NO: 3566368 - DNA, 17 bp, Homo sapiens
atcatatttgaaaacca

SEQ ID NO: 3566369 - DNA, 16 bp, Homo sapiens
atcatcccttaataaa

SEQ ID NO: 3566370 - DNA, 19 bp, Homo sapiens
atcatccctttcccttggt

SEQ ID NO: 3566371 - DNA, 12 bp, Homo sapiens
atcatcctactg

SEQ ID NO: 3566372 - DNA, 23 bp, Homo sapiens
atcatgagtgaataaatgtcttg

SEQ ID NO: 3566373 - DNA, 16 bp, Homo sapiens
atcatgtgtagagccc

SEQ ID NO: 3566374 - DNA, 22 bp, Homo sapiens
atcatgttgttgtgtgtatatg

SEQ ID NO: 3566375 - DNA, 23 bp, Homo sapiens
atcatgttgttgtgtgtatatgt

SEQ ID NO: 3566376 - DNA, 23 bp, Homo sapiens
atcatgtttacagaggacagtat

SEQ ID NO: 3566377 - DNA, 12 bp, Homo sapiens
atcattactgtt

SEQ ID NO: 3566378 - DNA, 23 bp, Homo sapiens
atcattcttactaaaaagtataa

SEQ ID NO: 3566379 - DNA, 15 bp, Homo sapiens
atcatttcagccaaa

SEQ ID NO: 3566380 - DNA, 16 bp, Homo sapiens
atcatttcagccaaag

SEQ ID NO: 3566381 - DNA, 22 bp, Homo sapiens
atcattttaaattccactgaaa

SEQ ID NO: 3566382 - DNA, 18 bp, Homo sapiens
atccaaaaagctctgaaa

SEQ ID NO: 3566383 - DNA, 21 bp, Homo sapiens
atccaaaaagctctgaaaaca

SEQ ID NO: 3566384 - DNA, 13 bp, Homo sapiens
atccaaaagaagc

SEQ ID NO: 3566385 - DNA, 18 bp, Homo sapiens
atccaaatcttgaatttc

SEQ ID NO: 3566386 - DNA, 22 bp, Homo sapiens
atccaaatttttttttaaagca

SEQ ID NO: 3566387 - DNA, 21 bp, Homo sapiens
atccaagaaaatggccagtga

SEQ ID NO: 3566388 - DNA, 15 bp, Homo sapiens
atccaaggcaaacaa

SEQ ID NO: 3566389 - DNA, 18 bp, Homo sapiens
atccaaggcaaacaatcc

SEQ ID NO: 3566390 - DNA, 21 bp, Homo sapiens
atccacaattattggcaaagt

SEQ ID NO: 3566391 - DNA, 19 bp, Homo sapiens
atccaccaccaaaattatt

SEQ ID NO: 3566392 - DNA, 23 bp, Homo sapiens
atccacccgggggagcccagtga

SEQ ID NO: 3566393 - DNA, 10 bp, Homo sapiens
atccagccac

SEQ ID NO: 3566394 - DNA, 12 bp, Homo sapiens
atccagccactt

SEQ ID NO: 3566395 - DNA, 21 bp, Homo sapiens
atccagcctggggctgaggct

SEQ ID NO: 3566396 - DNA, 14 bp, Homo sapiens
atccaggcagatcc

SEQ ID NO: 3566397 - DNA, 15 bp, Homo sapiens
atccaggcagatcca

SEQ ID NO: 3566398 - DNA, 16 bp, Homo sapiens
atccaggcagatccag

SEQ ID NO: 3566399 - DNA, 14 bp, Homo sapiens
atccaggcccctcc

SEQ ID NO: 3566400 - DNA, 19 bp, Homo sapiens
atccagggacagaggcccc

SEQ ID NO: 3566401 - DNA, 20 bp, Homo sapiens
atccagggacagaggcccca

SEQ ID NO: 3566402 - DNA, 18 bp, Homo sapiens
atccagggcagcaggcca

SEQ ID NO: 3566403 - DNA, 20 bp, Homo sapiens
atccagggcagcaggccaga

SEQ ID NO: 3566404 - DNA, 17 bp, Homo sapiens
atccagggggcaagagg

SEQ ID NO: 3566405 - DNA, 19 bp, Homo sapiens
atccaggttccctcccaga

SEQ ID NO: 3566406 - DNA, 21 bp, Homo sapiens
atccagtgacatgattctgaa

SEQ ID NO: 3566407 - DNA, 14 bp, Homo sapiens
atccagtggtgggt

SEQ ID NO: 3566408 - DNA, 16 bp, Homo sapiens
atccagtggtgggtaa

SEQ ID NO: 3566409 - DNA, 17 bp, Homo sapiens
atccagtgtgagatact

SEQ ID NO: 3566410 - DNA, 23 bp, Homo sapiens
atccataaagacaatcactgcca

SEQ ID NO: 3566411 - DNA, 13 bp, Homo sapiens
atccatcaggcca

SEQ ID NO: 3566412 - DNA, 13 bp, Homo sapiens
atccatcctgagc

SEQ ID NO: 3566413 - DNA, 14 bp, Homo sapiens
atccatcttgagcc

SEQ ID NO: 3566414 - DNA, 18 bp, Homo sapiens
atccatcttgagccacag

SEQ ID NO: 3566415 - DNA, 16 bp, Homo sapiens
atccattcacaagcct

SEQ ID NO: 3566416 - DNA, 21 bp, Homo sapiens
atccattcacaagcctcctgt

SEQ ID NO: 3566417 - DNA, 16 bp, Homo sapiens
atccatttcaggactc

SEQ ID NO: 3566418 - DNA, 14 bp, Homo sapiens
atcccaatctttct

SEQ ID NO: 3566419 - DNA, 15 bp, Homo sapiens
atcccaatctttcta

SEQ ID NO: 3566420 - DNA, 16 bp, Homo sapiens
atcccaatctttctat

SEQ ID NO: 3566421 - DNA, 20 bp, Homo sapiens
atcccaccccctcctccccc

SEQ ID NO: 3566422 - DNA, 13 bp, Homo sapiens
atcccaccttccc

SEQ ID NO: 3566423 - DNA, 14 bp, Homo sapiens
atcccaccttccca

SEQ ID NO: 3566424 - DNA, 15 bp, Homo sapiens
atcccctccctgcct

SEQ ID NO: 3566425 - DNA, 17 bp, Homo sapiens
attttacctattctgaa

SEQ ID NO: 3566426 - DNA, 13 bp, Homo sapiens
attttactgtctt

SEQ ID NO: 3566427 - DNA, 18 bp, Homo sapiens
attttagaaactacaaat

SEQ ID NO: 3566428 - DNA, 14 bp, Homo sapiens
attttagacattca

SEQ ID NO: 3566429 - DNA, 20 bp, Homo sapiens
attttatccctcacctgtag

SEQ ID NO: 3566430 - DNA, 13 bp, Homo sapiens
attttatgtgtaa

SEQ ID NO: 3566431 - DNA, 15 bp, Homo sapiens
attttattgtatttt

SEQ ID NO: 3566432 - DNA, 20 bp, Homo sapiens
attttattgtattttgatga

SEQ ID NO: 3566433 - DNA, 15 bp, Homo sapiens
attttatttacagct

SEQ ID NO: 3566434 - DNA, 18 bp, Homo sapiens
attttatttttagaattt

SEQ ID NO: 3566435 - DNA, 17 bp, Homo sapiens
attttcaagaaactgag

SEQ ID NO: 3566436 - DNA, 22 bp, Homo sapiens
attttcaagaaactgaggaatt

SEQ ID NO: 3566437 - DNA, 13 bp, Homo sapiens
attttcactgtag

SEQ ID NO: 3566438 - DNA, 16 bp, Homo sapiens
attttcagtgcatcat

SEQ ID NO: 3566439 - DNA, 13 bp, Homo sapiens
attttcagttcta

SEQ ID NO: 3566440 - DNA, 19 bp, Homo sapiens
attttccaggactgtttca

SEQ ID NO: 3566441 - DNA, 21 bp, Homo sapiens
attttccgcccactcctggga

SEQ ID NO: 3566442 - DNA, 13 bp, Homo sapiens
attttccttctga

SEQ ID NO: 3566443 - DNA, 14 bp, Homo sapiens
attttccttctgaa

SEQ ID NO: 3566444 - DNA, 16 bp, Homo sapiens
attttccttctgaagt

SEQ ID NO: 3566445 - DNA, 12 bp, Homo sapiens
attttctaaata

SEQ ID NO: 3566446 - DNA, 18 bp, Homo sapiens
attttctggaatacatga

SEQ ID NO: 3566447 - DNA, 16 bp, Homo sapiens
attttctttctgtaac

SEQ ID NO: 3566448 - DNA, 18 bp, Homo sapiens
attttcttttgaattgtt

SEQ ID NO: 3566449 - DNA, 20 bp, Homo sapiens
attttcttttgaattgtttt

SEQ ID NO: 3566450 - DNA, 18 bp, Homo sapiens
attttctttttcttaaga

SEQ ID NO: 3566451 - DNA, 22 bp, Homo sapiens
attttgaagtgctgtttattaa

SEQ ID NO: 3566452 - DNA, 18 bp, Homo sapiens
attttgacataagtaact

SEQ ID NO: 3566453 - DNA, 18 bp, Homo sapiens
attttgatgtaaagatgt

SEQ ID NO: 3566454 - DNA, 20 bp, Homo sapiens
attttgcaaaaatcctattc

SEQ ID NO: 3566455 - DNA, 12 bp, Homo sapiens
attttgctaact

SEQ ID NO: 3566456 - DNA, 16 bp, Homo sapiens
attttgctaactgggt

SEQ ID NO: 3566457 - DNA, 20 bp, Homo sapiens
attttgctgcttgatgatga

SEQ ID NO: 3566458 - DNA, 14 bp, Homo sapiens
attttggaaaataa

SEQ ID NO: 3566459 - DNA, 20 bp, Homo sapiens
attttggaaaataaattatt

SEQ ID NO: 3566460 - DNA, 20 bp, Homo sapiens
attttggagagtttcctgaa

SEQ ID NO: 3566461 - DNA, 18 bp, Homo sapiens
attttgtaacgaagacac

SEQ ID NO: 3566462 - DNA, 13 bp, Homo sapiens
attttgtaataaa

SEQ ID NO: 3566463 - DNA, 20 bp, Homo sapiens
attttgtgaaacagacttgt

SEQ ID NO: 3566464 - DNA, 24 bp, Homo sapiens
attttgtgaaacagacttgtatat

SEQ ID NO: 3566465 - DNA, 17 bp, Homo sapiens
attttgtgtaagaaata

SEQ ID NO: 3566466 - DNA, 23 bp, Homo sapiens
attttgttgctgttttgatttgt

SEQ ID NO: 3566467 - DNA, 15 bp, Homo sapiens
attttgttggcatag

SEQ ID NO: 3566468 - DNA, 20 bp, Homo sapiens
attttgtttcttttaaagca

SEQ ID NO: 3566469 - DNA, 16 bp, Homo sapiens
atttttaaaaaatgaa

SEQ ID NO: 3566470 - DNA, 13 bp, Homo sapiens
atttttaaagaat

SEQ ID NO: 3566471 - DNA, 12 bp, Homo sapiens
atttttaagaaa

SEQ ID NO: 3566472 - DNA, 18 bp, Homo sapiens
atttttaagaaagtaatt

SEQ ID NO: 3566473 - DNA, 23 bp, Homo sapiens
atttttaaggtctaatcagtgat

SEQ ID NO: 3566474 - DNA, 17 bp, Homo sapiens
atttttaggacatgaaa

SEQ ID NO: 3566475 - DNA, 17 bp, Homo sapiens
atttttatacactgtaa

SEQ ID NO: 3566476 - DNA, 18 bp, Homo sapiens
atttttatacactgtaag

SEQ ID NO: 3566477 - DNA, 14 bp, Homo sapiens
atttttatgtacat

SEQ ID NO: 3566478 - DNA, 17 bp, Homo sapiens
atttttatttctgactc

SEQ ID NO: 3566479 - DNA, 16 bp, Homo sapiens
atttttatttgtaaag

SEQ ID NO: 3566480 - DNA, 17 bp, Homo sapiens
atttttcaaaatcgttt

SEQ ID NO: 3566481 - DNA, 15 bp, Homo sapiens
atttttcatcctaaa

SEQ ID NO: 3566482 - DNA, 21 bp, Homo sapiens
atttttccaactactaataga

SEQ ID NO: 3566483 - DNA, 19 bp, Homo sapiens
atttttccagctccgtgtt

SEQ ID NO: 3566484 - DNA, 10 bp, Homo sapiens
atttttcctt

SEQ ID NO: 3566485 - DNA, 11 bp, Homo sapiens
atttttccttt

SEQ ID NO: 3566486 - DNA, 12 bp, Homo sapiens
atttttcctttt

SEQ ID NO: 3566487 - DNA, 18 bp, Homo sapiens
atttttctcccaagaaac

SEQ ID NO: 3566488 - DNA, 21 bp, Homo sapiens
atttttctcccaagaaacctg

SEQ ID NO: 3566489 - DNA, 24 bp, Homo sapiens
atttttctcccaagaaacctgact

SEQ ID NO: 3566490 - DNA, 21 bp, Homo sapiens
atttttgttagcaaagattaa

SEQ ID NO: 3566491 - DNA, 13 bp, Homo sapiens
attttttaaaaag

SEQ ID NO: 3566492 - DNA, 16 bp, Homo sapiens
attttttaataaactg

SEQ ID NO: 3566493 - DNA, 13 bp, Homo sapiens
attttttcagacc

SEQ ID NO: 3566494 - DNA, 15 bp, Homo sapiens
attttttgtataatt

SEQ ID NO: 3566495 - DNA, 18 bp, Homo sapiens
attttttttaagtattta

SEQ ID NO: 3566496 - DNA, 17 bp, Homo sapiens
attttttttatatttat

SEQ ID NO: 3566497 - DNA, 23 bp, Homo sapiens
attttttttccgtaaatgtctgc

SEQ ID NO: 3566498 - DNA, 20 bp, Homo sapiens
attttttttctttgaataaa

SEQ ID NO: 3566499 - DNA, 17 bp, Homo sapiens
atttttttttcctagcc

SEQ ID NO: 3566500 - DNA, 22 bp, Homo sapiens
attttttttttaaataaaagca

SEQ ID NO: 3566501 - DNA, 16 bp, Homo sapiens
attttttttttaaatc

SEQ ID NO: 3566502 - DNA, 18 bp, Homo sapiens
caaaaaaacaagtttaga

SEQ ID NO: 3566503 - DNA, 14 bp, Homo sapiens
caaaaacaaaaaga

SEQ ID NO: 3566504 - DNA, 14 bp, Homo sapiens
caaaaacaagacag

SEQ ID NO: 3566505 - DNA, 14 bp, Homo sapiens
caaaaagccacagc

SEQ ID NO: 3566506 - DNA, 20 bp, Homo sapiens
caaaaagccacagcagagca

SEQ ID NO: 3566507 - DNA, 21 bp, Homo sapiens
caaaaaggagccttttgctct

SEQ ID NO: 3566508 - DNA, 24 bp, Homo sapiens
caaaaaggagccttttgctctctg

SEQ ID NO: 3566509 - DNA, 13 bp, Homo sapiens
aggagacctccag

SEQ ID NO: 3566510 - DNA, 13 bp, Homo sapiens
aggagagagccag

SEQ ID NO: 3566511 - DNA, 15 bp, Homo sapiens
aggagagaggaggaa

SEQ ID NO: 3566512 - DNA, 12 bp, Homo sapiens
aggagagcctgg

SEQ ID NO: 3566513 - DNA, 19 bp, Homo sapiens
aggagataaggtggcttct

SEQ ID NO: 3566514 - DNA, 14 bp, Homo sapiens
aggagatgaccagg

SEQ ID NO: 3566515 - DNA, 16 bp, Homo sapiens
aggagatgaccaggga

SEQ ID NO: 3566516 - DNA, 15 bp, Homo sapiens
aggagatggagggct

SEQ ID NO: 3566517 - DNA, 15 bp, Homo sapiens
aggagcactgaaagt

SEQ ID NO: 3566518 - DNA, 14 bp, Homo sapiens
aggagcagaaagat

SEQ ID NO: 3566519 - DNA, 20 bp, Homo sapiens
aggagcagcaggagggggga

SEQ ID NO: 3566520 - DNA, 12 bp, Homo sapiens
aggagcaggctt

SEQ ID NO: 3566521 - DNA, 21 bp, Homo sapiens
aggagcaggcttgtggcagcc

SEQ ID NO: 3566522 - DNA, 12 bp, Homo sapiens
aggagcatcctt

SEQ ID NO: 3566523 - DNA, 15 bp, Homo sapiens
aggagccaccagttc

SEQ ID NO: 3566524 - DNA, 14 bp, Homo sapiens
aggagccagcctgc

SEQ ID NO: 3566525 - DNA, 18 bp, Homo sapiens
aggagccgaagcccaggg

SEQ ID NO: 3566526 - DNA, 21 bp, Homo sapiens
aggagcctagcggagcccagc

SEQ ID NO: 3566527 - DNA, 14 bp, Homo sapiens
aggagcctggccag

SEQ ID NO: 3566528 - DNA, 15 bp, Homo sapiens
aggagcctggccagg

SEQ ID NO: 3566529 - DNA, 18 bp, Homo sapiens
aggagcctggccaggcag

SEQ ID NO: 3566530 - DNA, 12 bp, Homo sapiens
aggagcctgtgc

SEQ ID NO: 3566531 - DNA, 13 bp, Homo sapiens
aggagcctgtgcg

SEQ ID NO: 3566532 - DNA, 22 bp, Homo sapiens
aggagcctgtgcgtcccagctg

SEQ ID NO: 3566533 - DNA, 22 bp, Homo sapiens
aggagctccatacacacgctgc

SEQ ID NO: 3566534 - DNA, 13 bp, Homo sapiens
aggagctgctata

SEQ ID NO: 3566535 - DNA, 20 bp, Homo sapiens
aggagctggggatccctccc

SEQ ID NO: 3566536 - DNA, 19 bp, Homo sapiens
aggaggaaaagtcttccta

SEQ ID NO: 3566537 - DNA, 22 bp, Homo sapiens
aggaggccaaccagcccgacag

SEQ ID NO: 3566538 - DNA, 16 bp, Homo sapiens
aggaggcctgtcccaa

SEQ ID NO: 3566539 - DNA, 22 bp, Homo sapiens
aggagggaggcaggggaggggt

SEQ ID NO: 3566540 - DNA, 23 bp, Homo sapiens
aggaggggcagcgcatgtgtgca

SEQ ID NO: 3566541 - DNA, 13 bp, Homo sapiens
aggaggggccgct

SEQ ID NO: 3566542 - DNA, 18 bp, Homo sapiens
aggagggggcaggctgag

SEQ ID NO: 3566543 - DNA, 20 bp, Homo sapiens
aggaggtgaaatccctgcct

SEQ ID NO: 3566544 - DNA, 15 bp, Homo sapiens
aggaggtgggccaca

SEQ ID NO: 3566545 - DNA, 18 bp, Homo sapiens
aggagtgtcctgcccatg

SEQ ID NO: 3566546 - DNA, 18 bp, Homo sapiens
aggagttacagggaagtg

SEQ ID NO: 3566547 - DNA, 13 bp, Homo sapiens
aggagtttgtggt

SEQ ID NO: 3566548 - DNA, 14 bp, Homo sapiens
aggatagatgctgg

SEQ ID NO: 3566549 - DNA, 20 bp, Homo sapiens
aggatagatgctggcccagg

SEQ ID NO: 3566550 - DNA, 22 bp, Homo sapiens
aggatagtgtgaagatctttgg

SEQ ID NO: 3566551 - DNA, 14 bp, Homo sapiens
aggatatattttat

SEQ ID NO: 3566552 - DNA, 17 bp, Homo sapiens
aggatatcggcatttgt

SEQ ID NO: 3566553 - DNA, 15 bp, Homo sapiens
aggatcagttaacta

SEQ ID NO: 3566554 - DNA, 23 bp, Homo sapiens
aggatcagttaactattgcattt

SEQ ID NO: 3566555 - DNA, 20 bp, Homo sapiens
aggatcatttgttggaatga

SEQ ID NO: 3566556 - DNA, 21 bp, Homo sapiens
aggatcatttgttggaatgaa

SEQ ID NO: 3566557 - DNA, 19 bp, Homo sapiens
aggatccagggcagcaggc

SEQ ID NO: 3566558 - DNA, 24 bp, Homo sapiens
aggatccagggcagcaggccagag

SEQ ID NO: 3566559 - DNA, 14 bp, Homo sapiens
aggatccagtgaca

SEQ ID NO: 3566560 - DNA, 17 bp, Homo sapiens
aggatccagtgacatga

SEQ ID NO: 3566561 - DNA, 15 bp, Homo sapiens
aggatcctggaggct

SEQ ID NO: 3566562 - DNA, 14 bp, Homo sapiens
aggatctctaaaga

SEQ ID NO: 3566563 - DNA, 12 bp, Homo sapiens
aggatctgtgat

SEQ ID NO: 3566564 - DNA, 18 bp, Homo sapiens
aggatctttgtggccaag

SEQ ID NO: 3566565 - DNA, 13 bp, Homo sapiens
aggatcttttgaa

SEQ ID NO: 3566566 - DNA, 23 bp, Homo sapiens
aggatgctaacatctaaaaatag

SEQ ID NO: 3566567 - DNA, 21 bp, Homo sapiens
aggatgggaatcaggcatgtg

SEQ ID NO: 3566568 - DNA, 14 bp, Homo sapiens
aggatgtgatatat

SEQ ID NO: 3566569 - DNA, 18 bp, Homo sapiens
aggatgtgatatataagt

SEQ ID NO: 3566570 - DNA, 19 bp, Homo sapiens
aggattaactaaagaagag

SEQ ID NO: 3566571 - DNA, 17 bp, Homo sapiens
aggattacagaaactga

SEQ ID NO: 3566572 - DNA, 19 bp, Homo sapiens
aggattacagaaactgatg

SEQ ID NO: 3566573 - DNA, 23 bp, Homo sapiens
aggattacagaaactgatgccaa

SEQ ID NO: 3566574 - DNA, 14 bp, Homo sapiens
aggattttaccaaa

SEQ ID NO: 3566575 - DNA, 16 bp, Homo sapiens
aggattttaccaaagc

SEQ ID NO: 3566576 - DNA, 15 bp, Homo sapiens
aggatttttatgtac

SEQ ID NO: 3566577 - DNA, 17 bp, Homo sapiens
aggcaaaatccttgctt

SEQ ID NO: 3566578 - DNA, 13 bp, Homo sapiens
aggcaaacaatcc

SEQ ID NO: 3566579 - DNA, 15 bp, Homo sapiens
aggcaaaggcctgga

SEQ ID NO: 3566580 - DNA, 15 bp, Homo sapiens
aggcacactttctgg

SEQ ID NO: 3566581 - DNA, 14 bp, Homo sapiens
aggcacagtgggag

SEQ ID NO: 3566582 - DNA, 15 bp, Homo sapiens
aggcacagtgggagc

SEQ ID NO: 3566583 - DNA, 17 bp, Homo sapiens
aggcaccacagcctcca

SEQ ID NO: 3566584 - DNA, 17 bp, Homo sapiens
aggcaccgtccaggccc

SEQ ID NO: 3566585 - DNA, 16 bp, Homo sapiens
aggcactgctgcccag

SEQ ID NO: 3566586 - DNA, 21 bp, Homo sapiens
aggcagagtggcgtggcctcc

SEQ ID NO: 3566587 - DNA, 11 bp, Homo sapiens
aggcagatcca

SEQ ID NO: 3566588 - DNA, 16 bp, Homo sapiens
aggcagatccaggact

SEQ ID NO: 3566589 - DNA, 13 bp, Homo sapiens
aggcagcgacccc

SEQ ID NO: 3566590 - DNA, 16 bp, Homo sapiens
aggcagcgaccccagg

SEQ ID NO: 3566591 - DNA, 20 bp, Homo sapiens
aggcagctatttcagcctcc

SEQ ID NO: 3566592 - DNA, 15 bp, Homo sapiens
aggcagctgaaattc

SEQ ID NO: 3566593 - DNA, 21 bp, Homo sapiens
aggcagcttctactcctgcct

SEQ ID NO: 3566594 - DNA, 15 bp, Homo sapiens
aggcagcttgaaact

SEQ ID NO: 3566595 - DNA, 14 bp, Homo sapiens
aggcagggagagag

SEQ ID NO: 3566596 - DNA, 19 bp, Homo sapiens
aggcaggggaatgtatgtg

SEQ ID NO: 3566597 - DNA, 23 bp, Homo sapiens
caaaaatagagaaaattcaggtc

SEQ ID NO: 3566598 - DNA, 19 bp, Homo sapiens
caaaaatcccaccttccca

SEQ ID NO: 3566599 - DNA, 20 bp, Homo sapiens
caaaaatcccaccttcccac

SEQ ID NO: 3566600 - DNA, 12 bp, Homo sapiens
caaaacaaaaca

SEQ ID NO: 3566601 - DNA, 16 bp, Homo sapiens
caaaacaaaggcctaa

SEQ ID NO: 3566602 - DNA, 22 bp, Homo sapiens
caaaacaaaggcctaattctat

SEQ ID NO: 3566603 - DNA, 16 bp, Homo sapiens
caaaacagctttgtct

SEQ ID NO: 3566604 - DNA, 17 bp, Homo sapiens
caaaacagctttgtctc

SEQ ID NO: 3566605 - DNA, 14 bp, Homo sapiens
caaaacccagctgc

SEQ ID NO: 3566606 - DNA, 14 bp, Homo sapiens
caaaacgggtcagt

SEQ ID NO: 3566607 - DNA, 21 bp, Homo sapiens
caaaactacttttctaaaatc

SEQ ID NO: 3566608 - DNA, 18 bp, Homo sapiens
caaaactgcactgtcaag

SEQ ID NO: 3566609 - DNA, 22 bp, Homo sapiens
caaaactgcctcaggaggcagg

SEQ ID NO: 3566610 - DNA, 18 bp, Homo sapiens
caaaacttaaaagtattc

SEQ ID NO: 3566611 - DNA, 14 bp, Homo sapiens
caaaacttgcatct

SEQ ID NO: 3566612 - DNA, 14 bp, Homo sapiens
caaaagaaacacca

SEQ ID NO: 3566613 - DNA, 19 bp, Homo sapiens
caaaagaaacaccagtgtt

SEQ ID NO: 3566614 - DNA, 14 bp, Homo sapiens
caaaagaagagttt

SEQ ID NO: 3566615 - DNA, 11 bp, Homo sapiens
caaaagacatt

SEQ ID NO: 3566616 - DNA, 18 bp, Homo sapiens
caaaagacattagagaaa

SEQ ID NO: 3566617 - DNA, 19 bp, Homo sapiens
caaaagacattagagaaaa

SEQ ID NO: 3566618 - DNA, 15 bp, Homo sapiens
caaaagatacaaaag

SEQ ID NO: 3566619 - DNA, 19 bp, Homo sapiens
caaaagatgtgcaaaatca

SEQ ID NO: 3566620 - DNA, 12 bp, Homo sapiens
caaaagctgctc

SEQ ID NO: 3566621 - DNA, 15 bp, Homo sapiens
caaaagctttttaaa

SEQ ID NO: 3566622 - DNA, 20 bp, Homo sapiens
caaaagctttttaaaattta

SEQ ID NO: 3566623 - DNA, 15 bp, Homo sapiens
caaaaggaacaaaaa

SEQ ID NO: 3566624 - DNA, 23 bp, Homo sapiens
caaaaggaagagctatatcctta

SEQ ID NO: 3566625 - DNA, 19 bp, Homo sapiens
caaaaggatctttgtggcc

SEQ ID NO: 3566626 - DNA, 22 bp, Homo sapiens
caaaaggatctttgtggccaag

SEQ ID NO: 3566627 - DNA, 18 bp, Homo sapiens
caaaataccactagtgga

SEQ ID NO: 3566628 - DNA, 17 bp, Homo sapiens
caaaatatttgtacata

SEQ ID NO: 3566629 - DNA, 16 bp, Homo sapiens
caaaatcctcaggaaa

SEQ ID NO: 3566630 - DNA, 17 bp, Homo sapiens
caaaatcctcaggaaat

SEQ ID NO: 3566631 - DNA, 11 bp, Homo sapiens
caaaatgaaag

SEQ ID NO: 3566632 - DNA, 16 bp, Homo sapiens
caaaatggacatggtg

SEQ ID NO: 3566633 - DNA, 15 bp, Homo sapiens
caaaatgtagggtta

SEQ ID NO: 3566634 - DNA, 11 bp, Homo sapiens
caaaattgctt

SEQ ID NO: 3566635 - DNA, 14 bp, Homo sapiens
caaaattgcttcta

SEQ ID NO: 3566636 - DNA, 21 bp, Homo sapiens
caaaattgcttctaaaacaat

SEQ ID NO: 3566637 - DNA, 14 bp, Homo sapiens
caaacaaacaaaca

SEQ ID NO: 3566638 - DNA, 15 bp, Homo sapiens
caaacacctcccagg

SEQ ID NO: 3566639 - DNA, 20 bp, Homo sapiens
caaacaggatcagttaacta

SEQ ID NO: 3566640 - DNA, 16 bp, Homo sapiens
caaacatcattgttta

SEQ ID NO: 3566641 - DNA, 21 bp, Homo sapiens
caaacattcgtgagctgggga

SEQ ID NO: 3566642 - DNA, 14 bp, Homo sapiens
caacctccagactc

SEQ ID NO: 3566643 - DNA, 18 bp, Homo sapiens
caacctccagactcagca

SEQ ID NO: 3566644 - DNA, 20 bp, Homo sapiens
caacctccgccttccgggtt

SEQ ID NO: 3566645 - DNA, 19 bp, Homo sapiens
caacctctgtggtcaccca

SEQ ID NO: 3566646 - DNA, 17 bp, Homo sapiens
caacctgcaaagatctg

SEQ ID NO: 3566647 - DNA, 20 bp, Homo sapiens
caaccttctgtggctcacag

SEQ ID NO: 3566648 - DNA, 12 bp, Homo sapiens
caacgcagccct

SEQ ID NO: 3566649 - DNA, 13 bp, Homo sapiens
caacgcagccctg

SEQ ID NO: 3566650 - DNA, 18 bp, Homo sapiens
caacgcagccctgctttg

SEQ ID NO: 3566651 - DNA, 17 bp, Homo sapiens
caacgcccctccaaacc

SEQ ID NO: 3566652 - DNA, 14 bp, Homo sapiens
caacgcccctgtgg

SEQ ID NO: 3566653 - DNA, 17 bp, Homo sapiens
caacgcccctgtggcca

SEQ ID NO: 3566654 - DNA, 19 bp, Homo sapiens
caacgcccctgtggccaac

SEQ ID NO: 3566655 - DNA, 22 bp, Homo sapiens
caacgcccctgtggccaactgc

SEQ ID NO: 3566656 - DNA, 14 bp, Homo sapiens
caacgtagcctggg

SEQ ID NO: 3566657 - DNA, 18 bp, Homo sapiens
caacgtgagagaaagaga

SEQ ID NO: 3566658 - DNA, 19 bp, Homo sapiens
caacgtgcaaagccaaggc

SEQ ID NO: 3566659 - DNA, 22 bp, Homo sapiens
caactaaaaatatatctgttgg

SEQ ID NO: 3566660 - DNA, 20 bp, Homo sapiens
caactactagtgtgactcct

SEQ ID NO: 3566661 - DNA, 17 bp, Homo sapiens
caactccatactccact

SEQ ID NO: 3566662 - DNA, 18 bp, Homo sapiens
caactccatactccactc

SEQ ID NO: 3566663 - DNA, 18 bp, Homo sapiens
caactctaactctgagag

SEQ ID NO: 3566664 - DNA, 17 bp, Homo sapiens
caactgacattgctcca

SEQ ID NO: 3566665 - DNA, 18 bp, Homo sapiens
caactgacctgagcggca

SEQ ID NO: 3566666 - DNA, 23 bp, Homo sapiens
caactgcaaagaaagtgggaggt

SEQ ID NO: 3566667 - DNA, 16 bp, Homo sapiens
caactgccaggctgcc

SEQ ID NO: 3566668 - DNA, 11 bp, Homo sapiens
caactgcccta

SEQ ID NO: 3566669 - DNA, 14 bp, Homo sapiens
caactggaagcttt

SEQ ID NO: 3566670 - DNA, 17 bp, Homo sapiens
caactgggcatttcaat

SEQ ID NO: 3566671 - DNA, 21 bp, Homo sapiens
caactggggttgcgtctgagg

SEQ ID NO: 3566672 - DNA, 19 bp, Homo sapiens
caactgtttccctgctgaa

SEQ ID NO: 3566673 - DNA, 19 bp, Homo sapiens
caacttctcttgctttcta

SEQ ID NO: 3566674 - DNA, 18 bp, Homo sapiens
caagaatagatgctgact

SEQ ID NO: 3566675 - DNA, 19 bp, Homo sapiens
caagaatagcattgtaaaa

SEQ ID NO: 3566676 - DNA, 21 bp, Homo sapiens
caagaattggaagctgccctg

SEQ ID NO: 3566677 - DNA, 21 bp, Homo sapiens
caagacacgtggcctcgtgag

SEQ ID NO: 3566678 - DNA, 15 bp, Homo sapiens
caagacgaggggcag

SEQ ID NO: 3566679 - DNA, 16 bp, Homo sapiens
caagacgaggggcagg

SEQ ID NO: 3566680 - DNA, 13 bp, Homo sapiens
caagactggccca

SEQ ID NO: 3566681 - DNA, 13 bp, Homo sapiens
caagagaaacttc

SEQ ID NO: 3566682 - DNA, 20 bp, Homo sapiens
caagagatctgtgtggctcc

SEQ ID NO: 3566683 - DNA, 21 bp, Homo sapiens
caagagatctttctttccaaa

SEQ ID NO: 3566684 - DNA, 17 bp, Homo sapiens
caagagcatgcacatgc

SEQ ID NO: 3566685 - DNA, 12 bp, Homo sapiens
caagagccaagt

SEQ ID NO: 3566686 - DNA, 14 bp, Homo sapiens
caagaggagatcca

SEQ ID NO: 3566687 - DNA, 19 bp, Homo sapiens
caagaggctgtagaaaggg

SEQ ID NO: 3566688 - DNA, 17 bp, Homo sapiens
caagagggcactggtgg

SEQ ID NO: 3566689 - DNA, 18 bp, Homo sapiens
caagagggcactggtggc

SEQ ID NO: 3566690 - DNA, 20 bp, Homo sapiens
caagagggcactggtggccc

SEQ ID NO: 3566691 - DNA, 19 bp, Homo sapiens
caagagtcgctgtgccaca

SEQ ID NO: 3566692 - DNA, 22 bp, Homo sapiens
caagagtgagatgtagaaagtt

SEQ ID NO: 3566693 - DNA, 15 bp, Homo sapiens
caagataaacattat

SEQ ID NO: 3566694 - DNA, 17 bp, Homo sapiens
caagatgttctcctgat

SEQ ID NO: 3566695 - DNA, 15 bp, Homo sapiens
caagatttttttcct

SEQ ID NO: 3566696 - DNA, 13 bp, Homo sapiens
caagcaatcctcc

SEQ ID NO: 3566697 - DNA, 22 bp, Homo sapiens
caagcaatcctcctacctcagc

SEQ ID NO: 3566698 - DNA, 19 bp, Homo sapiens
caagcaccaacctccagac

SEQ ID NO: 3566699 - DNA, 21 bp, Homo sapiens
caagcaccaacctccagactc

SEQ ID NO: 3566700 - DNA, 18 bp, Homo sapiens
caagcacctagcctcgct

SEQ ID NO: 3566701 - DNA, 16 bp, Homo sapiens
caagcataccaacacg

SEQ ID NO: 3566702 - DNA, 12 bp, Homo sapiens
caagcatttcat

SEQ ID NO: 3566703 - DNA, 20 bp, Homo sapiens
caagcatttcatgaaaaagc

SEQ ID NO: 3566704 - DNA, 15 bp, Homo sapiens
caagccaaagagcct

SEQ ID NO: 3566705 - DNA, 18 bp, Homo sapiens
caagccagattctcttga

SEQ ID NO: 3566706 - DNA, 21 bp, Homo sapiens
caagccgaccttccctccgcc

SEQ ID NO: 3566707 - DNA, 16 bp, Homo sapiens
caagccgtggcttccc

SEQ ID NO: 3566708 - DNA, 17 bp, Homo sapiens
caagccttggctctacc

SEQ ID NO: 3566709 - DNA, 19 bp, Homo sapiens
caagctaggccccagaggc

SEQ ID NO: 3566710 - DNA, 21 bp, Homo sapiens
caagctccatctccactccag

SEQ ID NO: 3566711 - DNA, 23 bp, Homo sapiens
caagctgcttgtcctgggcctgc

SEQ ID NO: 3566712 - DNA, 19 bp, Homo sapiens
caagctggtggcctctgca

SEQ ID NO: 3566713 - DNA, 16 bp, Homo sapiens
caagctgtccctgcag

SEQ ID NO: 3566714 - DNA, 18 bp, Homo sapiens
caagctgtccctgcaggg

SEQ ID NO: 3566715 - DNA, 14 bp, Homo sapiens
caagctgtgcaggc

SEQ ID NO: 3566716 - DNA, 23 bp, Homo sapiens
caagctgttatttcttccctgct

SEQ ID NO: 3566717 - DNA, 16 bp, Homo sapiens
caaggaaccctcaggc

SEQ ID NO: 3566718 - DNA, 13 bp, Homo sapiens
caaggaatttaaa

SEQ ID NO: 3566719 - DNA, 22 bp, Homo sapiens
caaggaatttaaaactgttatt

SEQ ID NO: 3566720 - DNA, 15 bp, Homo sapiens
caaggactgcaggga

SEQ ID NO: 3566721 - DNA, 22 bp, Homo sapiens
caaggactgcagggactgccag

SEQ ID NO: 3566722 - DNA, 19 bp, Homo sapiens
caaggacttcctgtccagc

SEQ ID NO: 3566723 - DNA, 21 bp, Homo sapiens
caaggacttcctgtccagctc

SEQ ID NO: 3566724 - DNA, 22 bp, Homo sapiens
caaggatagatgctggcccagg

SEQ ID NO: 3566725 - DNA, 21 bp, Homo sapiens
caaggattacagaaactgatg

SEQ ID NO: 3566726 - DNA, 18 bp, Homo sapiens
caaggcagcgaccccagg

SEQ ID NO: 3566727 - DNA, 21 bp, Homo sapiens
caaggcagcgaccccaggacc

SEQ ID NO: 3566728 - DNA, 16 bp, Homo sapiens
caaggcattctcccag

SEQ ID NO: 3566729 - DNA, 17 bp, Homo sapiens
caaggcattctcccagc

SEQ ID NO: 3566730 - DNA, 19 bp, Homo sapiens
caaggcattctcccagctc

SEQ ID NO: 3566731 - DNA, 15 bp, Homo sapiens
caaggccctgccctg

SEQ ID NO: 3566732 - DNA, 22 bp, Homo sapiens
caaggcctgcttgactttccag

SEQ ID NO: 3566733 - DNA, 15 bp, Homo sapiens
caaggctctcccctc

SEQ ID NO: 3566734 - DNA, 16 bp, Homo sapiens
caaggctctcccctct

SEQ ID NO: 3566735 - DNA, 22 bp, Homo sapiens
caagggaccaggtttgcaggag

SEQ ID NO: 3566736 - DNA, 12 bp, Homo sapiens
caagggccctgg

SEQ ID NO: 3566737 - DNA, 15 bp, Homo sapiens
caagggccctggcac

SEQ ID NO: 3566738 - DNA, 23 bp, Homo sapiens
caaggggaccccgagaaccctga

SEQ ID NO: 3566739 - DNA, 16 bp, Homo sapiens
caagggggctgctgct

SEQ ID NO: 3566740 - DNA, 17 bp, Homo sapiens
caagggggctgctgctc

SEQ ID NO: 3566741 - DNA, 16 bp, Homo sapiens
atagcatgaaataaaa

SEQ ID NO: 3566742 - DNA, 22 bp, Homo sapiens
atagcattatcttatcatttat

SEQ ID NO: 3566743 - DNA, 15 bp, Homo sapiens
atagcattgtaaaag

SEQ ID NO: 3566744 - DNA, 14 bp, Homo sapiens
atagctaagtacac

SEQ ID NO: 3566745 - DNA, 13 bp, Homo sapiens
atagctctctgac

SEQ ID NO: 3566746 - DNA, 16 bp, Homo sapiens
atagctctctgactgc

SEQ ID NO: 3566747 - DNA, 18 bp, Homo sapiens
atagctctctgactgctt

SEQ ID NO: 3566748 - DNA, 22 bp, Homo sapiens
atagctctggggtgggcagttt

SEQ ID NO: 3566749 - DNA, 22 bp, Homo sapiens
atagcttacaagccagctggag

SEQ ID NO: 3566750 - DNA, 20 bp, Homo sapiens
ataggactccatttctttct

SEQ ID NO: 3566751 - DNA, 21 bp, Homo sapiens
ataggactccatttctttctt

SEQ ID NO: 3566752 - DNA, 15 bp, Homo sapiens
ataggagaaagcaaa

SEQ ID NO: 3566753 - DNA, 21 bp, Homo sapiens
ataggagccgactctttgata

SEQ ID NO: 3566754 - DNA, 15 bp, Homo sapiens
ataggatcctggagg

SEQ ID NO: 3566755 - DNA, 19 bp, Homo sapiens
ataggcctgtcccttgcct

SEQ ID NO: 3566756 - DNA, 22 bp, Homo sapiens
ataggcctgtcccttgcctctg

SEQ ID NO: 3566757 - DNA, 17 bp, Homo sapiens
ataggctattttctaaa

SEQ ID NO: 3566758 - DNA, 16 bp, Homo sapiens
ataggtagctggggag

SEQ ID NO: 3566759 - DNA, 21 bp, Homo sapiens
ataggtagctggggagcccta

SEQ ID NO: 3566760 - DNA, 16 bp, Homo sapiens
ataggtctttctctca

SEQ ID NO: 3566761 - DNA, 17 bp, Homo sapiens
ataggtctttctctcag

SEQ ID NO: 3566762 - DNA, 21 bp, Homo sapiens
ataggttcttctatagtgatg

SEQ ID NO: 3566763 - DNA, 16 bp, Homo sapiens
atagtaaatgtgtttc

SEQ ID NO: 3566764 - DNA, 22 bp, Homo sapiens
atagtagatgtggcctttgaat

SEQ ID NO: 3566765 - DNA, 16 bp, Homo sapiens
atagtatcctccaggt

SEQ ID NO: 3566766 - DNA, 19 bp, Homo sapiens
atagtatcctccaggtttt

SEQ ID NO: 3566767 - DNA, 22 bp, Homo sapiens
atagtatcctccaggtttttca

SEQ ID NO: 3566768 - DNA, 19 bp, Homo sapiens
atagtattccaatcactgt

SEQ ID NO: 3566769 - DNA, 13 bp, Homo sapiens
atagtccttcctg

SEQ ID NO: 3566770 - DNA, 16 bp, Homo sapiens
atagtccttcctggca

SEQ ID NO: 3566771 - DNA, 17 bp, Homo sapiens
atagtgacatgcagtta

SEQ ID NO: 3566772 - DNA, 16 bp, Homo sapiens
atagtggggagacttc

SEQ ID NO: 3566773 - DNA, 18 bp, Homo sapiens
atagttactgtgtaatta

SEQ ID NO: 3566774 - DNA, 23 bp, Homo sapiens
atagttgccaatctaaaatggca

SEQ ID NO: 3566775 - DNA, 18 bp, Homo sapiens
atataaaatgtattcaag

SEQ ID NO: 3566776 - DNA, 19 bp, Homo sapiens
atataaaatgtattcaagc

SEQ ID NO: 3566777 - DNA, 17 bp, Homo sapiens
atataaagtatatgttc

SEQ ID NO: 3566778 - DNA, 13 bp, Homo sapiens
atataaagtcagt

SEQ ID NO: 3566779 - DNA, 12 bp, Homo sapiens
atataagctttt

SEQ ID NO: 3566780 - DNA, 15 bp, Homo sapiens
atataagtgtacata

SEQ ID NO: 3566781 - DNA, 18 bp, Homo sapiens
atataagtgtacatatgt

SEQ ID NO: 3566782 - DNA, 13 bp, Homo sapiens
atatactatttag

SEQ ID NO: 3566783 - DNA, 15 bp, Homo sapiens
atatactgctattta

SEQ ID NO: 3566784 - DNA, 18 bp, Homo sapiens
atatactgttcttcattt

SEQ ID NO: 3566785 - DNA, 15 bp, Homo sapiens
atatagaatgctgca

SEQ ID NO: 3566786 - DNA, 17 bp, Homo sapiens
atatagacacacataca

SEQ ID NO: 3566787 - DNA, 19 bp, Homo sapiens
atatagacacacatacata

SEQ ID NO: 3566788 - DNA, 20 bp, Homo sapiens
atatagacacacatacataa

SEQ ID NO: 3566789 - DNA, 18 bp, Homo sapiens
atatagacattctcacat

SEQ ID NO: 3566790 - DNA, 21 bp, Homo sapiens
atatagaccaattgaagcatg

SEQ ID NO: 3566791 - DNA, 14 bp, Homo sapiens
atatagctgctcct

SEQ ID NO: 3566792 - DNA, 13 bp, Homo sapiens
atataggctattt

SEQ ID NO: 3566793 - DNA, 10 bp, Homo sapiens
atatataaat

SEQ ID NO: 3566794 - DNA, 20 bp, Homo sapiens
atatataagtgtacatatgt

SEQ ID NO: 3566795 - DNA, 15 bp, Homo sapiens
atatataatgtatat

SEQ ID NO: 3566796 - DNA, 14 bp, Homo sapiens
atatataggcagtt

SEQ ID NO: 3566797 - DNA, 13 bp, Homo sapiens
atatatatgtgtg

SEQ ID NO: 3566798 - DNA, 21 bp, Homo sapiens
atatatctgttggagaaagaa

SEQ ID NO: 3566799 - DNA, 19 bp, Homo sapiens
atatatcttataaagtgga

SEQ ID NO: 3566800 - DNA, 13 bp, Homo sapiens
atatatgaggact

SEQ ID NO: 3566801 - DNA, 16 bp, Homo sapiens
atatatgcacacatat

SEQ ID NO: 3566802 - DNA, 21 bp, Homo sapiens
atatattctgaagcaacattt

SEQ ID NO: 3566803 - DNA, 18 bp, Homo sapiens
atatattgaatattttat

SEQ ID NO: 3566804 - DNA, 13 bp, Homo sapiens
atatatttaagca

SEQ ID NO: 3566805 - DNA, 17 bp, Homo sapiens
atatcaaagagaagatg

SEQ ID NO: 3566806 - DNA, 23 bp, Homo sapiens
atatcaaagagaagatgcctgtt

SEQ ID NO: 3566807 - DNA, 21 bp, Homo sapiens
atatcaaagtcattaaagaca

SEQ ID NO: 3566808 - DNA, 14 bp, Homo sapiens
atatcaggtgtata

SEQ ID NO: 3566809 - DNA, 15 bp, Homo sapiens
atatcatgaatgtga

SEQ ID NO: 3566810 - DNA, 13 bp, Homo sapiens
atatcatgtaaag

SEQ ID NO: 3566811 - DNA, 16 bp, Homo sapiens
atatccctacatgtat

SEQ ID NO: 3566812 - DNA, 23 bp, Homo sapiens
atatcccttggacattttatgtc

SEQ ID NO: 3566813 - DNA, 14 bp, Homo sapiens
atatcctttgcctc

SEQ ID NO: 3566814 - DNA, 21 bp, Homo sapiens
atatctaccccagactagatg

SEQ ID NO: 3566815 - DNA, 17 bp, Homo sapiens
atatctagtgacagagg

SEQ ID NO: 3566816 - DNA, 15 bp, Homo sapiens
atatctatgttttac

SEQ ID NO: 3566817 - DNA, 16 bp, Homo sapiens
atatctatgttttacc

SEQ ID NO: 3566818 - DNA, 16 bp, Homo sapiens
atatctgttggagaaa

SEQ ID NO: 3566819 - DNA, 12 bp, Homo sapiens
atatgatatgca

SEQ ID NO: 3566820 - DNA, 14 bp, Homo sapiens
atatgattgtttct

SEQ ID NO: 3566821 - DNA, 13 bp, Homo sapiens
atatgcaaagcac

SEQ ID NO: 3566822 - DNA, 14 bp, Homo sapiens
atatgcaaagcact

SEQ ID NO: 3566823 - DNA, 23 bp, Homo sapiens
atatgcaaagcactgacttctaa

SEQ ID NO: 3566824 - DNA, 17 bp, Homo sapiens
atatgcaagcagctttt

SEQ ID NO: 3566825 - DNA, 23 bp, Homo sapiens
atatgcacaaaactacttttcta

SEQ ID NO: 3566826 - DNA, 16 bp, Homo sapiens
atatgcacacatatat

SEQ ID NO: 3566827 - DNA, 17 bp, Homo sapiens
atatgcagttttcctta

SEQ ID NO: 3566828 - DNA, 14 bp, Homo sapiens
atatgcatgtagca

SEQ ID NO: 3566829 - DNA, 16 bp, Homo sapiens
atatgcctgattcata

SEQ ID NO: 3566830 - DNA, 15 bp, Homo sapiens
atatggagaacatgt

SEQ ID NO: 3566831 - DNA, 22 bp, Homo sapiens
atatggagtgagtcacctgctc

SEQ ID NO: 3566832 - DNA, 17 bp, Homo sapiens
atatggctgcccaggag

SEQ ID NO: 3566833 - DNA, 21 bp, Homo sapiens
atatggtaggaccctcgagag

SEQ ID NO: 3566834 - DNA, 15 bp, Homo sapiens
atatgtacagtttat

SEQ ID NO: 3566835 - DNA, 16 bp, Homo sapiens
atatgtacagtttatt

SEQ ID NO: 3566836 - DNA, 15 bp, Homo sapiens
atatgtagtatctat

SEQ ID NO: 3566837 - DNA, 10 bp, Homo sapiens
atatgtattt

SEQ ID NO: 3566838 - DNA, 12 bp, Homo sapiens
atatgtatttaa

SEQ ID NO: 3566839 - DNA, 14 bp, Homo sapiens
atatgtatttaaga

SEQ ID NO: 3566840 - DNA, 23 bp, Homo sapiens
atatgtatttaagatgtacattt

SEQ ID NO: 3566841 - DNA, 17 bp, Homo sapiens
atatgtcactagaatgg

SEQ ID NO: 3566842 - DNA, 14 bp, Homo sapiens
atatgttgttctta

SEQ ID NO: 3566843 - DNA, 18 bp, Homo sapiens
atattaaaattgttaata

SEQ ID NO: 3566844 - DNA, 22 bp, Homo sapiens
atattaaaattgttaatatgca

SEQ ID NO: 3566845 - DNA, 13 bp, Homo sapiens
atattaacatatt

SEQ ID NO: 3566846 - DNA, 13 bp, Homo sapiens
atattaataagaa

SEQ ID NO: 3566847 - DNA, 23 bp, Homo sapiens
atattaattagcaggttgggcta

SEQ ID NO: 3566848 - DNA, 14 bp, Homo sapiens
atattacctggatt

SEQ ID NO: 3566849 - DNA, 16 bp, Homo sapiens
atattacttgcctatc

SEQ ID NO: 3566850 - DNA, 13 bp, Homo sapiens
atattataaagga

SEQ ID NO: 3566851 - DNA, 20 bp, Homo sapiens
atattataaaggataaagaa

SEQ ID NO: 3566852 - DNA, 10 bp, Homo sapiens
atattataag

SEQ ID NO: 3566853 - DNA, 11 bp, Homo sapiens
atattataagt

SEQ ID NO: 3566854 - DNA, 21 bp, Homo sapiens
atattataagttgacctttat

SEQ ID NO: 3566855 - DNA, 14 bp, Homo sapiens
atattattaatata

SEQ ID NO: 3566856 - DNA, 22 bp, Homo sapiens
atattcattctttataaaccat

SEQ ID NO: 3566857 - DNA, 17 bp, Homo sapiens
atattccactatttgca

SEQ ID NO: 3566858 - DNA, 23 bp, Homo sapiens
atattcctttgcatattataaag

SEQ ID NO: 3566859 - DNA, 23 bp, Homo sapiens
agtaaggctggtaagagaagtga

SEQ ID NO: 3566860 - DNA, 20 bp, Homo sapiens
agtaagttatctttgaatat

SEQ ID NO: 3566861 - DNA, 12 bp, Homo sapiens
agtaagttctgt

SEQ ID NO: 3566862 - DNA, 12 bp, Homo sapiens
agtaataaagag

SEQ ID NO: 3566863 - DNA, 15 bp, Homo sapiens
agtaataaagagaaa

SEQ ID NO: 3566864 - DNA, 21 bp, Homo sapiens
agtaataaagagaaatatatt

SEQ ID NO: 3566865 - DNA, 15 bp, Homo sapiens
agtaattgttacaat

SEQ ID NO: 3566866 - DNA, 17 bp, Homo sapiens
agtaattgttacaattt

SEQ ID NO: 3566867 - DNA, 18 bp, Homo sapiens
agtaatttaatttgtaaa

SEQ ID NO: 3566868 - DNA, 16 bp, Homo sapiens
agtaatttagaagata

SEQ ID NO: 3566869 - DNA, 23 bp, Homo sapiens
agtacaaatgccttaaaatggaa

SEQ ID NO: 3566870 - DNA, 16 bp, Homo sapiens
agtacacaataagcaa

SEQ ID NO: 3566871 - DNA, 21 bp, Homo sapiens
agtacacaataagcaaaaaca

SEQ ID NO: 3566872 - DNA, 15 bp, Homo sapiens
agtacagtcttatca

SEQ ID NO: 3566873 - DNA, 17 bp, Homo sapiens
agtacattactaaatat

SEQ ID NO: 3566874 - DNA, 19 bp, Homo sapiens
agtacattactaaatatat

SEQ ID NO: 3566875 - DNA, 23 bp, Homo sapiens
agtaccagtaggggcttataata

SEQ ID NO: 3566876 - DNA, 15 bp, Homo sapiens
agtgactctcctgcc

SEQ ID NO: 3566877 - DNA, 21 bp, Homo sapiens
agtgactctcctgcctcagcc

SEQ ID NO: 3566878 - DNA, 16 bp, Homo sapiens
agtgagaagataaaaa

SEQ ID NO: 3566879 - DNA, 17 bp, Homo sapiens
agtgagatgtagaaagt

SEQ ID NO: 3566880 - DNA, 14 bp, Homo sapiens
agtgagcagtgttg

SEQ ID NO: 3566881 - DNA, 15 bp, Homo sapiens
agtgagcagtgttgc

SEQ ID NO: 3566882 - DNA, 11 bp, Homo sapiens
agtgagcctga

SEQ ID NO: 3566883 - DNA, 21 bp, Homo sapiens
agtgagcctgaattttgttgc

SEQ ID NO: 3566884 - DNA, 20 bp, Homo sapiens
agtgagtcacctgctccaga

SEQ ID NO: 3566885 - DNA, 18 bp, Homo sapiens
agtgagttcaactacatg

SEQ ID NO: 3566886 - DNA, 19 bp, Homo sapiens
agtgatgtcactagggcag

SEQ ID NO: 3566887 - DNA, 20 bp, Homo sapiens
agtgatgtttgccatttgct

SEQ ID NO: 3566888 - DNA, 19 bp, Homo sapiens
agtgattccatcaaagaga

SEQ ID NO: 3566889 - DNA, 19 bp, Homo sapiens
agtgattctcctgcctcag

SEQ ID NO: 3566890 - DNA, 14 bp, Homo sapiens
agtgattctgtttg

SEQ ID NO: 3566891 - DNA, 17 bp, Homo sapiens
agtgatttttggtcttc

SEQ ID NO: 3566892 - DNA, 17 bp, Homo sapiens
agtgcaagcccctgctc

SEQ ID NO: 3566893 - DNA, 22 bp, Homo sapiens
agtgcaataaatctgacccagt

SEQ ID NO: 3566894 - DNA, 15 bp, Homo sapiens
agtgcaatggtgcaa

SEQ ID NO: 3566895 - DNA, 20 bp, Homo sapiens
agtgcacatttggaattgac

SEQ ID NO: 3566896 - DNA, 12 bp, Homo sapiens
agtgcacctgcc

SEQ ID NO: 3566897 - DNA, 15 bp, Homo sapiens
agtgcacctgcctcc

SEQ ID NO: 3566898 - DNA, 22 bp, Homo sapiens
agtgcactgcattcctgtgccc

SEQ ID NO: 3566899 - DNA, 23 bp, Homo sapiens
agtgcactgcattcctgtgccct

SEQ ID NO: 3566900 - DNA, 12 bp, Homo sapiens
agtgcagccact

SEQ ID NO: 3566901 - DNA, 15 bp, Homo sapiens
agtgcagctcatgtt

SEQ ID NO: 3566902 - DNA, 15 bp, Homo sapiens
agtgcatctcagccc

SEQ ID NO: 3566903 - DNA, 20 bp, Homo sapiens
agtgccacttaatgtatgtt

SEQ ID NO: 3566904 - DNA, 21 bp, Homo sapiens
agtgccacttaatgtatgtta

SEQ ID NO: 3566905 - DNA, 18 bp, Homo sapiens
agtgcccatgtgtacatt

SEQ ID NO: 3566906 - DNA, 12 bp, Homo sapiens
agtgcctccaca

SEQ ID NO: 3566907 - DNA, 16 bp, Homo sapiens
agtgcctccacatgct

SEQ ID NO: 3566908 - DNA, 23 bp, Homo sapiens
agtgcctccacatgctgcctggc

SEQ ID NO: 3566909 - DNA, 18 bp, Homo sapiens
agtgcctgagctggggaa

SEQ ID NO: 3566910 - DNA, 20 bp, Homo sapiens
agtgccttctttagaccctc

SEQ ID NO: 3566911 - DNA, 16 bp, Homo sapiens
agtgcctttagagggt

SEQ ID NO: 3566912 - DNA, 14 bp, Homo sapiens
agtgcggttcctca

SEQ ID NO: 3566913 - DNA, 15 bp, Homo sapiens
agtgcggttcctcat

SEQ ID NO: 3566914 - DNA, 22 bp, Homo sapiens
agtgcggttcctcatctgagag

SEQ ID NO: 3566915 - DNA, 14 bp, Homo sapiens
agtgctcatctgtt

SEQ ID NO: 3566916 - DNA, 20 bp, Homo sapiens
agtgctcttcccactccagc

SEQ ID NO: 3566917 - DNA, 22 bp, Homo sapiens
agtgctcttcccactccagctg

SEQ ID NO: 3566918 - DNA, 19 bp, Homo sapiens
agtgctcttggctgacccc

SEQ ID NO: 3566919 - DNA, 14 bp, Homo sapiens
agtgctcttttctc

SEQ ID NO: 3566920 - DNA, 17 bp, Homo sapiens
agtgctcttttctcctc

SEQ ID NO: 3566921 - DNA, 15 bp, Homo sapiens
agtgctgaatttccc

SEQ ID NO: 3566922 - DNA, 14 bp, Homo sapiens
agtggaaagtcagg

SEQ ID NO: 3566923 - DNA, 21 bp, Homo sapiens
agtggaagtatgtatattaaa

SEQ ID NO: 3566924 - DNA, 19 bp, Homo sapiens
agtggaatagtatcctcca

SEQ ID NO: 3566925 - DNA, 20 bp, Homo sapiens
agtggaatagtatcctccag

SEQ ID NO: 3566926 - DNA, 23 bp, Homo sapiens
agtggaatagtatcctccaggtt

SEQ ID NO: 3566927 - DNA, 22 bp, Homo sapiens
agtggaatcctatatagaatgc

SEQ ID NO: 3566928 - DNA, 17 bp, Homo sapiens
agtggacgttaggccag

SEQ ID NO: 3566929 - DNA, 18 bp, Homo sapiens
agtggacgttaggccagg

SEQ ID NO: 3566930 - DNA, 22 bp, Homo sapiens
agtggacgttaggccaggcctt

SEQ ID NO: 3566931 - DNA, 12 bp, Homo sapiens
agtggagacagt

SEQ ID NO: 3566932 - DNA, 15 bp, Homo sapiens
agtggagacagtcct

SEQ ID NO: 3566933 - DNA, 21 bp, Homo sapiens
agtggagacagtcctttccca

SEQ ID NO: 3566934 - DNA, 15 bp, Homo sapiens
agtggagctgtctgt

SEQ ID NO: 3566935 - DNA, 17 bp, Homo sapiens
agtggagctgtctgtct

SEQ ID NO: 3566936 - DNA, 19 bp, Homo sapiens
agtggagttttataaatta

SEQ ID NO: 3566937 - DNA, 19 bp, Homo sapiens
agtggccactaagcagagg

SEQ ID NO: 3566938 - DNA, 21 bp, Homo sapiens
agtggcctccgtcactacctg

SEQ ID NO: 3566939 - DNA, 19 bp, Homo sapiens
agtggcggcacgtccttgg

SEQ ID NO: 3566940 - DNA, 16 bp, Homo sapiens
agtggcgtggcctccc

SEQ ID NO: 3566941 - DNA, 19 bp, Homo sapiens
agtggcgtggcctccccat

SEQ ID NO: 3566942 - DNA, 13 bp, Homo sapiens
agtggctcctccc

SEQ ID NO: 3566943 - DNA, 19 bp, Homo sapiens
agtggctgccttctttcca

SEQ ID NO: 3566944 - DNA, 15 bp, Homo sapiens
agtggctggggtgga

SEQ ID NO: 3566945 - DNA, 14 bp, Homo sapiens
agtggcttctttcc

SEQ ID NO: 3566946 - DNA, 13 bp, Homo sapiens
agtgggaagggag

SEQ ID NO: 3566947 - DNA, 12 bp, Homo sapiens
agtgggaatgtt

SEQ ID NO: 3566948 - DNA, 21 bp, Homo sapiens
agtgggacagggcatggccag

SEQ ID NO: 3566949 - DNA, 15 bp, Homo sapiens
agtgggagctgagct

SEQ ID NO: 3566950 - DNA, 12 bp, Homo sapiens
agtgggaggtca

SEQ ID NO: 3566951 - DNA, 20 bp, Homo sapiens
agtgggccccgggctggaga

SEQ ID NO: 3566952 - DNA, 15 bp, Homo sapiens
agtggggctggcatc

SEQ ID NO: 3566953 - DNA, 14 bp, Homo sapiens
agtgggtctgggat

SEQ ID NO: 3566954 - DNA, 14 bp, Homo sapiens
agtggtgagcaagc

SEQ ID NO: 3566955 - DNA, 20 bp, Homo sapiens
agtggtgcgtttataattgg

SEQ ID NO: 3566956 - DNA, 14 bp, Homo sapiens
agtggtgggtaatt

SEQ ID NO: 3566957 - DNA, 23 bp, Homo sapiens
agtggtgggtaattgtacaataa

SEQ ID NO: 3566958 - DNA, 14 bp, Homo sapiens
agtggttaggcagc

SEQ ID NO: 3566959 - DNA, 17 bp, Homo sapiens
agtggttaggcagcaag

SEQ ID NO: 3566960 - DNA, 15 bp, Homo sapiens
agtgtaaaattgtta

SEQ ID NO: 3566961 - DNA, 18 bp, Homo sapiens
agtgtagcctaaagggca

SEQ ID NO: 3566962 - DNA, 20 bp, Homo sapiens
agtgtagcctaaagggcagg

SEQ ID NO: 3566963 - DNA, 21 bp, Homo sapiens
agtgtagctgtaagggcagtg

SEQ ID NO: 3566964 - DNA, 15 bp, Homo sapiens
agtgtatgattactg

SEQ ID NO: 3566965 - DNA, 22 bp, Homo sapiens
agtgtatggaaataaatgtatc

SEQ ID NO: 3566966 - DNA, 19 bp, Homo sapiens
agtgtcagggtccaggaga

SEQ ID NO: 3566967 - DNA, 19 bp, Homo sapiens
agtgtcatgaagtgcacag

SEQ ID NO: 3566968 - DNA, 20 bp, Homo sapiens
agtgtcatgaagtgcacagg

SEQ ID NO: 3566969 - DNA, 16 bp, Homo sapiens
agtgtcctgcccatgc

SEQ ID NO: 3566970 - DNA, 18 bp, Homo sapiens
agtgtcctgcccatgccc

SEQ ID NO: 3566971 - DNA, 17 bp, Homo sapiens
agtgtctgtctgaggtg

SEQ ID NO: 3566972 - DNA, 18 bp, Homo sapiens
agtgtcttaattaaaaga

SEQ ID NO: 3566973 - DNA, 19 bp, Homo sapiens
agtgtgaagacccaaaaca

SEQ ID NO: 3566974 - DNA, 20 bp, Homo sapiens
agtgtgaagacccaaaacag

SEQ ID NO: 3566975 - DNA, 12 bp, Homo sapiens
agtgtgaagatc

SEQ ID NO: 3566976 - DNA, 20 bp, Homo sapiens
agtgtgaagcttccttggct

SEQ ID NO: 3566977 - DNA, 12 bp, Homo sapiens
agtgtgactcct

SEQ ID NO: 3566978 - DNA, 23 bp, Homo sapiens
agtgtgagaccccaaagactctg

SEQ ID NO: 3566979 - DNA, 17 bp, Homo sapiens
agtgtgagatactgtgt

SEQ ID NO: 3566980 - DNA, 18 bp, Homo sapiens
agtgtgagctcttccctt

SEQ ID NO: 3566981 - DNA, 19 bp, Homo sapiens
agtgtgatttgaattctgt

SEQ ID NO: 3566982 - DNA, 17 bp, Homo sapiens
agtgtgccagtttaaaa

SEQ ID NO: 3566983 - DNA, 22 bp, Homo sapiens
agtgtgccagtttaaaaagatg

SEQ ID NO: 3566984 - DNA, 19 bp, Homo sapiens
agtgtggcctgtgccagca

SEQ ID NO: 3566985 - DNA, 20 bp, Homo sapiens
agtgtggcctgtgccagcac

SEQ ID NO: 3566986 - DNA, 22 bp, Homo sapiens
agtgtggcctgtgccagcacca

SEQ ID NO: 3566987 - DNA, 15 bp, Homo sapiens
agtgtgggtctgtgt

SEQ ID NO: 3566988 - DNA, 16 bp, Homo sapiens
agtgtgggtctgtgtg

SEQ ID NO: 3566989 - DNA, 17 bp, Homo sapiens
agtgtgggtctgtgtgt

SEQ ID NO: 3566990 - DNA, 19 bp, Homo sapiens
agtgtgtcagtttttcctc

SEQ ID NO: 3566991 - DNA, 20 bp, Homo sapiens
agtgtgtggtcaacatttct

SEQ ID NO: 3566992 - DNA, 14 bp, Homo sapiens
agtgttatgagcca

SEQ ID NO: 3566993 - DNA, 18 bp, Homo sapiens
agtgttatttattcccca

SEQ ID NO: 3566994 - DNA, 20 bp, Homo sapiens
agtgttcctgaagctgctgt

SEQ ID NO: 3566995 - DNA, 18 bp, Homo sapiens
agtgttctgctcctgctt

SEQ ID NO: 3566996 - DNA, 21 bp, Homo sapiens
agtgttgtatttctatacagt

SEQ ID NO: 3566997 - DNA, 18 bp, Homo sapiens
agttaaaagcacaaagga

SEQ ID NO: 3566998 - DNA, 15 bp, Homo sapiens
agttaactattgcat

SEQ ID NO: 3566999 - DNA, 15 bp, Homo sapiens
agttaatttttccaa

SEQ ID NO: 3567000 - DNA, 17 bp, Homo sapiens
agttaatttttccaact

SEQ ID NO: 3567001 - DNA, 19 bp, Homo sapiens
agttacattaaaataaacc

SEQ ID NO: 3567002 - DNA, 15 bp, Homo sapiens
agttactgtgtaatt

SEQ ID NO: 3567003 - DNA, 16 bp, Homo sapiens
aggcagggggccctgc

SEQ ID NO: 3567004 - DNA, 20 bp, Homo sapiens
aggcagggggtgaggggcag

SEQ ID NO: 3567005 - DNA, 11 bp, Homo sapiens
aggcaggtgct

SEQ ID NO: 3567006 - DNA, 12 bp, Homo sapiens
aggcaggtgctt

SEQ ID NO: 3567007 - DNA, 20 bp, Homo sapiens
aggcagtggcaggggagcag

SEQ ID NO: 3567008 - DNA, 13 bp, Homo sapiens
aggcagttttcta

SEQ ID NO: 3567009 - DNA, 23 bp, Homo sapiens
aggcatactgccttgtttaatgt

SEQ ID NO: 3567010 - DNA, 14 bp, Homo sapiens
aggcatgagccact

SEQ ID NO: 3567011 - DNA, 22 bp, Homo sapiens
aggcatgtgccacccacccaac

SEQ ID NO: 3567012 - DNA, 18 bp, Homo sapiens
aggcatgtgtctggccct

SEQ ID NO: 3567013 - DNA, 20 bp, Homo sapiens
aggcatttgttggtttatca

SEQ ID NO: 3567014 - DNA, 13 bp, Homo sapiens
aggccaaaaaaat

SEQ ID NO: 3567015 - DNA, 15 bp, Homo sapiens
aggccaaaatcaaga

SEQ ID NO: 3567016 - DNA, 14 bp, Homo sapiens
aggccaaccagccc

SEQ ID NO: 3567017 - DNA, 15 bp, Homo sapiens
aggccaagggaccag

SEQ ID NO: 3567018 - DNA, 17 bp, Homo sapiens
aggccacagtggggctg

SEQ ID NO: 3567019 - DNA, 19 bp, Homo sapiens
aggccacagtggggctgca

SEQ ID NO: 3567020 - DNA, 13 bp, Homo sapiens
aggccaccccaaa

SEQ ID NO: 3567021 - DNA, 20 bp, Homo sapiens
aggccaccccaaaccccagc

SEQ ID NO: 3567022 - DNA, 17 bp, Homo sapiens
aggccagagaaagcaaa

SEQ ID NO: 3567023 - DNA, 21 bp, Homo sapiens
aggccagagaaagcaaaggtg

SEQ ID NO: 3567024 - DNA, 15 bp, Homo sapiens
aggccagagagggaa

SEQ ID NO: 3567025 - DNA, 16 bp, Homo sapiens
aggccagagagggaaa

SEQ ID NO: 3567026 - DNA, 22 bp, Homo sapiens
aggccagagagggaaaaggcag

SEQ ID NO: 3567027 - DNA, 19 bp, Homo sapiens
aggccagcaacattggcac

SEQ ID NO: 3567028 - DNA, 14 bp, Homo sapiens
aggccagcccagcc

SEQ ID NO: 3567029 - DNA, 19 bp, Homo sapiens
aggccagcccagccaggcc

SEQ ID NO: 3567030 - DNA, 12 bp, Homo sapiens
aggccagccttg

SEQ ID NO: 3567031 - DNA, 13 bp, Homo sapiens
aggccagctgcct

SEQ ID NO: 3567032 - DNA, 17 bp, Homo sapiens
aggccaggacgggccac

SEQ ID NO: 3567033 - DNA, 18 bp, Homo sapiens
aggccaggacgggccaca

SEQ ID NO: 3567034 - DNA, 15 bp, Homo sapiens
aggccaggccagctg

SEQ ID NO: 3567035 - DNA, 18 bp, Homo sapiens
aggccagtagttctcaaa

SEQ ID NO: 3567036 - DNA, 21 bp, Homo sapiens
aggccatccttccctgtctgc

SEQ ID NO: 3567037 - DNA, 14 bp, Homo sapiens
aggccatctcagga

SEQ ID NO: 3567038 - DNA, 13 bp, Homo sapiens
aggcccaatgctg

SEQ ID NO: 3567039 - DNA, 15 bp, Homo sapiens
aggcccaatgctgct

SEQ ID NO: 3567040 - DNA, 15 bp, Homo sapiens
aggcccactccccag

SEQ ID NO: 3567041 - DNA, 16 bp, Homo sapiens
aggcccactccccagc

SEQ ID NO: 3567042 - DNA, 23 bp, Homo sapiens
aggcccagctttccctgccaggc

SEQ ID NO: 3567043 - DNA, 12 bp, Homo sapiens
aggcccaggaga

SEQ ID NO: 3567044 - DNA, 19 bp, Homo sapiens
aggcccaggagacctccag

SEQ ID NO: 3567045 - DNA, 20 bp, Homo sapiens
aggcccaggagacctccagc

SEQ ID NO: 3567046 - DNA, 21 bp, Homo sapiens
aggcccatgggaggctggagt

SEQ ID NO: 3567047 - DNA, 16 bp, Homo sapiens
aggccccaccggccag

SEQ ID NO: 3567048 - DNA, 21 bp, Homo sapiens
aggccccaccggccaggccgc

SEQ ID NO: 3567049 - DNA, 14 bp, Homo sapiens
aggccccagagaga

SEQ ID NO: 3567050 - DNA, 19 bp, Homo sapiens
aggccccagagagaccctg

SEQ ID NO: 3567051 - DNA, 22 bp, Homo sapiens
aggccccagagagaccctgcaa

SEQ ID NO: 3567052 - DNA, 15 bp, Homo sapiens
aggccccagaggccc

SEQ ID NO: 3567053 - DNA, 22 bp, Homo sapiens
aggccccagaggccctggaggt

SEQ ID NO: 3567054 - DNA, 12 bp, Homo sapiens
aggccccctcct

SEQ ID NO: 3567055 - DNA, 13 bp, Homo sapiens
aggccccctcctc

SEQ ID NO: 3567056 - DNA, 16 bp, Homo sapiens
aggccccctcctcacg

SEQ ID NO: 3567057 - DNA, 22 bp, Homo sapiens
aggcccctaggtgcccagggcc

SEQ ID NO: 3567058 - DNA, 15 bp, Homo sapiens
aggccctctggagtg

SEQ ID NO: 3567059 - DNA, 13 bp, Homo sapiens
aggccctgtgagc

SEQ ID NO: 3567060 - DNA, 22 bp, Homo sapiens
aggcccttattttcaagaaact

SEQ ID NO: 3567061 - DNA, 22 bp, Homo sapiens
aggcccttcctctccactgcct

SEQ ID NO: 3567062 - DNA, 14 bp, Homo sapiens
aggccgcgcccagc

SEQ ID NO: 3567063 - DNA, 15 bp, Homo sapiens
aggccgcgcccagca

SEQ ID NO: 3567064 - DNA, 22 bp, Homo sapiens
aggcctaggtgcagctcctcag

SEQ ID NO: 3567065 - DNA, 21 bp, Homo sapiens
aggcctccaacgcccctgtgg

SEQ ID NO: 3567066 - DNA, 22 bp, Homo sapiens
aggcctccaacgcccctgtggc

SEQ ID NO: 3567067 - DNA, 13 bp, Homo sapiens
aggcctctgggac

SEQ ID NO: 3567068 - DNA, 17 bp, Homo sapiens
aggcctgctgccagtgc

SEQ ID NO: 3567069 - DNA, 18 bp, Homo sapiens
aggcctgctgccagtgca

SEQ ID NO: 3567070 - DNA, 19 bp, Homo sapiens
aggcctgcttgactttcca

SEQ ID NO: 3567071 - DNA, 15 bp, Homo sapiens
aggcctggaagagct

SEQ ID NO: 3567072 - DNA, 21 bp, Homo sapiens
aggcctggaagagctgagacc

SEQ ID NO: 3567073 - DNA, 12 bp, Homo sapiens
aggcctgggccg

SEQ ID NO: 3567074 - DNA, 12 bp, Homo sapiens
aggcctgtccca

SEQ ID NO: 3567075 - DNA, 17 bp, Homo sapiens
aggcctgtcccttgcct

SEQ ID NO: 3567076 - DNA, 21 bp, Homo sapiens
aggccttaactatttcacatg

SEQ ID NO: 3567077 - DNA, 18 bp, Homo sapiens
aggccttatctgaaaggc

SEQ ID NO: 3567078 - DNA, 18 bp, Homo sapiens
aggccttgccagttttcc

SEQ ID NO: 3567079 - DNA, 14 bp, Homo sapiens
aggcctttcctctg

SEQ ID NO: 3567080 - DNA, 20 bp, Homo sapiens
aggcctttcctctgcacgct

SEQ ID NO: 3567081 - DNA, 16 bp, Homo sapiens
aggccttttggaatgt

SEQ ID NO: 3567082 - DNA, 14 bp, Homo sapiens
aggcgccccttccc

SEQ ID NO: 3567083 - DNA, 15 bp, Homo sapiens
aggcgtactacccag

SEQ ID NO: 3567084 - DNA, 21 bp, Homo sapiens
aggcgtactacccagctctgt

SEQ ID NO: 3567085 - DNA, 14 bp, Homo sapiens
aggcgtttggagaa

SEQ ID NO: 3567086 - DNA, 20 bp, Homo sapiens
aggctaagaccctgtgtcct

SEQ ID NO: 3567087 - DNA, 21 bp, Homo sapiens
aggctacaacaaaaatcacca

SEQ ID NO: 3567088 - DNA, 23 bp, Homo sapiens
aggctactgtaatgctgcctcag

SEQ ID NO: 3567089 - DNA, 21 bp, Homo sapiens
aggctagagtgcaatggtgca

SEQ ID NO: 3567090 - DNA, 21 bp, Homo sapiens
aggctatggagggtcctcctc

SEQ ID NO: 3567091 - DNA, 18 bp, Homo sapiens
aggctattattttcactg

SEQ ID NO: 3567092 - DNA, 21 bp, Homo sapiens
aggctattgtcccctaaacca

SEQ ID NO: 3567093 - DNA, 14 bp, Homo sapiens
aggctattttctaa

SEQ ID NO: 3567094 - DNA, 19 bp, Homo sapiens
aggctattttctaaagact

SEQ ID NO: 3567095 - DNA, 13 bp, Homo sapiens
aggctcaggagaa

SEQ ID NO: 3567096 - DNA, 18 bp, Homo sapiens
aggctcaggagaagccag

SEQ ID NO: 3567097 - DNA, 23 bp, Homo sapiens
aggctcaggagaagccagtgtct

SEQ ID NO: 3567098 - DNA, 19 bp, Homo sapiens
aggctccgggcaccagggg

SEQ ID NO: 3567099 - DNA, 20 bp, Homo sapiens
aggctcctacctgtctgctg

SEQ ID NO: 3567100 - DNA, 13 bp, Homo sapiens
aggctcctctagg

SEQ ID NO: 3567101 - DNA, 17 bp, Homo sapiens
aggctcctctaggccct

SEQ ID NO: 3567102 - DNA, 18 bp, Homo sapiens
aggctcgtcagccacctg

SEQ ID NO: 3567103 - DNA, 16 bp, Homo sapiens
aggctctcccctctcg

SEQ ID NO: 3567104 - DNA, 19 bp, Homo sapiens
aggctcttaagcagcatgg

SEQ ID NO: 3567105 - DNA, 19 bp, Homo sapiens
aggctcttatgtgtgcctt

SEQ ID NO: 3567106 - DNA, 13 bp, Homo sapiens
aggctcttctcct

SEQ ID NO: 3567107 - DNA, 14 bp, Homo sapiens
aggctcttctcctt

SEQ ID NO: 3567108 - DNA, 21 bp, Homo sapiens
aggctgaaatatccacccagc

SEQ ID NO: 3567109 - DNA, 23 bp, Homo sapiens
aggctgaaatatccacccagcag

SEQ ID NO: 3567110 - DNA, 21 bp, Homo sapiens
aggctgacatgctcacacatt

SEQ ID NO: 3567111 - DNA, 21 bp, Homo sapiens
aggctgagaactcgttcacct

SEQ ID NO: 3567112 - DNA, 13 bp, Homo sapiens
aggctgaggactt

SEQ ID NO: 3567113 - DNA, 23 bp, Homo sapiens
aggctgagggtcgtgggaaaggg

SEQ ID NO: 3567114 - DNA, 22 bp, Homo sapiens
aggctgcaaggtttaggctggt

SEQ ID NO: 3567115 - DNA, 14 bp, Homo sapiens
aggctgcctcctgc

SEQ ID NO: 3567116 - DNA, 16 bp, Homo sapiens
aggctgcctcctgccc

SEQ ID NO: 3567117 - DNA, 18 bp, Homo sapiens
aggctgcctcctgccctt

SEQ ID NO: 3567118 - DNA, 22 bp, Homo sapiens
aggctggagtgcaatggtgtga

SEQ ID NO: 3567119 - DNA, 23 bp, Homo sapiens
aggctggatcttggagaatgtga

SEQ ID NO: 3567120 - DNA, 17 bp, Homo sapiens
aggctggggatggtagg

SEQ ID NO: 3567121 - DNA, 18 bp, Homo sapiens
aggctggtaagagaagtg

SEQ ID NO: 3567122 - DNA, 13 bp, Homo sapiens
aggctggtcttga

SEQ ID NO: 3567123 - DNA, 17 bp, Homo sapiens
aggctggtgaggtcctg

SEQ ID NO: 3567124 - DNA, 16 bp, Homo sapiens
aggctggtggcccagg

SEQ ID NO: 3567125 - DNA, 15 bp, Homo sapiens
aggctgtaactactt

SEQ ID NO: 3567126 - DNA, 14 bp, Homo sapiens
aggctgtacatagt

SEQ ID NO: 3567127 - DNA, 15 bp, Homo sapiens
aggctgtacatagtc

SEQ ID NO: 3567128 - DNA, 23 bp, Homo sapiens
aggctgtagaaaggggagaatgt

SEQ ID NO: 3567129 - DNA, 22 bp, Homo sapiens
aggctgtccttaacccacctct

SEQ ID NO: 3567130 - DNA, 15 bp, Homo sapiens
aggctgttaccattt

SEQ ID NO: 3567131 - DNA, 12 bp, Homo sapiens
aggcttctcctt

SEQ ID NO: 3567132 - DNA, 13 bp, Homo sapiens
aggcttctccttc

SEQ ID NO: 3567133 - DNA, 22 bp, Homo sapiens
agggaaaaaagagtttaaacaa

SEQ ID NO: 3567134 - DNA, 16 bp, Homo sapiens
agggaaaagcagctct

SEQ ID NO: 3567135 - DNA, 22 bp, Homo sapiens
agggaaaatgcagcagggatgc

SEQ ID NO: 3567136 - DNA, 13 bp, Homo sapiens
agggaaagcctct

SEQ ID NO: 3567137 - DNA, 14 bp, Homo sapiens
agggaaagcctctg

SEQ ID NO: 3567138 - DNA, 20 bp, Homo sapiens
agggaaatgtatgtgtgtct

SEQ ID NO: 3567139 - DNA, 23 bp, Homo sapiens
agatctgtgtggctcctgggccg

SEQ ID NO: 3567140 - DNA, 16 bp, Homo sapiens
agatctttctccttga

SEQ ID NO: 3567141 - DNA, 20 bp, Homo sapiens
agatgaactgactgaaggaa

SEQ ID NO: 3567142 - DNA, 11 bp, Homo sapiens
agatgaatgtc

SEQ ID NO: 3567143 - DNA, 15 bp, Homo sapiens
agatgaatgtcagtt

SEQ ID NO: 3567144 - DNA, 23 bp, Homo sapiens
agatgaatgtcagttgttattta

SEQ ID NO: 3567145 - DNA, 12 bp, Homo sapiens
agatgacaacct

SEQ ID NO: 3567146 - DNA, 22 bp, Homo sapiens
agatgacagaggtttgaaggag

SEQ ID NO: 3567147 - DNA, 15 bp, Homo sapiens
agatgaccagggatg

SEQ ID NO: 3567148 - DNA, 14 bp, Homo sapiens
agatgactttgcag

SEQ ID NO: 3567149 - DNA, 15 bp, Homo sapiens
agatgaggctcagag

SEQ ID NO: 3567150 - DNA, 18 bp, Homo sapiens
agatgaggctcagagagg

SEQ ID NO: 3567151 - DNA, 23 bp, Homo sapiens
agatgaggctcagagaggtagca

SEQ ID NO: 3567152 - DNA, 22 bp, Homo sapiens
agatgcacgtggggcccactgc

SEQ ID NO: 3567153 - DNA, 20 bp, Homo sapiens
agatgcagtcctcaggaagg

SEQ ID NO: 3567154 - DNA, 16 bp, Homo sapiens
agatgcagttcaaaaa

SEQ ID NO: 3567155 - DNA, 19 bp, Homo sapiens
agatgcatatagacacaca

SEQ ID NO: 3567156 - DNA, 23 bp, Homo sapiens
agatgccagcttctctctccagg

SEQ ID NO: 3567157 - DNA, 19 bp, Homo sapiens
agatgcctgttaatttata

SEQ ID NO: 3567158 - DNA, 15 bp, Homo sapiens
agatgctggcccagg

SEQ ID NO: 3567159 - DNA, 18 bp, Homo sapiens
agatgctggcccagggcc

SEQ ID NO: 3567160 - DNA, 21 bp, Homo sapiens
agatgctggcccagggcccag

SEQ ID NO: 3567161 - DNA, 20 bp, Homo sapiens
agatgctgtgcccctggcct

SEQ ID NO: 3567162 - DNA, 21 bp, Homo sapiens
agatgcttggttgtgttgagg

SEQ ID NO: 3567163 - DNA, 18 bp, Homo sapiens
agatggaaaattcatttt

SEQ ID NO: 3567164 - DNA, 22 bp, Homo sapiens
agatggaaaattcattttttaa

SEQ ID NO: 3567165 - DNA, 15 bp, Homo sapiens
agatggactcaggat

SEQ ID NO: 3567166 - DNA, 17 bp, Homo sapiens
agatggactcaggatcc

SEQ ID NO: 3567167 - DNA, 19 bp, Homo sapiens
agatggagacaccctctgg

SEQ ID NO: 3567168 - DNA, 22 bp, Homo sapiens
agatggagggcttggcccagcg

SEQ ID NO: 3567169 - DNA, 21 bp, Homo sapiens
agatggcataacctgtctcac

SEQ ID NO: 3567170 - DNA, 18 bp, Homo sapiens
agatggctgtgcctctgc

SEQ ID NO: 3567171 - DNA, 19 bp, Homo sapiens
agatggctgtgcctctgcc

SEQ ID NO: 3567172 - DNA, 15 bp, Homo sapiens
agatgtaattttgtg

SEQ ID NO: 3567173 - DNA, 16 bp, Homo sapiens
agatgtacctggtgga

SEQ ID NO: 3567174 - DNA, 19 bp, Homo sapiens
agatgtgcagcatttcact

SEQ ID NO: 3567175 - DNA, 21 bp, Homo sapiens
agatgttgagaggaacaagaa

SEQ ID NO: 3567176 - DNA, 23 bp, Homo sapiens
agattaaaattatatagctgctc

SEQ ID NO: 3567177 - DNA, 13 bp, Homo sapiens
agattaagaaata

SEQ ID NO: 3567178 - DNA, 14 bp, Homo sapiens
agattaagaaatag

SEQ ID NO: 3567179 - DNA, 15 bp, Homo sapiens
agattaagaaataga

SEQ ID NO: 3567180 - DNA, 20 bp, Homo sapiens
agattacaaatcagaagtca

SEQ ID NO: 3567181 - DNA, 18 bp, Homo sapiens
agattactttgctgcctt

SEQ ID NO: 3567182 - DNA, 20 bp, Homo sapiens
agattaggtcgttttccaaa

SEQ ID NO: 3567183 - DNA, 22 bp, Homo sapiens
agattcacttaacaaacaaatt

SEQ ID NO: 3567184 - DNA, 16 bp, Homo sapiens
agagccaagttccaaa

SEQ ID NO: 3567185 - DNA, 15 bp, Homo sapiens
agagccagcctggct

SEQ ID NO: 3567186 - DNA, 21 bp, Homo sapiens
agagccagcctggctctgccc

SEQ ID NO: 3567187 - DNA, 23 bp, Homo sapiens
agagccagcctggctctgccccc

SEQ ID NO: 3567188 - DNA, 15 bp, Homo sapiens
agagccaggatgccc

SEQ ID NO: 3567189 - DNA, 22 bp, Homo sapiens
agagccaggatgcccagatgaa

SEQ ID NO: 3567190 - DNA, 23 bp, Homo sapiens
agagccaggggggtgaggagctg

SEQ ID NO: 3567191 - DNA, 20 bp, Homo sapiens
agagccatacataaaagaaa

SEQ ID NO: 3567192 - DNA, 18 bp, Homo sapiens
agagcccagagtcccccc

SEQ ID NO: 3567193 - DNA, 13 bp, Homo sapiens
agagcccagctcc

SEQ ID NO: 3567194 - DNA, 14 bp, Homo sapiens
agagccccatggtg

SEQ ID NO: 3567195 - DNA, 13 bp, Homo sapiens
agagcccccagcc

SEQ ID NO: 3567196 - DNA, 19 bp, Homo sapiens
agagcccccagccctggga

SEQ ID NO: 3567197 - DNA, 19 bp, Homo sapiens
agagcccctactgtgggca

SEQ ID NO: 3567198 - DNA, 21 bp, Homo sapiens
agagcctcccaccagagccgg

SEQ ID NO: 3567199 - DNA, 23 bp, Homo sapiens
agagcctcccaccagagccggga

SEQ ID NO: 3567200 - DNA, 12 bp, Homo sapiens
agagcctggggg

SEQ ID NO: 3567201 - DNA, 16 bp, Homo sapiens
agagcgaggaaaggat

SEQ ID NO: 3567202 - DNA, 18 bp, Homo sapiens
agagctaggaaccctgga

SEQ ID NO: 3567203 - DNA, 20 bp, Homo sapiens
agagctaggaaccctggagg

SEQ ID NO: 3567204 - DNA, 11 bp, Homo sapiens
agagctgtgcc

SEQ ID NO: 3567205 - DNA, 16 bp, Homo sapiens
agagctgttatgctgt

SEQ ID NO: 3567206 - DNA, 19 bp, Homo sapiens
agagctgttatgctgtttc

SEQ ID NO: 3567207 - DNA, 21 bp, Homo sapiens
agagctgttatgctgtttcct

SEQ ID NO: 3567208 - DNA, 23 bp, Homo sapiens
agagctgttatgctgtttcctag

SEQ ID NO: 3567209 - DNA, 24 bp, Homo sapiens
agagctgttatgctgtttcctagc

SEQ ID NO: 3567210 - DNA, 18 bp, Homo sapiens
agagctgttcacagccag

SEQ ID NO: 3567211 - DNA, 15 bp, Homo sapiens
agagcttctggcact

SEQ ID NO: 3567212 - DNA, 18 bp, Homo sapiens
agagcttgtaataaatac

SEQ ID NO: 3567213 - DNA, 19 bp, Homo sapiens
agagcttgtaataaatact

SEQ ID NO: 3567214 - DNA, 20 bp, Homo sapiens
agagctttctgccttagcct

SEQ ID NO: 3567215 - DNA, 20 bp, Homo sapiens
agaggacagtatttgtgggg

SEQ ID NO: 3567216 - DNA, 23 bp, Homo sapiens
agaggactggttctgaggccaga

SEQ ID NO: 3567217 - DNA, 17 bp, Homo sapiens
agaggagccaccagttc

SEQ ID NO: 3567218 - DNA, 18 bp, Homo sapiens
agaggaggggccgctgcc

SEQ ID NO: 3567219 - DNA, 19 bp, Homo sapiens
agaggagggggcaggctga

SEQ ID NO: 3567220 - DNA, 20 bp, Homo sapiens
agaaatacaaaaaattagct

SEQ ID NO: 3567221 - DNA, 14 bp, Homo sapiens
agaaatgccccagt

SEQ ID NO: 3567222 - DNA, 17 bp, Homo sapiens
agaaatggctatgaaca

SEQ ID NO: 3567223 - DNA, 18 bp, Homo sapiens
agaaatgtagatgatatg

SEQ ID NO: 3567224 - DNA, 17 bp, Homo sapiens
agaaattgcatttcctg

SEQ ID NO: 3567225 - DNA, 13 bp, Homo sapiens
agaacaaaacttc

SEQ ID NO: 3567226 - DNA, 20 bp, Homo sapiens
agaacaaaggggcttaatta

SEQ ID NO: 3567227 - DNA, 19 bp, Homo sapiens
agaacaagttttggcagcc

SEQ ID NO: 3567228 - DNA, 22 bp, Homo sapiens
agaacaagttttggcagccatg

SEQ ID NO: 3567229 - DNA, 23 bp, Homo sapiens
agaacaagttttggcagccatga

SEQ ID NO: 3567230 - DNA, 20 bp, Homo sapiens
agaacaatattgactttgtc

SEQ ID NO: 3567231 - DNA, 20 bp, Homo sapiens
agaacaggcttggcaaagaa

SEQ ID NO: 3567232 - DNA, 12 bp, Homo sapiens
agaacagtgggc

SEQ ID NO: 3567233 - DNA, 18 bp, Homo sapiens
agaacagtggttgcctgg

SEQ ID NO: 3567234 - DNA, 19 bp, Homo sapiens
agaacagtggttgcctggg

SEQ ID NO: 3567235 - DNA, 22 bp, Homo sapiens
agaacagtggttgcctgggggc

SEQ ID NO: 3567236 - DNA, 17 bp, Homo sapiens
agaacatcccgcttctg

SEQ ID NO: 3567237 - DNA, 20 bp, Homo sapiens
agaacatctgtataccctct

SEQ ID NO: 3567238 - DNA, 14 bp, Homo sapiens
agaacatgttttat

SEQ ID NO: 3567239 - DNA, 12 bp, Homo sapiens
acttccctcagg

SEQ ID NO: 3567240 - DNA, 13 bp, Homo sapiens
acttccgctgagg

SEQ ID NO: 3567241 - DNA, 14 bp, Homo sapiens
acttccgctgaggg

SEQ ID NO: 3567242 - DNA, 15 bp, Homo sapiens
acttcctgctgcacc

SEQ ID NO: 3567243 - DNA, 17 bp, Homo sapiens
acttcctgctgcaccct

SEQ ID NO: 3567244 - DNA, 16 bp, Homo sapiens
acttcctgtgcctttc

SEQ ID NO: 3567245 - DNA, 19 bp, Homo sapiens
acttctaagactttactta

SEQ ID NO: 3567246 - DNA, 23 bp, Homo sapiens
acttctaagtaaaaccacagcag

SEQ ID NO: 3567247 - DNA, 20 bp, Homo sapiens
acttctcaaagagaattgta

SEQ ID NO: 3567248 - DNA, 16 bp, Homo sapiens
acttctcactcaccac

SEQ ID NO: 3567249 - DNA, 16 bp, Homo sapiens
acttctcttgctttct

SEQ ID NO: 3567250 - DNA, 21 bp, Homo sapiens
actcaagagaatttatgtgaa

SEQ ID NO: 3567251 - DNA, 14 bp, Homo sapiens
actcaatgtgctct

SEQ ID NO: 3567252 - DNA, 19 bp, Homo sapiens
actgcccaggcctgcctgt

SEQ ID NO: 3567253 - DNA, 13 bp, Homo sapiens
actgcccccagaa

SEQ ID NO: 3567254 - DNA, 21 bp, Homo sapiens
aatatgacaaacatcattgtt

SEQ ID NO: 3567255 - DNA, 16 bp, Homo sapiens
aatatgagtacaaatg

SEQ ID NO: 3567256 - DNA, 17 bp, Homo sapiens
aatatgcaaagcactga

SEQ ID NO: 3567257 - DNA, 14 bp, Homo sapiens
aatatgctggctgg

SEQ ID NO: 3567258 - DNA, 16 bp, Homo sapiens
aatatgctggctggag

SEQ ID NO: 3567259 - DNA, 23 bp, Homo sapiens
aatatgtataactttaacttctg

SEQ ID NO: 3567260 - DNA, 15 bp, Homo sapiens
aatatgttaaagttt

SEQ ID NO: 3567261 - DNA, 16 bp, Homo sapiens
aatatgttaaagttta

SEQ ID NO: 3567262 - DNA, 19 bp, Homo sapiens
aatatgttctctgaatgag

SEQ ID NO: 3567263 - DNA, 13 bp, Homo sapiens
aatattaaaattg

SEQ ID NO: 3567264 - DNA, 14 bp, Homo sapiens
aatattagttaatg

SEQ ID NO: 3567265 - DNA, 18 bp, Homo sapiens
aatattagttaatggatt

SEQ ID NO: 3567266 - DNA, 18 bp, Homo sapiens
aatattgatatgcttata

SEQ ID NO: 3567267 - DNA, 22 bp, Homo sapiens
aatattgtgcatgctagtgttg

SEQ ID NO: 3567268 - DNA, 16 bp, Homo sapiens
aatatttactatttca

SEQ ID NO: 3567269 - DNA, 13 bp, Homo sapiens
aatattttgctaa

SEQ ID NO: 3567270 - DNA, 21 bp, Homo sapiens
aatattttgctaactggttaa

SEQ ID NO: 3567271 - DNA, 11 bp, Homo sapiens
aatatttttgt

SEQ ID NO: 3567272 - DNA, 17 bp, Homo sapiens
aatattttttatttcta

SEQ ID NO: 3567273 - DNA, 20 bp, Homo sapiens
aatattttttatttctaagt

SEQ ID NO: 3567274 - DNA, 23 bp, Homo sapiens
aatattttttatttctaagtatt

SEQ ID NO: 3567275 - DNA, 16 bp, Homo sapiens
aatcaaatatgcaaag

SEQ ID NO: 3567276 - DNA, 10 bp, Homo sapiens
aatcaagagt

SEQ ID NO: 3567277 - DNA, 19 bp, Homo sapiens
aatcaagatttttttcctg

SEQ ID NO: 3567278 - DNA, 20 bp, Homo sapiens
aatcaagatttttttcctga

SEQ ID NO: 3567279 - DNA, 18 bp, Homo sapiens
aatcacagatgcatatag

SEQ ID NO: 3567280 - DNA, 11 bp, Homo sapiens
aatcactgcca

SEQ ID NO: 3567281 - DNA, 14 bp, Homo sapiens
aatcactgtgctta

SEQ ID NO: 3567282 - DNA, 22 bp, Homo sapiens
aatcactgtgcttaatttaaat

SEQ ID NO: 3567283 - DNA, 11 bp, Homo sapiens
aatcagaactc

SEQ ID NO: 3567284 - DNA, 18 bp, Homo sapiens
aatcagcattctcactcc

SEQ ID NO: 3567285 - DNA, 19 bp, Homo sapiens
aatcagcattctcactcct

SEQ ID NO: 3567286 - DNA, 14 bp, Homo sapiens
aatcagctggacat

SEQ ID NO: 3567287 - DNA, 15 bp, Homo sapiens
aatcagctggacata

SEQ ID NO: 3567288 - DNA, 19 bp, Homo sapiens
aatcatacaaactctcacc

SEQ ID NO: 3567289 - DNA, 23 bp, Homo sapiens
aatcatatagaccaattgaagca

SEQ ID NO: 3567290 - DNA, 14 bp, Homo sapiens
aatcatatttgaaa

SEQ ID NO: 3567291 - DNA, 22 bp, Homo sapiens
aatcatatttgaaaaccatatt

SEQ ID NO: 3567292 - DNA, 12 bp, Homo sapiens
aatcatgttgtt

SEQ ID NO: 3567293 - DNA, 14 bp, Homo sapiens
aatcattgttgcct

SEQ ID NO: 3567294 - DNA, 22 bp, Homo sapiens
aatcatttctgcatcagctgct

SEQ ID NO: 3567295 - DNA, 19 bp, Homo sapiens
aatccaaaaagctctgaaa

SEQ ID NO: 3567296 - DNA, 18 bp, Homo sapiens
aatccacctgcctcggcc

SEQ ID NO: 3567297 - DNA, 23 bp, Homo sapiens
aatccagaagttttaacttccag

SEQ ID NO: 3567298 - DNA, 18 bp, Homo sapiens
aatccaggcagatccagg

SEQ ID NO: 3567299 - DNA, 21 bp, Homo sapiens
aatccagtggtgggtaattgt

SEQ ID NO: 3567300 - DNA, 24 bp, Homo sapiens
aatccatttcaggactctctccag

SEQ ID NO: 3567301 - DNA, 22 bp, Homo sapiens
aatcccaatctttctatataaa

SEQ ID NO: 3567302 - DNA, 15 bp, Homo sapiens
aatcccaccttccca

SEQ ID NO: 3567303 - DNA, 16 bp, Homo sapiens
aatcctagacttgaaa

SEQ ID NO: 3567304 - DNA, 20 bp, Homo sapiens
aatcctagacttgaaagttt

SEQ ID NO: 3567305 - DNA, 22 bp, Homo sapiens
aatcctatatagaatgctgcac

SEQ ID NO: 3567306 - DNA, 18 bp, Homo sapiens
aatcctgattcatattta

SEQ ID NO: 3567307 - DNA, 11 bp, Homo sapiens
aatcctgtacc

SEQ ID NO: 3567308 - DNA, 17 bp, Homo sapiens
aatcctgtaccaaatct

SEQ ID NO: 3567309 - DNA, 18 bp, Homo sapiens
aatcctgtaccaaatctg

SEQ ID NO: 3567310 - DNA, 13 bp, Homo sapiens
aatccttctttgt

SEQ ID NO: 3567311 - DNA, 13 bp, Homo sapiens
aatctaaaatttc

SEQ ID NO: 3567312 - DNA, 15 bp, Homo sapiens
aatctaagtgatata

SEQ ID NO: 3567313 - DNA, 14 bp, Homo sapiens
aatctaatctgaac

SEQ ID NO: 3567314 - DNA, 21 bp, Homo sapiens
aatctctacaaaccctctgta

SEQ ID NO: 3567315 - DNA, 13 bp, Homo sapiens
aatctctgggggc

SEQ ID NO: 3567316 - DNA, 23 bp, Homo sapiens
aatctgaactgaccttgaatctt

SEQ ID NO: 3567317 - DNA, 23 bp, Homo sapiens
aatctgagcaggtacatttctga

SEQ ID NO: 3567318 - DNA, 12 bp, Homo sapiens
aatctgatgtat

SEQ ID NO: 3567319 - DNA, 22 bp, Homo sapiens
aatctgcttcatccaatgtgaa

SEQ ID NO: 3567320 - DNA, 15 bp, Homo sapiens
aatctggactcctct

SEQ ID NO: 3567321 - DNA, 14 bp, Homo sapiens
aatcttatggggcc

SEQ ID NO: 3567322 - DNA, 14 bp, Homo sapiens
aatcttcactttct

SEQ ID NO: 3567323 - DNA, 16 bp, Homo sapiens
aatcttcactttctta

SEQ ID NO: 3567324 - DNA, 14 bp, Homo sapiens
aatcttgaatttct

SEQ ID NO: 3567325 - DNA, 16 bp, Homo sapiens
aatctttcatgtcttg

SEQ ID NO: 3567326 - DNA, 21 bp, Homo sapiens
aatctttttatcccatttagt

SEQ ID NO: 3567327 - DNA, 13 bp, Homo sapiens
aatgaaaataact

SEQ ID NO: 3567328 - DNA, 14 bp, Homo sapiens
aatgaaaataactg

SEQ ID NO: 3567329 - DNA, 17 bp, Homo sapiens
aatgaaaataactgaac

SEQ ID NO: 3567330 - DNA, 15 bp, Homo sapiens
aatgaagaaggaagc

SEQ ID NO: 3567331 - DNA, 14 bp, Homo sapiens
aatgaatgaaacat

SEQ ID NO: 3567332 - DNA, 17 bp, Homo sapiens
aatgacaaaagatacaa

SEQ ID NO: 3567333 - DNA, 13 bp, Homo sapiens
aatgacacagtct

SEQ ID NO: 3567334 - DNA, 22 bp, Homo sapiens
aatgacaccacacttgttttct

SEQ ID NO: 3567335 - DNA, 21 bp, Homo sapiens
aatgacggtgttaattttgct

SEQ ID NO: 3567336 - DNA, 16 bp, Homo sapiens
aatgactcaaagtctg

SEQ ID NO: 3567337 - DNA, 16 bp, Homo sapiens
aatgactccactgttt

SEQ ID NO: 3567338 - DNA, 14 bp, Homo sapiens
aatgagaaaattgt

SEQ ID NO: 3567339 - DNA, 23 bp, Homo sapiens
aatgagccccttcatccgcctgt

SEQ ID NO: 3567340 - DNA, 12 bp, Homo sapiens
aatgaggatcca

SEQ ID NO: 3567341 - DNA, 19 bp, Homo sapiens
aatgaggatccagggcagc

SEQ ID NO: 3567342 - DNA, 14 bp, Homo sapiens
aatgaggtctgttt

SEQ ID NO: 3567343 - DNA, 17 bp, Homo sapiens
aatgagtcatttgttta

SEQ ID NO: 3567344 - DNA, 18 bp, Homo sapiens
aatgatatgcttgtaact

SEQ ID NO: 3567345 - DNA, 13 bp, Homo sapiens
aatgatcctgcca

SEQ ID NO: 3567346 - DNA, 19 bp, Homo sapiens
aatgatggcaattttgtaa

SEQ ID NO: 3567347 - DNA, 13 bp, Homo sapiens
aatgatttcatgc

SEQ ID NO: 3567348 - DNA, 13 bp, Homo sapiens
aatgcaaccattt

SEQ ID NO: 3567349 - DNA, 18 bp, Homo sapiens
aatgcaaccatttgaaac

SEQ ID NO: 3567350 - DNA, 21 bp, Homo sapiens
aatgcacagttgccacattta

SEQ ID NO: 3567351 - DNA, 20 bp, Homo sapiens
aatgcagcagggatgccctg

SEQ ID NO: 3567352 - DNA, 14 bp, Homo sapiens
aatgcataaatgca

SEQ ID NO: 3567353 - DNA, 18 bp, Homo sapiens
aatgcatatttgcaaagt

SEQ ID NO: 3567354 - DNA, 18 bp, Homo sapiens
aatgcatgagtaaaaaaa

SEQ ID NO: 3567355 - DNA, 15 bp, Homo sapiens
aatgcattcaaaata

SEQ ID NO: 3567356 - DNA, 17 bp, Homo sapiens
aatgcccagtaaaattt

SEQ ID NO: 3567357 - DNA, 16 bp, Homo sapiens
aatgccccagtgttat

SEQ ID NO: 3567358 - DNA, 15 bp, Homo sapiens
aatgccgctgtctct

SEQ ID NO: 3567359 - DNA, 18 bp, Homo sapiens
aatgcctcacgagatttg

SEQ ID NO: 3567360 - DNA, 20 bp, Homo sapiens
aatgccttaaaatggaattg

SEQ ID NO: 3567361 - DNA, 11 bp, Homo sapiens
aatgctctagt

SEQ ID NO: 3567362 - DNA, 19 bp, Homo sapiens
aatgctctctcaaattgtc

SEQ ID NO: 3567363 - DNA, 17 bp, Homo sapiens
aatgctgcaaacttaat

SEQ ID NO: 3567364 - DNA, 12 bp, Homo sapiens
aatgctgcactt

SEQ ID NO: 3567365 - DNA, 17 bp, Homo sapiens
aatgctgcacttcctgt

SEQ ID NO: 3567366 - DNA, 12 bp, Homo sapiens
aatgctgctttt

SEQ ID NO: 3567367 - DNA, 17 bp, Homo sapiens
aatgctggtgaaatgct

SEQ ID NO: 3567368 - DNA, 22 bp, Homo sapiens
aatgctgttagtaaatttctgt

SEQ ID NO: 3567369 - DNA, 21 bp, Homo sapiens
aatgcttgcatggagaatggg

SEQ ID NO: 3567370 - DNA, 16 bp, Homo sapiens
aatggaagaaatggct

SEQ ID NO: 3567371 - DNA, 14 bp, Homo sapiens
aatggacatggtgg

SEQ ID NO: 3567372 - DNA, 17 bp, Homo sapiens
aatggcaagttttccat

SEQ ID NO: 3567373 - DNA, 18 bp, Homo sapiens
aatggcagctagtgcctt

SEQ ID NO: 3567374 - DNA, 13 bp, Homo sapiens
aatggcagtcctg

SEQ ID NO: 3567375 - DNA, 15 bp, Homo sapiens
aatggcagtcctgga

SEQ ID NO: 3567376 - DNA, 22 bp, Homo sapiens
aatggcagtgactccccagccc

SEQ ID NO: 3567377 - DNA, 22 bp, Homo sapiens
aatggcatggcaggagtctctg

SEQ ID NO: 3567378 - DNA, 15 bp, Homo sapiens
aatggccattttaaa

SEQ ID NO: 3567379 - DNA, 18 bp, Homo sapiens
aatggcctggagcaggcc

SEQ ID NO: 3567380 - DNA, 15 bp, Homo sapiens
aatggctatgaacag

SEQ ID NO: 3567381 - DNA, 23 bp, Homo sapiens
aatggctatgaacagaaactaca

SEQ ID NO: 3567382 - DNA, 16 bp, Homo sapiens
aatgggacgaggacat

SEQ ID NO: 3567383 - DNA, 20 bp, Homo sapiens
aatgggcatttctaaaatgt

SEQ ID NO: 3567384 - DNA, 16 bp, Homo sapiens
aatgggctcaaccaga

SEQ ID NO: 3567385 - DNA, 12 bp, Homo sapiens
aatggggccaga

SEQ ID NO: 3567386 - DNA, 19 bp, Homo sapiens
aatgggggcaggaaagcca

SEQ ID NO: 3567387 - DNA, 18 bp, Homo sapiens
aatggggtcctggccatc

SEQ ID NO: 3567388 - DNA, 14 bp, Homo sapiens
aatggttaaatttt

SEQ ID NO: 3567389 - DNA, 17 bp, Homo sapiens
aatggttgatggaaaat

SEQ ID NO: 3567390 - DNA, 12 bp, Homo sapiens
aatgtaaaaaag

SEQ ID NO: 3567391 - DNA, 21 bp, Homo sapiens
aatgtaaactgtttctttaaa

SEQ ID NO: 3567392 - DNA, 16 bp, Homo sapiens
accttggcaccagaca

SEQ ID NO: 3567393 - DNA, 18 bp, Homo sapiens
accttggcaccagacacc

SEQ ID NO: 3567394 - DNA, 18 bp, Homo sapiens
accttgggtcctgaagtg

SEQ ID NO: 3567395 - DNA, 16 bp, Homo sapiens
acctttatctttcacc

SEQ ID NO: 3567396 - DNA, 22 bp, Homo sapiens
acctttatttattaaacttcag

SEQ ID NO: 3567397 - DNA, 16 bp, Homo sapiens
acctttctcctttgta

SEQ ID NO: 3567398 - DNA, 20 bp, Homo sapiens
acctttctcctttgtacttt

SEQ ID NO: 3567399 - DNA, 23 bp, Homo sapiens
acctttctcctttgtactttgtg

SEQ ID NO: 3567400 - DNA, 13 bp, Homo sapiens
acctttgtagtta

SEQ ID NO: 3567401 - DNA, 13 bp, Homo sapiens
accttttctcttt

SEQ ID NO: 3567402 - DNA, 23 bp, Homo sapiens
accttttgtagttttatttgtat

SEQ ID NO: 3567403 - DNA, 15 bp, Homo sapiens
acgaaactccatctc

SEQ ID NO: 3567404 - DNA, 21 bp, Homo sapiens
acgaaactccatctcaaaaca

SEQ ID NO: 3567405 - DNA, 14 bp, Homo sapiens
acgagcagcccagg

SEQ ID NO: 3567406 - DNA, 20 bp, Homo sapiens
acgagcaggctactgtcagc

SEQ ID NO: 3567407 - DNA, 22 bp, Homo sapiens
acgaggaaaagaacaaacaaaa

SEQ ID NO: 3567408 - DNA, 20 bp, Homo sapiens
acgaggacatttgtgggcaa

SEQ ID NO: 3567409 - DNA, 20 bp, Homo sapiens
acgagggtctcccctcctgc

SEQ ID NO: 3567410 - DNA, 21 bp, Homo sapiens
acgagggtctcccctcctgca

SEQ ID NO: 3567411 - DNA, 14 bp, Homo sapiens
acgagggtgccgtg

SEQ ID NO: 3567412 - DNA, 21 bp, Homo sapiens
acgcactctccccgctcaggg

SEQ ID NO: 3567413 - DNA, 15 bp, Homo sapiens
acgcagaggaatttt

SEQ ID NO: 3567414 - DNA, 12 bp, Homo sapiens
acgcagccctgc

SEQ ID NO: 3567415 - DNA, 23 bp, Homo sapiens
acgcagccctgctttgggctgcc

SEQ ID NO: 3567416 - DNA, 19 bp, Homo sapiens
acgcaggcccccaggtgcc

SEQ ID NO: 3567417 - DNA, 22 bp, Homo sapiens
acgcaggcccccaggtgccagt

SEQ ID NO: 3567418 - DNA, 18 bp, Homo sapiens
acgccaggcaccacagcc

SEQ ID NO: 3567419 - DNA, 14 bp, Homo sapiens
acgcccccccccac

SEQ ID NO: 3567420 - DNA, 12 bp, Homo sapiens
acgcccctccaa

SEQ ID NO: 3567421 - DNA, 16 bp, Homo sapiens
acgcccctccaaacct

SEQ ID NO: 3567422 - DNA, 20 bp, Homo sapiens
acgcccctccaaacctccag

SEQ ID NO: 3567423 - DNA, 15 bp, Homo sapiens
acgcccctgtggcca

SEQ ID NO: 3567424 - DNA, 17 bp, Homo sapiens
acgcccttggccatggg

SEQ ID NO: 3567425 - DNA, 16 bp, Homo sapiens
acgcgtctgcctgggc

SEQ ID NO: 3567426 - DNA, 16 bp, Homo sapiens
acgctcaatgcccagt

SEQ ID NO: 3567427 - DNA, 21 bp, Homo sapiens
acgctcaatgcccagtaaaat

SEQ ID NO: 3567428 - DNA, 22 bp, Homo sapiens
acgctcaatgcccagtaaaatt

SEQ ID NO: 3567429 - DNA, 18 bp, Homo sapiens
acgctgccttcggtaccc

SEQ ID NO: 3567430 - DNA, 15 bp, Homo sapiens
acgctgctctgcccc

SEQ ID NO: 3567431 - DNA, 16 bp, Homo sapiens
acgctgctctgcccca

SEQ ID NO: 3567432 - DNA, 17 bp, Homo sapiens
acgctgctctgccccag

SEQ ID NO: 3567433 - DNA, 12 bp, Homo sapiens
acggagggctgg

SEQ ID NO: 3567434 - DNA, 22 bp, Homo sapiens
acggatgccttcccctgggccc

SEQ ID NO: 3567435 - DNA, 13 bp, Homo sapiens
acggattattttt

SEQ ID NO: 3567436 - DNA, 16 bp, Homo sapiens
acggattattttttca

SEQ ID NO: 3567437 - DNA, 20 bp, Homo sapiens
acggccatctctttgtacag

SEQ ID NO: 3567438 - DNA, 22 bp, Homo sapiens
acggcctgcccagtcgacccca

SEQ ID NO: 3567439 - DNA, 22 bp, Homo sapiens
acggcctggctggtgggaaggc

SEQ ID NO: 3567440 - DNA, 23 bp, Homo sapiens
acggcctggctggtgggaaggcc

SEQ ID NO: 3567441 - DNA, 22 bp, Homo sapiens
acggcgaccaataaacagctcc

SEQ ID NO: 3567442 - DNA, 18 bp, Homo sapiens
acggcgggatcctccaca

SEQ ID NO: 3567443 - DNA, 23 bp, Homo sapiens
acggcgggatcctccacagagag

SEQ ID NO: 3567444 - DNA, 17 bp, Homo sapiens
acgggatgacctccaga

SEQ ID NO: 3567445 - DNA, 18 bp, Homo sapiens
acgggatgacctccagaa

SEQ ID NO: 3567446 - DNA, 19 bp, Homo sapiens
acgggatgacctccagaag

SEQ ID NO: 3567447 - DNA, 17 bp, Homo sapiens
acgggcccgggttgggt

SEQ ID NO: 3567448 - DNA, 19 bp, Homo sapiens
acggtctgtgtgctgtttg

SEQ ID NO: 3567449 - DNA, 13 bp, Homo sapiens
acggtgctaaaaa

SEQ ID NO: 3567450 - DNA, 21 bp, Homo sapiens
acggtggcggctgcacaacag

SEQ ID NO: 3567451 - DNA, 19 bp, Homo sapiens
acggtgttaattttgctaa

SEQ ID NO: 3567452 - DNA, 20 bp, Homo sapiens
acggtgttaattttgctaac

SEQ ID NO: 3567453 - DNA, 21 bp, Homo sapiens
acggtgttaattttgctaact

SEQ ID NO: 3567454 - DNA, 11 bp, Homo sapiens
acggttcctgg

SEQ ID NO: 3567455 - DNA, 12 bp, Homo sapiens
acgtaaatccac

SEQ ID NO: 3567456 - DNA, 12 bp, Homo sapiens
acgtagctattt

SEQ ID NO: 3567457 - DNA, 14 bp, Homo sapiens
acgtagctctctta

SEQ ID NO: 3567458 - DNA, 18 bp, Homo sapiens
acgtcccagcatccctgg

SEQ ID NO: 3567459 - DNA, 21 bp, Homo sapiens
acgtccttgggcgtctctaat

SEQ ID NO: 3567460 - DNA, 19 bp, Homo sapiens
acgtgaacgttttaataat

SEQ ID NO: 3567461 - DNA, 15 bp, Homo sapiens
acgtgagagaaagag

SEQ ID NO: 3567462 - DNA, 19 bp, Homo sapiens
acgtgagagaaagagagaa

SEQ ID NO: 3567463 - DNA, 22 bp, Homo sapiens
acgtgagagaaagagagaagcc

SEQ ID NO: 3567464 - DNA, 13 bp, Homo sapiens
acgtgcaaagcca

SEQ ID NO: 3567465 - DNA, 18 bp, Homo sapiens
acgtgctccgtagctctg

SEQ ID NO: 3567466 - DNA, 16 bp, Homo sapiens
acgtgtatagtatctg

SEQ ID NO: 3567467 - DNA, 17 bp, Homo sapiens
acgtgtatagtatctgt

SEQ ID NO: 3567468 - DNA, 13 bp, Homo sapiens
acgtttcactgca

SEQ ID NO: 3567469 - DNA, 22 bp, Homo sapiens
acgtttgcggcagtgttccttg

SEQ ID NO: 3567470 - DNA, 17 bp, Homo sapiens
actaaaaagtataaaat

SEQ ID NO: 3567471 - DNA, 14 bp, Homo sapiens
actaaaataatttt

SEQ ID NO: 3567472 - DNA, 14 bp, Homo sapiens
actaaaatgttcta

SEQ ID NO: 3567473 - DNA, 15 bp, Homo sapiens
actaaaattaatgca

SEQ ID NO: 3567474 - DNA, 17 bp, Homo sapiens
actaaactccatgatat

SEQ ID NO: 3567475 - DNA, 19 bp, Homo sapiens
actaaactttttttctgta

SEQ ID NO: 3567476 - DNA, 12 bp, Homo sapiens
actaaagaagag

SEQ ID NO: 3567477 - DNA, 14 bp, Homo sapiens
actaaagaagagga

SEQ ID NO: 3567478 - DNA, 21 bp, Homo sapiens
actaaataacacagatattgt

SEQ ID NO: 3567479 - DNA, 14 bp, Homo sapiens
actaacccagtctt

SEQ ID NO: 3567480 - DNA, 17 bp, Homo sapiens
actaacccagtctttct

SEQ ID NO: 3567481 - DNA, 15 bp, Homo sapiens
actaactatgcatgg

SEQ ID NO: 3567482 - DNA, 23 bp, Homo sapiens
actaactatgcatggtgccccag

SEQ ID NO: 3567483 - DNA, 13 bp, Homo sapiens
actaactggcagg

SEQ ID NO: 3567484 - DNA, 23 bp, Homo sapiens
actaagatgtgcagcatttcact

SEQ ID NO: 3567485 - DNA, 13 bp, Homo sapiens
actaagcagagga

SEQ ID NO: 3567486 - DNA, 22 bp, Homo sapiens
actaaggggcccggccagccat

SEQ ID NO: 3567487 - DNA, 20 bp, Homo sapiens
actaatagaataaaggcagt

SEQ ID NO: 3567488 - DNA, 13 bp, Homo sapiens
actaatatttctg

SEQ ID NO: 3567489 - DNA, 14 bp, Homo sapiens
actaatatttctgt

SEQ ID NO: 3567490 - DNA, 17 bp, Homo sapiens
actaatgtctcttctaa

SEQ ID NO: 3567491 - DNA, 20 bp, Homo sapiens
actaatgtctcttctaacat

SEQ ID NO: 3567492 - DNA, 19 bp, Homo sapiens
actaattggaaggagaggg

SEQ ID NO: 3567493 - DNA, 13 bp, Homo sapiens
actacacattttt

SEQ ID NO: 3567494 - DNA, 16 bp, Homo sapiens
actacacatttttaaa

SEQ ID NO: 3567495 - DNA, 20 bp, Homo sapiens
actacacatttttaaattgt

SEQ ID NO: 3567496 - DNA, 17 bp, Homo sapiens
actaccaaaagacatta

SEQ ID NO: 3567497 - DNA, 18 bp, Homo sapiens
actactagtgtgactcct

SEQ ID NO: 3567498 - DNA, 20 bp, Homo sapiens
actactgacagggagcagcc

SEQ ID NO: 3567499 - DNA, 15 bp, Homo sapiens
actactgcagtcttt

SEQ ID NO: 3567500 - DNA, 16 bp, Homo sapiens
actacttttctaaaat

SEQ ID NO: 3567501 - DNA, 15 bp, Homo sapiens
actagactactcaat

SEQ ID NO: 3567502 - DNA, 17 bp, Homo sapiens
actagagacaaatcttt

SEQ ID NO: 3567503 - DNA, 21 bp, Homo sapiens
actagagacaaatctttaaga

SEQ ID NO: 3567504 - DNA, 18 bp, Homo sapiens
actagagggacctctccc

SEQ ID NO: 3567505 - DNA, 19 bp, Homo sapiens
actagagggacctctccca

SEQ ID NO: 3567506 - DNA, 20 bp, Homo sapiens
actagagggacctctcccag

SEQ ID NO: 3567507 - DNA, 18 bp, Homo sapiens
actaggaaatccattcac

SEQ ID NO: 3567508 - DNA, 15 bp, Homo sapiens
actagtggaaagtca

SEQ ID NO: 3567509 - DNA, 14 bp, Homo sapiens
actagtgtgactcc

SEQ ID NO: 3567510 - DNA, 15 bp, Homo sapiens
actagtgtgactcct

SEQ ID NO: 3567511 - DNA, 23 bp, Homo sapiens
actatatgtgaaacattttttct

SEQ ID NO: 3567512 - DNA, 23 bp, Homo sapiens
actatatttgggcctgctccaga

SEQ ID NO: 3567513 - DNA, 19 bp, Homo sapiens
actatcaactacaaattag

SEQ ID NO: 3567514 - DNA, 19 bp, Homo sapiens
actatgatttaatttgaaa

SEQ ID NO: 3567515 - DNA, 22 bp, Homo sapiens
actatgcatggtgccccaggac

SEQ ID NO: 3567516 - DNA, 12 bp, Homo sapiens
actatgtaaact

SEQ ID NO: 3567517 - DNA, 14 bp, Homo sapiens
actatgtaaactac

SEQ ID NO: 3567518 - DNA, 17 bp, Homo sapiens
actattacagtgttgga

SEQ ID NO: 3567519 - DNA, 15 bp, Homo sapiens
actattatttcctat

SEQ ID NO: 3567520 - DNA, 14 bp, Homo sapiens
actattcaaacagt

SEQ ID NO: 3567521 - DNA, 18 bp, Homo sapiens
actattcaaacagtctca

SEQ ID NO: 3567522 - DNA, 16 bp, Homo sapiens
actattgtgccaactg

SEQ ID NO: 3567523 - DNA, 23 bp, Homo sapiens
actatttcacatgagtcaaaaca

SEQ ID NO: 3567524 - DNA, 18 bp, Homo sapiens
actatttgatgagtctta

SEQ ID NO: 3567525 - DNA, 16 bp, Homo sapiens
actatttgcagaggct

SEQ ID NO: 3567526 - DNA, 22 bp, Homo sapiens
actcaaatgagccccttcatcc

SEQ ID NO: 3567527 - DNA, 21 bp, Homo sapiens
actcaaatggggccagatcca

SEQ ID NO: 3567528 - DNA, 19 bp, Homo sapiens
acccttctgggtccaggga

SEQ ID NO: 3567529 - DNA, 22 bp, Homo sapiens
acccttttcccccttcccattt

SEQ ID NO: 3567530 - DNA, 15 bp, Homo sapiens
accgaccaactgccc

SEQ ID NO: 3567531 - DNA, 13 bp, Homo sapiens
accgagccctgga

SEQ ID NO: 3567532 - DNA, 14 bp, Homo sapiens
accgagccctggag

SEQ ID NO: 3567533 - DNA, 16 bp, Homo sapiens
accgagtctcttctcc

SEQ ID NO: 3567534 - DNA, 17 bp, Homo sapiens
accgagtctcttctcca

SEQ ID NO: 3567535 - DNA, 20 bp, Homo sapiens
accgagtctcttctccactg

SEQ ID NO: 3567536 - DNA, 24 bp, Homo sapiens
accgagtctcttctccactggatg

SEQ ID NO: 3567537 - DNA, 15 bp, Homo sapiens
accgcttctgccttt

SEQ ID NO: 3567538 - DNA, 14 bp, Homo sapiens
accggccaggccgc

SEQ ID NO: 3567539 - DNA, 21 bp, Homo sapiens
accggccaggccgcgcccagc

SEQ ID NO: 3567540 - DNA, 23 bp, Homo sapiens
accgggctgggagctctgcagag

SEQ ID NO: 3567541 - DNA, 17 bp, Homo sapiens
accggtgctgcaggagt

SEQ ID NO: 3567542 - DNA, 15 bp, Homo sapiens
accgtccaggcccca

SEQ ID NO: 3567543 - DNA, 19 bp, Homo sapiens
accgtttagaaaaaacaat

SEQ ID NO: 3567544 - DNA, 17 bp, Homo sapiens
acctacaataaactggt

SEQ ID NO: 3567545 - DNA, 21 bp, Homo sapiens
acctacagactccatctcttc

SEQ ID NO: 3567546 - DNA, 20 bp, Homo sapiens
acctacagagatgctaagag

SEQ ID NO: 3567547 - DNA, 17 bp, Homo sapiens
acctacattccaccctg

SEQ ID NO: 3567548 - DNA, 23 bp, Homo sapiens
acctacattccaccctgttactt

SEQ ID NO: 3567549 - DNA, 14 bp, Homo sapiens
acctaccccagcca

SEQ ID NO: 3567550 - DNA, 15 bp, Homo sapiens
acctagcagcctcaa

SEQ ID NO: 3567551 - DNA, 18 bp, Homo sapiens
acctagtacattactaaa

SEQ ID NO: 3567552 - DNA, 19 bp, Homo sapiens
acctagtacattactaaat

SEQ ID NO: 3567553 - DNA, 15 bp, Homo sapiens
acctatctcagccat

SEQ ID NO: 3567554 - DNA, 17 bp, Homo sapiens
acctatctcagccatag

SEQ ID NO: 3567555 - DNA, 14 bp, Homo sapiens
acctattctgaaaa

SEQ ID NO: 3567556 - DNA, 19 bp, Homo sapiens
acctattctgaaaaagaca

SEQ ID NO: 3567557 - DNA, 22 bp, Homo sapiens
acctattctgaaaaagacataa

SEQ ID NO: 3567558 - DNA, 15 bp, Homo sapiens
acctcactggcctgc

SEQ ID NO: 3567559 - DNA, 23 bp, Homo sapiens
acctcactggcctgccatgccag

SEQ ID NO: 3567560 - DNA, 15 bp, Homo sapiens
acctcagcctggcca

SEQ ID NO: 3567561 - DNA, 20 bp, Homo sapiens
acctcagcctggccagacac

SEQ ID NO: 3567562 - DNA, 21 bp, Homo sapiens
acctcagcctggccagacaca

SEQ ID NO: 3567563 - DNA, 16 bp, Homo sapiens
acctcatcagccttgg

SEQ ID NO: 3567564 - DNA, 19 bp, Homo sapiens
acctcatctgtggagctgc

SEQ ID NO: 3567565 - DNA, 21 bp, Homo sapiens
acctcatctgtggagctgcca

SEQ ID NO: 3567566 - DNA, 15 bp, Homo sapiens
acctccacacccacc

SEQ ID NO: 3567567 - DNA, 12 bp, Homo sapiens
acctccagactc

SEQ ID NO: 3567568 - DNA, 20 bp, Homo sapiens
acctccagcctccctgtctc

SEQ ID NO: 3567569 - DNA, 23 bp, Homo sapiens
acctccagcctccctgtctccag

SEQ ID NO: 3567570 - DNA, 13 bp, Homo sapiens
acctcccaactct

SEQ ID NO: 3567571 - DNA, 21 bp, Homo sapiens
acctccccctttcacactgga

SEQ ID NO: 3567572 - DNA, 13 bp, Homo sapiens
acctccctgcctc

SEQ ID NO: 3567573 - DNA, 15 bp, Homo sapiens
acctccgcccctgcc

SEQ ID NO: 3567574 - DNA, 18 bp, Homo sapiens
acctccggagcgccctgc

SEQ ID NO: 3567575 - DNA, 21 bp, Homo sapiens
acctccggagcgccctgcagg

SEQ ID NO: 3567576 - DNA, 12 bp, Homo sapiens
acctcctaccct

SEQ ID NO: 3567577 - DNA, 16 bp, Homo sapiens
acctcctaccctccca

SEQ ID NO: 3567578 - DNA, 17 bp, Homo sapiens
acctcctaccctcccac

SEQ ID NO: 3567579 - DNA, 18 bp, Homo sapiens
acctcctaccctcccacc

SEQ ID NO: 3567580 - DNA, 15 bp, Homo sapiens
acctcctcccactgc

SEQ ID NO: 3567581 - DNA, 20 bp, Homo sapiens
acctcgctgttgtcacatct

SEQ ID NO: 3567582 - DNA, 14 bp, Homo sapiens
acctctaagtgctg

SEQ ID NO: 3567583 - DNA, 16 bp, Homo sapiens
acctctaataaacact

SEQ ID NO: 3567584 - DNA, 14 bp, Homo sapiens
acctctaggaggag

SEQ ID NO: 3567585 - DNA, 14 bp, Homo sapiens
acctctcctgaccc

SEQ ID NO: 3567586 - DNA, 21 bp, Homo sapiens
acctctcctgacccctgcctg

SEQ ID NO: 3567587 - DNA, 13 bp, Homo sapiens
acctctcctgccc

SEQ ID NO: 3567588 - DNA, 14 bp, Homo sapiens
acctctcctgccct

SEQ ID NO: 3567589 - DNA, 19 bp, Homo sapiens
acctctgacaactgtgaag

SEQ ID NO: 3567590 - DNA, 23 bp, Homo sapiens
acctctgggtccttggctcccgg

SEQ ID NO: 3567591 - DNA, 22 bp, Homo sapiens
acctctgtctgagacaggtgcc

SEQ ID NO: 3567592 - DNA, 23 bp, Homo sapiens
acctctgtctgagacaggtgcct

SEQ ID NO: 3567593 - DNA, 20 bp, Homo sapiens
acctctgtgggcactggtgg

SEQ ID NO: 3567594 - DNA, 20 bp, Homo sapiens
acctctgtggtcacccatgc

SEQ ID NO: 3567595 - DNA, 22 bp, Homo sapiens
acctcttaaagaaaacccaccc

SEQ ID NO: 3567596 - DNA, 14 bp, Homo sapiens
acctgaaagagagg

SEQ ID NO: 3567597 - DNA, 21 bp, Homo sapiens
acctgaaggggttttcttgat

SEQ ID NO: 3567598 - DNA, 16 bp, Homo sapiens
acctgaatcagctgga

SEQ ID NO: 3567599 - DNA, 18 bp, Homo sapiens
acctgaatcagctggaca

SEQ ID NO: 3567600 - DNA, 20 bp, Homo sapiens
acctgagcggcaccctggtc

SEQ ID NO: 3567601 - DNA, 22 bp, Homo sapiens
acctgagtcaccctacctgtgc

SEQ ID NO: 3567602 - DNA, 20 bp, Homo sapiens
acctgatcctggaggcccag

SEQ ID NO: 3567603 - DNA, 16 bp, Homo sapiens
acctgattgtattttt

SEQ ID NO: 3567604 - DNA, 12 bp, Homo sapiens
acctgccaagga

SEQ ID NO: 3567605 - DNA, 14 bp, Homo sapiens
acctgccaaggagc

SEQ ID NO: 3567606 - DNA, 21 bp, Homo sapiens
acctgccacccccttccctgg

SEQ ID NO: 3567607 - DNA, 23 bp, Homo sapiens
acctgccacccccttccctggga

SEQ ID NO: 3567608 - DNA, 13 bp, Homo sapiens
acctgccccaagt

SEQ ID NO: 3567609 - DNA, 15 bp, Homo sapiens
acctgcccctgcctg

SEQ ID NO: 3567610 - DNA, 21 bp, Homo sapiens
acctgcccgcctaagaccctg

SEQ ID NO: 3567611 - DNA, 12 bp, Homo sapiens
acctgccctcta

SEQ ID NO: 3567612 - DNA, 23 bp, Homo sapiens
acctgccctctatttattagcca

SEQ ID NO: 3567613 - DNA, 13 bp, Homo sapiens
acctgctccagaa

SEQ ID NO: 3567614 - DNA, 17 bp, Homo sapiens
acctgctccagaagatg

SEQ ID NO: 3567615 - DNA, 19 bp, Homo sapiens
acctgctctcctcttgcca

SEQ ID NO: 3567616 - DNA, 22 bp, Homo sapiens
acctggacaaagtccaagtctg

SEQ ID NO: 3567617 - DNA, 20 bp, Homo sapiens
acctggagcttcagccaggt

SEQ ID NO: 3567618 - DNA, 18 bp, Homo sapiens
acctggatccagcactgg

SEQ ID NO: 3567619 - DNA, 14 bp, Homo sapiens
acctggcagctctg

SEQ ID NO: 3567620 - DNA, 22 bp, Homo sapiens
acctggccttaaagagggacag

SEQ ID NO: 3567621 - DNA, 17 bp, Homo sapiens
acctggcgtgctcagac

SEQ ID NO: 3567622 - DNA, 11 bp, Homo sapiens
acctggctgcc

SEQ ID NO: 3567623 - DNA, 16 bp, Homo sapiens
acctgggaaggccagc

SEQ ID NO: 3567624 - DNA, 14 bp, Homo sapiens
acctgggcacaaac

SEQ ID NO: 3567625 - DNA, 14 bp, Homo sapiens
acctggggtgaata

SEQ ID NO: 3567626 - DNA, 20 bp, Homo sapiens
acctggtccccactgctgag

SEQ ID NO: 3567627 - DNA, 17 bp, Homo sapiens
acctggtcgccaatcca

SEQ ID NO: 3567628 - DNA, 19 bp, Homo sapiens
acctgtaacctttcggcaa

SEQ ID NO: 3567629 - DNA, 16 bp, Homo sapiens
acctgtaatcccagca

SEQ ID NO: 3567630 - DNA, 19 bp, Homo sapiens
acctgtaatcccagcactt

SEQ ID NO: 3567631 - DNA, 16 bp, Homo sapiens
acctgtcctgtctttg

SEQ ID NO: 3567632 - DNA, 19 bp, Homo sapiens
acctgtcctgtctttgatc

SEQ ID NO: 3567633 - DNA, 13 bp, Homo sapiens
acctgtctgctgc

SEQ ID NO: 3567634 - DNA, 18 bp, Homo sapiens
acctgtctgctgccagca

SEQ ID NO: 3567635 - DNA, 16 bp, Homo sapiens
acctgtgactcctgtt

SEQ ID NO: 3567636 - DNA, 16 bp, Homo sapiens
acctgtgactcttagc

SEQ ID NO: 3567637 - DNA, 18 bp, Homo sapiens
acctgttcttagagtgta

SEQ ID NO: 3567638 - DNA, 20 bp, Homo sapiens
acctgttcttagagtgtagc

SEQ ID NO: 3567639 - DNA, 22 bp, Homo sapiens
acctgttcttagagtgtagctg

SEQ ID NO: 3567640 - DNA, 16 bp, Homo sapiens
accttaaaagtaataa

SEQ ID NO: 3567641 - DNA, 17 bp, Homo sapiens
accttaaaagtaataaa

SEQ ID NO: 3567642 - DNA, 18 bp, Homo sapiens
accttaaaagtaataaag

SEQ ID NO: 3567643 - DNA, 13 bp, Homo sapiens
accttaatgacaa

SEQ ID NO: 3567644 - DNA, 12 bp, Homo sapiens
accttatagtta

SEQ ID NO: 3567645 - DNA, 20 bp, Homo sapiens
accttatagttactgtgtaa

SEQ ID NO: 3567646 - DNA, 16 bp, Homo sapiens
accttcagattcccca

SEQ ID NO: 3567647 - DNA, 11 bp, Homo sapiens
accttcccagg

SEQ ID NO: 3567648 - DNA, 12 bp, Homo sapiens
accttcccaggg

SEQ ID NO: 3567649 - DNA, 20 bp, Homo sapiens
accttccccctcccccagcc

SEQ ID NO: 3567650 - DNA, 14 bp, Homo sapiens
accttcgggctgtg

SEQ ID NO: 3567651 - DNA, 15 bp, Homo sapiens
accttcgggctgtgc

SEQ ID NO: 3567652 - DNA, 17 bp, Homo sapiens
accttcgggctgtgccc

SEQ ID NO: 3567653 - DNA, 22 bp, Homo sapiens
accttctagttgcccccattcc

SEQ ID NO: 3567654 - DNA, 20 bp, Homo sapiens
accttctatgtattagtgtc

SEQ ID NO: 3567655 - DNA, 22 bp, Homo sapiens
accttctggcctcccacagact

SEQ ID NO: 3567656 - DNA, 15 bp, Homo sapiens
accttctgtggctca

SEQ ID NO: 3567657 - DNA, 11 bp, Homo sapiens
accttgaaggt

SEQ ID NO: 3567658 - DNA, 14 bp, Homo sapiens
accttgaaggtctg

SEQ ID NO: 3567659 - DNA, 22 bp, Homo sapiens
accttgaataaggcccactgta

SEQ ID NO: 3567660 - DNA, 24 bp, Homo sapiens
accttgcagaaggcaaggccctgc

SEQ ID NO: 3567661 - DNA, 16 bp, Homo sapiens
accttgctctcctcat

SEQ ID NO: 3567662 - DNA, 17 bp, Homo sapiens
accttgctctcctcatc

SEQ ID NO: 3567663 - DNA, 20 bp, Homo sapiens
accttgctctcctcatctcc

SEQ ID NO: 3567664 - DNA, 18 bp, Homo sapiens
ttaatgtatgttaccaaa

SEQ ID NO: 3567665 - DNA, 22 bp, Homo sapiens
ttaatgtcctctcaaagtaaaa

SEQ ID NO: 3567666 - DNA, 18 bp, Homo sapiens
ttaatgttccagtttgaa

SEQ ID NO: 3567667 - DNA, 15 bp, Homo sapiens
ttaattaaacattgt

SEQ ID NO: 3567668 - DNA, 15 bp, Homo sapiens
ttaattactgctata

SEQ ID NO: 3567669 - DNA, 22 bp, Homo sapiens
ttaattcttcagcgtaaaatgg

SEQ ID NO: 3567670 - DNA, 16 bp, Homo sapiens
ttaattgccagcaaat

SEQ ID NO: 3567671 - DNA, 12 bp, Homo sapiens
ttaattgctttg

SEQ ID NO: 3567672 - DNA, 18 bp, Homo sapiens
ttaatttataatgtattt

SEQ ID NO: 3567673 - DNA, 21 bp, Homo sapiens
ttaatttataatgtatttgaa

SEQ ID NO: 3567674 - DNA, 22 bp, Homo sapiens
ttaatttataatgtatttgaaa

SEQ ID NO: 3567675 - DNA, 13 bp, Homo sapiens
ttaatttgaaata

SEQ ID NO: 3567676 - DNA, 15 bp, Homo sapiens
ttaatttgaaatatg

SEQ ID NO: 3567677 - DNA, 21 bp, Homo sapiens
ttaatttgtaaaacttctgct

SEQ ID NO: 3567678 - DNA, 22 bp, Homo sapiens
ttaatttgtaaaacttctgctc

SEQ ID NO: 3567679 - DNA, 12 bp, Homo sapiens
ttaattttcact

SEQ ID NO: 3567680 - DNA, 15 bp, Homo sapiens
ttaattttcagttct

SEQ ID NO: 3567681 - DNA, 16 bp, Homo sapiens
ttaattttcagttcta

SEQ ID NO: 3567682 - DNA, 19 bp, Homo sapiens
ttaattttcagttctattt

SEQ ID NO: 3567683 - DNA, 23 bp, Homo sapiens
ttaattttgaagtgctgtttatt

SEQ ID NO: 3567684 - DNA, 17 bp, Homo sapiens
ttaattttgctaactgg

SEQ ID NO: 3567685 - DNA, 15 bp, Homo sapiens
ttaatttttcctttt

SEQ ID NO: 3567686 - DNA, 19 bp, Homo sapiens
ttacaaacaataagaacaa

SEQ ID NO: 3567687 - DNA, 19 bp, Homo sapiens
ttacaaagggaaagcctct

SEQ ID NO: 3567688 - DNA, 17 bp, Homo sapiens
ttacaaatcagaagtca

SEQ ID NO: 3567689 - DNA, 22 bp, Homo sapiens
ttacaaatcagaagtcatcttg

SEQ ID NO: 3567690 - DNA, 20 bp, Homo sapiens
ttacaacgccgagtgcactg

SEQ ID NO: 3567691 - DNA, 12 bp, Homo sapiens
ttacaactaaat

SEQ ID NO: 3567692 - DNA, 15 bp, Homo sapiens
ttacaactaaataac

SEQ ID NO: 3567693 - DNA, 20 bp, Homo sapiens
ttacaactaaataacacaga

SEQ ID NO: 3567694 - DNA, 16 bp, Homo sapiens
ttacaagtataacagt

SEQ ID NO: 3567695 - DNA, 15 bp, Homo sapiens
ttacaatagttctgt

SEQ ID NO: 3567696 - DNA, 16 bp, Homo sapiens
ttacacaattcttacc

SEQ ID NO: 3567697 - DNA, 12 bp, Homo sapiens
ttacagaaaata

SEQ ID NO: 3567698 - DNA, 13 bp, Homo sapiens
ttacagaaactga

SEQ ID NO: 3567699 - DNA, 15 bp, Homo sapiens
ttacagaaactgatg

SEQ ID NO: 3567700 - DNA, 19 bp, Homo sapiens
ttacagatttattcctttg

SEQ ID NO: 3567701 - DNA, 21 bp, Homo sapiens
ttacagatttattcctttgtt

SEQ ID NO: 3567702 - DNA, 15 bp, Homo sapiens
ttacagcctctgact

SEQ ID NO: 3567703 - DNA, 18 bp, Homo sapiens
ttacaggagccagcctgc

SEQ ID NO: 3567704 - DNA, 15 bp, Homo sapiens
ttacagggaagtggt

SEQ ID NO: 3567705 - DNA, 14 bp, Homo sapiens
ttacagtatttcta

SEQ ID NO: 3567706 - DNA, 12 bp, Homo sapiens
ttacagttctgt

SEQ ID NO: 3567707 - DNA, 17 bp, Homo sapiens
ttacataacggaaagtt

SEQ ID NO: 3567708 - DNA, 14 bp, Homo sapiens
ttacatatctgact

SEQ ID NO: 3567709 - DNA, 18 bp, Homo sapiens
ttctcactcctacctggt

SEQ ID NO: 3567710 - DNA, 19 bp, Homo sapiens
ttctcactgaactccaccg

SEQ ID NO: 3567711 - DNA, 20 bp, Homo sapiens
ttctcagatttctgaggaaa

SEQ ID NO: 3567712 - DNA, 18 bp, Homo sapiens
ttctcagccaggcgtggt

SEQ ID NO: 3567713 - DNA, 13 bp, Homo sapiens
ttctcagctccca

SEQ ID NO: 3567714 - DNA, 14 bp, Homo sapiens
ttctcagctgtgcc

SEQ ID NO: 3567715 - DNA, 20 bp, Homo sapiens
ttctcagctgtgccttccct

SEQ ID NO: 3567716 - DNA, 16 bp, Homo sapiens
ttctcagggctggagc

SEQ ID NO: 3567717 - DNA, 14 bp, Homo sapiens
ttctcatgttgaag

SEQ ID NO: 3567718 - DNA, 22 bp, Homo sapiens
ttctcatgttgaagctttaaga

SEQ ID NO: 3567719 - DNA, 19 bp, Homo sapiens
ttctccatcccctccctgc

SEQ ID NO: 3567720 - DNA, 13 bp, Homo sapiens
ttctcccaaagat

SEQ ID NO: 3567721 - DNA, 14 bp, Homo sapiens
ttctcccaaagatt

SEQ ID NO: 3567722 - DNA, 23 bp, Homo sapiens
ttctcccacatgaggccatctca

SEQ ID NO: 3567723 - DNA, 24 bp, Homo sapiens
ttctccctttctctctcctctctg

SEQ ID NO: 3567724 - DNA, 20 bp, Homo sapiens
ttctccttaagagacaattt

SEQ ID NO: 3567725 - DNA, 14 bp, Homo sapiens
ttctccttctcctt

SEQ ID NO: 3567726 - DNA, 21 bp, Homo sapiens
ttctccttgaatatctttcga

SEQ ID NO: 3567727 - DNA, 17 bp, Homo sapiens
ttctcctttcacaacct

SEQ ID NO: 3567728 - DNA, 22 bp, Homo sapiens
ttctcctttcacaaccttctgt

SEQ ID NO: 3567729 - DNA, 14 bp, Homo sapiens
ttctcctttgtact

SEQ ID NO: 3567730 - DNA, 20 bp, Homo sapiens
ttctctaaggaattatttca

SEQ ID NO: 3567731 - DNA, 15 bp, Homo sapiens
ttctctaatgcttga

SEQ ID NO: 3567732 - DNA, 19 bp, Homo sapiens
ttctctaatgcttgattta

SEQ ID NO: 3567733 - DNA, 21 bp, Homo sapiens
ttctctcatcggaggcccatg

SEQ ID NO: 3567734 - DNA, 19 bp, Homo sapiens
ttctctccagctgactaaa

SEQ ID NO: 3567735 - DNA, 19 bp, Homo sapiens
ttctctctccagggtgctt

SEQ ID NO: 3567736 - DNA, 18 bp, Homo sapiens
ttctctctcctctctgct

SEQ ID NO: 3567737 - DNA, 19 bp, Homo sapiens
ttctctctcctctctgctt

SEQ ID NO: 3567738 - DNA, 11 bp, Homo sapiens
ttctctctttt

SEQ ID NO: 3567739 - DNA, 10 bp, Homo sapiens
ttctctgcag

SEQ ID NO: 3567740 - DNA, 12 bp, Homo sapiens
ttctctgcagta

SEQ ID NO: 3567741 - DNA, 21 bp, Homo sapiens
ttctctgcagtaaaacacatt

SEQ ID NO: 3567742 - DNA, 23 bp, Homo sapiens
ttctctgggtctgattttctcac

SEQ ID NO: 3567743 - DNA, 23 bp, Homo sapiens
ttctcttccccttcctgtttcag

SEQ ID NO: 3567744 - DNA, 21 bp, Homo sapiens
ttctcttctaacatgaaatat

SEQ ID NO: 3567745 - DNA, 21 bp, Homo sapiens
ttctcttgaaaagttcaggga

SEQ ID NO: 3567746 - DNA, 19 bp, Homo sapiens
ttctctttcttattttgta

SEQ ID NO: 3567747 - DNA, 20 bp, Homo sapiens
ttctctttcttattttgtaa

SEQ ID NO: 3567748 - DNA, 17 bp, Homo sapiens
ttctcttttctttctgt

SEQ ID NO: 3567749 - DNA, 16 bp, Homo sapiens
ttctgaaaaagacata

SEQ ID NO: 3567750 - DNA, 21 bp, Homo sapiens
ttctgaaaaagacataaaaca

SEQ ID NO: 3567751 - DNA, 23 bp, Homo sapiens
ttctgaaaaagacataaaacaga

SEQ ID NO: 3567752 - DNA, 22 bp, Homo sapiens
ttctgaaccctccaaaggaact

SEQ ID NO: 3567753 - DNA, 23 bp, Homo sapiens
ttctgaacttttgtggagtttga

SEQ ID NO: 3567754 - DNA, 21 bp, Homo sapiens
ttctgaagaggaaaagtcaaa

SEQ ID NO: 3567755 - DNA, 15 bp, Homo sapiens
ttctgaagtctgagc

SEQ ID NO: 3567756 - DNA, 20 bp, Homo sapiens
ttctgaagtctgagcccatt

SEQ ID NO: 3567757 - DNA, 23 bp, Homo sapiens
ttctgaagtctgagcccatttct

SEQ ID NO: 3567758 - DNA, 17 bp, Homo sapiens
ttctgaataaagcaatt

SEQ ID NO: 3567759 - DNA, 16 bp, Homo sapiens
ttctgaataacttgaa

SEQ ID NO: 3567760 - DNA, 17 bp, Homo sapiens
ttctgaataacttgaag

SEQ ID NO: 3567761 - DNA, 14 bp, Homo sapiens
ttctgagcctgcct

SEQ ID NO: 3567762 - DNA, 16 bp, Homo sapiens
ttctgaggccagaaag

SEQ ID NO: 3567763 - DNA, 22 bp, Homo sapiens
ttctgatatgcagttttcctta

SEQ ID NO: 3567764 - DNA, 16 bp, Homo sapiens
ttctgatgtactctaa

SEQ ID NO: 3567765 - DNA, 23 bp, Homo sapiens
ttctgatgtctccagattggcac

SEQ ID NO: 3567766 - DNA, 14 bp, Homo sapiens
ttctgattctgatt

SEQ ID NO: 3567767 - DNA, 18 bp, Homo sapiens
ttctgcaagcctcatgcc

SEQ ID NO: 3567768 - DNA, 22 bp, Homo sapiens
ttctgccaataaattctaaatt

SEQ ID NO: 3567769 - DNA, 12 bp, Homo sapiens
ttctgcctgcca

SEQ ID NO: 3567770 - DNA, 17 bp, Homo sapiens
ttctgcctgccagctgc

SEQ ID NO: 3567771 - DNA, 18 bp, Homo sapiens
ttctgcctgccagctgca

SEQ ID NO: 3567772 - DNA, 19 bp, Homo sapiens
ttctgcctgccagctgcac

SEQ ID NO: 3567773 - DNA, 21 bp, Homo sapiens
ttctgccttagcctaccatgt

SEQ ID NO: 3567774 - DNA, 14 bp, Homo sapiens
ttctgcgctgtgta

SEQ ID NO: 3567775 - DNA, 12 bp, Homo sapiens
ttctgctcctgc

SEQ ID NO: 3567776 - DNA, 17 bp, Homo sapiens
ttctgctcctgcttttc

SEQ ID NO: 3567777 - DNA, 17 bp, Homo sapiens
ttctgctctatactgtg

SEQ ID NO: 3567778 - DNA, 18 bp, Homo sapiens
ttctgctctatactgtgg

SEQ ID NO: 3567779 - DNA, 15 bp, Homo sapiens
ttctgctgaaagact

SEQ ID NO: 3567780 - DNA, 16 bp, Homo sapiens
ttctgctgaaagactc

SEQ ID NO: 3567781 - DNA, 17 bp, Homo sapiens
ttctggaatacatgaaa

SEQ ID NO: 3567782 - DNA, 17 bp, Homo sapiens
ttctggagatggaagct

SEQ ID NO: 3567783 - DNA, 14 bp, Homo sapiens
ttctggcctcccac

SEQ ID NO: 3567784 - DNA, 15 bp, Homo sapiens
ttctggcctcccaca

SEQ ID NO: 3567785 - DNA, 14 bp, Homo sapiens
ttctgggaagggag

SEQ ID NO: 3567786 - DNA, 16 bp, Homo sapiens
ttctggggctgtgtta

SEQ ID NO: 3567787 - DNA, 15 bp, Homo sapiens
ttctgggtccaggga

SEQ ID NO: 3567788 - DNA, 17 bp, Homo sapiens
ttctggttccctgctgc

SEQ ID NO: 3567789 - DNA, 23 bp, Homo sapiens
ttctggttctgtgtcctctgcct

SEQ ID NO: 3567790 - DNA, 16 bp, Homo sapiens
ttctgtcagtgttaaa

SEQ ID NO: 3567791 - DNA, 12 bp, Homo sapiens
ttctgtggctca

SEQ ID NO: 3567792 - DNA, 18 bp, Homo sapiens
ttctgtggtttcatgtta

SEQ ID NO: 3567793 - DNA, 15 bp, Homo sapiens
ttctgtttgattctt

SEQ ID NO: 3567794 - DNA, 13 bp, Homo sapiens
ttcttaacttctt

SEQ ID NO: 3567795 - DNA, 16 bp, Homo sapiens
ttcttaacttcttgct

SEQ ID NO: 3567796 - DNA, 13 bp, Homo sapiens
ttcttacaaacca

SEQ ID NO: 3567797 - DNA, 22 bp, Homo sapiens
ttcttaccctgtacatatgtaa

SEQ ID NO: 3567798 - DNA, 22 bp, Homo sapiens
ttcttacctactattggcccta

SEQ ID NO: 3567799 - DNA, 20 bp, Homo sapiens
ttcttactaaaaagtataaa

SEQ ID NO: 3567800 - DNA, 19 bp, Homo sapiens
ttcttagctgtaacttaac

SEQ ID NO: 3567801 - DNA, 18 bp, Homo sapiens
ttcttatgcaaaatggaa

SEQ ID NO: 3567802 - DNA, 16 bp, Homo sapiens
ttcttcaaatgtttaa

SEQ ID NO: 3567803 - DNA, 15 bp, Homo sapiens
ttcttcacaggcact

SEQ ID NO: 3567804 - DNA, 18 bp, Homo sapiens
ttcttcacatgtttaact

SEQ ID NO: 3567805 - DNA, 18 bp, Homo sapiens
ttcttcactctggcttca

SEQ ID NO: 3567806 - DNA, 22 bp, Homo sapiens
ttcttcactgtcctccaagcca

SEQ ID NO: 3567807 - DNA, 18 bp, Homo sapiens
ttcttcacttacaagaaa

SEQ ID NO: 3567808 - DNA, 17 bp, Homo sapiens
ttcttcacttcaagctg

SEQ ID NO: 3567809 - DNA, 20 bp, Homo sapiens
ttcttcagcgtaaaatggtg

SEQ ID NO: 3567810 - DNA, 15 bp, Homo sapiens
ttcttcagtcctttg

SEQ ID NO: 3567811 - DNA, 23 bp, Homo sapiens
ttcttccacccacaaactccagg

SEQ ID NO: 3567812 - DNA, 11 bp, Homo sapiens
ttcttcctgtg

SEQ ID NO: 3567813 - DNA, 16 bp, Homo sapiens
ttcttccttttcactg

SEQ ID NO: 3567814 - DNA, 20 bp, Homo sapiens
ttcttctattaatcaagaga

SEQ ID NO: 3567815 - DNA, 12 bp, Homo sapiens
ttcttctttctt

SEQ ID NO: 3567816 - DNA, 17 bp, Homo sapiens
ttcttctttttgcttca

SEQ ID NO: 3567817 - DNA, 22 bp, Homo sapiens
ttcttgcataggctcttaagca

SEQ ID NO: 3567818 - DNA, 17 bp, Homo sapiens
ttcttgcttctttctag

SEQ ID NO: 3567819 - DNA, 19 bp, Homo sapiens
ttcttgcttctttctagaa

SEQ ID NO: 3567820 - DNA, 18 bp, Homo sapiens
ttcttgggatagtgttct

SEQ ID NO: 3567821 - DNA, 20 bp, Homo sapiens
ttctttagcttacctgggca

SEQ ID NO: 3567822 - DNA, 16 bp, Homo sapiens
ttctttataaaccata

SEQ ID NO: 3567823 - DNA, 13 bp, Homo sapiens
ttctttattcaca

SEQ ID NO: 3567824 - DNA, 11 bp, Homo sapiens
ttctttcctcc

SEQ ID NO: 3567825 - DNA, 19 bp, Homo sapiens
ttctttcttccacccacaa

SEQ ID NO: 3567826 - DNA, 14 bp, Homo sapiens
ttctttgcaccaaa

SEQ ID NO: 3567827 - DNA, 20 bp, Homo sapiens
ttctttggttccatgttgac

SEQ ID NO: 3567828 - DNA, 15 bp, Homo sapiens
ttctttgtacctttt

SEQ ID NO: 3567829 - DNA, 15 bp, Homo sapiens
ttctttgtgcctttg

SEQ ID NO: 3567830 - DNA, 21 bp, Homo sapiens
ttcttttcacattaggctgtt

SEQ ID NO: 3567831 - DNA, 23 bp, Homo sapiens
tgtggcctttagcaaaactggac

SEQ ID NO: 3567832 - DNA, 16 bp, Homo sapiens
tgtggcctttatgttc

SEQ ID NO: 3567833 - DNA, 12 bp, Homo sapiens
tgtggctcctgg

SEQ ID NO: 3567834 - DNA, 17 bp, Homo sapiens
tgtggctgtgaggggtg

SEQ ID NO: 3567835 - DNA, 19 bp, Homo sapiens
tgtggctttcagcctctgg

SEQ ID NO: 3567836 - DNA, 12 bp, Homo sapiens
tgtgggcaaagt

SEQ ID NO: 3567837 - DNA, 23 bp, Homo sapiens
tgtgggcaagcagatgacagagg

SEQ ID NO: 3567838 - DNA, 21 bp, Homo sapiens
tgtgggggaggcgcacagtgt

SEQ ID NO: 3567839 - DNA, 22 bp, Homo sapiens
tgtggtaacttgagattcaaga

SEQ ID NO: 3567840 - DNA, 21 bp, Homo sapiens
tgtggtcaacatttctcatgt

SEQ ID NO: 3567841 - DNA, 23 bp, Homo sapiens
tgtggtcaacatttctcatgttg

SEQ ID NO: 3567842 - DNA, 21 bp, Homo sapiens
tgtggtcatgtgagtctggga

SEQ ID NO: 3567843 - DNA, 18 bp, Homo sapiens
tgtggtctctgccccagc

SEQ ID NO: 3567844 - DNA, 20 bp, Homo sapiens
tgtggtgaggggctttctct

SEQ ID NO: 3567845 - DNA, 23 bp, Homo sapiens
tgtggtgaggggctttctcttcc

SEQ ID NO: 3567846 - DNA, 22 bp, Homo sapiens
tgtggtttcatgttagttacct

SEQ ID NO: 3567847 - DNA, 17 bp, Homo sapiens
tgtgtaagaaatacaga

SEQ ID NO: 3567848 - DNA, 14 bp, Homo sapiens
tgtgtacaatgtga

SEQ ID NO: 3567849 - DNA, 23 bp, Homo sapiens
tgtgtaccacttcctgaggcctc

SEQ ID NO: 3567850 - DNA, 17 bp, Homo sapiens
tgtgtcagtttttcctc

SEQ ID NO: 3567851 - DNA, 13 bp, Homo sapiens
tgtgtcatttctt

SEQ ID NO: 3567852 - DNA, 17 bp, Homo sapiens
tgtgtcatttcttcact

SEQ ID NO: 3567853 - DNA, 15 bp, Homo sapiens
tgtgtccctggacac

SEQ ID NO: 3567854 - DNA, 15 bp, Homo sapiens
tgtgtcctccaccat

SEQ ID NO: 3567855 - DNA, 14 bp, Homo sapiens
tgtgtcctctgcct

SEQ ID NO: 3567856 - DNA, 15 bp, Homo sapiens
tgtgtctcccagaac

SEQ ID NO: 3567857 - DNA, 13 bp, Homo sapiens
tgtgtctggccct

SEQ ID NO: 3567858 - DNA, 15 bp, Homo sapiens
tgtgtgattgacagc

SEQ ID NO: 3567859 - DNA, 16 bp, Homo sapiens
tgtgtgccaagagcta

SEQ ID NO: 3567860 - DNA, 12 bp, Homo sapiens
tgtgtgctgttt

SEQ ID NO: 3567861 - DNA, 16 bp, Homo sapiens
tgtgtgctgtttgaaa

SEQ ID NO: 3567862 - DNA, 17 bp, Homo sapiens
tgtgtgtatatgtattt

SEQ ID NO: 3567863 - DNA, 14 bp, Homo sapiens
tgtgtgtgattttt

SEQ ID NO: 3567864 - DNA, 14 bp, Homo sapiens
tgtgtgtggcaggg

SEQ ID NO: 3567865 - DNA, 16 bp, Homo sapiens
tgtgtgtgtgtatgtg

SEQ ID NO: 3567866 - DNA, 22 bp, Homo sapiens
tgtgttcagaagaatcttcctg

SEQ ID NO: 3567867 - DNA, 23 bp, Homo sapiens
tgtgttcagaagaatcttcctgg

SEQ ID NO: 3567868 - DNA, 16 bp, Homo sapiens
tgtgttgcactgaaca

SEQ ID NO: 3567869 - DNA, 23 bp, Homo sapiens
tgtgttgtgtgtgggagtgtgta

SEQ ID NO: 3567870 - DNA, 20 bp, Homo sapiens
tgtgtttaactgctgcaggg

SEQ ID NO: 3567871 - DNA, 14 bp, Homo sapiens
tgtgtttgattggc

SEQ ID NO: 3567872 - DNA, 21 bp, Homo sapiens
tgtgtttgccactgtgtttcc

SEQ ID NO: 3567873 - DNA, 20 bp, Homo sapiens
tgtgttttcatcatttcagc

SEQ ID NO: 3567874 - DNA, 16 bp, Homo sapiens
tgtgtttttttctaaa

SEQ ID NO: 3567875 - DNA, 14 bp, Homo sapiens
tgttaaaacataaa

SEQ ID NO: 3567876 - DNA, 19 bp, Homo sapiens
tgttaaaacataaacacat

SEQ ID NO: 3567877 - DNA, 22 bp, Homo sapiens
tgttaaaagaaaacactgtcat

SEQ ID NO: 3567878 - DNA, 22 bp, Homo sapiens
tgttaactatgacagatatatt

SEQ ID NO: 3567879 - DNA, 19 bp, Homo sapiens
tgttaactgttaactatga

SEQ ID NO: 3567880 - DNA, 17 bp, Homo sapiens
tgttaatatttctaaaa

SEQ ID NO: 3567881 - DNA, 20 bp, Homo sapiens
tgttaatatttctaaaagtt

SEQ ID NO: 3567882 - DNA, 14 bp, Homo sapiens
tgttaatatttctt

SEQ ID NO: 3567883 - DNA, 13 bp, Homo sapiens
tgttaatatttta

SEQ ID NO: 3567884 - DNA, 17 bp, Homo sapiens
tgttaatattttatgtg

SEQ ID NO: 3567885 - DNA, 19 bp, Homo sapiens
tgttaatattttatgtgta

SEQ ID NO: 3567886 - DNA, 18 bp, Homo sapiens
tgttaatttataatgtat

SEQ ID NO: 3567887 - DNA, 19 bp, Homo sapiens
tgttaatttataatgtatt

SEQ ID NO: 3567888 - DNA, 22 bp, Homo sapiens
tgttaatttataatgtatttga

SEQ ID NO: 3567889 - DNA, 15 bp, Homo sapiens
tgttaattttgctaa

SEQ ID NO: 3567890 - DNA, 18 bp, Homo sapiens
tgttaattttgctaactg

SEQ ID NO: 3567891 - DNA, 19 bp, Homo sapiens
tgttaattttgctaactgg

SEQ ID NO: 3567892 - DNA, 23 bp, Homo sapiens
tgttaattttgctaactgggtta

SEQ ID NO: 3567893 - DNA, 16 bp, Homo sapiens
tgtaccaaatctgaca

SEQ ID NO: 3567894 - DNA, 17 bp, Homo sapiens
tgtaccaaatctgacat

SEQ ID NO: 3567895 - DNA, 20 bp, Homo sapiens
tgtaccaaatctgacatatt

SEQ ID NO: 3567896 - DNA, 21 bp, Homo sapiens
tgtaccaaatctgacatatta

SEQ ID NO: 3567897 - DNA, 17 bp, Homo sapiens
tgtaccacctaatgttt

SEQ ID NO: 3567898 - DNA, 12 bp, Homo sapiens
tgtaccagttaa

SEQ ID NO: 3567899 - DNA, 14 bp, Homo sapiens
tgtaccagttaatt

SEQ ID NO: 3567900 - DNA, 21 bp, Homo sapiens
tgtaccagttaatttttccaa

SEQ ID NO: 3567901 - DNA, 17 bp, Homo sapiens
tgtactaacccagtctt

SEQ ID NO: 3567902 - DNA, 13 bp, Homo sapiens
tgtactcctccca

SEQ ID NO: 3567903 - DNA, 20 bp, Homo sapiens
tgtactgaaaaatggtaatt

SEQ ID NO: 3567904 - DNA, 19 bp, Homo sapiens
tgtactgcatatgaaagga

SEQ ID NO: 3567905 - DNA, 12 bp, Homo sapiens
tgtactgggaca

SEQ ID NO: 3567906 - DNA, 19 bp, Homo sapiens
tgtactgtatggaaacact

SEQ ID NO: 3567907 - DNA, 24 bp, Homo sapiens
tgtactgtatggaaacactgattt

SEQ ID NO: 3567908 - DNA, 15 bp, Homo sapiens
tgtacttgctccttt

SEQ ID NO: 3567909 - DNA, 11 bp, Homo sapiens
tgtactttgtg

SEQ ID NO: 3567910 - DNA, 13 bp, Homo sapiens
tgtactttgtgct

SEQ ID NO: 3567911 - DNA, 14 bp, Homo sapiens
tgtagaaactgagg

SEQ ID NO: 3567912 - DNA, 14 bp, Homo sapiens
tgtagattcatgca

SEQ ID NO: 3567913 - DNA, 12 bp, Homo sapiens
tgtagcagaaac

SEQ ID NO: 3567914 - DNA, 22 bp, Homo sapiens
tgtagcaggggaattccctccc

SEQ ID NO: 3567915 - DNA, 15 bp, Homo sapiens
tgtagccagctgtgc

SEQ ID NO: 3567916 - DNA, 17 bp, Homo sapiens
tgtagcctaaagggcag

SEQ ID NO: 3567917 - DNA, 18 bp, Homo sapiens
tgtagcctaaagggcagg

SEQ ID NO: 3567918 - DNA, 13 bp, Homo sapiens
tgtagctttgctc

SEQ ID NO: 3567919 - DNA, 22 bp, Homo sapiens
tgtagggttttttcttctttct

SEQ ID NO: 3567920 - DNA, 13 bp, Homo sapiens
tgtaggtgttatg

SEQ ID NO: 3567921 - DNA, 16 bp, Homo sapiens
tgtagtagcgtttttt

SEQ ID NO: 3567922 - DNA, 22 bp, Homo sapiens
tgtagtccgtgctgacagctgc

SEQ ID NO: 3567923 - DNA, 13 bp, Homo sapiens
tgtagttataaac

SEQ ID NO: 3567924 - DNA, 15 bp, Homo sapiens
tgtataaagaaactg

SEQ ID NO: 3567925 - DNA, 15 bp, Homo sapiens
tgtataaatgtacat

SEQ ID NO: 3567926 - DNA, 18 bp, Homo sapiens
tgtataaatgtacatttc

SEQ ID NO: 3567927 - DNA, 14 bp, Homo sapiens
tgtatactatagta

SEQ ID NO: 3567928 - DNA, 17 bp, Homo sapiens
tgtatactatagtacca

SEQ ID NO: 3567929 - DNA, 13 bp, Homo sapiens
tgtatagcatgaa

SEQ ID NO: 3567930 - DNA, 14 bp, Homo sapiens
tgtatagtatctgt

SEQ ID NO: 3567931 - DNA, 17 bp, Homo sapiens
tgtatataagttgctgt

SEQ ID NO: 3567932 - DNA, 13 bp, Homo sapiens
tgtatatgtattt

SEQ ID NO: 3567933 - DNA, 19 bp, Homo sapiens
tgtatatttttatattgtt

SEQ ID NO: 3567934 - DNA, 15 bp, Homo sapiens
tgtatcacaaatctt

SEQ ID NO: 3567935 - DNA, 15 bp, Homo sapiens
tgtatcagtgtcctt

SEQ ID NO: 3567936 - DNA, 16 bp, Homo sapiens
tgtatcagtgtccttt

SEQ ID NO: 3567937 - DNA, 15 bp, Homo sapiens
tgtatcatagaaatg

SEQ ID NO: 3567938 - DNA, 16 bp, Homo sapiens
tgtatcatagaaatgt

SEQ ID NO: 3567939 - DNA, 14 bp, Homo sapiens
tgtatccattctac

SEQ ID NO: 3567940 - DNA, 19 bp, Homo sapiens
tgtatcctggccctggggg

SEQ ID NO: 3567941 - DNA, 19 bp, Homo sapiens
tgtatctgtgcttctaata

SEQ ID NO: 3567942 - DNA, 22 bp, Homo sapiens
tgtatctgtgcttctaatatta

SEQ ID NO: 3567943 - DNA, 22 bp, Homo sapiens
tgtatgattactggcctttttc

SEQ ID NO: 3567944 - DNA, 15 bp, Homo sapiens
tgtatggaaacactg

SEQ ID NO: 3567945 - DNA, 21 bp, Homo sapiens
tgtatggtatctttagatatt

SEQ ID NO: 3567946 - DNA, 12 bp, Homo sapiens
tgtatgtcatgg

SEQ ID NO: 3567947 - DNA, 22 bp, Homo sapiens
tgtatgtgggggtctgtgtgtt

SEQ ID NO: 3567948 - DNA, 16 bp, Homo sapiens
tgtattattgttctca

SEQ ID NO: 3567949 - DNA, 21 bp, Homo sapiens
tgtattggtgttgcagccgca

SEQ ID NO: 3567950 - DNA, 16 bp, Homo sapiens
tgtattgtatattaca

SEQ ID NO: 3567951 - DNA, 18 bp, Homo sapiens
tgtattgtatattacaat

SEQ ID NO: 3567952 - DNA, 19 bp, Homo sapiens
tgtatttaaaaaaaagaaa

SEQ ID NO: 3567953 - DNA, 21 bp, Homo sapiens
tgtatttaaaaaaaagaaact

SEQ ID NO: 3567954 - DNA, 13 bp, Homo sapiens
tgtatttaagaca

SEQ ID NO: 3567955 - DNA, 20 bp, Homo sapiens
tgtatttaagacataaacaa

SEQ ID NO: 3567956 - DNA, 18 bp, Homo sapiens
tgtatttaagatgtacat

SEQ ID NO: 3567957 - DNA, 21 bp, Homo sapiens
tgtatttaagatgtacattta

SEQ ID NO: 3567958 - DNA, 23 bp, Homo sapiens
tgtatttaagatgtacatttaat

SEQ ID NO: 3567959 - DNA, 13 bp, Homo sapiens
tgtatttattaat

SEQ ID NO: 3567960 - DNA, 22 bp, Homo sapiens
tgtatttattaatttgaaacca

SEQ ID NO: 3567961 - DNA, 18 bp, Homo sapiens
tgtatttctatacagtag

SEQ ID NO: 3567962 - DNA, 14 bp, Homo sapiens
tgtatttgaaaatt

SEQ ID NO: 3567963 - DNA, 22 bp, Homo sapiens
tgtatttgaaaattacatgttt

SEQ ID NO: 3567964 - DNA, 15 bp, Homo sapiens
tgtattttgatgaga

SEQ ID NO: 3567965 - DNA, 19 bp, Homo sapiens
tgtcaaatatttagatgta

SEQ ID NO: 3567966 - DNA, 17 bp, Homo sapiens
tgtcaacttttaacttt

SEQ ID NO: 3567967 - DNA, 18 bp, Homo sapiens
tgtcaagccatttttaca

SEQ ID NO: 3567968 - DNA, 23 bp, Homo sapiens
tgtcaagccatttttacatctaa

SEQ ID NO: 3567969 - DNA, 19 bp, Homo sapiens
tgtcaagctgaccttgctg

SEQ ID NO: 3567970 - DNA, 17 bp, Homo sapiens
tgtcacagggactgaaa

SEQ ID NO: 3567971 - DNA, 16 bp, Homo sapiens
tgtcacaggttttcag

SEQ ID NO: 3567972 - DNA, 14 bp, Homo sapiens
tgtcaccagttaaa

SEQ ID NO: 3567973 - DNA, 22 bp, Homo sapiens
ttcttttgcaggagtttgtggt

SEQ ID NO: 3567974 - DNA, 23 bp, Homo sapiens
ttcttttgcaggagtttgtggta

SEQ ID NO: 3567975 - DNA, 17 bp, Homo sapiens
ttctttttggtttgcct

SEQ ID NO: 3567976 - DNA, 20 bp, Homo sapiens
ttgaaaaaaacttcattctc

SEQ ID NO: 3567977 - DNA, 21 bp, Homo sapiens
ttgaaaaactctttattttcc

SEQ ID NO: 3567978 - DNA, 13 bp, Homo sapiens
ttgaaaaatactg

SEQ ID NO: 3567979 - DNA, 17 bp, Homo sapiens
ttgaaaaccatatttta

SEQ ID NO: 3567980 - DNA, 16 bp, Homo sapiens
ttgaaaagactccaaa

SEQ ID NO: 3567981 - DNA, 17 bp, Homo sapiens
ttgaaaagcagacattt

SEQ ID NO: 3567982 - DNA, 17 bp, Homo sapiens
ttgaaaattacatgttt

SEQ ID NO: 3567983 - DNA, 15 bp, Homo sapiens
ttgaaaccaggacat

SEQ ID NO: 3567984 - DNA, 16 bp, Homo sapiens
ttgaaaccaggacatt

SEQ ID NO: 3567985 - DNA, 17 bp, Homo sapiens
ttgaaagaatgtaaagc

SEQ ID NO: 3567986 - DNA, 21 bp, Homo sapiens
ttgaaatgaggtctgtttaaa

SEQ ID NO: 3567987 - DNA, 15 bp, Homo sapiens
ttgaaatggaaatta

SEQ ID NO: 3567988 - DNA, 20 bp, Homo sapiens
ttgaaattatgtgacatttt

SEQ ID NO: 3567989 - DNA, 18 bp, Homo sapiens
ttgaaattgattaactta

SEQ ID NO: 3567990 - DNA, 16 bp, Homo sapiens
ttgaaccatccactta

SEQ ID NO: 3567991 - DNA, 17 bp, Homo sapiens
ttgaagaaacagagtgg

SEQ ID NO: 3567992 - DNA, 23 bp, Homo sapiens
ttgaagattctatgttaatattt

SEQ ID NO: 3567993 - DNA, 14 bp, Homo sapiens
ttgaaggagaatgg

SEQ ID NO: 3567994 - DNA, 22 bp, Homo sapiens
ttgaaggagaatggcatggcag

SEQ ID NO: 3567995 - DNA, 20 bp, Homo sapiens
ttgaagggccagagccaggg

SEQ ID NO: 3567996 - DNA, 16 bp, Homo sapiens
ttgaaggtagaatgtt

SEQ ID NO: 3567997 - DNA, 14 bp, Homo sapiens
ttgaagtgcagctc

SEQ ID NO: 3567998 - DNA, 13 bp, Homo sapiens
ttgaagttctaac

SEQ ID NO: 3567999 - DNA, 15 bp, Homo sapiens
ttgaataaagtattc

SEQ ID NO: 3568000 - DNA, 17 bp, Homo sapiens
ttgaataaagtattcta

SEQ ID NO: 3568001 - DNA, 13 bp, Homo sapiens
ttgaataaatgtc

SEQ ID NO: 3568002 - DNA, 16 bp, Homo sapiens
ttgaatacaggtaact

SEQ ID NO: 3568003 - DNA, 16 bp, Homo sapiens
ttgaatacatttgtat

SEQ ID NO: 3568004 - DNA, 18 bp, Homo sapiens
ttgaatacatttgtattt

SEQ ID NO: 3568005 - DNA, 24 bp, Homo sapiens
ttgaatttatttttaagaaagaaa

SEQ ID NO: 3568006 - DNA, 22 bp, Homo sapiens
ttgacacaggtctttcctaagg

SEQ ID NO: 3568007 - DNA, 15 bp, Homo sapiens
ttgacaccttagaga

SEQ ID NO: 3568008 - DNA, 15 bp, Homo sapiens
ttgacactgctctaa

SEQ ID NO: 3568009 - DNA, 18 bp, Homo sapiens
ttgacagctttgctgctg

SEQ ID NO: 3568010 - DNA, 17 bp, Homo sapiens
ttgacctttatttatta

SEQ ID NO: 3568011 - DNA, 19 bp, Homo sapiens
ttgactgatgattttcctt

SEQ ID NO: 3568012 - DNA, 19 bp, Homo sapiens
ttgacttgaaaagaaagaa

SEQ ID NO: 3568013 - DNA, 14 bp, Homo sapiens
ttgactttccagaa

SEQ ID NO: 3568014 - DNA, 19 bp, Homo sapiens
ttgagaaccagtctcctca

SEQ ID NO: 3568015 - DNA, 23 bp, Homo sapiens
ttgagaaccagtctcctcactct

SEQ ID NO: 3568016 - DNA, 21 bp, Homo sapiens
ttgagactcctcagcacccct

SEQ ID NO: 3568017 - DNA, 21 bp, Homo sapiens
ttgagatggagtttctctctt

SEQ ID NO: 3568018 - DNA, 23 bp, Homo sapiens
ttgagatggagtttctctcttgt

SEQ ID NO: 3568019 - DNA, 21 bp, Homo sapiens
ttgagattcaagacaagagct

SEQ ID NO: 3568020 - DNA, 18 bp, Homo sapiens
ttgagcaaataaacttac

SEQ ID NO: 3568021 - DNA, 17 bp, Homo sapiens
ttgagcatttttaaggg

SEQ ID NO: 3568022 - DNA, 15 bp, Homo sapiens
ttgaggaaatattaa

SEQ ID NO: 3568023 - DNA, 16 bp, Homo sapiens
ttgaggaaatattaat

SEQ ID NO: 3568024 - DNA, 16 bp, Homo sapiens
ttgaggcaaaagaagg

SEQ ID NO: 3568025 - DNA, 17 bp, Homo sapiens
ttgaggcttctccttct

SEQ ID NO: 3568026 - DNA, 19 bp, Homo sapiens
ttgaggggccctggccagg

SEQ ID NO: 3568027 - DNA, 21 bp, Homo sapiens
ttgaggtaccagttgtattta

SEQ ID NO: 3568028 - DNA, 14 bp, Homo sapiens
ttgaggtgcaagga

SEQ ID NO: 3568029 - DNA, 22 bp, Homo sapiens
ttgaggtttttaaatatatatt

SEQ ID NO: 3568030 - DNA, 17 bp, Homo sapiens
ttgagtataagaaatgc

SEQ ID NO: 3568031 - DNA, 21 bp, Homo sapiens
ttgagtgctgtctccatgttt

SEQ ID NO: 3568032 - DNA, 14 bp, Homo sapiens
ttgagtgtcaagct

SEQ ID NO: 3568033 - DNA, 17 bp, Homo sapiens
ttgagttaacaggacag

SEQ ID NO: 3568034 - DNA, 13 bp, Homo sapiens
ttgagttacatta

SEQ ID NO: 3568035 - DNA, 21 bp, Homo sapiens
ttgagttacattaaaataaac

SEQ ID NO: 3568036 - DNA, 17 bp, Homo sapiens
ttgagttggaacaacat

SEQ ID NO: 3568037 - DNA, 16 bp, Homo sapiens
ttgataattttccttt

SEQ ID NO: 3568038 - DNA, 15 bp, Homo sapiens
ttgatactaccaggg

SEQ ID NO: 3568039 - DNA, 18 bp, Homo sapiens
ttgatactaccagggtct

SEQ ID NO: 3568040 - DNA, 15 bp, Homo sapiens
ttgatactctttcta

SEQ ID NO: 3568041 - DNA, 16 bp, Homo sapiens
ttgatagtaaatgtcc

SEQ ID NO: 3568042 - DNA, 18 bp, Homo sapiens
ttgatagtgatgtatttt

SEQ ID NO: 3568043 - DNA, 19 bp, Homo sapiens
ttgatagtgatgtatttta

SEQ ID NO: 3568044 - DNA, 21 bp, Homo sapiens
ttgatcgcctctttgacattt

SEQ ID NO: 3568045 - DNA, 17 bp, Homo sapiens
ttgatctctcttgtcct

SEQ ID NO: 3568046 - DNA, 21 bp, Homo sapiens
ttgatggaaaataaacatcag

SEQ ID NO: 3568047 - DNA, 12 bp, Homo sapiens
ttgatggagccc

SEQ ID NO: 3568048 - DNA, 23 bp, Homo sapiens
ttgatgtacataactcctgtccc

SEQ ID NO: 3568049 - DNA, 14 bp, Homo sapiens
ttgatgttttcaca

SEQ ID NO: 3568050 - DNA, 16 bp, Homo sapiens
ttgattagagaccaga

SEQ ID NO: 3568051 - DNA, 15 bp, Homo sapiens
ttgatttttaagaaa

SEQ ID NO: 3568052 - DNA, 13 bp, Homo sapiens
ttgcaaagtgtat

SEQ ID NO: 3568053 - DNA, 19 bp, Homo sapiens
ttgcacaccattttgtaaa

SEQ ID NO: 3568054 - DNA, 21 bp, Homo sapiens
ttgcactaaaatgaggatcca

SEQ ID NO: 3568055 - DNA, 22 bp, Homo sapiens
ttgcactaaaatgaggatccag

SEQ ID NO: 3568056 - DNA, 20 bp, Homo sapiens
ttgcactctagcctggcaac

SEQ ID NO: 3568057 - DNA, 11 bp, Homo sapiens
ttgcactgaag

SEQ ID NO: 3568058 - DNA, 15 bp, Homo sapiens
ttgcactgaagtttt

SEQ ID NO: 3568059 - DNA, 19 bp, Homo sapiens
ttgcacttgttatattata

SEQ ID NO: 3568060 - DNA, 19 bp, Homo sapiens
ttgcagccgcagagaaatg

SEQ ID NO: 3568061 - DNA, 19 bp, Homo sapiens
ttgcagcctaagaagaagg

SEQ ID NO: 3568062 - DNA, 11 bp, Homo sapiens
ttgcaggaagg

SEQ ID NO: 3568063 - DNA, 17 bp, Homo sapiens
ttgcaggaagggaagag

SEQ ID NO: 3568064 - DNA, 9 bp, Homo sapiens
ttgcaggag

SEQ ID NO: 3568065 - DNA, 15 bp, Homo sapiens
ttgcagtttacagta

SEQ ID NO: 3568066 - DNA, 21 bp, Homo sapiens
ttgcagtttacagtatttcta

SEQ ID NO: 3568067 - DNA, 15 bp, Homo sapiens
ttgcatattttgaga

SEQ ID NO: 3568068 - DNA, 18 bp, Homo sapiens
ttgcatattttgagaaac

SEQ ID NO: 3568069 - DNA, 17 bp, Homo sapiens
ttgcattgaggaaatat

SEQ ID NO: 3568070 - DNA, 21 bp, Homo sapiens
ttgcatttggattggggtccc

SEQ ID NO: 3568071 - DNA, 18 bp, Homo sapiens
ttgccaaaacccagctgc

SEQ ID NO: 3568072 - DNA, 15 bp, Homo sapiens
ttgccaaaataccac

SEQ ID NO: 3568073 - DNA, 12 bp, Homo sapiens
ttgccaataaag

SEQ ID NO: 3568074 - DNA, 18 bp, Homo sapiens
ttgccaatctaaaatggc

SEQ ID NO: 3568075 - DNA, 12 bp, Homo sapiens
ttgccacattta

SEQ ID NO: 3568076 - DNA, 14 bp, Homo sapiens
ttgccactgcctct

SEQ ID NO: 3568077 - DNA, 15 bp, Homo sapiens
ttgccactgtgtttc

SEQ ID NO: 3568078 - DNA, 20 bp, Homo sapiens
ttgccagaggaccaatgctt

SEQ ID NO: 3568079 - DNA, 16 bp, Homo sapiens
ttgccagttttccctg

SEQ ID NO: 3568080 - DNA, 18 bp, Homo sapiens
ttgccatatggaggactg

SEQ ID NO: 3568081 - DNA, 18 bp, Homo sapiens
ttgccatttgtagctttg

SEQ ID NO: 3568082 - DNA, 14 bp, Homo sapiens
ttgcccacccctca

SEQ ID NO: 3568083 - DNA, 21 bp, Homo sapiens
ttgcccacccctcactcccca

SEQ ID NO: 3568084 - DNA, 16 bp, Homo sapiens
ttgccccacctccccc

SEQ ID NO: 3568085 - DNA, 21 bp, Homo sapiens
ttgccccatccagacctggct

SEQ ID NO: 3568086 - DNA, 22 bp, Homo sapiens
ttgccccatccagacctggctc

SEQ ID NO: 3568087 - DNA, 19 bp, Homo sapiens
ttgcccccattcccagcct

SEQ ID NO: 3568088 - DNA, 16 bp, Homo sapiens
ttgccccctctcactt

SEQ ID NO: 3568089 - DNA, 13 bp, Homo sapiens
ttgcccgctccca

SEQ ID NO: 3568090 - DNA, 23 bp, Homo sapiens
ttgcccgctcccacagcttcctg

SEQ ID NO: 3568091 - DNA, 19 bp, Homo sapiens
ttgcctaagaataaacatt

SEQ ID NO: 3568092 - DNA, 23 bp, Homo sapiens
ttgcctaagaataaacatttgtt

SEQ ID NO: 3568093 - DNA, 12 bp, Homo sapiens
ttgcctcttctt

SEQ ID NO: 3568094 - DNA, 13 bp, Homo sapiens
ttgcctgaagctt

SEQ ID NO: 3568095 - DNA, 23 bp, Homo sapiens
ttgcctgggggcttttgccactc

SEQ ID NO: 3568096 - DNA, 18 bp, Homo sapiens
ttgcctttatctctgagg

SEQ ID NO: 3568097 - DNA, 16 bp, Homo sapiens
ttgccttttatgtaaa

SEQ ID NO: 3568098 - DNA, 18 bp, Homo sapiens
ttgccttttatgtaaatt

SEQ ID NO: 3568099 - DNA, 21 bp, Homo sapiens
ttgcgaatattttgtaaatta

SEQ ID NO: 3568100 - DNA, 12 bp, Homo sapiens
ttgctaactggg

SEQ ID NO: 3568101 - DNA, 21 bp, Homo sapiens
ttgctaactgggttaaatatt

SEQ ID NO: 3568102 - DNA, 22 bp, Homo sapiens
ttgctatagtgacatgcagtta

SEQ ID NO: 3568103 - DNA, 20 bp, Homo sapiens
ttgctatgagctggggatgt

SEQ ID NO: 3568104 - DNA, 16 bp, Homo sapiens
ttgctcaaaattgctt

SEQ ID NO: 3568105 - DNA, 17 bp, Homo sapiens
ttgctcaaaattgcttc

SEQ ID NO: 3568106 - DNA, 18 bp, Homo sapiens
ttgctccttttgctcttt

SEQ ID NO: 3568107 - DNA, 14 bp, Homo sapiens
ttgctctacagata

SEQ ID NO: 3568108 - DNA, 16 bp, Homo sapiens
ttgctctcctcatctc

SEQ ID NO: 3568109 - DNA, 13 bp, Homo sapiens
ttgctctctgtga

SEQ ID NO: 3568110 - DNA, 18 bp, Homo sapiens
ttgctgaagatgccttga

SEQ ID NO: 3568111 - DNA, 17 bp, Homo sapiens
ttgctgagctgtttata

SEQ ID NO: 3568112 - DNA, 24 bp, Homo sapiens
ttgctgagctgtttatagagaatg

SEQ ID NO: 3568113 - DNA, 14 bp, Homo sapiens
ttgctgattgtcaa

SEQ ID NO: 3568114 - DNA, 20 bp, Homo sapiens
ttgctgcaagcacagccctt

SEQ ID NO: 3568115 - DNA, 11 bp, Homo sapiens
ttgctgggctt

SEQ ID NO: 3568116 - DNA, 16 bp, Homo sapiens
ttgctgggctttggga

SEQ ID NO: 3568117 - DNA, 14 bp, Homo sapiens
ttgctggtcctgca

SEQ ID NO: 3568118 - DNA, 15 bp, Homo sapiens
ttgctggtcctgcac

SEQ ID NO: 3568119 - DNA, 17 bp, Homo sapiens
ttgctgtacaaaagcaa

SEQ ID NO: 3568120 - DNA, 17 bp, Homo sapiens
ttgctgtgctttggaac

SEQ ID NO: 3568121 - DNA, 13 bp, Homo sapiens
ttgctgttaactg

SEQ ID NO: 3568122 - DNA, 14 bp, Homo sapiens
ttgctgttttcctc

SEQ ID NO: 3568123 - DNA, 20 bp, Homo sapiens
ttgctgttttcctcccttct

SEQ ID NO: 3568124 - DNA, 13 bp, Homo sapiens
ttgctgttttgat

SEQ ID NO: 3568125 - DNA, 17 bp, Homo sapiens
ttgcttccccttttgcc

SEQ ID NO: 3568126 - DNA, 20 bp, Homo sapiens
ttgcttccccttttgccaat

SEQ ID NO: 3568127 - DNA, 20 bp, Homo sapiens
ttgcttctaaaacaataaag

SEQ ID NO: 3568128 - DNA, 23 bp, Homo sapiens
ttgcttgcaatctaatctgaact

SEQ ID NO: 3568129 - DNA, 15 bp, Homo sapiens
ttgctttaaaacaaa

SEQ ID NO: 3568130 - DNA, 23 bp, Homo sapiens
ttgctttaatgagtgcacctgcc

SEQ ID NO: 3568131 - DNA, 10 bp, Homo sapiens
ttgctttcct

SEQ ID NO: 3568132 - DNA, 16 bp, Homo sapiens
ttgctttcctgggcct

SEQ ID NO: 3568133 - DNA, 19 bp, Homo sapiens
ttgctttgagactcctcag

SEQ ID NO: 3568134 - DNA, 11 bp, Homo sapiens
ttgctttgagc

SEQ ID NO: 3568135 - DNA, 17 bp, Homo sapiens
ttggaaaataaattatt

SEQ ID NO: 3568136 - DNA, 16 bp, Homo sapiens
ttggaaatcaaatgta

SEQ ID NO: 3568137 - DNA, 18 bp, Homo sapiens
ttggaaatcaaatgtaaa

SEQ ID NO: 3568138 - DNA, 19 bp, Homo sapiens
ttggaaatcaaatgtaaag

SEQ ID NO: 3568139 - DNA, 16 bp, Homo sapiens
ttggaaatgtgttttt

SEQ ID NO: 3568140 - DNA, 14 bp, Homo sapiens
ttggaaggagaggg

SEQ ID NO: 3568141 - DNA, 12 bp, Homo sapiens
ttggacagctga

SEQ ID NO: 3568142 - DNA, 16 bp, Homo sapiens
ttggacagctgataaa

SEQ ID NO: 3568143 - DNA, 12 bp, Homo sapiens
ttggacagtggc

SEQ ID NO: 3568144 - DNA, 22 bp, Homo sapiens
ttggacgggatgacctccagaa

SEQ ID NO: 3568145 - DNA, 22 bp, Homo sapiens
ttggagaaccagggctcttctc

SEQ ID NO: 3568146 - DNA, 17 bp, Homo sapiens
ttggagaaggtctgtgg

SEQ ID NO: 3568147 - DNA, 15 bp, Homo sapiens
ttggagcagcaggcc

SEQ ID NO: 3568148 - DNA, 16 bp, Homo sapiens
ttggagcagcaggcct

SEQ ID NO: 3568149 - DNA, 23 bp, Homo sapiens
ttggagtgctcttcccactccag

SEQ ID NO: 3568150 - DNA, 15 bp, Homo sapiens
ttggatacagctgct

SEQ ID NO: 3568151 - DNA, 16 bp, Homo sapiens
ttggatgttgctatag

SEQ ID NO: 3568152 - DNA, 21 bp, Homo sapiens
ttggatttcctaatactgtca

SEQ ID NO: 3568153 - DNA, 16 bp, Homo sapiens
ttggcacatgccacct

SEQ ID NO: 3568154 - DNA, 23 bp, Homo sapiens
ttggcaccagacacccaggactt

SEQ ID NO: 3568155 - DNA, 18 bp, Homo sapiens
ttggcacccccatgctgc

SEQ ID NO: 3568156 - DNA, 23 bp, Homo sapiens
ttggcaccttccccctcccccag

SEQ ID NO: 3568157 - DNA, 18 bp, Homo sapiens
ttggcacttattgaatat

SEQ ID NO: 3568158 - DNA, 15 bp, Homo sapiens
ttggcagccatgata

SEQ ID NO: 3568159 - DNA, 17 bp, Homo sapiens
ttggcagccatgataat

SEQ ID NO: 3568160 - DNA, 14 bp, Homo sapiens
ttggcaggcccact

SEQ ID NO: 3568161 - DNA, 19 bp, Homo sapiens
ttggcaggcccactcccca

SEQ ID NO: 3568162 - DNA, 16 bp, Homo sapiens
ttggcatagctctggg

SEQ ID NO: 3568163 - DNA, 14 bp, Homo sapiens
ttggcattgctgca

SEQ ID NO: 3568164 - DNA, 13 bp, Homo sapiens
ttggccatgcaga

SEQ ID NO: 3568165 - DNA, 18 bp, Homo sapiens
ttggcccccttcaggagc

SEQ ID NO: 3568166 - DNA, 19 bp, Homo sapiens
ttggcccccttcaggagcc

SEQ ID NO: 3568167 - DNA, 14 bp, Homo sapiens
ttggccctcctcag

SEQ ID NO: 3568168 - DNA, 20 bp, Homo sapiens
ttggccctcctcagctccct

SEQ ID NO: 3568169 - DNA, 18 bp, Homo sapiens
ttggcctggggtgcatct

SEQ ID NO: 3568170 - DNA, 21 bp, Homo sapiens
ttggcctggggtgcatctcct

SEQ ID NO: 3568171 - DNA, 21 bp, Homo sapiens
ttggctgacccctctggtgtg

SEQ ID NO: 3568172 - DNA, 22 bp, Homo sapiens
ttggctgcaggtgttctgctga

SEQ ID NO: 3568173 - DNA, 17 bp, Homo sapiens
ttggctggttaatggga

SEQ ID NO: 3568174 - DNA, 14 bp, Homo sapiens
ttggctttgcccac

SEQ ID NO: 3568175 - DNA, 20 bp, Homo sapiens
ttgggaagtttgctgtgctt

SEQ ID NO: 3568176 - DNA, 18 bp, Homo sapiens
ttgggaatggatcctgga

SEQ ID NO: 3568177 - DNA, 17 bp, Homo sapiens
ttgggacagccattttc

SEQ ID NO: 3568178 - DNA, 14 bp, Homo sapiens
ttgggagacatgtg

SEQ ID NO: 3568179 - DNA, 12 bp, Homo sapiens
ttgggagccagg

SEQ ID NO: 3568180 - DNA, 14 bp, Homo sapiens
ttgggagccaggac

SEQ ID NO: 3568181 - DNA, 15 bp, Homo sapiens
ttgggagccaggact

SEQ ID NO: 3568182 - DNA, 16 bp, Homo sapiens
ttgggagccaggactc

SEQ ID NO: 3568183 - DNA, 20 bp, Homo sapiens
ttgggagccaggactcccag

SEQ ID NO: 3568184 - DNA, 21 bp, Homo sapiens
ttgggatccaggcccctccct

SEQ ID NO: 3568185 - DNA, 18 bp, Homo sapiens
ttgggcagcaatttaaat

SEQ ID NO: 3568186 - DNA, 13 bp, Homo sapiens
ttgggccagacat

SEQ ID NO: 3568187 - DNA, 23 bp, Homo sapiens
ttgggcctcaggctctgcacaga

SEQ ID NO: 3568188 - DNA, 16 bp, Homo sapiens
ttgggcctgctccaga

SEQ ID NO: 3568189 - DNA, 19 bp, Homo sapiens
ttgggcctgctccagacct

SEQ ID NO: 3568190 - DNA, 22 bp, Homo sapiens
ttgggcttcaacagccaagctg

SEQ ID NO: 3568191 - DNA, 17 bp, Homo sapiens
ttgggcttgtgatttcc

SEQ ID NO: 3568192 - DNA, 18 bp, Homo sapiens
ttgggtcacatgactctc

SEQ ID NO: 3568193 - DNA, 18 bp, Homo sapiens
ttgggtgtttttcatgtt

SEQ ID NO: 3568194 - DNA, 12 bp, Homo sapiens
ttggtaactttt

SEQ ID NO: 3568195 - DNA, 13 bp, Homo sapiens
ttggtactgtaat

SEQ ID NO: 3568196 - DNA, 21 bp, Homo sapiens
ttggtagagaaggagcagaaa

SEQ ID NO: 3568197 - DNA, 18 bp, Homo sapiens
ttggtatagccatgattt

SEQ ID NO: 3568198 - DNA, 11 bp, Homo sapiens
ttggtcaaatt

SEQ ID NO: 3568199 - DNA, 18 bp, Homo sapiens
ttggtccttctttcctct

SEQ ID NO: 3568200 - DNA, 15 bp, Homo sapiens
ttggtctgccttctg

SEQ ID NO: 3568201 - DNA, 20 bp, Homo sapiens
ttggtctgccttctgctgaa

SEQ ID NO: 3568202 - DNA, 20 bp, Homo sapiens
ttggtggctgttcctgaagg

SEQ ID NO: 3568203 - DNA, 22 bp, Homo sapiens
ttggtggggtggcacctgtttc

SEQ ID NO: 3568204 - DNA, 23 bp, Homo sapiens
ttggtggggtggcacctgtttcc

SEQ ID NO: 3568205 - DNA, 16 bp, Homo sapiens
ttggtggtgaaattga

SEQ ID NO: 3568206 - DNA, 20 bp, Homo sapiens
ttggtgtgaatttgccagag

SEQ ID NO: 3568207 - DNA, 23 bp, Homo sapiens
ttggtgtgaatttgccagaggac

SEQ ID NO: 3568208 - DNA, 14 bp, Homo sapiens
ttggttagaagtaa

SEQ ID NO: 3568209 - DNA, 15 bp, Homo sapiens
ttggttcacctgtga

SEQ ID NO: 3568210 - DNA, 15 bp, Homo sapiens
ttggttccttctctg

SEQ ID NO: 3568211 - DNA, 14 bp, Homo sapiens
ttggttctgtgaac

SEQ ID NO: 3568212 - DNA, 23 bp, Homo sapiens
ttggtttaaagaaagtgtatttg

SEQ ID NO: 3568213 - DNA, 12 bp, Homo sapiens
ttgtaaaaatga

SEQ ID NO: 3568214 - DNA, 16 bp, Homo sapiens
ttgtaaaaatgagtca

SEQ ID NO: 3568215 - DNA, 23 bp, Homo sapiens
ttgtaaaaatgagtcatttgttt

SEQ ID NO: 3568216 - DNA, 13 bp, Homo sapiens
ttgtaaaacttct

SEQ ID NO: 3568217 - DNA, 18 bp, Homo sapiens
ttgtaaaacttctgctcg

SEQ ID NO: 3568218 - DNA, 18 bp, Homo sapiens
ttgtaaaatagaaaaagt

SEQ ID NO: 3568219 - DNA, 20 bp, Homo sapiens
ttgtaaatgaaacttaagaa

SEQ ID NO: 3568220 - DNA, 22 bp, Homo sapiens
ttgtaaatgaaacttaagaatt

SEQ ID NO: 3568221 - DNA, 14 bp, Homo sapiens
ttgtaaatgtgctt

SEQ ID NO: 3568222 - DNA, 22 bp, Homo sapiens
ttgtaagatggataatgtgtat

SEQ ID NO: 3568223 - DNA, 19 bp, Homo sapiens
ttgtaagtgaaaaacatga

SEQ ID NO: 3568224 - DNA, 12 bp, Homo sapiens
ttgtaataaact

SEQ ID NO: 3568225 - DNA, 15 bp, Homo sapiens
ttgtaataataaaga

SEQ ID NO: 3568226 - DNA, 22 bp, Homo sapiens
ttgtaatactttctatgtgaca

SEQ ID NO: 3568227 - DNA, 23 bp, Homo sapiens
ttgtaattccaaaatccaaaaag

SEQ ID NO: 3568228 - DNA, 23 bp, Homo sapiens
ttgtacacccatgaaagaaaact

SEQ ID NO: 3568229 - DNA, 16 bp, Homo sapiens
ttgtacatagttattt

SEQ ID NO: 3568230 - DNA, 12 bp, Homo sapiens
ttgtactgggac

SEQ ID NO: 3568231 - DNA, 15 bp, Homo sapiens
ttgtagatttagtgt

SEQ ID NO: 3568232 - DNA, 15 bp, Homo sapiens
ttgtagcatttggaa

SEQ ID NO: 3568233 - DNA, 23 bp, Homo sapiens
ttgtagtagcgttttttaaatgt

SEQ ID NO: 3568234 - DNA, 17 bp, Homo sapiens
ttgtagttactcaagca

SEQ ID NO: 3568235 - DNA, 14 bp, Homo sapiens
ttgtagttgtttta

SEQ ID NO: 3568236 - DNA, 12 bp, Homo sapiens
ttgtataattgg

SEQ ID NO: 3568237 - DNA, 21 bp, Homo sapiens
ttgtataattggatttcctaa

SEQ ID NO: 3568238 - DNA, 22 bp, Homo sapiens
ttgtatcttttatcctgggagc

SEQ ID NO: 3568239 - DNA, 22 bp, Homo sapiens
ttgtattcaaaaattatctata

SEQ ID NO: 3568240 - DNA, 18 bp, Homo sapiens
ttgtattgtatattacaa

SEQ ID NO: 3568241 - DNA, 15 bp, Homo sapiens
ttgtatttaagacat

SEQ ID NO: 3568242 - DNA, 17 bp, Homo sapiens
ttgtatttaagacataa

SEQ ID NO: 3568243 - DNA, 21 bp, Homo sapiens
ttgtatttaagacataaacaa

SEQ ID NO: 3568244 - DNA, 22 bp, Homo sapiens
ttgtatttattaatttgaaacc

SEQ ID NO: 3568245 - DNA, 22 bp, Homo sapiens
tgtttatattgtttttatatat

SEQ ID NO: 3568246 - DNA, 17 bp, Homo sapiens
tgtttcaaacatgccca

SEQ ID NO: 3568247 - DNA, 16 bp, Homo sapiens
tgtttccatcatttct

SEQ ID NO: 3568248 - DNA, 22 bp, Homo sapiens
tgtttcccgggcaatttaacaa

SEQ ID NO: 3568249 - DNA, 15 bp, Homo sapiens
tgtttccctctgtgt

SEQ ID NO: 3568250 - DNA, 17 bp, Homo sapiens
tgtttccctctgtgtta

SEQ ID NO: 3568251 - DNA, 12 bp, Homo sapiens
tgtttccctgct

SEQ ID NO: 3568252 - DNA, 14 bp, Homo sapiens
tgtttccctgctga

SEQ ID NO: 3568253 - DNA, 16 bp, Homo sapiens
tgtttcctgcaggcca

SEQ ID NO: 3568254 - DNA, 22 bp, Homo sapiens
tgtttgaagattatatgaagtt

SEQ ID NO: 3568255 - DNA, 22 bp, Homo sapiens
tgtttgagcatcgcttaggaga

SEQ ID NO: 3568256 - DNA, 13 bp, Homo sapiens
tgtttgattggct

SEQ ID NO: 3568257 - DNA, 22 bp, Homo sapiens
tgtttgctcaaaattgcttcta

SEQ ID NO: 3568258 - DNA, 16 bp, Homo sapiens
tgtttggaatattcca

SEQ ID NO: 3568259 - DNA, 14 bp, Homo sapiens
tgtttggttcaatt

SEQ ID NO: 3568260 - DNA, 16 bp, Homo sapiens
tgtttggtttcttcat

SEQ ID NO: 3568261 - DNA, 16 bp, Homo sapiens
tgtttgtaacaagaaa

SEQ ID NO: 3568262 - DNA, 19 bp, Homo sapiens
tgtttgtcatggtgaaatt

SEQ ID NO: 3568263 - DNA, 18 bp, Homo sapiens
tgttttaagtactacaca

SEQ ID NO: 3568264 - DNA, 14 bp, Homo sapiens
tgttttagttcttg

SEQ ID NO: 3568265 - DNA, 14 bp, Homo sapiens
tgttttcaaatgtt

SEQ ID NO: 3568266 - DNA, 19 bp, Homo sapiens
tgttttcattatctcaaaa

SEQ ID NO: 3568267 - DNA, 12 bp, Homo sapiens
tgttttcatttt

SEQ ID NO: 3568268 - DNA, 21 bp, Homo sapiens
tgttttcctcccttctgctac

SEQ ID NO: 3568269 - DNA, 16 bp, Homo sapiens
tgttttggatgttgct

SEQ ID NO: 3568270 - DNA, 14 bp, Homo sapiens
tgtttttacagagg

SEQ ID NO: 3568271 - DNA, 14 bp, Homo sapiens
tgtttttatttcaa

SEQ ID NO: 3568272 - DNA, 15 bp, Homo sapiens
tgtttttatttcaat

SEQ ID NO: 3568273 - DNA, 19 bp, Homo sapiens
tgtttttcatccattccta

SEQ ID NO: 3568274 - DNA, 13 bp, Homo sapiens
tgtttttcatgtt

SEQ ID NO: 3568275 - DNA, 14 bp, Homo sapiens
tgtttttgggaaga

SEQ ID NO: 3568276 - DNA, 15 bp, Homo sapiens
tgttttttcatttgt

SEQ ID NO: 3568277 - DNA, 23 bp, Homo sapiens
tgttttttcggacatgcttttct

SEQ ID NO: 3568278 - DNA, 15 bp, Homo sapiens
tgtttttttctaaaa

SEQ ID NO: 3568279 - DNA, 16 bp, Homo sapiens
tgtttttttctaaaaa

SEQ ID NO: 3568280 - DNA, 16 bp, Homo sapiens
tgtttttttgttatta

SEQ ID NO: 3568281 - DNA, 18 bp, Homo sapiens
tgtttttttgttattaaa

SEQ ID NO: 3568282 - DNA, 21 bp, Homo sapiens
tgtttttttttttttacatgt

SEQ ID NO: 3568283 - DNA, 14 bp, Homo sapiens
ttaaaaaatcagaa

SEQ ID NO: 3568284 - DNA, 22 bp, Homo sapiens
ttaaaaaatcagaacaaaactt

SEQ ID NO: 3568285 - DNA, 18 bp, Homo sapiens
ttaaaaaatgaatagtac

SEQ ID NO: 3568286 - DNA, 17 bp, Homo sapiens
ttaaaaagcagctgcat

SEQ ID NO: 3568287 - DNA, 19 bp, Homo sapiens
ttaaaaaggtaaatggtta

SEQ ID NO: 3568288 - DNA, 16 bp, Homo sapiens
ttaaaaagttgttctt

SEQ ID NO: 3568289 - DNA, 18 bp, Homo sapiens
ttaaaaataccttctatg

SEQ ID NO: 3568290 - DNA, 16 bp, Homo sapiens
ttaaaaggatgtataa

SEQ ID NO: 3568291 - DNA, 13 bp, Homo sapiens
ttaaaagtttcta

SEQ ID NO: 3568292 - DNA, 19 bp, Homo sapiens
ttaaaatacacactcaaat

SEQ ID NO: 3568293 - DNA, 15 bp, Homo sapiens
ttaaaatacatgaat

SEQ ID NO: 3568294 - DNA, 16 bp, Homo sapiens
ttaaaatattcctgca

SEQ ID NO: 3568295 - DNA, 11 bp, Homo sapiens
ttaaaatggaa

SEQ ID NO: 3568296 - DNA, 19 bp, Homo sapiens
ttaaaatggtttgtcctga

SEQ ID NO: 3568297 - DNA, 21 bp, Homo sapiens
ttaaaatggtttgtcctgatg

SEQ ID NO: 3568298 - DNA, 19 bp, Homo sapiens
ttaaaattatatagctgct

SEQ ID NO: 3568299 - DNA, 13 bp, Homo sapiens
ttaaaattgtgat

SEQ ID NO: 3568300 - DNA, 17 bp, Homo sapiens
ttaaacaatctttcatg

SEQ ID NO: 3568301 - DNA, 16 bp, Homo sapiens
ttaaacacaggctgtc

SEQ ID NO: 3568302 - DNA, 13 bp, Homo sapiens
ttaaacagaggat

SEQ ID NO: 3568303 - DNA, 23 bp, Homo sapiens
ttaaacagggtctcactctgttg

SEQ ID NO: 3568304 - DNA, 22 bp, Homo sapiens
ttaaactctgttgcaagtgcaa

SEQ ID NO: 3568305 - DNA, 15 bp, Homo sapiens
ttaaactgtgtttta

SEQ ID NO: 3568306 - DNA, 13 bp, Homo sapiens
ttaaacttcagca

SEQ ID NO: 3568307 - DNA, 15 bp, Homo sapiens
ttaaagaaaacccac

SEQ ID NO: 3568308 - DNA, 13 bp, Homo sapiens
ttaaagaatgtta

SEQ ID NO: 3568309 - DNA, 19 bp, Homo sapiens
ttaaagaatgttagtaaag

SEQ ID NO: 3568310 - DNA, 11 bp, Homo sapiens
ttaaagacaga

SEQ ID NO: 3568311 - DNA, 14 bp, Homo sapiens
ttaaagaggaatgg

SEQ ID NO: 3568312 - DNA, 22 bp, Homo sapiens
ttaaagcaagcaacacagagga

SEQ ID NO: 3568313 - DNA, 20 bp, Homo sapiens
ttaaagcttattaaaactca

SEQ ID NO: 3568314 - DNA, 20 bp, Homo sapiens
ttaaaggtttttgaaatcca

SEQ ID NO: 3568315 - DNA, 17 bp, Homo sapiens
ttaaagtggcaatctca

SEQ ID NO: 3568316 - DNA, 14 bp, Homo sapiens
ttaaataaaattta

SEQ ID NO: 3568317 - DNA, 16 bp, Homo sapiens
ttaaatatatattttg

SEQ ID NO: 3568318 - DNA, 16 bp, Homo sapiens
ttaaatattttgctaa

SEQ ID NO: 3568319 - DNA, 17 bp, Homo sapiens
ttaaatattttgctaac

SEQ ID NO: 3568320 - DNA, 21 bp, Homo sapiens
ttaaatattttgctaactggt

SEQ ID NO: 3568321 - DNA, 19 bp, Homo sapiens
ttaaatcttgaccaacaga

SEQ ID NO: 3568322 - DNA, 12 bp, Homo sapiens
ttaaatgtatac

SEQ ID NO: 3568323 - DNA, 14 bp, Homo sapiens
ttaaatgtatacta

SEQ ID NO: 3568324 - DNA, 18 bp, Homo sapiens
ttaaatgtgtacaatgta

SEQ ID NO: 3568325 - DNA, 20 bp, Homo sapiens
ttaaatgttatgactatgta

SEQ ID NO: 3568326 - DNA, 19 bp, Homo sapiens
ttaaattccactgaaaatt

SEQ ID NO: 3568327 - DNA, 19 bp, Homo sapiens
ttaaattcccgttttgtca

SEQ ID NO: 3568328 - DNA, 17 bp, Homo sapiens
ttaaattctcaaagttt

SEQ ID NO: 3568329 - DNA, 20 bp, Homo sapiens
ttaaattgcaatatataaga

SEQ ID NO: 3568330 - DNA, 17 bp, Homo sapiens
ttaaatttgttctttgt

SEQ ID NO: 3568331 - DNA, 16 bp, Homo sapiens
ttaaattttacatgac

SEQ ID NO: 3568332 - DNA, 18 bp, Homo sapiens
ttaaattttttttacatt

SEQ ID NO: 3568333 - DNA, 18 bp, Homo sapiens
ttaacaatgtctgaaaag

SEQ ID NO: 3568334 - DNA, 17 bp, Homo sapiens
ttaacatattatttcat

SEQ ID NO: 3568335 - DNA, 22 bp, Homo sapiens
ttaaccttttcaaattaatgtt

SEQ ID NO: 3568336 - DNA, 13 bp, Homo sapiens
ttaacgctgccta

SEQ ID NO: 3568337 - DNA, 20 bp, Homo sapiens
ttaactatgacagatatatt

SEQ ID NO: 3568338 - DNA, 17 bp, Homo sapiens
ttaacttcttgcttctt

SEQ ID NO: 3568339 - DNA, 18 bp, Homo sapiens
ttaactttttttcttcta

SEQ ID NO: 3568340 - DNA, 21 bp, Homo sapiens
ttaagaaaccttgctctcctc

SEQ ID NO: 3568341 - DNA, 19 bp, Homo sapiens
ttaagacataaacaaagac

SEQ ID NO: 3568342 - DNA, 18 bp, Homo sapiens
ttaagacctggcagctct

SEQ ID NO: 3568343 - DNA, 15 bp, Homo sapiens
ttaagatgtacattt

SEQ ID NO: 3568344 - DNA, 19 bp, Homo sapiens
ttaagcagcatggaaaaat

SEQ ID NO: 3568345 - DNA, 17 bp, Homo sapiens
ttaagccaaagaaacaa

SEQ ID NO: 3568346 - DNA, 20 bp, Homo sapiens
ttaagccaaagaaacaagct

SEQ ID NO: 3568347 - DNA, 14 bp, Homo sapiens
ttaagccttacaaa

SEQ ID NO: 3568348 - DNA, 16 bp, Homo sapiens
ttaaggatagtgtgaa

SEQ ID NO: 3568349 - DNA, 21 bp, Homo sapiens
ttaaggtctaatcagtgatta

SEQ ID NO: 3568350 - DNA, 14 bp, Homo sapiens
ttaagtaaaagtct

SEQ ID NO: 3568351 - DNA, 15 bp, Homo sapiens
ttaagtaaaagtcta

SEQ ID NO: 3568352 - DNA, 17 bp, Homo sapiens
ttaagtatatcatgtaa

SEQ ID NO: 3568353 - DNA, 22 bp, Homo sapiens
ttaagtgtgcagccatagtttg

SEQ ID NO: 3568354 - DNA, 13 bp, Homo sapiens
ttaataaattgct

SEQ ID NO: 3568355 - DNA, 15 bp, Homo sapiens
ttaataaattgctta

SEQ ID NO: 3568356 - DNA, 14 bp, Homo sapiens
ttaataatatcaaa

SEQ ID NO: 3568357 - DNA, 19 bp, Homo sapiens
ttaatacaagtaatattat

SEQ ID NO: 3568358 - DNA, 18 bp, Homo sapiens
ttaatatatttgaaaaaa

SEQ ID NO: 3568359 - DNA, 19 bp, Homo sapiens
ttaatatccctacatgtat

SEQ ID NO: 3568360 - DNA, 14 bp, Homo sapiens
ttaatatgaaattt

SEQ ID NO: 3568361 - DNA, 23 bp, Homo sapiens
ttaatatgaaattttttttcatg

SEQ ID NO: 3568362 - DNA, 14 bp, Homo sapiens
ttaatattacagat

SEQ ID NO: 3568363 - DNA, 16 bp, Homo sapiens
ttaatattttatgtgt

SEQ ID NO: 3568364 - DNA, 12 bp, Homo sapiens
ttaatcaagaga

SEQ ID NO: 3568365 - DNA, 21 bp, Homo sapiens
ttaatcaagatttttttcctg

SEQ ID NO: 3568366 - DNA, 20 bp, Homo sapiens
ttaatcacaaatttcactta

SEQ ID NO: 3568367 - DNA, 20 bp, Homo sapiens
ttaatcaggtcctcagagaa

SEQ ID NO: 3568368 - DNA, 21 bp, Homo sapiens
ttaatcatacaaactctcacc

SEQ ID NO: 3568369 - DNA, 16 bp, Homo sapiens
ttaatcatatttgaaa

SEQ ID NO: 3568370 - DNA, 17 bp, Homo sapiens
ttaatcatatttgaaaa

SEQ ID NO: 3568371 - DNA, 19 bp, Homo sapiens
ttaatccatttcaggactc

SEQ ID NO: 3568372 - DNA, 15 bp, Homo sapiens
ttaatcctgtaccaa

SEQ ID NO: 3568373 - DNA, 17 bp, Homo sapiens
ttaatcctgtaccaaat

SEQ ID NO: 3568374 - DNA, 23 bp, Homo sapiens
ttaatcttttttttaaaaaaact

SEQ ID NO: 3568375 - DNA, 20 bp, Homo sapiens
ttaatgacaacacttaatag

SEQ ID NO: 3568376 - DNA, 22 bp, Homo sapiens
ttaatgacaacacttaatagca

SEQ ID NO: 3568377 - DNA, 11 bp, Homo sapiens
ttaatgactta

SEQ ID NO: 3568378 - DNA, 18 bp, Homo sapiens
ttaatgagtgcacctgcc

SEQ ID NO: 3568379 - DNA, 19 bp, Homo sapiens
ttaatgagtgcacctgcct

SEQ ID NO: 3568380 - DNA, 21 bp, Homo sapiens
ttaatgatatgcttgtaacta

SEQ ID NO: 3568381 - DNA, 19 bp, Homo sapiens
ttaatggtttattctttgc

SEQ ID NO: 3568382 - DNA, 16 bp, Homo sapiens
tgggttccaaaatatt

SEQ ID NO: 3568383 - DNA, 16 bp, Homo sapiens
tgggttctgcctgcca

SEQ ID NO: 3568384 - DNA, 22 bp, Homo sapiens
tgggtttgggagccaggactcc

SEQ ID NO: 3568385 - DNA, 22 bp, Homo sapiens
tgggttttaattttcagttcta

SEQ ID NO: 3568386 - DNA, 19 bp, Homo sapiens
tgggtttttgtatccagag

SEQ ID NO: 3568387 - DNA, 21 bp, Homo sapiens
tgggtttttgtatccagagct

SEQ ID NO: 3568388 - DNA, 13 bp, Homo sapiens
tggtaacttgaga

SEQ ID NO: 3568389 - DNA, 21 bp, Homo sapiens
tggtaacttgagattcaagac

SEQ ID NO: 3568390 - DNA, 22 bp, Homo sapiens
tggtaatttaagattccagaga

SEQ ID NO: 3568391 - DNA, 21 bp, Homo sapiens
tggtactcccaaactgacaat

SEQ ID NO: 3568392 - DNA, 22 bp, Homo sapiens
tggtactcccaaactgacaatt

SEQ ID NO: 3568393 - DNA, 24 bp, Homo sapiens
tggtacttagagtttctgtttgat

SEQ ID NO: 3568394 - DNA, 16 bp, Homo sapiens
tggtagaatcattttt

SEQ ID NO: 3568395 - DNA, 17 bp, Homo sapiens
tggtagaccaaaataaa

SEQ ID NO: 3568396 - DNA, 17 bp, Homo sapiens
tggtagcttttcccttc

SEQ ID NO: 3568397 - DNA, 12 bp, Homo sapiens
tggtaggaccct

SEQ ID NO: 3568398 - DNA, 17 bp, Homo sapiens
tggtaggattgctgggg

SEQ ID NO: 3568399 - DNA, 17 bp, Homo sapiens
tggtatagccatgattt

SEQ ID NO: 3568400 - DNA, 17 bp, Homo sapiens
tggtatgaataattgca

SEQ ID NO: 3568401 - DNA, 22 bp, Homo sapiens
tggtatgggggatttcaaactt

SEQ ID NO: 3568402 - DNA, 18 bp, Homo sapiens
tggtattttcagagaaca

SEQ ID NO: 3568403 - DNA, 22 bp, Homo sapiens
tggtcaaacaaactctctgaac

SEQ ID NO: 3568404 - DNA, 14 bp, Homo sapiens
tggtcaacttaagg

SEQ ID NO: 3568405 - DNA, 20 bp, Homo sapiens
tggtcacaggactctgcctc

SEQ ID NO: 3568406 - DNA, 23 bp, Homo sapiens
tggtcacaggactctgcctcctc

SEQ ID NO: 3568407 - DNA, 14 bp, Homo sapiens
tggtcacccatgca

SEQ ID NO: 3568408 - DNA, 16 bp, Homo sapiens
tggtcagatttgaact

SEQ ID NO: 3568409 - DNA, 22 bp, Homo sapiens
tggtcagatttgaactcttcaa

SEQ ID NO: 3568410 - DNA, 14 bp, Homo sapiens
tggtccagctctga

SEQ ID NO: 3568411 - DNA, 20 bp, Homo sapiens
tggtccagctctgacatccc

SEQ ID NO: 3568412 - DNA, 22 bp, Homo sapiens
tggtccagctctgacatccctt

SEQ ID NO: 3568413 - DNA, 16 bp, Homo sapiens
tggtccttctttcctc

SEQ ID NO: 3568414 - DNA, 17 bp, Homo sapiens
tggtccttctttcctct

SEQ ID NO: 3568415 - DNA, 20 bp, Homo sapiens
tggtctgtggagatggactc

SEQ ID NO: 3568416 - DNA, 21 bp, Homo sapiens
tggtcttctgttgacattcgg

SEQ ID NO: 3568417 - DNA, 19 bp, Homo sapiens
tggtgaaattgactgatga

SEQ ID NO: 3568418 - DNA, 14 bp, Homo sapiens
tggtgacacctccc

SEQ ID NO: 3568419 - DNA, 12 bp, Homo sapiens
tggtgagcaagc

SEQ ID NO: 3568420 - DNA, 19 bp, Homo sapiens
tggtgagcaagcaccaacc

SEQ ID NO: 3568421 - DNA, 21 bp, Homo sapiens
tggtgagcaagcaccaacctc

SEQ ID NO: 3568422 - DNA, 16 bp, Homo sapiens
tggtgaggggctttct

SEQ ID NO: 3568423 - DNA, 16 bp, Homo sapiens
tggtgcaatcacagct

SEQ ID NO: 3568424 - DNA, 16 bp, Homo sapiens
tggtgccccaggacca

SEQ ID NO: 3568425 - DNA, 21 bp, Homo sapiens
tggtgcctatctgcctggagg

SEQ ID NO: 3568426 - DNA, 16 bp, Homo sapiens
tggtgctcttttttct

SEQ ID NO: 3568427 - DNA, 15 bp, Homo sapiens
tggtgctgcagattt

SEQ ID NO: 3568428 - DNA, 13 bp, Homo sapiens
tggtgctgccaca

SEQ ID NO: 3568429 - DNA, 23 bp, Homo sapiens
tggtgcttctcagatttctgagg

SEQ ID NO: 3568430 - DNA, 18 bp, Homo sapiens
tggtggcacacgcctgta

SEQ ID NO: 3568431 - DNA, 16 bp, Homo sapiens
tggtggctcatgcctg

SEQ ID NO: 3568432 - DNA, 14 bp, Homo sapiens
tggtggctgtggaa

SEQ ID NO: 3568433 - DNA, 23 bp, Homo sapiens
tggtgggaaggccggcagcgggc

SEQ ID NO: 3568434 - DNA, 20 bp, Homo sapiens
tggtgggggaggagcctctg

SEQ ID NO: 3568435 - DNA, 17 bp, Homo sapiens
tggtggggtctcctcag

SEQ ID NO: 3568436 - DNA, 23 bp, Homo sapiens
tggtggggtctcctcaggaccag

SEQ ID NO: 3568437 - DNA, 21 bp, Homo sapiens
tggtgggtaattgtacaataa

SEQ ID NO: 3568438 - DNA, 18 bp, Homo sapiens
tggtgtaatcattttaaa

SEQ ID NO: 3568439 - DNA, 12 bp, Homo sapiens
tggtgtgatctt

SEQ ID NO: 3568440 - DNA, 15 bp, Homo sapiens
tggtgtgtccctgga

SEQ ID NO: 3568441 - DNA, 20 bp, Homo sapiens
tggtgtgtccctggacacag

SEQ ID NO: 3568442 - DNA, 21 bp, Homo sapiens
tggtgtgtccctggacacagc

SEQ ID NO: 3568443 - DNA, 22 bp, Homo sapiens
tggtgtgtccctggacacagct

SEQ ID NO: 3568444 - DNA, 23 bp, Homo sapiens
tggtgtgtccctggacacagctc

SEQ ID NO: 3568445 - DNA, 22 bp, Homo sapiens
tggtgttgcagccgcagagaaa

SEQ ID NO: 3568446 - DNA, 19 bp, Homo sapiens
tggtgtttgtcatggtgaa

SEQ ID NO: 3568447 - DNA, 22 bp, Homo sapiens
tggtgtttgtcatggtgaaatt

SEQ ID NO: 3568448 - DNA, 15 bp, Homo sapiens
tggtgtttttacaga

SEQ ID NO: 3568449 - DNA, 12 bp, Homo sapiens
tggttaaatttt

SEQ ID NO: 3568450 - DNA, 15 bp, Homo sapiens
tggttcacctgtgac

SEQ ID NO: 3568451 - DNA, 16 bp, Homo sapiens
tggttcagacacagct

SEQ ID NO: 3568452 - DNA, 17 bp, Homo sapiens
tggttcagacacagctc

SEQ ID NO: 3568453 - DNA, 18 bp, Homo sapiens
tggttcagacacagctct

SEQ ID NO: 3568454 - DNA, 16 bp, Homo sapiens
tggttcagctaagcta

SEQ ID NO: 3568455 - DNA, 18 bp, Homo sapiens
tggttcccctgttcactc

SEQ ID NO: 3568456 - DNA, 20 bp, Homo sapiens
tggttcccctgttcactcta

SEQ ID NO: 3568457 - DNA, 23 bp, Homo sapiens
tggttcccctgttcactctactt

SEQ ID NO: 3568458 - DNA, 19 bp, Homo sapiens
tggttccctgctgcgctgc

SEQ ID NO: 3568459 - DNA, 17 bp, Homo sapiens
tggttcgtgctgtgctc

SEQ ID NO: 3568460 - DNA, 14 bp, Homo sapiens
tggttctgaggcca

SEQ ID NO: 3568461 - DNA, 21 bp, Homo sapiens
tggttgatggaaaataaacat

SEQ ID NO: 3568462 - DNA, 15 bp, Homo sapiens
tggtttaaagaaagt

SEQ ID NO: 3568463 - DNA, 16 bp, Homo sapiens
tggtttaaagaaagtg

SEQ ID NO: 3568464 - DNA, 17 bp, Homo sapiens
tggtttaaagaaagtgt

SEQ ID NO: 3568465 - DNA, 21 bp, Homo sapiens
tggtttaggccttgccagttt

SEQ ID NO: 3568466 - DNA, 23 bp, Homo sapiens
tggtttaggccttgccagttttc

SEQ ID NO: 3568467 - DNA, 17 bp, Homo sapiens
tggtttataataaactc

SEQ ID NO: 3568468 - DNA, 21 bp, Homo sapiens
tgggaagtttgctgtgctttg

SEQ ID NO: 3568469 - DNA, 23 bp, Homo sapiens
tgggaagtttgctgtgctttgga

SEQ ID NO: 3568470 - DNA, 23 bp, Homo sapiens
tgggaataagtgccaggatggaa

SEQ ID NO: 3568471 - DNA, 13 bp, Homo sapiens
tgggaatgggaga

SEQ ID NO: 3568472 - DNA, 14 bp, Homo sapiens
tgggaatgggagag

SEQ ID NO: 3568473 - DNA, 17 bp, Homo sapiens
tgggaatgttctttctg

SEQ ID NO: 3568474 - DNA, 22 bp, Homo sapiens
tgggaatgttctttctgctcta

SEQ ID NO: 3568475 - DNA, 18 bp, Homo sapiens
tgggacagccattttcca

SEQ ID NO: 3568476 - DNA, 16 bp, Homo sapiens
tgggacccacagaact

SEQ ID NO: 3568477 - DNA, 14 bp, Homo sapiens
tgggaccccagaga

SEQ ID NO: 3568478 - DNA, 15 bp, Homo sapiens
tgggactgactttcc

SEQ ID NO: 3568479 - DNA, 14 bp, Homo sapiens
tgggagacatgtga

SEQ ID NO: 3568480 - DNA, 16 bp, Homo sapiens
tgggagacatgtgaca

SEQ ID NO: 3568481 - DNA, 22 bp, Homo sapiens
tgggagatttggaatacacatg

SEQ ID NO: 3568482 - DNA, 12 bp, Homo sapiens
tgggagccagga

SEQ ID NO: 3568483 - DNA, 16 bp, Homo sapiens
tgggagccaggactcc

SEQ ID NO: 3568484 - DNA, 19 bp, Homo sapiens
tgggagccaggactcccag

SEQ ID NO: 3568485 - DNA, 13 bp, Homo sapiens
tgggagccgcctg

SEQ ID NO: 3568486 - DNA, 18 bp, Homo sapiens
tgggagcctagctcctgc

SEQ ID NO: 3568487 - DNA, 14 bp, Homo sapiens
tgggagctgagctg

SEQ ID NO: 3568488 - DNA, 21 bp, Homo sapiens
tgggagctgagctggaagggg

SEQ ID NO: 3568489 - DNA, 23 bp, Homo sapiens
tgggagctgctgggtggcagggg

SEQ ID NO: 3568490 - DNA, 20 bp, Homo sapiens
tgggagctggttagaaatgc

SEQ ID NO: 3568491 - DNA, 18 bp, Homo sapiens
tgggagcttccgctttga

SEQ ID NO: 3568492 - DNA, 15 bp, Homo sapiens
tgggaggagggaggc

SEQ ID NO: 3568493 - DNA, 16 bp, Homo sapiens
tgggagtccaaggtgg

SEQ ID NO: 3568494 - DNA, 21 bp, Homo sapiens
tgggagtgaggatgtctgggc

SEQ ID NO: 3568495 - DNA, 23 bp, Homo sapiens
tgggagttgctgttaatctgatg

SEQ ID NO: 3568496 - DNA, 18 bp, Homo sapiens
tgggatagtgttctgctc

SEQ ID NO: 3568497 - DNA, 19 bp, Homo sapiens
tgggatagtgttctgctcc

SEQ ID NO: 3568498 - DNA, 18 bp, Homo sapiens
tgggatatggctgcccag

SEQ ID NO: 3568499 - DNA, 24 bp, Homo sapiens
tgggatattctttagcttacctgg

SEQ ID NO: 3568500 - DNA, 12 bp, Homo sapiens
tgggatctgggg

SEQ ID NO: 3568501 - DNA, 15 bp, Homo sapiens
tgggatctggggaga

SEQ ID NO: 3568502 - DNA, 21 bp, Homo sapiens
tgggatggtcggatctcacag

SEQ ID NO: 3568503 - DNA, 17 bp, Homo sapiens
tgggattaagaaacctt

SEQ ID NO: 3568504 - DNA, 22 bp, Homo sapiens
tgggattaagaaaccttgctct

SEQ ID NO: 3568505 - DNA, 20 bp, Homo sapiens
tgggattataggcatgagcc

SEQ ID NO: 3568506 - DNA, 12 bp, Homo sapiens
tgggcacacgct

SEQ ID NO: 3568507 - DNA, 20 bp, Homo sapiens
tgggcacacgctgctctgcc

SEQ ID NO: 3568508 - DNA, 22 bp, Homo sapiens
tgggcacacgctgctctgcccc

SEQ ID NO: 3568509 - DNA, 14 bp, Homo sapiens
tgggcactggggcc

SEQ ID NO: 3568510 - DNA, 21 bp, Homo sapiens
tgggcagcaatttaaatgtta

SEQ ID NO: 3568511 - DNA, 16 bp, Homo sapiens
tgggcagttttttgaa

SEQ ID NO: 3568512 - DNA, 17 bp, Homo sapiens
tgggcattagcaaggca

SEQ ID NO: 3568513 - DNA, 20 bp, Homo sapiens
tgggcattagcaaggcagag

SEQ ID NO: 3568514 - DNA, 21 bp, Homo sapiens
tgggcattagcaaggcagagc

SEQ ID NO: 3568515 - DNA, 14 bp, Homo sapiens
tgggcatttcaatc

SEQ ID NO: 3568516 - DNA, 15 bp, Homo sapiens
tgggcatttggtgag

SEQ ID NO: 3568517 - DNA, 23 bp, Homo sapiens
tgggccaacaaagaacactaact

SEQ ID NO: 3568518 - DNA, 18 bp, Homo sapiens
tgggccacacccaggaag

SEQ ID NO: 3568519 - DNA, 21 bp, Homo sapiens
tgggccacacccaggaaggga

SEQ ID NO: 3568520 - DNA, 14 bp, Homo sapiens
tgggccactgggga

SEQ ID NO: 3568521 - DNA, 22 bp, Homo sapiens
tgggccactggggactttattt

SEQ ID NO: 3568522 - DNA, 13 bp, Homo sapiens
tgggcccctgagg

SEQ ID NO: 3568523 - DNA, 15 bp, Homo sapiens
tgggcccctgaggag

SEQ ID NO: 3568524 - DNA, 16 bp, Homo sapiens
tgggcccctgaggagc

SEQ ID NO: 3568525 - DNA, 19 bp, Homo sapiens
tgggccgtggcacagctgg

SEQ ID NO: 3568526 - DNA, 16 bp, Homo sapiens
tgggcctcaggctctg

SEQ ID NO: 3568527 - DNA, 19 bp, Homo sapiens
tgggcctcaggctctgcac

SEQ ID NO: 3568528 - DNA, 13 bp, Homo sapiens
tgggcctgagggt

SEQ ID NO: 3568529 - DNA, 16 bp, Homo sapiens
tgggcctgctccagac

SEQ ID NO: 3568530 - DNA, 16 bp, Homo sapiens
tgggccttcaccaagc

SEQ ID NO: 3568531 - DNA, 15 bp, Homo sapiens
tgggcggcacagcct

SEQ ID NO: 3568532 - DNA, 18 bp, Homo sapiens
tgggctattgctgctgcc

SEQ ID NO: 3568533 - DNA, 21 bp, Homo sapiens
tgggctcactgtgctggggca

SEQ ID NO: 3568534 - DNA, 14 bp, Homo sapiens
tgggctgacccagc

SEQ ID NO: 3568535 - DNA, 16 bp, Homo sapiens
tgggctgacccagcat

SEQ ID NO: 3568536 - DNA, 15 bp, Homo sapiens
tgggctgccctggtg

SEQ ID NO: 3568537 - DNA, 20 bp, Homo sapiens
tgggctgccctggtgctgcc

SEQ ID NO: 3568538 - DNA, 17 bp, Homo sapiens
tgggctggggcctcaga

SEQ ID NO: 3568539 - DNA, 18 bp, Homo sapiens
tgggctggggcctcagac

SEQ ID NO: 3568540 - DNA, 19 bp, Homo sapiens
tgggctggtggctcccgga

SEQ ID NO: 3568541 - DNA, 23 bp, Homo sapiens
tgggctggttggagaaggtcaca

SEQ ID NO: 3568542 - DNA, 20 bp, Homo sapiens
tgggcttcaacagccaagct

SEQ ID NO: 3568543 - DNA, 22 bp, Homo sapiens
tgggcttccccaggtggcctgg

SEQ ID NO: 3568544 - DNA, 22 bp, Homo sapiens
tgggcttgtgatttccatttct

SEQ ID NO: 3568545 - DNA, 22 bp, Homo sapiens
tgggctttgttgtgagaatggc

SEQ ID NO: 3568546 - DNA, 17 bp, Homo sapiens
tggggaagacagtggcc

SEQ ID NO: 3568547 - DNA, 20 bp, Homo sapiens
tggggacgccaaggaggtgg

SEQ ID NO: 3568548 - DNA, 20 bp, Homo sapiens
tggggagagcggctggagaa

SEQ ID NO: 3568549 - DNA, 16 bp, Homo sapiens
tggggagttaagacct

SEQ ID NO: 3568550 - DNA, 17 bp, Homo sapiens
tggggatagatgtgtgg

SEQ ID NO: 3568551 - DNA, 20 bp, Homo sapiens
tggggatagatgtgtggaca

SEQ ID NO: 3568552 - DNA, 22 bp, Homo sapiens
tggggatcttcccacaggaggg

SEQ ID NO: 3568553 - DNA, 17 bp, Homo sapiens
tggggcagaggagaact

SEQ ID NO: 3568554 - DNA, 15 bp, Homo sapiens
tggggcagctgagca

SEQ ID NO: 3568555 - DNA, 23 bp, Homo sapiens
tggggcaggattctctgcagccc

SEQ ID NO: 3568556 - DNA, 11 bp, Homo sapiens
tggggccactt

SEQ ID NO: 3568557 - DNA, 19 bp, Homo sapiens
tggggccagatccagcctg

SEQ ID NO: 3568558 - DNA, 14 bp, Homo sapiens
tggggccatgcctc

SEQ ID NO: 3568559 - DNA, 20 bp, Homo sapiens
tggggccgccacggcctggc

SEQ ID NO: 3568560 - DNA, 22 bp, Homo sapiens
tggggcctcagaccccctcagc

SEQ ID NO: 3568561 - DNA, 16 bp, Homo sapiens
tggggcctcagcctgc

SEQ ID NO: 3568562 - DNA, 20 bp, Homo sapiens
tggctgcttaaactggaaag

SEQ ID NO: 3568563 - DNA, 23 bp, Homo sapiens
tggctggaaagcagagcctcctg

SEQ ID NO: 3568564 - DNA, 18 bp, Homo sapiens
tggctgggactgggaaca

SEQ ID NO: 3568565 - DNA, 16 bp, Homo sapiens
tggctgggccttcacc

SEQ ID NO: 3568566 - DNA, 23 bp, Homo sapiens
tggctgggtggtattctggtagg

SEQ ID NO: 3568567 - DNA, 18 bp, Homo sapiens
tggctggtagcagcaggc

SEQ ID NO: 3568568 - DNA, 16 bp, Homo sapiens
tggctggtcttcactt

SEQ ID NO: 3568569 - DNA, 23 bp, Homo sapiens
tggctggtcttcactttcctcag

SEQ ID NO: 3568570 - DNA, 14 bp, Homo sapiens
tggctggtgggccc

SEQ ID NO: 3568571 - DNA, 19 bp, Homo sapiens
tggctgtaatgacaaaaga

SEQ ID NO: 3568572 - DNA, 11 bp, Homo sapiens
tggctgtccct

SEQ ID NO: 3568573 - DNA, 14 bp, Homo sapiens
tggctgtccctgtg

SEQ ID NO: 3568574 - DNA, 22 bp, Homo sapiens
tggctgtgcctctgcctgtctc

SEQ ID NO: 3568575 - DNA, 17 bp, Homo sapiens
tggcttaaagggatgga

SEQ ID NO: 3568576 - DNA, 21 bp, Homo sapiens
tggcttaaagggatggacttg

SEQ ID NO: 3568577 - DNA, 16 bp, Homo sapiens
tggcttcccgctcagc

SEQ ID NO: 3568578 - DNA, 19 bp, Homo sapiens
tggcttcccgctcagccct

SEQ ID NO: 3568579 - DNA, 22 bp, Homo sapiens
tggcttcccgctcagccctccc

SEQ ID NO: 3568580 - DNA, 15 bp, Homo sapiens
tggcttccctggaag

SEQ ID NO: 3568581 - DNA, 16 bp, Homo sapiens
tggcttccctggaagc

SEQ ID NO: 3568582 - DNA, 22 bp, Homo sapiens
tggcttggggattgtacacggg

SEQ ID NO: 3568583 - DNA, 21 bp, Homo sapiens
tggcttgtctcacgcagccag

SEQ ID NO: 3568584 - DNA, 12 bp, Homo sapiens
tggctttcacat

SEQ ID NO: 3568585 - DNA, 14 bp, Homo sapiens
tggctttcagagcc

SEQ ID NO: 3568586 - DNA, 22 bp, Homo sapiens
tggctttcagagccagcctggc

SEQ ID NO: 3568587 - DNA, 19 bp, Homo sapiens
tggcttttcactgctggct

SEQ ID NO: 3568588 - DNA, 20 bp, Homo sapiens
tgggaaacactgaaatgaaa

SEQ ID NO: 3568589 - DNA, 16 bp, Homo sapiens
tgggaaagcattgtaa

SEQ ID NO: 3568590 - DNA, 20 bp, Homo sapiens
tgggaaaggggagtaggtgg

SEQ ID NO: 3568591 - DNA, 14 bp, Homo sapiens
tgggaacacagttc

SEQ ID NO: 3568592 - DNA, 13 bp, Homo sapiens
tgggaagaagaag

SEQ ID NO: 3568593 - DNA, 22 bp, Homo sapiens
tgggaagggagcattgcagcct

SEQ ID NO: 3568594 - DNA, 17 bp, Homo sapiens
tggcaaaaagagtcaga

SEQ ID NO: 3568595 - DNA, 20 bp, Homo sapiens
tggcaaaaggatctttgtgg

SEQ ID NO: 3568596 - DNA, 19 bp, Homo sapiens
tggcaaacgtttctcaaat

SEQ ID NO: 3568597 - DNA, 23 bp, Homo sapiens
tggcaaagcagcaactattcaca

SEQ ID NO: 3568598 - DNA, 15 bp, Homo sapiens
tggcaaatccaggct

SEQ ID NO: 3568599 - DNA, 13 bp, Homo sapiens
tggcaacagatct

SEQ ID NO: 3568600 - DNA, 19 bp, Homo sapiens
tggcacaatgttggagcag

SEQ ID NO: 3568601 - DNA, 16 bp, Homo sapiens
tggcacagaccaggcc

SEQ ID NO: 3568602 - DNA, 17 bp, Homo sapiens
tggcacagaccaggcct

SEQ ID NO: 3568603 - DNA, 13 bp, Homo sapiens
tggcaccatcagc

SEQ ID NO: 3568604 - DNA, 18 bp, Homo sapiens
tggcacccccatgctgcc

SEQ ID NO: 3568605 - DNA, 19 bp, Homo sapiens
tggcacccccatgctgcct

SEQ ID NO: 3568606 - DNA, 16 bp, Homo sapiens
tggcacccctttctag

SEQ ID NO: 3568607 - DNA, 15 bp, Homo sapiens
tggcacgtgacaggc

SEQ ID NO: 3568608 - DNA, 19 bp, Homo sapiens
tggcagagaagatgaaatt

SEQ ID NO: 3568609 - DNA, 19 bp, Homo sapiens
tggcagagaccataagaga

SEQ ID NO: 3568610 - DNA, 22 bp, Homo sapiens
tggcagagaccataagagaaac

SEQ ID NO: 3568611 - DNA, 11 bp, Homo sapiens
tggcagagcca

SEQ ID NO: 3568612 - DNA, 23 bp, Homo sapiens
tggcagcaccgcctcttcccgcc

SEQ ID NO: 3568613 - DNA, 16 bp, Homo sapiens
tggcagccgtgccttc

SEQ ID NO: 3568614 - DNA, 14 bp, Homo sapiens
tggcagctagtgcc

SEQ ID NO: 3568615 - DNA, 15 bp, Homo sapiens
tggcagctagtgcct

SEQ ID NO: 3568616 - DNA, 11 bp, Homo sapiens
tggcagctctg

SEQ ID NO: 3568617 - DNA, 16 bp, Homo sapiens
tggcagctgccacgcc

SEQ ID NO: 3568618 - DNA, 21 bp, Homo sapiens
tgccctggtgctgccacactt

SEQ ID NO: 3568619 - DNA, 22 bp, Homo sapiens
tgccctttcaaagcacttaagt

SEQ ID NO: 3568620 - DNA, 20 bp, Homo sapiens
tgccgcgtcgccctcccagg

SEQ ID NO: 3568621 - DNA, 15 bp, Homo sapiens
tgccgctctaaattg

SEQ ID NO: 3568622 - DNA, 21 bp, Homo sapiens
tgccgctctaaattggctcca

SEQ ID NO: 3568623 - DNA, 15 bp, Homo sapiens
tgccgctctctctga

SEQ ID NO: 3568624 - DNA, 13 bp, Homo sapiens
tgccgctgtctct

SEQ ID NO: 3568625 - DNA, 14 bp, Homo sapiens
tgccgctgtctctg

SEQ ID NO: 3568626 - DNA, 16 bp, Homo sapiens
tgccgctgtctctgag

SEQ ID NO: 3568627 - DNA, 15 bp, Homo sapiens
tgccggctctgggcc

SEQ ID NO: 3568628 - DNA, 16 bp, Homo sapiens
tgccggtcgggcagcc

SEQ ID NO: 3568629 - DNA, 14 bp, Homo sapiens
tgccgtttcccctc

SEQ ID NO: 3568630 - DNA, 21 bp, Homo sapiens
tgcctaaatttaatgctgcct

SEQ ID NO: 3568631 - DNA, 18 bp, Homo sapiens
tgcctaagaataaacatt

SEQ ID NO: 3568632 - DNA, 18 bp, Homo sapiens
tgcctatctgacttcata

SEQ ID NO: 3568633 - DNA, 16 bp, Homo sapiens
tgcctatctgcctgga

SEQ ID NO: 3568634 - DNA, 17 bp, Homo sapiens
tgcctatgatactgtct

SEQ ID NO: 3568635 - DNA, 14 bp, Homo sapiens
tgcctccaccagca

SEQ ID NO: 3568636 - DNA, 14 bp, Homo sapiens
tgcctccaggaacc

SEQ ID NO: 3568637 - DNA, 24 bp, Homo sapiens
tgcctcctcacccccagctttgct

SEQ ID NO: 3568638 - DNA, 16 bp, Homo sapiens
tgcctcggatcccctt

SEQ ID NO: 3568639 - DNA, 18 bp, Homo sapiens
tgcctcggatccccttcc

SEQ ID NO: 3568640 - DNA, 21 bp, Homo sapiens
tgcctctgacagtccacaggg

SEQ ID NO: 3568641 - DNA, 13 bp, Homo sapiens
tgcctctgcagtc

SEQ ID NO: 3568642 - DNA, 14 bp, Homo sapiens
tgcctctgcagtct

SEQ ID NO: 3568643 - DNA, 11 bp, Homo sapiens
tgcctctgcct

SEQ ID NO: 3568644 - DNA, 13 bp, Homo sapiens
tgcctcttctttg

SEQ ID NO: 3568645 - DNA, 21 bp, Homo sapiens
tgcctcttctttgtgcctttg

SEQ ID NO: 3568646 - DNA, 14 bp, Homo sapiens
tgcctgacagcctt

SEQ ID NO: 3568647 - DNA, 21 bp, Homo sapiens
tgcctgacagccttccccagc

SEQ ID NO: 3568648 - DNA, 11 bp, Homo sapiens
tgcctgagctg

SEQ ID NO: 3568649 - DNA, 15 bp, Homo sapiens
tgcctgagctgggga

SEQ ID NO: 3568650 - DNA, 16 bp, Homo sapiens
tgcctgatttcattcc

SEQ ID NO: 3568651 - DNA, 14 bp, Homo sapiens
tgcctgcagcaggc

SEQ ID NO: 3568652 - DNA, 17 bp, Homo sapiens
tgcctgcatgagctggc

SEQ ID NO: 3568653 - DNA, 19 bp, Homo sapiens
tgcctggagacaaggtgct

SEQ ID NO: 3568654 - DNA, 18 bp, Homo sapiens
tgcctggaggctcctcta

SEQ ID NO: 3568655 - DNA, 17 bp, Homo sapiens
tgcctggccccctgtcc

SEQ ID NO: 3568656 - DNA, 11 bp, Homo sapiens
tgcctgggctc

SEQ ID NO: 3568657 - DNA, 18 bp, Homo sapiens
tgcctgttggcaggccca

SEQ ID NO: 3568658 - DNA, 22 bp, Homo sapiens
tgcctgttggcaggcccactcc

SEQ ID NO: 3568659 - DNA, 13 bp, Homo sapiens
tgcctgtttcccg

SEQ ID NO: 3568660 - DNA, 20 bp, Homo sapiens
tgccttaaaatggaattgaa

SEQ ID NO: 3568661 - DNA, 14 bp, Homo sapiens
tgccttagaacctt

SEQ ID NO: 3568662 - DNA, 21 bp, Homo sapiens
tgccttcaacaacgtgagaga

SEQ ID NO: 3568663 - DNA, 17 bp, Homo sapiens
tgccttcagctctacag

SEQ ID NO: 3568664 - DNA, 18 bp, Homo sapiens
tgccttcagctctacagc

SEQ ID NO: 3568665 - DNA, 14 bp, Homo sapiens
tgccttcagggaga

SEQ ID NO: 3568666 - DNA, 16 bp, Homo sapiens
tgccttctaaaggtgt

SEQ ID NO: 3568667 - DNA, 13 bp, Homo sapiens
tgccttctgctga

SEQ ID NO: 3568668 - DNA, 16 bp, Homo sapiens
tgccttctgctgaaag

SEQ ID NO: 3568669 - DNA, 13 bp, Homo sapiens
tgccttctttcca

SEQ ID NO: 3568670 - DNA, 14 bp, Homo sapiens
tgccttctttccat

SEQ ID NO: 3568671 - DNA, 12 bp, Homo sapiens
tgccttgtttaa

SEQ ID NO: 3568672 - DNA, 17 bp, Homo sapiens
tgccttgtttaatgtta

SEQ ID NO: 3568673 - DNA, 18 bp, Homo sapiens
tgccttgtttaatgttaa

SEQ ID NO: 3568674 - DNA, 19 bp, Homo sapiens
tgccttgtttaatgttaat

SEQ ID NO: 3568675 - DNA, 12 bp, Homo sapiens
tgcctttctttg

SEQ ID NO: 3568676 - DNA, 18 bp, Homo sapiens
tgcctttctttgcctctg

SEQ ID NO: 3568677 - DNA, 22 bp, Homo sapiens
tgcctttggaagggtctctctc

SEQ ID NO: 3568678 - DNA, 13 bp, Homo sapiens
tgcctttggcctg

SEQ ID NO: 3568679 - DNA, 15 bp, Homo sapiens
tgccttttatgtaaa

SEQ ID NO: 3568680 - DNA, 21 bp, Homo sapiens
tgcgagacgcacacagctgag

SEQ ID NO: 3568681 - DNA, 23 bp, Homo sapiens
tgcgagacgcacacagctgagca

SEQ ID NO: 3568682 - DNA, 14 bp, Homo sapiens
tgcgccaccatgcc

SEQ ID NO: 3568683 - DNA, 16 bp, Homo sapiens
tgcgccaccatgccct

SEQ ID NO: 3568684 - DNA, 13 bp, Homo sapiens
tgcgcctccagag

SEQ ID NO: 3568685 - DNA, 14 bp, Homo sapiens
tgcgcctccagagg

SEQ ID NO: 3568686 - DNA, 19 bp, Homo sapiens
tgcgcctcggtatctggct

SEQ ID NO: 3568687 - DNA, 17 bp, Homo sapiens
tgcgcctcgtgctggcg

SEQ ID NO: 3568688 - DNA, 19 bp, Homo sapiens
tgcgctgtgtacaatgtga

SEQ ID NO: 3568689 - DNA, 22 bp, Homo sapiens
tgcgctgtgtacaatgtgagat

SEQ ID NO: 3568690 - DNA, 20 bp, Homo sapiens
tgcgctttgcaatatttatt

SEQ ID NO: 3568691 - DNA, 17 bp, Homo sapiens
tgcggcagtgttccttg

SEQ ID NO: 3568692 - DNA, 20 bp, Homo sapiens
tgcggctgtgcagcctgtcc

SEQ ID NO: 3568693 - DNA, 15 bp, Homo sapiens
tgcgtcccagctgaa

SEQ ID NO: 3568694 - DNA, 21 bp, Homo sapiens
tgcgtcccagctgaaggcagt

SEQ ID NO: 3568695 - DNA, 16 bp, Homo sapiens
tgcgtcggtcctggtg

SEQ ID NO: 3568696 - DNA, 13 bp, Homo sapiens
tgcgtttttcctt

SEQ ID NO: 3568697 - DNA, 17 bp, Homo sapiens
tgctaaaacctgaaatt

SEQ ID NO: 3568698 - DNA, 14 bp, Homo sapiens
tgctaaaataacag

SEQ ID NO: 3568699 - DNA, 13 bp, Homo sapiens
tgctaactggtta

SEQ ID NO: 3568700 - DNA, 16 bp, Homo sapiens
tgctaactggttaaac

SEQ ID NO: 3568701 - DNA, 17 bp, Homo sapiens
tgctaagtaatttagaa

SEQ ID NO: 3568702 - DNA, 22 bp, Homo sapiens
tgctaagtaatttagaagatat

SEQ ID NO: 3568703 - DNA, 16 bp, Homo sapiens
tgctacaaaaacacag

SEQ ID NO: 3568704 - DNA, 15 bp, Homo sapiens
tgctactactgcagt

SEQ ID NO: 3568705 - DNA, 17 bp, Homo sapiens
tgctactactgcagtct

SEQ ID NO: 3568706 - DNA, 18 bp, Homo sapiens
tgctagagacgctgatcc

SEQ ID NO: 3568707 - DNA, 22 bp, Homo sapiens
tgctagataatagggttttcag

SEQ ID NO: 3568708 - DNA, 16 bp, Homo sapiens
tgctagatccagccca

SEQ ID NO: 3568709 - DNA, 17 bp, Homo sapiens
tgctatacatgttggaa

SEQ ID NO: 3568710 - DNA, 12 bp, Homo sapiens
tgctatagtgac

SEQ ID NO: 3568711 - DNA, 19 bp, Homo sapiens
tgctatagtgacatgcagt

SEQ ID NO: 3568712 - DNA, 18 bp, Homo sapiens
tgctatcagttttatagc

SEQ ID NO: 3568713 - DNA, 20 bp, Homo sapiens
tgctatctctgtgtgcacaa

SEQ ID NO: 3568714 - DNA, 21 bp, Homo sapiens
tgctatctctgtgtgcacaaa

SEQ ID NO: 3568715 - DNA, 22 bp, Homo sapiens
tgctattgtagagccagaggtc

SEQ ID NO: 3568716 - DNA, 18 bp, Homo sapiens
tgctcaaaattgcttcta

SEQ ID NO: 3568717 - DNA, 16 bp, Homo sapiens
tgctcaacccccctcc

SEQ ID NO: 3568718 - DNA, 13 bp, Homo sapiens
tgctcaatttcag

SEQ ID NO: 3568719 - DNA, 15 bp, Homo sapiens
tgctcaatttcagca

SEQ ID NO: 3568720 - DNA, 13 bp, Homo sapiens
tgctcagacagaa

SEQ ID NO: 3568721 - DNA, 14 bp, Homo sapiens
tgctcagaccagct

SEQ ID NO: 3568722 - DNA, 16 bp, Homo sapiens
tgctcagaccagctct

SEQ ID NO: 3568723 - DNA, 13 bp, Homo sapiens
tgctcagccctgc

SEQ ID NO: 3568724 - DNA, 20 bp, Homo sapiens
tgctcagctgtcaaggctca

SEQ ID NO: 3568725 - DNA, 21 bp, Homo sapiens
tgctcagcttctcctgtgtga

SEQ ID NO: 3568726 - DNA, 22 bp, Homo sapiens
tgctcagggaaaagcagctctc

SEQ ID NO: 3568727 - DNA, 17 bp, Homo sapiens
tgctcagtaatttgagg

SEQ ID NO: 3568728 - DNA, 16 bp, Homo sapiens
tgctcatctgttgtag

SEQ ID NO: 3568729 - DNA, 15 bp, Homo sapiens
tgctcattaattttg

SEQ ID NO: 3568730 - DNA, 14 bp, Homo sapiens
tgctccaactccat

SEQ ID NO: 3568731 - DNA, 23 bp, Homo sapiens
tgctccaactccatactccactc

SEQ ID NO: 3568732 - DNA, 20 bp, Homo sapiens
tgctccaagatgttctcctg

SEQ ID NO: 3568733 - DNA, 20 bp, Homo sapiens
tgctccacactcagaaaatt

SEQ ID NO: 3568734 - DNA, 12 bp, Homo sapiens
tgctccagaaga

SEQ ID NO: 3568735 - DNA, 20 bp, Homo sapiens
tgctccagaagatgccagct

SEQ ID NO: 3568736 - DNA, 14 bp, Homo sapiens
tgctccagacctga

SEQ ID NO: 3568737 - DNA, 21 bp, Homo sapiens
tgctccagacctgatcctgga

SEQ ID NO: 3568738 - DNA, 23 bp, Homo sapiens
tgctcccctaaagccaggctcag

SEQ ID NO: 3568739 - DNA, 21 bp, Homo sapiens
tgctccgtagctctgctgctg

SEQ ID NO: 3568740 - DNA, 14 bp, Homo sapiens
tgctcctagaggga

SEQ ID NO: 3568741 - DNA, 15 bp, Homo sapiens
tgctcctctcttggg

SEQ ID NO: 3568742 - DNA, 19 bp, Homo sapiens
tgctcctcttgttcctgaa

SEQ ID NO: 3568743 - DNA, 20 bp, Homo sapiens
tgctcctcttgttcctgaaa

SEQ ID NO: 3568744 - DNA, 11 bp, Homo sapiens
tgctcctgctt

SEQ ID NO: 3568745 - DNA, 12 bp, Homo sapiens
tgctcctgggca

SEQ ID NO: 3568746 - DNA, 16 bp, Homo sapiens
tgctccttggcacccc

SEQ ID NO: 3568747 - DNA, 15 bp, Homo sapiens
tgctcggctactggt

SEQ ID NO: 3568748 - DNA, 15 bp, Homo sapiens
tgctttgtgttcagt

SEQ ID NO: 3568749 - DNA, 17 bp, Homo sapiens
tgcttttatattctaat

SEQ ID NO: 3568750 - DNA, 19 bp, Homo sapiens
tgcttttatattctaatag

SEQ ID NO: 3568751 - DNA, 15 bp, Homo sapiens
tgcttttctgtcctg

SEQ ID NO: 3568752 - DNA, 19 bp, Homo sapiens
tgcttttctgtcctgggca

SEQ ID NO: 3568753 - DNA, 15 bp, Homo sapiens
tgcttttggcagaga

SEQ ID NO: 3568754 - DNA, 15 bp, Homo sapiens
tgctttttttggcct

SEQ ID NO: 3568755 - DNA, 20 bp, Homo sapiens
tggaaaaaccacccccaaat

SEQ ID NO: 3568756 - DNA, 13 bp, Homo sapiens
tggaaaataaaca

SEQ ID NO: 3568757 - DNA, 16 bp, Homo sapiens
tggaaacactgatttt

SEQ ID NO: 3568758 - DNA, 12 bp, Homo sapiens
tggaaacagcat

SEQ ID NO: 3568759 - DNA, 14 bp, Homo sapiens
tggaaacagcatga

SEQ ID NO: 3568760 - DNA, 23 bp, Homo sapiens
tggaaagcacaagactggcccag

SEQ ID NO: 3568761 - DNA, 19 bp, Homo sapiens
tggaaagcagagcctcctg

SEQ ID NO: 3568762 - DNA, 14 bp, Homo sapiens
tggaaataaagtca

SEQ ID NO: 3568763 - DNA, 18 bp, Homo sapiens
tggaaatcaaatgtaaag

SEQ ID NO: 3568764 - DNA, 12 bp, Homo sapiens
tggaacagtgta

SEQ ID NO: 3568765 - DNA, 17 bp, Homo sapiens
tgcatgtagcatataaa

SEQ ID NO: 3568766 - DNA, 16 bp, Homo sapiens
tgcatgtttgaaatga

SEQ ID NO: 3568767 - DNA, 18 bp, Homo sapiens
tgcattaaaatttcttat

SEQ ID NO: 3568768 - DNA, 19 bp, Homo sapiens
tgcattaaaatttcttatt

SEQ ID NO: 3568769 - DNA, 22 bp, Homo sapiens
tgcattaccagcttaaaacact

SEQ ID NO: 3568770 - DNA, 23 bp, Homo sapiens
tgcattaccagcttaaaacactt

SEQ ID NO: 3568771 - DNA, 19 bp, Homo sapiens
tgcattcctgtgccctaga

SEQ ID NO: 3568772 - DNA, 20 bp, Homo sapiens
tgcattctctcccatcctgg

SEQ ID NO: 3568773 - DNA, 21 bp, Homo sapiens
tgcattctctcccatcctggg

SEQ ID NO: 3568774 - DNA, 21 bp, Homo sapiens
tgcattgactttcagtaaaca

SEQ ID NO: 3568775 - DNA, 17 bp, Homo sapiens
tgcattgaggaaatatt

SEQ ID NO: 3568776 - DNA, 20 bp, Homo sapiens
tgcattgaggaaatattaat

SEQ ID NO: 3568777 - DNA, 18 bp, Homo sapiens
tgcattgccgctgtataa

SEQ ID NO: 3568778 - DNA, 18 bp, Homo sapiens
tgcatttataaagaccgt

SEQ ID NO: 3568779 - DNA, 14 bp, Homo sapiens
tgcatttatatgta

SEQ ID NO: 3568780 - DNA, 14 bp, Homo sapiens
tgcatttcctgaca

SEQ ID NO: 3568781 - DNA, 20 bp, Homo sapiens
tgcatttgtttgctgaaatt

SEQ ID NO: 3568782 - DNA, 19 bp, Homo sapiens
tgcattttaaccctatttt

SEQ ID NO: 3568783 - DNA, 15 bp, Homo sapiens
tgcatttttaccttt

SEQ ID NO: 3568784 - DNA, 22 bp, Homo sapiens
tgccaaaacccagctgcacccc

SEQ ID NO: 3568785 - DNA, 17 bp, Homo sapiens
tgccaaaatgctctagt

SEQ ID NO: 3568786 - DNA, 18 bp, Homo sapiens
tgccaaaatgctctagtg

SEQ ID NO: 3568787 - DNA, 18 bp, Homo sapiens
tgccaactgccaggctgc

SEQ ID NO: 3568788 - DNA, 23 bp, Homo sapiens
tgccaagagctactcccacagca

SEQ ID NO: 3568789 - DNA, 17 bp, Homo sapiens
tgccaagccagattctc

SEQ ID NO: 3568790 - DNA, 22 bp, Homo sapiens
tgccaagccagattctcttgaa

SEQ ID NO: 3568791 - DNA, 13 bp, Homo sapiens
tgccaaggagcat

SEQ ID NO: 3568792 - DNA, 17 bp, Homo sapiens
tgccaataaagcttttg

SEQ ID NO: 3568793 - DNA, 19 bp, Homo sapiens
tgccaataaattctaaatt

SEQ ID NO: 3568794 - DNA, 20 bp, Homo sapiens
tgccaataaattctaaatta

SEQ ID NO: 3568795 - DNA, 22 bp, Homo sapiens
tgccaataaattctaaattaca

SEQ ID NO: 3568796 - DNA, 16 bp, Homo sapiens
tgccaatctaaaatgg

SEQ ID NO: 3568797 - DNA, 16 bp, Homo sapiens
tgccaatctcaacacc

SEQ ID NO: 3568798 - DNA, 23 bp, Homo sapiens
tgccacagagaagtttgtagcca

SEQ ID NO: 3568799 - DNA, 20 bp, Homo sapiens
tgccacaggcttagggacag

SEQ ID NO: 3568800 - DNA, 16 bp, Homo sapiens
tgccacccacctccct

SEQ ID NO: 3568801 - DNA, 22 bp, Homo sapiens
tgccacccacctccctgcctcc

SEQ ID NO: 3568802 - DNA, 17 bp, Homo sapiens
tgccacccagccccagc

SEQ ID NO: 3568803 - DNA, 20 bp, Homo sapiens
tgccacccagccccagccag

SEQ ID NO: 3568804 - DNA, 19 bp, Homo sapiens
tgccacccccttccctggg

SEQ ID NO: 3568805 - DNA, 17 bp, Homo sapiens
tgccaccccgagggctg

SEQ ID NO: 3568806 - DNA, 13 bp, Homo sapiens
tgccactccttgt

SEQ ID NO: 3568807 - DNA, 17 bp, Homo sapiens
tgccactgcctcttcct

SEQ ID NO: 3568808 - DNA, 20 bp, Homo sapiens
tgccactgcctcttcctccc

SEQ ID NO: 3568809 - DNA, 21 bp, Homo sapiens
tgccactgggacagctggctg

SEQ ID NO: 3568810 - DNA, 22 bp, Homo sapiens
tgccactgggacagctggctgg

SEQ ID NO: 3568811 - DNA, 18 bp, Homo sapiens
tgccagagaggtggggat

SEQ ID NO: 3568812 - DNA, 15 bp, Homo sapiens
tgccagcaaataaat

SEQ ID NO: 3568813 - DNA, 16 bp, Homo sapiens
tgccagcaaataaata

SEQ ID NO: 3568814 - DNA, 23 bp, Homo sapiens
tgccagcaaataaatacgtgtca

SEQ ID NO: 3568815 - DNA, 13 bp, Homo sapiens
tgccagcttctct

SEQ ID NO: 3568816 - DNA, 14 bp, Homo sapiens
tgccagcttctctc

SEQ ID NO: 3568817 - DNA, 18 bp, Homo sapiens
tgccagcttctctctcca

SEQ ID NO: 3568818 - DNA, 19 bp, Homo sapiens
tgccagcttctctctccag

SEQ ID NO: 3568819 - DNA, 22 bp, Homo sapiens
tgccagcttctctctccagggt

SEQ ID NO: 3568820 - DNA, 18 bp, Homo sapiens
tgccaggggctctgtggc

SEQ ID NO: 3568821 - DNA, 17 bp, Homo sapiens
tgccagtccccctgccc

SEQ ID NO: 3568822 - DNA, 18 bp, Homo sapiens
tgccagtttaaaaagatg

SEQ ID NO: 3568823 - DNA, 16 bp, Homo sapiens
tgccagttttccctgg

SEQ ID NO: 3568824 - DNA, 18 bp, Homo sapiens
tgccagttttccctggaa

SEQ ID NO: 3568825 - DNA, 16 bp, Homo sapiens
tgccatctctgctcca

SEQ ID NO: 3568826 - DNA, 13 bp, Homo sapiens
tgccatgctgggc

SEQ ID NO: 3568827 - DNA, 23 bp, Homo sapiens
tgccatgctgggccactggggac

SEQ ID NO: 3568828 - DNA, 21 bp, Homo sapiens
tgccatggaattccctcctga

SEQ ID NO: 3568829 - DNA, 22 bp, Homo sapiens
tgccatttaaagcttattaaaa

SEQ ID NO: 3568830 - DNA, 23 bp, Homo sapiens
tgccatttgcttgtactgggaca

SEQ ID NO: 3568831 - DNA, 21 bp, Homo sapiens
tgcccaaacccttaactgaca

SEQ ID NO: 3568832 - DNA, 18 bp, Homo sapiens
tgcccaacctgctctcct

SEQ ID NO: 3568833 - DNA, 23 bp, Homo sapiens
tgcccaagaatagatgctgactg

SEQ ID NO: 3568834 - DNA, 17 bp, Homo sapiens
tgcccacccctcactcc

SEQ ID NO: 3568835 - DNA, 21 bp, Homo sapiens
tgcccacccctcactccccag

SEQ ID NO: 3568836 - DNA, 20 bp, Homo sapiens
tgcccacgagggtctcccct

SEQ ID NO: 3568837 - DNA, 18 bp, Homo sapiens
tgcccaggctggagtgca

SEQ ID NO: 3568838 - DNA, 14 bp, Homo sapiens
tgcccaggggagcc

SEQ ID NO: 3568839 - DNA, 19 bp, Homo sapiens
tgcccagtaaaatttcagg

SEQ ID NO: 3568840 - DNA, 20 bp, Homo sapiens
tgcccagtaaaatttcagga

SEQ ID NO: 3568841 - DNA, 17 bp, Homo sapiens
tgcccagtcgaccccaa

SEQ ID NO: 3568842 - DNA, 17 bp, Homo sapiens
tgcccatgcaccttcca

SEQ ID NO: 3568843 - DNA, 16 bp, Homo sapiens
tgcccatgggagctgg

SEQ ID NO: 3568844 - DNA, 20 bp, Homo sapiens
tgccccaagtggtgagcaag

SEQ ID NO: 3568845 - DNA, 20 bp, Homo sapiens
tgccccacaaaacttcagtg

SEQ ID NO: 3568846 - DNA, 22 bp, Homo sapiens
tgccccaccactccccaacccc

SEQ ID NO: 3568847 - DNA, 13 bp, Homo sapiens
tgccccagcctgt

SEQ ID NO: 3568848 - DNA, 15 bp, Homo sapiens
tgccccagggctccc

SEQ ID NO: 3568849 - DNA, 12 bp, Homo sapiens
tgccccagtgtt

SEQ ID NO: 3568850 - DNA, 20 bp, Homo sapiens
tgccccatccagacctggct

SEQ ID NO: 3568851 - DNA, 21 bp, Homo sapiens
tgccccatccagacctggctc

SEQ ID NO: 3568852 - DNA, 18 bp, Homo sapiens
tgccccatcctccagcag

SEQ ID NO: 3568853 - DNA, 17 bp, Homo sapiens
tgcccccactgaccaga

SEQ ID NO: 3568854 - DNA, 13 bp, Homo sapiens
tgcccccagaaag

SEQ ID NO: 3568855 - DNA, 20 bp, Homo sapiens
tgccccccctaagagacaca

SEQ ID NO: 3568856 - DNA, 21 bp, Homo sapiens
tgcccccgctcccgctcccag

SEQ ID NO: 3568857 - DNA, 20 bp, Homo sapiens
tgccccctcccccatgggct

SEQ ID NO: 3568858 - DNA, 12 bp, Homo sapiens
tgccccctgcca

SEQ ID NO: 3568859 - DNA, 12 bp, Homo sapiens
tgccccctgggc

SEQ ID NO: 3568860 - DNA, 16 bp, Homo sapiens
tgccccctgggctggg

SEQ ID NO: 3568861 - DNA, 21 bp, Homo sapiens
tgccccgagcccaggcagcta

SEQ ID NO: 3568862 - DNA, 15 bp, Homo sapiens
tgccccggcctcctc

SEQ ID NO: 3568863 - DNA, 13 bp, Homo sapiens
tgcccctaaagag

SEQ ID NO: 3568864 - DNA, 21 bp, Homo sapiens
tgcccctaaagagcatcctga

SEQ ID NO: 3568865 - DNA, 22 bp, Homo sapiens
tgcccctaaagagcatcctgat

SEQ ID NO: 3568866 - DNA, 15 bp, Homo sapiens
tgcccctcccttcaa

SEQ ID NO: 3568867 - DNA, 16 bp, Homo sapiens
tgcccctgcctgacag

SEQ ID NO: 3568868 - DNA, 14 bp, Homo sapiens
tgcccctggccttg

SEQ ID NO: 3568869 - DNA, 17 bp, Homo sapiens
tgcccctggctttgcct

SEQ ID NO: 3568870 - DNA, 21 bp, Homo sapiens
tgcccctggctttgcctcttc

SEQ ID NO: 3568871 - DNA, 12 bp, Homo sapiens
tgcccctgtctg

SEQ ID NO: 3568872 - DNA, 14 bp, Homo sapiens
tgccccttccctgg

SEQ ID NO: 3568873 - DNA, 15 bp, Homo sapiens
tgccccttccctggg

SEQ ID NO: 3568874 - DNA, 18 bp, Homo sapiens
tgccccttccctgggttt

SEQ ID NO: 3568875 - DNA, 16 bp, Homo sapiens
tgcccgactgactgga

SEQ ID NO: 3568876 - DNA, 18 bp, Homo sapiens
tgcccgactgactggagg

SEQ ID NO: 3568877 - DNA, 15 bp, Homo sapiens
tgcccgcatgtgtgc

SEQ ID NO: 3568878 - DNA, 14 bp, Homo sapiens
tgcccgcctaagac

SEQ ID NO: 3568879 - DNA, 18 bp, Homo sapiens
tgcccgcctaagaccctg

SEQ ID NO: 3568880 - DNA, 20 bp, Homo sapiens
tgcccgcctaagaccctgaa

SEQ ID NO: 3568881 - DNA, 14 bp, Homo sapiens
tgcccgctcccaca

SEQ ID NO: 3568882 - DNA, 18 bp, Homo sapiens
tgcccggggaaaggcaag

SEQ ID NO: 3568883 - DNA, 21 bp, Homo sapiens
tgcccggggaaaggcaaggtc

SEQ ID NO: 3568884 - DNA, 23 bp, Homo sapiens
tgccctaagcccccagggcctcc

SEQ ID NO: 3568885 - DNA, 13 bp, Homo sapiens
tgccctaattaaa

SEQ ID NO: 3568886 - DNA, 14 bp, Homo sapiens
tgccctagctgacc

SEQ ID NO: 3568887 - DNA, 18 bp, Homo sapiens
tgccctcaagtaaaagaa

SEQ ID NO: 3568888 - DNA, 18 bp, Homo sapiens
tgccctcattttatgtca

SEQ ID NO: 3568889 - DNA, 22 bp, Homo sapiens
tgccctcctaaatgtcagctgt

SEQ ID NO: 3568890 - DNA, 15 bp, Homo sapiens
tgccctcctctccca

SEQ ID NO: 3568891 - DNA, 22 bp, Homo sapiens
tgccctctatttattagccaac

SEQ ID NO: 3568892 - DNA, 21 bp, Homo sapiens
tgccctgcccaacctctgtgg

SEQ ID NO: 3568893 - DNA, 14 bp, Homo sapiens
tgccctgggctcct

SEQ ID NO: 3568894 - DNA, 15 bp, Homo sapiens
tgccctgggctcctc

SEQ ID NO: 3568895 - DNA, 18 bp, Homo sapiens
tgccctggtgctgccaca

SEQ ID NO: 3568896 - DNA, 22 bp, Homo sapiens
tgaccccgagaagtgctcttgg

SEQ ID NO: 3568897 - DNA, 15 bp, Homo sapiens
tgaccccgccatgca

SEQ ID NO: 3568898 - DNA, 15 bp, Homo sapiens
tgaccccttccctgt

SEQ ID NO: 3568899 - DNA, 18 bp, Homo sapiens
tgaccctcaggcacacct

SEQ ID NO: 3568900 - DNA, 19 bp, Homo sapiens
tgaccctcaggcacacctt

SEQ ID NO: 3568901 - DNA, 20 bp, Homo sapiens
tgacccttacagcctctgac

SEQ ID NO: 3568902 - DNA, 12 bp, Homo sapiens
tgaccgagagaa

SEQ ID NO: 3568903 - DNA, 16 bp, Homo sapiens
tgaccgagagaacctc

SEQ ID NO: 3568904 - DNA, 14 bp, Homo sapiens
tgaccgagccctgg

SEQ ID NO: 3568905 - DNA, 15 bp, Homo sapiens
tgaccgagccctgga

SEQ ID NO: 3568906 - DNA, 20 bp, Homo sapiens
tgaccgatgtgtctcccaga

SEQ ID NO: 3568907 - DNA, 18 bp, Homo sapiens
tgacctaccccagccagg

SEQ ID NO: 3568908 - DNA, 15 bp, Homo sapiens
tgacctcccaactct

SEQ ID NO: 3568909 - DNA, 10 bp, Homo sapiens
tgacctgccc

SEQ ID NO: 3568910 - DNA, 15 bp, Homo sapiens
tgaccttgaatcttt

SEQ ID NO: 3568911 - DNA, 22 bp, Homo sapiens
tgacggaaacaacgttgctatt

SEQ ID NO: 3568912 - DNA, 21 bp, Homo sapiens
tgacggcagggaaatgtatgt

SEQ ID NO: 3568913 - DNA, 21 bp, Homo sapiens
tgacgtgctccgtagctctgc

SEQ ID NO: 3568914 - DNA, 19 bp, Homo sapiens
tgactaaactttttttctg

SEQ ID NO: 3568915 - DNA, 21 bp, Homo sapiens
tgactaaactttttttctgta

SEQ ID NO: 3568916 - DNA, 16 bp, Homo sapiens
tgactagaactcctgt

SEQ ID NO: 3568917 - DNA, 12 bp, Homo sapiens
tgactatgtaaa

SEQ ID NO: 3568918 - DNA, 22 bp, Homo sapiens
tgactccagggtgacaaggcct

SEQ ID NO: 3568919 - DNA, 15 bp, Homo sapiens
tgactccccagccca

SEQ ID NO: 3568920 - DNA, 17 bp, Homo sapiens
tgactccccagcccagc

SEQ ID NO: 3568921 - DNA, 19 bp, Homo sapiens
tgactccccagcccagcac

SEQ ID NO: 3568922 - DNA, 12 bp, Homo sapiens
tgactccctggg

SEQ ID NO: 3568923 - DNA, 15 bp, Homo sapiens
tgactccctgggagc

SEQ ID NO: 3568924 - DNA, 17 bp, Homo sapiens
tgactcctgctggtacc

SEQ ID NO: 3568925 - DNA, 22 bp, Homo sapiens
tgactcctgctggtacctgccc

SEQ ID NO: 3568926 - DNA, 12 bp, Homo sapiens
tgactcctgttg

SEQ ID NO: 3568927 - DNA, 19 bp, Homo sapiens
tgactcctgttgccatgga

SEQ ID NO: 3568928 - DNA, 16 bp, Homo sapiens
tgactcttacacactg

SEQ ID NO: 3568929 - DNA, 20 bp, Homo sapiens
tgactcttagccctcaccac

SEQ ID NO: 3568930 - DNA, 14 bp, Homo sapiens
tgactgaaggaaaa

SEQ ID NO: 3568931 - DNA, 14 bp, Homo sapiens
tgactgaatgctgt

SEQ ID NO: 3568932 - DNA, 15 bp, Homo sapiens
tgactgatgattttc

SEQ ID NO: 3568933 - DNA, 16 bp, Homo sapiens
tgactgccaagccaga

SEQ ID NO: 3568934 - DNA, 21 bp, Homo sapiens
tgactgccaagccagattctc

SEQ ID NO: 3568935 - DNA, 23 bp, Homo sapiens
tgactggaggaggcctgtcccaa

SEQ ID NO: 3568936 - DNA, 22 bp, Homo sapiens
tgactgtactcctcccaggcgc

SEQ ID NO: 3568937 - DNA, 13 bp, Homo sapiens
tgactgtcactgt

SEQ ID NO: 3568938 - DNA, 16 bp, Homo sapiens
tgactgtcactgttcc

SEQ ID NO: 3568939 - DNA, 14 bp, Homo sapiens
tgactgtcagcaag

SEQ ID NO: 3568940 - DNA, 15 bp, Homo sapiens
tgacttatagtacat

SEQ ID NO: 3568941 - DNA, 20 bp, Homo sapiens
tgacttatttctgctctgga

SEQ ID NO: 3568942 - DNA, 20 bp, Homo sapiens
tgacttcagtgaatattttt

SEQ ID NO: 3568943 - DNA, 22 bp, Homo sapiens
tgacttctaagtaaaaccacag

SEQ ID NO: 3568944 - DNA, 22 bp, Homo sapiens
tgacttgaaaagaaagaaacca

SEQ ID NO: 3568945 - DNA, 12 bp, Homo sapiens
tgacttgtatat

SEQ ID NO: 3568946 - DNA, 14 bp, Homo sapiens
tgacttgtttgttt

SEQ ID NO: 3568947 - DNA, 14 bp, Homo sapiens
tgactttcagtaaa

SEQ ID NO: 3568948 - DNA, 14 bp, Homo sapiens
tgactttccagaat

SEQ ID NO: 3568949 - DNA, 14 bp, Homo sapiens
tgactttgcagatg

SEQ ID NO: 3568950 - DNA, 18 bp, Homo sapiens
tgactttggtttttccaa

SEQ ID NO: 3568951 - DNA, 19 bp, Homo sapiens
tgactttggtttttccaac

SEQ ID NO: 3568952 - DNA, 15 bp, Homo sapiens
tgagaaacagctcag

SEQ ID NO: 3568953 - DNA, 21 bp, Homo sapiens
tgagaaacagctcagccagtg

SEQ ID NO: 3568954 - DNA, 15 bp, Homo sapiens
tgagaaactgctgca

SEQ ID NO: 3568955 - DNA, 16 bp, Homo sapiens
tgagaaccttttcaaa

SEQ ID NO: 3568956 - DNA, 17 bp, Homo sapiens
tgagaaccttttcaaac

SEQ ID NO: 3568957 - DNA, 13 bp, Homo sapiens
tgagaaggggcag

SEQ ID NO: 3568958 - DNA, 18 bp, Homo sapiens
tgagaatctatatttaac

SEQ ID NO: 3568959 - DNA, 18 bp, Homo sapiens
tgagaatggcctggagca

SEQ ID NO: 3568960 - DNA, 20 bp, Homo sapiens
tgagacaggtgcctaacctg

SEQ ID NO: 3568961 - DNA, 13 bp, Homo sapiens
tgagacatccagc

SEQ ID NO: 3568962 - DNA, 14 bp, Homo sapiens
tgagactcctcagc

SEQ ID NO: 3568963 - DNA, 18 bp, Homo sapiens
tgagactcctcagcaccc

SEQ ID NO: 3568964 - DNA, 23 bp, Homo sapiens
tgagagaaagagagaagccagcc

SEQ ID NO: 3568965 - DNA, 15 bp, Homo sapiens
tgagagaccctggcc

SEQ ID NO: 3568966 - DNA, 13 bp, Homo sapiens
tgagagcataatt

SEQ ID NO: 3568967 - DNA, 18 bp, Homo sapiens
tgagagcatctcaggagg

SEQ ID NO: 3568968 - DNA, 14 bp, Homo sapiens
tgagagtcaaagct

SEQ ID NO: 3568969 - DNA, 16 bp, Homo sapiens
tgagagtcaaagctga

SEQ ID NO: 3568970 - DNA, 16 bp, Homo sapiens
tgagatactgtgtata

SEQ ID NO: 3568971 - DNA, 16 bp, Homo sapiens
tgagatattaaattct

SEQ ID NO: 3568972 - DNA, 23 bp, Homo sapiens
tgagatgccccgagcccaggcag

SEQ ID NO: 3568973 - DNA, 20 bp, Homo sapiens
tgagatggagtttctctctt

SEQ ID NO: 3568974 - DNA, 16 bp, Homo sapiens
tgagatgtagaaagtt

SEQ ID NO: 3568975 - DNA, 18 bp, Homo sapiens
tgagatgtgaacacatca

SEQ ID NO: 3568976 - DNA, 20 bp, Homo sapiens
tgagattcaagacaagagct

SEQ ID NO: 3568977 - DNA, 18 bp, Homo sapiens
tgagcaagcaccaacctc

SEQ ID NO: 3568978 - DNA, 20 bp, Homo sapiens
tgagcaagcaccaacctcca

SEQ ID NO: 3568979 - DNA, 16 bp, Homo sapiens
tgagcacaaagaagaa

SEQ ID NO: 3568980 - DNA, 15 bp, Homo sapiens
tgagcaggattttaa

SEQ ID NO: 3568981 - DNA, 16 bp, Homo sapiens
tgagcaggtacatttc

SEQ ID NO: 3568982 - DNA, 18 bp, Homo sapiens
tgagcaggtacatttctg

SEQ ID NO: 3568983 - DNA, 23 bp, Homo sapiens
tgagcaggtacatttctgattct

SEQ ID NO: 3568984 - DNA, 16 bp, Homo sapiens
tgagcagtcgcctgcc

SEQ ID NO: 3568985 - DNA, 17 bp, Homo sapiens
tgagcagtcgcctgcct

SEQ ID NO: 3568986 - DNA, 20 bp, Homo sapiens
tgagcagtcgcctgcctgca

SEQ ID NO: 3568987 - DNA, 21 bp, Homo sapiens
tgagcagtgttgcgtttttcc

SEQ ID NO: 3568988 - DNA, 21 bp, Homo sapiens
tgagcagttgttatattcatt

SEQ ID NO: 3568989 - DNA, 16 bp, Homo sapiens
tgagcatggagacagc

SEQ ID NO: 3568990 - DNA, 17 bp, Homo sapiens
tgagcatggagacagca

SEQ ID NO: 3568991 - DNA, 17 bp, Homo sapiens
tgagcatggcagctggt

SEQ ID NO: 3568992 - DNA, 14 bp, Homo sapiens
tgagcatggggcca

SEQ ID NO: 3568993 - DNA, 18 bp, Homo sapiens
tgagcatggggccaggaa

SEQ ID NO: 3568994 - DNA, 12 bp, Homo sapiens
tgagccagcagg

SEQ ID NO: 3568995 - DNA, 13 bp, Homo sapiens
tgagccagcaggg

SEQ ID NO: 3568996 - DNA, 15 bp, Homo sapiens
tgagcccatttctgg

SEQ ID NO: 3568997 - DNA, 16 bp, Homo sapiens
tgagcccctccccagc

SEQ ID NO: 3568998 - DNA, 18 bp, Homo sapiens
tgagcccctccccagcca

SEQ ID NO: 3568999 - DNA, 16 bp, Homo sapiens
tgagcggcaccctggt

SEQ ID NO: 3569000 - DNA, 15 bp, Homo sapiens
tgagctacaggacaa

SEQ ID NO: 3569001 - DNA, 23 bp, Homo sapiens
tgagctcttcccttattcctaat

SEQ ID NO: 3569002 - DNA, 15 bp, Homo sapiens
tgagctggcaaccag

SEQ ID NO: 3569003 - DNA, 18 bp, Homo sapiens
tgagctggcaaccagcca

SEQ ID NO: 3569004 - DNA, 20 bp, Homo sapiens
tgaaggaataaattgctcct

SEQ ID NO: 3569005 - DNA, 10 bp, Homo sapiens
tgaaggaatt

SEQ ID NO: 3569006 - DNA, 13 bp, Homo sapiens
tgaaggagaatgg

SEQ ID NO: 3569007 - DNA, 15 bp, Homo sapiens
tgaagggccagagcc

SEQ ID NO: 3569008 - DNA, 17 bp, Homo sapiens
tgaagggccagagccag

SEQ ID NO: 3569009 - DNA, 22 bp, Homo sapiens
tgaaggggccaaggagggtgag

SEQ ID NO: 3569010 - DNA, 10 bp, Homo sapiens
tgaaggggcg

SEQ ID NO: 3569011 - DNA, 15 bp, Homo sapiens
tgaaggggttttctt

SEQ ID NO: 3569012 - DNA, 16 bp, Homo sapiens
tgaagggtgcctagtt

SEQ ID NO: 3569013 - DNA, 13 bp, Homo sapiens
tgaagtagaagtt

SEQ ID NO: 3569014 - DNA, 23 bp, Homo sapiens
tgaagtcacccctttctgtccca

SEQ ID NO: 3569015 - DNA, 13 bp, Homo sapiens
tgaagtccttcag

SEQ ID NO: 3569016 - DNA, 23 bp, Homo sapiens
tgaagtccttcagtgagcccctc

SEQ ID NO: 3569017 - DNA, 17 bp, Homo sapiens
tgaagtctgagcccatt

SEQ ID NO: 3569018 - DNA, 17 bp, Homo sapiens
tgaagtgcacaggagcc

SEQ ID NO: 3569019 - DNA, 16 bp, Homo sapiens
tgaagtgccttaaata

SEQ ID NO: 3569020 - DNA, 18 bp, Homo sapiens
tgaagtgctgtttattaa

SEQ ID NO: 3569021 - DNA, 14 bp, Homo sapiens
tgaagttcatcttg

SEQ ID NO: 3569022 - DNA, 19 bp, Homo sapiens
tgaagtttaattgtctcaa

SEQ ID NO: 3569023 - DNA, 16 bp, Homo sapiens
tgaagtttttgaaata

SEQ ID NO: 3569024 - DNA, 16 bp, Homo sapiens
tgaataaaacactcat

SEQ ID NO: 3569025 - DNA, 16 bp, Homo sapiens
tgaataaagacaccta

SEQ ID NO: 3569026 - DNA, 13 bp, Homo sapiens
tgaatacattaac

SEQ ID NO: 3569027 - DNA, 17 bp, Homo sapiens
tgaatacatttgtattt

SEQ ID NO: 3569028 - DNA, 16 bp, Homo sapiens
tgaatacttattttca

SEQ ID NO: 3569029 - DNA, 20 bp, Homo sapiens
tgaatacttattttcagtgc

SEQ ID NO: 3569030 - DNA, 12 bp, Homo sapiens
tgaatatatgat

SEQ ID NO: 3569031 - DNA, 23 bp, Homo sapiens
tgaatatgtagtatctatatgac

SEQ ID NO: 3569032 - DNA, 22 bp, Homo sapiens
tgaatatgtcatcactctaggt

SEQ ID NO: 3569033 - DNA, 13 bp, Homo sapiens
tgaatctgtctat

SEQ ID NO: 3569034 - DNA, 20 bp, Homo sapiens
tgaatctttttatcccattt

SEQ ID NO: 3569035 - DNA, 23 bp, Homo sapiens
tgaatctttttatcccatttagt

SEQ ID NO: 3569036 - DNA, 15 bp, Homo sapiens
tgaatgaaaataact

SEQ ID NO: 3569037 - DNA, 19 bp, Homo sapiens
tgaatgactccactgtttt

SEQ ID NO: 3569038 - DNA, 15 bp, Homo sapiens
tgaatgcagaaaaca

SEQ ID NO: 3569039 - DNA, 18 bp, Homo sapiens
tgaatgcctcgctccctt

SEQ ID NO: 3569040 - DNA, 22 bp, Homo sapiens
tgaatggacggtttaggtgaaa

SEQ ID NO: 3569041 - DNA, 15 bp, Homo sapiens
tgaatgggcatttct

SEQ ID NO: 3569042 - DNA, 19 bp, Homo sapiens
tgaatgggcatttctaaaa

SEQ ID NO: 3569043 - DNA, 15 bp, Homo sapiens
tgaatgtcagttgtt

SEQ ID NO: 3569044 - DNA, 22 bp, Homo sapiens
tgaatgtcagttgttatttatt

SEQ ID NO: 3569045 - DNA, 20 bp, Homo sapiens
tgaatgtggctgaagttgaa

SEQ ID NO: 3569046 - DNA, 19 bp, Homo sapiens
tgaattaatatccctacat

SEQ ID NO: 3569047 - DNA, 20 bp, Homo sapiens
tgaattaggctgtaactact

SEQ ID NO: 3569048 - DNA, 15 bp, Homo sapiens
tgaattagttttaaa

SEQ ID NO: 3569049 - DNA, 19 bp, Homo sapiens
tgaattcaccacagacttt

SEQ ID NO: 3569050 - DNA, 15 bp, Homo sapiens
tgaattcatttcact

SEQ ID NO: 3569051 - DNA, 15 bp, Homo sapiens
tgaattggaaagact

SEQ ID NO: 3569052 - DNA, 16 bp, Homo sapiens
tgaatttttttttcct

SEQ ID NO: 3569053 - DNA, 20 bp, Homo sapiens
tgaatttttttttcctagcc

SEQ ID NO: 3569054 - DNA, 18 bp, Homo sapiens
tgacaaaaggctccagtt

SEQ ID NO: 3569055 - DNA, 16 bp, Homo sapiens
tgacaaaattcatttg

SEQ ID NO: 3569056 - DNA, 18 bp, Homo sapiens
tgacaaaattcatttgct

SEQ ID NO: 3569057 - DNA, 19 bp, Homo sapiens
tgacaaaattcatttgctt

SEQ ID NO: 3569058 - DNA, 12 bp, Homo sapiens
tgacaacacagc

SEQ ID NO: 3569059 - DNA, 12 bp, Homo sapiens
tgacaacactta

SEQ ID NO: 3569060 - DNA, 15 bp, Homo sapiens
tgacaacacttaata

SEQ ID NO: 3569061 - DNA, 13 bp, Homo sapiens
tgacaacctccat

SEQ ID NO: 3569062 - DNA, 15 bp, Homo sapiens
tgacaactgtgaagc

SEQ ID NO: 3569063 - DNA, 15 bp, Homo sapiens
tgacaaggcctgctt

SEQ ID NO: 3569064 - DNA, 15 bp, Homo sapiens
tgacaattttaccta

SEQ ID NO: 3569065 - DNA, 22 bp, Homo sapiens
tgacacaccaggcgctaattca

SEQ ID NO: 3569066 - DNA, 23 bp, Homo sapiens
tgacacaccaggcgctaattcaa

SEQ ID NO: 3569067 - DNA, 17 bp, Homo sapiens
tgacacaggtctttcct

SEQ ID NO: 3569068 - DNA, 18 bp, Homo sapiens
tgacacaggtctttccta

SEQ ID NO: 3569069 - DNA, 23 bp, Homo sapiens
tgacaccacacttgttttctttg

SEQ ID NO: 3569070 - DNA, 14 bp, Homo sapiens
tgacaccctggcct

SEQ ID NO: 3569071 - DNA, 15 bp, Homo sapiens
tgacaccctggcctg

SEQ ID NO: 3569072 - DNA, 18 bp, Homo sapiens
tgacaccctggcctgaac

SEQ ID NO: 3569073 - DNA, 18 bp, Homo sapiens
tgacaccgtgggtcatta

SEQ ID NO: 3569074 - DNA, 13 bp, Homo sapiens
tgacacctccccc

SEQ ID NO: 3569075 - DNA, 21 bp, Homo sapiens
tgacactaaactccatgatat

SEQ ID NO: 3569076 - DNA, 16 bp, Homo sapiens
tgacactgctctaaca

SEQ ID NO: 3569077 - DNA, 21 bp, Homo sapiens
tgacagactttggacagtggc

SEQ ID NO: 3569078 - DNA, 22 bp, Homo sapiens
tgacagactttggacagtggcc

SEQ ID NO: 3569079 - DNA, 21 bp, Homo sapiens
tgacagaggtttgaaggagaa

SEQ ID NO: 3569080 - DNA, 14 bp, Homo sapiens
tgacagatcacagg

SEQ ID NO: 3569081 - DNA, 22 bp, Homo sapiens
tgacagccacaccgtggcagct

SEQ ID NO: 3569082 - DNA, 15 bp, Homo sapiens
tgacagctgctccta

SEQ ID NO: 3569083 - DNA, 23 bp, Homo sapiens
tgacagctgctcctagagggagg

SEQ ID NO: 3569084 - DNA, 14 bp, Homo sapiens
tgacagctttgctg

SEQ ID NO: 3569085 - DNA, 18 bp, Homo sapiens
tgacagctttgctgctga

SEQ ID NO: 3569086 - DNA, 14 bp, Homo sapiens
tgacaggcctgtcc

SEQ ID NO: 3569087 - DNA, 16 bp, Homo sapiens
tgacagggccagtgca

SEQ ID NO: 3569088 - DNA, 14 bp, Homo sapiens
tgacagtgaagata

SEQ ID NO: 3569089 - DNA, 19 bp, Homo sapiens
tgacagtgttgaaaatgtt

SEQ ID NO: 3569090 - DNA, 13 bp, Homo sapiens
tgacatacatatt

SEQ ID NO: 3569091 - DNA, 17 bp, Homo sapiens
tgacatacatccaacat

SEQ ID NO: 3569092 - DNA, 13 bp, Homo sapiens
tgacatcacttgt

SEQ ID NO: 3569093 - DNA, 19 bp, Homo sapiens
tgacatcacttgtacaaaa

SEQ ID NO: 3569094 - DNA, 21 bp, Homo sapiens
tgacatcacttgtacaaaata

SEQ ID NO: 3569095 - DNA, 15 bp, Homo sapiens
tgacatcccttcctg

SEQ ID NO: 3569096 - DNA, 12 bp, Homo sapiens
tgacatgaaaag

SEQ ID NO: 3569097 - DNA, 16 bp, Homo sapiens
tgacatgaaaagttat

SEQ ID NO: 3569098 - DNA, 18 bp, Homo sapiens
tgacatgcactcagctct

SEQ ID NO: 3569099 - DNA, 22 bp, Homo sapiens
tgacatgggcctttaagaacct

SEQ ID NO: 3569100 - DNA, 20 bp, Homo sapiens
tgacattcggggtgatcctg

SEQ ID NO: 3569101 - DNA, 18 bp, Homo sapiens
tgacattcttagctgtaa

SEQ ID NO: 3569102 - DNA, 21 bp, Homo sapiens
tgacattgaatggatcaatac

SEQ ID NO: 3569103 - DNA, 16 bp, Homo sapiens
tctttgaatatgtagt

SEQ ID NO: 3569104 - DNA, 19 bp, Homo sapiens
tctttgacatttttgccaa

SEQ ID NO: 3569105 - DNA, 15 bp, Homo sapiens
tctttgcaccaaaga

SEQ ID NO: 3569106 - DNA, 18 bp, Homo sapiens
tctttgccatctctgctc

SEQ ID NO: 3569107 - DNA, 11 bp, Homo sapiens
tctttgcctct

SEQ ID NO: 3569108 - DNA, 17 bp, Homo sapiens
tctttgcctctgcagtc

SEQ ID NO: 3569109 - DNA, 16 bp, Homo sapiens
tctttgctgcattcct

SEQ ID NO: 3569110 - DNA, 13 bp, Homo sapiens
tctttgctgcccc

SEQ ID NO: 3569111 - DNA, 17 bp, Homo sapiens
tctttgctgcccctgtc

SEQ ID NO: 3569112 - DNA, 19 bp, Homo sapiens
tctttgctgcccctgtctg

SEQ ID NO: 3569113 - DNA, 20 bp, Homo sapiens
tctttgctgcccctgtctgg

SEQ ID NO: 3569114 - DNA, 18 bp, Homo sapiens
tctttgctttgctttctg

SEQ ID NO: 3569115 - DNA, 23 bp, Homo sapiens
tctttgctttgctttctgctcag

SEQ ID NO: 3569116 - DNA, 15 bp, Homo sapiens
tctttggcatgattt

SEQ ID NO: 3569117 - DNA, 12 bp, Homo sapiens
tctttggctgca

SEQ ID NO: 3569118 - DNA, 16 bp, Homo sapiens
tctttgggccagacat

SEQ ID NO: 3569119 - DNA, 13 bp, Homo sapiens
tctttgtcaaact

SEQ ID NO: 3569120 - DNA, 21 bp, Homo sapiens
tctttgtgataattctcagta

SEQ ID NO: 3569121 - DNA, 13 bp, Homo sapiens
tctttgtgccttt

SEQ ID NO: 3569122 - DNA, 19 bp, Homo sapiens
tctttgtgcctttggcctg

SEQ ID NO: 3569123 - DNA, 22 bp, Homo sapiens
tctttgtggccaaggagctgct

SEQ ID NO: 3569124 - DNA, 20 bp, Homo sapiens
tctttgtttccagcttgcat

SEQ ID NO: 3569125 - DNA, 13 bp, Homo sapiens
tcttttcacatta

SEQ ID NO: 3569126 - DNA, 17 bp, Homo sapiens
tcttttcctggcagctg

SEQ ID NO: 3569127 - DNA, 16 bp, Homo sapiens
tcttttctttctgtct

SEQ ID NO: 3569128 - DNA, 14 bp, Homo sapiens
tctttttaaagttc

SEQ ID NO: 3569129 - DNA, 18 bp, Homo sapiens
tctttttaaagttcaaac

SEQ ID NO: 3569130 - DNA, 21 bp, Homo sapiens
tctttttgccagttttccctg

SEQ ID NO: 3569131 - DNA, 15 bp, Homo sapiens
tctttttttgcttta

SEQ ID NO: 3569132 - DNA, 22 bp, Homo sapiens
tctttttttgctttaaaacaaa

SEQ ID NO: 3569133 - DNA, 16 bp, Homo sapiens
tgaaaaaaacttcatt

SEQ ID NO: 3569134 - DNA, 13 bp, Homo sapiens
tgaaaaagaataa

SEQ ID NO: 3569135 - DNA, 17 bp, Homo sapiens
tgaaaaagacataaaac

SEQ ID NO: 3569136 - DNA, 16 bp, Homo sapiens
tgaaaacccagactgt

SEQ ID NO: 3569137 - DNA, 16 bp, Homo sapiens
tgaaaactaaggattt

SEQ ID NO: 3569138 - DNA, 12 bp, Homo sapiens
tgaaaacttcaa

SEQ ID NO: 3569139 - DNA, 20 bp, Homo sapiens
tgaaaacttcaaagctgaat

SEQ ID NO: 3569140 - DNA, 23 bp, Homo sapiens
tgaaaacttcaaagctgaatatt

SEQ ID NO: 3569141 - DNA, 13 bp, Homo sapiens
tgaaaagaaagaa

SEQ ID NO: 3569142 - DNA, 17 bp, Homo sapiens
tgaaaagactccaaaga

SEQ ID NO: 3569143 - DNA, 22 bp, Homo sapiens
tgaaaagatgtacctggtggat

SEQ ID NO: 3569144 - DNA, 14 bp, Homo sapiens
tgaaaagtaattga

SEQ ID NO: 3569145 - DNA, 24 bp, Homo sapiens
tgaaaagtaattgaaaaaggtgat

SEQ ID NO: 3569146 - DNA, 12 bp, Homo sapiens
tgaaaagttatt

SEQ ID NO: 3569147 - DNA, 13 bp, Homo sapiens
tgaaaagttattt

SEQ ID NO: 3569148 - DNA, 22 bp, Homo sapiens
tgaaaatatagacattctcaca

SEQ ID NO: 3569149 - DNA, 20 bp, Homo sapiens
tgaaaatattgttttacaat

SEQ ID NO: 3569150 - DNA, 17 bp, Homo sapiens
tgaaaatatttgtatca

SEQ ID NO: 3569151 - DNA, 14 bp, Homo sapiens
tgaaaatgaagaag

SEQ ID NO: 3569152 - DNA, 20 bp, Homo sapiens
tgaaaatgaagaaggaagct

SEQ ID NO: 3569153 - DNA, 16 bp, Homo sapiens
tgaaaatgggctcaac

SEQ ID NO: 3569154 - DNA, 22 bp, Homo sapiens
tgaaaattctaacccaagacat

SEQ ID NO: 3569155 - DNA, 22 bp, Homo sapiens
tgaaacaacaaataggaattgt

SEQ ID NO: 3569156 - DNA, 15 bp, Homo sapiens
tgaaacaacttggaa

SEQ ID NO: 3569157 - DNA, 16 bp, Homo sapiens
tgaaacacaataccta

SEQ ID NO: 3569158 - DNA, 13 bp, Homo sapiens
tgaaacagaaaaa

SEQ ID NO: 3569159 - DNA, 14 bp, Homo sapiens
tgaaacagaaaaat

SEQ ID NO: 3569160 - DNA, 14 bp, Homo sapiens
tgaaacagaaacaa

SEQ ID NO: 3569161 - DNA, 19 bp, Homo sapiens
tgaaacattttttcttctg

SEQ ID NO: 3569162 - DNA, 11 bp, Homo sapiens
tgaaagaagca

SEQ ID NO: 3569163 - DNA, 12 bp, Homo sapiens
tgaaagaagcaa

SEQ ID NO: 3569164 - DNA, 14 bp, Homo sapiens
tgaaagaagcaaga

SEQ ID NO: 3569165 - DNA, 15 bp, Homo sapiens
tgaaagagaggactg

SEQ ID NO: 3569166 - DNA, 23 bp, Homo sapiens
tgaaagatggctgtgcctctgcc

SEQ ID NO: 3569167 - DNA, 16 bp, Homo sapiens
tgaaagcataacatgg

SEQ ID NO: 3569168 - DNA, 22 bp, Homo sapiens
tgaaagcgacttcaggtcaggt

SEQ ID NO: 3569169 - DNA, 13 bp, Homo sapiens
tgaaagttttcca

SEQ ID NO: 3569170 - DNA, 20 bp, Homo sapiens
tgaaagttttccagtattga

SEQ ID NO: 3569171 - DNA, 22 bp, Homo sapiens
tgaaataaaactggctttggct

SEQ ID NO: 3569172 - DNA, 12 bp, Homo sapiens
tgaaataaaata

SEQ ID NO: 3569173 - DNA, 18 bp, Homo sapiens
tgaaataacaaaatggac

SEQ ID NO: 3569174 - DNA, 20 bp, Homo sapiens
tgaaataacaaaatggacat

SEQ ID NO: 3569175 - DNA, 12 bp, Homo sapiens
tgaaataataga

SEQ ID NO: 3569176 - DNA, 15 bp, Homo sapiens
tgaaatacctttgta

SEQ ID NO: 3569177 - DNA, 16 bp, Homo sapiens
tgaaatacctttgtag

SEQ ID NO: 3569178 - DNA, 23 bp, Homo sapiens
tgaaatacctttgtagttactca

SEQ ID NO: 3569179 - DNA, 13 bp, Homo sapiens
tgaaatactttat

SEQ ID NO: 3569180 - DNA, 18 bp, Homo sapiens
tgaaatatgctggctgga

SEQ ID NO: 3569181 - DNA, 23 bp, Homo sapiens
tgaaatatgtataactttaactt

SEQ ID NO: 3569182 - DNA, 14 bp, Homo sapiens
tgaaatcctgcttc

SEQ ID NO: 3569183 - DNA, 17 bp, Homo sapiens
tgaaatgccctcctaaa

SEQ ID NO: 3569184 - DNA, 18 bp, Homo sapiens
tgaaatgcttttatattc

SEQ ID NO: 3569185 - DNA, 21 bp, Homo sapiens
tgaaatgcttttatattctaa

SEQ ID NO: 3569186 - DNA, 13 bp, Homo sapiens
tgaaatgtcaacc

SEQ ID NO: 3569187 - DNA, 17 bp, Homo sapiens
tgaaatttaattacaaa

SEQ ID NO: 3569188 - DNA, 22 bp, Homo sapiens
tgaaatttcagattcccagagc

SEQ ID NO: 3569189 - DNA, 12 bp, Homo sapiens
tgaaatttgata

SEQ ID NO: 3569190 - DNA, 15 bp, Homo sapiens
tgaaatttttattaa

SEQ ID NO: 3569191 - DNA, 20 bp, Homo sapiens
tgaacattggttctttcatt

SEQ ID NO: 3569192 - DNA, 15 bp, Homo sapiens
tgaaccaaattgcac

SEQ ID NO: 3569193 - DNA, 19 bp, Homo sapiens
tctgtaattgtaattccaa

SEQ ID NO: 3569194 - DNA, 22 bp, Homo sapiens
tctgtaccagttaatttttcca

SEQ ID NO: 3569195 - DNA, 22 bp, Homo sapiens
tctgtaggccagtagttctcaa

SEQ ID NO: 3569196 - DNA, 19 bp, Homo sapiens
tctgtatataagttgctgt

SEQ ID NO: 3569197 - DNA, 21 bp, Homo sapiens
tctgtatataagttgctgtgt

SEQ ID NO: 3569198 - DNA, 15 bp, Homo sapiens
tctgtatgtcatgga

SEQ ID NO: 3569199 - DNA, 18 bp, Homo sapiens
tctgtattgaaaatggct

SEQ ID NO: 3569200 - DNA, 23 bp, Homo sapiens
tctgtcccactacatctgggact

SEQ ID NO: 3569201 - DNA, 20 bp, Homo sapiens
tctgtccgtgccccttccct

SEQ ID NO: 3569202 - DNA, 21 bp, Homo sapiens
tctgtccgtgccccttccctg

SEQ ID NO: 3569203 - DNA, 23 bp, Homo sapiens
tctgtccgtgccccttccctggg

SEQ ID NO: 3569204 - DNA, 14 bp, Homo sapiens
tctgtcctcagcct

SEQ ID NO: 3569205 - DNA, 15 bp, Homo sapiens
tctgtcctcagcctt

SEQ ID NO: 3569206 - DNA, 21 bp, Homo sapiens
tctgtcctcagccttgccaga

SEQ ID NO: 3569207 - DNA, 15 bp, Homo sapiens
tctgtcctcttggcc

SEQ ID NO: 3569208 - DNA, 13 bp, Homo sapiens
tctgtcctgggca

SEQ ID NO: 3569209 - DNA, 14 bp, Homo sapiens
tctgtctgaggtga

SEQ ID NO: 3569210 - DNA, 18 bp, Homo sapiens
tctgtctgggctcagaca

SEQ ID NO: 3569211 - DNA, 12 bp, Homo sapiens
tctgtctgggga

SEQ ID NO: 3569212 - DNA, 19 bp, Homo sapiens
tctgtgaacaagcttcagt

SEQ ID NO: 3569213 - DNA, 14 bp, Homo sapiens
tctgtgacctctga

SEQ ID NO: 3569214 - DNA, 12 bp, Homo sapiens
tctgtgattggc

SEQ ID NO: 3569215 - DNA, 15 bp, Homo sapiens
tctgtgattggctgg

SEQ ID NO: 3569216 - DNA, 12 bp, Homo sapiens
tctgtgcaaaca

SEQ ID NO: 3569217 - DNA, 18 bp, Homo sapiens
tctgtgctgtttcaaagt

SEQ ID NO: 3569218 - DNA, 17 bp, Homo sapiens
tctgtggagctgccaca

SEQ ID NO: 3569219 - DNA, 19 bp, Homo sapiens
tctgtgtaccacttcctga

SEQ ID NO: 3569220 - DNA, 16 bp, Homo sapiens
tctgtgtcatttcttc

SEQ ID NO: 3569221 - DNA, 14 bp, Homo sapiens
tctgtgtggctcct

SEQ ID NO: 3569222 - DNA, 17 bp, Homo sapiens
tctgtgtggctcctggg

SEQ ID NO: 3569223 - DNA, 11 bp, Homo sapiens
tctgtgtgtgt

SEQ ID NO: 3569224 - DNA, 21 bp, Homo sapiens
tctgtgtgtgtgtatgtgggg

SEQ ID NO: 3569225 - DNA, 20 bp, Homo sapiens
tctgtgtgtttatgtgtgtg

SEQ ID NO: 3569226 - DNA, 19 bp, Homo sapiens
tctgttcacttttcctccc

SEQ ID NO: 3569227 - DNA, 21 bp, Homo sapiens
tctgttcacttttcctccctc

SEQ ID NO: 3569228 - DNA, 22 bp, Homo sapiens
tctgttcacttttcctccctca

SEQ ID NO: 3569229 - DNA, 18 bp, Homo sapiens
tctgttcccccttcacaa

SEQ ID NO: 3569230 - DNA, 16 bp, Homo sapiens
tctgttgcaagtgcaa

SEQ ID NO: 3569231 - DNA, 13 bp, Homo sapiens
tctgtttaaagtg

SEQ ID NO: 3569232 - DNA, 13 bp, Homo sapiens
tctgtttgattct

SEQ ID NO: 3569233 - DNA, 16 bp, Homo sapiens
tctgtttgattctttt

SEQ ID NO: 3569234 - DNA, 13 bp, Homo sapiens
tcttaaaaaatgt

SEQ ID NO: 3569235 - DNA, 18 bp, Homo sapiens
tcttaaaaaatgtgaaat

SEQ ID NO: 3569236 - DNA, 13 bp, Homo sapiens
tcttaaaacctgc

SEQ ID NO: 3569237 - DNA, 23 bp, Homo sapiens
tcttaaaacctgcttttcaatgt

SEQ ID NO: 3569238 - DNA, 16 bp, Homo sapiens
tcttaaaagtttctaa

SEQ ID NO: 3569239 - DNA, 19 bp, Homo sapiens
tcttaaagaaaacccaccc

SEQ ID NO: 3569240 - DNA, 20 bp, Homo sapiens
tcttaaagaaaacccacccc

SEQ ID NO: 3569241 - DNA, 23 bp, Homo sapiens
tcttaacttcttgcttctttcta

SEQ ID NO: 3569242 - DNA, 18 bp, Homo sapiens
tcttaagcagcatggaaa

SEQ ID NO: 3569243 - DNA, 15 bp, Homo sapiens
tcttaatccattaaa

SEQ ID NO: 3569244 - DNA, 18 bp, Homo sapiens
tcttaatgtatcaaactg

SEQ ID NO: 3569245 - DNA, 16 bp, Homo sapiens
tcttaatgtctggtgt

SEQ ID NO: 3569246 - DNA, 10 bp, Homo sapiens
tcttaatttt

SEQ ID NO: 3569247 - DNA, 22 bp, Homo sapiens
tcttacacattccatcttacat

SEQ ID NO: 3569248 - DNA, 22 bp, Homo sapiens
tcttaccctgtacatatgtaaa

SEQ ID NO: 3569249 - DNA, 17 bp, Homo sapiens
tcttacctactattggc

SEQ ID NO: 3569250 - DNA, 18 bp, Homo sapiens
tcttacctactattggcc

SEQ ID NO: 3569251 - DNA, 21 bp, Homo sapiens
tcttacctactattggcccta

SEQ ID NO: 3569252 - DNA, 21 bp, Homo sapiens
tcttacctgtatgtctccagt

SEQ ID NO: 3569253 - DNA, 21 bp, Homo sapiens
tcttacgcacgatatctagtg

SEQ ID NO: 3569254 - DNA, 16 bp, Homo sapiens
tcttactaatgtaaaa

SEQ ID NO: 3569255 - DNA, 21 bp, Homo sapiens
tcttactaatgtaaaatgatt

SEQ ID NO: 3569256 - DNA, 19 bp, Homo sapiens
tcttagaggtccatggaga

SEQ ID NO: 3569257 - DNA, 23 bp, Homo sapiens
tcttagatattcactaaggactt

SEQ ID NO: 3569258 - DNA, 18 bp, Homo sapiens
tcttagctatccttggct

SEQ ID NO: 3569259 - DNA, 22 bp, Homo sapiens
tcttagctatccttggctttca

SEQ ID NO: 3569260 - DNA, 15 bp, Homo sapiens
tcttagctgtctgct

SEQ ID NO: 3569261 - DNA, 18 bp, Homo sapiens
tcttagctgtctgctcag

SEQ ID NO: 3569262 - DNA, 19 bp, Homo sapiens
tcttataagaagaagagag

SEQ ID NO: 3569263 - DNA, 16 bp, Homo sapiens
tcttatgcaaaatgga

SEQ ID NO: 3569264 - DNA, 17 bp, Homo sapiens
tcttatttacccttttc

SEQ ID NO: 3569265 - DNA, 17 bp, Homo sapiens
tcttattttgtaataaa

SEQ ID NO: 3569266 - DNA, 18 bp, Homo sapiens
tcttattttgtaataaac

SEQ ID NO: 3569267 - DNA, 19 bp, Homo sapiens
tcttattttgtaataaact

SEQ ID NO: 3569268 - DNA, 16 bp, Homo sapiens
tcttcaactgaccagc

SEQ ID NO: 3569269 - DNA, 19 bp, Homo sapiens
tcttcaactgaccagcctc

SEQ ID NO: 3569270 - DNA, 19 bp, Homo sapiens
tcttcacatgtttaacttt

SEQ ID NO: 3569271 - DNA, 17 bp, Homo sapiens
tcttcactctggcttca

SEQ ID NO: 3569272 - DNA, 17 bp, Homo sapiens
tcttcagaactgccctt

SEQ ID NO: 3569273 - DNA, 19 bp, Homo sapiens
tcttcagaactgcccttgc

SEQ ID NO: 3569274 - DNA, 20 bp, Homo sapiens
tcttcagaactgcccttgct

SEQ ID NO: 3569275 - DNA, 23 bp, Homo sapiens
tcttcagaactgcccttgctgcc

SEQ ID NO: 3569276 - DNA, 21 bp, Homo sapiens
tcttcagtcctttgtctttct

SEQ ID NO: 3569277 - DNA, 16 bp, Homo sapiens
tcttcagtgactcctg

SEQ ID NO: 3569278 - DNA, 19 bp, Homo sapiens
tcttcagtgactcctgctg

SEQ ID NO: 3569279 - DNA, 21 bp, Homo sapiens
tcttcagtgactcctgctggt

SEQ ID NO: 3569280 - DNA, 16 bp, Homo sapiens
tcttcatgtccagtga

SEQ ID NO: 3569281 - DNA, 16 bp, Homo sapiens
tcttcattctttactg

SEQ ID NO: 3569282 - DNA, 14 bp, Homo sapiens
tcttccacccacaa

SEQ ID NO: 3569283 - DNA, 21 bp, Homo sapiens
tcttccacccacaaactccag

SEQ ID NO: 3569284 - DNA, 12 bp, Homo sapiens
tcttcccacagg

SEQ ID NO: 3569285 - DNA, 15 bp, Homo sapiens
tcttcccacaggagg

SEQ ID NO: 3569286 - DNA, 17 bp, Homo sapiens
tcttccccttcctgttt

SEQ ID NO: 3569287 - DNA, 18 bp, Homo sapiens
tcttccccttcctgtttc

SEQ ID NO: 3569288 - DNA, 16 bp, Homo sapiens
tcttccctgctttgca

SEQ ID NO: 3569289 - DNA, 21 bp, Homo sapiens
tcttccctggaaaccttccac

SEQ ID NO: 3569290 - DNA, 19 bp, Homo sapiens
tcttcctagttttctcctc

SEQ ID NO: 3569291 - DNA, 11 bp, Homo sapiens
tcttcctctgc

SEQ ID NO: 3569292 - DNA, 12 bp, Homo sapiens
tcttcctctgct

SEQ ID NO: 3569293 - DNA, 14 bp, Homo sapiens
tcttcctctgctga

SEQ ID NO: 3569294 - DNA, 23 bp, Homo sapiens
tcttcctgtgaagtttaattgtc

SEQ ID NO: 3569295 - DNA, 18 bp, Homo sapiens
tcttccttttcactgctg

SEQ ID NO: 3569296 - DNA, 18 bp, Homo sapiens
tcttcgctggactattgt

SEQ ID NO: 3569297 - DNA, 11 bp, Homo sapiens
tcttctaacat

SEQ ID NO: 3569298 - DNA, 22 bp, Homo sapiens
tcttctaacatgaaatatattt

SEQ ID NO: 3569299 - DNA, 13 bp, Homo sapiens
tcttctatttatt

SEQ ID NO: 3569300 - DNA, 22 bp, Homo sapiens
tcttctatttatttatttattc

SEQ ID NO: 3569301 - DNA, 14 bp, Homo sapiens
tcttctcctttcac

SEQ ID NO: 3569302 - DNA, 14 bp, Homo sapiens
tcttctctccagct

SEQ ID NO: 3569303 - DNA, 18 bp, Homo sapiens
tcttctgaagatcagaac

SEQ ID NO: 3569304 - DNA, 17 bp, Homo sapiens
tcttctgctcttttcct

SEQ ID NO: 3569305 - DNA, 10 bp, Homo sapiens
tcttctggag

SEQ ID NO: 3569306 - DNA, 17 bp, Homo sapiens
tcttctggagatggaag

SEQ ID NO: 3569307 - DNA, 18 bp, Homo sapiens
tcttcttaaaagtttcta

SEQ ID NO: 3569308 - DNA, 17 bp, Homo sapiens
tcttctttctgtcttta

SEQ ID NO: 3569309 - DNA, 11 bp, Homo sapiens
tcttctttctt

SEQ ID NO: 3569310 - DNA, 12 bp, Homo sapiens
tcttctttgtgc

SEQ ID NO: 3569311 - DNA, 16 bp, Homo sapiens
tcttctttgtgccttt

SEQ ID NO: 3569312 - DNA, 15 bp, Homo sapiens
tcttcttttttatct

SEQ ID NO: 3569313 - DNA, 17 bp, Homo sapiens
tcttctttttttgtgat

SEQ ID NO: 3569314 - DNA, 17 bp, Homo sapiens
tcttgaacgagcagccc

SEQ ID NO: 3569315 - DNA, 18 bp, Homo sapiens
tcttgaacgagcagccca

SEQ ID NO: 3569316 - DNA, 19 bp, Homo sapiens
tcttgaacgagcagcccag

SEQ ID NO: 3569317 - DNA, 14 bp, Homo sapiens
tcttgaactgggct

SEQ ID NO: 3569318 - DNA, 19 bp, Homo sapiens
tcttgaataaagtattcta

SEQ ID NO: 3569319 - DNA, 23 bp, Homo sapiens
tcttgaatatgggcggaagtact

SEQ ID NO: 3569320 - DNA, 14 bp, Homo sapiens
tcttgaattagtat

SEQ ID NO: 3569321 - DNA, 20 bp, Homo sapiens
tcttgacgagtgtgaagctt

SEQ ID NO: 3569322 - DNA, 17 bp, Homo sapiens
tcttgagccacagtcac

SEQ ID NO: 3569323 - DNA, 20 bp, Homo sapiens
tcttgagtataagaaatgca

SEQ ID NO: 3569324 - DNA, 20 bp, Homo sapiens
tcttgagttcctctgcagtt

SEQ ID NO: 3569325 - DNA, 17 bp, Homo sapiens
tcttgcagcatttacta

SEQ ID NO: 3569326 - DNA, 22 bp, Homo sapiens
tcttgcagcatttactatgcac

SEQ ID NO: 3569327 - DNA, 21 bp, Homo sapiens
tcttgcataggctcttaagca

SEQ ID NO: 3569328 - DNA, 18 bp, Homo sapiens
tcttgcccttcctactcc

SEQ ID NO: 3569329 - DNA, 18 bp, Homo sapiens
tctgaagctgctgcagct

SEQ ID NO: 3569330 - DNA, 14 bp, Homo sapiens
tctgaagtctgagc

SEQ ID NO: 3569331 - DNA, 19 bp, Homo sapiens
tctgaagtctgagcccatt

SEQ ID NO: 3569332 - DNA, 17 bp, Homo sapiens
tctgaatgaaaataact

SEQ ID NO: 3569333 - DNA, 18 bp, Homo sapiens
tctgaatgaaaataactg

SEQ ID NO: 3569334 - DNA, 23 bp, Homo sapiens
tctgaatgagcctttgtgctttt

SEQ ID NO: 3569335 - DNA, 20 bp, Homo sapiens
tctgacagtccacaggggcc

SEQ ID NO: 3569336 - DNA, 13 bp, Homo sapiens
tctgacatattat

SEQ ID NO: 3569337 - DNA, 21 bp, Homo sapiens
tctgacatattatgcctgaat

SEQ ID NO: 3569338 - DNA, 14 bp, Homo sapiens
tctgacatcccttc

SEQ ID NO: 3569339 - DNA, 18 bp, Homo sapiens
tctgacatcccttcctgg

SEQ ID NO: 3569340 - DNA, 23 bp, Homo sapiens
tctgacatcccttcctggaaaca

SEQ ID NO: 3569341 - DNA, 11 bp, Homo sapiens
tctgacccagt

SEQ ID NO: 3569342 - DNA, 15 bp, Homo sapiens
tctgacccagtgccc

SEQ ID NO: 3569343 - DNA, 22 bp, Homo sapiens
tctgacccagtgcccccactga

SEQ ID NO: 3569344 - DNA, 18 bp, Homo sapiens
tctgacctcttggccaca

SEQ ID NO: 3569345 - DNA, 15 bp, Homo sapiens
tctgagagctgtttt

SEQ ID NO: 3569346 - DNA, 16 bp, Homo sapiens
tctgagcccatttctg

SEQ ID NO: 3569347 - DNA, 16 bp, Homo sapiens
tctgaggccagaaagg

SEQ ID NO: 3569348 - DNA, 13 bp, Homo sapiens
tctgaggcctgcc

SEQ ID NO: 3569349 - DNA, 20 bp, Homo sapiens
tctgaggcctgccccctggg

SEQ ID NO: 3569350 - DNA, 13 bp, Homo sapiens
tctgagtcaaatc

SEQ ID NO: 3569351 - DNA, 16 bp, Homo sapiens
tctgagtcaaatccag

SEQ ID NO: 3569352 - DNA, 15 bp, Homo sapiens
tctgatgtactctaa

SEQ ID NO: 3569353 - DNA, 15 bp, Homo sapiens
tctgatgtataatgt

SEQ ID NO: 3569354 - DNA, 16 bp, Homo sapiens
tctgatgtataatgta

SEQ ID NO: 3569355 - DNA, 17 bp, Homo sapiens
tctgatgtataatgtaa

SEQ ID NO: 3569356 - DNA, 18 bp, Homo sapiens
tctgatgtataatgtaat

SEQ ID NO: 3569357 - DNA, 23 bp, Homo sapiens
tctgatgtataatgtaatgtttt

SEQ ID NO: 3569358 - DNA, 15 bp, Homo sapiens
tctgattctgattgc

SEQ ID NO: 3569359 - DNA, 12 bp, Homo sapiens
tctgattgctat

SEQ ID NO: 3569360 - DNA, 13 bp, Homo sapiens
tctgattgctatc

SEQ ID NO: 3569361 - DNA, 16 bp, Homo sapiens
tctgattgctatcagc

SEQ ID NO: 3569362 - DNA, 11 bp, Homo sapiens
tctgattggct

SEQ ID NO: 3569363 - DNA, 12 bp, Homo sapiens
tctgattggctg

SEQ ID NO: 3569364 - DNA, 16 bp, Homo sapiens
tctgattggctgctta

SEQ ID NO: 3569365 - DNA, 18 bp, Homo sapiens
tctgcaacatttgacaaa

SEQ ID NO: 3569366 - DNA, 14 bp, Homo sapiens
tctgcacccagaac

SEQ ID NO: 3569367 - DNA, 22 bp, Homo sapiens
tctgcacgctcaatgcccagta

SEQ ID NO: 3569368 - DNA, 14 bp, Homo sapiens
tctgcactgaggat

SEQ ID NO: 3569369 - DNA, 20 bp, Homo sapiens
tctgcactgaggatttcttt

SEQ ID NO: 3569370 - DNA, 22 bp, Homo sapiens
tctgcactggggcgtttcctac

SEQ ID NO: 3569371 - DNA, 18 bp, Homo sapiens
tctgcagtaaaacacatt

SEQ ID NO: 3569372 - DNA, 23 bp, Homo sapiens
tctgcagtaaaacacatttggga

SEQ ID NO: 3569373 - DNA, 17 bp, Homo sapiens
tctgcagtctcatttct

SEQ ID NO: 3569374 - DNA, 18 bp, Homo sapiens
tctgcagtctcatttctc

SEQ ID NO: 3569375 - DNA, 17 bp, Homo sapiens
tctgcagttttgacatt

SEQ ID NO: 3569376 - DNA, 14 bp, Homo sapiens
tctgcatgttttcc

SEQ ID NO: 3569377 - DNA, 15 bp, Homo sapiens
tctgcatgttttcca

SEQ ID NO: 3569378 - DNA, 17 bp, Homo sapiens
tctgcattcaggatcaa

SEQ ID NO: 3569379 - DNA, 16 bp, Homo sapiens
tctgccccctccccca

SEQ ID NO: 3569380 - DNA, 23 bp, Homo sapiens
tctgccctggattggttggcaaa

SEQ ID NO: 3569381 - DNA, 16 bp, Homo sapiens
tctgccctgggctcct

SEQ ID NO: 3569382 - DNA, 19 bp, Homo sapiens
tctgccggtcgggcagcca

SEQ ID NO: 3569383 - DNA, 21 bp, Homo sapiens
tctgccggtcgggcagccagc

SEQ ID NO: 3569384 - DNA, 22 bp, Homo sapiens
tctgccggtcgggcagccagca

SEQ ID NO: 3569385 - DNA, 21 bp, Homo sapiens
tctgcctagagtgtagcctaa

SEQ ID NO: 3569386 - DNA, 18 bp, Homo sapiens
tctgcctgccagctgcac

SEQ ID NO: 3569387 - DNA, 21 bp, Homo sapiens
tctgcctgccagctgcactga

SEQ ID NO: 3569388 - DNA, 22 bp, Homo sapiens
tctgcctggaggcaaaggcctg

SEQ ID NO: 3569389 - DNA, 12 bp, Homo sapiens
tctgcctgtctc

SEQ ID NO: 3569390 - DNA, 23 bp, Homo sapiens
tctgccttaaacacacattgcag

SEQ ID NO: 3569391 - DNA, 13 bp, Homo sapiens
tctgccttagcct

SEQ ID NO: 3569392 - DNA, 19 bp, Homo sapiens
tctgccttctgctgaaaga

SEQ ID NO: 3569393 - DNA, 16 bp, Homo sapiens
tctgcgctgtgtacaa

SEQ ID NO: 3569394 - DNA, 22 bp, Homo sapiens
tctgctcagacagaacccctac

SEQ ID NO: 3569395 - DNA, 16 bp, Homo sapiens
tctgctccataccttt

SEQ ID NO: 3569396 - DNA, 20 bp, Homo sapiens
tctgctccataccttttctc

SEQ ID NO: 3569397 - DNA, 12 bp, Homo sapiens
tctgctctggaa

SEQ ID NO: 3569398 - DNA, 16 bp, Homo sapiens
tctgctcttttcctgg

SEQ ID NO: 3569399 - DNA, 18 bp, Homo sapiens
tctgctgagttggcctgg

SEQ ID NO: 3569400 - DNA, 12 bp, Homo sapiens
tctgctgcagtt

SEQ ID NO: 3569401 - DNA, 19 bp, Homo sapiens
tctgctgccagcacagtag

SEQ ID NO: 3569402 - DNA, 23 bp, Homo sapiens
tctgctgggaacctagcacacct

SEQ ID NO: 3569403 - DNA, 17 bp, Homo sapiens
tctgctgggctctgcct

SEQ ID NO: 3569404 - DNA, 17 bp, Homo sapiens
tctgctgttcttcagtc

SEQ ID NO: 3569405 - DNA, 16 bp, Homo sapiens
tctggaacccagactc

SEQ ID NO: 3569406 - DNA, 19 bp, Homo sapiens
tctggaacctcagcctggc

SEQ ID NO: 3569407 - DNA, 19 bp, Homo sapiens
tctggaataaagttgcaga

SEQ ID NO: 3569408 - DNA, 14 bp, Homo sapiens
tctggaatacatga

SEQ ID NO: 3569409 - DNA, 18 bp, Homo sapiens
tctggacagccccaccct

SEQ ID NO: 3569410 - DNA, 19 bp, Homo sapiens
tctggacagccccaccctg

SEQ ID NO: 3569411 - DNA, 15 bp, Homo sapiens
tctggacagtacctg

SEQ ID NO: 3569412 - DNA, 23 bp, Homo sapiens
tctggacagtacctgattgtatt

SEQ ID NO: 3569413 - DNA, 14 bp, Homo sapiens
tctggactgttctg

SEQ ID NO: 3569414 - DNA, 17 bp, Homo sapiens
tctggactgttctgtag

SEQ ID NO: 3569415 - DNA, 14 bp, Homo sapiens
tctggagagcccag

SEQ ID NO: 3569416 - DNA, 24 bp, Homo sapiens
tctggagatggaagcttgttgaaa

SEQ ID NO: 3569417 - DNA, 18 bp, Homo sapiens
tctggaggtcatctggcg

SEQ ID NO: 3569418 - DNA, 17 bp, Homo sapiens
tctggagttgatctgga

SEQ ID NO: 3569419 - DNA, 21 bp, Homo sapiens
tctggagttgatctggaaccc

SEQ ID NO: 3569420 - DNA, 18 bp, Homo sapiens
tctggccacatcagcccc

SEQ ID NO: 3569421 - DNA, 12 bp, Homo sapiens
tctggccctggg

SEQ ID NO: 3569422 - DNA, 13 bp, Homo sapiens
tctggcctcccac

SEQ ID NO: 3569423 - DNA, 21 bp, Homo sapiens
tctggcggaggtctctgggag

SEQ ID NO: 3569424 - DNA, 15 bp, Homo sapiens
tctggctctaattca

SEQ ID NO: 3569425 - DNA, 20 bp, Homo sapiens
tctggctctaattcacagtg

SEQ ID NO: 3569426 - DNA, 15 bp, Homo sapiens
tctggctggtcttca

SEQ ID NO: 3569427 - DNA, 21 bp, Homo sapiens
tctggcttcaaaaagccacag

SEQ ID NO: 3569428 - DNA, 23 bp, Homo sapiens
tctggcttcaaaaagccacagca

SEQ ID NO: 3569429 - DNA, 20 bp, Homo sapiens
tctggcttccctaaactgca

SEQ ID NO: 3569430 - DNA, 21 bp, Homo sapiens
tctggcttccctaaactgcag

SEQ ID NO: 3569431 - DNA, 23 bp, Homo sapiens
tctggcttccctaaactgcagcc

SEQ ID NO: 3569432 - DNA, 14 bp, Homo sapiens
tctgggaacttgtc

SEQ ID NO: 3569433 - DNA, 18 bp, Homo sapiens
tctgggaatgggagaggg

SEQ ID NO: 3569434 - DNA, 16 bp, Homo sapiens
tctgggacccacagaa

SEQ ID NO: 3569435 - DNA, 20 bp, Homo sapiens
tctgggcaaagcccctcaca

SEQ ID NO: 3569436 - DNA, 21 bp, Homo sapiens
tctgggcaaagcccctcacac

SEQ ID NO: 3569437 - DNA, 21 bp, Homo sapiens
tctgggcaccacctctgtggg

SEQ ID NO: 3569438 - DNA, 13 bp, Homo sapiens
tctgggcctgagg

SEQ ID NO: 3569439 - DNA, 16 bp, Homo sapiens
tctggggacaggcccg

SEQ ID NO: 3569440 - DNA, 18 bp, Homo sapiens
tctggggagagcggctgg

SEQ ID NO: 3569441 - DNA, 21 bp, Homo sapiens
tctggggagagcggctggaga

SEQ ID NO: 3569442 - DNA, 23 bp, Homo sapiens
tctggggctgtgttatgaaaata

SEQ ID NO: 3569443 - DNA, 15 bp, Homo sapiens
tctgggggagtggaa

SEQ ID NO: 3569444 - DNA, 15 bp, Homo sapiens
tctgggggctgagga

SEQ ID NO: 3569445 - DNA, 22 bp, Homo sapiens
tctggggggagaaaaaaaaagc

SEQ ID NO: 3569446 - DNA, 14 bp, Homo sapiens
tctgggggtcctct

SEQ ID NO: 3569447 - DNA, 18 bp, Homo sapiens
tctgggggtcctctctga

SEQ ID NO: 3569448 - DNA, 17 bp, Homo sapiens
tctgggtccttggctcc

SEQ ID NO: 3569449 - DNA, 22 bp, Homo sapiens
tctgggtctgattttctcactg

SEQ ID NO: 3569450 - DNA, 14 bp, Homo sapiens
tctgggtgaggtag

SEQ ID NO: 3569451 - DNA, 14 bp, Homo sapiens
tctgggtgctgccc

SEQ ID NO: 3569452 - DNA, 22 bp, Homo sapiens
tctggtaatattgacttgtata

SEQ ID NO: 3569453 - DNA, 17 bp, Homo sapiens
tctggtgctcctgcatc

SEQ ID NO: 3569454 - DNA, 14 bp, Homo sapiens
tctggtgtttgtca

SEQ ID NO: 3569455 - DNA, 21 bp, Homo sapiens
tctggtgtttgtcatggtgaa

SEQ ID NO: 3569456 - DNA, 15 bp, Homo sapiens
tctggttccctgctg

SEQ ID NO: 3569457 - DNA, 17 bp, Homo sapiens
tctggttccctgctgcg

SEQ ID NO: 3569458 - DNA, 14 bp, Homo sapiens
tctggttctgtgtc

SEQ ID NO: 3569459 - DNA, 17 bp, Homo sapiens
tctggttctgtgtcctc

SEQ ID NO: 3569460 - DNA, 19 bp, Homo sapiens
tctggttgctaatgacagc

SEQ ID NO: 3569461 - DNA, 21 bp, Homo sapiens
tctggttgctaatgacagcct

SEQ ID NO: 3569462 - DNA, 12 bp, Homo sapiens
tctgtaataata

SEQ ID NO: 3569463 - DNA, 15 bp, Homo sapiens
tctgtaataatagac

SEQ ID NO: 3569464 - DNA, 16 bp, Homo sapiens
tctgtaataatagact

SEQ ID NO: 3569465 - DNA, 23 bp, Homo sapiens
tctcaaaaaaaagaaaatgtctt

SEQ ID NO: 3569466 - DNA, 17 bp, Homo sapiens
tctcaaaataaagcaat

SEQ ID NO: 3569467 - DNA, 16 bp, Homo sapiens
tctcaaagtaaggctg

SEQ ID NO: 3569468 - DNA, 13 bp, Homo sapiens
tctcaaagtttta

SEQ ID NO: 3569469 - DNA, 19 bp, Homo sapiens
tctcaaagttttattataa

SEQ ID NO: 3569470 - DNA, 16 bp, Homo sapiens
tctcaaatctgcttca

SEQ ID NO: 3569471 - DNA, 16 bp, Homo sapiens
tctcaaatgctggcaa

SEQ ID NO: 3569472 - DNA, 22 bp, Homo sapiens
tctcaagtaaaacaaatgaaat

SEQ ID NO: 3569473 - DNA, 17 bp, Homo sapiens
tctcaattgctttgtaa

SEQ ID NO: 3569474 - DNA, 18 bp, Homo sapiens
tctcacaggctgagaact

SEQ ID NO: 3569475 - DNA, 20 bp, Homo sapiens
tctcaccagcagtcgtgggg

SEQ ID NO: 3569476 - DNA, 22 bp, Homo sapiens
tctcactgaactccaccgacca

SEQ ID NO: 3569477 - DNA, 13 bp, Homo sapiens
tctcagaaataaa

SEQ ID NO: 3569478 - DNA, 21 bp, Homo sapiens
tctcagaggcctgctgccagt

SEQ ID NO: 3569479 - DNA, 17 bp, Homo sapiens
tctcagatttctgagga

SEQ ID NO: 3569480 - DNA, 18 bp, Homo sapiens
tctcagatttctgaggaa

SEQ ID NO: 3569481 - DNA, 21 bp, Homo sapiens
tctcaggaaatcaaatatgca

SEQ ID NO: 3569482 - DNA, 23 bp, Homo sapiens
tctcaggaaatcaaatatgcaaa

SEQ ID NO: 3569483 - DNA, 22 bp, Homo sapiens
tctcaggagatggagggcttgg

SEQ ID NO: 3569484 - DNA, 22 bp, Homo sapiens
tctcagggaactgaccctcagg

SEQ ID NO: 3569485 - DNA, 14 bp, Homo sapiens
tctcagggctggag

SEQ ID NO: 3569486 - DNA, 13 bp, Homo sapiens
tctcataaattta

SEQ ID NO: 3569487 - DNA, 16 bp, Homo sapiens
tctcatccttttggat

SEQ ID NO: 3569488 - DNA, 16 bp, Homo sapiens
tctcatcggaggccca

SEQ ID NO: 3569489 - DNA, 17 bp, Homo sapiens
tctcatgttttcaactg

SEQ ID NO: 3569490 - DNA, 14 bp, Homo sapiens
tctcattcatcctt

SEQ ID NO: 3569491 - DNA, 14 bp, Homo sapiens
tctcattgctctga

SEQ ID NO: 3569492 - DNA, 13 bp, Homo sapiens
tctccaaagaaga

SEQ ID NO: 3569493 - DNA, 14 bp, Homo sapiens
tctccagcaggccc

SEQ ID NO: 3569494 - DNA, 14 bp, Homo sapiens
tctccagctgcctg

SEQ ID NO: 3569495 - DNA, 17 bp, Homo sapiens
tctccagggcccccacc

SEQ ID NO: 3569496 - DNA, 19 bp, Homo sapiens
tctccaggggcctgcagaa

SEQ ID NO: 3569497 - DNA, 19 bp, Homo sapiens
tctccaggtcagcctggaa

SEQ ID NO: 3569498 - DNA, 15 bp, Homo sapiens
tctccatcccctccc

SEQ ID NO: 3569499 - DNA, 16 bp, Homo sapiens
tctccatcccctccct

SEQ ID NO: 3569500 - DNA, 19 bp, Homo sapiens
tctccatcccctccctgcc

SEQ ID NO: 3569501 - DNA, 15 bp, Homo sapiens
tctccatcctgcaga

SEQ ID NO: 3569502 - DNA, 15 bp, Homo sapiens
tctccatggagccta

SEQ ID NO: 3569503 - DNA, 20 bp, Homo sapiens
tctccatggagcctacctct

SEQ ID NO: 3569504 - DNA, 16 bp, Homo sapiens
tctccatgtttgatgt

SEQ ID NO: 3569505 - DNA, 21 bp, Homo sapiens
tctcccacatgaggccatctc

SEQ ID NO: 3569506 - DNA, 14 bp, Homo sapiens
tctcccacatgcca

SEQ ID NO: 3569507 - DNA, 14 bp, Homo sapiens
tctcccagaactat

SEQ ID NO: 3569508 - DNA, 12 bp, Homo sapiens
tctcccagctct

SEQ ID NO: 3569509 - DNA, 14 bp, Homo sapiens
tctcccagctctag

SEQ ID NO: 3569510 - DNA, 21 bp, Homo sapiens
tctcccagtgtgagaccccaa

SEQ ID NO: 3569511 - DNA, 24 bp, Homo sapiens
tctcccatcctggggcagcactcc

SEQ ID NO: 3569512 - DNA, 16 bp, Homo sapiens
tctccccagcccagag

SEQ ID NO: 3569513 - DNA, 17 bp, Homo sapiens
tctccccagcccagaga

SEQ ID NO: 3569514 - DNA, 13 bp, Homo sapiens
tctccccatatat

SEQ ID NO: 3569515 - DNA, 14 bp, Homo sapiens
tctcccctcctgca

SEQ ID NO: 3569516 - DNA, 12 bp, Homo sapiens
tctcccctctcg

SEQ ID NO: 3569517 - DNA, 20 bp, Homo sapiens
tctcccctctcgccccatcc

SEQ ID NO: 3569518 - DNA, 12 bp, Homo sapiens
tctccccttctc

SEQ ID NO: 3569519 - DNA, 14 bp, Homo sapiens
tctccctttctctc

SEQ ID NO: 3569520 - DNA, 15 bp, Homo sapiens
tctccctttctctct

SEQ ID NO: 3569521 - DNA, 15 bp, Homo sapiens
tctccgagctctggt

SEQ ID NO: 3569522 - DNA, 17 bp, Homo sapiens
tctccgagctctggtgc

SEQ ID NO: 3569523 - DNA, 14 bp, Homo sapiens
tctccgttccatct

SEQ ID NO: 3569524 - DNA, 15 bp, Homo sapiens
tctccgttccatctg

SEQ ID NO: 3569525 - DNA, 20 bp, Homo sapiens
tctccgtttattataaactg

SEQ ID NO: 3569526 - DNA, 16 bp, Homo sapiens
tctcctcactctgtcc

SEQ ID NO: 3569527 - DNA, 19 bp, Homo sapiens
tctcctcactctgtccctg

SEQ ID NO: 3569528 - DNA, 14 bp, Homo sapiens
tctcctcagcctcc

SEQ ID NO: 3569529 - DNA, 13 bp, Homo sapiens
tctcctcatctcc

SEQ ID NO: 3569530 - DNA, 14 bp, Homo sapiens
tctcctcatctcca

SEQ ID NO: 3569531 - DNA, 12 bp, Homo sapiens
tctcctcccagg

SEQ ID NO: 3569532 - DNA, 23 bp, Homo sapiens
tctcctcccttaccctcctctgc

SEQ ID NO: 3569533 - DNA, 16 bp, Homo sapiens
tctcctcttgccactg

SEQ ID NO: 3569534 - DNA, 16 bp, Homo sapiens
tctcctgacccctgcc

SEQ ID NO: 3569535 - DNA, 14 bp, Homo sapiens
tctcctgactttta

SEQ ID NO: 3569536 - DNA, 15 bp, Homo sapiens
tctcctgcctcagcc

SEQ ID NO: 3569537 - DNA, 18 bp, Homo sapiens
tctcctgcctcagcctcc

SEQ ID NO: 3569538 - DNA, 13 bp, Homo sapiens
tctccttcctgtg

SEQ ID NO: 3569539 - DNA, 20 bp, Homo sapiens
tctcctttgtactttgtgct

SEQ ID NO: 3569540 - DNA, 15 bp, Homo sapiens
tctccttttgaggct

SEQ ID NO: 3569541 - DNA, 13 bp, Homo sapiens
tctcggctctgca

SEQ ID NO: 3569542 - DNA, 23 bp, Homo sapiens
tctcggctgccaggggctctgtg

SEQ ID NO: 3569543 - DNA, 15 bp, Homo sapiens
tctcgggagccctag

SEQ ID NO: 3569544 - DNA, 20 bp, Homo sapiens
tctcgtgagtcatttaaatg

SEQ ID NO: 3569545 - DNA, 17 bp, Homo sapiens
tctctaatgcttgattt

SEQ ID NO: 3569546 - DNA, 13 bp, Homo sapiens
tctctacaaaccc

SEQ ID NO: 3569547 - DNA, 17 bp, Homo sapiens
tctctactaaaaatgca

SEQ ID NO: 3569548 - DNA, 16 bp, Homo sapiens
tctctatagcaccagg

SEQ ID NO: 3569549 - DNA, 22 bp, Homo sapiens
tctctatagcaccagggctcac

SEQ ID NO: 3569550 - DNA, 13 bp, Homo sapiens
tctctcagggatg

SEQ ID NO: 3569551 - DNA, 18 bp, Homo sapiens
tctctccaggtcagcctg

SEQ ID NO: 3569552 - DNA, 22 bp, Homo sapiens
tctctccaggtcagcctggaag

SEQ ID NO: 3569553 - DNA, 16 bp, Homo sapiens
tctctccagtgaaatg

SEQ ID NO: 3569554 - DNA, 17 bp, Homo sapiens
tctctcccatcctgggg

SEQ ID NO: 3569555 - DNA, 23 bp, Homo sapiens
tctctccccatatataaattatt

SEQ ID NO: 3569556 - DNA, 12 bp, Homo sapiens
tctctcctctct

SEQ ID NO: 3569557 - DNA, 14 bp, Homo sapiens
tctctcctctctgc

SEQ ID NO: 3569558 - DNA, 21 bp, Homo sapiens
tctctcctctctgcttcataa

SEQ ID NO: 3569559 - DNA, 12 bp, Homo sapiens
tctctctccagg

SEQ ID NO: 3569560 - DNA, 13 bp, Homo sapiens
tctctctccaggg

SEQ ID NO: 3569561 - DNA, 14 bp, Homo sapiens
tctctctccagggt

SEQ ID NO: 3569562 - DNA, 15 bp, Homo sapiens
tctctctccagggtg

SEQ ID NO: 3569563 - DNA, 12 bp, Homo sapiens
tctctctcctct

SEQ ID NO: 3569564 - DNA, 13 bp, Homo sapiens
tctctctctacaa

SEQ ID NO: 3569565 - DNA, 15 bp, Homo sapiens
tctctctgagggggt

SEQ ID NO: 3569566 - DNA, 19 bp, Homo sapiens
tctctcttgtcctcttctg

SEQ ID NO: 3569567 - DNA, 12 bp, Homo sapiens
tctctgaggcta

SEQ ID NO: 3569568 - DNA, 19 bp, Homo sapiens
tctctgagtcaaatccagt

SEQ ID NO: 3569569 - DNA, 20 bp, Homo sapiens
tctctgagtcaaatccagtg

SEQ ID NO: 3569570 - DNA, 21 bp, Homo sapiens
tctctgagtcaaatccagtgg

SEQ ID NO: 3569571 - DNA, 20 bp, Homo sapiens
tctctgcagtaaaacacatt

SEQ ID NO: 3569572 - DNA, 21 bp, Homo sapiens
tctctgccagttacttgggct

SEQ ID NO: 3569573 - DNA, 13 bp, Homo sapiens
tctctgcccaacc

SEQ ID NO: 3569574 - DNA, 15 bp, Homo sapiens
tctctgccccagcct

SEQ ID NO: 3569575 - DNA, 18 bp, Homo sapiens
tctctgccccagcctgtc

SEQ ID NO: 3569576 - DNA, 18 bp, Homo sapiens
tctctgccctgggctcct

SEQ ID NO: 3569577 - DNA, 21 bp, Homo sapiens
tctctgccctgggctcctctt

SEQ ID NO: 3569578 - DNA, 19 bp, Homo sapiens
tctctgcctcacctggtcg

SEQ ID NO: 3569579 - DNA, 14 bp, Homo sapiens
tctctggctgggga

SEQ ID NO: 3569580 - DNA, 14 bp, Homo sapiens
tctctgggcttagg

SEQ ID NO: 3569581 - DNA, 16 bp, Homo sapiens
tctctgttacaaaaga

SEQ ID NO: 3569582 - DNA, 15 bp, Homo sapiens
tctctgttggtctgc

SEQ ID NO: 3569583 - DNA, 17 bp, Homo sapiens
tctcttatgcattagta

SEQ ID NO: 3569584 - DNA, 18 bp, Homo sapiens
tctcttccccttagaaac

SEQ ID NO: 3569585 - DNA, 18 bp, Homo sapiens
tctcttccccttccctta

SEQ ID NO: 3569586 - DNA, 13 bp, Homo sapiens
tctcttctaacat

SEQ ID NO: 3569587 - DNA, 22 bp, Homo sapiens
tctcttctaacatgaaatatat

SEQ ID NO: 3569588 - DNA, 11 bp, Homo sapiens
tctcttctcca

SEQ ID NO: 3569589 - DNA, 14 bp, Homo sapiens
tctcttctctccag

SEQ ID NO: 3569590 - DNA, 16 bp, Homo sapiens
tctcttctctccagct

SEQ ID NO: 3569591 - DNA, 23 bp, Homo sapiens
tctcttctctccagctgactaaa

SEQ ID NO: 3569592 - DNA, 13 bp, Homo sapiens
tctcttctggtgt

SEQ ID NO: 3569593 - DNA, 12 bp, Homo sapiens
tctcttctttaa

SEQ ID NO: 3569594 - DNA, 23 bp, Homo sapiens
tctcttgaataaagtattctagt

SEQ ID NO: 3569595 - DNA, 18 bp, Homo sapiens
tctcttgcccttcctact

SEQ ID NO: 3569596 - DNA, 13 bp, Homo sapiens
tctcttgctttct

SEQ ID NO: 3569597 - DNA, 15 bp, Homo sapiens
tctctttcttatttt

SEQ ID NO: 3569598 - DNA, 20 bp, Homo sapiens
tctctttcttattttgtaat

SEQ ID NO: 3569599 - DNA, 14 bp, Homo sapiens
tctgaaaaagacat

SEQ ID NO: 3569600 - DNA, 20 bp, Homo sapiens
tctgaaaaagacataaaaca

SEQ ID NO: 3569601 - DNA, 15 bp, Homo sapiens
tctgaaaggccagca

SEQ ID NO: 3569602 - DNA, 18 bp, Homo sapiens
tctgaaaggccagcagct

SEQ ID NO: 3569603 - DNA, 17 bp, Homo sapiens
tccttttttatacagga

SEQ ID NO: 3569604 - DNA, 15 bp, Homo sapiens
tcgacagggcctgga

SEQ ID NO: 3569605 - DNA, 19 bp, Homo sapiens
tcgacccagaatggagcct

SEQ ID NO: 3569606 - DNA, 16 bp, Homo sapiens
tcgactcagcctcagg

SEQ ID NO: 3569607 - DNA, 17 bp, Homo sapiens
tcgactggtccagctct

SEQ ID NO: 3569608 - DNA, 13 bp, Homo sapiens
tcgagaccagcct

SEQ ID NO: 3569609 - DNA, 14 bp, Homo sapiens
tcgagaccagcctg

SEQ ID NO: 3569610 - DNA, 17 bp, Homo sapiens
tcgagaccagcctggcc

SEQ ID NO: 3569611 - DNA, 18 bp, Homo sapiens
tcgagaccagcctggcca

SEQ ID NO: 3569612 - DNA, 20 bp, Homo sapiens
tcgagaccatcctggccaac

SEQ ID NO: 3569613 - DNA, 13 bp, Homo sapiens
tcgagagccttac

SEQ ID NO: 3569614 - DNA, 14 bp, Homo sapiens
tcgagatagttttt

SEQ ID NO: 3569615 - DNA, 20 bp, Homo sapiens
tcgaggccacattgctggct

SEQ ID NO: 3569616 - DNA, 21 bp, Homo sapiens
tcgaggccacattgctggctg

SEQ ID NO: 3569617 - DNA, 14 bp, Homo sapiens
tcgatatttattga

SEQ ID NO: 3569618 - DNA, 23 bp, Homo sapiens
tcgcaatagttttttacttctct

SEQ ID NO: 3569619 - DNA, 12 bp, Homo sapiens
tcgcccagcagg

SEQ ID NO: 3569620 - DNA, 14 bp, Homo sapiens
tcgccctcccaggc

SEQ ID NO: 3569621 - DNA, 16 bp, Homo sapiens
tcgcctgcctgcagca

SEQ ID NO: 3569622 - DNA, 23 bp, Homo sapiens
tcgctaaagggaccatctgctgc

SEQ ID NO: 3569623 - DNA, 15 bp, Homo sapiens
tcgctggactattgt

SEQ ID NO: 3569624 - DNA, 16 bp, Homo sapiens
tcgctgtgccacaggc

SEQ ID NO: 3569625 - DNA, 21 bp, Homo sapiens
tcggacatgcttttctgccac

SEQ ID NO: 3569626 - DNA, 22 bp, Homo sapiens
tcggacatgcttttctgccact

SEQ ID NO: 3569627 - DNA, 19 bp, Homo sapiens
tcggactgcccccagaaag

SEQ ID NO: 3569628 - DNA, 16 bp, Homo sapiens
tcggagaagagctgtt

SEQ ID NO: 3569629 - DNA, 16 bp, Homo sapiens
tcggagagcagcagca

SEQ ID NO: 3569630 - DNA, 11 bp, Homo sapiens
tcggagaggga

SEQ ID NO: 3569631 - DNA, 16 bp, Homo sapiens
tcggaggcccatgccc

SEQ ID NO: 3569632 - DNA, 14 bp, Homo sapiens
tcggagtgcctgga

SEQ ID NO: 3569633 - DNA, 13 bp, Homo sapiens
tcggatccccttc

SEQ ID NO: 3569634 - DNA, 12 bp, Homo sapiens
tcggctgccagg

SEQ ID NO: 3569635 - DNA, 13 bp, Homo sapiens
tcgggagcaccca

SEQ ID NO: 3569636 - DNA, 14 bp, Homo sapiens
tcgggagcacccag

SEQ ID NO: 3569637 - DNA, 19 bp, Homo sapiens
tcgggagccctagccctgc

SEQ ID NO: 3569638 - DNA, 20 bp, Homo sapiens
tcgggagccctagccctgct

SEQ ID NO: 3569639 - DNA, 18 bp, Homo sapiens
tcgggagccttgtcagtg

SEQ ID NO: 3569640 - DNA, 21 bp, Homo sapiens
tcgggagccttgtcagtgtgt

SEQ ID NO: 3569641 - DNA, 22 bp, Homo sapiens
tcgggccccatcctcatccctg

SEQ ID NO: 3569642 - DNA, 15 bp, Homo sapiens
tcggtacccaccaca

SEQ ID NO: 3569643 - DNA, 13 bp, Homo sapiens
tcggtcctggtgc

SEQ ID NO: 3569644 - DNA, 16 bp, Homo sapiens
tcggtgtccccaccat

SEQ ID NO: 3569645 - DNA, 13 bp, Homo sapiens
tcgtgagctgggg

SEQ ID NO: 3569646 - DNA, 18 bp, Homo sapiens
tcgtgagctggggactca

SEQ ID NO: 3569647 - DNA, 20 bp, Homo sapiens
tcgtgagctggggactcagg

SEQ ID NO: 3569648 - DNA, 13 bp, Homo sapiens
tcgtgaggggcaa

SEQ ID NO: 3569649 - DNA, 22 bp, Homo sapiens
tcgtgctggcggacgcagctgg

SEQ ID NO: 3569650 - DNA, 13 bp, Homo sapiens
tcgtgctgtgctc

SEQ ID NO: 3569651 - DNA, 17 bp, Homo sapiens
tcgtggactgtgctggt

SEQ ID NO: 3569652 - DNA, 19 bp, Homo sapiens
tcgtgggaaaggggagtag

SEQ ID NO: 3569653 - DNA, 14 bp, Homo sapiens
tcgtggtgggggag

SEQ ID NO: 3569654 - DNA, 14 bp, Homo sapiens
tcgtgtatttatta

SEQ ID NO: 3569655 - DNA, 21 bp, Homo sapiens
tcgtgttggtattttcagaga

SEQ ID NO: 3569656 - DNA, 22 bp, Homo sapiens
tcgtgttggtattttcagagaa

SEQ ID NO: 3569657 - DNA, 13 bp, Homo sapiens
tcgttctctgcct

SEQ ID NO: 3569658 - DNA, 15 bp, Homo sapiens
tcgttttccaaagag

SEQ ID NO: 3569659 - DNA, 11 bp, Homo sapiens
tctaaaacaat

SEQ ID NO: 3569660 - DNA, 13 bp, Homo sapiens
tctaaaacaataa

SEQ ID NO: 3569661 - DNA, 19 bp, Homo sapiens
tctaaaatctaaaatttca

SEQ ID NO: 3569662 - DNA, 18 bp, Homo sapiens
tctaaaatgttaaaacat

SEQ ID NO: 3569663 - DNA, 13 bp, Homo sapiens
tctaaagagcatc

SEQ ID NO: 3569664 - DNA, 16 bp, Homo sapiens
tctaaagccaagcact

SEQ ID NO: 3569665 - DNA, 18 bp, Homo sapiens
tctaaattacaaaggtaa

SEQ ID NO: 3569666 - DNA, 23 bp, Homo sapiens
tctaacagccctcctctgcactc

SEQ ID NO: 3569667 - DNA, 14 bp, Homo sapiens
tctaacctgtgacc

SEQ ID NO: 3569668 - DNA, 16 bp, Homo sapiens
tctaagcctgaagggg

SEQ ID NO: 3569669 - DNA, 22 bp, Homo sapiens
tctaagtaaaaccacagcagtt

SEQ ID NO: 3569670 - DNA, 21 bp, Homo sapiens
tctaagtatttaaatgttcta

SEQ ID NO: 3569671 - DNA, 13 bp, Homo sapiens
tctaagtgctgct

SEQ ID NO: 3569672 - DNA, 14 bp, Homo sapiens
tctaataaacactg

SEQ ID NO: 3569673 - DNA, 15 bp, Homo sapiens
tctaatagtttttca

SEQ ID NO: 3569674 - DNA, 22 bp, Homo sapiens
tctaatattagttggctttcat

SEQ ID NO: 3569675 - DNA, 13 bp, Homo sapiens
tctaatcagtgat

SEQ ID NO: 3569676 - DNA, 23 bp, Homo sapiens
tctaatcagtgattatttttcca

SEQ ID NO: 3569677 - DNA, 18 bp, Homo sapiens
tctaatccttttccttat

SEQ ID NO: 3569678 - DNA, 12 bp, Homo sapiens
tctaatctgaac

SEQ ID NO: 3569679 - DNA, 13 bp, Homo sapiens
tctaatctgaact

SEQ ID NO: 3569680 - DNA, 20 bp, Homo sapiens
tctaatgattcaaatgtttt

SEQ ID NO: 3569681 - DNA, 17 bp, Homo sapiens
tctaatgtctgcagctc

SEQ ID NO: 3569682 - DNA, 14 bp, Homo sapiens
tctaatgtgtgaat

SEQ ID NO: 3569683 - DNA, 14 bp, Homo sapiens
tctaatttaactta

SEQ ID NO: 3569684 - DNA, 16 bp, Homo sapiens
tctaatttaacttatt

SEQ ID NO: 3569685 - DNA, 16 bp, Homo sapiens
tctacaactggagttt

SEQ ID NO: 3569686 - DNA, 14 bp, Homo sapiens
tctaccaagctgtc

SEQ ID NO: 3569687 - DNA, 16 bp, Homo sapiens
tctaccaagctgtcac

SEQ ID NO: 3569688 - DNA, 15 bp, Homo sapiens
tctaccatttcagag

SEQ ID NO: 3569689 - DNA, 18 bp, Homo sapiens
tctaccatttcagagagg

SEQ ID NO: 3569690 - DNA, 21 bp, Homo sapiens
tctaccccagactagatgtag

SEQ ID NO: 3569691 - DNA, 17 bp, Homo sapiens
tctacccttggaaagaa

SEQ ID NO: 3569692 - DNA, 18 bp, Homo sapiens
tctacccttggaaagaaa

SEQ ID NO: 3569693 - DNA, 14 bp, Homo sapiens
tctacctgtcctcc

SEQ ID NO: 3569694 - DNA, 20 bp, Homo sapiens
tctactaagttattttatga

SEQ ID NO: 3569695 - DNA, 15 bp, Homo sapiens
tctactatgatcaga

SEQ ID NO: 3569696 - DNA, 20 bp, Homo sapiens
tctactatgatcagaagaac

SEQ ID NO: 3569697 - DNA, 19 bp, Homo sapiens
tctagaaagagaaacagtt

SEQ ID NO: 3569698 - DNA, 13 bp, Homo sapiens
tctagcctctgga

SEQ ID NO: 3569699 - DNA, 21 bp, Homo sapiens
tctagcctctggactggaaag

SEQ ID NO: 3569700 - DNA, 21 bp, Homo sapiens
tctagcctggcaacagagcga

SEQ ID NO: 3569701 - DNA, 22 bp, Homo sapiens
tctagcctggcaacagagcgag

SEQ ID NO: 3569702 - DNA, 16 bp, Homo sapiens
tctagctctcacagac

SEQ ID NO: 3569703 - DNA, 17 bp, Homo sapiens
tctagctctcacagaca

SEQ ID NO: 3569704 - DNA, 20 bp, Homo sapiens
tctaggcatacttttcaaag

SEQ ID NO: 3569705 - DNA, 13 bp, Homo sapiens
tctaggccctgtg

SEQ ID NO: 3569706 - DNA, 15 bp, Homo sapiens
tctaggccctgtgag

SEQ ID NO: 3569707 - DNA, 20 bp, Homo sapiens
tctaggccctgtgagcacaa

SEQ ID NO: 3569708 - DNA, 23 bp, Homo sapiens
tctaggccctgtgagcacaaaga

SEQ ID NO: 3569709 - DNA, 17 bp, Homo sapiens
tctaggcctttcctctg

SEQ ID NO: 3569710 - DNA, 18 bp, Homo sapiens
tctaggcctttcctctgc

SEQ ID NO: 3569711 - DNA, 21 bp, Homo sapiens
tctaggcctttcctctgcacg

SEQ ID NO: 3569712 - DNA, 22 bp, Homo sapiens
tctagggacatgaaatttacaa

SEQ ID NO: 3569713 - DNA, 18 bp, Homo sapiens
tctagggtccctgaacgc

SEQ ID NO: 3569714 - DNA, 23 bp, Homo sapiens
tctagggtccctgaacgccctgg

SEQ ID NO: 3569715 - DNA, 15 bp, Homo sapiens
tctagtacctgtgac

SEQ ID NO: 3569716 - DNA, 17 bp, Homo sapiens
tctagtacctgtgactc

SEQ ID NO: 3569717 - DNA, 14 bp, Homo sapiens
tctagtgccttcta

SEQ ID NO: 3569718 - DNA, 18 bp, Homo sapiens
tctagtgtccataaataa

SEQ ID NO: 3569719 - DNA, 19 bp, Homo sapiens
tctagtgtccataaataaa

SEQ ID NO: 3569720 - DNA, 21 bp, Homo sapiens
tctataacagatcctttcaaa

SEQ ID NO: 3569721 - DNA, 15 bp, Homo sapiens
tctatacagtagctt

SEQ ID NO: 3569722 - DNA, 15 bp, Homo sapiens
tctatacccacccag

SEQ ID NO: 3569723 - DNA, 17 bp, Homo sapiens
tctatacccacccagaa

SEQ ID NO: 3569724 - DNA, 12 bp, Homo sapiens
tctatactgtgg

SEQ ID NO: 3569725 - DNA, 20 bp, Homo sapiens
tctatactgtggcctgcagg

SEQ ID NO: 3569726 - DNA, 21 bp, Homo sapiens
tctatactgtggcctgcagga

SEQ ID NO: 3569727 - DNA, 17 bp, Homo sapiens
tctatagcaccagggct

SEQ ID NO: 3569728 - DNA, 23 bp, Homo sapiens
tctatataaaatgtattcaagca

SEQ ID NO: 3569729 - DNA, 19 bp, Homo sapiens
tctatattcctccagctgg

SEQ ID NO: 3569730 - DNA, 16 bp, Homo sapiens
tctatctcatctgtct

SEQ ID NO: 3569731 - DNA, 21 bp, Homo sapiens
tctatgctgtttgtagtgaaa

SEQ ID NO: 3569732 - DNA, 23 bp, Homo sapiens
tctatgggaagatacttattttt

SEQ ID NO: 3569733 - DNA, 16 bp, Homo sapiens
tctatgttaatatttt

SEQ ID NO: 3569734 - DNA, 13 bp, Homo sapiens
tctattctccaga

SEQ ID NO: 3569735 - DNA, 16 bp, Homo sapiens
tctattgatacaatat

SEQ ID NO: 3569736 - DNA, 14 bp, Homo sapiens
tctatttatgcctt

SEQ ID NO: 3569737 - DNA, 12 bp, Homo sapiens
tctatttattag

SEQ ID NO: 3569738 - DNA, 14 bp, Homo sapiens
tctatttcttgaag

SEQ ID NO: 3569739 - DNA, 11 bp, Homo sapiens
tctattttaca

SEQ ID NO: 3569740 - DNA, 15 bp, Homo sapiens
tctattttgtaactg

SEQ ID NO: 3569741 - DNA, 18 bp, Homo sapiens
tcctccgccttaccagga

SEQ ID NO: 3569742 - DNA, 15 bp, Homo sapiens
tcctccgtagggtct

SEQ ID NO: 3569743 - DNA, 14 bp, Homo sapiens
tcctcctacctcag

SEQ ID NO: 3569744 - DNA, 22 bp, Homo sapiens
tcctcctatctccctggctcac

SEQ ID NO: 3569745 - DNA, 13 bp, Homo sapiens
tcctcctcccaag

SEQ ID NO: 3569746 - DNA, 14 bp, Homo sapiens
tcctcctccctgca

SEQ ID NO: 3569747 - DNA, 18 bp, Homo sapiens
tcctcctccctgcatctg

SEQ ID NO: 3569748 - DNA, 14 bp, Homo sapiens
tcctcgcacacact

SEQ ID NO: 3569749 - DNA, 21 bp, Homo sapiens
tcctcggagagcagcagcacc

SEQ ID NO: 3569750 - DNA, 15 bp, Homo sapiens
tcctcgtgggtccca

SEQ ID NO: 3569751 - DNA, 23 bp, Homo sapiens
tcctcgtgggtcccagagacctc

SEQ ID NO: 3569752 - DNA, 18 bp, Homo sapiens
tcctctaggccctgtgag

SEQ ID NO: 3569753 - DNA, 16 bp, Homo sapiens
tcctctcaggctgggc

SEQ ID NO: 3569754 - DNA, 12 bp, Homo sapiens
tcctctccactg

SEQ ID NO: 3569755 - DNA, 18 bp, Homo sapiens
tcctctccactgccttcg

SEQ ID NO: 3569756 - DNA, 22 bp, Homo sapiens
tcctctcccattgtccctctgc

SEQ ID NO: 3569757 - DNA, 14 bp, Homo sapiens
tcctctccccagcc

SEQ ID NO: 3569758 - DNA, 16 bp, Homo sapiens
tcctctccccagccca

SEQ ID NO: 3569759 - DNA, 17 bp, Homo sapiens
tcctctccccagcccag

SEQ ID NO: 3569760 - DNA, 20 bp, Homo sapiens
tcctctccccagcccagaga

SEQ ID NO: 3569761 - DNA, 18 bp, Homo sapiens
tcctctcgagatagtttt

SEQ ID NO: 3569762 - DNA, 22 bp, Homo sapiens
tcctctcgagatagttttttct

SEQ ID NO: 3569763 - DNA, 16 bp, Homo sapiens
tcctctcggctgccag

SEQ ID NO: 3569764 - DNA, 17 bp, Homo sapiens
tcctctctgagtcaaat

SEQ ID NO: 3569765 - DNA, 18 bp, Homo sapiens
tcctctctgagtcaaatc

SEQ ID NO: 3569766 - DNA, 21 bp, Homo sapiens
tcctctctgagtcaaatccag

SEQ ID NO: 3569767 - DNA, 14 bp, Homo sapiens
tcctctctgcttca

SEQ ID NO: 3569768 - DNA, 14 bp, Homo sapiens
tcctctcttgggta

SEQ ID NO: 3569769 - DNA, 22 bp, Homo sapiens
tcctctgcctgggctctggaag

SEQ ID NO: 3569770 - DNA, 14 bp, Homo sapiens
tcctctgctgggaa

SEQ ID NO: 3569771 - DNA, 17 bp, Homo sapiens
tcctctgtccaggcact

SEQ ID NO: 3569772 - DNA, 17 bp, Homo sapiens
tcctcttagctcagctg

SEQ ID NO: 3569773 - DNA, 18 bp, Homo sapiens
tcctcttctgctcttttc

SEQ ID NO: 3569774 - DNA, 21 bp, Homo sapiens
tcctcttctgctcttttcctg

SEQ ID NO: 3569775 - DNA, 20 bp, Homo sapiens
tcctcttggccatccttctg

SEQ ID NO: 3569776 - DNA, 17 bp, Homo sapiens
tcctcttgttcctgaaa

SEQ ID NO: 3569777 - DNA, 19 bp, Homo sapiens
tcctcttgttcctgaaatg

SEQ ID NO: 3569778 - DNA, 16 bp, Homo sapiens
tcctctttgctttgct

SEQ ID NO: 3569779 - DNA, 18 bp, Homo sapiens
tcctcttttcctggcagc

SEQ ID NO: 3569780 - DNA, 15 bp, Homo sapiens
tcctgaaatgtgttt

SEQ ID NO: 3569781 - DNA, 18 bp, Homo sapiens
tcctgaaatgtgtttcct

SEQ ID NO: 3569782 - DNA, 15 bp, Homo sapiens
tcctgaactttctcc

SEQ ID NO: 3569783 - DNA, 23 bp, Homo sapiens
tcctgaagaaccagtccccccac

SEQ ID NO: 3569784 - DNA, 13 bp, Homo sapiens
tcctgaagctgct

SEQ ID NO: 3569785 - DNA, 15 bp, Homo sapiens
tcctgaagctgctgt

SEQ ID NO: 3569786 - DNA, 16 bp, Homo sapiens
tcctgaagctgctgtg

SEQ ID NO: 3569787 - DNA, 19 bp, Homo sapiens
tcctgaagctgctgtgtcc

SEQ ID NO: 3569788 - DNA, 15 bp, Homo sapiens
tcctgagctggcctg

SEQ ID NO: 3569789 - DNA, 16 bp, Homo sapiens
tcctgagctggcctgt

SEQ ID NO: 3569790 - DNA, 20 bp, Homo sapiens
tcctgagctggcctgtctgc

SEQ ID NO: 3569791 - DNA, 12 bp, Homo sapiens
tcctgagggcta

SEQ ID NO: 3569792 - DNA, 22 bp, Homo sapiens
tcctgataccattctattctcc

SEQ ID NO: 3569793 - DNA, 14 bp, Homo sapiens
tcctgcaggccagg

SEQ ID NO: 3569794 - DNA, 19 bp, Homo sapiens
tcctgcaggccaggccagc

SEQ ID NO: 3569795 - DNA, 15 bp, Homo sapiens
tcctgcagggcttct

SEQ ID NO: 3569796 - DNA, 24 bp, Homo sapiens
tcctgcagtcccacactgtgcaga

SEQ ID NO: 3569797 - DNA, 20 bp, Homo sapiens
tcctgccacatggagccccc

SEQ ID NO: 3569798 - DNA, 13 bp, Homo sapiens
tcctgccaccagc

SEQ ID NO: 3569799 - DNA, 13 bp, Homo sapiens
tcctgccccctgc

SEQ ID NO: 3569800 - DNA, 14 bp, Homo sapiens
tcctgcctcagcct

SEQ ID NO: 3569801 - DNA, 19 bp, Homo sapiens
tcctgcctcagcctcccca

SEQ ID NO: 3569802 - DNA, 17 bp, Homo sapiens
tcctgcctttaagccaa

SEQ ID NO: 3569803 - DNA, 18 bp, Homo sapiens
tcctgcctttaagccaaa

SEQ ID NO: 3569804 - DNA, 23 bp, Homo sapiens
tcctgcctttaagccaaagaaac

SEQ ID NO: 3569805 - DNA, 12 bp, Homo sapiens
tcctgcctttta

SEQ ID NO: 3569806 - DNA, 18 bp, Homo sapiens
tcctgctaagttaatgtt

SEQ ID NO: 3569807 - DNA, 14 bp, Homo sapiens
tcctgctgcaccct

SEQ ID NO: 3569808 - DNA, 21 bp, Homo sapiens
tcctgctgcaccctgcgcctc

SEQ ID NO: 3569809 - DNA, 17 bp, Homo sapiens
tcctgctgctgctactg

SEQ ID NO: 3569810 - DNA, 19 bp, Homo sapiens
tcctgcttttctgtcctgg

SEQ ID NO: 3569811 - DNA, 20 bp, Homo sapiens
tcctgcttttctgtcctggg

SEQ ID NO: 3569812 - DNA, 21 bp, Homo sapiens
tcctgcttttctgtcctgggc

SEQ ID NO: 3569813 - DNA, 13 bp, Homo sapiens
tcctggaaacagc

SEQ ID NO: 3569814 - DNA, 20 bp, Homo sapiens
tcctggaaacagcatgaata

SEQ ID NO: 3569815 - DNA, 19 bp, Homo sapiens
tcctggaggctggggatgg

SEQ ID NO: 3569816 - DNA, 18 bp, Homo sapiens
tcctggcacaatgttgga

SEQ ID NO: 3569817 - DNA, 17 bp, Homo sapiens
tcctggcagctgctgtg

SEQ ID NO: 3569818 - DNA, 17 bp, Homo sapiens
tcctggcagggccacct

SEQ ID NO: 3569819 - DNA, 23 bp, Homo sapiens
tcctggcagggccacctgcagga

SEQ ID NO: 3569820 - DNA, 20 bp, Homo sapiens
tcctggccatcccacaagtg

SEQ ID NO: 3569821 - DNA, 19 bp, Homo sapiens
tcctggccctgggggtctg

SEQ ID NO: 3569822 - DNA, 19 bp, Homo sapiens
tcctgggcacacgctgctc

SEQ ID NO: 3569823 - DNA, 18 bp, Homo sapiens
tcctgggcattagcaagg

SEQ ID NO: 3569824 - DNA, 15 bp, Homo sapiens
tcctgggcctgcaga

SEQ ID NO: 3569825 - DNA, 22 bp, Homo sapiens
tcctgggggttctttcttcctc

SEQ ID NO: 3569826 - DNA, 23 bp, Homo sapiens
tcctgggttcaagcaatcctcct

SEQ ID NO: 3569827 - DNA, 13 bp, Homo sapiens
tcctggtgccctg

SEQ ID NO: 3569828 - DNA, 21 bp, Homo sapiens
tcctggtgcctatctgcctgg

SEQ ID NO: 3569829 - DNA, 19 bp, Homo sapiens
tcctgtccctcatccatag

SEQ ID NO: 3569830 - DNA, 13 bp, Homo sapiens
tcctgtcctgctc

SEQ ID NO: 3569831 - DNA, 22 bp, Homo sapiens
tcctgtcttctttctccatgga

SEQ ID NO: 3569832 - DNA, 23 bp, Homo sapiens
tcctgtgccctagatgcacgtgg

SEQ ID NO: 3569833 - DNA, 15 bp, Homo sapiens
tcctgtgcctttcct

SEQ ID NO: 3569834 - DNA, 23 bp, Homo sapiens
tcctgttcagaaaggggctcttc

SEQ ID NO: 3569835 - DNA, 23 bp, Homo sapiens
tcctgtttggtggggtggcacct

SEQ ID NO: 3569836 - DNA, 20 bp, Homo sapiens
tccttaacccacctctcctg

SEQ ID NO: 3569837 - DNA, 16 bp, Homo sapiens
tccttaagagacaatt

SEQ ID NO: 3569838 - DNA, 11 bp, Homo sapiens
tccttaagtat

SEQ ID NO: 3569839 - DNA, 21 bp, Homo sapiens
tccttataggcctgtcccttg

SEQ ID NO: 3569840 - DNA, 17 bp, Homo sapiens
tccttatccctctcttc

SEQ ID NO: 3569841 - DNA, 12 bp, Homo sapiens
tccttattcagc

SEQ ID NO: 3569842 - DNA, 15 bp, Homo sapiens
tccttatttgccttc

SEQ ID NO: 3569843 - DNA, 19 bp, Homo sapiens
tccttatttgccttctact

SEQ ID NO: 3569844 - DNA, 15 bp, Homo sapiens
tccttcagatatttt

SEQ ID NO: 3569845 - DNA, 11 bp, Homo sapiens
tccttcagcac

SEQ ID NO: 3569846 - DNA, 16 bp, Homo sapiens
tccttcaggcagctga

SEQ ID NO: 3569847 - DNA, 20 bp, Homo sapiens
tccttcaggcagctgaaatt

SEQ ID NO: 3569848 - DNA, 23 bp, Homo sapiens
tccttcagtgagcccctccccag

SEQ ID NO: 3569849 - DNA, 13 bp, Homo sapiens
tccttccacctgc

SEQ ID NO: 3569850 - DNA, 14 bp, Homo sapiens
tccttccacctgcc

SEQ ID NO: 3569851 - DNA, 17 bp, Homo sapiens
tccttccccaagtaatt

SEQ ID NO: 3569852 - DNA, 19 bp, Homo sapiens
tccttccctgttctccctt

SEQ ID NO: 3569853 - DNA, 21 bp, Homo sapiens
tccttccctgttctccctttc

SEQ ID NO: 3569854 - DNA, 15 bp, Homo sapiens
tccttctcactgcca

SEQ ID NO: 3569855 - DNA, 12 bp, Homo sapiens
tccttctccttc

SEQ ID NO: 3569856 - DNA, 12 bp, Homo sapiens
tccttctctggg

SEQ ID NO: 3569857 - DNA, 23 bp, Homo sapiens
tccttctctgggtctgattttct

SEQ ID NO: 3569858 - DNA, 12 bp, Homo sapiens
tccttctgaagt

SEQ ID NO: 3569859 - DNA, 18 bp, Homo sapiens
tccttgattacttccact

SEQ ID NO: 3569860 - DNA, 22 bp, Homo sapiens
tccttgcttatgacatcacttg

SEQ ID NO: 3569861 - DNA, 16 bp, Homo sapiens
tccttggactcatttt

SEQ ID NO: 3569862 - DNA, 17 bp, Homo sapiens
tccttggccatgcagaa

SEQ ID NO: 3569863 - DNA, 18 bp, Homo sapiens
tccttggctttatgcaaa

SEQ ID NO: 3569864 - DNA, 22 bp, Homo sapiens
tccttggctttcagagccagcc

SEQ ID NO: 3569865 - DNA, 23 bp, Homo sapiens
tccttgtcccgtctggacctggg

SEQ ID NO: 3569866 - DNA, 14 bp, Homo sapiens
tccttgtggcctat

SEQ ID NO: 3569867 - DNA, 14 bp, Homo sapiens
tcctttactcctgg

SEQ ID NO: 3569868 - DNA, 16 bp, Homo sapiens
tcctttactcctggct

SEQ ID NO: 3569869 - DNA, 16 bp, Homo sapiens
tcctttcacaaccttc

SEQ ID NO: 3569870 - DNA, 19 bp, Homo sapiens
tcctttcacaaccttctgt

SEQ ID NO: 3569871 - DNA, 13 bp, Homo sapiens
tcctttgttactt

SEQ ID NO: 3569872 - DNA, 23 bp, Homo sapiens
tccttttatctccttgtggccta

SEQ ID NO: 3569873 - DNA, 11 bp, Homo sapiens
tccttttccta

SEQ ID NO: 3569874 - DNA, 14 bp, Homo sapiens
tccttttcctatcc

SEQ ID NO: 3569875 - DNA, 13 bp, Homo sapiens
tccttttgacact

SEQ ID NO: 3569876 - DNA, 14 bp, Homo sapiens
tccttttgacactg

SEQ ID NO: 3569877 - DNA, 22 bp, Homo sapiens
tccttttgacactgctctaaca

SEQ ID NO: 3569878 - DNA, 16 bp, Homo sapiens
tccctctcttcccctt

SEQ ID NO: 3569879 - DNA, 15 bp, Homo sapiens
tccctcttcctctcc

SEQ ID NO: 3569880 - DNA, 21 bp, Homo sapiens
tccctgcaaaactccaggcag

SEQ ID NO: 3569881 - DNA, 14 bp, Homo sapiens
tccctgcagggcca

SEQ ID NO: 3569882 - DNA, 16 bp, Homo sapiens
tccctgcatctgacca

SEQ ID NO: 3569883 - DNA, 19 bp, Homo sapiens
tccctgcccctctctgcct

SEQ ID NO: 3569884 - DNA, 16 bp, Homo sapiens
tccctgcctcaggcca

SEQ ID NO: 3569885 - DNA, 18 bp, Homo sapiens
tccctgcctcaggccaag

SEQ ID NO: 3569886 - DNA, 15 bp, Homo sapiens
tccctgcctgctcct

SEQ ID NO: 3569887 - DNA, 19 bp, Homo sapiens
tccctgcctgctccttggc

SEQ ID NO: 3569888 - DNA, 23 bp, Homo sapiens
tccctgcctgctccttggcaccc

SEQ ID NO: 3569889 - DNA, 12 bp, Homo sapiens
tccctgcctgga

SEQ ID NO: 3569890 - DNA, 16 bp, Homo sapiens
tccctgcctggaggct

SEQ ID NO: 3569891 - DNA, 15 bp, Homo sapiens
tccctgcctgtttcc

SEQ ID NO: 3569892 - DNA, 12 bp, Homo sapiens
tccctgctgaat

SEQ ID NO: 3569893 - DNA, 14 bp, Homo sapiens
tccctgctgtgcca

SEQ ID NO: 3569894 - DNA, 22 bp, Homo sapiens
tccctgctgtgccatgctgggc

SEQ ID NO: 3569895 - DNA, 17 bp, Homo sapiens
tccctgctttgcatctt

SEQ ID NO: 3569896 - DNA, 18 bp, Homo sapiens
tccctgctttgcatcttt

SEQ ID NO: 3569897 - DNA, 12 bp, Homo sapiens
tccctggacaca

SEQ ID NO: 3569898 - DNA, 13 bp, Homo sapiens
tccctggacacag

SEQ ID NO: 3569899 - DNA, 17 bp, Homo sapiens
tccctggagcaggagcc

SEQ ID NO: 3569900 - DNA, 17 bp, Homo sapiens
tccctggctcactggca

SEQ ID NO: 3569901 - DNA, 16 bp, Homo sapiens
tccctgggagggaggt

SEQ ID NO: 3569902 - DNA, 14 bp, Homo sapiens
tccctggggtgggg

SEQ ID NO: 3569903 - DNA, 14 bp, Homo sapiens
tccctgggtctggg

SEQ ID NO: 3569904 - DNA, 16 bp, Homo sapiens
tccctggtcggagagg

SEQ ID NO: 3569905 - DNA, 17 bp, Homo sapiens
tccctggtcggagaggg

SEQ ID NO: 3569906 - DNA, 14 bp, Homo sapiens
tccctgtctccagc

SEQ ID NO: 3569907 - DNA, 17 bp, Homo sapiens
tccctgtctccagctgc

SEQ ID NO: 3569908 - DNA, 18 bp, Homo sapiens
tccctgtctccagctgcc

SEQ ID NO: 3569909 - DNA, 19 bp, Homo sapiens
tccctgtctccagctgcct

SEQ ID NO: 3569910 - DNA, 21 bp, Homo sapiens
tccctgtctccagctgcctgg

SEQ ID NO: 3569911 - DNA, 22 bp, Homo sapiens
tccctgtctccagctgcctggg

SEQ ID NO: 3569912 - DNA, 23 bp, Homo sapiens
tccctgtctccagctgcctgggc

SEQ ID NO: 3569913 - DNA, 15 bp, Homo sapiens
tccctgttccccaga

SEQ ID NO: 3569914 - DNA, 16 bp, Homo sapiens
tccctgttccccagag

SEQ ID NO: 3569915 - DNA, 15 bp, Homo sapiens
tccctgttctccctt

SEQ ID NO: 3569916 - DNA, 23 bp, Homo sapiens
tccctgttctccctttctctctc

SEQ ID NO: 3569917 - DNA, 14 bp, Homo sapiens
tcccttacaaggtg

SEQ ID NO: 3569918 - DNA, 20 bp, Homo sapiens
tcccttcaagacgaggggca

SEQ ID NO: 3569919 - DNA, 17 bp, Homo sapiens
tcccttcctggaaacag

SEQ ID NO: 3569920 - DNA, 22 bp, Homo sapiens
tcccttcctggaaacagcatga

SEQ ID NO: 3569921 - DNA, 23 bp, Homo sapiens
tcccttcctggaaacagcatgaa

SEQ ID NO: 3569922 - DNA, 15 bp, Homo sapiens
tcccttctgctactg

SEQ ID NO: 3569923 - DNA, 19 bp, Homo sapiens
tcccttgcctctgccctgg

SEQ ID NO: 3569924 - DNA, 22 bp, Homo sapiens
tcccttgcctctgccctggatt

SEQ ID NO: 3569925 - DNA, 20 bp, Homo sapiens
tccctttctaagcaaccaca

SEQ ID NO: 3569926 - DNA, 21 bp, Homo sapiens
tccctttctaagcaaccacac

SEQ ID NO: 3569927 - DNA, 17 bp, Homo sapiens
tccctttctctctcctc

SEQ ID NO: 3569928 - DNA, 14 bp, Homo sapiens
tcccttttccatga

SEQ ID NO: 3569929 - DNA, 17 bp, Homo sapiens
tccgaaatgctgtcttt

SEQ ID NO: 3569930 - DNA, 20 bp, Homo sapiens
tccgaaatgctgtctttctt

SEQ ID NO: 3569931 - DNA, 15 bp, Homo sapiens
tccgaagtctctgat

SEQ ID NO: 3569932 - DNA, 16 bp, Homo sapiens
tccgatgcccgcccgg

SEQ ID NO: 3569933 - DNA, 12 bp, Homo sapiens
tccgcctgtggg

SEQ ID NO: 3569934 - DNA, 18 bp, Homo sapiens
tccgctttgaaagaagca

SEQ ID NO: 3569935 - DNA, 19 bp, Homo sapiens
tccgctttgaaagaagcaa

SEQ ID NO: 3569936 - DNA, 20 bp, Homo sapiens
tccgctttgaaagaagcaag

SEQ ID NO: 3569937 - DNA, 16 bp, Homo sapiens
tccggagcgccctgca

SEQ ID NO: 3569938 - DNA, 19 bp, Homo sapiens
tccggccaaggtgccacca

SEQ ID NO: 3569939 - DNA, 14 bp, Homo sapiens
tccggggagaaacc

SEQ ID NO: 3569940 - DNA, 20 bp, Homo sapiens
tccggggagaaacccagaga

SEQ ID NO: 3569941 - DNA, 22 bp, Homo sapiens
tccgggggcagctctggagggg

SEQ ID NO: 3569942 - DNA, 16 bp, Homo sapiens
tccgtagctctgctgc

SEQ ID NO: 3569943 - DNA, 18 bp, Homo sapiens
tccgtagctctgctgctg

SEQ ID NO: 3569944 - DNA, 19 bp, Homo sapiens
tccgtagctctgctgctga

SEQ ID NO: 3569945 - DNA, 20 bp, Homo sapiens
tccgtagggtctttcttggg

SEQ ID NO: 3569946 - DNA, 21 bp, Homo sapiens
tccgtccatccgactgcccct

SEQ ID NO: 3569947 - DNA, 18 bp, Homo sapiens
tccgtgccccttccctgg

SEQ ID NO: 3569948 - DNA, 18 bp, Homo sapiens
tccgtgctgacagctgct

SEQ ID NO: 3569949 - DNA, 19 bp, Homo sapiens
tccgtgctgacagctgctc

SEQ ID NO: 3569950 - DNA, 21 bp, Homo sapiens
tccgtgctgacagctgctcct

SEQ ID NO: 3569951 - DNA, 21 bp, Homo sapiens
tccgtggccccgccctcaggc

SEQ ID NO: 3569952 - DNA, 14 bp, Homo sapiens
tccgtgtttctcta

SEQ ID NO: 3569953 - DNA, 15 bp, Homo sapiens
tccgtgtttctctaa

SEQ ID NO: 3569954 - DNA, 16 bp, Homo sapiens
tccgtgtttctctaag

SEQ ID NO: 3569955 - DNA, 21 bp, Homo sapiens
tccgtttattataaactgtat

SEQ ID NO: 3569956 - DNA, 16 bp, Homo sapiens
tccgtttcgcgctggc

SEQ ID NO: 3569957 - DNA, 22 bp, Homo sapiens
tcctaaaactgggattaagaaa

SEQ ID NO: 3569958 - DNA, 23 bp, Homo sapiens
tcctaaaactgggattaagaaac

SEQ ID NO: 3569959 - DNA, 20 bp, Homo sapiens
tcctaattgtgcccctaaag

SEQ ID NO: 3569960 - DNA, 22 bp, Homo sapiens
tcctacagtgactccctgggag

SEQ ID NO: 3569961 - DNA, 14 bp, Homo sapiens
tcctacccatcccc

SEQ ID NO: 3569962 - DNA, 15 bp, Homo sapiens
tcctaccctcccacc

SEQ ID NO: 3569963 - DNA, 17 bp, Homo sapiens
tcctaccctcccaccag

SEQ ID NO: 3569964 - DNA, 21 bp, Homo sapiens
tcctaccctcccaccagaacg

SEQ ID NO: 3569965 - DNA, 20 bp, Homo sapiens
tcctacctcagcctcctggg

SEQ ID NO: 3569966 - DNA, 23 bp, Homo sapiens
tcctacgcaccattttgtcaggt

SEQ ID NO: 3569967 - DNA, 16 bp, Homo sapiens
tcctagactgctcctg

SEQ ID NO: 3569968 - DNA, 19 bp, Homo sapiens
tcctagactgctcctgggc

SEQ ID NO: 3569969 - DNA, 19 bp, Homo sapiens
tcctagacttgaaagtttt

SEQ ID NO: 3569970 - DNA, 20 bp, Homo sapiens
tcctagacttgaaagttttc

SEQ ID NO: 3569971 - DNA, 17 bp, Homo sapiens
tcctagagggaggggcc

SEQ ID NO: 3569972 - DNA, 20 bp, Homo sapiens
tcctagctaggagcaggctt

SEQ ID NO: 3569973 - DNA, 20 bp, Homo sapiens
tcctagctgtgttattcctg

SEQ ID NO: 3569974 - DNA, 17 bp, Homo sapiens
tcctagtcattcttccc

SEQ ID NO: 3569975 - DNA, 14 bp, Homo sapiens
tcctagtgaaagag

SEQ ID NO: 3569976 - DNA, 23 bp, Homo sapiens
tcctagtggagttttataaatta

SEQ ID NO: 3569977 - DNA, 17 bp, Homo sapiens
tcctatcagaagtttct

SEQ ID NO: 3569978 - DNA, 13 bp, Homo sapiens
tcctatctccctg

SEQ ID NO: 3569979 - DNA, 20 bp, Homo sapiens
tcctatctccctggctcact

SEQ ID NO: 3569980 - DNA, 20 bp, Homo sapiens
tcctatgaaatactttatag

SEQ ID NO: 3569981 - DNA, 22 bp, Homo sapiens
tcctatgatggatggcagactc

SEQ ID NO: 3569982 - DNA, 23 bp, Homo sapiens
tcctatgatggatggcagactct

SEQ ID NO: 3569983 - DNA, 12 bp, Homo sapiens
tcctattatatt

SEQ ID NO: 3569984 - DNA, 15 bp, Homo sapiens
tcctcaaagaaagtg

SEQ ID NO: 3569985 - DNA, 16 bp, Homo sapiens
tcctcaaagaaagtgt

SEQ ID NO: 3569986 - DNA, 19 bp, Homo sapiens
tcctcaaagaaagtgtatt

SEQ ID NO: 3569987 - DNA, 15 bp, Homo sapiens
tcctcacccacctct

SEQ ID NO: 3569988 - DNA, 13 bp, Homo sapiens
tcctcacccccag

SEQ ID NO: 3569989 - DNA, 16 bp, Homo sapiens
tcctcacccccagctt

SEQ ID NO: 3569990 - DNA, 17 bp, Homo sapiens
tcctcacgccttggcct

SEQ ID NO: 3569991 - DNA, 20 bp, Homo sapiens
tcctcagagaatttctacca

SEQ ID NO: 3569992 - DNA, 14 bp, Homo sapiens
tcctcagctccctg

SEQ ID NO: 3569993 - DNA, 14 bp, Homo sapiens
tcctcagctgcctc

SEQ ID NO: 3569994 - DNA, 21 bp, Homo sapiens
tcctcagctgcctcctgcgcc

SEQ ID NO: 3569995 - DNA, 19 bp, Homo sapiens
tcctcagggatcacactgc

SEQ ID NO: 3569996 - DNA, 12 bp, Homo sapiens
tcctcatccctg

SEQ ID NO: 3569997 - DNA, 21 bp, Homo sapiens
tcctcatctgggggagtggaa

SEQ ID NO: 3569998 - DNA, 12 bp, Homo sapiens
tcctccaagcca

SEQ ID NO: 3569999 - DNA, 14 bp, Homo sapiens
tcctccaagccagc

SEQ ID NO: 3570000 - DNA, 13 bp, Homo sapiens
tcctccacagaga

SEQ ID NO: 3570001 - DNA, 14 bp, Homo sapiens
tcctccacttcatt

SEQ ID NO: 3570002 - DNA, 12 bp, Homo sapiens
tcctccagcagg

SEQ ID NO: 3570003 - DNA, 20 bp, Homo sapiens
tcctccagcagggaaaatgc

SEQ ID NO: 3570004 - DNA, 17 bp, Homo sapiens
tcctccagcctcccctc

SEQ ID NO: 3570005 - DNA, 19 bp, Homo sapiens
tcctccagcctcccctccc

SEQ ID NO: 3570006 - DNA, 23 bp, Homo sapiens
tcctccagcctcccctcccctgg

SEQ ID NO: 3570007 - DNA, 12 bp, Homo sapiens
tcctccaggtcg

SEQ ID NO: 3570008 - DNA, 11 bp, Homo sapiens
tcctccaggtt

SEQ ID NO: 3570009 - DNA, 21 bp, Homo sapiens
tcctccaggtttttcaattaa

SEQ ID NO: 3570010 - DNA, 17 bp, Homo sapiens
tcctccatctttctaca

SEQ ID NO: 3570011 - DNA, 22 bp, Homo sapiens
tcctcccaaggcattctcccag

SEQ ID NO: 3570012 - DNA, 20 bp, Homo sapiens
tcctcccgaaaaatgtgtgg

SEQ ID NO: 3570013 - DNA, 13 bp, Homo sapiens
tcctcccttctgc

SEQ ID NO: 3570014 - DNA, 15 bp, Homo sapiens
tcccaagtgtactat

SEQ ID NO: 3570015 - DNA, 14 bp, Homo sapiens
tcccaatctttcta

SEQ ID NO: 3570016 - DNA, 19 bp, Homo sapiens
tcccaatctttctatataa

SEQ ID NO: 3570017 - DNA, 22 bp, Homo sapiens
tcccacaactactagtgtgact

SEQ ID NO: 3570018 - DNA, 18 bp, Homo sapiens
tcccacagcagccccagg

SEQ ID NO: 3570019 - DNA, 16 bp, Homo sapiens
tcccacaggagggcca

SEQ ID NO: 3570020 - DNA, 15 bp, Homo sapiens
tcccacaggcccttc

SEQ ID NO: 3570021 - DNA, 13 bp, Homo sapiens
tcccacatgaggc

SEQ ID NO: 3570022 - DNA, 23 bp, Homo sapiens
tcccacatgaggccatctcagga

SEQ ID NO: 3570023 - DNA, 23 bp, Homo sapiens
tcccacatggccatcttctttct

SEQ ID NO: 3570024 - DNA, 22 bp, Homo sapiens
tcccaccagaacgcaccccact

SEQ ID NO: 3570025 - DNA, 16 bp, Homo sapiens
tcccaccagagccggg

SEQ ID NO: 3570026 - DNA, 16 bp, Homo sapiens
tcccaccattcctgcc

SEQ ID NO: 3570027 - DNA, 19 bp, Homo sapiens
tcccacccacacagctgcc

SEQ ID NO: 3570028 - DNA, 21 bp, Homo sapiens
tcccacccacacagctgccct

SEQ ID NO: 3570029 - DNA, 19 bp, Homo sapiens
tcccaccccctcctccccc

SEQ ID NO: 3570030 - DNA, 20 bp, Homo sapiens
tcccaccccctcctccccca

SEQ ID NO: 3570031 - DNA, 20 bp, Homo sapiens
tcccaccgtacaaccccctc

SEQ ID NO: 3570032 - DNA, 15 bp, Homo sapiens
tcccacctctccttt

SEQ ID NO: 3570033 - DNA, 18 bp, Homo sapiens
tcccactccagctgacag

SEQ ID NO: 3570034 - DNA, 22 bp, Homo sapiens
tcccactctgggcaaagcccct

SEQ ID NO: 3570035 - DNA, 14 bp, Homo sapiens
tcccactgccctgg

SEQ ID NO: 3570036 - DNA, 19 bp, Homo sapiens
tcccagaaaaagtaactca

SEQ ID NO: 3570037 - DNA, 21 bp, Homo sapiens
tcccagaacctctaagtgctg

SEQ ID NO: 3570038 - DNA, 22 bp, Homo sapiens
tcccagaacctctaagtgctgc

SEQ ID NO: 3570039 - DNA, 20 bp, Homo sapiens
tcccagaactattctggggg

SEQ ID NO: 3570040 - DNA, 23 bp, Homo sapiens
tcccagaactattctgggggccc

SEQ ID NO: 3570041 - DNA, 16 bp, Homo sapiens
tcccagacaggccctc

SEQ ID NO: 3570042 - DNA, 15 bp, Homo sapiens
tcccagagacctcat

SEQ ID NO: 3570043 - DNA, 16 bp, Homo sapiens
tcccagagcaaaataa

SEQ ID NO: 3570044 - DNA, 21 bp, Homo sapiens
tcccagaggagccaccagttc

SEQ ID NO: 3570045 - DNA, 20 bp, Homo sapiens
tcccagagtgctgggattac

SEQ ID NO: 3570046 - DNA, 22 bp, Homo sapiens
tcccagcaagacctcatctgtg

SEQ ID NO: 3570047 - DNA, 18 bp, Homo sapiens
tcccagcatccctggagc

SEQ ID NO: 3570048 - DNA, 19 bp, Homo sapiens
tcccagcatccctggagca

SEQ ID NO: 3570049 - DNA, 17 bp, Homo sapiens
tcccagcatcgcactct

SEQ ID NO: 3570050 - DNA, 16 bp, Homo sapiens
tcccagctctagcctc

SEQ ID NO: 3570051 - DNA, 14 bp, Homo sapiens
tcccaggaccctga

SEQ ID NO: 3570052 - DNA, 19 bp, Homo sapiens
tcccaggaccctgaagggg

SEQ ID NO: 3570053 - DNA, 21 bp, Homo sapiens
tcccaggctctcaacagggga

SEQ ID NO: 3570054 - DNA, 16 bp, Homo sapiens
tcccaggttcccccag

SEQ ID NO: 3570055 - DNA, 14 bp, Homo sapiens
tcccagtcatttaa

SEQ ID NO: 3570056 - DNA, 22 bp, Homo sapiens
tcccagtcatttaataaatgtg

SEQ ID NO: 3570057 - DNA, 19 bp, Homo sapiens
tcccagtgtgagaccccaa

SEQ ID NO: 3570058 - DNA, 15 bp, Homo sapiens
tcccagttaagtgaa

SEQ ID NO: 3570059 - DNA, 15 bp, Homo sapiens
tcccatcctggggca

SEQ ID NO: 3570060 - DNA, 15 bp, Homo sapiens
tcccattatatttat

SEQ ID NO: 3570061 - DNA, 20 bp, Homo sapiens
tcccattcactagaaaatga

SEQ ID NO: 3570062 - DNA, 15 bp, Homo sapiens
tcccattcttggccc

SEQ ID NO: 3570063 - DNA, 18 bp, Homo sapiens
tcccatttagtgtgaata

SEQ ID NO: 3570064 - DNA, 19 bp, Homo sapiens
tccccaagggccctggcac

SEQ ID NO: 3570065 - DNA, 16 bp, Homo sapiens
tccccaattctcccct

SEQ ID NO: 3570066 - DNA, 14 bp, Homo sapiens
tccccaccatctgc

SEQ ID NO: 3570067 - DNA, 15 bp, Homo sapiens
tccccaccatctgct

SEQ ID NO: 3570068 - DNA, 23 bp, Homo sapiens
tccccaccatctgctgtcttttc

SEQ ID NO: 3570069 - DNA, 20 bp, Homo sapiens
tccccaccttcacctcggag

SEQ ID NO: 3570070 - DNA, 15 bp, Homo sapiens
tccccactgctgagc

SEQ ID NO: 3570071 - DNA, 17 bp, Homo sapiens
tccccactgctgagctg

SEQ ID NO: 3570072 - DNA, 14 bp, Homo sapiens
tccccagagctgtg

SEQ ID NO: 3570073 - DNA, 20 bp, Homo sapiens
tccccagagctgtgccagca

SEQ ID NO: 3570074 - DNA, 21 bp, Homo sapiens
tccccagagctgtgccagcag

SEQ ID NO: 3570075 - DNA, 21 bp, Homo sapiens
tccccagcatgcaccacgggc

SEQ ID NO: 3570076 - DNA, 19 bp, Homo sapiens
tccccagccagcctggctg

SEQ ID NO: 3570077 - DNA, 20 bp, Homo sapiens
tccccagccagcctggctgg

SEQ ID NO: 3570078 - DNA, 16 bp, Homo sapiens
tccccagcccagagac

SEQ ID NO: 3570079 - DNA, 14 bp, Homo sapiens
tccccagcccagca

SEQ ID NO: 3570080 - DNA, 17 bp, Homo sapiens
tccccagctcacccctg

SEQ ID NO: 3570081 - DNA, 22 bp, Homo sapiens
tccccagctcacccctggagga

SEQ ID NO: 3570082 - DNA, 16 bp, Homo sapiens
tccccaggaggcctgg

SEQ ID NO: 3570083 - DNA, 20 bp, Homo sapiens
tccccagggagctctgggga

SEQ ID NO: 3570084 - DNA, 10 bp, Homo sapiens
tccccagtga

SEQ ID NO: 3570085 - DNA, 17 bp, Homo sapiens
tccccagtgactccagg

SEQ ID NO: 3570086 - DNA, 13 bp, Homo sapiens
tcccccaccactc

SEQ ID NO: 3570087 - DNA, 17 bp, Homo sapiens
tcccccaccactcaggc

SEQ ID NO: 3570088 - DNA, 19 bp, Homo sapiens
tcccccaccactcaggcca

SEQ ID NO: 3570089 - DNA, 14 bp, Homo sapiens
tcccccagccactc

SEQ ID NO: 3570090 - DNA, 15 bp, Homo sapiens
tcccccagccactcc

SEQ ID NO: 3570091 - DNA, 20 bp, Homo sapiens
tcccccataaaatgatcctg

SEQ ID NO: 3570092 - DNA, 14 bp, Homo sapiens
tcccccatgggctg

SEQ ID NO: 3570093 - DNA, 17 bp, Homo sapiens
tcccccccatgcactgt

SEQ ID NO: 3570094 - DNA, 19 bp, Homo sapiens
tccccccgagtctccggga

SEQ ID NO: 3570095 - DNA, 16 bp, Homo sapiens
tcccccgtttctcctt

SEQ ID NO: 3570096 - DNA, 21 bp, Homo sapiens
tccccctcccccagccactcc

SEQ ID NO: 3570097 - DNA, 15 bp, Homo sapiens
tccccctccttgtgc

SEQ ID NO: 3570098 - DNA, 20 bp, Homo sapiens
tccccctcttcttctgaaga

SEQ ID NO: 3570099 - DNA, 13 bp, Homo sapiens
tccccctgcccca

SEQ ID NO: 3570100 - DNA, 22 bp, Homo sapiens
tcccccttcacaaagcccaagg

SEQ ID NO: 3570101 - DNA, 15 bp, Homo sapiens
tcccccttcatccat

SEQ ID NO: 3570102 - DNA, 21 bp, Homo sapiens
tccccgcaccccccaagctgt

SEQ ID NO: 3570103 - DNA, 19 bp, Homo sapiens
tccccgcagtgtgcactaa

SEQ ID NO: 3570104 - DNA, 21 bp, Homo sapiens
tccccgcagtgtgcactaagg

SEQ ID NO: 3570105 - DNA, 18 bp, Homo sapiens
tccccgcccctgtggccc

SEQ ID NO: 3570106 - DNA, 21 bp, Homo sapiens
tccccgcccctgtggccctgg

SEQ ID NO: 3570107 - DNA, 14 bp, Homo sapiens
tccccgtctctgcc

SEQ ID NO: 3570108 - DNA, 17 bp, Homo sapiens
tccccgtctctgccctg

SEQ ID NO: 3570109 - DNA, 23 bp, Homo sapiens
tccccgtctctgccctgggctcc

SEQ ID NO: 3570110 - DNA, 17 bp, Homo sapiens
tcccctactctgcccct

SEQ ID NO: 3570111 - DNA, 20 bp, Homo sapiens
tcccctcacacacacccccc

SEQ ID NO: 3570112 - DNA, 22 bp, Homo sapiens
tcccctcacacacaccccccca

SEQ ID NO: 3570113 - DNA, 19 bp, Homo sapiens
tcccctcccacctctcctt

SEQ ID NO: 3570114 - DNA, 13 bp, Homo sapiens
tcccctccctgcc

SEQ ID NO: 3570115 - DNA, 14 bp, Homo sapiens
tcccctccctgcct

SEQ ID NO: 3570116 - DNA, 16 bp, Homo sapiens
tcccctccctgcctgc

SEQ ID NO: 3570117 - DNA, 16 bp, Homo sapiens
tcccctcctgcacaca

SEQ ID NO: 3570118 - DNA, 18 bp, Homo sapiens
tcccctccttggctttat

SEQ ID NO: 3570119 - DNA, 15 bp, Homo sapiens
tcccctctccttcct

SEQ ID NO: 3570120 - DNA, 19 bp, Homo sapiens
tcccctctcgccccatccc

SEQ ID NO: 3570121 - DNA, 12 bp, Homo sapiens
tcccctgacagg

SEQ ID NO: 3570122 - DNA, 16 bp, Homo sapiens
tccccttcctaccacc

SEQ ID NO: 3570123 - DNA, 12 bp, Homo sapiens
tccccttcctgt

SEQ ID NO: 3570124 - DNA, 14 bp, Homo sapiens
tcccgccccgcccc

SEQ ID NO: 3570125 - DNA, 15 bp, Homo sapiens
tcccgccccgcccct

SEQ ID NO: 3570126 - DNA, 22 bp, Homo sapiens
tcccgcccttccatgtgccttt

SEQ ID NO: 3570127 - DNA, 14 bp, Homo sapiens
tcccgctcagccct

SEQ ID NO: 3570128 - DNA, 23 bp, Homo sapiens
tcccgcttctgaagctgctgcag

SEQ ID NO: 3570129 - DNA, 21 bp, Homo sapiens
tcccggagggccctgagctga

SEQ ID NO: 3570130 - DNA, 16 bp, Homo sapiens
tcccggccagctctgg

SEQ ID NO: 3570131 - DNA, 23 bp, Homo sapiens
tcccggtgtatcctggccctggg

SEQ ID NO: 3570132 - DNA, 23 bp, Homo sapiens
tccctaaaatggcgaacatgtgt

SEQ ID NO: 3570133 - DNA, 16 bp, Homo sapiens
tccctaaactgcagcc

SEQ ID NO: 3570134 - DNA, 20 bp, Homo sapiens
tccctaatttatcttcatgt

SEQ ID NO: 3570135 - DNA, 17 bp, Homo sapiens
tccctacactgatgcaa

SEQ ID NO: 3570136 - DNA, 16 bp, Homo sapiens
tccctacttcctgtga

SEQ ID NO: 3570137 - DNA, 18 bp, Homo sapiens
tccctcacccatcctaga

SEQ ID NO: 3570138 - DNA, 12 bp, Homo sapiens
tccctcacctgt

SEQ ID NO: 3570139 - DNA, 14 bp, Homo sapiens
tccctcacctgtag

SEQ ID NO: 3570140 - DNA, 22 bp, Homo sapiens
tccctcaccttggcaccagaca

SEQ ID NO: 3570141 - DNA, 23 bp, Homo sapiens
tccctcattccaccttcccatgc

SEQ ID NO: 3570142 - DNA, 14 bp, Homo sapiens
tccctccaccccac

SEQ ID NO: 3570143 - DNA, 21 bp, Homo sapiens
tccctccagtattgccccctc

SEQ ID NO: 3570144 - DNA, 16 bp, Homo sapiens
tccctccatttttctc

SEQ ID NO: 3570145 - DNA, 14 bp, Homo sapiens
tccctcccccccat

SEQ ID NO: 3570146 - DNA, 12 bp, Homo sapiens
tccctccccctc

SEQ ID NO: 3570147 - DNA, 14 bp, Homo sapiens
tccctccccctcct

SEQ ID NO: 3570148 - DNA, 19 bp, Homo sapiens
tccctcctgagtgccccac

SEQ ID NO: 3570149 - DNA, 16 bp, Homo sapiens
tccctctctcataccc

SEQ ID NO: 3570150 - DNA, 22 bp, Homo sapiens
ctttaaaacgcgtctgcctggg

SEQ ID NO: 3570151 - DNA, 20 bp, Homo sapiens
ctttaaagggatggcaagat

SEQ ID NO: 3570152 - DNA, 12 bp, Homo sapiens
ctttaaattata

SEQ ID NO: 3570153 - DNA, 14 bp, Homo sapiens
ctttaaattatatg

SEQ ID NO: 3570154 - DNA, 22 bp, Homo sapiens
ctttaaattatatgatatgcat

SEQ ID NO: 3570155 - DNA, 13 bp, Homo sapiens
ctttaaatttcag

SEQ ID NO: 3570156 - DNA, 16 bp, Homo sapiens
ctttaagaatagttct

SEQ ID NO: 3570157 - DNA, 14 bp, Homo sapiens
ctttaagaggacat

SEQ ID NO: 3570158 - DNA, 16 bp, Homo sapiens
ctttaagccaaagaaa

SEQ ID NO: 3570159 - DNA, 17 bp, Homo sapiens
ctttaagccaaagaaac

SEQ ID NO: 3570160 - DNA, 18 bp, Homo sapiens
ctttaagccaaagaaaca

SEQ ID NO: 3570161 - DNA, 20 bp, Homo sapiens
ctttaagtgtgctgggcaga

SEQ ID NO: 3570162 - DNA, 17 bp, Homo sapiens
ctttaataaattgctta

SEQ ID NO: 3570163 - DNA, 21 bp, Homo sapiens
ctttaataaattgcttactga

SEQ ID NO: 3570164 - DNA, 14 bp, Homo sapiens
ctttaatatgaaat

SEQ ID NO: 3570165 - DNA, 16 bp, Homo sapiens
ctttaatgatatgctt

SEQ ID NO: 3570166 - DNA, 22 bp, Homo sapiens
ctttaatgatatgcttgtaact

SEQ ID NO: 3570167 - DNA, 17 bp, Homo sapiens
ctttacaactaaataac

SEQ ID NO: 3570168 - DNA, 12 bp, Homo sapiens
ctttactcctgg

SEQ ID NO: 3570169 - DNA, 12 bp, Homo sapiens
ctttactttcag

SEQ ID NO: 3570170 - DNA, 19 bp, Homo sapiens
ctttagagaagtatacata

SEQ ID NO: 3570171 - DNA, 12 bp, Homo sapiens
ctttagattaaa

SEQ ID NO: 3570172 - DNA, 13 bp, Homo sapiens
ctttagcagtttc

SEQ ID NO: 3570173 - DNA, 17 bp, Homo sapiens
ctttagcagtttcctca

SEQ ID NO: 3570174 - DNA, 18 bp, Homo sapiens
ctttagcagtttcctcag

SEQ ID NO: 3570175 - DNA, 20 bp, Homo sapiens
ctttagcagtttcctcagtg

SEQ ID NO: 3570176 - DNA, 21 bp, Homo sapiens
ctttagcagtttcctcagtga

SEQ ID NO: 3570177 - DNA, 23 bp, Homo sapiens
ctttagcagtttcctcagtgatg

SEQ ID NO: 3570178 - DNA, 18 bp, Homo sapiens
ctttataactaacatgtc

SEQ ID NO: 3570179 - DNA, 13 bp, Homo sapiens
ctttataattcta

SEQ ID NO: 3570180 - DNA, 16 bp, Homo sapiens
ctttatattttcctct

SEQ ID NO: 3570181 - DNA, 18 bp, Homo sapiens
ctttatctttcacctttc

SEQ ID NO: 3570182 - DNA, 15 bp, Homo sapiens
ctttatgcacaaaat

SEQ ID NO: 3570183 - DNA, 19 bp, Homo sapiens
ctttattgccaaaacccag

SEQ ID NO: 3570184 - DNA, 21 bp, Homo sapiens
ctttatttattaaacttcagc

SEQ ID NO: 3570185 - DNA, 21 bp, Homo sapiens
ctttattttcccctatcattt

SEQ ID NO: 3570186 - DNA, 20 bp, Homo sapiens
ctttcaagtcagttctgtga

SEQ ID NO: 3570187 - DNA, 17 bp, Homo sapiens
ctttcacccatcctagg

SEQ ID NO: 3570188 - DNA, 20 bp, Homo sapiens
ctttcagaatcttttcaatg

SEQ ID NO: 3570189 - DNA, 19 bp, Homo sapiens
ctttcagcaagataaacat

SEQ ID NO: 3570190 - DNA, 18 bp, Homo sapiens
ctttcagcagtctaaatt

SEQ ID NO: 3570191 - DNA, 16 bp, Homo sapiens
ctttcatctacctttt

SEQ ID NO: 3570192 - DNA, 17 bp, Homo sapiens
ctttcattaccctacag

SEQ ID NO: 3570193 - DNA, 20 bp, Homo sapiens
ctttcattaccctacagaca

SEQ ID NO: 3570194 - DNA, 24 bp, Homo sapiens
ctttcattaccctacagacagctt

SEQ ID NO: 3570195 - DNA, 18 bp, Homo sapiens
ctttcatttgctttggaa

SEQ ID NO: 3570196 - DNA, 15 bp, Homo sapiens
ctttccaccatacct

SEQ ID NO: 3570197 - DNA, 19 bp, Homo sapiens
ctttccagaatgaccttga

SEQ ID NO: 3570198 - DNA, 23 bp, Homo sapiens
ctttccagagcaaccagaaggag

SEQ ID NO: 3570199 - DNA, 22 bp, Homo sapiens
ctttccatgttttttcttcaaa

SEQ ID NO: 3570200 - DNA, 19 bp, Homo sapiens
ctttcctccccctgcaact

SEQ ID NO: 3570201 - DNA, 13 bp, Homo sapiens
ctttcctctgcac

SEQ ID NO: 3570202 - DNA, 15 bp, Homo sapiens
ctttcctttactcct

SEQ ID NO: 3570203 - DNA, 17 bp, Homo sapiens
ctttcgtctactgcaag

SEQ ID NO: 3570204 - DNA, 15 bp, Homo sapiens
ctttctaagcaacca

SEQ ID NO: 3570205 - DNA, 20 bp, Homo sapiens
ctttctaagcaaccacactg

SEQ ID NO: 3570206 - DNA, 22 bp, Homo sapiens
ctttctaagcaaccacactgct

SEQ ID NO: 3570207 - DNA, 22 bp, Homo sapiens
ctttctagaaagagaaacagtt

SEQ ID NO: 3570208 - DNA, 17 bp, Homo sapiens
ctttctagttcaatgcc

SEQ ID NO: 3570209 - DNA, 20 bp, Homo sapiens
ctttctatataaaatgtatt

SEQ ID NO: 3570210 - DNA, 23 bp, Homo sapiens
ctttctatataaaatgtattcaa

SEQ ID NO: 3570211 - DNA, 18 bp, Homo sapiens
ctttctccatggagccta

SEQ ID NO: 3570212 - DNA, 14 bp, Homo sapiens
ctttctctcagtga

SEQ ID NO: 3570213 - DNA, 15 bp, Homo sapiens
ctttctctgaggaca

SEQ ID NO: 3570214 - DNA, 15 bp, Homo sapiens
ctttctctgggctta

SEQ ID NO: 3570215 - DNA, 22 bp, Homo sapiens
ctttctcttccccttcctgttt

SEQ ID NO: 3570216 - DNA, 19 bp, Homo sapiens
ctttctcttccttttatat

SEQ ID NO: 3570217 - DNA, 15 bp, Homo sapiens
ctttctgcagaaaca

SEQ ID NO: 3570218 - DNA, 13 bp, Homo sapiens
ctttctgccttag

SEQ ID NO: 3570219 - DNA, 16 bp, Homo sapiens
ctttctgctcagcttc

SEQ ID NO: 3570220 - DNA, 12 bp, Homo sapiens
ctttctgtccca

SEQ ID NO: 3570221 - DNA, 13 bp, Homo sapiens
ctttctgtcccac

SEQ ID NO: 3570222 - DNA, 22 bp, Homo sapiens
ctttcttacctactattggccc

SEQ ID NO: 3570223 - DNA, 19 bp, Homo sapiens
ctttcttattttgtaataa

SEQ ID NO: 3570224 - DNA, 20 bp, Homo sapiens
ctttcttattttgtaataaa

SEQ ID NO: 3570225 - DNA, 13 bp, Homo sapiens
ctttcttcactct

SEQ ID NO: 3570226 - DNA, 17 bp, Homo sapiens
ctttcttcactctggct

SEQ ID NO: 3570227 - DNA, 19 bp, Homo sapiens
ctttcttcactctggcttc

SEQ ID NO: 3570228 - DNA, 22 bp, Homo sapiens
ctttcttcactctggcttcaaa

SEQ ID NO: 3570229 - DNA, 20 bp, Homo sapiens
ctttcttccattccttcatg

SEQ ID NO: 3570230 - DNA, 12 bp, Homo sapiens
ctttcttcctct

SEQ ID NO: 3570231 - DNA, 13 bp, Homo sapiens
ctttcttcctctg

SEQ ID NO: 3570232 - DNA, 15 bp, Homo sapiens
ctttcttcctctgct

SEQ ID NO: 3570233 - DNA, 14 bp, Homo sapiens
ctttcttgctccct

SEQ ID NO: 3570234 - DNA, 19 bp, Homo sapiens
ctttcttgctccctgactg

SEQ ID NO: 3570235 - DNA, 21 bp, Homo sapiens
ctttctttccaaaacatttct

SEQ ID NO: 3570236 - DNA, 16 bp, Homo sapiens
ctttctttcttttgca

SEQ ID NO: 3570237 - DNA, 17 bp, Homo sapiens
ctttctttgcaccaaag

SEQ ID NO: 3570238 - DNA, 16 bp, Homo sapiens
ctttctttgcctctgc

SEQ ID NO: 3570239 - DNA, 21 bp, Homo sapiens
ctttctttgcctctgcagtct

SEQ ID NO: 3570240 - DNA, 17 bp, Homo sapiens
ctttctttgtcattcag

SEQ ID NO: 3570241 - DNA, 22 bp, Homo sapiens
ctttcttttgcaggagtttgtg

SEQ ID NO: 3570242 - DNA, 11 bp, Homo sapiens
gaaaatgtctt

SEQ ID NO: 3570243 - DNA, 17 bp, Homo sapiens
gaaaattacatgttttt

SEQ ID NO: 3570244 - DNA, 22 bp, Homo sapiens
gaaaattaggatttcatgattt

SEQ ID NO: 3570245 - DNA, 14 bp, Homo sapiens
gaaaattcattttt

SEQ ID NO: 3570246 - DNA, 13 bp, Homo sapiens
gaaaattccctgg

SEQ ID NO: 3570247 - DNA, 16 bp, Homo sapiens
gaaaatttttgtagta

SEQ ID NO: 3570248 - DNA, 19 bp, Homo sapiens
gaaacaaaaacactaaaaa

SEQ ID NO: 3570249 - DNA, 15 bp, Homo sapiens
gaaacaaaatcctca

SEQ ID NO: 3570250 - DNA, 13 bp, Homo sapiens
gaaacaagctgtg

SEQ ID NO: 3570251 - DNA, 14 bp, Homo sapiens
gaaacaagctgtgc

SEQ ID NO: 3570252 - DNA, 15 bp, Homo sapiens
gaaacaagctgtgca

SEQ ID NO: 3570253 - DNA, 16 bp, Homo sapiens
gaaacaccagtgttag

SEQ ID NO: 3570254 - DNA, 19 bp, Homo sapiens
gaaacaccagtgttagctt

SEQ ID NO: 3570255 - DNA, 19 bp, Homo sapiens
gaaacactgcaaattttaa

SEQ ID NO: 3570256 - DNA, 23 bp, Homo sapiens
gaaacactgcaaattttaactgt

SEQ ID NO: 3570257 - DNA, 13 bp, Homo sapiens
gaaacagaaaaat

SEQ ID NO: 3570258 - DNA, 12 bp, Homo sapiens
gaaacagaggct

SEQ ID NO: 3570259 - DNA, 17 bp, Homo sapiens
gaaacagagtggcctcc

SEQ ID NO: 3570260 - DNA, 11 bp, Homo sapiens
gaaacagcatg

SEQ ID NO: 3570261 - DNA, 16 bp, Homo sapiens
gaaacagcatgaataa

SEQ ID NO: 3570262 - DNA, 12 bp, Homo sapiens
gaaacagctcag

SEQ ID NO: 3570263 - DNA, 20 bp, Homo sapiens
gaaacatcctatgaaatact

SEQ ID NO: 3570264 - DNA, 21 bp, Homo sapiens
gaaacatcctatgaaatactt

SEQ ID NO: 3570265 - DNA, 17 bp, Homo sapiens
gaaaccaacaagaacca

SEQ ID NO: 3570266 - DNA, 20 bp, Homo sapiens
gaaaccacagtcttcccagc

SEQ ID NO: 3570267 - DNA, 14 bp, Homo sapiens
gaaaccttccaccc

SEQ ID NO: 3570268 - DNA, 15 bp, Homo sapiens
gaaaccttccaccca

SEQ ID NO: 3570269 - DNA, 18 bp, Homo sapiens
gaaaccttttatttttat

SEQ ID NO: 3570270 - DNA, 21 bp, Homo sapiens
gaaactccatctcaaaacaaa

SEQ ID NO: 3570271 - DNA, 15 bp, Homo sapiens
gaaactctaccctga

SEQ ID NO: 3570272 - DNA, 22 bp, Homo sapiens
gaaactgaggaattttctttgt

SEQ ID NO: 3570273 - DNA, 22 bp, Homo sapiens
gaaactgatgccaaggggctga

SEQ ID NO: 3570274 - DNA, 23 bp, Homo sapiens
gaaactggtccatgtaaatactt

SEQ ID NO: 3570275 - DNA, 22 bp, Homo sapiens
gaaactgttcccacctgctgga

SEQ ID NO: 3570276 - DNA, 18 bp, Homo sapiens
gaaacttggccagtttgt

SEQ ID NO: 3570277 - DNA, 23 bp, Homo sapiens
gaaacttttttattttttaaatc

SEQ ID NO: 3570278 - DNA, 11 bp, Homo sapiens
gaaagaagcaa

SEQ ID NO: 3570279 - DNA, 13 bp, Homo sapiens
gaaagaagcaaga

SEQ ID NO: 3570280 - DNA, 16 bp, Homo sapiens
gaaagaagcaagacac

SEQ ID NO: 3570281 - DNA, 17 bp, Homo sapiens
gaaagaagggggccctg

SEQ ID NO: 3570282 - DNA, 19 bp, Homo sapiens
gaaagaagggggccctgct

SEQ ID NO: 3570283 - DNA, 18 bp, Homo sapiens
gaaagactcgagaaccaa

SEQ ID NO: 3570284 - DNA, 19 bp, Homo sapiens
gaaagacttctcaaagaga

SEQ ID NO: 3570285 - DNA, 16 bp, Homo sapiens
gaaagagagaagccag

SEQ ID NO: 3570286 - DNA, 19 bp, Homo sapiens
gaaagagagaagccagcca

SEQ ID NO: 3570287 - DNA, 22 bp, Homo sapiens
gaaagagctaggaaccctggag

SEQ ID NO: 3570288 - DNA, 19 bp, Homo sapiens
gaaagagctgcctggatga

SEQ ID NO: 3570289 - DNA, 15 bp, Homo sapiens
gaaagaggaaaagaa

SEQ ID NO: 3570290 - DNA, 20 bp, Homo sapiens
gaaagaggcagcttgaaact

SEQ ID NO: 3570291 - DNA, 14 bp, Homo sapiens
gaaagaggcaggga

SEQ ID NO: 3570292 - DNA, 16 bp, Homo sapiens
gaaagaggtgaaaatg

SEQ ID NO: 3570293 - DNA, 18 bp, Homo sapiens
gaaagaggttaggagtag

SEQ ID NO: 3570294 - DNA, 17 bp, Homo sapiens
cttcttaaaagtttcta

SEQ ID NO: 3570295 - DNA, 22 bp, Homo sapiens
cttcttagggattaaatataga

SEQ ID NO: 3570296 - DNA, 13 bp, Homo sapiens
cttcttccttctt

SEQ ID NO: 3570297 - DNA, 20 bp, Homo sapiens
cttcttccttcttgtcacca

SEQ ID NO: 3570298 - DNA, 23 bp, Homo sapiens
cttctttccatcaactcccaact

SEQ ID NO: 3570299 - DNA, 12 bp, Homo sapiens
cttctttccttt

SEQ ID NO: 3570300 - DNA, 21 bp, Homo sapiens
cttctttgctgcattcctttt

SEQ ID NO: 3570301 - DNA, 13 bp, Homo sapiens
cttcttttgctct

SEQ ID NO: 3570302 - DNA, 14 bp, Homo sapiens
cttcttttgctctt

SEQ ID NO: 3570303 - DNA, 20 bp, Homo sapiens
cttcttttttatctggttct

SEQ ID NO: 3570304 - DNA, 15 bp, Homo sapiens
cttgaaaagaaagaa

SEQ ID NO: 3570305 - DNA, 19 bp, Homo sapiens
cttgaaaagaaagaaacca

SEQ ID NO: 3570306 - DNA, 20 bp, Homo sapiens
cttgaaaagttcagggaccg

SEQ ID NO: 3570307 - DNA, 23 bp, Homo sapiens
cttgaaacagattcaggccagcc

SEQ ID NO: 3570308 - DNA, 13 bp, Homo sapiens
cttgaaattgatt

SEQ ID NO: 3570309 - DNA, 20 bp, Homo sapiens
cttgaaattgattaacttat

SEQ ID NO: 3570310 - DNA, 15 bp, Homo sapiens
cttgaacgagcagcc

SEQ ID NO: 3570311 - DNA, 18 bp, Homo sapiens
cttgaacgagcagcccag

SEQ ID NO: 3570312 - DNA, 20 bp, Homo sapiens
cttgaacgagcagcccaggg

SEQ ID NO: 3570313 - DNA, 17 bp, Homo sapiens
cttgaagaaacagagtg

SEQ ID NO: 3570314 - DNA, 23 bp, Homo sapiens
cttgaagaaacagagtggcctcc

SEQ ID NO: 3570315 - DNA, 19 bp, Homo sapiens
cttgaagggccagagccag

SEQ ID NO: 3570316 - DNA, 20 bp, Homo sapiens
cttgaatatgggcggaagta

SEQ ID NO: 3570317 - DNA, 20 bp, Homo sapiens
cttgaatctttttatcccat

SEQ ID NO: 3570318 - DNA, 17 bp, Homo sapiens
cttgaattagtatttca

SEQ ID NO: 3570319 - DNA, 12 bp, Homo sapiens
cttgaatttctg

SEQ ID NO: 3570320 - DNA, 15 bp, Homo sapiens
cttgacacctgctga

SEQ ID NO: 3570321 - DNA, 20 bp, Homo sapiens
cttgaccaacagaaaccttt

SEQ ID NO: 3570322 - DNA, 21 bp, Homo sapiens
cttgaccaacagaaacctttt

SEQ ID NO: 3570323 - DNA, 18 bp, Homo sapiens
cttgactgcattgccgct

SEQ ID NO: 3570324 - DNA, 17 bp, Homo sapiens
cttgacttgtggggcag

SEQ ID NO: 3570325 - DNA, 13 bp, Homo sapiens
cttgactttccag

SEQ ID NO: 3570326 - DNA, 14 bp, Homo sapiens
cttgactttccaga

SEQ ID NO: 3570327 - DNA, 19 bp, Homo sapiens
cttgagaaccagtctcctc

SEQ ID NO: 3570328 - DNA, 18 bp, Homo sapiens
cttgagaaccttttcaaa

SEQ ID NO: 3570329 - DNA, 21 bp, Homo sapiens
cttgagccacagtcactggat

SEQ ID NO: 3570330 - DNA, 13 bp, Homo sapiens
cttgaggaaacaa

SEQ ID NO: 3570331 - DNA, 21 bp, Homo sapiens
cttgaggaaacaacagcttta

SEQ ID NO: 3570332 - DNA, 15 bp, Homo sapiens
cttgagttcctctgc

SEQ ID NO: 3570333 - DNA, 16 bp, Homo sapiens
cttgagttcctctgca

SEQ ID NO: 3570334 - DNA, 17 bp, Homo sapiens
cttgagttcctctgcag

SEQ ID NO: 3570335 - DNA, 13 bp, Homo sapiens
cttgatctctctt

SEQ ID NO: 3570336 - DNA, 15 bp, Homo sapiens
cttgatctctcttgt

SEQ ID NO: 3570337 - DNA, 20 bp, Homo sapiens
cttgatctctcttgtcctct

SEQ ID NO: 3570338 - DNA, 13 bp, Homo sapiens
cttgatgtatttc

SEQ ID NO: 3570339 - DNA, 18 bp, Homo sapiens
cttgatgtgttatctctt

SEQ ID NO: 3570340 - DNA, 14 bp, Homo sapiens
cttgattacttcca

SEQ ID NO: 3570341 - DNA, 15 bp, Homo sapiens
cttgattcattctga

SEQ ID NO: 3570342 - DNA, 14 bp, Homo sapiens
cttgattcccaccg

SEQ ID NO: 3570343 - DNA, 22 bp, Homo sapiens
cttgattcgtagatttaataac

SEQ ID NO: 3570344 - DNA, 15 bp, Homo sapiens
cttgcaacccaaggt

SEQ ID NO: 3570345 - DNA, 16 bp, Homo sapiens
cttgcagcatttacta

SEQ ID NO: 3570346 - DNA, 21 bp, Homo sapiens
cttgcagcatttactatgcac

SEQ ID NO: 3570347 - DNA, 15 bp, Homo sapiens
cttgcagcggctcct

SEQ ID NO: 3570348 - DNA, 16 bp, Homo sapiens
cttgcagcggctcctg

SEQ ID NO: 3570349 - DNA, 20 bp, Homo sapiens
cttgcataggctcttaagca

SEQ ID NO: 3570350 - DNA, 13 bp, Homo sapiens
cttgcatggagaa

SEQ ID NO: 3570351 - DNA, 15 bp, Homo sapiens
cttgccactgcctct

SEQ ID NO: 3570352 - DNA, 16 bp, Homo sapiens
cttgccatttgtagct

SEQ ID NO: 3570353 - DNA, 18 bp, Homo sapiens
cttgccgcgtcgccctcc

SEQ ID NO: 3570354 - DNA, 23 bp, Homo sapiens
cttgccgcgtcgccctcccaggc

SEQ ID NO: 3570355 - DNA, 22 bp, Homo sapiens
cttgcctaaatttaatgctgcc

SEQ ID NO: 3570356 - DNA, 15 bp, Homo sapiens
cttgctccctgactg

SEQ ID NO: 3570357 - DNA, 17 bp, Homo sapiens
cttgctccctgactggg

SEQ ID NO: 3570358 - DNA, 16 bp, Homo sapiens
cttgctctcctcatct

SEQ ID NO: 3570359 - DNA, 19 bp, Homo sapiens
cttgctctcctcatctcca

SEQ ID NO: 3570360 - DNA, 20 bp, Homo sapiens
cttgctgccatgatgtatat

SEQ ID NO: 3570361 - DNA, 12 bp, Homo sapiens
cttgctgctgcc

SEQ ID NO: 3570362 - DNA, 13 bp, Homo sapiens
cttgctgctgcct

SEQ ID NO: 3570363 - DNA, 16 bp, Homo sapiens
cttgctgctgccttca

SEQ ID NO: 3570364 - DNA, 13 bp, Homo sapiens
cttgctgggcttt

SEQ ID NO: 3570365 - DNA, 18 bp, Homo sapiens
cttgctgggctttgggaa

SEQ ID NO: 3570366 - DNA, 19 bp, Homo sapiens
cttgcttctttctagaaag

SEQ ID NO: 3570367 - DNA, 14 bp, Homo sapiens
cttgctttcctgca

SEQ ID NO: 3570368 - DNA, 17 bp, Homo sapiens
cttgctttcctgcatct

SEQ ID NO: 3570369 - DNA, 19 bp, Homo sapiens
cttgctttcctgggccttt

SEQ ID NO: 3570370 - DNA, 17 bp, Homo sapiens
cttgctttcttctttcc

SEQ ID NO: 3570371 - DNA, 18 bp, Homo sapiens
cttgctttcttctttcct

SEQ ID NO: 3570372 - DNA, 22 bp, Homo sapiens
cttgctttcttttttaaaatca

SEQ ID NO: 3570373 - DNA, 12 bp, Homo sapiens
cttggaaagaaa

SEQ ID NO: 3570374 - DNA, 16 bp, Homo sapiens
cttggaaagaaatgta

SEQ ID NO: 3570375 - DNA, 16 bp, Homo sapiens
cttggaacaccctgga

SEQ ID NO: 3570376 - DNA, 13 bp, Homo sapiens
cttggaagccagg

SEQ ID NO: 3570377 - DNA, 16 bp, Homo sapiens
cttggacattttatgt

SEQ ID NO: 3570378 - DNA, 19 bp, Homo sapiens
cttggacattttatgtctt

SEQ ID NO: 3570379 - DNA, 21 bp, Homo sapiens
cttggaggacctggcgtgctc

SEQ ID NO: 3570380 - DNA, 18 bp, Homo sapiens
cttggaggagagagaccc

SEQ ID NO: 3570381 - DNA, 18 bp, Homo sapiens
cttggagggctcagggca

SEQ ID NO: 3570382 - DNA, 22 bp, Homo sapiens
cttggatatataggctattttc

SEQ ID NO: 3570383 - DNA, 18 bp, Homo sapiens
cttggcaatattccttag

SEQ ID NO: 3570384 - DNA, 18 bp, Homo sapiens
cttggcacccccatgctg

SEQ ID NO: 3570385 - DNA, 15 bp, Homo sapiens
cttggcagtgggaat

SEQ ID NO: 3570386 - DNA, 14 bp, Homo sapiens
cttggccacagact

SEQ ID NO: 3570387 - DNA, 16 bp, Homo sapiens
cttggccctcctcagc

SEQ ID NO: 3570388 - DNA, 17 bp, Homo sapiens
cttggccctcctcagct

SEQ ID NO: 3570389 - DNA, 19 bp, Homo sapiens
cttggccctcctcagctcc

SEQ ID NO: 3570390 - DNA, 21 bp, Homo sapiens
cttggccctcctcagctccct

SEQ ID NO: 3570391 - DNA, 14 bp, Homo sapiens
cttggcccttcaag

SEQ ID NO: 3570392 - DNA, 15 bp, Homo sapiens
cttggccgactcagg

SEQ ID NO: 3570393 - DNA, 20 bp, Homo sapiens
cttggctcccgggggcccca

SEQ ID NO: 3570394 - DNA, 16 bp, Homo sapiens
cttggctgacccctct

SEQ ID NO: 3570395 - DNA, 13 bp, Homo sapiens
cttcaaagtgcct

SEQ ID NO: 3570396 - DNA, 14 bp, Homo sapiens
cttcaaagtgcctg

SEQ ID NO: 3570397 - DNA, 22 bp, Homo sapiens
cttcaaagtgcctgggctcagc

SEQ ID NO: 3570398 - DNA, 22 bp, Homo sapiens
cttcaacaacgtgagagaaaga

SEQ ID NO: 3570399 - DNA, 14 bp, Homo sapiens
cttcaacagccaag

SEQ ID NO: 3570400 - DNA, 23 bp, Homo sapiens
cttcaacagccaagctggcacaa

SEQ ID NO: 3570401 - DNA, 20 bp, Homo sapiens
cttcaactgaccagcctcca

SEQ ID NO: 3570402 - DNA, 22 bp, Homo sapiens
cttcaagctgttatttcttccc

SEQ ID NO: 3570403 - DNA, 19 bp, Homo sapiens
cttcaagggtcagggtgag

SEQ ID NO: 3570404 - DNA, 19 bp, Homo sapiens
cttcaatttctagtacctg

SEQ ID NO: 3570405 - DNA, 14 bp, Homo sapiens
cttcacaacagatt

SEQ ID NO: 3570406 - DNA, 14 bp, Homo sapiens
cttcacaggcactc

SEQ ID NO: 3570407 - DNA, 16 bp, Homo sapiens
cttcacatgtttaact

SEQ ID NO: 3570408 - DNA, 14 bp, Homo sapiens
cttcactctggctt

SEQ ID NO: 3570409 - DNA, 14 bp, Homo sapiens
cttcacttcaagct

SEQ ID NO: 3570410 - DNA, 17 bp, Homo sapiens
cttcactttcctcagtt

SEQ ID NO: 3570411 - DNA, 20 bp, Homo sapiens
cttcactttcttaagcaaca

SEQ ID NO: 3570412 - DNA, 20 bp, Homo sapiens
cttcagaactgcccttgctg

SEQ ID NO: 3570413 - DNA, 14 bp, Homo sapiens
cttcagactcaagt

SEQ ID NO: 3570414 - DNA, 16 bp, Homo sapiens
ctgctagcaaatggca

SEQ ID NO: 3570415 - DNA, 16 bp, Homo sapiens
ctgctatttacactat

SEQ ID NO: 3570416 - DNA, 17 bp, Homo sapiens
ctgctatttttcatcct

SEQ ID NO: 3570417 - DNA, 18 bp, Homo sapiens
ctgctcagccctgcacca

SEQ ID NO: 3570418 - DNA, 16 bp, Homo sapiens
ctgctcagcttctcct

SEQ ID NO: 3570419 - DNA, 19 bp, Homo sapiens
ctgctccaatgactgagca

SEQ ID NO: 3570420 - DNA, 16 bp, Homo sapiens
ctgctccaccagcagc

SEQ ID NO: 3570421 - DNA, 14 bp, Homo sapiens
ctgctccagacctg

SEQ ID NO: 3570422 - DNA, 15 bp, Homo sapiens
ctgctccagacctga

SEQ ID NO: 3570423 - DNA, 21 bp, Homo sapiens
ctgctccagacctgatcctgg

SEQ ID NO: 3570424 - DNA, 21 bp, Homo sapiens
ctgctccataccttttctctt

SEQ ID NO: 3570425 - DNA, 18 bp, Homo sapiens
ctgctcccctaaagccag

SEQ ID NO: 3570426 - DNA, 19 bp, Homo sapiens
ctgctcccctaaagccagg

SEQ ID NO: 3570427 - DNA, 14 bp, Homo sapiens
ctgctcctagaggg

SEQ ID NO: 3570428 - DNA, 17 bp, Homo sapiens
ctgctcctagagggagg

SEQ ID NO: 3570429 - DNA, 22 bp, Homo sapiens
ctgctcctcttgttcctgaaat

SEQ ID NO: 3570430 - DNA, 23 bp, Homo sapiens
ctgctcctcttgttcctgaaatg

SEQ ID NO: 3570431 - DNA, 10 bp, Homo sapiens
ctgctcctgc

SEQ ID NO: 3570432 - DNA, 11 bp, Homo sapiens
ctgctcctgct

SEQ ID NO: 3570433 - DNA, 13 bp, Homo sapiens
ctgctcctgcttt

SEQ ID NO: 3570434 - DNA, 15 bp, Homo sapiens
ctgctcctgcttttc

SEQ ID NO: 3570435 - DNA, 16 bp, Homo sapiens
ctgctcctgcttttct

SEQ ID NO: 3570436 - DNA, 17 bp, Homo sapiens
ctgctcctgcttttctg

SEQ ID NO: 3570437 - DNA, 19 bp, Homo sapiens
ctgctccttggcaccccca

SEQ ID NO: 3570438 - DNA, 18 bp, Homo sapiens
ctggaggaggcctgtccc

SEQ ID NO: 3570439 - DNA, 18 bp, Homo sapiens
ctggaggcaaaggcctgg

SEQ ID NO: 3570440 - DNA, 21 bp, Homo sapiens
ctggaggcccagttcaccctg

SEQ ID NO: 3570441 - DNA, 11 bp, Homo sapiens
ctggaggctgg

SEQ ID NO: 3570442 - DNA, 18 bp, Homo sapiens
ctggaggctggggatggt

SEQ ID NO: 3570443 - DNA, 18 bp, Homo sapiens
ctggaggggcagtggaga

SEQ ID NO: 3570444 - DNA, 20 bp, Homo sapiens
ctggaggggcagtggagatc

SEQ ID NO: 3570445 - DNA, 14 bp, Homo sapiens
ctggaggtcatctg

SEQ ID NO: 3570446 - DNA, 15 bp, Homo sapiens
ctggaggtctccagg

SEQ ID NO: 3570447 - DNA, 16 bp, Homo sapiens
ctggaggtctggctga

SEQ ID NO: 3570448 - DNA, 13 bp, Homo sapiens
ctggagtggccac

SEQ ID NO: 3570449 - DNA, 19 bp, Homo sapiens
ctgggccaactcacctgag

SEQ ID NO: 3570450 - DNA, 18 bp, Homo sapiens
ctgggcccggaagggctt

SEQ ID NO: 3570451 - DNA, 18 bp, Homo sapiens
ctgggccctctttccctg

SEQ ID NO: 3570452 - DNA, 19 bp, Homo sapiens
ctgggccgtggcacagctg

SEQ ID NO: 3570453 - DNA, 12 bp, Homo sapiens
ctgggcctgagg

SEQ ID NO: 3570454 - DNA, 16 bp, Homo sapiens
ctgggcctgcccctgt

SEQ ID NO: 3570455 - DNA, 23 bp, Homo sapiens
ctgggcgtagtggctcacacctg

SEQ ID NO: 3570456 - DNA, 17 bp, Homo sapiens
ctgggcgtccagctcag

SEQ ID NO: 3570457 - DNA, 18 bp, Homo sapiens
ctgggcgtccagctcagc

SEQ ID NO: 3570458 - DNA, 20 bp, Homo sapiens
ctgggcgtccagctcagccc

SEQ ID NO: 3570459 - DNA, 16 bp, Homo sapiens
ctgggctattgctgct

SEQ ID NO: 3570460 - DNA, 12 bp, Homo sapiens
ctgggctcagac

SEQ ID NO: 3570461 - DNA, 15 bp, Homo sapiens
ctgggctcagcctgg

SEQ ID NO: 3570462 - DNA, 18 bp, Homo sapiens
ctgggctcagcctggttt

SEQ ID NO: 3570463 - DNA, 20 bp, Homo sapiens
ctgggctgcccacctggctg

SEQ ID NO: 3570464 - DNA, 21 bp, Homo sapiens
ctgggctgggccctctttccc

SEQ ID NO: 3570465 - DNA, 17 bp, Homo sapiens
ctgggcttagggtcctg

SEQ ID NO: 3570466 - DNA, 19 bp, Homo sapiens
ctgggcttatatgtacttt

SEQ ID NO: 3570467 - DNA, 13 bp, Homo sapiens
ctgggctttggga

SEQ ID NO: 3570468 - DNA, 17 bp, Homo sapiens
ctggggaagacagtggc

SEQ ID NO: 3570469 - DNA, 16 bp, Homo sapiens
ctggggacagcttcct

SEQ ID NO: 3570470 - DNA, 18 bp, Homo sapiens
ctggggacagcttcctca

SEQ ID NO: 3570471 - DNA, 14 bp, Homo sapiens
ctggggactcaggg

SEQ ID NO: 3570472 - DNA, 23 bp, Homo sapiens
ctggggactttatttatttctag

SEQ ID NO: 3570473 - DNA, 22 bp, Homo sapiens
ctggggagagcggctggagaaa

SEQ ID NO: 3570474 - DNA, 19 bp, Homo sapiens
ctggggatcttcccacagg

SEQ ID NO: 3570475 - DNA, 20 bp, Homo sapiens
ctggggatcttcccacagga

SEQ ID NO: 3570476 - DNA, 17 bp, Homo sapiens
ctggggatgtctctcat

SEQ ID NO: 3570477 - DNA, 21 bp, Homo sapiens
ctggggccgccacggcctggc

SEQ ID NO: 3570478 - DNA, 19 bp, Homo sapiens
ctggggcctcagaccccct

SEQ ID NO: 3570479 - DNA, 20 bp, Homo sapiens
ctggggctgaggctgaggca

SEQ ID NO: 3570480 - DNA, 21 bp, Homo sapiens
ctgggggattcctgagctggc

SEQ ID NO: 3570481 - DNA, 17 bp, Homo sapiens
ctgggggtcctctctga

SEQ ID NO: 3570482 - DNA, 22 bp, Homo sapiens
ctggggtcaccttctagttgcc

SEQ ID NO: 3570483 - DNA, 13 bp, Homo sapiens
ctggggtctggag

SEQ ID NO: 3570484 - DNA, 13 bp, Homo sapiens
ctggggtgaatac

SEQ ID NO: 3570485 - DNA, 20 bp, Homo sapiens
ctggggtgaatacttatttt

SEQ ID NO: 3570486 - DNA, 13 bp, Homo sapiens
ctggggtggagtg

SEQ ID NO: 3570487 - DNA, 15 bp, Homo sapiens
ctggggtggagtggg

SEQ ID NO: 3570488 - DNA, 18 bp, Homo sapiens
ctggggtgggcagttttt

SEQ ID NO: 3570489 - DNA, 13 bp, Homo sapiens
ctggggtggggtc

SEQ ID NO: 3570490 - DNA, 15 bp, Homo sapiens
ctgggtacttcttga

SEQ ID NO: 3570491 - DNA, 20 bp, Homo sapiens
ctgggtacttcttgaaggtg

SEQ ID NO: 3570492 - DNA, 17 bp, Homo sapiens
ctgggtccttggctccc

SEQ ID NO: 3570493 - DNA, 18 bp, Homo sapiens
ctgggtccttggctcccg

SEQ ID NO: 3570494 - DNA, 17 bp, Homo sapiens
ctgggtctgattttctc

SEQ ID NO: 3570495 - DNA, 18 bp, Homo sapiens
ctgggtctgcgatgcagc

SEQ ID NO: 3570496 - DNA, 14 bp, Homo sapiens
ctgggtgacatttg

SEQ ID NO: 3570497 - DNA, 13 bp, Homo sapiens
ctgggtgatctgc

SEQ ID NO: 3570498 - DNA, 17 bp, Homo sapiens
ctgggtgatctgctgct

SEQ ID NO: 3570499 - DNA, 12 bp, Homo sapiens
ctgggtgcagaa

SEQ ID NO: 3570500 - DNA, 15 bp, Homo sapiens
ctgggtgcagaagct

SEQ ID NO: 3570501 - DNA, 17 bp, Homo sapiens
ctgggtgcagaagctgt

SEQ ID NO: 3570502 - DNA, 13 bp, Homo sapiens
ctgggtgctgccc

SEQ ID NO: 3570503 - DNA, 16 bp, Homo sapiens
ctgggttaaatatttt

SEQ ID NO: 3570504 - DNA, 17 bp, Homo sapiens
ctgggtttgggagccag

SEQ ID NO: 3570505 - DNA, 13 bp, Homo sapiens
ctggtaaggctgg

SEQ ID NO: 3570506 - DNA, 15 bp, Homo sapiens
ctggtaatattgact

SEQ ID NO: 3570507 - DNA, 17 bp, Homo sapiens
ctggtagatgctgaggc

SEQ ID NO: 3570508 - DNA, 20 bp, Homo sapiens
ctggtagatgctgaggcccc

SEQ ID NO: 3570509 - DNA, 16 bp, Homo sapiens
ctggtagcagcaggct

SEQ ID NO: 3570510 - DNA, 18 bp, Homo sapiens
ctggtagcagcaggctca

SEQ ID NO: 3570511 - DNA, 19 bp, Homo sapiens
ctggtcacaggactctgcc

SEQ ID NO: 3570512 - DNA, 21 bp, Homo sapiens
ctggtcacaggactctgcctc

SEQ ID NO: 3570513 - DNA, 23 bp, Homo sapiens
ctggtcacaggactctgcctcct

SEQ ID NO: 3570514 - DNA, 20 bp, Homo sapiens
ctggtcagtcgtggagcgcc

SEQ ID NO: 3570515 - DNA, 16 bp, Homo sapiens
ctggtccagctctgac

SEQ ID NO: 3570516 - DNA, 17 bp, Homo sapiens
ctggtccagctctgaca

SEQ ID NO: 3570517 - DNA, 21 bp, Homo sapiens
ctggtccagctctgacatccc

SEQ ID NO: 3570518 - DNA, 23 bp, Homo sapiens
ctggtccatgtaaatactttcca

SEQ ID NO: 3570519 - DNA, 19 bp, Homo sapiens
ctggtccccactgctgagc

SEQ ID NO: 3570520 - DNA, 17 bp, Homo sapiens
ctggtctcctcagcctc

SEQ ID NO: 3570521 - DNA, 13 bp, Homo sapiens
ctggtctgtggag

SEQ ID NO: 3570522 - DNA, 19 bp, Homo sapiens
ctggtctgtggagatggac

SEQ ID NO: 3570523 - DNA, 23 bp, Homo sapiens
ctggtcttcactttcctcagttg

SEQ ID NO: 3570524 - DNA, 19 bp, Homo sapiens
ctggtcttgaactgggctc

SEQ ID NO: 3570525 - DNA, 20 bp, Homo sapiens
ctggtcttgtggaattggga

SEQ ID NO: 3570526 - DNA, 19 bp, Homo sapiens
ctggtgcacgcaggcacag

SEQ ID NO: 3570527 - DNA, 21 bp, Homo sapiens
ctggtgcatgacaagtactgt

SEQ ID NO: 3570528 - DNA, 11 bp, Homo sapiens
ctggtgccctg

SEQ ID NO: 3570529 - DNA, 23 bp, Homo sapiens
ctggtgcctatctgcctggaggc

SEQ ID NO: 3570530 - DNA, 13 bp, Homo sapiens
ctggtgctcctgc

SEQ ID NO: 3570531 - DNA, 22 bp, Homo sapiens
ctggtgctttagttaggtcatt

SEQ ID NO: 3570532 - DNA, 20 bp, Homo sapiens
ctggtggcccgacagcctgg

SEQ ID NO: 3570533 - DNA, 21 bp, Homo sapiens
ctggtggcccgacagcctggc

SEQ ID NO: 3570534 - DNA, 22 bp, Homo sapiens
ctggtggcccgacagcctggca

SEQ ID NO: 3570535 - DNA, 18 bp, Homo sapiens
ctggtggtgcagccttcc

SEQ ID NO: 3570536 - DNA, 21 bp, Homo sapiens
ctggtggtgcagccttcccct

SEQ ID NO: 3570537 - DNA, 14 bp, Homo sapiens
ctggtgtgtggtga

SEQ ID NO: 3570538 - DNA, 21 bp, Homo sapiens
ctggtgtgtggtgaggggctt

SEQ ID NO: 3570539 - DNA, 13 bp, Homo sapiens
ctggtgtttgtca

SEQ ID NO: 3570540 - DNA, 15 bp, Homo sapiens
ctggtgtttgtcatg

SEQ ID NO: 3570541 - DNA, 15 bp, Homo sapiens
ctggttacctggaga

SEQ ID NO: 3570542 - DNA, 15 bp, Homo sapiens
ctggttagctgacag

SEQ ID NO: 3570543 - DNA, 17 bp, Homo sapiens
ctggttccctgctgcgc

SEQ ID NO: 3570544 - DNA, 21 bp, Homo sapiens
ctggttccctgctgcgctgct

SEQ ID NO: 3570545 - DNA, 16 bp, Homo sapiens
ctggttctgaggccag

SEQ ID NO: 3570546 - DNA, 18 bp, Homo sapiens
ctggtttaattcagcaga

SEQ ID NO: 3570547 - DNA, 13 bp, Homo sapiens
ctggtttataata

SEQ ID NO: 3570548 - DNA, 12 bp, Homo sapiens
ctggtttctgag

SEQ ID NO: 3570549 - DNA, 14 bp, Homo sapiens
ctgtaaaagaaaaa

SEQ ID NO: 3570550 - DNA, 17 bp, Homo sapiens
ctgtaaagatgaatgtc

SEQ ID NO: 3570551 - DNA, 20 bp, Homo sapiens
ctgtaaatcctagacttgaa

SEQ ID NO: 3570552 - DNA, 23 bp, Homo sapiens
ctgtaacaggtattttgtttctt

SEQ ID NO: 3570553 - DNA, 16 bp, Homo sapiens
ctgtaactactttata

SEQ ID NO: 3570554 - DNA, 18 bp, Homo sapiens
ctgtaagggcagtgccca

SEQ ID NO: 3570555 - DNA, 15 bp, Homo sapiens
ctgtaatgacaaaag

SEQ ID NO: 3570556 - DNA, 17 bp, Homo sapiens
ctgtaatgacaaaagat

SEQ ID NO: 3570557 - DNA, 18 bp, Homo sapiens
ctgtacacacccgcctga

SEQ ID NO: 3570558 - DNA, 21 bp, Homo sapiens
ctgtacacacccgcctgacac

SEQ ID NO: 3570559 - DNA, 16 bp, Homo sapiens
ctgtacatagtccttt

SEQ ID NO: 3570560 - DNA, 15 bp, Homo sapiens
ctgtaccaaatctga

SEQ ID NO: 3570561 - DNA, 20 bp, Homo sapiens
ctgtaccaaatctgacatat

SEQ ID NO: 3570562 - DNA, 17 bp, Homo sapiens
ctgtaccagttaatttt

SEQ ID NO: 3570563 - DNA, 15 bp, Homo sapiens
ctgtacctcagtgga

SEQ ID NO: 3570564 - DNA, 23 bp, Homo sapiens
ctgtacctcagtggatcttcaga

SEQ ID NO: 3570565 - DNA, 14 bp, Homo sapiens
ctgtacctctgcct

SEQ ID NO: 3570566 - DNA, 17 bp, Homo sapiens
ctgtacctgttcctccc

SEQ ID NO: 3570567 - DNA, 15 bp, Homo sapiens
ctgtactaacccagt

SEQ ID NO: 3570568 - DNA, 18 bp, Homo sapiens
ctgtactaacccagtctt

SEQ ID NO: 3570569 - DNA, 16 bp, Homo sapiens
ctgtactcctcccagg

SEQ ID NO: 3570570 - DNA, 22 bp, Homo sapiens
ctgtagaaaggggagaatgtca

SEQ ID NO: 3570571 - DNA, 14 bp, Homo sapiens
ctgtaggaaaccca

SEQ ID NO: 3570572 - DNA, 12 bp, Homo sapiens
ctgtaggcctca

SEQ ID NO: 3570573 - DNA, 16 bp, Homo sapiens
ctgtaggtgttatgta

SEQ ID NO: 3570574 - DNA, 17 bp, Homo sapiens
ctgtaggtgttatgtat

SEQ ID NO: 3570575 - DNA, 21 bp, Homo sapiens
ctgtaggtgttatgtattcct

SEQ ID NO: 3570576 - DNA, 20 bp, Homo sapiens
ctgtataagacactttgcca

SEQ ID NO: 3570577 - DNA, 19 bp, Homo sapiens
ctgtatagctcttttccta

SEQ ID NO: 3570578 - DNA, 23 bp, Homo sapiens
ctgtatccaggttccctcccaga

SEQ ID NO: 3570579 - DNA, 17 bp, Homo sapiens
ctgtatgcagtactaaa

SEQ ID NO: 3570580 - DNA, 19 bp, Homo sapiens
ctgtatggaaacactgatt

SEQ ID NO: 3570581 - DNA, 21 bp, Homo sapiens
ctgttacttatgtagaaactg

SEQ ID NO: 3570582 - DNA, 14 bp, Homo sapiens
ctgttatgctgttt

SEQ ID NO: 3570583 - DNA, 18 bp, Homo sapiens
ctgttatttcttccctgc

SEQ ID NO: 3570584 - DNA, 12 bp, Homo sapiens
ctgttattttta

SEQ ID NO: 3570585 - DNA, 23 bp, Homo sapiens
ctgttatttttacagcaaaagat

SEQ ID NO: 3570586 - DNA, 17 bp, Homo sapiens
ctgttcacttttcctcc

SEQ ID NO: 3570587 - DNA, 13 bp, Homo sapiens
ctgttccattaca

SEQ ID NO: 3570588 - DNA, 19 bp, Homo sapiens
ctgttccattacaccacag

SEQ ID NO: 3570589 - DNA, 18 bp, Homo sapiens
ctgttcccattcttgcat

SEQ ID NO: 3570590 - DNA, 15 bp, Homo sapiens
ctgttccccagagaa

SEQ ID NO: 3570591 - DNA, 15 bp, Homo sapiens
ctgttcccccttcac

SEQ ID NO: 3570592 - DNA, 20 bp, Homo sapiens
ccgagtctcttctccactgg

SEQ ID NO: 3570593 - DNA, 21 bp, Homo sapiens
ccgagtctcttctccactgga

SEQ ID NO: 3570594 - DNA, 13 bp, Homo sapiens
ccgcaccccccaa

SEQ ID NO: 3570595 - DNA, 13 bp, Homo sapiens
ccgcacccggctc

SEQ ID NO: 3570596 - DNA, 12 bp, Homo sapiens
ccgcagggcggg

SEQ ID NO: 3570597 - DNA, 21 bp, Homo sapiens
ccgcaggtgctcatgctgctc

SEQ ID NO: 3570598 - DNA, 22 bp, Homo sapiens
ccgcatgtgtgcctggccgcag

SEQ ID NO: 3570599 - DNA, 13 bp, Homo sapiens
ccgccacggcctg

SEQ ID NO: 3570600 - DNA, 15 bp, Homo sapiens
ccgccacggcctggc

SEQ ID NO: 3570601 - DNA, 12 bp, Homo sapiens
ccgccagggctg

SEQ ID NO: 3570602 - DNA, 14 bp, Homo sapiens
ccgccagggctggg

SEQ ID NO: 3570603 - DNA, 17 bp, Homo sapiens
ccgccagggctggggac

SEQ ID NO: 3570604 - DNA, 23 bp, Homo sapiens
ccgccaggtgcccgcgccaggcc

SEQ ID NO: 3570605 - DNA, 16 bp, Homo sapiens
ccgcccactcctggga

SEQ ID NO: 3570606 - DNA, 15 bp, Homo sapiens
ccgcccctcccacgc

SEQ ID NO: 3570607 - DNA, 17 bp, Homo sapiens
ccgcccctgtggccctg

SEQ ID NO: 3570608 - DNA, 21 bp, Homo sapiens
ccgcccctgtggccctggcca

SEQ ID NO: 3570609 - DNA, 16 bp, Homo sapiens
ccgccgccgccgctgc

SEQ ID NO: 3570610 - DNA, 13 bp, Homo sapiens
ccgccgctgccct

SEQ ID NO: 3570611 - DNA, 14 bp, Homo sapiens
ccgcctcaaaatgt

SEQ ID NO: 3570612 - DNA, 16 bp, Homo sapiens
ccgccttctcccacat

SEQ ID NO: 3570613 - DNA, 18 bp, Homo sapiens
ccgcgatgccctgggggc

SEQ ID NO: 3570614 - DNA, 15 bp, Homo sapiens
ccgcgcccagcagag

SEQ ID NO: 3570615 - DNA, 14 bp, Homo sapiens
ccgcgcgcccaccc

SEQ ID NO: 3570616 - DNA, 19 bp, Homo sapiens
ccgcgctcgcccagcagga

SEQ ID NO: 3570617 - DNA, 20 bp, Homo sapiens
ccgcgctcgcccagcaggag

SEQ ID NO: 3570618 - DNA, 11 bp, Homo sapiens
ccgctcagccc

SEQ ID NO: 3570619 - DNA, 12 bp, Homo sapiens
ccgctcagccct

SEQ ID NO: 3570620 - DNA, 19 bp, Homo sapiens
ccgctcagccctccctgcc

SEQ ID NO: 3570621 - DNA, 22 bp, Homo sapiens
ccgctcagccctccctgcccct

SEQ ID NO: 3570622 - DNA, 15 bp, Homo sapiens
ccgctcaggggcctg

SEQ ID NO: 3570623 - DNA, 19 bp, Homo sapiens
ccgctcccacagcttcctg

SEQ ID NO: 3570624 - DNA, 17 bp, Homo sapiens
ccgctgccacccacctc

SEQ ID NO: 3570625 - DNA, 24 bp, Homo sapiens
ccgctgccacccacctccctgcct

SEQ ID NO: 3570626 - DNA, 13 bp, Homo sapiens
ccgctgtctctga

SEQ ID NO: 3570627 - DNA, 23 bp, Homo sapiens
ccggaaggaggccaaccagcccg

SEQ ID NO: 3570628 - DNA, 19 bp, Homo sapiens
ccggagcaaactctgctgt

SEQ ID NO: 3570629 - DNA, 13 bp, Homo sapiens
ccggagcaagcag

SEQ ID NO: 3570630 - DNA, 19 bp, Homo sapiens
ccggagcgccctgcagggc

SEQ ID NO: 3570631 - DNA, 19 bp, Homo sapiens
ccggcaagcgagcacagta

SEQ ID NO: 3570632 - DNA, 11 bp, Homo sapiens
ccggccagctc

SEQ ID NO: 3570633 - DNA, 17 bp, Homo sapiens
ccggccagctctggagt

SEQ ID NO: 3570634 - DNA, 21 bp, Homo sapiens
ccggccccccgcgctcgccca

SEQ ID NO: 3570635 - DNA, 17 bp, Homo sapiens
ccggccggagggcagga

SEQ ID NO: 3570636 - DNA, 22 bp, Homo sapiens
ccggcctcctcggagagcagca

SEQ ID NO: 3570637 - DNA, 23 bp, Homo sapiens
ccggcggaattcaccagtgttcc

SEQ ID NO: 3570638 - DNA, 19 bp, Homo sapiens
ccggcggccccgccgcaga

SEQ ID NO: 3570639 - DNA, 17 bp, Homo sapiens
ccggctatgggggcact

SEQ ID NO: 3570640 - DNA, 13 bp, Homo sapiens
ccggctctgggcc

SEQ ID NO: 3570641 - DNA, 18 bp, Homo sapiens
ccggctctgggcctgagg

SEQ ID NO: 3570642 - DNA, 15 bp, Homo sapiens
ccggctttcaggagc

SEQ ID NO: 3570643 - DNA, 22 bp, Homo sapiens
ccgggaggaaaaggcccctgca

SEQ ID NO: 3570644 - DNA, 19 bp, Homo sapiens
ccgggcctggagaactaga

SEQ ID NO: 3570645 - DNA, 14 bp, Homo sapiens
ccgggcgcagccct

SEQ ID NO: 3570646 - DNA, 22 bp, Homo sapiens
ccgggcgggcgtgggaggaggg

SEQ ID NO: 3570647 - DNA, 13 bp, Homo sapiens
ccgggctgggagc

SEQ ID NO: 3570648 - DNA, 18 bp, Homo sapiens
ccgggctgggagctctgc

SEQ ID NO: 3570649 - DNA, 19 bp, Homo sapiens
ccgggctgggagctctgca

SEQ ID NO: 3570650 - DNA, 18 bp, Homo sapiens
ccggggagaaacccagag

SEQ ID NO: 3570651 - DNA, 14 bp, Homo sapiens
ccgggggagcccag

SEQ ID NO: 3570652 - DNA, 16 bp, Homo sapiens
ccggggggtctcttct

SEQ ID NO: 3570653 - DNA, 20 bp, Homo sapiens
ccggggtgtaacttcctgct

SEQ ID NO: 3570654 - DNA, 21 bp, Homo sapiens
ccggggtgtaacttcctgctg

SEQ ID NO: 3570655 - DNA, 21 bp, Homo sapiens
ccggtaactgtcctgtcctgc

SEQ ID NO: 3570656 - DNA, 23 bp, Homo sapiens
ccggtcagaggagcgcaggcagc

SEQ ID NO: 3570657 - DNA, 14 bp, Homo sapiens
ccggtgctgcagga

SEQ ID NO: 3570658 - DNA, 19 bp, Homo sapiens
ccggtgtatcctggccctg

SEQ ID NO: 3570659 - DNA, 22 bp, Homo sapiens
ccggtgtatcctggccctgggg

SEQ ID NO: 3570660 - DNA, 20 bp, Homo sapiens
ccgtacttgggtcacatgac

SEQ ID NO: 3570661 - DNA, 16 bp, Homo sapiens
ccgtagctctgctgct

SEQ ID NO: 3570662 - DNA, 20 bp, Homo sapiens
ccgtaggggctcctgagtgt

SEQ ID NO: 3570663 - DNA, 15 bp, Homo sapiens
ccgtagggtctttct

SEQ ID NO: 3570664 - DNA, 12 bp, Homo sapiens
ccgtcacagcct

SEQ ID NO: 3570665 - DNA, 18 bp, Homo sapiens
ccgtccaggagcctgtgc

SEQ ID NO: 3570666 - DNA, 15 bp, Homo sapiens
ccgtcctctcggctg

SEQ ID NO: 3570667 - DNA, 14 bp, Homo sapiens
ccgtctctgccctg

SEQ ID NO: 3570668 - DNA, 21 bp, Homo sapiens
ccgtctctgccctgggctcct

SEQ ID NO: 3570669 - DNA, 16 bp, Homo sapiens
ccgtgatctcccctca

SEQ ID NO: 3570670 - DNA, 14 bp, Homo sapiens
ccgtgccttcagct

SEQ ID NO: 3570671 - DNA, 14 bp, Homo sapiens
ccgtgctgacagct

SEQ ID NO: 3570672 - DNA, 16 bp, Homo sapiens
ccgtgctgacagctgc

SEQ ID NO: 3570673 - DNA, 18 bp, Homo sapiens
ccgtgctgacagctgctc

SEQ ID NO: 3570674 - DNA, 14 bp, Homo sapiens
ccgtggatttgtac

SEQ ID NO: 3570675 - DNA, 20 bp, Homo sapiens
ccgtggcacagctgggagcc

SEQ ID NO: 3570676 - DNA, 18 bp, Homo sapiens
ccgtggcagcttgctggg

SEQ ID NO: 3570677 - DNA, 20 bp, Homo sapiens
ccgtggcagcttgctgggct

SEQ ID NO: 3570678 - DNA, 20 bp, Homo sapiens
ccgtggccccgccctcaggc

SEQ ID NO: 3570679 - DNA, 14 bp, Homo sapiens
ccgtggcttcccgc

SEQ ID NO: 3570680 - DNA, 19 bp, Homo sapiens
ccgtgtctcagcctctgcc

SEQ ID NO: 3570681 - DNA, 13 bp, Homo sapiens
ccgtgtttctcta

SEQ ID NO: 3570682 - DNA, 18 bp, Homo sapiens
ccgtttagaaaaaacaat

SEQ ID NO: 3570683 - DNA, 14 bp, Homo sapiens
ccgtttctcctttt

SEQ ID NO: 3570684 - DNA, 19 bp, Homo sapiens
cctaaaaagattgccaatt

SEQ ID NO: 3570685 - DNA, 18 bp, Homo sapiens
cctaaaagcacactcatc

SEQ ID NO: 3570686 - DNA, 21 bp, Homo sapiens
cctaaaccaaaaactgaaagt

SEQ ID NO: 3570687 - DNA, 21 bp, Homo sapiens
cctaaaccccaagcttcccaa

SEQ ID NO: 3570688 - DNA, 12 bp, Homo sapiens
cctaaagagata

SEQ ID NO: 3570689 - DNA, 20 bp, Homo sapiens
cctaaagagcatcctgatac

SEQ ID NO: 3570690 - DNA, 15 bp, Homo sapiens
cctaaagccaggctc

SEQ ID NO: 3570691 - DNA, 23 bp, Homo sapiens
cctaaagccaggctcaggagaag

SEQ ID NO: 3570692 - DNA, 19 bp, Homo sapiens
cctaaagcctcaaaacaaa

SEQ ID NO: 3570693 - DNA, 18 bp, Homo sapiens
cctaaagggcagggccca

SEQ ID NO: 3570694 - DNA, 14 bp, Homo sapiens
cctaaataaattat

SEQ ID NO: 3570695 - DNA, 16 bp, Homo sapiens
cctaaatttaatgctg

SEQ ID NO: 3570696 - DNA, 21 bp, Homo sapiens
cctaacaacattgtagcctca

SEQ ID NO: 3570697 - DNA, 11 bp, Homo sapiens
cctaaccaagt

SEQ ID NO: 3570698 - DNA, 20 bp, Homo sapiens
cctaacttcctgtgcctttc

SEQ ID NO: 3570699 - DNA, 17 bp, Homo sapiens
cctaagaagaaggccag

SEQ ID NO: 3570700 - DNA, 21 bp, Homo sapiens
cctaagaagaaggccagagag

SEQ ID NO: 3570701 - DNA, 16 bp, Homo sapiens
cctaagaccctgaatc

SEQ ID NO: 3570702 - DNA, 15 bp, Homo sapiens
cctaagcccccaggg

SEQ ID NO: 3570703 - DNA, 19 bp, Homo sapiens
cctaagcccccagggcctc

SEQ ID NO: 3570704 - DNA, 12 bp, Homo sapiens
cctaaggctgca

SEQ ID NO: 3570705 - DNA, 16 bp, Homo sapiens
cctaagtggctgcctt

SEQ ID NO: 3570706 - DNA, 19 bp, Homo sapiens
cctaagtggctgccttctt

SEQ ID NO: 3570707 - DNA, 13 bp, Homo sapiens
cctaatccaggca

SEQ ID NO: 3570708 - DNA, 14 bp, Homo sapiens
cctaatccaggcag

SEQ ID NO: 3570709 - DNA, 15 bp, Homo sapiens
cctaatccaggcaga

SEQ ID NO: 3570710 - DNA, 20 bp, Homo sapiens
cctaatccaggcagatccag

SEQ ID NO: 3570711 - DNA, 18 bp, Homo sapiens
cctaatggctatttttga

SEQ ID NO: 3570712 - DNA, 20 bp, Homo sapiens
cctaatggctatttttgaag

SEQ ID NO: 3570713 - DNA, 14 bp, Homo sapiens
cctacaataaactg

SEQ ID NO: 3570714 - DNA, 13 bp, Homo sapiens
cctacagtatata

SEQ ID NO: 3570715 - DNA, 17 bp, Homo sapiens
cctacagtatataagct

SEQ ID NO: 3570716 - DNA, 21 bp, Homo sapiens
cctacagtgactccctgggag

SEQ ID NO: 3570717 - DNA, 19 bp, Homo sapiens
cctacatgaaacagaaaca

SEQ ID NO: 3570718 - DNA, 16 bp, Homo sapiens
cctaccgagtctcttc

SEQ ID NO: 3570719 - DNA, 17 bp, Homo sapiens
cctaccgagtctcttct

SEQ ID NO: 3570720 - DNA, 19 bp, Homo sapiens
cctaccgctggccctgccg

SEQ ID NO: 3570721 - DNA, 21 bp, Homo sapiens
cctaccgctggccctgccgtt

SEQ ID NO: 3570722 - DNA, 16 bp, Homo sapiens
cctacctgtctgctgc

SEQ ID NO: 3570723 - DNA, 16 bp, Homo sapiens
cctacctgtgcctgac

SEQ ID NO: 3570724 - DNA, 22 bp, Homo sapiens
ctgagtcaaatccagtggtggg

SEQ ID NO: 3570725 - DNA, 17 bp, Homo sapiens
ctgagtgagttcaacta

SEQ ID NO: 3570726 - DNA, 15 bp, Homo sapiens
ctgagtggcagcagc

SEQ ID NO: 3570727 - DNA, 16 bp, Homo sapiens
ctgagtggcagcagcc

SEQ ID NO: 3570728 - DNA, 18 bp, Homo sapiens
ctgagtggcagcagcccc

SEQ ID NO: 3570729 - DNA, 23 bp, Homo sapiens
ctgagttggcctggccatttcca

SEQ ID NO: 3570730 - DNA, 23 bp, Homo sapiens
ctgataccattctattctccaga

SEQ ID NO: 3570731 - DNA, 19 bp, Homo sapiens
ctgatactgggtctgcgat

SEQ ID NO: 3570732 - DNA, 16 bp, Homo sapiens
ctgatatcaacagctt

SEQ ID NO: 3570733 - DNA, 14 bp, Homo sapiens
ctgatcccaccccc

SEQ ID NO: 3570734 - DNA, 17 bp, Homo sapiens
ctgatcctggaggccca

SEQ ID NO: 3570735 - DNA, 19 bp, Homo sapiens
ctgatcctggaggcccagt

SEQ ID NO: 3570736 - DNA, 21 bp, Homo sapiens
ctgatcctggaggcccagttc

SEQ ID NO: 3570737 - DNA, 16 bp, Homo sapiens
ctgatgattttccttt

SEQ ID NO: 3570738 - DNA, 12 bp, Homo sapiens
ctgatgcaagga

SEQ ID NO: 3570739 - DNA, 14 bp, Homo sapiens
ctgatgcaaggatt

SEQ ID NO: 3570740 - DNA, 21 bp, Homo sapiens
ctgatgcaaggattacagaaa

SEQ ID NO: 3570741 - DNA, 17 bp, Homo sapiens
ctgatgccaaggggctg

SEQ ID NO: 3570742 - DNA, 17 bp, Homo sapiens
ctgatgtataatgtaat

SEQ ID NO: 3570743 - DNA, 18 bp, Homo sapiens
ctgatgttcctagtgaaa

SEQ ID NO: 3570744 - DNA, 20 bp, Homo sapiens
ctgattacgtttacattctt

SEQ ID NO: 3570745 - DNA, 19 bp, Homo sapiens
ctgattagttgacagtatt

SEQ ID NO: 3570746 - DNA, 21 bp, Homo sapiens
ctgattagttgacagtattaa

SEQ ID NO: 3570747 - DNA, 21 bp, Homo sapiens
ctgattcatagtaaaatacct

SEQ ID NO: 3570748 - DNA, 19 bp, Homo sapiens
ctgattgctatcagcaatg

SEQ ID NO: 3570749 - DNA, 12 bp, Homo sapiens
ctgattggctgc

SEQ ID NO: 3570750 - DNA, 14 bp, Homo sapiens
ctgattggctgctt

SEQ ID NO: 3570751 - DNA, 16 bp, Homo sapiens
ctgattggctgcttaa

SEQ ID NO: 3570752 - DNA, 15 bp, Homo sapiens
ctgatttcattcctc

SEQ ID NO: 3570753 - DNA, 18 bp, Homo sapiens
ctgattttcaaagctttt

SEQ ID NO: 3570754 - DNA, 15 bp, Homo sapiens
ctgattttctcactg

SEQ ID NO: 3570755 - DNA, 16 bp, Homo sapiens
ctgcaaaaaaagcctc

SEQ ID NO: 3570756 - DNA, 18 bp, Homo sapiens
ctgcaaaaaaagcctcca

SEQ ID NO: 3570757 - DNA, 17 bp, Homo sapiens
ctgcaaaactccaggca

SEQ ID NO: 3570758 - DNA, 14 bp, Homo sapiens
ctgcaaacacacct

SEQ ID NO: 3570759 - DNA, 17 bp, Homo sapiens
ctgcaaattttaactgt

SEQ ID NO: 3570760 - DNA, 17 bp, Homo sapiens
ctgcaacatttgacaaa

SEQ ID NO: 3570761 - DNA, 19 bp, Homo sapiens
ctgcaacttccgctgaggg

SEQ ID NO: 3570762 - DNA, 19 bp, Homo sapiens
ctgcaagaccacggaggga

SEQ ID NO: 3570763 - DNA, 21 bp, Homo sapiens
ctgcaagaccacggagggagc

SEQ ID NO: 3570764 - DNA, 22 bp, Homo sapiens
ctgcaagaccacggagggagcg

SEQ ID NO: 3570765 - DNA, 21 bp, Homo sapiens
ctgcaagagccaagttccaaa

SEQ ID NO: 3570766 - DNA, 14 bp, Homo sapiens
ctgcacaacagccc

SEQ ID NO: 3570767 - DNA, 16 bp, Homo sapiens
ctgcacaacagccctg

SEQ ID NO: 3570768 - DNA, 11 bp, Homo sapiens
ctgcacacagg

SEQ ID NO: 3570769 - DNA, 21 bp, Homo sapiens
ctgcacagacaagcagccctt

SEQ ID NO: 3570770 - DNA, 22 bp, Homo sapiens
ctgcacagtgcatctcagccca

SEQ ID NO: 3570771 - DNA, 11 bp, Homo sapiens
ctgcacatcta

SEQ ID NO: 3570772 - DNA, 17 bp, Homo sapiens
ctgcacatctacacaca

SEQ ID NO: 3570773 - DNA, 16 bp, Homo sapiens
ctgcaccaccatgccc

SEQ ID NO: 3570774 - DNA, 19 bp, Homo sapiens
ctgcaccatgctgctgggg

SEQ ID NO: 3570775 - DNA, 20 bp, Homo sapiens
ctgcaccatgctgctgggga

SEQ ID NO: 3570776 - DNA, 21 bp, Homo sapiens
ctgcaccatgctgctggggaa

SEQ ID NO: 3570777 - DNA, 20 bp, Homo sapiens
ctgcaccccttcctgggcac

SEQ ID NO: 3570778 - DNA, 12 bp, Homo sapiens
ctgcaccctgcg

SEQ ID NO: 3570779 - DNA, 18 bp, Homo sapiens
ctgcaccctgcgcctcca

SEQ ID NO: 3570780 - DNA, 19 bp, Homo sapiens
ctgcaccctgcgcctccag

SEQ ID NO: 3570781 - DNA, 20 bp, Homo sapiens
ctgcaccctgcgcctccaga

SEQ ID NO: 3570782 - DNA, 15 bp, Homo sapiens
ctgcacctcctaccc

SEQ ID NO: 3570783 - DNA, 24 bp, Homo sapiens
ctgcacctcctaccctcccaccag

SEQ ID NO: 3570784 - DNA, 16 bp, Homo sapiens
ctgcactcccacctga

SEQ ID NO: 3570785 - DNA, 23 bp, Homo sapiens
ctgcactcctttatctgtaattg

SEQ ID NO: 3570786 - DNA, 13 bp, Homo sapiens
ctgcactgaggat

SEQ ID NO: 3570787 - DNA, 15 bp, Homo sapiens
ctgcactgatgctgc

SEQ ID NO: 3570788 - DNA, 17 bp, Homo sapiens
ctgcactgatgctgccc

SEQ ID NO: 3570789 - DNA, 12 bp, Homo sapiens
ctgcagaaccca

SEQ ID NO: 3570790 - DNA, 15 bp, Homo sapiens
ctgcagaacccacca

SEQ ID NO: 3570791 - DNA, 17 bp, Homo sapiens
ctgcagaaggaaagaag

SEQ ID NO: 3570792 - DNA, 22 bp, Homo sapiens
ctgcagaaggaaagaagggggc

SEQ ID NO: 3570793 - DNA, 22 bp, Homo sapiens
ctgcagattagttctttttgcc

SEQ ID NO: 3570794 - DNA, 14 bp, Homo sapiens
ctgcagatttgata

SEQ ID NO: 3570795 - DNA, 14 bp, Homo sapiens
ctgcagcaggcagc

SEQ ID NO: 3570796 - DNA, 15 bp, Homo sapiens
ctgcagcaggcagct

SEQ ID NO: 3570797 - DNA, 14 bp, Homo sapiens
ctgcagcccattcc

SEQ ID NO: 3570798 - DNA, 20 bp, Homo sapiens
ctgcagcccattcccaaggg

SEQ ID NO: 3570799 - DNA, 21 bp, Homo sapiens
ctgcagcccgtgtccaggagc

SEQ ID NO: 3570800 - DNA, 17 bp, Homo sapiens
ctgcagcctctctggct

SEQ ID NO: 3570801 - DNA, 19 bp, Homo sapiens
ctgcagcctctctggctgg

SEQ ID NO: 3570802 - DNA, 14 bp, Homo sapiens
ctgcagcctgcagg

SEQ ID NO: 3570803 - DNA, 15 bp, Homo sapiens
ctgcagcctgcagga

SEQ ID NO: 3570804 - DNA, 19 bp, Homo sapiens
ctgcagccttcatcagaac

SEQ ID NO: 3570805 - DNA, 19 bp, Homo sapiens
ctgcagctcaagggctggc

SEQ ID NO: 3570806 - DNA, 13 bp, Homo sapiens
ctgcagctgtttg

SEQ ID NO: 3570807 - DNA, 14 bp, Homo sapiens
ctgcaggaagaaac

SEQ ID NO: 3570808 - DNA, 17 bp, Homo sapiens
ctgcaggaagaaacttt

SEQ ID NO: 3570809 - DNA, 22 bp, Homo sapiens
ctgcaggcaggcggctcctcct

SEQ ID NO: 3570810 - DNA, 17 bp, Homo sapiens
ctgcaggccaggccagc

SEQ ID NO: 3570811 - DNA, 18 bp, Homo sapiens
ctgcaggccaggccagct

SEQ ID NO: 3570812 - DNA, 17 bp, Homo sapiens
ctgcagggacagagcat

SEQ ID NO: 3570813 - DNA, 15 bp, Homo sapiens
ctgcagggccatctg

SEQ ID NO: 3570814 - DNA, 13 bp, Homo sapiens
ctgcagggccggg

SEQ ID NO: 3570815 - DNA, 17 bp, Homo sapiens
ctgcagggggtgtgtct

SEQ ID NO: 3570816 - DNA, 23 bp, Homo sapiens
ctgcagggggtgtgtctgctcag

SEQ ID NO: 3570817 - DNA, 22 bp, Homo sapiens
ctgcagtcccacactgtgcaga

SEQ ID NO: 3570818 - DNA, 17 bp, Homo sapiens
ctgcagtctcatttctc

SEQ ID NO: 3570819 - DNA, 16 bp, Homo sapiens
cccatgcaccttccag

SEQ ID NO: 3570820 - DNA, 23 bp, Homo sapiens
cccatggccggctttcaggagct

SEQ ID NO: 3570821 - DNA, 15 bp, Homo sapiens
cccatgggcacagtg

SEQ ID NO: 3570822 - DNA, 11 bp, Homo sapiens
cccatgggctg

SEQ ID NO: 3570823 - DNA, 15 bp, Homo sapiens
cccatgggctgtgtc

SEQ ID NO: 3570824 - DNA, 21 bp, Homo sapiens
cccatgtgtacattctgccta

SEQ ID NO: 3570825 - DNA, 19 bp, Homo sapiens
cccatgttgtaatgctgca

SEQ ID NO: 3570826 - DNA, 20 bp, Homo sapiens
cccatgttgtaatgctgcac

SEQ ID NO: 3570827 - DNA, 18 bp, Homo sapiens
cccattccaaagctttat

SEQ ID NO: 3570828 - DNA, 17 bp, Homo sapiens
cccattcccagcctgac

SEQ ID NO: 3570829 - DNA, 22 bp, Homo sapiens
cccattctgttttcccccagca

SEQ ID NO: 3570830 - DNA, 14 bp, Homo sapiens
cccattgtccctct

SEQ ID NO: 3570831 - DNA, 18 bp, Homo sapiens
cccattgtccctctgccc

SEQ ID NO: 3570832 - DNA, 14 bp, Homo sapiens
cccatttctctaca

SEQ ID NO: 3570833 - DNA, 22 bp, Homo sapiens
cccatttctggggggagaaaaa

SEQ ID NO: 3570834 - DNA, 22 bp, Homo sapiens
cccatttgttttcggcagcctt

SEQ ID NO: 3570835 - DNA, 17 bp, Homo sapiens
ccccaaaatccaaaact

SEQ ID NO: 3570836 - DNA, 21 bp, Homo sapiens
ccccaaaatccaaaacttctc

SEQ ID NO: 3570837 - DNA, 13 bp, Homo sapiens
ccccaacccctct

SEQ ID NO: 3570838 - DNA, 14 bp, Homo sapiens
ccccaagctgtttt

SEQ ID NO: 3570839 - DNA, 17 bp, Homo sapiens
ccccaagctgttttctt

SEQ ID NO: 3570840 - DNA, 13 bp, Homo sapiens
ccccaagcttccc

SEQ ID NO: 3570841 - DNA, 15 bp, Homo sapiens
ccccaagggccctgg

SEQ ID NO: 3570842 - DNA, 16 bp, Homo sapiens
ccccaagggccctggc

SEQ ID NO: 3570843 - DNA, 20 bp, Homo sapiens
ccccaagggccctggcaccc

SEQ ID NO: 3570844 - DNA, 14 bp, Homo sapiens
gacctcttctggag

SEQ ID NO: 3570845 - DNA, 16 bp, Homo sapiens
gacctgagagcatctc

SEQ ID NO: 3570846 - DNA, 19 bp, Homo sapiens
gacctgagcggcaccctgg

SEQ ID NO: 3570847 - DNA, 22 bp, Homo sapiens
gacctgagcggcaccctggtct

SEQ ID NO: 3570848 - DNA, 23 bp, Homo sapiens
gacctgagcggcaccctggtctg

SEQ ID NO: 3570849 - DNA, 14 bp, Homo sapiens
gacctgatcctgga

SEQ ID NO: 3570850 - DNA, 12 bp, Homo sapiens
gacctgccccaa

SEQ ID NO: 3570851 - DNA, 19 bp, Homo sapiens
gacctggagcttcagccag

SEQ ID NO: 3570852 - DNA, 20 bp, Homo sapiens
gacctggagcttcagccagg

SEQ ID NO: 3570853 - DNA, 10 bp, Homo sapiens
gacctggcag

SEQ ID NO: 3570854 - DNA, 16 bp, Homo sapiens
gacctggcagctctgg

SEQ ID NO: 3570855 - DNA, 17 bp, Homo sapiens
gacctgtcctgtctttg

SEQ ID NO: 3570856 - DNA, 16 bp, Homo sapiens
gaccttccctccgcct

SEQ ID NO: 3570857 - DNA, 15 bp, Homo sapiens
gacctttatttatta

SEQ ID NO: 3570858 - DNA, 17 bp, Homo sapiens
gacctttcctgaggaag

SEQ ID NO: 3570859 - DNA, 15 bp, Homo sapiens
gacgaagggttggac

SEQ ID NO: 3570860 - DNA, 19 bp, Homo sapiens
gacgcacacagctgagcac

SEQ ID NO: 3570861 - DNA, 18 bp, Homo sapiens
gacgccaggcaccacagc

SEQ ID NO: 3570862 - DNA, 19 bp, Homo sapiens
gacgccaggcaccacagcc

SEQ ID NO: 3570863 - DNA, 21 bp, Homo sapiens
gacgctgatccataaagacaa

SEQ ID NO: 3570864 - DNA, 17 bp, Homo sapiens
gacgggatgacctccag

SEQ ID NO: 3570865 - DNA, 19 bp, Homo sapiens
gacgggatgacctccagaa

SEQ ID NO: 3570866 - DNA, 21 bp, Homo sapiens
gacgggatgacctccagaagt

SEQ ID NO: 3570867 - DNA, 22 bp, Homo sapiens
gacgggatgacctccagaagtc

SEQ ID NO: 3570868 - DNA, 19 bp, Homo sapiens
gacgggccacacgtggctg

SEQ ID NO: 3570869 - DNA, 17 bp, Homo sapiens
gacggggtttctccatg

SEQ ID NO: 3570870 - DNA, 19 bp, Homo sapiens
gacggtgttaattttgcta

SEQ ID NO: 3570871 - DNA, 22 bp, Homo sapiens
gacggtgttaattttgctaact

SEQ ID NO: 3570872 - DNA, 20 bp, Homo sapiens
gacgtctccccttctctgcc

SEQ ID NO: 3570873 - DNA, 23 bp, Homo sapiens
gacgtgctccgtagctctgctgc

SEQ ID NO: 3570874 - DNA, 17 bp, Homo sapiens
gacgttaggccaggcct

SEQ ID NO: 3570875 - DNA, 17 bp, Homo sapiens
gacgtttgcggcagtgt

SEQ ID NO: 3570876 - DNA, 19 bp, Homo sapiens
gactaaactttttttctgt

SEQ ID NO: 3570877 - DNA, 20 bp, Homo sapiens
gactaaactttttttctgta

SEQ ID NO: 3570878 - DNA, 18 bp, Homo sapiens
gactaaatgatctctgaa

SEQ ID NO: 3570879 - DNA, 16 bp, Homo sapiens
gactacctctgtgcct

SEQ ID NO: 3570880 - DNA, 20 bp, Homo sapiens
gactacttgggagcaccgcc

SEQ ID NO: 3570881 - DNA, 23 bp, Homo sapiens
gactagaactcctgtcttctttc

SEQ ID NO: 3570882 - DNA, 19 bp, Homo sapiens
gactagaagattagaaact

SEQ ID NO: 3570883 - DNA, 17 bp, Homo sapiens
gactagagggacctctc

SEQ ID NO: 3570884 - DNA, 20 bp, Homo sapiens
gactagagggacctctccca

SEQ ID NO: 3570885 - DNA, 19 bp, Homo sapiens
gactatatttgggcctgct

SEQ ID NO: 3570886 - DNA, 22 bp, Homo sapiens
gactattcaaacagtctcagga

SEQ ID NO: 3570887 - DNA, 17 bp, Homo sapiens
gactattgtgccaactg

SEQ ID NO: 3570888 - DNA, 22 bp, Homo sapiens
gactcaagtacccattctgttt

SEQ ID NO: 3570889 - DNA, 18 bp, Homo sapiens
gactcaattatttgcata

SEQ ID NO: 3570890 - DNA, 15 bp, Homo sapiens
gactcaggatccagt

SEQ ID NO: 3570891 - DNA, 22 bp, Homo sapiens
gactcaggatccagtgacatga

SEQ ID NO: 3570892 - DNA, 12 bp, Homo sapiens
gactcagggacc

SEQ ID NO: 3570893 - DNA, 15 bp, Homo sapiens
gactcagtgaccagt

SEQ ID NO: 3570894 - DNA, 18 bp, Homo sapiens
gactcagtgaccagtgcc

SEQ ID NO: 3570895 - DNA, 19 bp, Homo sapiens
gactccaaagctgttccat

SEQ ID NO: 3570896 - DNA, 22 bp, Homo sapiens
gactccaagagggaatggtcaa

SEQ ID NO: 3570897 - DNA, 10 bp, Homo sapiens
gactccaggg

SEQ ID NO: 3570898 - DNA, 16 bp, Homo sapiens
gactccatctcttctg

SEQ ID NO: 3570899 - DNA, 23 bp, Homo sapiens
gactccattggggtgagaggtga

SEQ ID NO: 3570900 - DNA, 23 bp, Homo sapiens
gactcccattcctgaagaaccag

SEQ ID NO: 3570901 - DNA, 18 bp, Homo sapiens
gactccccagcccagcac

SEQ ID NO: 3570902 - DNA, 19 bp, Homo sapiens
gactccccagcccagcacc

SEQ ID NO: 3570903 - DNA, 13 bp, Homo sapiens
gactcctcagcac

SEQ ID NO: 3570904 - DNA, 17 bp, Homo sapiens
gactcctgctggtacct

SEQ ID NO: 3570905 - DNA, 19 bp, Homo sapiens
gactcctgctggtacctgc

SEQ ID NO: 3570906 - DNA, 14 bp, Homo sapiens
gactcctggcaggg

SEQ ID NO: 3570907 - DNA, 19 bp, Homo sapiens
gactccttatctctttcca

SEQ ID NO: 3570908 - DNA, 16 bp, Homo sapiens
gactcggaatctattt

SEQ ID NO: 3570909 - DNA, 21 bp, Homo sapiens
gactctaaggttatctacttt

SEQ ID NO: 3570910 - DNA, 16 bp, Homo sapiens
gactctctccaggagg

SEQ ID NO: 3570911 - DNA, 18 bp, Homo sapiens
gactctctccaggagggc

SEQ ID NO: 3570912 - DNA, 23 bp, Homo sapiens
gactctgacctcttggccacaga

SEQ ID NO: 3570913 - DNA, 12 bp, Homo sapiens
gactctgcctcc

SEQ ID NO: 3570914 - DNA, 16 bp, Homo sapiens
gactctgcctcctctt

SEQ ID NO: 3570915 - DNA, 18 bp, Homo sapiens
gactctggaggtcatctg

SEQ ID NO: 3570916 - DNA, 23 bp, Homo sapiens
gactctggaggtcatctggcgga

SEQ ID NO: 3570917 - DNA, 21 bp, Homo sapiens
gactcttagccctcaccacag

SEQ ID NO: 3570918 - DNA, 17 bp, Homo sapiens
gactctttgatatgcca

SEQ ID NO: 3570919 - DNA, 17 bp, Homo sapiens
gactgaaaacctctcct

SEQ ID NO: 3570920 - DNA, 18 bp, Homo sapiens
gactgaaaacctctcctc

SEQ ID NO: 3570921 - DNA, 14 bp, Homo sapiens
gactgaaggaaaag

SEQ ID NO: 3570922 - DNA, 12 bp, Homo sapiens
gactgagcagcc

SEQ ID NO: 3570923 - DNA, 13 bp, Homo sapiens
gactgagcagccg

SEQ ID NO: 3570924 - DNA, 15 bp, Homo sapiens
gactgagctggggga

SEQ ID NO: 3570925 - DNA, 17 bp, Homo sapiens
gactgatagacaccata

SEQ ID NO: 3570926 - DNA, 18 bp, Homo sapiens
gactgccaagccagattc

SEQ ID NO: 3570927 - DNA, 20 bp, Homo sapiens
gactgccagtccccctgccc

SEQ ID NO: 3570928 - DNA, 15 bp, Homo sapiens
gactgcccctgctgt

SEQ ID NO: 3570929 - DNA, 13 bp, Homo sapiens
gactgctcctggg

SEQ ID NO: 3570930 - DNA, 16 bp, Homo sapiens
gactgctcctgggcat

SEQ ID NO: 3570931 - DNA, 15 bp, Homo sapiens
gactgcttggggtgg

SEQ ID NO: 3570932 - DNA, 22 bp, Homo sapiens
gactgctttggatagtctccta

SEQ ID NO: 3570933 - DNA, 15 bp, Homo sapiens
gactggactgcttgg

SEQ ID NO: 3570934 - DNA, 15 bp, Homo sapiens
gactggaggaggcct

SEQ ID NO: 3570935 - DNA, 24 bp, Homo sapiens
gactggcccagtgccagcaagtcc

SEQ ID NO: 3570936 - DNA, 19 bp, Homo sapiens
gactggtccagctctgaca

SEQ ID NO: 3570937 - DNA, 17 bp, Homo sapiens
gactggttctgaggcca

SEQ ID NO: 3570938 - DNA, 16 bp, Homo sapiens
gactgtactcctccca

SEQ ID NO: 3570939 - DNA, 18 bp, Homo sapiens
gactgtactcctcccagg

SEQ ID NO: 3570940 - DNA, 14 bp, Homo sapiens
gactgtcagtgggg

SEQ ID NO: 3570941 - DNA, 22 bp, Homo sapiens
gactgtcagtggggcagcctct

SEQ ID NO: 3570942 - DNA, 22 bp, Homo sapiens
gactgtctcaagagggcactgg

SEQ ID NO: 3570943 - DNA, 22 bp, Homo sapiens
gactgtgtttaactgctgcagg

SEQ ID NO: 3570944 - DNA, 13 bp, Homo sapiens
gactgttgggaca

SEQ ID NO: 3570945 - DNA, 14 bp, Homo sapiens
gactgttgggacag

SEQ ID NO: 3570946 - DNA, 16 bp, Homo sapiens
gactgttgggacagcc

SEQ ID NO: 3570947 - DNA, 20 bp, Homo sapiens
gacttaagcatctggctcta

SEQ ID NO: 3570948 - DNA, 22 bp, Homo sapiens
gacttaagcatctggctctaat

SEQ ID NO: 3570949 - DNA, 16 bp, Homo sapiens
gacttatagtacatga

SEQ ID NO: 3570950 - DNA, 18 bp, Homo sapiens
gacttatagtacatgata

SEQ ID NO: 3570951 - DNA, 14 bp, Homo sapiens
gacttatggcatga

SEQ ID NO: 3570952 - DNA, 20 bp, Homo sapiens
gacttatggcatgactcttc

SEQ ID NO: 3570953 - DNA, 17 bp, Homo sapiens
gacttatttctgctctg

SEQ ID NO: 3570954 - DNA, 20 bp, Homo sapiens
gacttatttctgctctggaa

SEQ ID NO: 3570955 - DNA, 19 bp, Homo sapiens
gacttcctctggctcccca

SEQ ID NO: 3570956 - DNA, 16 bp, Homo sapiens
gacttcgcagccccgg

SEQ ID NO: 3570957 - DNA, 16 bp, Homo sapiens
gacttctaagtaaaac

SEQ ID NO: 3570958 - DNA, 17 bp, Homo sapiens
gacttctaagtaaaacc

SEQ ID NO: 3570959 - DNA, 19 bp, Homo sapiens
gacttctaagtaaaaccac

SEQ ID NO: 3570960 - DNA, 23 bp, Homo sapiens
gacttctaagtaaaaccacagca

SEQ ID NO: 3570961 - DNA, 16 bp, Homo sapiens
gacttctcaaagagaa

SEQ ID NO: 3570962 - DNA, 15 bp, Homo sapiens
gacttctcaccagca

SEQ ID NO: 3570963 - DNA, 17 bp, Homo sapiens
gacttctctttcttatt

SEQ ID NO: 3570964 - DNA, 15 bp, Homo sapiens
gacttgaaagttttc

SEQ ID NO: 3570965 - DNA, 22 bp, Homo sapiens
gacttgtatagcatgaaataaa

SEQ ID NO: 3570966 - DNA, 23 bp, Homo sapiens
gacttgtatagcatgaaataaaa

SEQ ID NO: 3570967 - DNA, 16 bp, Homo sapiens
gacttgtgattggctg

SEQ ID NO: 3570968 - DNA, 18 bp, Homo sapiens
gacttgtgattggctgca

SEQ ID NO: 3570969 - DNA, 16 bp, Homo sapiens
gacttgttcttgatag

SEQ ID NO: 3570970 - DNA, 15 bp, Homo sapiens
gactttatttatttc

SEQ ID NO: 3570971 - DNA, 17 bp, Homo sapiens
gactttatttatttcta

SEQ ID NO: 3570972 - DNA, 19 bp, Homo sapiens
gactttatttatttctagt

SEQ ID NO: 3570973 - DNA, 17 bp, Homo sapiens
gactttcagtaaacata

SEQ ID NO: 3570974 - DNA, 19 bp, Homo sapiens
gactttccagaatgacctt

SEQ ID NO: 3570975 - DNA, 20 bp, Homo sapiens
gagcaggagccccgccacag

SEQ ID NO: 3570976 - DNA, 19 bp, Homo sapiens
gagcaggcccaatgctgct

SEQ ID NO: 3570977 - DNA, 20 bp, Homo sapiens
gagcaggcccaatgctgctt

SEQ ID NO: 3570978 - DNA, 18 bp, Homo sapiens
gagcagggatctgccccc

SEQ ID NO: 3570979 - DNA, 18 bp, Homo sapiens
gagcagggtccacagctg

SEQ ID NO: 3570980 - DNA, 20 bp, Homo sapiens
gagcagggtccacagctgga

SEQ ID NO: 3570981 - DNA, 20 bp, Homo sapiens
gagcaggtacatttctgatt

SEQ ID NO: 3570982 - DNA, 22 bp, Homo sapiens
gagcaggttccccaagggccct

SEQ ID NO: 3570983 - DNA, 19 bp, Homo sapiens
gagcagtcgcctgcctgca

SEQ ID NO: 3570984 - DNA, 17 bp, Homo sapiens
gagcataatttaaaaat

SEQ ID NO: 3570985 - DNA, 22 bp, Homo sapiens
gagcatccttggcagtgggaat

SEQ ID NO: 3570986 - DNA, 18 bp, Homo sapiens
gagcatggagacagcagt

SEQ ID NO: 3570987 - DNA, 15 bp, Homo sapiens
gagcatggggccagg

SEQ ID NO: 3570988 - DNA, 13 bp, Homo sapiens
gagcattgcagcc

SEQ ID NO: 3570989 - DNA, 16 bp, Homo sapiens
gagcattgcagcctaa

SEQ ID NO: 3570990 - DNA, 22 bp, Homo sapiens
gagcattgtcaccgcaggtgct

SEQ ID NO: 3570991 - DNA, 22 bp, Homo sapiens
gagccaaatgaccgagccctgg

SEQ ID NO: 3570992 - DNA, 17 bp, Homo sapiens
gagccaagggatggaca

SEQ ID NO: 3570993 - DNA, 13 bp, Homo sapiens
gagccacaaaaga

SEQ ID NO: 3570994 - DNA, 14 bp, Homo sapiens
gagccacctggatc

SEQ ID NO: 3570995 - DNA, 14 bp, Homo sapiens
gagccagcagggca

SEQ ID NO: 3570996 - DNA, 11 bp, Homo sapiens
gagccagcctg

SEQ ID NO: 3570997 - DNA, 13 bp, Homo sapiens
gagccagcctggc

SEQ ID NO: 3570998 - DNA, 16 bp, Homo sapiens
gagccagcctggctct

SEQ ID NO: 3570999 - DNA, 16 bp, Homo sapiens
gagccaggactcccag

SEQ ID NO: 3571000 - DNA, 17 bp, Homo sapiens
gagccaggatgcccaga

SEQ ID NO: 3571001 - DNA, 19 bp, Homo sapiens
gagcccactgtcctgggcc

SEQ ID NO: 3571002 - DNA, 17 bp, Homo sapiens
gagcccagcctgggagc

SEQ ID NO: 3571003 - DNA, 23 bp, Homo sapiens
gagcccagcctgggagcccagag

SEQ ID NO: 3571004 - DNA, 12 bp, Homo sapiens
gagcccagctcc

SEQ ID NO: 3571005 - DNA, 13 bp, Homo sapiens
gagcccagctcca

SEQ ID NO: 3571006 - DNA, 19 bp, Homo sapiens
gagcccagtgaagcctctg

SEQ ID NO: 3571007 - DNA, 15 bp, Homo sapiens
gagcccccagccctg

SEQ ID NO: 3571008 - DNA, 17 bp, Homo sapiens
gagcccccagccctggg

SEQ ID NO: 3571009 - DNA, 18 bp, Homo sapiens
gagcccccagccctggga

SEQ ID NO: 3571010 - DNA, 17 bp, Homo sapiens
gagcccctactgtgggc

SEQ ID NO: 3571011 - DNA, 16 bp, Homo sapiens
gagcccctccccagcc

SEQ ID NO: 3571012 - DNA, 17 bp, Homo sapiens
gagcccctccccagcca

SEQ ID NO: 3571013 - DNA, 21 bp, Homo sapiens
gagcccctccccagccagccc

SEQ ID NO: 3571014 - DNA, 14 bp, Homo sapiens
gagcccctggggaa

SEQ ID NO: 3571015 - DNA, 20 bp, Homo sapiens
gagcccctgtctagagaggg

SEQ ID NO: 3571016 - DNA, 22 bp, Homo sapiens
gagcccctgtctagagagggag

SEQ ID NO: 3571017 - DNA, 23 bp, Homo sapiens
gagccccttcatccgcctgtggg

SEQ ID NO: 3571018 - DNA, 14 bp, Homo sapiens
gagccctagccctg

SEQ ID NO: 3571019 - DNA, 17 bp, Homo sapiens
gagccctagccctgctc

SEQ ID NO: 3571020 - DNA, 17 bp, Homo sapiens
gagccctcctgagggcc

SEQ ID NO: 3571021 - DNA, 16 bp, Homo sapiens
gagcctacctctgtct

SEQ ID NO: 3571022 - DNA, 17 bp, Homo sapiens
gagcctacctctgtctg

SEQ ID NO: 3571023 - DNA, 14 bp, Homo sapiens
gagcctagctcctg

SEQ ID NO: 3571024 - DNA, 18 bp, Homo sapiens
gagcctcccaccagagcc

SEQ ID NO: 3571025 - DNA, 11 bp, Homo sapiens
gagcctcctgg

SEQ ID NO: 3571026 - DNA, 13 bp, Homo sapiens
gagcctcctggga

SEQ ID NO: 3571027 - DNA, 16 bp, Homo sapiens
gagcctgaagggtgcc

SEQ ID NO: 3571028 - DNA, 19 bp, Homo sapiens
gagcctgaattttgttgct

SEQ ID NO: 3571029 - DNA, 16 bp, Homo sapiens
gagcctggccaggcag

SEQ ID NO: 3571030 - DNA, 20 bp, Homo sapiens
gagcctggccaggcagggag

SEQ ID NO: 3571031 - DNA, 18 bp, Homo sapiens
gagcctgtgcgtcccagc

SEQ ID NO: 3571032 - DNA, 23 bp, Homo sapiens
gagcctttgtgctttttgtcatg

SEQ ID NO: 3571033 - DNA, 13 bp, Homo sapiens
gagccttttgctc

SEQ ID NO: 3571034 - DNA, 17 bp, Homo sapiens
gagccttttgctctctg

SEQ ID NO: 3571035 - DNA, 17 bp, Homo sapiens
gagcctttttacctggc

SEQ ID NO: 3571036 - DNA, 15 bp, Homo sapiens
gagcgaggaaaggat

SEQ ID NO: 3571037 - DNA, 12 bp, Homo sapiens
gagcgcaggcag

SEQ ID NO: 3571038 - DNA, 17 bp, Homo sapiens
gagcgccctgcagggcc

SEQ ID NO: 3571039 - DNA, 18 bp, Homo sapiens
gagcgccctgcagggccg

SEQ ID NO: 3571040 - DNA, 19 bp, Homo sapiens
gagcgccctgcagggccgg

SEQ ID NO: 3571041 - DNA, 12 bp, Homo sapiens
gagcggctggag

SEQ ID NO: 3571042 - DNA, 15 bp, Homo sapiens
gagcggctggagaaa

SEQ ID NO: 3571043 - DNA, 16 bp, Homo sapiens
gagctagaacattcca

SEQ ID NO: 3571044 - DNA, 13 bp, Homo sapiens
gagctaggaaccc

SEQ ID NO: 3571045 - DNA, 18 bp, Homo sapiens
gagctccatacacacgct

SEQ ID NO: 3571046 - DNA, 22 bp, Homo sapiens
gagctccatacacacgctgcct

SEQ ID NO: 3571047 - DNA, 18 bp, Homo sapiens
gagctctggggacagctt

SEQ ID NO: 3571048 - DNA, 21 bp, Homo sapiens
gagctctggggacagcttcct

SEQ ID NO: 3571049 - DNA, 23 bp, Homo sapiens
gagctctggggacagcttcctca

SEQ ID NO: 3571050 - DNA, 22 bp, Homo sapiens
gagctcttcccttattcctaat

SEQ ID NO: 3571051 - DNA, 16 bp, Homo sapiens
gagctgccacagagaa

SEQ ID NO: 3571052 - DNA, 18 bp, Homo sapiens
gagctgctatagcctggg

SEQ ID NO: 3571053 - DNA, 20 bp, Homo sapiens
gagctgctatagcctggggt

SEQ ID NO: 3571054 - DNA, 13 bp, Homo sapiens
gagctgctgccct

SEQ ID NO: 3571055 - DNA, 15 bp, Homo sapiens
gagctggcaaccagc

SEQ ID NO: 3571056 - DNA, 18 bp, Homo sapiens
gagctggcaaccagccag

SEQ ID NO: 3571057 - DNA, 18 bp, Homo sapiens
gagctggggactcaggga

SEQ ID NO: 3571058 - DNA, 19 bp, Homo sapiens
gagctggggactcagggac

SEQ ID NO: 3571059 - DNA, 14 bp, Homo sapiens
gagctgtctgtctc

SEQ ID NO: 3571060 - DNA, 15 bp, Homo sapiens
gagctgtctgtctct

SEQ ID NO: 3571061 - DNA, 15 bp, Homo sapiens
gagctgtgccagcag

SEQ ID NO: 3571062 - DNA, 16 bp, Homo sapiens
gagctgttatgctgtt

SEQ ID NO: 3571063 - DNA, 21 bp, Homo sapiens
gagctgttatgctgtttccta

SEQ ID NO: 3571064 - DNA, 17 bp, Homo sapiens
gagcttcagccaggtct

SEQ ID NO: 3571065 - DNA, 18 bp, Homo sapiens
gagcttcagccaggtctg

SEQ ID NO: 3571066 - DNA, 19 bp, Homo sapiens
gagcttcagccaggtctga

SEQ ID NO: 3571067 - DNA, 21 bp, Homo sapiens
gagcttccgctttgaaagaag

SEQ ID NO: 3571068 - DNA, 16 bp, Homo sapiens
gagcttgtaataaata

SEQ ID NO: 3571069 - DNA, 18 bp, Homo sapiens
gagcttgtaataaatact

SEQ ID NO: 3571070 - DNA, 21 bp, Homo sapiens
gaggaaaagtcaaagtgttgc

SEQ ID NO: 3571071 - DNA, 16 bp, Homo sapiens
gaggaaaagtcttcct

SEQ ID NO: 3571072 - DNA, 17 bp, Homo sapiens
gaggaaaagtcttccta

SEQ ID NO: 3571073 - DNA, 18 bp, Homo sapiens
gaggaaacaacagcttta

SEQ ID NO: 3571074 - DNA, 13 bp, Homo sapiens
gaggaaaggattt

SEQ ID NO: 3571075 - DNA, 18 bp, Homo sapiens
gaggaagtggctgtccct

SEQ ID NO: 3571076 - DNA, 14 bp, Homo sapiens
gaggaagtggtgtt

SEQ ID NO: 3571077 - DNA, 22 bp, Homo sapiens
gaggaatggccctcattcagta

SEQ ID NO: 3571078 - DNA, 22 bp, Homo sapiens
gaggaatttatacctcaaacta

SEQ ID NO: 3571079 - DNA, 22 bp, Homo sapiens
gaggaattttctttgtgtagct

SEQ ID NO: 3571080 - DNA, 14 bp, Homo sapiens
gaggacatggggag

SEQ ID NO: 3571081 - DNA, 15 bp, Homo sapiens
gaggaccaatgcttg

SEQ ID NO: 3571082 - DNA, 19 bp, Homo sapiens
gaggacctggcgtgctcag

SEQ ID NO: 3571083 - DNA, 22 bp, Homo sapiens
gaggacctggcgtgctcagacc

SEQ ID NO: 3571084 - DNA, 13 bp, Homo sapiens
gaggagagagacc

SEQ ID NO: 3571085 - DNA, 20 bp, Homo sapiens
gaggagataaggtggcttct

SEQ ID NO: 3571086 - DNA, 21 bp, Homo sapiens
gaggagataaggtggcttctc

SEQ ID NO: 3571087 - DNA, 21 bp, Homo sapiens
gaggagcagcaggagggggga

SEQ ID NO: 3571088 - DNA, 16 bp, Homo sapiens
gaggagcctctggctt

SEQ ID NO: 3571089 - DNA, 18 bp, Homo sapiens
gaggagcctctggcttcc

SEQ ID NO: 3571090 - DNA, 21 bp, Homo sapiens
gaggagcctgtgcgtcccagc

SEQ ID NO: 3571091 - DNA, 22 bp, Homo sapiens
gaggagcctgtgcgtcccagct

SEQ ID NO: 3571092 - DNA, 19 bp, Homo sapiens
gaggagcttctcccagtgt

SEQ ID NO: 3571093 - DNA, 22 bp, Homo sapiens
gaggaggcctgtcccaattctg

SEQ ID NO: 3571094 - DNA, 17 bp, Homo sapiens
gaggagggaggcggcct

SEQ ID NO: 3571095 - DNA, 14 bp, Homo sapiens
gaggatacagagga

SEQ ID NO: 3571096 - DNA, 17 bp, Homo sapiens
gaggatccagggcagca

SEQ ID NO: 3571097 - DNA, 20 bp, Homo sapiens
gaggatccagggcagcaggc

SEQ ID NO: 3571098 - DNA, 23 bp, Homo sapiens
gaggatccagggcagcaggccag

SEQ ID NO: 3571099 - DNA, 14 bp, Homo sapiens
gaggcaaaggcctg

SEQ ID NO: 3571100 - DNA, 21 bp, Homo sapiens
gaggcaattagacactttgga

SEQ ID NO: 3571101 - DNA, 14 bp, Homo sapiens
gaggcacactttct

SEQ ID NO: 3571102 - DNA, 18 bp, Homo sapiens
gaggcacactttctggca

SEQ ID NO: 3571103 - DNA, 18 bp, Homo sapiens
gaggcaggagaatcactt

SEQ ID NO: 3571104 - DNA, 22 bp, Homo sapiens
gaggcagggacctaaagggact

SEQ ID NO: 3571105 - DNA, 17 bp, Homo sapiens
gaggcatagtcacctag

SEQ ID NO: 3571106 - DNA, 16 bp, Homo sapiens
gaggccaaccagcccg

SEQ ID NO: 3571107 - DNA, 16 bp, Homo sapiens
gagtgggccccgggct

SEQ ID NO: 3571108 - DNA, 17 bp, Homo sapiens
gagtgggcgcagtggct

SEQ ID NO: 3571109 - DNA, 13 bp, Homo sapiens
gagtggttaggca

SEQ ID NO: 3571110 - DNA, 22 bp, Homo sapiens
gagtgtaaaatgtatattttta

SEQ ID NO: 3571111 - DNA, 20 bp, Homo sapiens
gagtgtagcctaaagggcag

SEQ ID NO: 3571112 - DNA, 23 bp, Homo sapiens
gagtgtagcctaaagggcagggc

SEQ ID NO: 3571113 - DNA, 14 bp, Homo sapiens
gagtgtagctgtaa

SEQ ID NO: 3571114 - DNA, 13 bp, Homo sapiens
gagtgtgtaattt

SEQ ID NO: 3571115 - DNA, 19 bp, Homo sapiens
gagtgtgtggtctctgccc

SEQ ID NO: 3571116 - DNA, 16 bp, Homo sapiens
gagttaacaggacagt

SEQ ID NO: 3571117 - DNA, 16 bp, Homo sapiens
gagttacagttctgtg

SEQ ID NO: 3571118 - DNA, 15 bp, Homo sapiens
gagttcaactacatg

SEQ ID NO: 3571119 - DNA, 22 bp, Homo sapiens
gagttccggggagaaacccaga

SEQ ID NO: 3571120 - DNA, 19 bp, Homo sapiens
gagttccttatccctctct

SEQ ID NO: 3571121 - DNA, 16 bp, Homo sapiens
gagttctttgctgccc

SEQ ID NO: 3571122 - DNA, 22 bp, Homo sapiens
gagttctttgctgcccctgtct

SEQ ID NO: 3571123 - DNA, 23 bp, Homo sapiens
gagttctttgctgcccctgtctg

SEQ ID NO: 3571124 - DNA, 19 bp, Homo sapiens
gagttgatctggaacccag

SEQ ID NO: 3571125 - DNA, 13 bp, Homo sapiens
gagttggctggga

SEQ ID NO: 3571126 - DNA, 15 bp, Homo sapiens
gagtttctgtttgat

SEQ ID NO: 3571127 - DNA, 13 bp, Homo sapiens
gataaaaatcata

SEQ ID NO: 3571128 - DNA, 16 bp, Homo sapiens
gataaaagatggccat

SEQ ID NO: 3571129 - DNA, 13 bp, Homo sapiens
gataaatttaatc

SEQ ID NO: 3571130 - DNA, 22 bp, Homo sapiens
gataacaatgttttaacaagaa

SEQ ID NO: 3571131 - DNA, 12 bp, Homo sapiens
gataagaaaacc

SEQ ID NO: 3571132 - DNA, 13 bp, Homo sapiens
gataataggtcat

SEQ ID NO: 3571133 - DNA, 20 bp, Homo sapiens
gataatctgagcaggtacat

SEQ ID NO: 3571134 - DNA, 18 bp, Homo sapiens
gatacaaaagctttttaa

SEQ ID NO: 3571135 - DNA, 19 bp, Homo sapiens
gatacaccgggcctggaga

SEQ ID NO: 3571136 - DNA, 21 bp, Homo sapiens
gatacagtattatagatataa

SEQ ID NO: 3571137 - DNA, 19 bp, Homo sapiens
gataccattctattctcca

SEQ ID NO: 3571138 - DNA, 12 bp, Homo sapiens
gatactgtctct

SEQ ID NO: 3571139 - DNA, 21 bp, Homo sapiens
gatactgtctctccagtgaaa

SEQ ID NO: 3571140 - DNA, 13 bp, Homo sapiens
gatactttgaagt

SEQ ID NO: 3571141 - DNA, 22 bp, Homo sapiens
gatactttgaagtgcagctcat

SEQ ID NO: 3571142 - DNA, 20 bp, Homo sapiens
gatagacacatatgaggggg

SEQ ID NO: 3571143 - DNA, 17 bp, Homo sapiens
gatagatgctggcccag

SEQ ID NO: 3571144 - DNA, 18 bp, Homo sapiens
gatagatgctggcccagg

SEQ ID NO: 3571145 - DNA, 14 bp, Homo sapiens
gatagatgtgtgga

SEQ ID NO: 3571146 - DNA, 15 bp, Homo sapiens
gatagcaaactccag

SEQ ID NO: 3571147 - DNA, 23 bp, Homo sapiens
gatagtggggagacttcttggct

SEQ ID NO: 3571148 - DNA, 20 bp, Homo sapiens
gatagtgttctgctcctgct

SEQ ID NO: 3571149 - DNA, 20 bp, Homo sapiens
gatataaaactctgggtctt

SEQ ID NO: 3571150 - DNA, 22 bp, Homo sapiens
gatataatagtagatttgaaca

SEQ ID NO: 3571151 - DNA, 21 bp, Homo sapiens
gatatataggctattttctaa

SEQ ID NO: 3571152 - DNA, 20 bp, Homo sapiens
gatatatcatgagtgaataa

SEQ ID NO: 3571153 - DNA, 21 bp, Homo sapiens
gatatctagctagtaatatat

SEQ ID NO: 3571154 - DNA, 19 bp, Homo sapiens
gatatggctgcccaggaga

SEQ ID NO: 3571155 - DNA, 15 bp, Homo sapiens
gatatgtctgctgag

SEQ ID NO: 3571156 - DNA, 16 bp, Homo sapiens
gatattcaataaagca

SEQ ID NO: 3571157 - DNA, 17 bp, Homo sapiens
gatattcagatgtatgt

SEQ ID NO: 3571158 - DNA, 13 bp, Homo sapiens
gatatttcaatct

SEQ ID NO: 3571159 - DNA, 21 bp, Homo sapiens
gatattttcaacgcagccctg

SEQ ID NO: 3571160 - DNA, 22 bp, Homo sapiens
gatattttcaacgcagccctgc

SEQ ID NO: 3571161 - DNA, 14 bp, Homo sapiens
gatcaaaaggccca

SEQ ID NO: 3571162 - DNA, 22 bp, Homo sapiens
gatcaaaccccgaccacctgcc

SEQ ID NO: 3571163 - DNA, 13 bp, Homo sapiens
gatcacaggcctt

SEQ ID NO: 3571164 - DNA, 20 bp, Homo sapiens
gatcagaacattcagctctg

SEQ ID NO: 3571165 - DNA, 23 bp, Homo sapiens
gatcagaacattcagctctggag

SEQ ID NO: 3571166 - DNA, 14 bp, Homo sapiens
gatcagaagaacat

SEQ ID NO: 3571167 - DNA, 14 bp, Homo sapiens
gatcagtatttcac

SEQ ID NO: 3571168 - DNA, 15 bp, Homo sapiens
gatcataaactgact

SEQ ID NO: 3571169 - DNA, 14 bp, Homo sapiens
gatcattatcagcc

SEQ ID NO: 3571170 - DNA, 11 bp, Homo sapiens
gatccagccac

SEQ ID NO: 3571171 - DNA, 14 bp, Homo sapiens
gatccagccacttc

SEQ ID NO: 3571172 - DNA, 15 bp, Homo sapiens
gatccagggacagag

SEQ ID NO: 3571173 - DNA, 16 bp, Homo sapiens
gatccagggcagcagg

SEQ ID NO: 3571174 - DNA, 19 bp, Homo sapiens
gatccagggcagcaggcca

SEQ ID NO: 3571175 - DNA, 15 bp, Homo sapiens
gatccagtgacatga

SEQ ID NO: 3571176 - DNA, 15 bp, Homo sapiens
gatccatcttgagcc

SEQ ID NO: 3571177 - DNA, 15 bp, Homo sapiens
gatcccaccccctcc

SEQ ID NO: 3571178 - DNA, 21 bp, Homo sapiens
gatccccgtctctgccctggg

SEQ ID NO: 3571179 - DNA, 16 bp, Homo sapiens
gatccccttcctacca

SEQ ID NO: 3571180 - DNA, 18 bp, Homo sapiens
gatccccttcctaccacc

SEQ ID NO: 3571181 - DNA, 14 bp, Homo sapiens
gatcctccacagag

SEQ ID NO: 3571182 - DNA, 22 bp, Homo sapiens
gatcctgaatctgtgcaaacag

SEQ ID NO: 3571183 - DNA, 21 bp, Homo sapiens
gatcctgccaatctaatgtga

SEQ ID NO: 3571184 - DNA, 11 bp, Homo sapiens
gatcctgctgg

SEQ ID NO: 3571185 - DNA, 12 bp, Homo sapiens
gatcctgctggg

SEQ ID NO: 3571186 - DNA, 15 bp, Homo sapiens
gatcctggaggccca

SEQ ID NO: 3571187 - DNA, 16 bp, Homo sapiens
gatcctggaggcccag

SEQ ID NO: 3571188 - DNA, 15 bp, Homo sapiens
gatcctgttctgcgc

SEQ ID NO: 3571189 - DNA, 20 bp, Homo sapiens
gatcgagaccatcctggcca

SEQ ID NO: 3571190 - DNA, 22 bp, Homo sapiens
gatcggccatcaagggaagaac

SEQ ID NO: 3571191 - DNA, 21 bp, Homo sapiens
gatctattgtttgttgcacta

SEQ ID NO: 3571192 - DNA, 16 bp, Homo sapiens
gatctcacaggctgag

SEQ ID NO: 3571193 - DNA, 22 bp, Homo sapiens
gatctctcttgtcctcttctgc

SEQ ID NO: 3571194 - DNA, 19 bp, Homo sapiens
gatctgctgggctctgcct

SEQ ID NO: 3571195 - DNA, 15 bp, Homo sapiens
gatctggaacccaga

SEQ ID NO: 3571196 - DNA, 17 bp, Homo sapiens
gatctggaacccagact

SEQ ID NO: 3571197 - DNA, 18 bp, Homo sapiens
gatctggaacccagactc

SEQ ID NO: 3571198 - DNA, 16 bp, Homo sapiens
gatctggaacctcagc

SEQ ID NO: 3571199 - DNA, 20 bp, Homo sapiens
gatctggaacctcagcctgg

SEQ ID NO: 3571200 - DNA, 22 bp, Homo sapiens
gatctggggagagcggctggag

SEQ ID NO: 3571201 - DNA, 15 bp, Homo sapiens
gatctgtcctcagcc

SEQ ID NO: 3571202 - DNA, 13 bp, Homo sapiens
gatctgtgattgg

SEQ ID NO: 3571203 - DNA, 17 bp, Homo sapiens
gatctgtgattggctgg

SEQ ID NO: 3571204 - DNA, 11 bp, Homo sapiens
gatctgtgtgg

SEQ ID NO: 3571205 - DNA, 13 bp, Homo sapiens
gatctgtgtggct

SEQ ID NO: 3571206 - DNA, 20 bp, Homo sapiens
gatctgtgtggctcctgggc

SEQ ID NO: 3571207 - DNA, 17 bp, Homo sapiens
gatcttcagaactgccc

SEQ ID NO: 3571208 - DNA, 19 bp, Homo sapiens
gatcttcagaactgccctt

SEQ ID NO: 3571209 - DNA, 21 bp, Homo sapiens
gatcttcagaactgcccttgc

SEQ ID NO: 3571210 - DNA, 15 bp, Homo sapiens
gatcttcccacagga

SEQ ID NO: 3571211 - DNA, 13 bp, Homo sapiens
gatctttaaaata

SEQ ID NO: 3571212 - DNA, 14 bp, Homo sapiens
gatctttaaaatac

SEQ ID NO: 3571213 - DNA, 18 bp, Homo sapiens
gatgaaaactaaggattt

SEQ ID NO: 3571214 - DNA, 19 bp, Homo sapiens
gcaggcccaatgctgcttt

SEQ ID NO: 3571215 - DNA, 18 bp, Homo sapiens
gcaggcccactccccagc

SEQ ID NO: 3571216 - DNA, 22 bp, Homo sapiens
gcaggcccactccccagcccca

SEQ ID NO: 3571217 - DNA, 14 bp, Homo sapiens
gcaggcccatggga

SEQ ID NO: 3571218 - DNA, 13 bp, Homo sapiens
gcaggcctctggg

SEQ ID NO: 3571219 - DNA, 14 bp, Homo sapiens
gcaggcctctggga

SEQ ID NO: 3571220 - DNA, 16 bp, Homo sapiens
gcaggcctctgggacc

SEQ ID NO: 3571221 - DNA, 23 bp, Homo sapiens
gcaggctgagggtcgtgggaaag

SEQ ID NO: 3571222 - DNA, 16 bp, Homo sapiens
gcaggcttgtggcagc

SEQ ID NO: 3571223 - DNA, 13 bp, Homo sapiens
gcagggaaggaga

SEQ ID NO: 3571224 - DNA, 17 bp, Homo sapiens
gcagggaaggagacacc

SEQ ID NO: 3571225 - DNA, 15 bp, Homo sapiens
gcagggaatgcagca

SEQ ID NO: 3571226 - DNA, 16 bp, Homo sapiens
gcagggaccgggcgca

SEQ ID NO: 3571227 - DNA, 14 bp, Homo sapiens
gcagggacctgaga

SEQ ID NO: 3571228 - DNA, 13 bp, Homo sapiens
gcagggagagagt

SEQ ID NO: 3571229 - DNA, 23 bp, Homo sapiens
gcagggatccccaggaggcctgg

SEQ ID NO: 3571230 - DNA, 20 bp, Homo sapiens
gcagggatgatggcagagcc

SEQ ID NO: 3571231 - DNA, 22 bp, Homo sapiens
gcagggatgatggcagagccag

SEQ ID NO: 3571232 - DNA, 24 bp, Homo sapiens
gcagggccatctgactgccaagcc

SEQ ID NO: 3571233 - DNA, 22 bp, Homo sapiens
gcagggccgggcagggggacag

SEQ ID NO: 3571234 - DNA, 16 bp, Homo sapiens
gcagggcgcccagcgc

SEQ ID NO: 3571235 - DNA, 17 bp, Homo sapiens
gcagggctaaataaaga

SEQ ID NO: 3571236 - DNA, 18 bp, Homo sapiens
gcagggctaaataaagag

SEQ ID NO: 3571237 - DNA, 21 bp, Homo sapiens
gcagggctaaataaagaggag

SEQ ID NO: 3571238 - DNA, 17 bp, Homo sapiens
gcaggggaggccatctg

SEQ ID NO: 3571239 - DNA, 21 bp, Homo sapiens
gcaggggaggccatctggaga

SEQ ID NO: 3571240 - DNA, 12 bp, Homo sapiens
gcaggggagggg

SEQ ID NO: 3571241 - DNA, 14 bp, Homo sapiens
gcaggggcctctgt

SEQ ID NO: 3571242 - DNA, 18 bp, Homo sapiens
gcagggggacagcaggga

SEQ ID NO: 3571243 - DNA, 19 bp, Homo sapiens
gcagggggacagcagggac

SEQ ID NO: 3571244 - DNA, 15 bp, Homo sapiens
gcagggggccccgcc

SEQ ID NO: 3571245 - DNA, 20 bp, Homo sapiens
gcagggggccccgccagggc

SEQ ID NO: 3571246 - DNA, 16 bp, Homo sapiens
gcaggggggctgtgcc

SEQ ID NO: 3571247 - DNA, 14 bp, Homo sapiens
gcagggggtgaggg

SEQ ID NO: 3571248 - DNA, 16 bp, Homo sapiens
gcagggggtgaggggc

SEQ ID NO: 3571249 - DNA, 17 bp, Homo sapiens
gcagggtccacagctgg

SEQ ID NO: 3571250 - DNA, 18 bp, Homo sapiens
gcagggtccacagctgga

SEQ ID NO: 3571251 - DNA, 18 bp, Homo sapiens
gcagggttacacaaaaat

SEQ ID NO: 3571252 - DNA, 16 bp, Homo sapiens
gcaggtacatttctga

SEQ ID NO: 3571253 - DNA, 20 bp, Homo sapiens
gcaggtgctcatgctgctcc

SEQ ID NO: 3571254 - DNA, 15 bp, Homo sapiens
gcaggtgtcctgagc

SEQ ID NO: 3571255 - DNA, 16 bp, Homo sapiens
gcaggtgtcctgagca

SEQ ID NO: 3571256 - DNA, 16 bp, Homo sapiens
gcaggtgttctgctga

SEQ ID NO: 3571257 - DNA, 15 bp, Homo sapiens
gcagtaaaacacatt

SEQ ID NO: 3571258 - DNA, 16 bp, Homo sapiens
gcagtaaatatttact

SEQ ID NO: 3571259 - DNA, 13 bp, Homo sapiens
gcagtacaaatgt

SEQ ID NO: 3571260 - DNA, 13 bp, Homo sapiens
gcagtcccacact

SEQ ID NO: 3571261 - DNA, 13 bp, Homo sapiens
gcagtcctcagga

SEQ ID NO: 3571262 - DNA, 16 bp, Homo sapiens
gcagtcctcaggaagg

SEQ ID NO: 3571263 - DNA, 16 bp, Homo sapiens
gcagtcctggaggcag

SEQ ID NO: 3571264 - DNA, 12 bp, Homo sapiens
gcagtcgcctgc

SEQ ID NO: 3571265 - DNA, 23 bp, Homo sapiens
gcagtcgcctgcctgcagcaggc

SEQ ID NO: 3571266 - DNA, 18 bp, Homo sapiens
gcagtctccttcagcacg

SEQ ID NO: 3571267 - DNA, 22 bp, Homo sapiens
gcagtctttatttttttcccat

SEQ ID NO: 3571268 - DNA, 16 bp, Homo sapiens
gcagtgaactattttt

SEQ ID NO: 3571269 - DNA, 17 bp, Homo sapiens
gcagtgactccccagcc

SEQ ID NO: 3571270 - DNA, 18 bp, Homo sapiens
gcagtgactccccagccc

SEQ ID NO: 3571271 - DNA, 13 bp, Homo sapiens
gcagtgatgtcac

SEQ ID NO: 3571272 - DNA, 22 bp, Homo sapiens
gcagtgatgtttgccatttgct

SEQ ID NO: 3571273 - DNA, 19 bp, Homo sapiens
gcagtgcccatgtgtacat

SEQ ID NO: 3571274 - DNA, 18 bp, Homo sapiens
gcagtggcaggggagcag

SEQ ID NO: 3571275 - DNA, 16 bp, Homo sapiens
gcagtggcttctttcc

SEQ ID NO: 3571276 - DNA, 17 bp, Homo sapiens
gcagtgttatttatttc

SEQ ID NO: 3571277 - DNA, 16 bp, Homo sapiens
gcagttaatttatata

SEQ ID NO: 3571278 - DNA, 13 bp, Homo sapiens
gcagttaccacag

SEQ ID NO: 3571279 - DNA, 21 bp, Homo sapiens
gcagttcagaatggcagtcct

SEQ ID NO: 3571280 - DNA, 22 bp, Homo sapiens
gcagttcagaatggcagtcctg

SEQ ID NO: 3571281 - DNA, 19 bp, Homo sapiens
gcagttcattctaccaagc

SEQ ID NO: 3571282 - DNA, 21 bp, Homo sapiens
gcagttcattctaccaagctg

SEQ ID NO: 3571283 - DNA, 15 bp, Homo sapiens
gcagttcctgtccca

SEQ ID NO: 3571284 - DNA, 17 bp, Homo sapiens
gcagttcctgtcccaca

SEQ ID NO: 3571285 - DNA, 15 bp, Homo sapiens
gcagttgaaaagact

SEQ ID NO: 3571286 - DNA, 19 bp, Homo sapiens
gcagttgaaaagactccaa

SEQ ID NO: 3571287 - DNA, 22 bp, Homo sapiens
gcagttgacaggtacttggagg

SEQ ID NO: 3571288 - DNA, 16 bp, Homo sapiens
gcagttgtagcagaaa

SEQ ID NO: 3571289 - DNA, 12 bp, Homo sapiens
gcagtttacagt

SEQ ID NO: 3571290 - DNA, 18 bp, Homo sapiens
gcataaaaattaaatgga

SEQ ID NO: 3571291 - DNA, 14 bp, Homo sapiens
gcataacctgtctc

SEQ ID NO: 3571292 - DNA, 18 bp, Homo sapiens
gcatataatgaataaatc

SEQ ID NO: 3571293 - DNA, 14 bp, Homo sapiens
gcatatagacacac

SEQ ID NO: 3571294 - DNA, 19 bp, Homo sapiens
gcatatttgcaaagtgtat

SEQ ID NO: 3571295 - DNA, 21 bp, Homo sapiens
gcatcaagggagacaccagtg

SEQ ID NO: 3571296 - DNA, 22 bp, Homo sapiens
gcatcaagggagacaccagtgg

SEQ ID NO: 3571297 - DNA, 19 bp, Homo sapiens
gcatcaggctaagaccctg

SEQ ID NO: 3571298 - DNA, 17 bp, Homo sapiens
gcatccaaggcaaacaa

SEQ ID NO: 3571299 - DNA, 13 bp, Homo sapiens
gcatccctggagc

SEQ ID NO: 3571300 - DNA, 20 bp, Homo sapiens
gcatccctggagcaggagcc

SEQ ID NO: 3571301 - DNA, 18 bp, Homo sapiens
gcatcgggagcacccaga

SEQ ID NO: 3571302 - DNA, 14 bp, Homo sapiens
gcatctcagcccac

SEQ ID NO: 3571303 - DNA, 22 bp, Homo sapiens
gcatctctccccatatataaat

SEQ ID NO: 3571304 - DNA, 22 bp, Homo sapiens
gcatctgaatgaaaataactga

SEQ ID NO: 3571305 - DNA, 17 bp, Homo sapiens
gcatctgaccagcagcg

SEQ ID NO: 3571306 - DNA, 15 bp, Homo sapiens
gcatgaataaaacac

SEQ ID NO: 3571307 - DNA, 22 bp, Homo sapiens
gcatgaataaaacactcatccc

SEQ ID NO: 3571308 - DNA, 16 bp, Homo sapiens
gcatgacaagtactgt

SEQ ID NO: 3571309 - DNA, 15 bp, Homo sapiens
gcatgactttcctta

SEQ ID NO: 3571310 - DNA, 17 bp, Homo sapiens
gcatgactttccttagg

SEQ ID NO: 3571311 - DNA, 12 bp, Homo sapiens
gcatgagctggc

SEQ ID NO: 3571312 - DNA, 21 bp, Homo sapiens
gcatgcgccaccatgccctat

SEQ ID NO: 3571313 - DNA, 20 bp, Homo sapiens
gcatgctagtgttgtatttc

SEQ ID NO: 3571314 - DNA, 21 bp, Homo sapiens
gcatgctagtgttgtatttct

SEQ ID NO: 3571315 - DNA, 15 bp, Homo sapiens
gcatgcttgggctga

SEQ ID NO: 3571316 - DNA, 13 bp, Homo sapiens
gcatggaaaaatg

SEQ ID NO: 3571317 - DNA, 15 bp, Homo sapiens
gcatggagaatggga

SEQ ID NO: 3571318 - DNA, 17 bp, Homo sapiens
gcatggagacagcagtt

SEQ ID NO: 3571319 - DNA, 20 bp, Homo sapiens
gcatggcaaggactgcaggg

SEQ ID NO: 3571320 - DNA, 15 bp, Homo sapiens
gcatggcactgactg

SEQ ID NO: 3571321 - DNA, 13 bp, Homo sapiens
gcatggcaggagt

SEQ ID NO: 3571322 - DNA, 15 bp, Homo sapiens
gcatggcaggagtct

SEQ ID NO: 3571323 - DNA, 13 bp, Homo sapiens
gcatggccaggtg

SEQ ID NO: 3571324 - DNA, 22 bp, Homo sapiens
gcatgggctcgccgtgtctcag

SEQ ID NO: 3571325 - DNA, 16 bp, Homo sapiens
gcatgggtccagggcc

SEQ ID NO: 3571326 - DNA, 20 bp, Homo sapiens
gcatggtgccccaggaccag

SEQ ID NO: 3571327 - DNA, 18 bp, Homo sapiens
gcatggtggctcatgcct

SEQ ID NO: 3571328 - DNA, 15 bp, Homo sapiens
gcatgtgtcccttcc

SEQ ID NO: 3571329 - DNA, 11 bp, Homo sapiens
gcatgtgtgcc

SEQ ID NO: 3571330 - DNA, 19 bp, Homo sapiens
gcatgttgggttgttacag

SEQ ID NO: 3571331 - DNA, 14 bp, Homo sapiens
gcatgtttgaaatg

SEQ ID NO: 3571332 - DNA, 18 bp, Homo sapiens
gcatgtttgaaatgaggt

SEQ ID NO: 3571333 - DNA, 14 bp, Homo sapiens
gcatgttttccagg

SEQ ID NO: 3571334 - DNA, 21 bp, Homo sapiens
gcattagcaaggcagagcctt

SEQ ID NO: 3571335 - DNA, 18 bp, Homo sapiens
gcattatatttgtaaatt

SEQ ID NO: 3571336 - DNA, 16 bp, Homo sapiens
gcattattctctttta

SEQ ID NO: 3571337 - DNA, 22 bp, Homo sapiens
gcattattctcttttatctgtt

SEQ ID NO: 3571338 - DNA, 20 bp, Homo sapiens
gcattcaaaaagacagcaga

SEQ ID NO: 3571339 - DNA, 13 bp, Homo sapiens
gcattctcactcc

SEQ ID NO: 3571340 - DNA, 15 bp, Homo sapiens
gcattctcactccta

SEQ ID NO: 3571341 - DNA, 17 bp, Homo sapiens
gcattctctcccatcct

SEQ ID NO: 3571342 - DNA, 21 bp, Homo sapiens
gcattctctcccatcctgggg

SEQ ID NO: 3571343 - DNA, 14 bp, Homo sapiens
gcattgaaataata

SEQ ID NO: 3571344 - DNA, 20 bp, Homo sapiens
gcattgtaaaagcattttgt

SEQ ID NO: 3571345 - DNA, 14 bp, Homo sapiens
gcattgtgtggaat

SEQ ID NO: 3571346 - DNA, 16 bp, Homo sapiens
gcatttcataaactaa

SEQ ID NO: 3571347 - DNA, 18 bp, Homo sapiens
gccagtgaagtccttcag

SEQ ID NO: 3571348 - DNA, 11 bp, Homo sapiens
gcactcagatt

SEQ ID NO: 3571349 - DNA, 13 bp, Homo sapiens
gcactccagactc

SEQ ID NO: 3571350 - DNA, 15 bp, Homo sapiens
gcactccagactctg

SEQ ID NO: 3571351 - DNA, 17 bp, Homo sapiens
gcactcccacctgacac

SEQ ID NO: 3571352 - DNA, 14 bp, Homo sapiens
gcactccccagagc

SEQ ID NO: 3571353 - DNA, 20 bp, Homo sapiens
gcactccccagagctgtgcc

SEQ ID NO: 3571354 - DNA, 15 bp, Homo sapiens
gcactcctttatctg

SEQ ID NO: 3571355 - DNA, 13 bp, Homo sapiens
gcactctcagagt

SEQ ID NO: 3571356 - DNA, 15 bp, Homo sapiens
gcactctccccgctc

SEQ ID NO: 3571357 - DNA, 13 bp, Homo sapiens
gcactctggcagc

SEQ ID NO: 3571358 - DNA, 14 bp, Homo sapiens
gcactctggcagca

SEQ ID NO: 3571359 - DNA, 17 bp, Homo sapiens
gcactgaaccacattca

SEQ ID NO: 3571360 - DNA, 19 bp, Homo sapiens
gcactgaagtttttgaaat

SEQ ID NO: 3571361 - DNA, 23 bp, Homo sapiens
gcactgaagtttttgaaatacct

SEQ ID NO: 3571362 - DNA, 12 bp, Homo sapiens
gcactgagcagg

SEQ ID NO: 3571363 - DNA, 16 bp, Homo sapiens
gcactgagcagggatc

SEQ ID NO: 3571364 - DNA, 18 bp, Homo sapiens
gcactgcattcctgtgcc

SEQ ID NO: 3571365 - DNA, 16 bp, Homo sapiens
gcactggcgaggagag

SEQ ID NO: 3571366 - DNA, 23 bp, Homo sapiens
gcactggggcgtttcctactgcg

SEQ ID NO: 3571367 - DNA, 14 bp, Homo sapiens
gcactggtggcccg

SEQ ID NO: 3571368 - DNA, 15 bp, Homo sapiens
gcactgtcaagatga

SEQ ID NO: 3571369 - DNA, 17 bp, Homo sapiens
gcactgtgaaggaccct

SEQ ID NO: 3571370 - DNA, 18 bp, Homo sapiens
gcactgtgaaggaccctt

SEQ ID NO: 3571371 - DNA, 21 bp, Homo sapiens
gcacttacacttataaaataa

SEQ ID NO: 3571372 - DNA, 21 bp, Homo sapiens
gcacttgagaaccagtctcct

SEQ ID NO: 3571373 - DNA, 19 bp, Homo sapiens
gcacttgcctatgatactg

SEQ ID NO: 3571374 - DNA, 20 bp, Homo sapiens
gcacttttttaaatataaaa

SEQ ID NO: 3571375 - DNA, 20 bp, Homo sapiens
gcagaaagcatccctcaccc

SEQ ID NO: 3571376 - DNA, 13 bp, Homo sapiens
gcagaagacgtct

SEQ ID NO: 3571377 - DNA, 18 bp, Homo sapiens
gcagaagacgtctcccct

SEQ ID NO: 3571378 - DNA, 21 bp, Homo sapiens
gcagaaggaaagaagggggcc

SEQ ID NO: 3571379 - DNA, 22 bp, Homo sapiens
gcagaaggaaagaagggggccc

SEQ ID NO: 3571380 - DNA, 22 bp, Homo sapiens
gcagaaggcaaggccctgccct

SEQ ID NO: 3571381 - DNA, 19 bp, Homo sapiens
gcagaccagctggcgggtg

SEQ ID NO: 3571382 - DNA, 12 bp, Homo sapiens
gcagacctggag

SEQ ID NO: 3571383 - DNA, 13 bp, Homo sapiens
gcagacctggagc

SEQ ID NO: 3571384 - DNA, 15 bp, Homo sapiens
gcagacctggagctt

SEQ ID NO: 3571385 - DNA, 19 bp, Homo sapiens
gcagacggtctgtgtgctg

SEQ ID NO: 3571386 - DNA, 22 bp, Homo sapiens
gcagacggtctgtgtgctgttt

SEQ ID NO: 3571387 - DNA, 12 bp, Homo sapiens
gcagactgtgaa

SEQ ID NO: 3571388 - DNA, 17 bp, Homo sapiens
gcagagaaatgccccag

SEQ ID NO: 3571389 - DNA, 19 bp, Homo sapiens
gcagagaaatgccccagtg

SEQ ID NO: 3571390 - DNA, 20 bp, Homo sapiens
gcagagaaatgccccagtgt

SEQ ID NO: 3571391 - DNA, 21 bp, Homo sapiens
gcagagaggtttcgatattta

SEQ ID NO: 3571392 - DNA, 15 bp, Homo sapiens
gcagagcctcctggg

SEQ ID NO: 3571393 - DNA, 19 bp, Homo sapiens
gcagagcctttttacctgg

SEQ ID NO: 3571394 - DNA, 21 bp, Homo sapiens
gcagaggagaacttgctgcct

SEQ ID NO: 3571395 - DNA, 21 bp, Homo sapiens
gcagaggaggggccgctgcca

SEQ ID NO: 3571396 - DNA, 20 bp, Homo sapiens
gcagaggcgtactacccagc

SEQ ID NO: 3571397 - DNA, 18 bp, Homo sapiens
gcagagttacagttctgt

SEQ ID NO: 3571398 - DNA, 21 bp, Homo sapiens
gcagagttacagttctgtggt

SEQ ID NO: 3571399 - DNA, 14 bp, Homo sapiens
gcagatactttgaa

SEQ ID NO: 3571400 - DNA, 14 bp, Homo sapiens
gcagatccaggact

SEQ ID NO: 3571401 - DNA, 21 bp, Homo sapiens
gcagatttttatgttttgaaa

SEQ ID NO: 3571402 - DNA, 14 bp, Homo sapiens
gcagcaccaaccac

SEQ ID NO: 3571403 - DNA, 19 bp, Homo sapiens
gcagcaccgcctcttcccg

SEQ ID NO: 3571404 - DNA, 19 bp, Homo sapiens
gcagcagccccccttgccc

SEQ ID NO: 3571405 - DNA, 21 bp, Homo sapiens
gcagcaggaaggaacaaagac

SEQ ID NO: 3571406 - DNA, 14 bp, Homo sapiens
gcagcaggaggggg

SEQ ID NO: 3571407 - DNA, 21 bp, Homo sapiens
gcagcaggaggggggagggaa

SEQ ID NO: 3571408 - DNA, 13 bp, Homo sapiens
gcagcaggcagct

SEQ ID NO: 3571409 - DNA, 17 bp, Homo sapiens
gcagcaggccagagaaa

SEQ ID NO: 3571410 - DNA, 21 bp, Homo sapiens
gcagcaggccagagaaagcaa

SEQ ID NO: 3571411 - DNA, 23 bp, Homo sapiens
gcagcaggccagagaaagcaaag

SEQ ID NO: 3571412 - DNA, 18 bp, Homo sapiens
gcagcaggctcaggcaca

SEQ ID NO: 3571413 - DNA, 17 bp, Homo sapiens
gcagcagggatgccctg

SEQ ID NO: 3571414 - DNA, 19 bp, Homo sapiens
gcagcagggatgccctgga

SEQ ID NO: 3571415 - DNA, 22 bp, Homo sapiens
gcagcagtcgcccaagcagaca

SEQ ID NO: 3571416 - DNA, 18 bp, Homo sapiens
gcagcatccaccccaccc

SEQ ID NO: 3571417 - DNA, 18 bp, Homo sapiens
gcagcatgcttgggctga

SEQ ID NO: 3571418 - DNA, 19 bp, Homo sapiens
gcagcccagggcctagagg

SEQ ID NO: 3571419 - DNA, 19 bp, Homo sapiens
gcagcccgtgtccaggagc

SEQ ID NO: 3571420 - DNA, 20 bp, Homo sapiens
gcagcccgtgtccaggagcc

SEQ ID NO: 3571421 - DNA, 14 bp, Homo sapiens
gcagccctgctttg

SEQ ID NO: 3571422 - DNA, 14 bp, Homo sapiens
gcagccgcagagaa

SEQ ID NO: 3571423 - DNA, 17 bp, Homo sapiens
gcagccgcagagaaatg

SEQ ID NO: 3571424 - DNA, 14 bp, Homo sapiens
gcagccgccagctg

SEQ ID NO: 3571425 - DNA, 15 bp, Homo sapiens
gcagccgccagctgg

SEQ ID NO: 3571426 - DNA, 14 bp, Homo sapiens
gcagccgtgccttc

SEQ ID NO: 3571427 - DNA, 15 bp, Homo sapiens
gcagcctaagaagaa

SEQ ID NO: 3571428 - DNA, 18 bp, Homo sapiens
gcagcctaagaagaaggc

SEQ ID NO: 3571429 - DNA, 14 bp, Homo sapiens
gcagcctctctggc

SEQ ID NO: 3571430 - DNA, 17 bp, Homo sapiens
gcagcctctctggctgg

SEQ ID NO: 3571431 - DNA, 21 bp, Homo sapiens
gcagcctctctggctggtctt

SEQ ID NO: 3571432 - DNA, 17 bp, Homo sapiens
gcagcctgattcggggc

SEQ ID NO: 3571433 - DNA, 16 bp, Homo sapiens
gcagcctgcaggacct

SEQ ID NO: 3571434 - DNA, 19 bp, Homo sapiens
gcagcctgtcctgggctgg

SEQ ID NO: 3571435 - DNA, 19 bp, Homo sapiens
gcagccttcatcagaactc

SEQ ID NO: 3571436 - DNA, 15 bp, Homo sapiens
gcagccttcccctcc

SEQ ID NO: 3571437 - DNA, 19 bp, Homo sapiens
gcagccttcccctccctgt

SEQ ID NO: 3571438 - DNA, 18 bp, Homo sapiens
gcagcgcagggctggcac

SEQ ID NO: 3571439 - DNA, 16 bp, Homo sapiens
gcagcggcgtgaggcc

SEQ ID NO: 3571440 - DNA, 14 bp, Homo sapiens
gcagcggctccact

SEQ ID NO: 3571441 - DNA, 12 bp, Homo sapiens
gcagcggctcct

SEQ ID NO: 3571442 - DNA, 15 bp, Homo sapiens
gcagcggctcctgca

SEQ ID NO: 3571443 - DNA, 13 bp, Homo sapiens
gcagctagtgcct

SEQ ID NO: 3571444 - DNA, 20 bp, Homo sapiens
gcagctatttcagcctcctg

SEQ ID NO: 3571445 - DNA, 17 bp, Homo sapiens
gcagctcaagggctggc

SEQ ID NO: 3571446 - DNA, 18 bp, Homo sapiens
gcagctcaagggctggca

SEQ ID NO: 3571447 - DNA, 13 bp, Homo sapiens
gcagctcatgttt

SEQ ID NO: 3571448 - DNA, 16 bp, Homo sapiens
gcagctccctcctcag

SEQ ID NO: 3571449 - DNA, 17 bp, Homo sapiens
gcagctccctcctcagg

SEQ ID NO: 3571450 - DNA, 13 bp, Homo sapiens
gcagctcctcagc

SEQ ID NO: 3571451 - DNA, 12 bp, Homo sapiens
gcagctctcccc

SEQ ID NO: 3571452 - DNA, 18 bp, Homo sapiens
gcagctgaaatatgctgg

SEQ ID NO: 3571453 - DNA, 17 bp, Homo sapiens
gcagctggcccccagcc

SEQ ID NO: 3571454 - DNA, 18 bp, Homo sapiens
gcagctggcccccagccc

SEQ ID NO: 3571455 - DNA, 19 bp, Homo sapiens
gcagctggcccccagccct

SEQ ID NO: 3571456 - DNA, 20 bp, Homo sapiens
gcagctggcccccagccctg

SEQ ID NO: 3571457 - DNA, 22 bp, Homo sapiens
gcagctggcccccagccctggg

SEQ ID NO: 3571458 - DNA, 19 bp, Homo sapiens
gcagctgggtgcagaagct

SEQ ID NO: 3571459 - DNA, 17 bp, Homo sapiens
gcagcttctactcctgc

SEQ ID NO: 3571460 - DNA, 15 bp, Homo sapiens
gcagcttgctgggct

SEQ ID NO: 3571461 - DNA, 18 bp, Homo sapiens
gcaggaaagccacatctt

SEQ ID NO: 3571462 - DNA, 19 bp, Homo sapiens
gcaggaaagccacatcttg

SEQ ID NO: 3571463 - DNA, 13 bp, Homo sapiens
gcaggaaggaaaa

SEQ ID NO: 3571464 - DNA, 14 bp, Homo sapiens
gcaggaaggacccc

SEQ ID NO: 3571465 - DNA, 19 bp, Homo sapiens
gcaggaccctgtcctgcag

SEQ ID NO: 3571466 - DNA, 15 bp, Homo sapiens
gcaggacctcgtgcc

SEQ ID NO: 3571467 - DNA, 16 bp, Homo sapiens
gcaggactcctggcag

SEQ ID NO: 3571468 - DNA, 17 bp, Homo sapiens
gcaggactcctggcagg

SEQ ID NO: 3571469 - DNA, 14 bp, Homo sapiens
gcaggagaatcact

SEQ ID NO: 3571470 - DNA, 14 bp, Homo sapiens
gcaggagccccgcc

SEQ ID NO: 3571471 - DNA, 19 bp, Homo sapiens
gctgtactgagcactgaac

SEQ ID NO: 3571472 - DNA, 20 bp, Homo sapiens
gctgtatgtcttaaaacctg

SEQ ID NO: 3571473 - DNA, 21 bp, Homo sapiens
gctgtcaaaactactgacagg

SEQ ID NO: 3571474 - DNA, 13 bp, Homo sapiens
gctgtccctgcag

SEQ ID NO: 3571475 - DNA, 16 bp, Homo sapiens
gctgtccctgcagggc

SEQ ID NO: 3571476 - DNA, 20 bp, Homo sapiens
gctgtctttcttgctccctg

SEQ ID NO: 3571477 - DNA, 14 bp, Homo sapiens
gctgtgccacaggc

SEQ ID NO: 3571478 - DNA, 14 bp, Homo sapiens
gctgtgccttccct

SEQ ID NO: 3571479 - DNA, 20 bp, Homo sapiens
gctgtgctccacactcagaa

SEQ ID NO: 3571480 - DNA, 17 bp, Homo sapiens
gctgtgctctggcacca

SEQ ID NO: 3571481 - DNA, 13 bp, Homo sapiens
gctgtgctgctca

SEQ ID NO: 3571482 - DNA, 14 bp, Homo sapiens
gctgtgctgctcaa

SEQ ID NO: 3571483 - DNA, 15 bp, Homo sapiens
gctgtgctttggaac

SEQ ID NO: 3571484 - DNA, 18 bp, Homo sapiens
gctgtggggaacacagct

SEQ ID NO: 3571485 - DNA, 22 bp, Homo sapiens
gctgtggggcagctgagcagct

SEQ ID NO: 3571486 - DNA, 23 bp, Homo sapiens
gctgtggtttccatctgaaagta

SEQ ID NO: 3571487 - DNA, 15 bp, Homo sapiens
gctgttaatatttct

SEQ ID NO: 3571488 - DNA, 18 bp, Homo sapiens
gctgttaatctgatgtat

SEQ ID NO: 3571489 - DNA, 21 bp, Homo sapiens
gctgttaatctgatgtataat

SEQ ID NO: 3571490 - DNA, 22 bp, Homo sapiens
gctgttaatctgatgtataatg

SEQ ID NO: 3571491 - DNA, 19 bp, Homo sapiens
gctgttacagttttcttca

SEQ ID NO: 3571492 - DNA, 14 bp, Homo sapiens
gctgttatgctgtt

SEQ ID NO: 3571493 - DNA, 18 bp, Homo sapiens
gctgttatttcttccctg

SEQ ID NO: 3571494 - DNA, 20 bp, Homo sapiens
gctgttatttcttccctgct

SEQ ID NO: 3571495 - DNA, 23 bp, Homo sapiens
gctgttccattacaccacagcat

SEQ ID NO: 3571496 - DNA, 21 bp, Homo sapiens
gctgttgtcacatctcaggga

SEQ ID NO: 3571497 - DNA, 13 bp, Homo sapiens
gctgtttcaaagt

SEQ ID NO: 3571498 - DNA, 20 bp, Homo sapiens
gctgttttcctcccttctgc

SEQ ID NO: 3571499 - DNA, 22 bp, Homo sapiens
gctgttttcctcccttctgcta

SEQ ID NO: 3571500 - DNA, 15 bp, Homo sapiens
gcttaaactggaaag

SEQ ID NO: 3571501 - DNA, 22 bp, Homo sapiens
gcttaaagggatggacttgtga

SEQ ID NO: 3571502 - DNA, 22 bp, Homo sapiens
gcttaattattgatgttttcat

SEQ ID NO: 3571503 - DNA, 14 bp, Homo sapiens
gcttacaggagcca

SEQ ID NO: 3571504 - DNA, 17 bp, Homo sapiens
gcttacaggagccagcc

SEQ ID NO: 3571505 - DNA, 20 bp, Homo sapiens
gcttacaggagccagcctgc

SEQ ID NO: 3571506 - DNA, 21 bp, Homo sapiens
gcttacctgggcacaaacaga

SEQ ID NO: 3571507 - DNA, 23 bp, Homo sapiens
gcttagggacaggaccccagctc

SEQ ID NO: 3571508 - DNA, 20 bp, Homo sapiens
gcttagttggctttgcccac

SEQ ID NO: 3571509 - DNA, 14 bp, Homo sapiens
gcttatatgtactt

SEQ ID NO: 3571510 - DNA, 15 bp, Homo sapiens
gcttatatgtacttt

SEQ ID NO: 3571511 - DNA, 16 bp, Homo sapiens
gcttcaaaaagccaca

SEQ ID NO: 3571512 - DNA, 19 bp, Homo sapiens
gcttcaaaaagccacagca

SEQ ID NO: 3571513 - DNA, 17 bp, Homo sapiens
gcttcaacagccaagct

SEQ ID NO: 3571514 - DNA, 18 bp, Homo sapiens
gcttcaacagccaagctg

SEQ ID NO: 3571515 - DNA, 19 bp, Homo sapiens
gcttcaccccaatcccagc

SEQ ID NO: 3571516 - DNA, 13 bp, Homo sapiens
gcttcagactcaa

SEQ ID NO: 3571517 - DNA, 13 bp, Homo sapiens
gcttcagccaggt

SEQ ID NO: 3571518 - DNA, 21 bp, Homo sapiens
gcttcagccaggtctgactcc

SEQ ID NO: 3571519 - DNA, 15 bp, Homo sapiens
gcttccatgatgcac

SEQ ID NO: 3571520 - DNA, 22 bp, Homo sapiens
gcttccatgatgcacagtatct

SEQ ID NO: 3571521 - DNA, 21 bp, Homo sapiens
gcttcccaacagatcatatgg

SEQ ID NO: 3571522 - DNA, 18 bp, Homo sapiens
gcttccccttttgccaat

SEQ ID NO: 3571523 - DNA, 17 bp, Homo sapiens
gcttccctaaactgcag

SEQ ID NO: 3571524 - DNA, 18 bp, Homo sapiens
gcttccctaaactgcagc

SEQ ID NO: 3571525 - DNA, 13 bp, Homo sapiens
gcttccctggaag

SEQ ID NO: 3571526 - DNA, 14 bp, Homo sapiens
gcttccctggaagc

SEQ ID NO: 3571527 - DNA, 18 bp, Homo sapiens
gcttccgctttgaaagaa

SEQ ID NO: 3571528 - DNA, 17 bp, Homo sapiens
gcttcctcacacccctg

SEQ ID NO: 3571529 - DNA, 20 bp, Homo sapiens
gcttcctcacacccctgtcc

SEQ ID NO: 3571530 - DNA, 15 bp, Homo sapiens
gcttcctgagggcta

SEQ ID NO: 3571531 - DNA, 12 bp, Homo sapiens
gcttcctgctgt

SEQ ID NO: 3571532 - DNA, 18 bp, Homo sapiens
gcttcctgctgtatgtga

SEQ ID NO: 3571533 - DNA, 23 bp, Homo sapiens
gcttcctggctgtaaatcctaga

SEQ ID NO: 3571534 - DNA, 19 bp, Homo sapiens
gcttctaaatggtgctgca

SEQ ID NO: 3571535 - DNA, 21 bp, Homo sapiens
gcttctaaatggtgctgcaga

SEQ ID NO: 3571536 - DNA, 15 bp, Homo sapiens
gcttctacatgatgc

SEQ ID NO: 3571537 - DNA, 15 bp, Homo sapiens
gcttctcctgtgtga

SEQ ID NO: 3571538 - DNA, 16 bp, Homo sapiens
gcttctctgcagtaaa

SEQ ID NO: 3571539 - DNA, 23 bp, Homo sapiens
gcttctctgcagtaaaacacatt

SEQ ID NO: 3571540 - DNA, 21 bp, Homo sapiens
gcttctttctagaaagagaaa

SEQ ID NO: 3571541 - DNA, 18 bp, Homo sapiens
gcttgacttgtggggcag

SEQ ID NO: 3571542 - DNA, 18 bp, Homo sapiens
gcttgactttccagaatg

SEQ ID NO: 3571543 - DNA, 18 bp, Homo sapiens
gcttgcatggagaatggg

SEQ ID NO: 3571544 - DNA, 16 bp, Homo sapiens
gcttgcccgctcccac

SEQ ID NO: 3571545 - DNA, 17 bp, Homo sapiens
gcttgcccgctcccaca

SEQ ID NO: 3571546 - DNA, 13 bp, Homo sapiens
gcttgctgggctt

SEQ ID NO: 3571547 - DNA, 18 bp, Homo sapiens
gcttgctgggtacctggt

SEQ ID NO: 3571548 - DNA, 12 bp, Homo sapiens
gcttggaagcca

SEQ ID NO: 3571549 - DNA, 21 bp, Homo sapiens
gcttggctcacaaggcccagg

SEQ ID NO: 3571550 - DNA, 18 bp, Homo sapiens
gcttgggctgacccagca

SEQ ID NO: 3571551 - DNA, 16 bp, Homo sapiens
gcttggggctcgggcc

SEQ ID NO: 3571552 - DNA, 12 bp, Homo sapiens
gcttggtgtgac

SEQ ID NO: 3571553 - DNA, 19 bp, Homo sapiens
gcttgtctcacgcagccag

SEQ ID NO: 3571554 - DNA, 19 bp, Homo sapiens
gcttgtggcagcctgattc

SEQ ID NO: 3571555 - DNA, 9 bp, Homo sapiens
gctttaaaa

SEQ ID NO: 3571556 - DNA, 13 bp, Homo sapiens
gctttaaaacaaa

SEQ ID NO: 3571557 - DNA, 22 bp, Homo sapiens
gctttaagaactaaaatgttct

SEQ ID NO: 3571558 - DNA, 23 bp, Homo sapiens
gctttaagaactaaaatgttcta

SEQ ID NO: 3571559 - DNA, 20 bp, Homo sapiens
gctttaagtgtgctgggcag

SEQ ID NO: 3571560 - DNA, 19 bp, Homo sapiens
gctttagaaccgtaggttt

SEQ ID NO: 3571561 - DNA, 17 bp, Homo sapiens
gctttatgcaaatacaa

SEQ ID NO: 3571562 - DNA, 18 bp, Homo sapiens
gctttatgcaaatacaat

SEQ ID NO: 3571563 - DNA, 23 bp, Homo sapiens
gctttcacatttaaatggttctg

SEQ ID NO: 3571564 - DNA, 20 bp, Homo sapiens
gctttcccccaggcgcctgc

SEQ ID NO: 3571565 - DNA, 22 bp, Homo sapiens
gctttcccccaggcgcctgcgc

SEQ ID NO: 3571566 - DNA, 16 bp, Homo sapiens
gctttccctgccaggc

SEQ ID NO: 3571567 - DNA, 18 bp, Homo sapiens
gctttctatgctgtttgt

SEQ ID NO: 3571568 - DNA, 13 bp, Homo sapiens
gctttctcttccc

SEQ ID NO: 3571569 - DNA, 21 bp, Homo sapiens
gctttctcttccccttcctgt

SEQ ID NO: 3571570 - DNA, 13 bp, Homo sapiens
gctttctgctcag

SEQ ID NO: 3571571 - DNA, 18 bp, Homo sapiens
gctttctgctcagcttct

SEQ ID NO: 3571572 - DNA, 21 bp, Homo sapiens
gctttctgctcagcttctcct

SEQ ID NO: 3571573 - DNA, 13 bp, Homo sapiens
gctttcttctttc

SEQ ID NO: 3571574 - DNA, 15 bp, Homo sapiens
gctttcttctttcct

SEQ ID NO: 3571575 - DNA, 19 bp, Homo sapiens
gctttgaaagaagcaagac

SEQ ID NO: 3571576 - DNA, 20 bp, Homo sapiens
gctttgaaagaagcaagaca

SEQ ID NO: 3571577 - DNA, 21 bp, Homo sapiens
gctttgggaagtttgctgtgc

SEQ ID NO: 3571578 - DNA, 22 bp, Homo sapiens
gctttgggaagtttgctgtgct

SEQ ID NO: 3571579 - DNA, 16 bp, Homo sapiens
gctttgggctgccctg

SEQ ID NO: 3571580 - DNA, 18 bp, Homo sapiens
gctttgggctgccctggt

SEQ ID NO: 3571581 - DNA, 17 bp, Homo sapiens
gctttggttccttctct

SEQ ID NO: 3571582 - DNA, 18 bp, Homo sapiens
gctttggttccttctctg

SEQ ID NO: 3571583 - DNA, 19 bp, Homo sapiens
gctttggttccttctctgg

SEQ ID NO: 3571584 - DNA, 17 bp, Homo sapiens
gctttgtagaaattaaa

SEQ ID NO: 3571585 - DNA, 16 bp, Homo sapiens
gctttgtaggtgtctc

SEQ ID NO: 3571586 - DNA, 15 bp, Homo sapiens
gctttgtatgcactt

SEQ ID NO: 3571587 - DNA, 11 bp, Homo sapiens
gctttgtctcc

SEQ ID NO: 3571588 - DNA, 14 bp, Homo sapiens
gctttgtctccaaa

SEQ ID NO: 3571589 - DNA, 19 bp, Homo sapiens
gctttgtctccaaagaaga

SEQ ID NO: 3571590 - DNA, 20 bp, Homo sapiens
gctttgtgaccagaaagctt

SEQ ID NO: 3571591 - DNA, 23 bp, Homo sapiens
gcttttcactgctggctgcctta

SEQ ID NO: 3571592 - DNA, 13 bp, Homo sapiens
gcttttctgccac

SEQ ID NO: 3571593 - DNA, 15 bp, Homo sapiens
gcttttctgtcctgg

SEQ ID NO: 3571594 - DNA, 17 bp, Homo sapiens
gcttttctgtcctgggc

SEQ ID NO: 3571595 - DNA, 15 bp, Homo sapiens
gcttttgggggtcag

SEQ ID NO: 3571596 - DNA, 21 bp, Homo sapiens
ggaaaaaagagtttaaacaaa

SEQ ID NO: 3571597 - DNA, 14 bp, Homo sapiens
ggaaaagaaacctg

SEQ ID NO: 3571598 - DNA, 19 bp, Homo sapiens
ggaaaagcggacatcagct

SEQ ID NO: 3571599 - DNA, 14 bp, Homo sapiens
ggaaaaggcccctg

SEQ ID NO: 3571600 - DNA, 17 bp, Homo sapiens
ggaaaaggcccctgcaa

SEQ ID NO: 3571601 - DNA, 18 bp, Homo sapiens
ggaaaataaaatatttaa

SEQ ID NO: 3571602 - DNA, 14 bp, Homo sapiens
ggaaaataaattat

SEQ ID NO: 3571603 - DNA, 23 bp, Homo sapiens
ggaaaatgacctcaaggaagcta

SEQ ID NO: 3571604 - DNA, 15 bp, Homo sapiens
ggaaaattcattttt

SEQ ID NO: 3571605 - DNA, 14 bp, Homo sapiens
ggaaaattgcccca

SEQ ID NO: 3571606 - DNA, 23 bp, Homo sapiens
ggaaacactgaaatgaaatcttc

SEQ ID NO: 3571607 - DNA, 22 bp, Homo sapiens
ggaaacagagtccaatttaagg

SEQ ID NO: 3571608 - DNA, 11 bp, Homo sapiens
ggaaacagcat

SEQ ID NO: 3571609 - DNA, 14 bp, Homo sapiens
ggaaacagcatgaa

SEQ ID NO: 3571610 - DNA, 15 bp, Homo sapiens
ggaaacagcatgaat

SEQ ID NO: 3571611 - DNA, 18 bp, Homo sapiens
ggaaaccttccacccagt

SEQ ID NO: 3571612 - DNA, 14 bp, Homo sapiens
ggaaactcagggct

SEQ ID NO: 3571613 - DNA, 14 bp, Homo sapiens
ggaaactgaagcat

SEQ ID NO: 3571614 - DNA, 21 bp, Homo sapiens
ggaaacttgatttgagatttt

SEQ ID NO: 3571615 - DNA, 17 bp, Homo sapiens
ggaaagaagggggccct

SEQ ID NO: 3571616 - DNA, 19 bp, Homo sapiens
ggaaagcagagcctcctgg

SEQ ID NO: 3571617 - DNA, 20 bp, Homo sapiens
ggaaagcagagcctcctggg

SEQ ID NO: 3571618 - DNA, 15 bp, Homo sapiens
ggaaagcctctggcc

SEQ ID NO: 3571619 - DNA, 22 bp, Homo sapiens
ggaaagcctctggccgtcacac

SEQ ID NO: 3571620 - DNA, 15 bp, Homo sapiens
ggaaagcgggcagcc

SEQ ID NO: 3571621 - DNA, 19 bp, Homo sapiens
ggaaaggattttaccaaag

SEQ ID NO: 3571622 - DNA, 23 bp, Homo sapiens
ggaaagggagggatgaccttccc

SEQ ID NO: 3571623 - DNA, 11 bp, Homo sapiens
ggaaaggggag

SEQ ID NO: 3571624 - DNA, 13 bp, Homo sapiens
ggaaagtgtgaag

SEQ ID NO: 3571625 - DNA, 16 bp, Homo sapiens
ggaaagtgtgaagacc

SEQ ID NO: 3571626 - DNA, 17 bp, Homo sapiens
ggaaatcaaatgtaaag

SEQ ID NO: 3571627 - DNA, 21 bp, Homo sapiens
ggaaattagataaataaaaat

SEQ ID NO: 3571628 - DNA, 18 bp, Homo sapiens
ggaacaatcacagggaat

SEQ ID NO: 3571629 - DNA, 17 bp, Homo sapiens
ggaacacatctggctgc

SEQ ID NO: 3571630 - DNA, 14 bp, Homo sapiens
ggaacaccctggat

SEQ ID NO: 3571631 - DNA, 19 bp, Homo sapiens
ggaacaccctggatgctgt

SEQ ID NO: 3571632 - DNA, 18 bp, Homo sapiens
ggaacataaaaaggacat

SEQ ID NO: 3571633 - DNA, 15 bp, Homo sapiens
ggaacccccctccca

SEQ ID NO: 3571634 - DNA, 17 bp, Homo sapiens
ggaacccccctcccacc

SEQ ID NO: 3571635 - DNA, 13 bp, Homo sapiens
ggaacctcagcct

SEQ ID NO: 3571636 - DNA, 15 bp, Homo sapiens
ggaacctcagcctgg

SEQ ID NO: 3571637 - DNA, 16 bp, Homo sapiens
ggaacctcagcctggc

SEQ ID NO: 3571638 - DNA, 21 bp, Homo sapiens
ggaacctcagcctggccagac

SEQ ID NO: 3571639 - DNA, 13 bp, Homo sapiens
ggaactcagatcc

SEQ ID NO: 3571640 - DNA, 16 bp, Homo sapiens
ggaactcagatccagg

SEQ ID NO: 3571641 - DNA, 20 bp, Homo sapiens
ggaactcagatccagggaca

SEQ ID NO: 3571642 - DNA, 18 bp, Homo sapiens
ggaactgaccctcaggca

SEQ ID NO: 3571643 - DNA, 21 bp, Homo sapiens
ggaacttaaaaccttgaaggt

SEQ ID NO: 3571644 - DNA, 22 bp, Homo sapiens
ggaacttggggagttaagacct

SEQ ID NO: 3571645 - DNA, 15 bp, Homo sapiens
ggaagaaactttttt

SEQ ID NO: 3571646 - DNA, 15 bp, Homo sapiens
ggaagaagaaaggac

SEQ ID NO: 3571647 - DNA, 20 bp, Homo sapiens
ggaagaaggacttgtttccc

SEQ ID NO: 3571648 - DNA, 14 bp, Homo sapiens
ggaagacagtggcc

SEQ ID NO: 3571649 - DNA, 21 bp, Homo sapiens
ggaagacttttggtagagaag

SEQ ID NO: 3571650 - DNA, 21 bp, Homo sapiens
ggaagagaagagggcccagcc

SEQ ID NO: 3571651 - DNA, 15 bp, Homo sapiens
ggaagagctgagacc

SEQ ID NO: 3571652 - DNA, 18 bp, Homo sapiens
ggaagatgacctgcccca

SEQ ID NO: 3571653 - DNA, 24 bp, Homo sapiens
ggaagcaataggtagctggggagc

SEQ ID NO: 3571654 - DNA, 17 bp, Homo sapiens
ggaagcatgtagactgt

SEQ ID NO: 3571655 - DNA, 10 bp, Homo sapiens
ggaagccagg

SEQ ID NO: 3571656 - DNA, 21 bp, Homo sapiens
ggaagccaggtacaggagagg

SEQ ID NO: 3571657 - DNA, 20 bp, Homo sapiens
ggaagccatcccttttttta

SEQ ID NO: 3571658 - DNA, 11 bp, Homo sapiens
ggaagctagac

SEQ ID NO: 3571659 - DNA, 20 bp, Homo sapiens
ggaagctctccgagctctgg

SEQ ID NO: 3571660 - DNA, 15 bp, Homo sapiens
ggaaggaacaaagac

SEQ ID NO: 3571661 - DNA, 23 bp, Homo sapiens
ggaaggaatgtcagggccaggtg

SEQ ID NO: 3571662 - DNA, 19 bp, Homo sapiens
ggaaggacaggaccctcag

SEQ ID NO: 3571663 - DNA, 21 bp, Homo sapiens
ggaaggacaggaccctcagga

SEQ ID NO: 3571664 - DNA, 19 bp, Homo sapiens
ggaaggcttggtcccatcg

SEQ ID NO: 3571665 - DNA, 23 bp, Homo sapiens
ggaagggacaccaagccttggct

SEQ ID NO: 3571666 - DNA, 13 bp, Homo sapiens
ggaaggggccacg

SEQ ID NO: 3571667 - DNA, 22 bp, Homo sapiens
ggaaggggccccatggcagctc

SEQ ID NO: 3571668 - DNA, 16 bp, Homo sapiens
ggaagtaacagacaca

SEQ ID NO: 3571669 - DNA, 16 bp, Homo sapiens
ggaagtacttccctca

SEQ ID NO: 3571670 - DNA, 12 bp, Homo sapiens
ggaagtacttgg

SEQ ID NO: 3571671 - DNA, 18 bp, Homo sapiens
ggaagtgggtgggtagat

SEQ ID NO: 3571672 - DNA, 20 bp, Homo sapiens
ggaagtgggtgggtagattt

SEQ ID NO: 3571673 - DNA, 12 bp, Homo sapiens
ggaagtgtgggt

SEQ ID NO: 3571674 - DNA, 18 bp, Homo sapiens
ggaagtgtgtgccaagag

SEQ ID NO: 3571675 - DNA, 21 bp, Homo sapiens
ggaataatttccttcaggcag

SEQ ID NO: 3571676 - DNA, 19 bp, Homo sapiens
ggaatagtatcctccaggt

SEQ ID NO: 3571677 - DNA, 22 bp, Homo sapiens
ggaatagtatcctccaggtttt

SEQ ID NO: 3571678 - DNA, 13 bp, Homo sapiens
ggaatcttcacta

SEQ ID NO: 3571679 - DNA, 13 bp, Homo sapiens
ggaatgcagcagg

SEQ ID NO: 3571680 - DNA, 16 bp, Homo sapiens
ggaatgtcagggccag

SEQ ID NO: 3571681 - DNA, 14 bp, Homo sapiens
ggaatgttctttct

SEQ ID NO: 3571682 - DNA, 22 bp, Homo sapiens
ggaattacaaaacctatttttc

SEQ ID NO: 3571683 - DNA, 13 bp, Homo sapiens
ggaattatttcac

SEQ ID NO: 3571684 - DNA, 18 bp, Homo sapiens
ggaattccctccccctcc

SEQ ID NO: 3571685 - DNA, 14 bp, Homo sapiens
ggaatttcccagga

SEQ ID NO: 3571686 - DNA, 15 bp, Homo sapiens
ggaatttcccaggac

SEQ ID NO: 3571687 - DNA, 17 bp, Homo sapiens
ggaatttcccaggaccc

SEQ ID NO: 3571688 - DNA, 18 bp, Homo sapiens
ggaatttcccaggaccct

SEQ ID NO: 3571689 - DNA, 24 bp, Homo sapiens
ggacacaacagcagtctccttcag

SEQ ID NO: 3571690 - DNA, 16 bp, Homo sapiens
ggacacagatcccggg

SEQ ID NO: 3571691 - DNA, 12 bp, Homo sapiens
ggacagcaggga

SEQ ID NO: 3571692 - DNA, 16 bp, Homo sapiens
ggacagccattttcca

SEQ ID NO: 3571693 - DNA, 17 bp, Homo sapiens
ggacagccccaccctgg

SEQ ID NO: 3571694 - DNA, 14 bp, Homo sapiens
ggacagcttcctca

SEQ ID NO: 3571695 - DNA, 16 bp, Homo sapiens
ggacagcttcctcaca

SEQ ID NO: 3571696 - DNA, 23 bp, Homo sapiens
ggacaggaccctcaggaattcag

SEQ ID NO: 3571697 - DNA, 19 bp, Homo sapiens
ggacaggcccgcttgctgg

SEQ ID NO: 3571698 - DNA, 15 bp, Homo sapiens
ggacagggcatggcc

SEQ ID NO: 3571699 - DNA, 17 bp, Homo sapiens
ggacagtggcctcttga

SEQ ID NO: 3571700 - DNA, 17 bp, Homo sapiens
ggacagttgatggagcc

SEQ ID NO: 3571701 - DNA, 17 bp, Homo sapiens
ggacatagaatctgtga

SEQ ID NO: 3571702 - DNA, 20 bp, Homo sapiens
ggacatccccccgccaaaag

SEQ ID NO: 3571703 - DNA, 19 bp, Homo sapiens
ggacatttgtgggcaagca

SEQ ID NO: 3571704 - DNA, 13 bp, Homo sapiens
ggacattttatgt

SEQ ID NO: 3571705 - DNA, 21 bp, Homo sapiens
ggaccaattctggacagacag

SEQ ID NO: 3571706 - DNA, 22 bp, Homo sapiens
ggaccaattctggacagacaga

SEQ ID NO: 3571707 - DNA, 17 bp, Homo sapiens
ggaccaccgttcagtca

SEQ ID NO: 3571708 - DNA, 16 bp, Homo sapiens
ggaccagctcaggaca

SEQ ID NO: 3571709 - DNA, 19 bp, Homo sapiens
ggaccaggtttgcaggagc

SEQ ID NO: 3571710 - DNA, 14 bp, Homo sapiens
ggacccaaaccccc

SEQ ID NO: 3571711 - DNA, 16 bp, Homo sapiens
ggacccaaaccccctg

SEQ ID NO: 3571712 - DNA, 20 bp, Homo sapiens
ggacccaaaccccctgcagc

SEQ ID NO: 3571713 - DNA, 22 bp, Homo sapiens
ggacccatccctgcctggaggc

SEQ ID NO: 3571714 - DNA, 22 bp, Homo sapiens
ggaccccagagaaaacccggag

SEQ ID NO: 3571715 - DNA, 18 bp, Homo sapiens
ggaccccgagaaccctga

SEQ ID NO: 3571716 - DNA, 22 bp, Homo sapiens
ggaccccgagaaccctgagcag

SEQ ID NO: 3571717 - DNA, 21 bp, Homo sapiens
ggaccctgtcctgcagtccca

SEQ ID NO: 3571718 - DNA, 20 bp, Homo sapiens
ggaccggtgctgcaggagtg

SEQ ID NO: 3571719 - DNA, 14 bp, Homo sapiens
ggaccgtccagggg

SEQ ID NO: 3571720 - DNA, 13 bp, Homo sapiens
ggacctcgtgcca

SEQ ID NO: 3571721 - DNA, 12 bp, Homo sapiens
ggacctctccca

SEQ ID NO: 3571722 - DNA, 13 bp, Homo sapiens
ggacctgagagca

SEQ ID NO: 3571723 - DNA, 21 bp, Homo sapiens
ggacctttaacttttttttct

SEQ ID NO: 3571724 - DNA, 23 bp, Homo sapiens
ggacgatcaggaggaagtgagca

SEQ ID NO: 3571725 - DNA, 20 bp, Homo sapiens
ggacgggatgacctccagaa

SEQ ID NO: 3571726 - DNA, 13 bp, Homo sapiens
ggacgggccacac

SEQ ID NO: 3571727 - DNA, 16 bp, Homo sapiens
ggactaaatgatctct

SEQ ID NO: 3571728 - DNA, 18 bp, Homo sapiens
ggactagaagattagaaa

SEQ ID NO: 3571729 - DNA, 18 bp, Homo sapiens
ggactagagggacctctc

SEQ ID NO: 3571730 - DNA, 20 bp, Homo sapiens
ggactatatttgggcctgct

SEQ ID NO: 3571731 - DNA, 15 bp, Homo sapiens
ggactcccagaacct

SEQ ID NO: 3571732 - DNA, 14 bp, Homo sapiens
ggactcggagggtg

SEQ ID NO: 3571733 - DNA, 13 bp, Homo sapiens
ggactctaaagtc

SEQ ID NO: 3571734 - DNA, 16 bp, Homo sapiens
ggactctctccaggag

SEQ ID NO: 3571735 - DNA, 17 bp, Homo sapiens
ggactctctccaggagg

SEQ ID NO: 3571736 - DNA, 18 bp, Homo sapiens
ggactgaaaacctctcct

SEQ ID NO: 3571737 - DNA, 18 bp, Homo sapiens
ggactgaaccagggtatt

SEQ ID NO: 3571738 - DNA, 16 bp, Homo sapiens
ggactgccaggctgtt

SEQ ID NO: 3571739 - DNA, 15 bp, Homo sapiens
ggactgcccccagaa

SEQ ID NO: 3571740 - DNA, 23 bp, Homo sapiens
ggactgcccccagaaagcctcct

SEQ ID NO: 3571741 - DNA, 19 bp, Homo sapiens
ggactggttctgaggccag

SEQ ID NO: 3571742 - DNA, 15 bp, Homo sapiens
ggactgtcatagaaa

SEQ ID NO: 3571743 - DNA, 13 bp, Homo sapiens
ggactgtgctggt

SEQ ID NO: 3571744 - DNA, 13 bp, Homo sapiens
ggactgtttcaaa

SEQ ID NO: 3571745 - DNA, 15 bp, Homo sapiens
ggacttaaactgctg

SEQ ID NO: 3571746 - DNA, 11 bp, Homo sapiens
ggacttcctgt

SEQ ID NO: 3571747 - DNA, 21 bp, Homo sapiens
ggacttcctgtccagctccaa

SEQ ID NO: 3571748 - DNA, 13 bp, Homo sapiens
ggacttgtttccc

SEQ ID NO: 3571749 - DNA, 17 bp, Homo sapiens
ggactttatttatttct

SEQ ID NO: 3571750 - DNA, 18 bp, Homo sapiens
ggactttatttatttcta

SEQ ID NO: 3571751 - DNA, 18 bp, Homo sapiens
ggagaaaaaaaaagcaaa

SEQ ID NO: 3571752 - DNA, 19 bp, Homo sapiens
ggagaaaaagaagaaaaga

SEQ ID NO: 3571753 - DNA, 21 bp, Homo sapiens
ggagaaacccacgacctgtcc

SEQ ID NO: 3571754 - DNA, 13 bp, Homo sapiens
ggagaaacccaga

SEQ ID NO: 3571755 - DNA, 12 bp, Homo sapiens
ggagaaagaagt

SEQ ID NO: 3571756 - DNA, 21 bp, Homo sapiens
ggagaaagaagtggagacagt

SEQ ID NO: 3571757 - DNA, 13 bp, Homo sapiens
ggagaaagagctg

SEQ ID NO: 3571758 - DNA, 19 bp, Homo sapiens
ggagaaagagctgcctgga

SEQ ID NO: 3571759 - DNA, 14 bp, Homo sapiens
ggagaaagatgcag

SEQ ID NO: 3571760 - DNA, 24 bp, Homo sapiens
ggagaaagcttggttctgtgaaca

SEQ ID NO: 3571761 - DNA, 22 bp, Homo sapiens
ggagaacagtggttgcctgggg

SEQ ID NO: 3571762 - DNA, 15 bp, Homo sapiens
ggagaagcaatgggt

SEQ ID NO: 3571763 - DNA, 19 bp, Homo sapiens
ggagaagctcctctcccca

SEQ ID NO: 3571764 - DNA, 19 bp, Homo sapiens
ggagaaggcatatggagaa

SEQ ID NO: 3571765 - DNA, 19 bp, Homo sapiens
ggagaagtcttctatttat

SEQ ID NO: 3571766 - DNA, 17 bp, Homo sapiens
ggagaatggcatggcag

SEQ ID NO: 3571767 - DNA, 15 bp, Homo sapiens
ggagacaaaagagca

SEQ ID NO: 3571768 - DNA, 21 bp, Homo sapiens
ggagacaccaagctcaccctt

SEQ ID NO: 3571769 - DNA, 16 bp, Homo sapiens
ggagacaccctctggg

SEQ ID NO: 3571770 - DNA, 19 bp, Homo sapiens
ggagacaccctctgggggt

SEQ ID NO: 3571771 - DNA, 23 bp, Homo sapiens
ggagacagatcactcctggaggc

SEQ ID NO: 3571772 - DNA, 17 bp, Homo sapiens
ggagacaggagcctagc

SEQ ID NO: 3571773 - DNA, 14 bp, Homo sapiens
ggagacatgtgaca

SEQ ID NO: 3571774 - DNA, 15 bp, Homo sapiens
ggagacatgtgacat

SEQ ID NO: 3571775 - DNA, 20 bp, Homo sapiens
ggagacccccaggcagaggg

SEQ ID NO: 3571776 - DNA, 12 bp, Homo sapiens
ggagagagcagg

SEQ ID NO: 3571777 - DNA, 12 bp, Homo sapiens
ggagagagccag

SEQ ID NO: 3571778 - DNA, 14 bp, Homo sapiens
ggagagagccagga

SEQ ID NO: 3571779 - DNA, 15 bp, Homo sapiens
ggagagagccaggat

SEQ ID NO: 3571780 - DNA, 22 bp, Homo sapiens
ggagagatccctgcagaaccca

SEQ ID NO: 3571781 - DNA, 13 bp, Homo sapiens
ggagagcagcagc

SEQ ID NO: 3571782 - DNA, 15 bp, Homo sapiens
ggagagcggctggag

SEQ ID NO: 3571783 - DNA, 22 bp, Homo sapiens
ggagaggccctctggagtggcc

SEQ ID NO: 3571784 - DNA, 23 bp, Homo sapiens
ggagaggtgattctcagggctgg

SEQ ID NO: 3571785 - DNA, 19 bp, Homo sapiens
ggagagttctttgctgccc

SEQ ID NO: 3571786 - DNA, 18 bp, Homo sapiens
ggagatactggtggaagt

SEQ ID NO: 3571787 - DNA, 14 bp, Homo sapiens
ggagatgaccaggg

SEQ ID NO: 3571788 - DNA, 16 bp, Homo sapiens
ggagatgaccagggat

SEQ ID NO: 3571789 - DNA, 15 bp, Homo sapiens
ggagatgctgtgccc

SEQ ID NO: 3571790 - DNA, 23 bp, Homo sapiens
ggagatgctgtgcccctggcctt

SEQ ID NO: 3571791 - DNA, 22 bp, Homo sapiens
ggagatggggaataatttcctt

SEQ ID NO: 3571792 - DNA, 16 bp, Homo sapiens
ggagcaaactctgctg

SEQ ID NO: 3571793 - DNA, 16 bp, Homo sapiens
ggagcaagcaggagtg

SEQ ID NO: 3571794 - DNA, 16 bp, Homo sapiens
ggagcacccagagcac

SEQ ID NO: 3571795 - DNA, 14 bp, Homo sapiens
ggagcagaggaggg

SEQ ID NO: 3571796 - DNA, 19 bp, Homo sapiens
ggagcagcaggagggggga

SEQ ID NO: 3571797 - DNA, 12 bp, Homo sapiens
ggagcaggagcc

SEQ ID NO: 3571798 - DNA, 17 bp, Homo sapiens
ggagcaggcttgtggca

SEQ ID NO: 3571799 - DNA, 17 bp, Homo sapiens
ggagcaggttccccaag

SEQ ID NO: 3571800 - DNA, 23 bp, Homo sapiens
ggagcaggttccccaagggccct

SEQ ID NO: 3571801 - DNA, 23 bp, Homo sapiens
ggagcatttaatggcagctagtg

SEQ ID NO: 3571802 - DNA, 22 bp, Homo sapiens
ggagccaaatgaccgagccctg

SEQ ID NO: 3571803 - DNA, 16 bp, Homo sapiens
ggagccagcctgcttc

SEQ ID NO: 3571804 - DNA, 19 bp, Homo sapiens
ggagccagcctgcttccca

SEQ ID NO: 3571805 - DNA, 21 bp, Homo sapiens
ggagccaggactcccagaacc

SEQ ID NO: 3571806 - DNA, 14 bp, Homo sapiens
ggagcccactgtcc

SEQ ID NO: 3571807 - DNA, 17 bp, Homo sapiens
ggagcccagcctgggag

SEQ ID NO: 3571808 - DNA, 11 bp, Homo sapiens
ggagccccctc

SEQ ID NO: 3571809 - DNA, 16 bp, Homo sapiens
ggagccccgccaggtg

SEQ ID NO: 3571810 - DNA, 12 bp, Homo sapiens
ggagccctagcc

SEQ ID NO: 3571811 - DNA, 17 bp, Homo sapiens
ggagccgaagcccaggg

SEQ ID NO: 3571812 - DNA, 21 bp, Homo sapiens
ggagccgggcaaactggccgc

SEQ ID NO: 3571813 - DNA, 17 bp, Homo sapiens
ggagcctagcggagccc

SEQ ID NO: 3571814 - DNA, 21 bp, Homo sapiens
ggagcctagcggagcccagcc

SEQ ID NO: 3571815 - DNA, 15 bp, Homo sapiens
ggagcctagctcctg

SEQ ID NO: 3571816 - DNA, 17 bp, Homo sapiens
ggagcctagctcctgcc

SEQ ID NO: 3571817 - DNA, 18 bp, Homo sapiens
ggagcctagctcctgcca

SEQ ID NO: 3571818 - DNA, 17 bp, Homo sapiens
ggagcctggccaggcag

SEQ ID NO: 3571819 - DNA, 17 bp, Homo sapiens
ggagcctggggtgtcct

SEQ ID NO: 3571820 - DNA, 19 bp, Homo sapiens
ggagcctgtgcgtcccagc

SEQ ID NO: 3571821 - DNA, 19 bp, Homo sapiens
ggagccttcccgggcgggc

SEQ ID NO: 3571822 - DNA, 17 bp, Homo sapiens
ggagcgccctgcagggc

SEQ ID NO: 3571823 - DNA, 18 bp, Homo sapiens
ggagcgccctgcagggcc

SEQ ID NO: 3571824 - DNA, 14 bp, Homo sapiens
ggagctctggggac

SEQ ID NO: 3571825 - DNA, 22 bp, Homo sapiens
ggagctgagctggaaggggcca

SEQ ID NO: 3571826 - DNA, 18 bp, Homo sapiens
ggagctgctatagcctgg

SEQ ID NO: 3571827 - DNA, 19 bp, Homo sapiens
ggagctgctatagcctggg

SEQ ID NO: 3571828 - DNA, 21 bp, Homo sapiens
ggagctgctgggtggcagggg

SEQ ID NO: 3571829 - DNA, 23 bp, Homo sapiens
ggagctggttagaaatgcagaat

SEQ ID NO: 3571830 - DNA, 15 bp, Homo sapiens
ggagcttcagccagg

SEQ ID NO: 3571831 - DNA, 13 bp, Homo sapiens
ggagcttccgctt

SEQ ID NO: 3571832 - DNA, 22 bp, Homo sapiens
ggagcttctcccagtgtgagac

SEQ ID NO: 3571833 - DNA, 15 bp, Homo sapiens
ggagcttgggaatgg

SEQ ID NO: 3571834 - DNA, 21 bp, Homo sapiens
ggaggaaaaccaagccgtggc

SEQ ID NO: 3571835 - DNA, 21 bp, Homo sapiens
ggaggacctggcgtgctcaga

SEQ ID NO: 3571836 - DNA, 15 bp, Homo sapiens
ggaggactgtgacag

SEQ ID NO: 3571837 - DNA, 19 bp, Homo sapiens
ggaggaggcctgtcccaat

SEQ ID NO: 3571838 - DNA, 12 bp, Homo sapiens
ggaggcacactt

SEQ ID NO: 3571839 - DNA, 14 bp, Homo sapiens
ggaggccaaccagc

SEQ ID NO: 3571840 - DNA, 21 bp, Homo sapiens
ggaggccaaccagcccgacag

SEQ ID NO: 3571841 - DNA, 22 bp, Homo sapiens
ggaggccaccccaaaccccagc

SEQ ID NO: 3571842 - DNA, 19 bp, Homo sapiens
ggaggcccagttcaccctg

SEQ ID NO: 3571843 - DNA, 18 bp, Homo sapiens
ggaggccccctcctcacg

SEQ ID NO: 3571844 - DNA, 14 bp, Homo sapiens
ggaggcggcctcca

SEQ ID NO: 3571845 - DNA, 16 bp, Homo sapiens
ggaggcggcctccatg

SEQ ID NO: 3571846 - DNA, 20 bp, Homo sapiens
ggaggctacctcacctgggc

SEQ ID NO: 3571847 - DNA, 15 bp, Homo sapiens
ggaggctgaggcagg

SEQ ID NO: 3571848 - DNA, 22 bp, Homo sapiens
ggagggaagacctgaaagagag

SEQ ID NO: 3571849 - DNA, 16 bp, Homo sapiens
ggagggaagggagcca

SEQ ID NO: 3571850 - DNA, 16 bp, Homo sapiens
ggagggaggcggcctc

SEQ ID NO: 3571851 - DNA, 11 bp, Homo sapiens
ggagggcagga

SEQ ID NO: 3571852 - DNA, 14 bp, Homo sapiens
ggagggccagcgct

SEQ ID NO: 3571853 - DNA, 20 bp, Homo sapiens
ggaggggatgataaaggaaa

SEQ ID NO: 3571854 - DNA, 13 bp, Homo sapiens
ggaggggcctggc

SEQ ID NO: 3571855 - DNA, 18 bp, Homo sapiens
ggaggggcctggcagccg

SEQ ID NO: 3571856 - DNA, 22 bp, Homo sapiens
ggagggggtttgctggggaact

SEQ ID NO: 3571857 - DNA, 21 bp, Homo sapiens
ggaggtccctggtcggagagg

SEQ ID NO: 3571858 - DNA, 14 bp, Homo sapiens
ggaggtctggctga

SEQ ID NO: 3571859 - DNA, 13 bp, Homo sapiens
ggagtagccaagc

SEQ ID NO: 3571860 - DNA, 14 bp, Homo sapiens
ggagtcagtgccag

SEQ ID NO: 3571861 - DNA, 18 bp, Homo sapiens
ggagtcagtgccaggtcc

SEQ ID NO: 3571862 - DNA, 22 bp, Homo sapiens
ggagtctctgccagttacttgg

SEQ ID NO: 3571863 - DNA, 21 bp, Homo sapiens
ggagtgagtcacctgctccag

SEQ ID NO: 3571864 - DNA, 23 bp, Homo sapiens
ggagtgctcttcccactccagct

SEQ ID NO: 3571865 - DNA, 20 bp, Homo sapiens
ggagtggaatagtatcctcc

SEQ ID NO: 3571866 - DNA, 16 bp, Homo sapiens
ggagtgggaagggagc

SEQ ID NO: 3571867 - DNA, 20 bp, Homo sapiens
ggagtggttaggcagcaagc

SEQ ID NO: 3571868 - DNA, 14 bp, Homo sapiens
ggagtgtcctgccc

SEQ ID NO: 3571869 - DNA, 23 bp, Homo sapiens
ggagttaagacctggcagctctg

SEQ ID NO: 3571870 - DNA, 20 bp, Homo sapiens
ggagttccttatccctctct

SEQ ID NO: 3571871 - DNA, 24 bp, Homo sapiens
ggagttccttatccctctcttccc

SEQ ID NO: 3571872 - DNA, 17 bp, Homo sapiens
ggagttgatctggaacc

SEQ ID NO: 3571873 - DNA, 21 bp, Homo sapiens
ggagttgatctggaacccaga

SEQ ID NO: 3571874 - DNA, 17 bp, Homo sapiens
ggataaaataatgctgc

SEQ ID NO: 3571875 - DNA, 19 bp, Homo sapiens
ggataaaataatgctgcaa

SEQ ID NO: 3571876 - DNA, 15 bp, Homo sapiens
ggatacagaggagat

SEQ ID NO: 3571877 - DNA, 14 bp, Homo sapiens
ggatagatgctggc

SEQ ID NO: 3571878 - DNA, 18 bp, Homo sapiens
ggatagatgctggcccag

SEQ ID NO: 3571879 - DNA, 19 bp, Homo sapiens
ggatagtccttcctggcat

SEQ ID NO: 3571880 - DNA, 17 bp, Homo sapiens
gccttaaggccctcatt

SEQ ID NO: 3571881 - DNA, 15 bp, Homo sapiens
gccttacaaagggaa

SEQ ID NO: 3571882 - DNA, 16 bp, Homo sapiens
gccttacaaagggaaa

SEQ ID NO: 3571883 - DNA, 22 bp, Homo sapiens
gccttacaaagggaaagcctct

SEQ ID NO: 3571884 - DNA, 23 bp, Homo sapiens
gccttacaaagggaaagcctctg

SEQ ID NO: 3571885 - DNA, 16 bp, Homo sapiens
gccttagaacctttct

SEQ ID NO: 3571886 - DNA, 16 bp, Homo sapiens
gccttataaaccaatc

SEQ ID NO: 3571887 - DNA, 18 bp, Homo sapiens
gccttataaaccaatctt

SEQ ID NO: 3571888 - DNA, 21 bp, Homo sapiens
gccttcaacaacgtgagagaa

SEQ ID NO: 3571889 - DNA, 13 bp, Homo sapiens
gccttcagctcta

SEQ ID NO: 3571890 - DNA, 14 bp, Homo sapiens
gccttcatcagaac

SEQ ID NO: 3571891 - DNA, 15 bp, Homo sapiens
gccttcatcagaact

SEQ ID NO: 3571892 - DNA, 18 bp, Homo sapiens
gccttccatttcccctct

SEQ ID NO: 3571893 - DNA, 17 bp, Homo sapiens
gccttcccatggccatt

SEQ ID NO: 3571894 - DNA, 13 bp, Homo sapiens
gccttccccagct

SEQ ID NO: 3571895 - DNA, 14 bp, Homo sapiens
gccttccccagctc

SEQ ID NO: 3571896 - DNA, 13 bp, Homo sapiens
gccttcccctccc

SEQ ID NO: 3571897 - DNA, 16 bp, Homo sapiens
gccttcccgggcgggc

SEQ ID NO: 3571898 - DNA, 22 bp, Homo sapiens
gccttcgatacaccgggcctgg

SEQ ID NO: 3571899 - DNA, 23 bp, Homo sapiens
gccttcgatacaccgggcctgga

SEQ ID NO: 3571900 - DNA, 19 bp, Homo sapiens
gccttcggtacccaccaca

SEQ ID NO: 3571901 - DNA, 20 bp, Homo sapiens
gccttctgctgaaagactcg

SEQ ID NO: 3571902 - DNA, 21 bp, Homo sapiens
gccttctttccatcaactccc

SEQ ID NO: 3571903 - DNA, 14 bp, Homo sapiens
gccttgcaagatgg

SEQ ID NO: 3571904 - DNA, 17 bp, Homo sapiens
gccttgcagcggctcct

SEQ ID NO: 3571905 - DNA, 20 bp, Homo sapiens
gccttgcagcggctcctgca

SEQ ID NO: 3571906 - DNA, 18 bp, Homo sapiens
gccttgccagttttccga

SEQ ID NO: 3571907 - DNA, 13 bp, Homo sapiens
gccttggagaggg

SEQ ID NO: 3571908 - DNA, 16 bp, Homo sapiens
gccttgtacagtctgc

SEQ ID NO: 3571909 - DNA, 21 bp, Homo sapiens
gccttgtacagtctgctcctc

SEQ ID NO: 3571910 - DNA, 23 bp, Homo sapiens
gccttgtcagtgtgtcagttttt

SEQ ID NO: 3571911 - DNA, 23 bp, Homo sapiens
gcctttaaaacgcgtctgcctgg

SEQ ID NO: 3571912 - DNA, 24 bp, Homo sapiens
gcctttaaaacgcgtctgcctggg

SEQ ID NO: 3571913 - DNA, 14 bp, Homo sapiens
gcctttaagaacct

SEQ ID NO: 3571914 - DNA, 20 bp, Homo sapiens
gcctttaagaaccttaatga

SEQ ID NO: 3571915 - DNA, 16 bp, Homo sapiens
gcctttaagccaaaga

SEQ ID NO: 3571916 - DNA, 20 bp, Homo sapiens
gcctttagcaaaactggaca

SEQ ID NO: 3571917 - DNA, 13 bp, Homo sapiens
gcctttatttgct

SEQ ID NO: 3571918 - DNA, 15 bp, Homo sapiens
gcctttcctctgcac

SEQ ID NO: 3571919 - DNA, 12 bp, Homo sapiens
gcctttctttgc

SEQ ID NO: 3571920 - DNA, 16 bp, Homo sapiens
gcctttctttgcctct

SEQ ID NO: 3571921 - DNA, 17 bp, Homo sapiens
gcctttgggtgctgttt

SEQ ID NO: 3571922 - DNA, 15 bp, Homo sapiens
gccttttatgtaaat

SEQ ID NO: 3571923 - DNA, 17 bp, Homo sapiens
gccttttctttaacttt

SEQ ID NO: 3571924 - DNA, 15 bp, Homo sapiens
gccttttgctctctg

SEQ ID NO: 3571925 - DNA, 16 bp, Homo sapiens
gccttttgctctctgt

SEQ ID NO: 3571926 - DNA, 23 bp, Homo sapiens
gcctttttacctggcctagaaag

SEQ ID NO: 3571927 - DNA, 14 bp, Homo sapiens
gcctttttcattta

SEQ ID NO: 3571928 - DNA, 20 bp, Homo sapiens
gcgaacagccttagagctct

SEQ ID NO: 3571929 - DNA, 21 bp, Homo sapiens
gcgaacagccttagagctctt

SEQ ID NO: 3571930 - DNA, 17 bp, Homo sapiens
gcgaactctcagaaata

SEQ ID NO: 3571931 - DNA, 22 bp, Homo sapiens
gcgaccaataaacagctcccag

SEQ ID NO: 3571932 - DNA, 20 bp, Homo sapiens
gcgcaactggagccagcaac

SEQ ID NO: 3571933 - DNA, 17 bp, Homo sapiens
gcgcaggcagcgcaggg

SEQ ID NO: 3571934 - DNA, 18 bp, Homo sapiens
gcgcaggcagcgcagggc

SEQ ID NO: 3571935 - DNA, 20 bp, Homo sapiens
gcgcaggcagcgcagggctg

SEQ ID NO: 3571936 - DNA, 13 bp, Homo sapiens
gcgccaccatgcc

SEQ ID NO: 3571937 - DNA, 15 bp, Homo sapiens
gcgccaggccctcag

SEQ ID NO: 3571938 - DNA, 18 bp, Homo sapiens
gcgcccctgcctgtgccc

SEQ ID NO: 3571939 - DNA, 17 bp, Homo sapiens
gcgccctgcagggccgg

SEQ ID NO: 3571940 - DNA, 22 bp, Homo sapiens
gcgcccttaactgcatccagcc

SEQ ID NO: 3571941 - DNA, 16 bp, Homo sapiens
gcgctcgcccagcagg

SEQ ID NO: 3571942 - DNA, 17 bp, Homo sapiens
gcgctggaatccagaag

SEQ ID NO: 3571943 - DNA, 22 bp, Homo sapiens
gcgctggaatccagaaggaagc

SEQ ID NO: 3571944 - DNA, 13 bp, Homo sapiens
gcgctgtgtacaa

SEQ ID NO: 3571945 - DNA, 21 bp, Homo sapiens
gcggaattcaccagtgttcct

SEQ ID NO: 3571946 - DNA, 14 bp, Homo sapiens
gcggacgcagctgg

SEQ ID NO: 3571947 - DNA, 13 bp, Homo sapiens
gcggagcccagcc

SEQ ID NO: 3571948 - DNA, 21 bp, Homo sapiens
gcggagcccagcctgggagcc

SEQ ID NO: 3571949 - DNA, 23 bp, Homo sapiens
gcggagccttcccgggcgggcgt

SEQ ID NO: 3571950 - DNA, 16 bp, Homo sapiens
gcggaggtctctggga

SEQ ID NO: 3571951 - DNA, 20 bp, Homo sapiens
gcggaggtctctgggagccc

SEQ ID NO: 3571952 - DNA, 23 bp, Homo sapiens
gcggaggtctctgggagcccaga

SEQ ID NO: 3571953 - DNA, 18 bp, Homo sapiens
gcggcccgcgcagctgcc

SEQ ID NO: 3571954 - DNA, 16 bp, Homo sapiens
gcggcggtcccagctc

SEQ ID NO: 3571955 - DNA, 20 bp, Homo sapiens
gcggctgcacaacagccctg

SEQ ID NO: 3571956 - DNA, 17 bp, Homo sapiens
gcgggatcctccacaga

SEQ ID NO: 3571957 - DNA, 21 bp, Homo sapiens
gcgggatcctccacagagagg

SEQ ID NO: 3571958 - DNA, 19 bp, Homo sapiens
gcgggcacacctcctccca

SEQ ID NO: 3571959 - DNA, 10 bp, Homo sapiens
gcgggcagcc

SEQ ID NO: 3571960 - DNA, 21 bp, Homo sapiens
gcgggcagccccgttttgggg

SEQ ID NO: 3571961 - DNA, 16 bp, Homo sapiens
gcgggcgaggccgccc

SEQ ID NO: 3571962 - DNA, 21 bp, Homo sapiens
gcggggcccaggcagcctccg

SEQ ID NO: 3571963 - DNA, 14 bp, Homo sapiens
gcggtcccagctcc

SEQ ID NO: 3571964 - DNA, 18 bp, Homo sapiens
gcggtcccagctccctgg

SEQ ID NO: 3571965 - DNA, 17 bp, Homo sapiens
gcggtggctgccccggc

SEQ ID NO: 3571966 - DNA, 18 bp, Homo sapiens
gcgtactacccagctctg

SEQ ID NO: 3571967 - DNA, 19 bp, Homo sapiens
gcgtactacccagctctgt

SEQ ID NO: 3571968 - DNA, 17 bp, Homo sapiens
gcgtccagctcagccct

SEQ ID NO: 3571969 - DNA, 12 bp, Homo sapiens
gcgtcccagctg

SEQ ID NO: 3571970 - DNA, 23 bp, Homo sapiens
gcgtcccagctgaaggcagtggc

SEQ ID NO: 3571971 - DNA, 17 bp, Homo sapiens
gcgtcgccctcccaggc

SEQ ID NO: 3571972 - DNA, 12 bp, Homo sapiens
gcgtctgcctgg

SEQ ID NO: 3571973 - DNA, 17 bp, Homo sapiens
gcgtctggactgttctg

SEQ ID NO: 3571974 - DNA, 19 bp, Homo sapiens
gcgtggcctccccatgggc

SEQ ID NO: 3571975 - DNA, 14 bp, Homo sapiens
gcgttgggagccta

SEQ ID NO: 3571976 - DNA, 15 bp, Homo sapiens
gcgttgggagcctag

SEQ ID NO: 3571977 - DNA, 17 bp, Homo sapiens
gcgttgggagcctagct

SEQ ID NO: 3571978 - DNA, 19 bp, Homo sapiens
gcgttgttgcatgtttgaa

SEQ ID NO: 3571979 - DNA, 19 bp, Homo sapiens
gcgttttttaaatgtatac

SEQ ID NO: 3571980 - DNA, 17 bp, Homo sapiens
gctaaagggaccatctg

SEQ ID NO: 3571981 - DNA, 22 bp, Homo sapiens
gctaaagggaccatctgctgca

SEQ ID NO: 3571982 - DNA, 16 bp, Homo sapiens
gctaacaccagacaga

SEQ ID NO: 3571983 - DNA, 13 bp, Homo sapiens
gctaactggttaa

SEQ ID NO: 3571984 - DNA, 23 bp, Homo sapiens
gctaagaacctggaacttgggga

SEQ ID NO: 3571985 - DNA, 21 bp, Homo sapiens
gctaagtacacaataagcaaa

SEQ ID NO: 3571986 - DNA, 19 bp, Homo sapiens
gctaagtcattggcaaagt

SEQ ID NO: 3571987 - DNA, 23 bp, Homo sapiens
gctaataaactttgtgctgatct

SEQ ID NO: 3571988 - DNA, 14 bp, Homo sapiens
gctaatcaaaactt

SEQ ID NO: 3571989 - DNA, 22 bp, Homo sapiens
gctaatcagcattctcactcct

SEQ ID NO: 3571990 - DNA, 12 bp, Homo sapiens
gctaattgtacc

SEQ ID NO: 3571991 - DNA, 22 bp, Homo sapiens
gctaatttagagataggaaact

SEQ ID NO: 3571992 - DNA, 20 bp, Homo sapiens
gctaatttatcctgaaattt

SEQ ID NO: 3571993 - DNA, 20 bp, Homo sapiens
gctacaaccctaccctggca

SEQ ID NO: 3571994 - DNA, 13 bp, Homo sapiens
gctaccagtattt

SEQ ID NO: 3571995 - DNA, 14 bp, Homo sapiens
gctaccagtattta

SEQ ID NO: 3571996 - DNA, 18 bp, Homo sapiens
gctaccagtatttagaag

SEQ ID NO: 3571997 - DNA, 21 bp, Homo sapiens
gctaccagtatttagaagcca

SEQ ID NO: 3571998 - DNA, 20 bp, Homo sapiens
gctacctgctcagccctgca

SEQ ID NO: 3571999 - DNA, 18 bp, Homo sapiens
gctactactgcagtcttt

SEQ ID NO: 3572000 - DNA, 20 bp, Homo sapiens
gctactatgatttaatttga

SEQ ID NO: 3572001 - DNA, 22 bp, Homo sapiens
gctactcaggaggctgaggcag

SEQ ID NO: 3572002 - DNA, 20 bp, Homo sapiens
gctactcagtggggctggca

SEQ ID NO: 3572003 - DNA, 23 bp, Homo sapiens
gctactcagtggggctggcatca

SEQ ID NO: 3572004 - DNA, 20 bp, Homo sapiens
gctactggttacctggagaa

SEQ ID NO: 3572005 - DNA, 18 bp, Homo sapiens
gctactgtaatgctgcct

SEQ ID NO: 3572006 - DNA, 21 bp, Homo sapiens
gctactgtaatgctgcctcag

SEQ ID NO: 3572007 - DNA, 17 bp, Homo sapiens
gctagaagcctactggt

SEQ ID NO: 3572008 - DNA, 20 bp, Homo sapiens
gctagataatagggttttca

SEQ ID NO: 3572009 - DNA, 15 bp, Homo sapiens
gctagatccagccca

SEQ ID NO: 3572010 - DNA, 17 bp, Homo sapiens
gctaggaaccctggagg

SEQ ID NO: 3572011 - DNA, 12 bp, Homo sapiens
gctaggaatgaa

SEQ ID NO: 3572012 - DNA, 13 bp, Homo sapiens
gctaggaatgaaa

SEQ ID NO: 3572013 - DNA, 20 bp, Homo sapiens
gctaggagcaggcttgtggc

SEQ ID NO: 3572014 - DNA, 15 bp, Homo sapiens
gctaggccccagagg

SEQ ID NO: 3572015 - DNA, 17 bp, Homo sapiens
gctaggccccagaggcc

SEQ ID NO: 3572016 - DNA, 21 bp, Homo sapiens
gctaggcctccgttgtctggt

SEQ ID NO: 3572017 - DNA, 19 bp, Homo sapiens
gctagtcaagctcctcctc

SEQ ID NO: 3572018 - DNA, 18 bp, Homo sapiens
gctataaattcctctttg

SEQ ID NO: 3572019 - DNA, 18 bp, Homo sapiens
gctataggtgctacaaaa

SEQ ID NO: 3572020 - DNA, 19 bp, Homo sapiens
gctataggtgctacaaaaa

SEQ ID NO: 3572021 - DNA, 21 bp, Homo sapiens
gctataggtgctacaaaaaca

SEQ ID NO: 3572022 - DNA, 19 bp, Homo sapiens
gctatcacctagcagcctc

SEQ ID NO: 3572023 - DNA, 22 bp, Homo sapiens
gctatcagcaatgccccaaact

SEQ ID NO: 3572024 - DNA, 16 bp, Homo sapiens
gctatcaggagaaagc

SEQ ID NO: 3572025 - DNA, 13 bp, Homo sapiens
gctatctaatttt

SEQ ID NO: 3572026 - DNA, 20 bp, Homo sapiens
gctatctctgtgtgcacaaa

SEQ ID NO: 3572027 - DNA, 19 bp, Homo sapiens
gctatgaaacaatcttcca

SEQ ID NO: 3572028 - DNA, 17 bp, Homo sapiens
gctatgagctggggatg

SEQ ID NO: 3572029 - DNA, 21 bp, Homo sapiens
gctattattttcactgtagaa

SEQ ID NO: 3572030 - DNA, 12 bp, Homo sapiens
gctattgctgct

SEQ ID NO: 3572031 - DNA, 16 bp, Homo sapiens
gctatttacactatta

SEQ ID NO: 3572032 - DNA, 17 bp, Homo sapiens
gctattttctaaagact

SEQ ID NO: 3572033 - DNA, 22 bp, Homo sapiens
gctattttctaaagacttgtat

SEQ ID NO: 3572034 - DNA, 20 bp, Homo sapiens
gctatttttatacactgtaa

SEQ ID NO: 3572035 - DNA, 24 bp, Homo sapiens
gctattttttcccttctcttctaa

SEQ ID NO: 3572036 - DNA, 13 bp, Homo sapiens
gctcaaaattgct

SEQ ID NO: 3572037 - DNA, 14 bp, Homo sapiens
gctcaaaattgctt

SEQ ID NO: 3572038 - DNA, 17 bp, Homo sapiens
gctcaaaattgcttcta

SEQ ID NO: 3572039 - DNA, 16 bp, Homo sapiens
gctcaacccccctccc

SEQ ID NO: 3572040 - DNA, 19 bp, Homo sapiens
gctcaacccccctcccaga

SEQ ID NO: 3572041 - DNA, 13 bp, Homo sapiens
gctcaatgcccag

SEQ ID NO: 3572042 - DNA, 14 bp, Homo sapiens
gctcaatttcagca

SEQ ID NO: 3572043 - DNA, 16 bp, Homo sapiens
gctcacaaggcccagg

SEQ ID NO: 3572044 - DNA, 14 bp, Homo sapiens
gctcacacctgtaa

SEQ ID NO: 3572045 - DNA, 22 bp, Homo sapiens
gctcacagaacccttggagcca

SEQ ID NO: 3572046 - DNA, 17 bp, Homo sapiens
gctcaccccatcatccc

SEQ ID NO: 3572047 - DNA, 17 bp, Homo sapiens
gctcactgcaacctccg

SEQ ID NO: 3572048 - DNA, 16 bp, Homo sapiens
gctcagaccagctctt

SEQ ID NO: 3572049 - DNA, 22 bp, Homo sapiens
gctcagactgggcactggggcc

SEQ ID NO: 3572050 - DNA, 23 bp, Homo sapiens
gctcagagaggtagcactctcag

SEQ ID NO: 3572051 - DNA, 15 bp, Homo sapiens
gctcagccctccctg

SEQ ID NO: 3572052 - DNA, 12 bp, Homo sapiens
gctcagccctgg

SEQ ID NO: 3572053 - DNA, 16 bp, Homo sapiens
gctcagccctggcctg

SEQ ID NO: 3572054 - DNA, 18 bp, Homo sapiens
gctcagccctggcctggc

SEQ ID NO: 3572055 - DNA, 13 bp, Homo sapiens
gctcagctgagca

SEQ ID NO: 3572056 - DNA, 18 bp, Homo sapiens
gctcagctgagcatggag

SEQ ID NO: 3572057 - DNA, 16 bp, Homo sapiens
gctcagcttctcctgt

SEQ ID NO: 3572058 - DNA, 14 bp, Homo sapiens
gctcaggagaagcc

SEQ ID NO: 3572059 - DNA, 16 bp, Homo sapiens
gctcaggagaagccag

SEQ ID NO: 3572060 - DNA, 20 bp, Homo sapiens
gctcaggagaagccagtgtc

SEQ ID NO: 3572061 - DNA, 15 bp, Homo sapiens
gctcagggaaaagca

SEQ ID NO: 3572062 - DNA, 13 bp, Homo sapiens
gctcaggggcctg

SEQ ID NO: 3572063 - DNA, 16 bp, Homo sapiens
gctcaggggcctggag

SEQ ID NO: 3572064 - DNA, 16 bp, Homo sapiens
gctcagtaatttgagg

SEQ ID NO: 3572065 - DNA, 19 bp, Homo sapiens
gctcatgcctgtaaccctg

SEQ ID NO: 3572066 - DNA, 14 bp, Homo sapiens
gctcatgctgctcc

SEQ ID NO: 3572067 - DNA, 13 bp, Homo sapiens
gctcatgttttta

SEQ ID NO: 3572068 - DNA, 17 bp, Homo sapiens
gctcatgtttttaactt

SEQ ID NO: 3572069 - DNA, 18 bp, Homo sapiens
gctccaacctgcaaagat

SEQ ID NO: 3572070 - DNA, 20 bp, Homo sapiens
gctccaaggggaatcagaac

SEQ ID NO: 3572071 - DNA, 23 bp, Homo sapiens
gctccaatgactgagcagcatcc

SEQ ID NO: 3572072 - DNA, 13 bp, Homo sapiens
gctccacactcag

SEQ ID NO: 3572073 - DNA, 19 bp, Homo sapiens
gctccacactcagaaaatt

SEQ ID NO: 3572074 - DNA, 13 bp, Homo sapiens
gctccaccagcag

SEQ ID NO: 3572075 - DNA, 14 bp, Homo sapiens
gctccaccagcagc

SEQ ID NO: 3572076 - DNA, 15 bp, Homo sapiens
gctccaccagcagca

SEQ ID NO: 3572077 - DNA, 19 bp, Homo sapiens
gctccacgtctgcgccgcc

SEQ ID NO: 3572078 - DNA, 24 bp, Homo sapiens
gctccagaagatgccagcttctct

SEQ ID NO: 3572079 - DNA, 20 bp, Homo sapiens
gctccagacctgatcctgga

SEQ ID NO: 3572080 - DNA, 21 bp, Homo sapiens
gctccagacctgatcctggag

SEQ ID NO: 3572081 - DNA, 17 bp, Homo sapiens
gctccatacacacgctg

SEQ ID NO: 3572082 - DNA, 21 bp, Homo sapiens
gctccatccgtgcctcttttt

SEQ ID NO: 3572083 - DNA, 15 bp, Homo sapiens
gctcccacagcttcc

SEQ ID NO: 3572084 - DNA, 21 bp, Homo sapiens
gctcccaggttcccccagcaa

SEQ ID NO: 3572085 - DNA, 12 bp, Homo sapiens
gctccccaaggc

SEQ ID NO: 3572086 - DNA, 18 bp, Homo sapiens
gctcccctaaagccaggc

SEQ ID NO: 3572087 - DNA, 15 bp, Homo sapiens
gctcccctcggagaa

SEQ ID NO: 3572088 - DNA, 18 bp, Homo sapiens
gctcccctcggagaagag

SEQ ID NO: 3572089 - DNA, 21 bp, Homo sapiens
gctcccctcggagaagagctg

SEQ ID NO: 3572090 - DNA, 14 bp, Homo sapiens
gctccctcctcagg

SEQ ID NO: 3572091 - DNA, 18 bp, Homo sapiens
gctccctcttcctctcca

SEQ ID NO: 3572092 - DNA, 16 bp, Homo sapiens
gctccctgtggcactc

SEQ ID NO: 3572093 - DNA, 21 bp, Homo sapiens
gctccgatgcccgcccgggga

SEQ ID NO: 3572094 - DNA, 13 bp, Homo sapiens
gctccgcagggcg

SEQ ID NO: 3572095 - DNA, 16 bp, Homo sapiens
gctccgtagctctgct

SEQ ID NO: 3572096 - DNA, 21 bp, Homo sapiens
gctccgtagctctgctgctga

SEQ ID NO: 3572097 - DNA, 16 bp, Homo sapiens
gctccgtgtttctcta

SEQ ID NO: 3572098 - DNA, 21 bp, Homo sapiens
gctcctacctgtctgctgcca

SEQ ID NO: 3572099 - DNA, 15 bp, Homo sapiens
gctcctagagggagg

SEQ ID NO: 3572100 - DNA, 12 bp, Homo sapiens
gctcctctcagt

SEQ ID NO: 3572101 - DNA, 15 bp, Homo sapiens
gctcctctccccagc

SEQ ID NO: 3572102 - DNA, 16 bp, Homo sapiens
gctcctctccccagcc

SEQ ID NO: 3572103 - DNA, 20 bp, Homo sapiens
gctcctctccccagcccaga

SEQ ID NO: 3572104 - DNA, 22 bp, Homo sapiens
gctcctctccccagcccagaga

SEQ ID NO: 3572105 - DNA, 18 bp, Homo sapiens
gctcctcttagctcagct

SEQ ID NO: 3572106 - DNA, 17 bp, Homo sapiens
gctcctcttgttcctga

SEQ ID NO: 3572107 - DNA, 20 bp, Homo sapiens
gctcctgcaaaaggaggtga

SEQ ID NO: 3572108 - DNA, 20 bp, Homo sapiens
gctcctgcatctcatgagtg

SEQ ID NO: 3572109 - DNA, 20 bp, Homo sapiens
gctcctgcttttctgtcctg

SEQ ID NO: 3572110 - DNA, 22 bp, Homo sapiens
gctcctgcttttctgtcctggg

SEQ ID NO: 3572111 - DNA, 23 bp, Homo sapiens
gctcctgcttttctgtcctgggc

SEQ ID NO: 3572112 - DNA, 20 bp, Homo sapiens
gctcctgggcattagcaagg

SEQ ID NO: 3572113 - DNA, 22 bp, Homo sapiens
gctccttggcacccccatgctg

SEQ ID NO: 3572114 - DNA, 13 bp, Homo sapiens
gctcgcccagcag

SEQ ID NO: 3572115 - DNA, 13 bp, Homo sapiens
gctcggctactgg

SEQ ID NO: 3572116 - DNA, 20 bp, Homo sapiens
gctcggggtgtgtcatttct

SEQ ID NO: 3572117 - DNA, 21 bp, Homo sapiens
gctcggggtgtgtcatttcta

SEQ ID NO: 3572118 - DNA, 16 bp, Homo sapiens
gctcgtggactgtgct

SEQ ID NO: 3572119 - DNA, 21 bp, Homo sapiens
gctcgtggactgtgctggtgc

SEQ ID NO: 3572120 - DNA, 14 bp, Homo sapiens
gctctaaattggct

SEQ ID NO: 3572121 - DNA, 22 bp, Homo sapiens
gctctacagctaatcagcattc

SEQ ID NO: 3572122 - DNA, 21 bp, Homo sapiens
gctctactggtcttgtggaat

SEQ ID NO: 3572123 - DNA, 12 bp, Homo sapiens
gctctagtgcct

SEQ ID NO: 3572124 - DNA, 16 bp, Homo sapiens
tcaacagccaagctgg

SEQ ID NO: 3572125 - DNA, 20 bp, Homo sapiens
tcaacagccaagctggcaca

SEQ ID NO: 3572126 - DNA, 16 bp, Homo sapiens
tcaacatatactattt

SEQ ID NO: 3572127 - DNA, 17 bp, Homo sapiens
tcaacatttctcatgtt

SEQ ID NO: 3572128 - DNA, 20 bp, Homo sapiens
tcaacatttctcatgttgaa

SEQ ID NO: 3572129 - DNA, 17 bp, Homo sapiens
tcaaccaatgccaaaaa

SEQ ID NO: 3572130 - DNA, 15 bp, Homo sapiens
tcaaccattccccat

SEQ ID NO: 3572131 - DNA, 18 bp, Homo sapiens
tcaaccattccccatggg

SEQ ID NO: 3572132 - DNA, 13 bp, Homo sapiens
tcaacccccctcc

SEQ ID NO: 3572133 - DNA, 12 bp, Homo sapiens
tatccacccagc

SEQ ID NO: 3572134 - DNA, 15 bp, Homo sapiens
tatccactttgcaca

SEQ ID NO: 3572135 - DNA, 15 bp, Homo sapiens
tatccagagctgttt

SEQ ID NO: 3572136 - DNA, 20 bp, Homo sapiens
tatccattctacctgtcctc

SEQ ID NO: 3572137 - DNA, 15 bp, Homo sapiens
tatccctcacctgta

SEQ ID NO: 3572138 - DNA, 17 bp, Homo sapiens
tatccctctcttcccct

SEQ ID NO: 3572139 - DNA, 19 bp, Homo sapiens
tatccctgcggcctccaca

SEQ ID NO: 3572140 - DNA, 18 bp, Homo sapiens
tatcccttggacatttta

SEQ ID NO: 3572141 - DNA, 13 bp, Homo sapiens
tatcctccaggtt

SEQ ID NO: 3572142 - DNA, 15 bp, Homo sapiens
tatcctccaggtttt

SEQ ID NO: 3572143 - DNA, 18 bp, Homo sapiens
tatcctccaggtttttca

SEQ ID NO: 3572144 - DNA, 19 bp, Homo sapiens
tatcctccaggtttttcaa

SEQ ID NO: 3572145 - DNA, 21 bp, Homo sapiens
tatcctccaggtttttcaatt

SEQ ID NO: 3572146 - DNA, 14 bp, Homo sapiens
tatcctgaaatttc

SEQ ID NO: 3572147 - DNA, 22 bp, Homo sapiens
tatcctgcttctgatatgcagt

SEQ ID NO: 3572148 - DNA, 20 bp, Homo sapiens
tatcctggagcattgtgtat

SEQ ID NO: 3572149 - DNA, 17 bp, Homo sapiens
tatcctggccctggggg

SEQ ID NO: 3572150 - DNA, 20 bp, Homo sapiens
tatccttataggcctgtccc

SEQ ID NO: 3572151 - DNA, 21 bp, Homo sapiens
tatccttataggcctgtccct

SEQ ID NO: 3572152 - DNA, 22 bp, Homo sapiens
tatccttataggcctgtccctt

SEQ ID NO: 3572153 - DNA, 13 bp, Homo sapiens
tatctataattta

SEQ ID NO: 3572154 - DNA, 13 bp, Homo sapiens
tatctatagctaa

SEQ ID NO: 3572155 - DNA, 14 bp, Homo sapiens
tatctcaagtaaaa

SEQ ID NO: 3572156 - DNA, 19 bp, Homo sapiens
tatctcaagtaaaacaaat

SEQ ID NO: 3572157 - DNA, 15 bp, Homo sapiens
tatctcagccatagg

SEQ ID NO: 3572158 - DNA, 12 bp, Homo sapiens
tatctccctggc

SEQ ID NO: 3572159 - DNA, 16 bp, Homo sapiens
tatctccctggctcac

SEQ ID NO: 3572160 - DNA, 20 bp, Homo sapiens
tatctccctggctcactggc

SEQ ID NO: 3572161 - DNA, 15 bp, Homo sapiens
tagtgacatgcagtt

SEQ ID NO: 3572162 - DNA, 22 bp, Homo sapiens
tagtgaccccttccctgtcctt

SEQ ID NO: 3572163 - DNA, 19 bp, Homo sapiens
tagtgagactagacatagt

SEQ ID NO: 3572164 - DNA, 14 bp, Homo sapiens
tagtgatggttccc

SEQ ID NO: 3572165 - DNA, 21 bp, Homo sapiens
tagtgattccatcaaagagaa

SEQ ID NO: 3572166 - DNA, 16 bp, Homo sapiens
tagtgattgtaacaaa

SEQ ID NO: 3572167 - DNA, 22 bp, Homo sapiens
tagtgccacttaatgtatgtta

SEQ ID NO: 3572168 - DNA, 16 bp, Homo sapiens
tagtgccttctaaagg

SEQ ID NO: 3572169 - DNA, 19 bp, Homo sapiens
tagtggagttttataaatt

SEQ ID NO: 3572170 - DNA, 20 bp, Homo sapiens
tagtggagttttataaatta

SEQ ID NO: 3572171 - DNA, 20 bp, Homo sapiens
tagtgtcaacttttaacttt

SEQ ID NO: 3572172 - DNA, 18 bp, Homo sapiens
tagtgtgaagatctttgg

SEQ ID NO: 3572173 - DNA, 11 bp, Homo sapiens
tagtgtgactc

SEQ ID NO: 3572174 - DNA, 12 bp, Homo sapiens
tagtgtgactcc

SEQ ID NO: 3572175 - DNA, 19 bp, Homo sapiens
tagtgttcaaaacaaaatg

SEQ ID NO: 3572176 - DNA, 20 bp, Homo sapiens
tagtgttcaaaacaaaatga

SEQ ID NO: 3572177 - DNA, 24 bp, Homo sapiens
tagtgttctgctcctgcttttctg

SEQ ID NO: 3572178 - DNA, 21 bp, Homo sapiens
tagtgtttggacagctgataa

SEQ ID NO: 3572179 - DNA, 19 bp, Homo sapiens
tagttaatggattaaattt

SEQ ID NO: 3572180 - DNA, 14 bp, Homo sapiens
tagttaccttatag

SEQ ID NO: 3572181 - DNA, 17 bp, Homo sapiens
tagttaccttatagtta

SEQ ID NO: 3572182 - DNA, 19 bp, Homo sapiens
tagttaccttatagttact

SEQ ID NO: 3572183 - DNA, 23 bp, Homo sapiens
tagttaccttatagttactgtgt

SEQ ID NO: 3572184 - DNA, 13 bp, Homo sapiens
tagttactcaagc

SEQ ID NO: 3572185 - DNA, 18 bp, Homo sapiens
tagttactgtgtaattag

SEQ ID NO: 3572186 - DNA, 15 bp, Homo sapiens
tagttatatatatgt

SEQ ID NO: 3572187 - DNA, 16 bp, Homo sapiens
tagttctttcctcccc

SEQ ID NO: 3572188 - DNA, 18 bp, Homo sapiens
tagttgccaatctaaaat

SEQ ID NO: 3572189 - DNA, 19 bp, Homo sapiens
tagttgcccccattcccag

SEQ ID NO: 3572190 - DNA, 22 bp, Homo sapiens
tagttgcccccattcccagcct

SEQ ID NO: 3572191 - DNA, 16 bp, Homo sapiens
tagtttgggtattttt

SEQ ID NO: 3572192 - DNA, 18 bp, Homo sapiens
tataaaatgtattcaagc

SEQ ID NO: 3572193 - DNA, 16 bp, Homo sapiens
tataaaggataaagaa

SEQ ID NO: 3572194 - DNA, 14 bp, Homo sapiens
tataaagtatatgt

SEQ ID NO: 3572195 - DNA, 18 bp, Homo sapiens
tataaagtatatgttctg

SEQ ID NO: 3572196 - DNA, 23 bp, Homo sapiens
tacctattctgaaaaagacataa

SEQ ID NO: 3572197 - DNA, 22 bp, Homo sapiens
tacctcaagccccatttcctca

SEQ ID NO: 3572198 - DNA, 21 bp, Homo sapiens
tacctctaataaacactgttt

SEQ ID NO: 3572199 - DNA, 21 bp, Homo sapiens
tacctctattttaattactgc

SEQ ID NO: 3572200 - DNA, 12 bp, Homo sapiens
tacctgaaagga

SEQ ID NO: 3572201 - DNA, 18 bp, Homo sapiens
tacctgaaggggttttct

SEQ ID NO: 3572202 - DNA, 19 bp, Homo sapiens
tacctgaaggggttttctt

SEQ ID NO: 3572203 - DNA, 17 bp, Homo sapiens
tacctgctcagccctgc

SEQ ID NO: 3572204 - DNA, 18 bp, Homo sapiens
tacctggtccccactgct

SEQ ID NO: 3572205 - DNA, 16 bp, Homo sapiens
tacctgtctgctgcca

SEQ ID NO: 3572206 - DNA, 22 bp, Homo sapiens
tacctgtgtttttttctaaaaa

SEQ ID NO: 3572207 - DNA, 13 bp, Homo sapiens
tacctgttcctcc

SEQ ID NO: 3572208 - DNA, 17 bp, Homo sapiens
taccttatagttactgt

SEQ ID NO: 3572209 - DNA, 18 bp, Homo sapiens
taccttatagttactgtg

SEQ ID NO: 3572210 - DNA, 15 bp, Homo sapiens
taccttctatgtatt

SEQ ID NO: 3572211 - DNA, 20 bp, Homo sapiens
taccttctatgtattagtgt

SEQ ID NO: 3572212 - DNA, 17 bp, Homo sapiens
taccttgaaatgctgtt

SEQ ID NO: 3572213 - DNA, 18 bp, Homo sapiens
taccttgaaatgctgtta

SEQ ID NO: 3572214 - DNA, 16 bp, Homo sapiens
taccttgtatactgta

SEQ ID NO: 3572215 - DNA, 14 bp, Homo sapiens
tacctttgtagtta

SEQ ID NO: 3572216 - DNA, 20 bp, Homo sapiens
taccttttctcttttctttc

SEQ ID NO: 3572217 - DNA, 21 bp, Homo sapiens
taccttttctcttttctttct

SEQ ID NO: 3572218 - DNA, 15 bp, Homo sapiens
tacgggggcacttgg

SEQ ID NO: 3572219 - DNA, 21 bp, Homo sapiens
tacgggggcacttggaggacc

SEQ ID NO: 3572220 - DNA, 17 bp, Homo sapiens
tacgtagctatttttat

SEQ ID NO: 3572221 - DNA, 14 bp, Homo sapiens
tacgtagctctctt

SEQ ID NO: 3572222 - DNA, 15 bp, Homo sapiens
tacgtagctctctta

SEQ ID NO: 3572223 - DNA, 23 bp, Homo sapiens
tacgtgatctctgttacaaaaga

SEQ ID NO: 3572224 - DNA, 14 bp, Homo sapiens
tacgtgtcaaaaaa

SEQ ID NO: 3572225 - DNA, 17 bp, Homo sapiens
tacgtgtcaaaaaagaa

SEQ ID NO: 3572226 - DNA, 18 bp, Homo sapiens
tactaaaaagtataaaat

SEQ ID NO: 3572227 - DNA, 17 bp, Homo sapiens
tactaaatatataaagt

SEQ ID NO: 3572228 - DNA, 18 bp, Homo sapiens
tactaagttattttatga

SEQ ID NO: 3572229 - DNA, 20 bp, Homo sapiens
tactaatgtctcttctaaca

SEQ ID NO: 3572230 - DNA, 20 bp, Homo sapiens
tactaccagggtctctcagg

SEQ ID NO: 3572231 - DNA, 15 bp, Homo sapiens
tactacccagctctg

SEQ ID NO: 3572232 - DNA, 14 bp, Homo sapiens
tactacctgtaatg

SEQ ID NO: 3572233 - DNA, 20 bp, Homo sapiens
tactagtcaccagagacttt

SEQ ID NO: 3572234 - DNA, 22 bp, Homo sapiens
tactagtcaccagagactttag

SEQ ID NO: 3572235 - DNA, 15 bp, Homo sapiens
tactagtgtgactcc

SEQ ID NO: 3572236 - DNA, 14 bp, Homo sapiens
tactatgatcagaa

SEQ ID NO: 3572237 - DNA, 22 bp, Homo sapiens
tactattgttgctgaaacttgc

SEQ ID NO: 3572238 - DNA, 21 bp, Homo sapiens
tactcaggaggctgaggcagg

SEQ ID NO: 3572239 - DNA, 17 bp, Homo sapiens
tactcagtggggctggc

SEQ ID NO: 3572240 - DNA, 17 bp, Homo sapiens
tactccactccaagtgc

SEQ ID NO: 3572241 - DNA, 21 bp, Homo sapiens
tactccactccaagtgcccca

SEQ ID NO: 3572242 - DNA, 22 bp, Homo sapiens
tactcccactcccggcctgtca

SEQ ID NO: 3572243 - DNA, 17 bp, Homo sapiens
tactcccccaccactca

SEQ ID NO: 3572244 - DNA, 20 bp, Homo sapiens
tactcctccattactctatt

SEQ ID NO: 3572245 - DNA, 13 bp, Homo sapiens
tactctccatatc

SEQ ID NO: 3572246 - DNA, 14 bp, Homo sapiens
tactctcttatgca

SEQ ID NO: 3572247 - DNA, 12 bp, Homo sapiens
tactctttgaaa

SEQ ID NO: 3572248 - DNA, 22 bp, Homo sapiens
tacagctgctttgagctacagg

SEQ ID NO: 3572249 - DNA, 23 bp, Homo sapiens
tacagctgctttgagctacagga

SEQ ID NO: 3572250 - DNA, 14 bp, Homo sapiens
tacagctgtgctcc

SEQ ID NO: 3572251 - DNA, 16 bp, Homo sapiens
tacagctgtgctccac

SEQ ID NO: 3572252 - DNA, 19 bp, Homo sapiens
tacaggagaggcagcatgc

SEQ ID NO: 3572253 - DNA, 16 bp, Homo sapiens
tacaggagccagcctg

SEQ ID NO: 3572254 - DNA, 15 bp, Homo sapiens
tacaggcgtgagcca

SEQ ID NO: 3572255 - DNA, 17 bp, Homo sapiens
tacaggtgacagtgaag

SEQ ID NO: 3572256 - DNA, 16 bp, Homo sapiens
tacagtaactgtgact

SEQ ID NO: 3572257 - DNA, 19 bp, Homo sapiens
tacagtagcttgaaattga

SEQ ID NO: 3572258 - DNA, 21 bp, Homo sapiens
tacagttctgtggtttcatgt

SEQ ID NO: 3572259 - DNA, 17 bp, Homo sapiens
tacataaaagaaataaa

SEQ ID NO: 3572260 - DNA, 15 bp, Homo sapiens
tacataactcctgtc

SEQ ID NO: 3572261 - DNA, 23 bp, Homo sapiens
tacataactcctgtcccttttcc

SEQ ID NO: 3572262 - DNA, 19 bp, Homo sapiens
tacataatggtactcccaa

SEQ ID NO: 3572263 - DNA, 16 bp, Homo sapiens
tacatacaccagcatt

SEQ ID NO: 3572264 - DNA, 17 bp, Homo sapiens
tacatatttattttctt

SEQ ID NO: 3572265 - DNA, 15 bp, Homo sapiens
tacatctggctggaa

SEQ ID NO: 3572266 - DNA, 23 bp, Homo sapiens
tacatgaagcagaaccttctttg

SEQ ID NO: 3572267 - DNA, 19 bp, Homo sapiens
tacatgggccagtttatat

SEQ ID NO: 3572268 - DNA, 20 bp, Homo sapiens
tacatgttctttgtaccttt

SEQ ID NO: 3572269 - DNA, 17 bp, Homo sapiens
tacatgttggaaatgtg

SEQ ID NO: 3572270 - DNA, 15 bp, Homo sapiens
tacatgttttttcat

SEQ ID NO: 3572271 - DNA, 15 bp, Homo sapiens
tacattaaaataaac

SEQ ID NO: 3572272 - DNA, 14 bp, Homo sapiens
tacattaacggtgc

SEQ ID NO: 3572273 - DNA, 16 bp, Homo sapiens
tacattaacggtgcta

SEQ ID NO: 3572274 - DNA, 15 bp, Homo sapiens
tacattactaaatat

SEQ ID NO: 3572275 - DNA, 12 bp, Homo sapiens
tacattcagatt

SEQ ID NO: 3572276 - DNA, 15 bp, Homo sapiens
tacattgtgtcctgc

SEQ ID NO: 3572277 - DNA, 16 bp, Homo sapiens
tacattgtgtcctgct

SEQ ID NO: 3572278 - DNA, 19 bp, Homo sapiens
tacattgtgtcctgcttat

SEQ ID NO: 3572279 - DNA, 20 bp, Homo sapiens
tacatttaaaacattaaaat

SEQ ID NO: 3572280 - DNA, 14 bp, Homo sapiens
tacatttaataata

SEQ ID NO: 3572281 - DNA, 15 bp, Homo sapiens
tacatttcatacaac

SEQ ID NO: 3572282 - DNA, 17 bp, Homo sapiens
tacatttccaaatgaac

SEQ ID NO: 3572283 - DNA, 15 bp, Homo sapiens
tacatttctgattct

SEQ ID NO: 3572284 - DNA, 16 bp, Homo sapiens
tacatttctgattctg

SEQ ID NO: 3572285 - DNA, 13 bp, Homo sapiens
tacatttgtattt

SEQ ID NO: 3572286 - DNA, 20 bp, Homo sapiens
tacattttttgggcagcaat

SEQ ID NO: 3572287 - DNA, 15 bp, Homo sapiens
taccaaaagacatta

SEQ ID NO: 3572288 - DNA, 14 bp, Homo sapiens
taccaaatctgaca

SEQ ID NO: 3572289 - DNA, 17 bp, Homo sapiens
taccaaatctgacatat

SEQ ID NO: 3572290 - DNA, 17 bp, Homo sapiens
taccaagctgtcacagg

SEQ ID NO: 3572291 - DNA, 21 bp, Homo sapiens
taccacctaatgtttatagga

SEQ ID NO: 3572292 - DNA, 17 bp, Homo sapiens
taccactagtggaaagt

SEQ ID NO: 3572293 - DNA, 17 bp, Homo sapiens
taccacttcctgaggcc

SEQ ID NO: 3572294 - DNA, 18 bp, Homo sapiens
taccagggtctctcaggg

SEQ ID NO: 3572295 - DNA, 15 bp, Homo sapiens
taccagtatttagaa

SEQ ID NO: 3572296 - DNA, 17 bp, Homo sapiens
taccagtgacgctgctg

SEQ ID NO: 3572297 - DNA, 19 bp, Homo sapiens
taccagttaatttttccaa

SEQ ID NO: 3572298 - DNA, 14 bp, Homo sapiens
taccatatgatctg

SEQ ID NO: 3572299 - DNA, 12 bp, Homo sapiens
taccatcatctc

SEQ ID NO: 3572300 - DNA, 13 bp, Homo sapiens
taccatcatctct

SEQ ID NO: 3572301 - DNA, 16 bp, Homo sapiens
taccatgccatttaaa

SEQ ID NO: 3572302 - DNA, 15 bp, Homo sapiens
taccatttcagagag

SEQ ID NO: 3572303 - DNA, 19 bp, Homo sapiens
taccattttaacgctgcct

SEQ ID NO: 3572304 - DNA, 13 bp, Homo sapiens
tacccaaccctgc

SEQ ID NO: 3572305 - DNA, 17 bp, Homo sapiens
tacccatccccgcagtg

SEQ ID NO: 3572306 - DNA, 13 bp, Homo sapiens
taccccagccagg

SEQ ID NO: 3572307 - DNA, 15 bp, Homo sapiens
taccccagccaggct

SEQ ID NO: 3572308 - DNA, 19 bp, Homo sapiens
tacccctcaaactgcacat

SEQ ID NO: 3572309 - DNA, 16 bp, Homo sapiens
taccctaaccaagttc

SEQ ID NO: 3572310 - DNA, 14 bp, Homo sapiens
taccctacagacag

SEQ ID NO: 3572311 - DNA, 13 bp, Homo sapiens
taccctcctctgc

SEQ ID NO: 3572312 - DNA, 12 bp, Homo sapiens
taccctggcagg

SEQ ID NO: 3572313 - DNA, 20 bp, Homo sapiens
taccctggcagggacctgag

SEQ ID NO: 3572314 - DNA, 17 bp, Homo sapiens
taccctgtacatatgta

SEQ ID NO: 3572315 - DNA, 13 bp, Homo sapiens
tacccttttcccc

SEQ ID NO: 3572316 - DNA, 19 bp, Homo sapiens
tacccttttcccccttccc

SEQ ID NO: 3572317 - DNA, 21 bp, Homo sapiens
taccgagtctcttctccactg

SEQ ID NO: 3572318 - DNA, 22 bp, Homo sapiens
tacctaagagaagaggctggcc

SEQ ID NO: 3572319 - DNA, 15 bp, Homo sapiens
tacctacaataaact

SEQ ID NO: 3572320 - DNA, 15 bp, Homo sapiens
tacctactattggcc

SEQ ID NO: 3572321 - DNA, 16 bp, Homo sapiens
tacctatcatcttaag

SEQ ID NO: 3572322 - DNA, 18 bp, Homo sapiens
tacctattctgaaaaaga

SEQ ID NO: 3572323 - DNA, 21 bp, Homo sapiens
tacctattctgaaaaagacat

SEQ ID NO: 3572324 - DNA, 17 bp, Homo sapiens
taatctggactcctctg

SEQ ID NO: 3572325 - DNA, 13 bp, Homo sapiens
taatgacaacact

SEQ ID NO: 3572326 - DNA, 16 bp, Homo sapiens
taatgacttagaaact

SEQ ID NO: 3572327 - DNA, 17 bp, Homo sapiens
taatgagtgcacctgcc

SEQ ID NO: 3572328 - DNA, 16 bp, Homo sapiens
taatgatatgcttgta

SEQ ID NO: 3572329 - DNA, 16 bp, Homo sapiens
taatgattcaaatgtt

SEQ ID NO: 3572330 - DNA, 16 bp, Homo sapiens
taatgctgcacttcct

SEQ ID NO: 3572331 - DNA, 17 bp, Homo sapiens
taatggcagctagtgcc

SEQ ID NO: 3572332 - DNA, 19 bp, Homo sapiens
taatggcagctagtgcctt

SEQ ID NO: 3572333 - DNA, 20 bp, Homo sapiens
taatggcagctagtgccttt

SEQ ID NO: 3572334 - DNA, 20 bp, Homo sapiens
taatggtactcccaaactga

SEQ ID NO: 3572335 - DNA, 16 bp, Homo sapiens
taatggtagttttaca

SEQ ID NO: 3572336 - DNA, 13 bp, Homo sapiens
taatgtaaaatga

SEQ ID NO: 3572337 - DNA, 19 bp, Homo sapiens
taatgtatcaaatacattt

SEQ ID NO: 3572338 - DNA, 17 bp, Homo sapiens
taatgtatttgaaaatt

SEQ ID NO: 3572339 - DNA, 21 bp, Homo sapiens
taatgtctggtgtttgtcatg

SEQ ID NO: 3572340 - DNA, 21 bp, Homo sapiens
taatgtgagtgtgaagctttg

SEQ ID NO: 3572341 - DNA, 21 bp, Homo sapiens
taatgttgggtagaaagagat

SEQ ID NO: 3572342 - DNA, 18 bp, Homo sapiens
taatgtttttatttcaat

SEQ ID NO: 3572343 - DNA, 21 bp, Homo sapiens
taatgtttttatttcaattgt

SEQ ID NO: 3572344 - DNA, 22 bp, Homo sapiens
taatgtttttatttcaattgtt

SEQ ID NO: 3572345 - DNA, 14 bp, Homo sapiens
taattaaaaaatag

SEQ ID NO: 3572346 - DNA, 15 bp, Homo sapiens
taattaaaacacttt

SEQ ID NO: 3572347 - DNA, 21 bp, Homo sapiens
taattaaacattgtgatcatt

SEQ ID NO: 3572348 - DNA, 16 bp, Homo sapiens
taattacaaacaataa

SEQ ID NO: 3572349 - DNA, 18 bp, Homo sapiens
taattacaaacaataaga

SEQ ID NO: 3572350 - DNA, 14 bp, Homo sapiens
taattagtgccact

SEQ ID NO: 3572351 - DNA, 21 bp, Homo sapiens
taattagtgccacttaatgta

SEQ ID NO: 3572352 - DNA, 20 bp, Homo sapiens
taattcaagcctctaaacag

SEQ ID NO: 3572353 - DNA, 22 bp, Homo sapiens
taattcaaggaatttcttaact

SEQ ID NO: 3572354 - DNA, 14 bp, Homo sapiens
taattcacagtgct

SEQ ID NO: 3572355 - DNA, 23 bp, Homo sapiens
taattcttcagcgtaaaatggtg

SEQ ID NO: 3572356 - DNA, 19 bp, Homo sapiens
taattctttgacctgttgg

SEQ ID NO: 3572357 - DNA, 17 bp, Homo sapiens
taattgaaagaatgtaa

SEQ ID NO: 3572358 - DNA, 16 bp, Homo sapiens
taattggatttcctaa

SEQ ID NO: 3572359 - DNA, 17 bp, Homo sapiens
taattggatttcctaat

SEQ ID NO: 3572360 - DNA, 23 bp, Homo sapiens
taattggatttcctaatactgtc

SEQ ID NO: 3572361 - DNA, 24 bp, Homo sapiens
taattgggaactgaaatccttgag

SEQ ID NO: 3572362 - DNA, 15 bp, Homo sapiens
taattgtaattccaa

SEQ ID NO: 3572363 - DNA, 14 bp, Homo sapiens
taattgtacaataa

SEQ ID NO: 3572364 - DNA, 21 bp, Homo sapiens
taattgtacaataaatttttt

SEQ ID NO: 3572365 - DNA, 12 bp, Homo sapiens
taattgtcatta

SEQ ID NO: 3572366 - DNA, 12 bp, Homo sapiens
taattgtgcccc

SEQ ID NO: 3572367 - DNA, 15 bp, Homo sapiens
taatttaaaattgtg

SEQ ID NO: 3572368 - DNA, 15 bp, Homo sapiens
taatttaaactgtgt

SEQ ID NO: 3572369 - DNA, 16 bp, Homo sapiens
taatttaaactgtgtt

SEQ ID NO: 3572370 - DNA, 15 bp, Homo sapiens
taatttaaatagcat

SEQ ID NO: 3572371 - DNA, 22 bp, Homo sapiens
taatttaatttgtaaaacttct

SEQ ID NO: 3572372 - DNA, 16 bp, Homo sapiens
taatttaatttttcct

SEQ ID NO: 3572373 - DNA, 22 bp, Homo sapiens
taatttacctaagattacaaat

SEQ ID NO: 3572374 - DNA, 14 bp, Homo sapiens
taatttagaatggt

SEQ ID NO: 3572375 - DNA, 22 bp, Homo sapiens
taatttagagataggaaactga

SEQ ID NO: 3572376 - DNA, 17 bp, Homo sapiens
taatttataatgtattt

SEQ ID NO: 3572377 - DNA, 18 bp, Homo sapiens
taatttattaattgcttt

SEQ ID NO: 3572378 - DNA, 19 bp, Homo sapiens
taatttattaattgctttg

SEQ ID NO: 3572379 - DNA, 13 bp, Homo sapiens
taatttatttcaa

SEQ ID NO: 3572380 - DNA, 13 bp, Homo sapiens
taatttcaaatgt

SEQ ID NO: 3572381 - DNA, 20 bp, Homo sapiens
taatttgaagatagaaggtt

SEQ ID NO: 3572382 - DNA, 19 bp, Homo sapiens
taatttggctttcacattt

SEQ ID NO: 3572383 - DNA, 16 bp, Homo sapiens
taatttgtaaaacttc

SEQ ID NO: 3572384 - DNA, 19 bp, Homo sapiens
taatttgtaaaacttctgc

SEQ ID NO: 3572385 - DNA, 17 bp, Homo sapiens
taattttgaaaagatgt

SEQ ID NO: 3572386 - DNA, 16 bp, Homo sapiens
taattttgctaactgg

SEQ ID NO: 3572387 - DNA, 20 bp, Homo sapiens
taattttgtgtaagaaatac

SEQ ID NO: 3572388 - DNA, 13 bp, Homo sapiens
taatttttccaac

SEQ ID NO: 3572389 - DNA, 12 bp, Homo sapiens
taatttttcctt

SEQ ID NO: 3572390 - DNA, 20 bp, Homo sapiens
taaatattagttaatggatt

SEQ ID NO: 3572391 - DNA, 15 bp, Homo sapiens
taaatattttgctaa

SEQ ID NO: 3572392 - DNA, 17 bp, Homo sapiens
taaatattttgctaact

SEQ ID NO: 3572393 - DNA, 13 bp, Homo sapiens
taaatcacacatt

SEQ ID NO: 3572394 - DNA, 13 bp, Homo sapiens
taaatcatgttgt

SEQ ID NO: 3572395 - DNA, 18 bp, Homo sapiens
taaatcctagacttgaaa

SEQ ID NO: 3572396 - DNA, 16 bp, Homo sapiens
taaatcctgaagagca

SEQ ID NO: 3572397 - DNA, 14 bp, Homo sapiens
taaatctgacccag

SEQ ID NO: 3572398 - DNA, 17 bp, Homo sapiens
taaatctgacccagtgc

SEQ ID NO: 3572399 - DNA, 21 bp, Homo sapiens
taaatgaaacttaagaattga

SEQ ID NO: 3572400 - DNA, 16 bp, Homo sapiens
taaatgcttttctaat

SEQ ID NO: 3572401 - DNA, 20 bp, Homo sapiens
taaatggttaaattttacat

SEQ ID NO: 3572402 - DNA, 16 bp, Homo sapiens
taaatggttctgtgct

SEQ ID NO: 3572403 - DNA, 12 bp, Homo sapiens
taaatgtatact

SEQ ID NO: 3572404 - DNA, 17 bp, Homo sapiens
taaatgtatactatagt

SEQ ID NO: 3572405 - DNA, 15 bp, Homo sapiens
taaatgtattttaca

SEQ ID NO: 3572406 - DNA, 21 bp, Homo sapiens
taaatgtcactttttgaggca

SEQ ID NO: 3572407 - DNA, 13 bp, Homo sapiens
taaatgtctgcac

SEQ ID NO: 3572408 - DNA, 23 bp, Homo sapiens
taaatgtgatatgattggcaata

SEQ ID NO: 3572409 - DNA, 14 bp, Homo sapiens
taaatgtgtacaat

SEQ ID NO: 3572410 - DNA, 19 bp, Homo sapiens
taaatgtgtttcttgctgc

SEQ ID NO: 3572411 - DNA, 12 bp, Homo sapiens
taaatgttacct

SEQ ID NO: 3572412 - DNA, 22 bp, Homo sapiens
taaatgttatgactatgtaaac

SEQ ID NO: 3572413 - DNA, 18 bp, Homo sapiens
taaatgttctaacagatc

SEQ ID NO: 3572414 - DNA, 16 bp, Homo sapiens
taaattatatgatatg

SEQ ID NO: 3572415 - DNA, 21 bp, Homo sapiens
taaattatatgatatgcatgt

SEQ ID NO: 3572416 - DNA, 19 bp, Homo sapiens
taaattattactttaaatt

SEQ ID NO: 3572417 - DNA, 18 bp, Homo sapiens
taaattccactgaaaatt

SEQ ID NO: 3572418 - DNA, 21 bp, Homo sapiens
taaattcccaaatcctagact

SEQ ID NO: 3572419 - DNA, 19 bp, Homo sapiens
taaattcccgttttgtcac

SEQ ID NO: 3572420 - DNA, 16 bp, Homo sapiens
taaattcctctttgct

SEQ ID NO: 3572421 - DNA, 17 bp, Homo sapiens
taaattcctctttgctt

SEQ ID NO: 3572422 - DNA, 11 bp, Homo sapiens
taaattctaaa

SEQ ID NO: 3572423 - DNA, 15 bp, Homo sapiens
taaattctaaattac

SEQ ID NO: 3572424 - DNA, 19 bp, Homo sapiens
taaattctactaagttatt

SEQ ID NO: 3572425 - DNA, 23 bp, Homo sapiens
taaattctagtgtccataaataa

SEQ ID NO: 3572426 - DNA, 19 bp, Homo sapiens
taaattctcaaagttttat

SEQ ID NO: 3572427 - DNA, 22 bp, Homo sapiens
taaattgcagtttacagtattt

SEQ ID NO: 3572428 - DNA, 15 bp, Homo sapiens
taaatttaactttaa

SEQ ID NO: 3572429 - DNA, 14 bp, Homo sapiens
taaatttaatgctg

SEQ ID NO: 3572430 - DNA, 17 bp, Homo sapiens
taaatttactttacaca

SEQ ID NO: 3572431 - DNA, 10 bp, Homo sapiens
taaatttagc

SEQ ID NO: 3572432 - DNA, 14 bp, Homo sapiens
taaatttctgggat

SEQ ID NO: 3572433 - DNA, 21 bp, Homo sapiens
taaatttctgggatatttaac

SEQ ID NO: 3572434 - DNA, 20 bp, Homo sapiens
taaatttgatttacatatat

SEQ ID NO: 3572435 - DNA, 20 bp, Homo sapiens
taaatttgttctttgtttag

SEQ ID NO: 3572436 - DNA, 14 bp, Homo sapiens
taaattttaaaaag

SEQ ID NO: 3572437 - DNA, 21 bp, Homo sapiens
taaattttttacgtagctatt

SEQ ID NO: 3572438 - DNA, 20 bp, Homo sapiens
taaattttttttggtcaaat

SEQ ID NO: 3572439 - DNA, 21 bp, Homo sapiens
taaattttttttggtcaaatt

SEQ ID NO: 3572440 - DNA, 14 bp, Homo sapiens
taacaagaaaatga

SEQ ID NO: 3572441 - DNA, 13 bp, Homo sapiens
taacaagaagcaa

SEQ ID NO: 3572442 - DNA, 23 bp, Homo sapiens
taacaattcagtaacaaaggttt

SEQ ID NO: 3572443 - DNA, 18 bp, Homo sapiens
taacactaaattgcagtt

SEQ ID NO: 3572444 - DNA, 16 bp, Homo sapiens
taacagatcctttcaa

SEQ ID NO: 3572445 - DNA, 18 bp, Homo sapiens
taacagatcctttcaaaa

SEQ ID NO: 3572446 - DNA, 11 bp, Homo sapiens
taacagccctc

SEQ ID NO: 3572447 - DNA, 17 bp, Homo sapiens
taacagccctcctctgc

SEQ ID NO: 3572448 - DNA, 18 bp, Homo sapiens
taacagccctcctctgca

SEQ ID NO: 3572449 - DNA, 11 bp, Homo sapiens
taacaggacag

SEQ ID NO: 3572450 - DNA, 14 bp, Homo sapiens
taacatctaaaaat

SEQ ID NO: 3572451 - DNA, 20 bp, Homo sapiens
taacatctaaaaatagactt

SEQ ID NO: 3572452 - DNA, 10 bp, Homo sapiens
taacatgaaa

SEQ ID NO: 3572453 - DNA, 13 bp, Homo sapiens
taacatgaaatat

SEQ ID NO: 3572454 - DNA, 15 bp, Homo sapiens
taacatgaaatatat

SEQ ID NO: 3572455 - DNA, 21 bp, Homo sapiens
taacatgggctcttcactagt

SEQ ID NO: 3572456 - DNA, 15 bp, Homo sapiens
taaccattctgtcca

SEQ ID NO: 3572457 - DNA, 21 bp, Homo sapiens
taacccacctctcctgccctg

SEQ ID NO: 3572458 - DNA, 17 bp, Homo sapiens
taaccctggcacttaag

SEQ ID NO: 3572459 - DNA, 12 bp, Homo sapiens
taacctgggacc

SEQ ID NO: 3572460 - DNA, 18 bp, Homo sapiens
taaccttctattttctat

SEQ ID NO: 3572461 - DNA, 13 bp, Homo sapiens
taactaaagaaga

SEQ ID NO: 3572462 - DNA, 14 bp, Homo sapiens
taactaaagaagag

SEQ ID NO: 3572463 - DNA, 15 bp, Homo sapiens
taactaaagaagagg

SEQ ID NO: 3572464 - DNA, 19 bp, Homo sapiens
taactaaagaagaggagaa

SEQ ID NO: 3572465 - DNA, 14 bp, Homo sapiens
taactactttataa

SEQ ID NO: 3572466 - DNA, 16 bp, Homo sapiens
taactactttataact

SEQ ID NO: 3572467 - DNA, 21 bp, Homo sapiens
taactagacacagataataat

SEQ ID NO: 3572468 - DNA, 14 bp, Homo sapiens
taactatgacagat

SEQ ID NO: 3572469 - DNA, 15 bp, Homo sapiens
taactattgcattta

SEQ ID NO: 3572470 - DNA, 16 bp, Homo sapiens
taactattgcatttat

SEQ ID NO: 3572471 - DNA, 17 bp, Homo sapiens
taactcctgtccctttt

SEQ ID NO: 3572472 - DNA, 19 bp, Homo sapiens
taactcctgtcccttttcc

SEQ ID NO: 3572473 - DNA, 16 bp, Homo sapiens
taactctgagagctgt

SEQ ID NO: 3572474 - DNA, 15 bp, Homo sapiens
taactgaaccaaatt

SEQ ID NO: 3572475 - DNA, 12 bp, Homo sapiens
taactggttaaa

SEQ ID NO: 3572476 - DNA, 19 bp, Homo sapiens
taactgtaaagatgaatgt

SEQ ID NO: 3572477 - DNA, 20 bp, Homo sapiens
taactgtaaagatgaatgtc

SEQ ID NO: 3572478 - DNA, 21 bp, Homo sapiens
taactgtattttctttcactt

SEQ ID NO: 3572479 - DNA, 12 bp, Homo sapiens
taactgtcctgt

SEQ ID NO: 3572480 - DNA, 15 bp, Homo sapiens
taactgtcctgtcct

SEQ ID NO: 3572481 - DNA, 15 bp, Homo sapiens
taacttccaaataaa

SEQ ID NO: 3572482 - DNA, 16 bp, Homo sapiens
taacttccagtggctg

SEQ ID NO: 3572483 - DNA, 11 bp, Homo sapiens
taacttcctgc

SEQ ID NO: 3572484 - DNA, 12 bp, Homo sapiens
taacttcctgct

SEQ ID NO: 3572485 - DNA, 19 bp, Homo sapiens
taacttcctgctgcaccct

SEQ ID NO: 3572486 - DNA, 22 bp, Homo sapiens
taacttcctgctgcaccctgcg

SEQ ID NO: 3572487 - DNA, 12 bp, Homo sapiens
taacttctgttt

SEQ ID NO: 3572488 - DNA, 12 bp, Homo sapiens
taacttcttgct

SEQ ID NO: 3572489 - DNA, 15 bp, Homo sapiens
taacttcttgcttct

SEQ ID NO: 3572490 - DNA, 19 bp, Homo sapiens
taacttcttgcttctttct

SEQ ID NO: 3572491 - DNA, 17 bp, Homo sapiens
taacttgagattcaaga

SEQ ID NO: 3572492 - DNA, 13 bp, Homo sapiens
taacttgctttct

SEQ ID NO: 3572493 - DNA, 17 bp, Homo sapiens
taacttgctttcttctt

SEQ ID NO: 3572494 - DNA, 18 bp, Homo sapiens
taacttgctttcttcttt

SEQ ID NO: 3572495 - DNA, 15 bp, Homo sapiens
taacttttaatttaa

SEQ ID NO: 3572496 - DNA, 16 bp, Homo sapiens
taacttttaatttaaa

SEQ ID NO: 3572497 - DNA, 22 bp, Homo sapiens
taacttttgtgaattaggctgt

SEQ ID NO: 3572498 - DNA, 21 bp, Homo sapiens
taactttttttcttctacttt

SEQ ID NO: 3572499 - DNA, 19 bp, Homo sapiens
taacttttttttctctctt

SEQ ID NO: 3572500 - DNA, 17 bp, Homo sapiens
taagaaccttaatgaca

SEQ ID NO: 3572501 - DNA, 23 bp, Homo sapiens
taagaaccttaatgacaacactt

SEQ ID NO: 3572502 - DNA, 14 bp, Homo sapiens
taagaagaaggcca

SEQ ID NO: 3572503 - DNA, 18 bp, Homo sapiens
taagaagaaggccagaga

SEQ ID NO: 3572504 - DNA, 15 bp, Homo sapiens
taagaataaacattt

SEQ ID NO: 3572505 - DNA, 20 bp, Homo sapiens
taagaattgaattggaaaga

SEQ ID NO: 3572506 - DNA, 19 bp, Homo sapiens
taagacaaatattcctttg

SEQ ID NO: 3572507 - DNA, 20 bp, Homo sapiens
taagacactgaaaaatctaa

SEQ ID NO: 3572508 - DNA, 13 bp, Homo sapiens
taagacataaaca

SEQ ID NO: 3572509 - DNA, 16 bp, Homo sapiens
taagacataaacaaag

SEQ ID NO: 3572510 - DNA, 19 bp, Homo sapiens
taagaccctgtgtcctcca

SEQ ID NO: 3572511 - DNA, 16 bp, Homo sapiens
taagagaaacctgcca

SEQ ID NO: 3572512 - DNA, 23 bp, Homo sapiens
taagagggattagggagagaaga

SEQ ID NO: 3572513 - DNA, 22 bp, Homo sapiens
taagatacttagattagaccta

SEQ ID NO: 3572514 - DNA, 19 bp, Homo sapiens
taagatggataatgtgtat

SEQ ID NO: 3572515 - DNA, 21 bp, Homo sapiens
taagattccagagagtggctc

SEQ ID NO: 3572516 - DNA, 19 bp, Homo sapiens
taagcaaattttgtattat

SEQ ID NO: 3572517 - DNA, 13 bp, Homo sapiens
taagcaacaatgg

SEQ ID NO: 3572518 - DNA, 19 bp, Homo sapiens
taagcaaccacactgcttg

SEQ ID NO: 3572519 - DNA, 17 bp, Homo sapiens
taagcagcatggaaaaa

SEQ ID NO: 3572520 - DNA, 16 bp, Homo sapiens
taagcagcttgaatgg

SEQ ID NO: 3572521 - DNA, 23 bp, Homo sapiens
taagcagcttgaatggtttttct

SEQ ID NO: 3572522 - DNA, 21 bp, Homo sapiens
taagcaggttgttatttaggt

SEQ ID NO: 3572523 - DNA, 20 bp, Homo sapiens
taagcagttcattctaccaa

SEQ ID NO: 3572524 - DNA, 21 bp, Homo sapiens
taagcagttcattctaccaag

SEQ ID NO: 3572525 - DNA, 19 bp, Homo sapiens
taagccaaactcaggccca

SEQ ID NO: 3572526 - DNA, 20 bp, Homo sapiens
taagcccccagggcctccag

SEQ ID NO: 3572527 - DNA, 20 bp, Homo sapiens
gtggaacataaaaaggacat

SEQ ID NO: 3572528 - DNA, 19 bp, Homo sapiens
gtggaagtgtgggtctgtg

SEQ ID NO: 3572529 - DNA, 18 bp, Homo sapiens
gtggaatagtatcctcca

SEQ ID NO: 3572530 - DNA, 21 bp, Homo sapiens
gtggaatagtatcctccaggt

SEQ ID NO: 3572531 - DNA, 20 bp, Homo sapiens
gtggacacaacagcagtctc

SEQ ID NO: 3572532 - DNA, 21 bp, Homo sapiens
gtggacaggcgcctggtgtga

SEQ ID NO: 3572533 - DNA, 11 bp, Homo sapiens
gtggagacagt

SEQ ID NO: 3572534 - DNA, 18 bp, Homo sapiens
gtggagatcaggagtgac

SEQ ID NO: 3572535 - DNA, 20 bp, Homo sapiens
gtggagttttataaattaaa

SEQ ID NO: 3572536 - DNA, 14 bp, Homo sapiens
gtggatcttcagaa

SEQ ID NO: 3572537 - DNA, 12 bp, Homo sapiens
gtggatgggcaa

SEQ ID NO: 3572538 - DNA, 21 bp, Homo sapiens
gtggattgtatttaagacata

SEQ ID NO: 3572539 - DNA, 21 bp, Homo sapiens
gtggcaaagcagcaactattc

SEQ ID NO: 3572540 - DNA, 15 bp, Homo sapiens
gtggcacagctggga

SEQ ID NO: 3572541 - DNA, 14 bp, Homo sapiens
gtggcagcagcccc

SEQ ID NO: 3572542 - DNA, 14 bp, Homo sapiens
gtggcagcttgctg

SEQ ID NO: 3572543 - DNA, 19 bp, Homo sapiens
gtggcagcttgctgggctt

SEQ ID NO: 3572544 - DNA, 16 bp, Homo sapiens
gtggcaggggagcagg

SEQ ID NO: 3572545 - DNA, 23 bp, Homo sapiens
gtggcagggggccccgccagggc

SEQ ID NO: 3572546 - DNA, 15 bp, Homo sapiens
gtggccaaggagctg

SEQ ID NO: 3572547 - DNA, 18 bp, Homo sapiens
gtggccaaggagctgcta

SEQ ID NO: 3572548 - DNA, 16 bp, Homo sapiens
gtggccccgccctcag

SEQ ID NO: 3572549 - DNA, 16 bp, Homo sapiens
gtggcccgacagcctg

SEQ ID NO: 3572550 - DNA, 14 bp, Homo sapiens
gtggccctgaacct

SEQ ID NO: 3572551 - DNA, 11 bp, Homo sapiens
gtggcctatga

SEQ ID NO: 3572552 - DNA, 12 bp, Homo sapiens
gtggcctatgaa

SEQ ID NO: 3572553 - DNA, 13 bp, Homo sapiens
gtggcctccccat

SEQ ID NO: 3572554 - DNA, 13 bp, Homo sapiens
gtggcctccctgc

SEQ ID NO: 3572555 - DNA, 15 bp, Homo sapiens
gtggcctccctgctg

SEQ ID NO: 3572556 - DNA, 19 bp, Homo sapiens
gtggcctccctgctgtgcc

SEQ ID NO: 3572557 - DNA, 13 bp, Homo sapiens
gtggcctgcagga

SEQ ID NO: 3572558 - DNA, 14 bp, Homo sapiens
gtggcctgcaggag

SEQ ID NO: 3572559 - DNA, 21 bp, Homo sapiens
gtggccttccccagcatgcac

SEQ ID NO: 3572560 - DNA, 17 bp, Homo sapiens
gtggcggctgcacaaca

SEQ ID NO: 3572561 - DNA, 13 bp, Homo sapiens
gtggcgtggcctc

SEQ ID NO: 3572562 - DNA, 15 bp, Homo sapiens
gtggcgtggcctccc

SEQ ID NO: 3572563 - DNA, 22 bp, Homo sapiens
gtggctagtcaagctcctcctc

SEQ ID NO: 3572564 - DNA, 20 bp, Homo sapiens
gtggctcctcccggtgccca

SEQ ID NO: 3572565 - DNA, 12 bp, Homo sapiens
gtggctcctggg

SEQ ID NO: 3572566 - DNA, 14 bp, Homo sapiens
gtggctcctgggcc

SEQ ID NO: 3572567 - DNA, 15 bp, Homo sapiens
gtggctgagcccctg

SEQ ID NO: 3572568 - DNA, 17 bp, Homo sapiens
gtggctgagcccctgtc

SEQ ID NO: 3572569 - DNA, 22 bp, Homo sapiens
gtggctggaaccacattgaaga

SEQ ID NO: 3572570 - DNA, 13 bp, Homo sapiens
gtggctgtttctt

SEQ ID NO: 3572571 - DNA, 20 bp, Homo sapiens
gtggcttcccgctcagccct

SEQ ID NO: 3572572 - DNA, 21 bp, Homo sapiens
gtggcttcccgctcagccctc

SEQ ID NO: 3572573 - DNA, 12 bp, Homo sapiens
gtggcttgggga

SEQ ID NO: 3572574 - DNA, 16 bp, Homo sapiens
gtggctttcagcctct

SEQ ID NO: 3572575 - DNA, 18 bp, Homo sapiens
gtggctttcagcctctgg

SEQ ID NO: 3572576 - DNA, 14 bp, Homo sapiens
gtgggagctgagct

SEQ ID NO: 3572577 - DNA, 15 bp, Homo sapiens
gtgggaggagggagg

SEQ ID NO: 3572578 - DNA, 13 bp, Homo sapiens
gtgggaggtcagg

SEQ ID NO: 3572579 - DNA, 18 bp, Homo sapiens
gtgggcaaagtcctcctt

SEQ ID NO: 3572580 - DNA, 20 bp, Homo sapiens
gtgggcaagcagatgacaga

SEQ ID NO: 3572581 - DNA, 16 bp, Homo sapiens
gtgggccttttgctca

SEQ ID NO: 3572582 - DNA, 18 bp, Homo sapiens
gtgggcgttgggagccta

SEQ ID NO: 3572583 - DNA, 19 bp, Homo sapiens
gtggggaacggaggaggac

SEQ ID NO: 3572584 - DNA, 22 bp, Homo sapiens
gtggggcaggattctctgcagc

SEQ ID NO: 3572585 - DNA, 22 bp, Homo sapiens
gtggggccataaacggttcctg

SEQ ID NO: 3572586 - DNA, 12 bp, Homo sapiens
gtggggcccact

SEQ ID NO: 3572587 - DNA, 17 bp, Homo sapiens
gtggggcccactgctcg

SEQ ID NO: 3572588 - DNA, 14 bp, Homo sapiens
gtggggctgcaggc

SEQ ID NO: 3572589 - DNA, 12 bp, Homo sapiens
gtggggctggca

SEQ ID NO: 3572590 - DNA, 13 bp, Homo sapiens
gtggggctggcat

SEQ ID NO: 3572591 - DNA, 15 bp, Homo sapiens
gtgggggtctgtgtg

SEQ ID NO: 3572592 - DNA, 19 bp, Homo sapiens
gtggggtcatgccctcctc

SEQ ID NO: 3572593 - DNA, 15 bp, Homo sapiens
gtggggttgctgaag

SEQ ID NO: 3572594 - DNA, 22 bp, Homo sapiens
gtgggtaattgtacaataaatt

SEQ ID NO: 3572595 - DNA, 22 bp, Homo sapiens
gtggtcaggcgtagatcaccag

SEQ ID NO: 3572596 - DNA, 16 bp, Homo sapiens
gtggtcatgtgagtct

SEQ ID NO: 3572597 - DNA, 14 bp, Homo sapiens
gtggtgaggggctt

SEQ ID NO: 3572598 - DNA, 22 bp, Homo sapiens
gtggtgaggggctttctcttcc

SEQ ID NO: 3572599 - DNA, 19 bp, Homo sapiens
gtggtgcagccttcccctc

SEQ ID NO: 3572600 - DNA, 16 bp, Homo sapiens
gtggtggtaaccctgg

SEQ ID NO: 3572601 - DNA, 20 bp, Homo sapiens
gtggtggtaaccctggtggt

SEQ ID NO: 3572602 - DNA, 13 bp, Homo sapiens
gtggtgtgactct

SEQ ID NO: 3572603 - DNA, 14 bp, Homo sapiens
gtggtgtgatctta

SEQ ID NO: 3572604 - DNA, 18 bp, Homo sapiens
gtggtgtgtccctggaca

SEQ ID NO: 3572605 - DNA, 20 bp, Homo sapiens
gtggtgtttcctgcaggcca

SEQ ID NO: 3572606 - DNA, 12 bp, Homo sapiens
gtggttccagta

SEQ ID NO: 3572607 - DNA, 18 bp, Homo sapiens
gtggttgctgttttcctc

SEQ ID NO: 3572608 - DNA, 18 bp, Homo sapiens
gtgtaacttcctgctgca

SEQ ID NO: 3572609 - DNA, 19 bp, Homo sapiens
gtgtaacttcctgctgcac

SEQ ID NO: 3572610 - DNA, 22 bp, Homo sapiens
gtgtaataagacttagattgtg

SEQ ID NO: 3572611 - DNA, 14 bp, Homo sapiens
gtgtaatcatttta

SEQ ID NO: 3572612 - DNA, 20 bp, Homo sapiens
gtgtaatttaaaattgtgat

SEQ ID NO: 3572613 - DNA, 22 bp, Homo sapiens
gtgtaatttaaaattgtgatgt

SEQ ID NO: 3572614 - DNA, 23 bp, Homo sapiens
gtgtaatttaaaattgtgatgtg

SEQ ID NO: 3572615 - DNA, 20 bp, Homo sapiens
gtgtaccacctaatgtttat

SEQ ID NO: 3572616 - DNA, 14 bp, Homo sapiens
gtgtacttttcctt

SEQ ID NO: 3572617 - DNA, 16 bp, Homo sapiens
gtgtacttttcctttg

SEQ ID NO: 3572618 - DNA, 23 bp, Homo sapiens
gtgtagagcccctactgtgggca

SEQ ID NO: 3572619 - DNA, 19 bp, Homo sapiens
gtgtagcctaaagggcagg

SEQ ID NO: 3572620 - DNA, 21 bp, Homo sapiens
gtgtagcctaaagggcagggc

SEQ ID NO: 3572621 - DNA, 12 bp, Homo sapiens
gtgtagctgtaa

SEQ ID NO: 3572622 - DNA, 23 bp, Homo sapiens
gtgtagctgtaagggcagtgccc

SEQ ID NO: 3572623 - DNA, 15 bp, Homo sapiens
gtgtatatgtattta

SEQ ID NO: 3572624 - DNA, 20 bp, Homo sapiens
gtgtatcctggccctggggg

SEQ ID NO: 3572625 - DNA, 19 bp, Homo sapiens
gtgtatctgtgcttctaat

SEQ ID NO: 3572626 - DNA, 19 bp, Homo sapiens
gtgtatgccacacctggcc

SEQ ID NO: 3572627 - DNA, 20 bp, Homo sapiens
gtgtatgccacacctggcct

SEQ ID NO: 3572628 - DNA, 19 bp, Homo sapiens
gtgtatggaaataaatgta

SEQ ID NO: 3572629 - DNA, 23 bp, Homo sapiens
gtgtatttaaaaaaaagaaactt

SEQ ID NO: 3572630 - DNA, 19 bp, Homo sapiens
gtgtccataaataaagttt

SEQ ID NO: 3572631 - DNA, 19 bp, Homo sapiens
gtgtccctggacacagctc

SEQ ID NO: 3572632 - DNA, 21 bp, Homo sapiens
gtgtccctggacacagctctt

SEQ ID NO: 3572633 - DNA, 21 bp, Homo sapiens
gtgtcctctctgtgtccctgc

SEQ ID NO: 3572634 - DNA, 23 bp, Homo sapiens
gtgtcgaggccacattgctggct

SEQ ID NO: 3572635 - DNA, 23 bp, Homo sapiens
gtgtcgtcttgaacgagcagccc

SEQ ID NO: 3572636 - DNA, 12 bp, Homo sapiens
gtgtctcagcct

SEQ ID NO: 3572637 - DNA, 20 bp, Homo sapiens
gtgtctcagcctctgccagc

SEQ ID NO: 3572638 - DNA, 22 bp, Homo sapiens
gtgtcttaattaaaagaatatt

SEQ ID NO: 3572639 - DNA, 18 bp, Homo sapiens
gtgtgaacctacctgcct

SEQ ID NO: 3572640 - DNA, 22 bp, Homo sapiens
gggtccttttgacactgctcta

SEQ ID NO: 3572641 - DNA, 12 bp, Homo sapiens
gggtctcccctc

SEQ ID NO: 3572642 - DNA, 12 bp, Homo sapiens
gggtctctcagg

SEQ ID NO: 3572643 - DNA, 17 bp, Homo sapiens
gggtctctctccaggtc

SEQ ID NO: 3572644 - DNA, 22 bp, Homo sapiens
gggtctgggcgtccagctcagc

SEQ ID NO: 3572645 - DNA, 14 bp, Homo sapiens
gggtcttagctctt

SEQ ID NO: 3572646 - DNA, 14 bp, Homo sapiens
gggtgaatctgtct

SEQ ID NO: 3572647 - DNA, 15 bp, Homo sapiens
gggtgacaaggcctg

SEQ ID NO: 3572648 - DNA, 14 bp, Homo sapiens
gggtgaggagctgg

SEQ ID NO: 3572649 - DNA, 16 bp, Homo sapiens
gggtgagggccacctc

SEQ ID NO: 3572650 - DNA, 13 bp, Homo sapiens
gggtgaggtaggc

SEQ ID NO: 3572651 - DNA, 21 bp, Homo sapiens
gggtgccgctctctctgaggg

SEQ ID NO: 3572652 - DNA, 16 bp, Homo sapiens
gggtgccgctgtctct

SEQ ID NO: 3572653 - DNA, 21 bp, Homo sapiens
gggtgcggcggtcccagctcc

SEQ ID NO: 3572654 - DNA, 12 bp, Homo sapiens
gggtgctgctct

SEQ ID NO: 3572655 - DNA, 16 bp, Homo sapiens
gggtgctgttttgcca

SEQ ID NO: 3572656 - DNA, 22 bp, Homo sapiens
gggtggaatgccgctgtctctg

SEQ ID NO: 3572657 - DNA, 13 bp, Homo sapiens
gggtgggccaggc

SEQ ID NO: 3572658 - DNA, 17 bp, Homo sapiens
gggtgggggagggaaag

SEQ ID NO: 3572659 - DNA, 18 bp, Homo sapiens
gggtgggggtgctgctct

SEQ ID NO: 3572660 - DNA, 23 bp, Homo sapiens
gggtgtaacttcctgctgcaccc

SEQ ID NO: 3572661 - DNA, 24 bp, Homo sapiens
gggtgtcaaacattcgtgagctgg

SEQ ID NO: 3572662 - DNA, 22 bp, Homo sapiens
gggttaaatattttgctaactg

SEQ ID NO: 3572663 - DNA, 21 bp, Homo sapiens
gggttaatcatatttgaaaac

SEQ ID NO: 3572664 - DNA, 14 bp, Homo sapiens
gggttctttcttcc

SEQ ID NO: 3572665 - DNA, 17 bp, Homo sapiens
gggttctttcttcctct

SEQ ID NO: 3572666 - DNA, 19 bp, Homo sapiens
gggttctttcttcctctgc

SEQ ID NO: 3572667 - DNA, 15 bp, Homo sapiens
gggttgcgtctgagg

SEQ ID NO: 3572668 - DNA, 16 bp, Homo sapiens
gggttgcgtctgaggc

SEQ ID NO: 3572669 - DNA, 23 bp, Homo sapiens
gggttgcgtctgaggcctgcccc

SEQ ID NO: 3572670 - DNA, 15 bp, Homo sapiens
gggtttgggagccag

SEQ ID NO: 3572671 - DNA, 17 bp, Homo sapiens
gggttttccgcccacag

SEQ ID NO: 3572672 - DNA, 12 bp, Homo sapiens
ggtaaaagtgtt

SEQ ID NO: 3572673 - DNA, 21 bp, Homo sapiens
ggtaaagcagttcctgtccca

SEQ ID NO: 3572674 - DNA, 20 bp, Homo sapiens
ggtaaatggttaaattttac

SEQ ID NO: 3572675 - DNA, 22 bp, Homo sapiens
ggtggctgtttcttgtctgtta

SEQ ID NO: 3572676 - DNA, 20 bp, Homo sapiens
ggtgggcagatcatgggtca

SEQ ID NO: 3572677 - DNA, 14 bp, Homo sapiens
ggtgggccaggctg

SEQ ID NO: 3572678 - DNA, 14 bp, Homo sapiens
ggtggggatcctgc

SEQ ID NO: 3572679 - DNA, 22 bp, Homo sapiens
ggtgggggtgccgctctctctg

SEQ ID NO: 3572680 - DNA, 21 bp, Homo sapiens
ggtgggggtgccgctgtctct

SEQ ID NO: 3572681 - DNA, 19 bp, Homo sapiens
ggtgggggtgctctctctg

SEQ ID NO: 3572682 - DNA, 18 bp, Homo sapiens
ggtgggggtgctgctctc

SEQ ID NO: 3572683 - DNA, 15 bp, Homo sapiens
ggtggggtcatgccc

SEQ ID NO: 3572684 - DNA, 19 bp, Homo sapiens
ggtggggtcatgccctcct

SEQ ID NO: 3572685 - DNA, 14 bp, Homo sapiens
ggtggtaaccctgg

SEQ ID NO: 3572686 - DNA, 14 bp, Homo sapiens
ggtggtcaggcgta

SEQ ID NO: 3572687 - DNA, 18 bp, Homo sapiens
ggtgtaatcattttaaat

SEQ ID NO: 3572688 - DNA, 13 bp, Homo sapiens
ggtgtataaatgt

SEQ ID NO: 3572689 - DNA, 20 bp, Homo sapiens
ggtgtgaatttgccagagga

SEQ ID NO: 3572690 - DNA, 22 bp, Homo sapiens
ggtgtgaggaggacaaaataaa

SEQ ID NO: 3572691 - DNA, 22 bp, Homo sapiens
ggtgtgggatctggggagagcg

SEQ ID NO: 3572692 - DNA, 17 bp, Homo sapiens
ggtgtgtccctggacac

SEQ ID NO: 3572693 - DNA, 18 bp, Homo sapiens
ggtgtgtccctggacaca

SEQ ID NO: 3572694 - DNA, 19 bp, Homo sapiens
ggtgtgtccctggacacag

SEQ ID NO: 3572695 - DNA, 13 bp, Homo sapiens
ggtgttctgctga

SEQ ID NO: 3572696 - DNA, 19 bp, Homo sapiens
ggtgttgcagccgcagaga

SEQ ID NO: 3572697 - DNA, 21 bp, Homo sapiens
ggtgttgcagccgcagagaaa

SEQ ID NO: 3572698 - DNA, 21 bp, Homo sapiens
ggtgtttggtttcttcattct

SEQ ID NO: 3572699 - DNA, 19 bp, Homo sapiens
ggttaaacattaatattta

SEQ ID NO: 3572700 - DNA, 18 bp, Homo sapiens
ggttaaatattttgctaa

SEQ ID NO: 3572701 - DNA, 17 bp, Homo sapiens
ggttaatcatatttgaa

SEQ ID NO: 3572702 - DNA, 22 bp, Homo sapiens
ggttaatcatatttgaaaacca

SEQ ID NO: 3572703 - DNA, 19 bp, Homo sapiens
ggttcaagtgactctcctg

SEQ ID NO: 3572704 - DNA, 15 bp, Homo sapiens
ggttcacctgtgact

SEQ ID NO: 3572705 - DNA, 18 bp, Homo sapiens
ggttcagacacagctctt

SEQ ID NO: 3572706 - DNA, 19 bp, Homo sapiens
ggttcagacacagctcttc

SEQ ID NO: 3572707 - DNA, 19 bp, Homo sapiens
ggttccccaagggccctgg

SEQ ID NO: 3572708 - DNA, 20 bp, Homo sapiens
ggttccccaagggccctggc

SEQ ID NO: 3572709 - DNA, 15 bp, Homo sapiens
ggttcccctgttcac

SEQ ID NO: 3572710 - DNA, 13 bp, Homo sapiens
ggttctaaggctc

SEQ ID NO: 3572711 - DNA, 19 bp, Homo sapiens
ggttctgtgtcctctgcct

SEQ ID NO: 3572712 - DNA, 18 bp, Homo sapiens
ggttctttcatttgcttt

SEQ ID NO: 3572713 - DNA, 17 bp, Homo sapiens
ggttctttcttcctctg

SEQ ID NO: 3572714 - DNA, 17 bp, Homo sapiens
ggttgatggaaaataaa

SEQ ID NO: 3572715 - DNA, 14 bp, Homo sapiens
ggttgcctgggggc

SEQ ID NO: 3572716 - DNA, 13 bp, Homo sapiens
ggttgctccattt

SEQ ID NO: 3572717 - DNA, 20 bp, Homo sapiens
ggttgctggtcctgcacatg

SEQ ID NO: 3572718 - DNA, 20 bp, Homo sapiens
ggttgctgttttcctccctt

SEQ ID NO: 3572719 - DNA, 19 bp, Homo sapiens
ggttgggagaatgtcagta

SEQ ID NO: 3572720 - DNA, 13 bp, Homo sapiens
ggtttataataaa

SEQ ID NO: 3572721 - DNA, 10 bp, Homo sapiens
ggtttattct

SEQ ID NO: 3572722 - DNA, 16 bp, Homo sapiens
ggtttcatgttagtta

SEQ ID NO: 3572723 - DNA, 14 bp, Homo sapiens
ggtttcgactggtc

SEQ ID NO: 3572724 - DNA, 16 bp, Homo sapiens
ggtttcgactggtcca

SEQ ID NO: 3572725 - DNA, 22 bp, Homo sapiens
ggtttcgactggtccagctctg

SEQ ID NO: 3572726 - DNA, 21 bp, Homo sapiens
ggtttctccatgttggtcagg

SEQ ID NO: 3572727 - DNA, 15 bp, Homo sapiens
ggtttgaaggagaat

SEQ ID NO: 3572728 - DNA, 16 bp, Homo sapiens
ggtttgggagccagga

SEQ ID NO: 3572729 - DNA, 22 bp, Homo sapiens
ggtttgggagccaggactccca

SEQ ID NO: 3572730 - DNA, 19 bp, Homo sapiens
ggttttattgtttaaaatc

SEQ ID NO: 3572731 - DNA, 15 bp, Homo sapiens
ggttttcagagaatt

SEQ ID NO: 3572732 - DNA, 21 bp, Homo sapiens
ggttttccaatcatttgacta

SEQ ID NO: 3572733 - DNA, 15 bp, Homo sapiens
ggtttttcaattaaa

SEQ ID NO: 3572734 - DNA, 20 bp, Homo sapiens
ggtttttttctttggctgca

SEQ ID NO: 3572735 - DNA, 22 bp, Homo sapiens
gtaaaaaaaaaaaaaagcaaca

SEQ ID NO: 3572736 - DNA, 18 bp, Homo sapiens
gtaaaaatgaaggaatta

SEQ ID NO: 3572737 - DNA, 17 bp, Homo sapiens
gtaaaaatgagtcattt

SEQ ID NO: 3572738 - DNA, 23 bp, Homo sapiens
gtaaaatgctggtgaaatgctgt

SEQ ID NO: 3572739 - DNA, 14 bp, Homo sapiens
gtaaacagggtacc

SEQ ID NO: 3572740 - DNA, 20 bp, Homo sapiens
gtaaacgctgtccctagtaa

SEQ ID NO: 3572741 - DNA, 16 bp, Homo sapiens
gtaaactcaaaatatt

SEQ ID NO: 3572742 - DNA, 17 bp, Homo sapiens
gtaaagcagttcctgtc

SEQ ID NO: 3572743 - DNA, 19 bp, Homo sapiens
gtaaatcctagacttgaaa

SEQ ID NO: 3572744 - DNA, 16 bp, Homo sapiens
gtaaatggttaaattt

SEQ ID NO: 3572745 - DNA, 24 bp, Homo sapiens
gtaaatgtgtttcttgctgccatg

SEQ ID NO: 3572746 - DNA, 18 bp, Homo sapiens
gtaacaagaaagtggtct

SEQ ID NO: 3572747 - DNA, 22 bp, Homo sapiens
gtaacaggtattttgtttcttt

SEQ ID NO: 3572748 - DNA, 14 bp, Homo sapiens
gtaaccctggtggt

SEQ ID NO: 3572749 - DNA, 14 bp, Homo sapiens
gtaactgagagaaa

SEQ ID NO: 3572750 - DNA, 17 bp, Homo sapiens
gtaactgtcctgtcctg

SEQ ID NO: 3572751 - DNA, 14 bp, Homo sapiens
gtaacttcctgctg

SEQ ID NO: 3572752 - DNA, 20 bp, Homo sapiens
gtaacttcctgctgcaccct

SEQ ID NO: 3572753 - DNA, 16 bp, Homo sapiens
gtaacttcctgtggat

SEQ ID NO: 3572754 - DNA, 17 bp, Homo sapiens
gtaacttcctgtggatg

SEQ ID NO: 3572755 - DNA, 21 bp, Homo sapiens
gtaacttgagattcaagacaa

SEQ ID NO: 3572756 - DNA, 13 bp, Homo sapiens
gtaagaaatacag

SEQ ID NO: 3572757 - DNA, 16 bp, Homo sapiens
gtaagctttgttctgg

SEQ ID NO: 3572758 - DNA, 10 bp, Homo sapiens
gtaaggctgt

SEQ ID NO: 3572759 - DNA, 15 bp, Homo sapiens
gtaagggcagtgccc

SEQ ID NO: 3572760 - DNA, 16 bp, Homo sapiens
gtaagttatctttgaa

SEQ ID NO: 3572761 - DNA, 21 bp, Homo sapiens
gtaagttctgtggttccagta

SEQ ID NO: 3572762 - DNA, 11 bp, Homo sapiens
gtaataaactc

SEQ ID NO: 3572763 - DNA, 10 bp, Homo sapiens
gtaataaaga

SEQ ID NO: 3572764 - DNA, 13 bp, Homo sapiens
gtaataaagagaa

SEQ ID NO: 3572765 - DNA, 16 bp, Homo sapiens
gtaataataaagaata

SEQ ID NO: 3572766 - DNA, 16 bp, Homo sapiens
gtaataatagactgta

SEQ ID NO: 3572767 - DNA, 20 bp, Homo sapiens
gtaatattgacttgtatatt

SEQ ID NO: 3572768 - DNA, 13 bp, Homo sapiens
gtaatatttttat

SEQ ID NO: 3572769 - DNA, 12 bp, Homo sapiens
gtaatgctgcac

SEQ ID NO: 3572770 - DNA, 21 bp, Homo sapiens
gtaatgctgcctcaggaccca

SEQ ID NO: 3572771 - DNA, 23 bp, Homo sapiens
gtaatgtttttatttcaattgtt

SEQ ID NO: 3572772 - DNA, 12 bp, Homo sapiens
gtaattgctttt

SEQ ID NO: 3572773 - DNA, 14 bp, Homo sapiens
gtaattgtacaata

SEQ ID NO: 3572774 - DNA, 15 bp, Homo sapiens
gtaattgtacaataa

SEQ ID NO: 3572775 - DNA, 17 bp, Homo sapiens
gtaattgtacaataaat

SEQ ID NO: 3572776 - DNA, 19 bp, Homo sapiens
gtaattgtacaataaattt

SEQ ID NO: 3572777 - DNA, 23 bp, Homo sapiens
gtaatttaaaattgtgatgtgtc

SEQ ID NO: 3572778 - DNA, 18 bp, Homo sapiens
gtaatttaatttgtaaaa

SEQ ID NO: 3572779 - DNA, 16 bp, Homo sapiens
gtaatttgaggacaac

SEQ ID NO: 3572780 - DNA, 16 bp, Homo sapiens
gtaattttgtgtaaga

SEQ ID NO: 3572781 - DNA, 17 bp, Homo sapiens
gtacaaatgtttttcat

SEQ ID NO: 3572782 - DNA, 10 bp, Homo sapiens
gtacaataaa

SEQ ID NO: 3572783 - DNA, 16 bp, Homo sapiens
gtacaatgtacacact

SEQ ID NO: 3572784 - DNA, 18 bp, Homo sapiens
gtacacaataagcaaaaa

SEQ ID NO: 3572785 - DNA, 20 bp, Homo sapiens
ggctgtgtcctaaggcccat

SEQ ID NO: 3572786 - DNA, 21 bp, Homo sapiens
ggctgttaaaaaaaagatgag

SEQ ID NO: 3572787 - DNA, 21 bp, Homo sapiens
ggcttcaaaaagccacagcag

SEQ ID NO: 3572788 - DNA, 23 bp, Homo sapiens
ggcttcaaaaagccacagcagag

SEQ ID NO: 3572789 - DNA, 18 bp, Homo sapiens
ggcttcaacagccaagct

SEQ ID NO: 3572790 - DNA, 15 bp, Homo sapiens
ggcttccccactccc

SEQ ID NO: 3572791 - DNA, 15 bp, Homo sapiens
ggcttccctggaagc

SEQ ID NO: 3572792 - DNA, 22 bp, Homo sapiens
ggcttccctggaagctctccga

SEQ ID NO: 3572793 - DNA, 22 bp, Homo sapiens
ggcttcgcgctggaatccagaa

SEQ ID NO: 3572794 - DNA, 16 bp, Homo sapiens
ggcttctcctcctctg

SEQ ID NO: 3572795 - DNA, 21 bp, Homo sapiens
ggcttctccttctccttccca

SEQ ID NO: 3572796 - DNA, 19 bp, Homo sapiens
ggcttggggattgtacacg

SEQ ID NO: 3572797 - DNA, 21 bp, Homo sapiens
ggcttggggattgtacacggg

SEQ ID NO: 3572798 - DNA, 22 bp, Homo sapiens
ggcttgtgatttccatttctga

SEQ ID NO: 3572799 - DNA, 17 bp, Homo sapiens
ggctttatgcaaataca

SEQ ID NO: 3572800 - DNA, 18 bp, Homo sapiens
ggctttatgcaaatacaa

SEQ ID NO: 3572801 - DNA, 23 bp, Homo sapiens
ggctttcaggagctccatacaca

SEQ ID NO: 3572802 - DNA, 15 bp, Homo sapiens
ggctttgcccacccc

SEQ ID NO: 3572803 - DNA, 12 bp, Homo sapiens
ggctttgcctct

SEQ ID NO: 3572804 - DNA, 15 bp, Homo sapiens
ggctttgcctcttct

SEQ ID NO: 3572805 - DNA, 20 bp, Homo sapiens
ggcttttactgaagcctttc

SEQ ID NO: 3572806 - DNA, 14 bp, Homo sapiens
ggcttttcactgct

SEQ ID NO: 3572807 - DNA, 15 bp, Homo sapiens
ggcttttcactgctg

SEQ ID NO: 3572808 - DNA, 20 bp, Homo sapiens
gggaaaaagttgatgtcaat

SEQ ID NO: 3572809 - DNA, 13 bp, Homo sapiens
gggaaaaggcagg

SEQ ID NO: 3572810 - DNA, 23 bp, Homo sapiens
gggaaacagagtccaatttaagg

SEQ ID NO: 3572811 - DNA, 14 bp, Homo sapiens
gggaaagcctctgg

SEQ ID NO: 3572812 - DNA, 19 bp, Homo sapiens
gggaaaggatggagtgttt

SEQ ID NO: 3572813 - DNA, 16 bp, Homo sapiens
gggaacactgagaaag

SEQ ID NO: 3572814 - DNA, 15 bp, Homo sapiens
gggaaccactcccac

SEQ ID NO: 3572815 - DNA, 16 bp, Homo sapiens
gggaaccccagggggc

SEQ ID NO: 3572816 - DNA, 14 bp, Homo sapiens
gggaagctcccacc

SEQ ID NO: 3572817 - DNA, 19 bp, Homo sapiens
gggaagctcccaccccact

SEQ ID NO: 3572818 - DNA, 14 bp, Homo sapiens
gggaagggagccaa

SEQ ID NO: 3572819 - DNA, 16 bp, Homo sapiens
gggaagggagccaagg

SEQ ID NO: 3572820 - DNA, 15 bp, Homo sapiens
gggaagttcagcaag

SEQ ID NO: 3572821 - DNA, 23 bp, Homo sapiens
gggaataatttccttcaggcagc

SEQ ID NO: 3572822 - DNA, 23 bp, Homo sapiens
gggaatagtctagatggctcctc

SEQ ID NO: 3572823 - DNA, 14 bp, Homo sapiens
gggaatcagaactc

SEQ ID NO: 3572824 - DNA, 22 bp, Homo sapiens
gggaatctagcccaacctacat

SEQ ID NO: 3572825 - DNA, 16 bp, Homo sapiens
gggaattccctccccc

SEQ ID NO: 3572826 - DNA, 18 bp, Homo sapiens
gggaattccctccccctc

SEQ ID NO: 3572827 - DNA, 17 bp, Homo sapiens
gggacagaggccccagc

SEQ ID NO: 3572828 - DNA, 18 bp, Homo sapiens
gggacagaggccccagcc

SEQ ID NO: 3572829 - DNA, 19 bp, Homo sapiens
gggacagccattttccaac

SEQ ID NO: 3572830 - DNA, 14 bp, Homo sapiens
gggacagctggctg

SEQ ID NO: 3572831 - DNA, 16 bp, Homo sapiens
gggacagctggctggg

SEQ ID NO: 3572832 - DNA, 20 bp, Homo sapiens
gggacagcttcctcacaccc

SEQ ID NO: 3572833 - DNA, 15 bp, Homo sapiens
gggacaggaccccag

SEQ ID NO: 3572834 - DNA, 21 bp, Homo sapiens
gggacaggcccgcttgctggg

SEQ ID NO: 3572835 - DNA, 21 bp, Homo sapiens
gggacattgttctttccggcc

SEQ ID NO: 3572836 - DNA, 16 bp, Homo sapiens
gggaccactgggtgag

SEQ ID NO: 3572837 - DNA, 23 bp, Homo sapiens
gggctgggccctctttccctgcg

SEQ ID NO: 3572838 - DNA, 14 bp, Homo sapiens
gggctggggcctca

SEQ ID NO: 3572839 - DNA, 13 bp, Homo sapiens
gggctgggggagg

SEQ ID NO: 3572840 - DNA, 16 bp, Homo sapiens
gggctgtgccaacctg

SEQ ID NO: 3572841 - DNA, 22 bp, Homo sapiens
gggcttcaacagccaagctggc

SEQ ID NO: 3572842 - DNA, 12 bp, Homo sapiens
gggcttggccca

SEQ ID NO: 3572843 - DNA, 12 bp, Homo sapiens
gggctttctctt

SEQ ID NO: 3572844 - DNA, 24 bp, Homo sapiens
gggctttgggaagtttgctgtgct

SEQ ID NO: 3572845 - DNA, 19 bp, Homo sapiens
gggctttggttccttctct

SEQ ID NO: 3572846 - DNA, 21 bp, Homo sapiens
gggctttggttccttctctgg

SEQ ID NO: 3572847 - DNA, 22 bp, Homo sapiens
gggctttggttccttctctggg

SEQ ID NO: 3572848 - DNA, 21 bp, Homo sapiens
ggggaactcagatccagggac

SEQ ID NO: 3572849 - DNA, 12 bp, Homo sapiens
ggggaagacagt

SEQ ID NO: 3572850 - DNA, 14 bp, Homo sapiens
ggggactttattta

SEQ ID NO: 3572851 - DNA, 12 bp, Homo sapiens
ggggagaaaccc

SEQ ID NO: 3572852 - DNA, 16 bp, Homo sapiens
ggggagaaacccagag

SEQ ID NO: 3572853 - DNA, 14 bp, Homo sapiens
ggggagatggggag

SEQ ID NO: 3572854 - DNA, 17 bp, Homo sapiens
ggggagatggggaggag

SEQ ID NO: 3572855 - DNA, 21 bp, Homo sapiens
ggggagcaaaagaaacaccag

SEQ ID NO: 3572856 - DNA, 12 bp, Homo sapiens
ggggagcccagt

SEQ ID NO: 3572857 - DNA, 11 bp, Homo sapiens
ggggagccctc

SEQ ID NO: 3572858 - DNA, 15 bp, Homo sapiens
ggggaggccatctgg

SEQ ID NO: 3572859 - DNA, 15 bp, Homo sapiens
ggggaggcgcacagt

SEQ ID NO: 3572860 - DNA, 18 bp, Homo sapiens
ggggagggaagggagcca

SEQ ID NO: 3572861 - DNA, 20 bp, Homo sapiens
ggggagggaagggagccaag

SEQ ID NO: 3572862 - DNA, 14 bp, Homo sapiens
ggggatccagccac

SEQ ID NO: 3572863 - DNA, 20 bp, Homo sapiens
ggggatcttcccacaggagg

SEQ ID NO: 3572864 - DNA, 14 bp, Homo sapiens
ggggatgttctgcc

SEQ ID NO: 3572865 - DNA, 23 bp, Homo sapiens
ggggatttcaaacttaaacaaaa

SEQ ID NO: 3572866 - DNA, 19 bp, Homo sapiens
ggggcaagacagaaaagtg

SEQ ID NO: 3572867 - DNA, 21 bp, Homo sapiens
ggggcagatgttcccggagca

SEQ ID NO: 3572868 - DNA, 19 bp, Homo sapiens
ggggcaggccagggcagtt

SEQ ID NO: 3572869 - DNA, 21 bp, Homo sapiens
ggggccaacctcaggctccta

SEQ ID NO: 3572870 - DNA, 13 bp, Homo sapiens
ggggccagatcca

SEQ ID NO: 3572871 - DNA, 14 bp, Homo sapiens
ggggccagatccag

SEQ ID NO: 3572872 - DNA, 17 bp, Homo sapiens
ggggccagatccagcct

SEQ ID NO: 3572873 - DNA, 21 bp, Homo sapiens
ggggccataaacggttcctgg

SEQ ID NO: 3572874 - DNA, 23 bp, Homo sapiens
ggggccccacctcggcacacact

SEQ ID NO: 3572875 - DNA, 19 bp, Homo sapiens
ggggcccgacaggtgggcc

SEQ ID NO: 3572876 - DNA, 21 bp, Homo sapiens
ggggcccgacaggtgggcctg

SEQ ID NO: 3572877 - DNA, 13 bp, Homo sapiens
ggggcccggccag

SEQ ID NO: 3572878 - DNA, 10 bp, Homo sapiens
ggggccctgc

SEQ ID NO: 3572879 - DNA, 16 bp, Homo sapiens
ggggccctgccccacc

SEQ ID NO: 3572880 - DNA, 16 bp, Homo sapiens
ggggccctggccagga

SEQ ID NO: 3572881 - DNA, 18 bp, Homo sapiens
ggggccgccacggcctgg

SEQ ID NO: 3572882 - DNA, 19 bp, Homo sapiens
ggggccgccacggcctggc

SEQ ID NO: 3572883 - DNA, 20 bp, Homo sapiens
ggggcgtctgttcccccttc

SEQ ID NO: 3572884 - DNA, 15 bp, Homo sapiens
ggggctgcacctcct

SEQ ID NO: 3572885 - DNA, 23 bp, Homo sapiens
ggggctgcacctcctaccctccc

SEQ ID NO: 3572886 - DNA, 16 bp, Homo sapiens
ggggctgcaggcaggc

SEQ ID NO: 3572887 - DNA, 12 bp, Homo sapiens
ggggctggggga

SEQ ID NO: 3572888 - DNA, 23 bp, Homo sapiens
ggggctgtcctgccacccagccc

SEQ ID NO: 3572889 - DNA, 12 bp, Homo sapiens
ggggctgtgcca

SEQ ID NO: 3572890 - DNA, 14 bp, Homo sapiens
ggggctgtgccaac

SEQ ID NO: 3572891 - DNA, 19 bp, Homo sapiens
gggggaacactgagaaaga

SEQ ID NO: 3572892 - DNA, 22 bp, Homo sapiens
gggggaacactgagaaagaggc

SEQ ID NO: 3572893 - DNA, 22 bp, Homo sapiens
gggggagccggtaactgtcctg

SEQ ID NO: 3572894 - DNA, 13 bp, Homo sapiens
gggggagtgggcg

SEQ ID NO: 3572895 - DNA, 23 bp, Homo sapiens
gggggtcctctctgagtcaaatc

SEQ ID NO: 3572896 - DNA, 15 bp, Homo sapiens
gggggtgctgctctc

SEQ ID NO: 3572897 - DNA, 16 bp, Homo sapiens
ggggtaaggtgcatct

SEQ ID NO: 3572898 - DNA, 21 bp, Homo sapiens
ggggtcatgccctcctctccc

SEQ ID NO: 3572899 - DNA, 18 bp, Homo sapiens
ggggtccctccaccccac

SEQ ID NO: 3572900 - DNA, 13 bp, Homo sapiens
ggggtcctctctg

SEQ ID NO: 3572901 - DNA, 14 bp, Homo sapiens
ggggtcctctctga

SEQ ID NO: 3572902 - DNA, 18 bp, Homo sapiens
ggggtcctctctgagtca

SEQ ID NO: 3572903 - DNA, 20 bp, Homo sapiens
ggggtcctctctgagtcaaa

SEQ ID NO: 3572904 - DNA, 11 bp, Homo sapiens
ggggtcctggc

SEQ ID NO: 3572905 - DNA, 14 bp, Homo sapiens
ggggtcctggccat

SEQ ID NO: 3572906 - DNA, 14 bp, Homo sapiens
ggggtgaggagctg

SEQ ID NO: 3572907 - DNA, 17 bp, Homo sapiens
ggggtgcatctcctccc

SEQ ID NO: 3572908 - DNA, 16 bp, Homo sapiens
ggggtgccgctctctc

SEQ ID NO: 3572909 - DNA, 19 bp, Homo sapiens
ggggtgcggcggtcccagc

SEQ ID NO: 3572910 - DNA, 23 bp, Homo sapiens
ggggtggaatgccgctgtctctg

SEQ ID NO: 3572911 - DNA, 22 bp, Homo sapiens
ggggtggcccgaaagggtctcc

SEQ ID NO: 3572912 - DNA, 13 bp, Homo sapiens
ggggtgggccagg

SEQ ID NO: 3572913 - DNA, 17 bp, Homo sapiens
ggggtgggccaggctga

SEQ ID NO: 3572914 - DNA, 22 bp, Homo sapiens
ggggtgtaacttcctgctgcac

SEQ ID NO: 3572915 - DNA, 19 bp, Homo sapiens
ggggtttgtgtttgattgg

SEQ ID NO: 3572916 - DNA, 17 bp, Homo sapiens
gggtaaagtttgctcta

SEQ ID NO: 3572917 - DNA, 18 bp, Homo sapiens
gggtaattgtacaataaa

SEQ ID NO: 3572918 - DNA, 19 bp, Homo sapiens
gggtacctggtccccactg

SEQ ID NO: 3572919 - DNA, 10 bp, Homo sapiens
gggtattttt

SEQ ID NO: 3572920 - DNA, 21 bp, Homo sapiens
gggtcagcatccagtgtgaga

SEQ ID NO: 3572921 - DNA, 21 bp, Homo sapiens
gggtcatgccctcctctccca

SEQ ID NO: 3572922 - DNA, 18 bp, Homo sapiens
gggtcattcatggcctgg

SEQ ID NO: 3572923 - DNA, 12 bp, Homo sapiens
gggtccacagct

SEQ ID NO: 3572924 - DNA, 19 bp, Homo sapiens
gggtccaggagagcctggg

SEQ ID NO: 3572925 - DNA, 18 bp, Homo sapiens
gggtccctgaacgccctg

SEQ ID NO: 3572926 - DNA, 12 bp, Homo sapiens
gggtcctctctg

SEQ ID NO: 3572927 - DNA, 22 bp, Homo sapiens
gggtcctctctgagtcaaatcc

SEQ ID NO: 3572928 - DNA, 17 bp, Homo sapiens
gggtcctggccatccca

SEQ ID NO: 3572929 - DNA, 13 bp, Homo sapiens
gtgaagaggtctg

SEQ ID NO: 3572930 - DNA, 19 bp, Homo sapiens
gtgaagcctaccagaagaa

SEQ ID NO: 3572931 - DNA, 12 bp, Homo sapiens
gtgaaggaccct

SEQ ID NO: 3572932 - DNA, 21 bp, Homo sapiens
gtgaagtccttcagtgagccc

SEQ ID NO: 3572933 - DNA, 15 bp, Homo sapiens
gtgaagttcatcttg

SEQ ID NO: 3572934 - DNA, 18 bp, Homo sapiens
gtgaagttcatcttgcag

SEQ ID NO: 3572935 - DNA, 19 bp, Homo sapiens
gtgaagtttaattgtctca

SEQ ID NO: 3572936 - DNA, 13 bp, Homo sapiens
gtgaataaatgtc

SEQ ID NO: 3572937 - DNA, 16 bp, Homo sapiens
gtgaataaatgtcttg

SEQ ID NO: 3572938 - DNA, 23 bp, Homo sapiens
gtgaatacttattttcagtgcat

SEQ ID NO: 3572939 - DNA, 15 bp, Homo sapiens
gtgaatatttttgta

SEQ ID NO: 3572940 - DNA, 18 bp, Homo sapiens
gtgaatctgtctatctgt

SEQ ID NO: 3572941 - DNA, 23 bp, Homo sapiens
gtgaattcattctggaggggcag

SEQ ID NO: 3572942 - DNA, 13 bp, Homo sapiens
gtgacaaaattca

SEQ ID NO: 3572943 - DNA, 17 bp, Homo sapiens
gtgacaaaattcatttg

SEQ ID NO: 3572944 - DNA, 17 bp, Homo sapiens
gtgacaaagcaatttac

SEQ ID NO: 3572945 - DNA, 21 bp, Homo sapiens
gtgacagactttggacagtgg

SEQ ID NO: 3572946 - DNA, 18 bp, Homo sapiens
gtgacaggctcgtcagcc

SEQ ID NO: 3572947 - DNA, 20 bp, Homo sapiens
gtgacaggctcgtcagccac

SEQ ID NO: 3572948 - DNA, 12 bp, Homo sapiens
gtgacatttctc

SEQ ID NO: 3572949 - DNA, 23 bp, Homo sapiens
gtgacccccttgattcccaccgt

SEQ ID NO: 3572950 - DNA, 15 bp, Homo sapiens
gtgaccctgggcagt

SEQ ID NO: 3572951 - DNA, 13 bp, Homo sapiens
gtgacgctgctga

SEQ ID NO: 3572952 - DNA, 21 bp, Homo sapiens
gtgactatggagctgagcagg

SEQ ID NO: 3572953 - DNA, 20 bp, Homo sapiens
gtgactcagcatcacccacc

SEQ ID NO: 3572954 - DNA, 11 bp, Homo sapiens
gtgactccagg

SEQ ID NO: 3572955 - DNA, 13 bp, Homo sapiens
gtgactccagggt

SEQ ID NO: 3572956 - DNA, 12 bp, Homo sapiens
gtgactcctgct

SEQ ID NO: 3572957 - DNA, 20 bp, Homo sapiens
gtgactcctgctggtacctg

SEQ ID NO: 3572958 - DNA, 22 bp, Homo sapiens
gtgactcctgctggtacctgcc

SEQ ID NO: 3572959 - DNA, 18 bp, Homo sapiens
gtgactccttatctcttt

SEQ ID NO: 3572960 - DNA, 20 bp, Homo sapiens
gtgactccttatctctttcc

SEQ ID NO: 3572961 - DNA, 22 bp, Homo sapiens
gtgagaaagggattgctgaggc

SEQ ID NO: 3572962 - DNA, 11 bp, Homo sapiens
gtgagaatggc

SEQ ID NO: 3572963 - DNA, 15 bp, Homo sapiens
gtgagaatggcctgg

SEQ ID NO: 3572964 - DNA, 16 bp, Homo sapiens
gtgagagaaagagaga

SEQ ID NO: 3572965 - DNA, 21 bp, Homo sapiens
gtgagagaaagagagaagcca

SEQ ID NO: 3572966 - DNA, 22 bp, Homo sapiens
gtgagagaaagagagaagccag

SEQ ID NO: 3572967 - DNA, 13 bp, Homo sapiens
gtgagagaattta

SEQ ID NO: 3572968 - DNA, 17 bp, Homo sapiens
gtgagcacaaagaagaa

SEQ ID NO: 3572969 - DNA, 19 bp, Homo sapiens
gtgagcacacccgtgtgca

SEQ ID NO: 3572970 - DNA, 13 bp, Homo sapiens
gtgagcagtgttg

SEQ ID NO: 3572971 - DNA, 13 bp, Homo sapiens
gtgaggagagagg

SEQ ID NO: 3572972 - DNA, 23 bp, Homo sapiens
gtgagggccaccggtgggcagtg

SEQ ID NO: 3572973 - DNA, 22 bp, Homo sapiens
gtgaggggctttctcttcccct

SEQ ID NO: 3572974 - DNA, 15 bp, Homo sapiens
gtgagggtcctgcag

SEQ ID NO: 3572975 - DNA, 14 bp, Homo sapiens
gtgagtcacctgct

SEQ ID NO: 3572976 - DNA, 23 bp, Homo sapiens
gtgagtcacctgctccagaagat

SEQ ID NO: 3572977 - DNA, 13 bp, Homo sapiens
gtgagtcattatg

SEQ ID NO: 3572978 - DNA, 17 bp, Homo sapiens
gtgagtcatttaaatgt

SEQ ID NO: 3572979 - DNA, 21 bp, Homo sapiens
gtgatatataagtgtacatat

SEQ ID NO: 3572980 - DNA, 23 bp, Homo sapiens
gtgatatataagtgtacatatgt

SEQ ID NO: 3572981 - DNA, 19 bp, Homo sapiens
gtgatcctgttctgcgctg

SEQ ID NO: 3572982 - DNA, 14 bp, Homo sapiens
gtgatctgctgctg

SEQ ID NO: 3572983 - DNA, 22 bp, Homo sapiens
gtgatggttcccctgttcactc

SEQ ID NO: 3572984 - DNA, 18 bp, Homo sapiens
gtgattctcagggctgga

SEQ ID NO: 3572985 - DNA, 17 bp, Homo sapiens
gtgattgacagctttgc

SEQ ID NO: 3572986 - DNA, 22 bp, Homo sapiens
gtgattgacagctttgctgctg

SEQ ID NO: 3572987 - DNA, 23 bp, Homo sapiens
gtgattgtaacaaattgatctgt

SEQ ID NO: 3572988 - DNA, 12 bp, Homo sapiens
gtgatttttgtt

SEQ ID NO: 3572989 - DNA, 16 bp, Homo sapiens
gtgcaaaggtgtgctt

SEQ ID NO: 3572990 - DNA, 22 bp, Homo sapiens
gtgcaataaatctgacccagtg

SEQ ID NO: 3572991 - DNA, 17 bp, Homo sapiens
gtgcaatcacagctcac

SEQ ID NO: 3572992 - DNA, 15 bp, Homo sapiens
gtgcacaaatattta

SEQ ID NO: 3572993 - DNA, 23 bp, Homo sapiens
gtgcacaacccaccacccccttt

SEQ ID NO: 3572994 - DNA, 17 bp, Homo sapiens
gtgcacatctgttttgt

SEQ ID NO: 3572995 - DNA, 22 bp, Homo sapiens
gtgcacgcaggcacagcagctg

SEQ ID NO: 3572996 - DNA, 12 bp, Homo sapiens
gtgcactccaga

SEQ ID NO: 3572997 - DNA, 15 bp, Homo sapiens
gtgcagcatttcact

SEQ ID NO: 3572998 - DNA, 16 bp, Homo sapiens
gtgcagcatttcactt

SEQ ID NO: 3572999 - DNA, 15 bp, Homo sapiens
gtgcagccatagttt

SEQ ID NO: 3573000 - DNA, 19 bp, Homo sapiens
gtgcagccccagggcctgc

SEQ ID NO: 3573001 - DNA, 15 bp, Homo sapiens
gtgcagcctgtcctg

SEQ ID NO: 3573002 - DNA, 17 bp, Homo sapiens
gtgcagccttcccctcc

SEQ ID NO: 3573003 - DNA, 15 bp, Homo sapiens
gtgcagctcatgttt

SEQ ID NO: 3573004 - DNA, 14 bp, Homo sapiens
gtgcagctcctcag

SEQ ID NO: 3573005 - DNA, 15 bp, Homo sapiens
gtgcagctcctcagc

SEQ ID NO: 3573006 - DNA, 21 bp, Homo sapiens
gtgcagtttggtgtgtcctcc

SEQ ID NO: 3573007 - DNA, 14 bp, Homo sapiens
gtgcatctcagccc

SEQ ID NO: 3573008 - DNA, 22 bp, Homo sapiens
gtgcatctcctcccgcccttcc

SEQ ID NO: 3573009 - DNA, 22 bp, Homo sapiens
gtgcatgctagtgttgtatttc

SEQ ID NO: 3573010 - DNA, 13 bp, Homo sapiens
gtgccaacctgtt

SEQ ID NO: 3573011 - DNA, 14 bp, Homo sapiens
gtgccaactgccag

SEQ ID NO: 3573012 - DNA, 15 bp, Homo sapiens
gtgccacttaatgta

SEQ ID NO: 3573013 - DNA, 15 bp, Homo sapiens
gtgccagaggccaga

SEQ ID NO: 3573014 - DNA, 21 bp, Homo sapiens
gtgccagcaagtccttaggct

SEQ ID NO: 3573015 - DNA, 23 bp, Homo sapiens
gtgcccaagaatagatgctgact

SEQ ID NO: 3573016 - DNA, 21 bp, Homo sapiens
gtgcccagggccagtgggacc

SEQ ID NO: 3573017 - DNA, 14 bp, Homo sapiens
gtgccccaggacca

SEQ ID NO: 3573018 - DNA, 19 bp, Homo sapiens
gtgccccaggaccagctca

SEQ ID NO: 3573019 - DNA, 21 bp, Homo sapiens
gtgcccctaaagagcatcctg

SEQ ID NO: 3573020 - DNA, 22 bp, Homo sapiens
gtgcccctaaagagcatcctga

SEQ ID NO: 3573021 - DNA, 23 bp, Homo sapiens
gtgcccgactgactggaggaggc

SEQ ID NO: 3573022 - DNA, 17 bp, Homo sapiens
gtgcccgcatgtgtgcc

SEQ ID NO: 3573023 - DNA, 19 bp, Homo sapiens
gtgcccgcatgtgtgcctg

SEQ ID NO: 3573024 - DNA, 23 bp, Homo sapiens
gtgccgaccacgccccaggacct

SEQ ID NO: 3573025 - DNA, 24 bp, Homo sapiens
gtgccgaccacgccccaggacctc

SEQ ID NO: 3573026 - DNA, 15 bp, Homo sapiens
gtgcctatctgcctg

SEQ ID NO: 3573027 - DNA, 19 bp, Homo sapiens
gtgcctatctgcctggagg

SEQ ID NO: 3573028 - DNA, 22 bp, Homo sapiens
gtgcctccacatgctgcctggc

SEQ ID NO: 3573029 - DNA, 12 bp, Homo sapiens
gtgcctctgcct

SEQ ID NO: 3573030 - DNA, 13 bp, Homo sapiens
gtgcctctgcctg

SEQ ID NO: 3573031 - DNA, 12 bp, Homo sapiens
gtgcctctggga

SEQ ID NO: 3573032 - DNA, 15 bp, Homo sapiens
gtgcctctgggactg

SEQ ID NO: 3573033 - DNA, 12 bp, Homo sapiens
gtgcctgggctc

SEQ ID NO: 3573034 - DNA, 11 bp, Homo sapiens
gtgcctttcct

SEQ ID NO: 3573035 - DNA, 14 bp, Homo sapiens
gtgcctttcctatc

SEQ ID NO: 3573036 - DNA, 14 bp, Homo sapiens
gtgcctttctttgc

SEQ ID NO: 3573037 - DNA, 17 bp, Homo sapiens
gtgcctttctttgcctc

SEQ ID NO: 3573038 - DNA, 14 bp, Homo sapiens
gtgccttttgccat

SEQ ID NO: 3573039 - DNA, 14 bp, Homo sapiens
gtgcggctgtgcag

SEQ ID NO: 3573040 - DNA, 16 bp, Homo sapiens
gtgctaaaaatgaaaa

SEQ ID NO: 3573041 - DNA, 20 bp, Homo sapiens
gtgctacaaaaacacagcaa

SEQ ID NO: 3573042 - DNA, 22 bp, Homo sapiens
gtgctacaaaaacacagcaagg

SEQ ID NO: 3573043 - DNA, 18 bp, Homo sapiens
gtgctagatccagcccaa

SEQ ID NO: 3573044 - DNA, 15 bp, Homo sapiens
gtgctatgaaacaat

SEQ ID NO: 3573045 - DNA, 14 bp, Homo sapiens
gtgctcatgctgct

SEQ ID NO: 3573046 - DNA, 20 bp, Homo sapiens
gtgctcccaaaacattttaa

SEQ ID NO: 3573047 - DNA, 19 bp, Homo sapiens
gtgctctggcaccatcagc

SEQ ID NO: 3573048 - DNA, 12 bp, Homo sapiens
gtgctctggtct

SEQ ID NO: 3573049 - DNA, 18 bp, Homo sapiens
gtgctcttcccactccag

SEQ ID NO: 3573050 - DNA, 22 bp, Homo sapiens
gtgctcttggctgacccctctg

SEQ ID NO: 3573051 - DNA, 20 bp, Homo sapiens
gtccttactcccccaccact

SEQ ID NO: 3573052 - DNA, 15 bp, Homo sapiens
gtccttaggctactg

SEQ ID NO: 3573053 - DNA, 20 bp, Homo sapiens
gtccttcagtgagcccctcc

SEQ ID NO: 3573054 - DNA, 22 bp, Homo sapiens
gtccttcagtgagcccctcccc

SEQ ID NO: 3573055 - DNA, 19 bp, Homo sapiens
gtccttccctgttctccct

SEQ ID NO: 3573056 - DNA, 20 bp, Homo sapiens
gtccttccctgttctccctt

SEQ ID NO: 3573057 - DNA, 14 bp, Homo sapiens
gtccttggctcccg

SEQ ID NO: 3573058 - DNA, 20 bp, Homo sapiens
gtcctttcccaccattcctg

SEQ ID NO: 3573059 - DNA, 16 bp, Homo sapiens
gtcctttgtctttctt

SEQ ID NO: 3573060 - DNA, 20 bp, Homo sapiens
gtcgaggccacattgctggc

SEQ ID NO: 3573061 - DNA, 14 bp, Homo sapiens
gtcgcctgcctgca

SEQ ID NO: 3573062 - DNA, 17 bp, Homo sapiens
gtcgctgtgccacaggc

SEQ ID NO: 3573063 - DNA, 22 bp, Homo sapiens
gtcggagaggcgtttggagaag

SEQ ID NO: 3573064 - DNA, 18 bp, Homo sapiens
gtcggagtgcctggagtc

SEQ ID NO: 3573065 - DNA, 13 bp, Homo sapiens
gtcggatctcaca

SEQ ID NO: 3573066 - DNA, 14 bp, Homo sapiens
gtcggatctcacag

SEQ ID NO: 3573067 - DNA, 14 bp, Homo sapiens
gtcggccccatctc

SEQ ID NO: 3573068 - DNA, 13 bp, Homo sapiens
gtcgggcagccag

SEQ ID NO: 3573069 - DNA, 23 bp, Homo sapiens
gtcgggtgggggagggaaaggga

SEQ ID NO: 3573070 - DNA, 23 bp, Homo sapiens
gtcgggttttattgtttaaaatc

SEQ ID NO: 3573071 - DNA, 17 bp, Homo sapiens
gtcggtcctggtgccct

SEQ ID NO: 3573072 - DNA, 18 bp, Homo sapiens
gtcggtcctggtgccctg

SEQ ID NO: 3573073 - DNA, 18 bp, Homo sapiens
gtcgtgggaaaggggagt

SEQ ID NO: 3573074 - DNA, 16 bp, Homo sapiens
gtcgttgttgtggaag

SEQ ID NO: 3573075 - DNA, 13 bp, Homo sapiens
gtctaaattttct

SEQ ID NO: 3573076 - DNA, 18 bp, Homo sapiens
gtctactgcaagagccaa

SEQ ID NO: 3573077 - DNA, 15 bp, Homo sapiens
gtctagatggctcct

SEQ ID NO: 3573078 - DNA, 20 bp, Homo sapiens
gtctagatggctcctctcag

SEQ ID NO: 3573079 - DNA, 21 bp, Homo sapiens
gtctagatggctcctctcagt

SEQ ID NO: 3573080 - DNA, 16 bp, Homo sapiens
gtctaggcactgagca

SEQ ID NO: 3573081 - DNA, 17 bp, Homo sapiens
gtctcaaaataaagcaa

SEQ ID NO: 3573082 - DNA, 18 bp, Homo sapiens
gtctcaaaataaagcaat

SEQ ID NO: 3573083 - DNA, 15 bp, Homo sapiens
gtctcagcctctgcc

SEQ ID NO: 3573084 - DNA, 17 bp, Homo sapiens
gtctcagcctctgccag

SEQ ID NO: 3573085 - DNA, 18 bp, Homo sapiens
gtctcagcctctgccagc

SEQ ID NO: 3573086 - DNA, 22 bp, Homo sapiens
gtctcagcctctgccagcgcca

SEQ ID NO: 3573087 - DNA, 20 bp, Homo sapiens
gtctccaaagaagatagctc

SEQ ID NO: 3573088 - DNA, 23 bp, Homo sapiens
gtctccacacacagctgggctgt

SEQ ID NO: 3573089 - DNA, 11 bp, Homo sapiens
gtctccagctg

SEQ ID NO: 3573090 - DNA, 13 bp, Homo sapiens
gtctccagctgcc

SEQ ID NO: 3573091 - DNA, 16 bp, Homo sapiens
gtctccagctgcctgg

SEQ ID NO: 3573092 - DNA, 20 bp, Homo sapiens
gtctccagctgcctgggccc

SEQ ID NO: 3573093 - DNA, 18 bp, Homo sapiens
gtctccaggggcctgcag

SEQ ID NO: 3573094 - DNA, 20 bp, Homo sapiens
gtctccaggggcctgcagaa

SEQ ID NO: 3573095 - DNA, 13 bp, Homo sapiens
gtctccatgtttg

SEQ ID NO: 3573096 - DNA, 19 bp, Homo sapiens
gtctccccaattctcccct

SEQ ID NO: 3573097 - DNA, 15 bp, Homo sapiens
gtctcccctcctgca

SEQ ID NO: 3573098 - DNA, 19 bp, Homo sapiens
gtctccccttctctgcctc

SEQ ID NO: 3573099 - DNA, 16 bp, Homo sapiens
gtctccgaaatgctgt

SEQ ID NO: 3573100 - DNA, 18 bp, Homo sapiens
gtctccgaaatgctgtct

SEQ ID NO: 3573101 - DNA, 20 bp, Homo sapiens
gtctccgaaatgctgtcttt

SEQ ID NO: 3573102 - DNA, 13 bp, Homo sapiens
gtctcctcagcct

SEQ ID NO: 3573103 - DNA, 23 bp, Homo sapiens
gtctcctcagcctcctcatctgg

SEQ ID NO: 3573104 - DNA, 14 bp, Homo sapiens
gtctcctcaggacc

SEQ ID NO: 3573105 - DNA, 15 bp, Homo sapiens
gtctcctcaggacca

SEQ ID NO: 3573106 - DNA, 17 bp, Homo sapiens
gtctcgaactcctgacc

SEQ ID NO: 3573107 - DNA, 22 bp, Homo sapiens
gtctcggatgacaccctggcct

SEQ ID NO: 3573108 - DNA, 16 bp, Homo sapiens
gtctctccagtgaaat

SEQ ID NO: 3573109 - DNA, 14 bp, Homo sapiens
gtctctcttctctc

SEQ ID NO: 3573110 - DNA, 15 bp, Homo sapiens
gtctctcttctctcc

SEQ ID NO: 3573111 - DNA, 23 bp, Homo sapiens
gtctctcttctctccagctgact

SEQ ID NO: 3573112 - DNA, 22 bp, Homo sapiens
gtctctgccagttacttgggct

SEQ ID NO: 3573113 - DNA, 17 bp, Homo sapiens
gtctctgccctgggctc

SEQ ID NO: 3573114 - DNA, 18 bp, Homo sapiens
gtctctgccctgggctcc

SEQ ID NO: 3573115 - DNA, 20 bp, Homo sapiens
gtctctgccctgggctcctc

SEQ ID NO: 3573116 - DNA, 12 bp, Homo sapiens
gtctctgggagc

SEQ ID NO: 3573117 - DNA, 16 bp, Homo sapiens
gtctctgggagcccag

SEQ ID NO: 3573118 - DNA, 17 bp, Homo sapiens
gtctctgggagcccaga

SEQ ID NO: 3573119 - DNA, 18 bp, Homo sapiens
gtctcttctccactggat

SEQ ID NO: 3573120 - DNA, 21 bp, Homo sapiens
gtctcttctgaataaagcaat

SEQ ID NO: 3573121 - DNA, 12 bp, Homo sapiens
gtctgaaactgg

SEQ ID NO: 3573122 - DNA, 12 bp, Homo sapiens
gtctgactccaa

SEQ ID NO: 3573123 - DNA, 12 bp, Homo sapiens
gtctgagacagg

SEQ ID NO: 3573124 - DNA, 16 bp, Homo sapiens
gtctgagacaggtgcc

SEQ ID NO: 3573125 - DNA, 16 bp, Homo sapiens
gtctgagcccatttct

SEQ ID NO: 3573126 - DNA, 19 bp, Homo sapiens
gtctgaggcctgccccctg

SEQ ID NO: 3573127 - DNA, 21 bp, Homo sapiens
gtctgagtcatggccgggtgg

SEQ ID NO: 3573128 - DNA, 15 bp, Homo sapiens
gtctgattggctgct

SEQ ID NO: 3573129 - DNA, 18 bp, Homo sapiens
gtctgattggctgcttaa

SEQ ID NO: 3573130 - DNA, 20 bp, Homo sapiens
gtctgcactgaggatttctt

SEQ ID NO: 3573131 - DNA, 23 bp, Homo sapiens
gtctgcagctcaagggctggcac

SEQ ID NO: 3573132 - DNA, 12 bp, Homo sapiens
gtctgcagctgt

SEQ ID NO: 3573133 - DNA, 17 bp, Homo sapiens
gtctgccttctgctgaa

SEQ ID NO: 3573134 - DNA, 22 bp, Homo sapiens
gtctgctgagttggcctggcca

SEQ ID NO: 3573135 - DNA, 13 bp, Homo sapiens
gtctgctgccagc

SEQ ID NO: 3573136 - DNA, 14 bp, Homo sapiens
gtctgctgccagca

SEQ ID NO: 3573137 - DNA, 15 bp, Homo sapiens
gtctggacctgggga

SEQ ID NO: 3573138 - DNA, 15 bp, Homo sapiens
gtctggactgttctg

SEQ ID NO: 3573139 - DNA, 14 bp, Homo sapiens
gtctggccctgggg

SEQ ID NO: 3573140 - DNA, 19 bp, Homo sapiens
gtctggctgagcccctggg

SEQ ID NO: 3573141 - DNA, 19 bp, Homo sapiens
gtctgggatatggctgccc

SEQ ID NO: 3573142 - DNA, 21 bp, Homo sapiens
gtctgggatatggctgcccag

SEQ ID NO: 3573143 - DNA, 23 bp, Homo sapiens
gtctgggcaccacctctgtgggc

SEQ ID NO: 3573144 - DNA, 18 bp, Homo sapiens
gtctggtctcctcagcct

SEQ ID NO: 3573145 - DNA, 20 bp, Homo sapiens
gtctggtgtttgtcatggtg

SEQ ID NO: 3573146 - DNA, 20 bp, Homo sapiens
gtctggttgctaatgacagc

SEQ ID NO: 3573147 - DNA, 12 bp, Homo sapiens
gtctgtatgtca

SEQ ID NO: 3573148 - DNA, 20 bp, Homo sapiens
gtctgtggagatggactcag

SEQ ID NO: 3573149 - DNA, 13 bp, Homo sapiens
gtctgtggtgcag

SEQ ID NO: 3573150 - DNA, 11 bp, Homo sapiens
gtctgtgtgct

SEQ ID NO: 3573151 - DNA, 22 bp, Homo sapiens
gtctgtgtgtttatgtgtgtgt

SEQ ID NO: 3573152 - DNA, 19 bp, Homo sapiens
gtctgttgattaaagatga

SEQ ID NO: 3573153 - DNA, 14 bp, Homo sapiens
gtctgtttaaagtg

SEQ ID NO: 3573154 - DNA, 16 bp, Homo sapiens
gtcttaaaaaatgtga

SEQ ID NO: 3573155 - DNA, 21 bp, Homo sapiens
gtcttaattaaaagaatattt

SEQ ID NO: 3573156 - DNA, 18 bp, Homo sapiens
gtcttcactttcctcagt

SEQ ID NO: 3573157 - DNA, 20 bp, Homo sapiens
gtcttcactttcctcagttg

SEQ ID NO: 3573158 - DNA, 14 bp, Homo sapiens
gtcttctatttatt

SEQ ID NO: 3573159 - DNA, 15 bp, Homo sapiens
gtcttctttctccat

SEQ ID NO: 3573160 - DNA, 22 bp, Homo sapiens
gtcttggccgactcagggacct

SEQ ID NO: 3573161 - DNA, 15 bp, Homo sapiens
gtcttggggccactt

SEQ ID NO: 3573162 - DNA, 16 bp, Homo sapiens
gtctttaatcattggt

SEQ ID NO: 3573163 - DNA, 21 bp, Homo sapiens
gtctttatttttttcccatga

SEQ ID NO: 3573164 - DNA, 23 bp, Homo sapiens
gtctttcagcaagataaacatta

SEQ ID NO: 3573165 - DNA, 14 bp, Homo sapiens
gtctttctctcagt

SEQ ID NO: 3573166 - DNA, 22 bp, Homo sapiens
gtctttcttcactctggcttca

SEQ ID NO: 3573167 - DNA, 20 bp, Homo sapiens
gtctttctttgtcattcagt

SEQ ID NO: 3573168 - DNA, 13 bp, Homo sapiens
gtcttttaaactg

SEQ ID NO: 3573169 - DNA, 14 bp, Homo sapiens
gtcttttaaactgg

SEQ ID NO: 3573170 - DNA, 15 bp, Homo sapiens
gtcttttaaactgga

SEQ ID NO: 3573171 - DNA, 15 bp, Homo sapiens
gtcttttctttgcca

SEQ ID NO: 3573172 - DNA, 20 bp, Homo sapiens
gtcttttctttgccatctct

SEQ ID NO: 3573173 - DNA, 20 bp, Homo sapiens
gtctttttctagggtccctg

SEQ ID NO: 3573174 - DNA, 12 bp, Homo sapiens
gtgaaaagaata

SEQ ID NO: 3573175 - DNA, 14 bp, Homo sapiens
gtgaaaatgaagaa

SEQ ID NO: 3573176 - DNA, 22 bp, Homo sapiens
gtgaaataccaacctgaagaca

SEQ ID NO: 3573177 - DNA, 17 bp, Homo sapiens
gtgaaattataactatt

SEQ ID NO: 3573178 - DNA, 18 bp, Homo sapiens
gtgaaattataactatta

SEQ ID NO: 3573179 - DNA, 22 bp, Homo sapiens
gtgaaattataactattacagt

SEQ ID NO: 3573180 - DNA, 13 bp, Homo sapiens
gtgaacacatcag

SEQ ID NO: 3573181 - DNA, 19 bp, Homo sapiens
gtgaactaccatgctttgt

SEQ ID NO: 3573182 - DNA, 16 bp, Homo sapiens
gtcaccaggggaggag

SEQ ID NO: 3573183 - DNA, 21 bp, Homo sapiens
gtcaccctgctttggcggccc

SEQ ID NO: 3573184 - DNA, 13 bp, Homo sapiens
gtcacctgctcca

SEQ ID NO: 3573185 - DNA, 16 bp, Homo sapiens
gtcactacctggctgc

SEQ ID NO: 3573186 - DNA, 17 bp, Homo sapiens
gtcactacctggctgcg

SEQ ID NO: 3573187 - DNA, 11 bp, Homo sapiens
gtcactcccaa

SEQ ID NO: 3573188 - DNA, 20 bp, Homo sapiens
gtcactgcacagtgcatctc

SEQ ID NO: 3573189 - DNA, 19 bp, Homo sapiens
gtcactggaccactgggca

SEQ ID NO: 3573190 - DNA, 17 bp, Homo sapiens
gtcactgttccttgtca

SEQ ID NO: 3573191 - DNA, 20 bp, Homo sapiens
ggctccatatcatttgagtt

SEQ ID NO: 3573192 - DNA, 21 bp, Homo sapiens
ggctcccacaggcccttcctc

SEQ ID NO: 3573193 - DNA, 11 bp, Homo sapiens
ggctccccaag

SEQ ID NO: 3573194 - DNA, 16 bp, Homo sapiens
ggctccccaaggctgc

SEQ ID NO: 3573195 - DNA, 17 bp, Homo sapiens
ggctcccgggggcccca

SEQ ID NO: 3573196 - DNA, 23 bp, Homo sapiens
ggctccgggcaccaggggccaac

SEQ ID NO: 3573197 - DNA, 17 bp, Homo sapiens
ggctcctcccggtgccc

SEQ ID NO: 3573198 - DNA, 22 bp, Homo sapiens
ggctcctctaggccctgtgagc

SEQ ID NO: 3573199 - DNA, 17 bp, Homo sapiens
ggctcctctcaggctgg

SEQ ID NO: 3573200 - DNA, 23 bp, Homo sapiens
ggctcctgaccccgccatgcatg

SEQ ID NO: 3573201 - DNA, 15 bp, Homo sapiens
ggctcctgagtgtca

SEQ ID NO: 3573202 - DNA, 20 bp, Homo sapiens
ggctcgccgtgtctcagcct

SEQ ID NO: 3573203 - DNA, 19 bp, Homo sapiens
ggctctaattcacagtgct

SEQ ID NO: 3573204 - DNA, 23 bp, Homo sapiens
ggctctcatgttttcaactgcca

SEQ ID NO: 3573205 - DNA, 23 bp, Homo sapiens
ggctctcccctctcgccccatcc

SEQ ID NO: 3573206 - DNA, 22 bp, Homo sapiens
ggctctctatagcaccagggct

SEQ ID NO: 3573207 - DNA, 15 bp, Homo sapiens
ggctctgccccctcc

SEQ ID NO: 3573208 - DNA, 13 bp, Homo sapiens
ggctctgccccgc

SEQ ID NO: 3573209 - DNA, 19 bp, Homo sapiens
ggctctgctggccggagca

SEQ ID NO: 3573210 - DNA, 15 bp, Homo sapiens
ggctctgggaatggg

SEQ ID NO: 3573211 - DNA, 18 bp, Homo sapiens
ggctctgggtgctgccct

SEQ ID NO: 3573212 - DNA, 15 bp, Homo sapiens
ggctctgtggcaaaa

SEQ ID NO: 3573213 - DNA, 23 bp, Homo sapiens
ggctcttaagcagcatggaaaaa

SEQ ID NO: 3573214 - DNA, 20 bp, Homo sapiens
ggctcttatgtgtgcctttg

SEQ ID NO: 3573215 - DNA, 15 bp, Homo sapiens
ggctcttctcctttc

SEQ ID NO: 3573216 - DNA, 23 bp, Homo sapiens
ggctcttctcctttcacaacctt

SEQ ID NO: 3573217 - DNA, 15 bp, Homo sapiens
ggctcttctgagcag

SEQ ID NO: 3573218 - DNA, 15 bp, Homo sapiens
ggctcttgactactt

SEQ ID NO: 3573219 - DNA, 15 bp, Homo sapiens
ggctgacccagcatc

SEQ ID NO: 3573220 - DNA, 22 bp, Homo sapiens
ggctgacccctctggtgtgtgg

SEQ ID NO: 3573221 - DNA, 16 bp, Homo sapiens
ggctgagccctcctga

SEQ ID NO: 3573222 - DNA, 17 bp, Homo sapiens
ggctgagccctcctgag

SEQ ID NO: 3573223 - DNA, 12 bp, Homo sapiens
ggctgagccctg

SEQ ID NO: 3573224 - DNA, 14 bp, Homo sapiens
ggctgaggcagaag

SEQ ID NO: 3573225 - DNA, 17 bp, Homo sapiens
ggctgagggtcgtggga

SEQ ID NO: 3573226 - DNA, 21 bp, Homo sapiens
ggctgagggtcgtgggaaagg

SEQ ID NO: 3573227 - DNA, 18 bp, Homo sapiens
ggctgagtggcagcagcc

SEQ ID NO: 3573228 - DNA, 19 bp, Homo sapiens
ggctgagtggcagcagccc

SEQ ID NO: 3573229 - DNA, 22 bp, Homo sapiens
ggctgcaaggtttaggctggtg

SEQ ID NO: 3573230 - DNA, 23 bp, Homo sapiens
ggctgcacaacagccctgcctga

SEQ ID NO: 3573231 - DNA, 13 bp, Homo sapiens
ggctgcacaggct

SEQ ID NO: 3573232 - DNA, 19 bp, Homo sapiens
ggctgcaggaagaaacttt

SEQ ID NO: 3573233 - DNA, 17 bp, Homo sapiens
ggctgcaggcaggcggc

SEQ ID NO: 3573234 - DNA, 20 bp, Homo sapiens
ggctgccaacatgatccccg

SEQ ID NO: 3573235 - DNA, 19 bp, Homo sapiens
ggctgccaggggctctgtg

SEQ ID NO: 3573236 - DNA, 21 bp, Homo sapiens
ggctgccaggggctctgtggc

SEQ ID NO: 3573237 - DNA, 21 bp, Homo sapiens
ggctgcccacctggctgccaa

SEQ ID NO: 3573238 - DNA, 13 bp, Homo sapiens
ggctgcccaggag

SEQ ID NO: 3573239 - DNA, 13 bp, Homo sapiens
ggctgccctggtg

SEQ ID NO: 3573240 - DNA, 22 bp, Homo sapiens
ggctgccctggtgctgccacac

SEQ ID NO: 3573241 - DNA, 19 bp, Homo sapiens
ggctgcctgtgggcttccc

SEQ ID NO: 3573242 - DNA, 16 bp, Homo sapiens
ggctgccttagaacct

SEQ ID NO: 3573243 - DNA, 13 bp, Homo sapiens
ggctgccttcttt

SEQ ID NO: 3573244 - DNA, 17 bp, Homo sapiens
ggctgcggggcgggcac

SEQ ID NO: 3573245 - DNA, 16 bp, Homo sapiens
ggctgctgctcctctc

SEQ ID NO: 3573246 - DNA, 20 bp, Homo sapiens
ggctgctgctcctctcttgg

SEQ ID NO: 3573247 - DNA, 19 bp, Homo sapiens
ggctgcttaaactggaaag

SEQ ID NO: 3573248 - DNA, 16 bp, Homo sapiens
ggctggaaagcagagc

SEQ ID NO: 3573249 - DNA, 22 bp, Homo sapiens
ggctggaaagcagagcctcctg

SEQ ID NO: 3573250 - DNA, 23 bp, Homo sapiens
ggctggaaagcagagcctcctgg

SEQ ID NO: 3573251 - DNA, 19 bp, Homo sapiens
ggctggaagtacttggccc

SEQ ID NO: 3573252 - DNA, 23 bp, Homo sapiens
ggctggagaaagagctgcctgga

SEQ ID NO: 3573253 - DNA, 22 bp, Homo sapiens
ggctggagttggggcagaggag

SEQ ID NO: 3573254 - DNA, 17 bp, Homo sapiens
ggctggatctgtgaggg

SEQ ID NO: 3573255 - DNA, 15 bp, Homo sapiens
ggctggtaagagaag

SEQ ID NO: 3573256 - DNA, 15 bp, Homo sapiens
ggctggtagcagcag

SEQ ID NO: 3573257 - DNA, 23 bp, Homo sapiens
ggctggtagcagcaggctcaggc

SEQ ID NO: 3573258 - DNA, 20 bp, Homo sapiens
ggctggtctcgaactcctga

SEQ ID NO: 3573259 - DNA, 16 bp, Homo sapiens
ggctggtggcccagga

SEQ ID NO: 3573260 - DNA, 16 bp, Homo sapiens
ggctggttggagaagg

SEQ ID NO: 3573261 - DNA, 18 bp, Homo sapiens
ggctgtaatgacaaaaga

SEQ ID NO: 3573262 - DNA, 19 bp, Homo sapiens
ggctgtaatgacaaaagat

SEQ ID NO: 3573263 - DNA, 19 bp, Homo sapiens
ggctgtacatagtcctttt

SEQ ID NO: 3573264 - DNA, 17 bp, Homo sapiens
ggctgtctgttgtattc

SEQ ID NO: 3573265 - DNA, 14 bp, Homo sapiens
ctgggctttgggaa

SEQ ID NO: 3573266 - DNA, 15 bp, Homo sapiens
ctggggaagacagtg

SEQ ID NO: 3573267 - DNA, 16 bp, Homo sapiens
ctggggaagacagtgg

SEQ ID NO: 3573268 - DNA, 18 bp, Homo sapiens
ctggggaagacagtggcc

SEQ ID NO: 3573269 - DNA, 15 bp, Homo sapiens
ctggggacagcttcc

SEQ ID NO: 3573270 - DNA, 12 bp, Homo sapiens
ctggggacaggc

SEQ ID NO: 3573271 - DNA, 14 bp, Homo sapiens
ctggggacaggccc

SEQ ID NO: 3573272 - DNA, 17 bp, Homo sapiens
ctggggacaggcccgct

SEQ ID NO: 3573273 - DNA, 24 bp, Homo sapiens
ctggggacccaaaccccctgcagc

SEQ ID NO: 3573274 - DNA, 21 bp, Homo sapiens
ctggggactttatttatttct

SEQ ID NO: 3573275 - DNA, 20 bp, Homo sapiens
ctggggagagcggctggaga

SEQ ID NO: 3573276 - DNA, 20 bp, Homo sapiens
ctggggagccctattgctgc

SEQ ID NO: 3573277 - DNA, 20 bp, Homo sapiens
ctggggagtggttaggcagc

SEQ ID NO: 3573278 - DNA, 17 bp, Homo sapiens
ctggggatcttcccaca

SEQ ID NO: 3573279 - DNA, 16 bp, Homo sapiens
ctggggatgtctctca

SEQ ID NO: 3573280 - DNA, 22 bp, Homo sapiens
ctggggatgtctctcatgacca

SEQ ID NO: 3573281 - DNA, 21 bp, Homo sapiens
ctggggcagcactccccagag

SEQ ID NO: 3573282 - DNA, 13 bp, Homo sapiens
ctggggcctcaga

SEQ ID NO: 3573283 - DNA, 14 bp, Homo sapiens
ctggggcctcagcc

SEQ ID NO: 3573284 - DNA, 15 bp, Homo sapiens
ctggggcgtttccta

SEQ ID NO: 3573285 - DNA, 14 bp, Homo sapiens
ctgggggagtggaa

SEQ ID NO: 3573286 - DNA, 21 bp, Homo sapiens
ctgggggcccgacaggtgggc

SEQ ID NO: 3573287 - DNA, 17 bp, Homo sapiens
ctggggggagaaaaaaa

SEQ ID NO: 3573288 - DNA, 14 bp, Homo sapiens
ctgggggtcctctc

SEQ ID NO: 3573289 - DNA, 22 bp, Homo sapiens
ctgggggtggacatctgacccc

SEQ ID NO: 3573290 - DNA, 16 bp, Homo sapiens
ctgggggtgggccagg

SEQ ID NO: 3573291 - DNA, 16 bp, Homo sapiens
ctggggtgggcagttt

SEQ ID NO: 3573292 - DNA, 19 bp, Homo sapiens
ctggggttgcgtctgaggc

SEQ ID NO: 3573293 - DNA, 22 bp, Homo sapiens
ctggggttgcgtctgaggcctg

SEQ ID NO: 3573294 - DNA, 17 bp, Homo sapiens
ctgggtacttcttgaag

SEQ ID NO: 3573295 - DNA, 23 bp, Homo sapiens
ctgggtacttcttgaaggtgctg

SEQ ID NO: 3573296 - DNA, 13 bp, Homo sapiens
ctgggtccaggga

SEQ ID NO: 3573297 - DNA, 15 bp, Homo sapiens
ctgggtccagggagg

SEQ ID NO: 3573298 - DNA, 22 bp, Homo sapiens
ctgggtctgattttctcactga

SEQ ID NO: 3573299 - DNA, 18 bp, Homo sapiens
ctgggtctggggacaggc

SEQ ID NO: 3573300 - DNA, 16 bp, Homo sapiens
ctgggtcttggccatg

SEQ ID NO: 3573301 - DNA, 18 bp, Homo sapiens
ctgggtcttggccatgat

SEQ ID NO: 3573302 - DNA, 17 bp, Homo sapiens
ctgggtgctagatccag

SEQ ID NO: 3573303 - DNA, 12 bp, Homo sapiens
ctgggtggcagg

SEQ ID NO: 3573304 - DNA, 13 bp, Homo sapiens
ctgggtggcaggg

SEQ ID NO: 3573305 - DNA, 14 bp, Homo sapiens
ctgggtggcagggg

SEQ ID NO: 3573306 - DNA, 22 bp, Homo sapiens
ctgggttaaatattttgctaac

SEQ ID NO: 3573307 - DNA, 16 bp, Homo sapiens
ctgggtttgggagcca

SEQ ID NO: 3573308 - DNA, 18 bp, Homo sapiens
ctgggtttgggagccagg

SEQ ID NO: 3573309 - DNA, 22 bp, Homo sapiens
ctgggtttgggagccaggactc

SEQ ID NO: 3573310 - DNA, 23 bp, Homo sapiens
ctggtaaacattcctccagcctc

SEQ ID NO: 3573311 - DNA, 21 bp, Homo sapiens
ctggtaataaatgtgactcag

SEQ ID NO: 3573312 - DNA, 19 bp, Homo sapiens
ctggtaatattgacttgta

SEQ ID NO: 3573313 - DNA, 14 bp, Homo sapiens
ctggtacctgccct

SEQ ID NO: 3573314 - DNA, 21 bp, Homo sapiens
ctggtacctgccctctattta

SEQ ID NO: 3573315 - DNA, 16 bp, Homo sapiens
ctggtactctgtgaaa

SEQ ID NO: 3573316 - DNA, 19 bp, Homo sapiens
ctggtacttagagtttctg

SEQ ID NO: 3573317 - DNA, 14 bp, Homo sapiens
ctggtagcagcagg

SEQ ID NO: 3573318 - DNA, 20 bp, Homo sapiens
ctggtagcagcaggctcagg

SEQ ID NO: 3573319 - DNA, 21 bp, Homo sapiens
ctggtagcagcaggctcaggc

SEQ ID NO: 3573320 - DNA, 14 bp, Homo sapiens
ctggtatgaataat

SEQ ID NO: 3573321 - DNA, 17 bp, Homo sapiens
ctggtatgaataattgc

SEQ ID NO: 3573322 - DNA, 21 bp, Homo sapiens
ctggtatgaataattgcatca

SEQ ID NO: 3573323 - DNA, 21 bp, Homo sapiens
ctggtattggaatagcagcct

SEQ ID NO: 3573324 - DNA, 13 bp, Homo sapiens
ctggtatttatat

SEQ ID NO: 3573325 - DNA, 17 bp, Homo sapiens
ctggtcaaacaaactct

SEQ ID NO: 3573326 - DNA, 23 bp, Homo sapiens
ctggtcaaacaaactctctgaac

SEQ ID NO: 3573327 - DNA, 20 bp, Homo sapiens
ctggtcacaggactctgcct

SEQ ID NO: 3573328 - DNA, 17 bp, Homo sapiens
ctggtcccacgagggtg

SEQ ID NO: 3573329 - DNA, 21 bp, Homo sapiens
ctggtccccactgctgagctg

SEQ ID NO: 3573330 - DNA, 13 bp, Homo sapiens
ctggtcctaccca

SEQ ID NO: 3573331 - DNA, 14 bp, Homo sapiens
ctggtcctgcacat

SEQ ID NO: 3573332 - DNA, 16 bp, Homo sapiens
ctggtcctgcacatga

SEQ ID NO: 3573333 - DNA, 17 bp, Homo sapiens
ctggtcctgcacatgag

SEQ ID NO: 3573334 - DNA, 14 bp, Homo sapiens
ctggtcggagaggg

SEQ ID NO: 3573335 - DNA, 18 bp, Homo sapiens
ctggtctcgaactcctga

SEQ ID NO: 3573336 - DNA, 20 bp, Homo sapiens
ctggtctcgaactcctgacc

SEQ ID NO: 3573337 - DNA, 22 bp, Homo sapiens
ctggtctcgaactcctgacctc

SEQ ID NO: 3573338 - DNA, 22 bp, Homo sapiens
ctggtctgtggagatggactca

SEQ ID NO: 3573339 - DNA, 18 bp, Homo sapiens
ctggtgaactgagctggg

SEQ ID NO: 3573340 - DNA, 21 bp, Homo sapiens
ctggtgccctggatgcccagg

SEQ ID NO: 3573341 - DNA, 20 bp, Homo sapiens
ctggtgcctatctgcctgga

SEQ ID NO: 3573342 - DNA, 21 bp, Homo sapiens
ctggtgcctatctgcctggag

SEQ ID NO: 3573343 - DNA, 14 bp, Homo sapiens
ctggtgctcctgca

SEQ ID NO: 3573344 - DNA, 22 bp, Homo sapiens
ctggtgctgccacacttcaggc

SEQ ID NO: 3573345 - DNA, 11 bp, Homo sapiens
ctggtggccca

SEQ ID NO: 3573346 - DNA, 14 bp, Homo sapiens
ctggtggcccagga

SEQ ID NO: 3573347 - DNA, 15 bp, Homo sapiens
ctggtggcctctgca

SEQ ID NO: 3573348 - DNA, 23 bp, Homo sapiens
ctggtggctcccggagggccctg

SEQ ID NO: 3573349 - DNA, 17 bp, Homo sapiens
ctggtggtgcagccttc

SEQ ID NO: 3573350 - DNA, 22 bp, Homo sapiens
ctggtgtgaactcaccctggga

SEQ ID NO: 3573351 - DNA, 18 bp, Homo sapiens
ctggtgtgtggtgagggg

SEQ ID NO: 3573352 - DNA, 22 bp, Homo sapiens
ctggtgtgtggtgaggggcttt

SEQ ID NO: 3573353 - DNA, 16 bp, Homo sapiens
ctggtgtttgtcatgg

SEQ ID NO: 3573354 - DNA, 13 bp, Homo sapiens
ctggttaatgtag

SEQ ID NO: 3573355 - DNA, 16 bp, Homo sapiens
ctggttcagacacagc

SEQ ID NO: 3573356 - DNA, 13 bp, Homo sapiens
ctggttcctgtgt

SEQ ID NO: 3573357 - DNA, 19 bp, Homo sapiens
ctggttctgaggccagaaa

SEQ ID NO: 3573358 - DNA, 14 bp, Homo sapiens
ctggttctgtgtcc

SEQ ID NO: 3573359 - DNA, 23 bp, Homo sapiens
ctggttctgtgtcctctgcctgg

SEQ ID NO: 3573360 - DNA, 17 bp, Homo sapiens
ctggttgagtgtgtggt

SEQ ID NO: 3573361 - DNA, 19 bp, Homo sapiens
ctggttgagtgtgtggtct

SEQ ID NO: 3573362 - DNA, 19 bp, Homo sapiens
ctggttgctaatgacagcc

SEQ ID NO: 3573363 - DNA, 19 bp, Homo sapiens
ctggttggagaaggtcaca

SEQ ID NO: 3573364 - DNA, 16 bp, Homo sapiens
ctggtttgttccctgt

SEQ ID NO: 3573365 - DNA, 19 bp, Homo sapiens
ctgtaacaatgtaataaaa

SEQ ID NO: 3573366 - DNA, 19 bp, Homo sapiens
ctgtaacatcgcacagttt

SEQ ID NO: 3573367 - DNA, 20 bp, Homo sapiens
ctgtaacatcgcacagttta

SEQ ID NO: 3573368 - DNA, 18 bp, Homo sapiens
ctgtaaccttctattttc

SEQ ID NO: 3573369 - DNA, 20 bp, Homo sapiens
ctgtaaccttctattttcta

SEQ ID NO: 3573370 - DNA, 19 bp, Homo sapiens
ctgtaactactttataact

SEQ ID NO: 3573371 - DNA, 14 bp, Homo sapiens
ctgtaactgagaga

SEQ ID NO: 3573372 - DNA, 17 bp, Homo sapiens
ctgtaactgagagaaag

SEQ ID NO: 3573373 - DNA, 16 bp, Homo sapiens
ctgtaacttccaaata

SEQ ID NO: 3573374 - DNA, 19 bp, Homo sapiens
ctgtaacttccaaataaat

SEQ ID NO: 3573375 - DNA, 17 bp, Homo sapiens
ctgtaagctttgttctg

SEQ ID NO: 3573376 - DNA, 20 bp, Homo sapiens
ctgtaagctttgttctggga

SEQ ID NO: 3573377 - DNA, 12 bp, Homo sapiens
ctgtaataatag

SEQ ID NO: 3573378 - DNA, 16 bp, Homo sapiens
ctgtaatgttaataat

SEQ ID NO: 3573379 - DNA, 18 bp, Homo sapiens
ctgtaattatatctaaaa

SEQ ID NO: 3573380 - DNA, 15 bp, Homo sapiens
ctgtacaaaagcaat

SEQ ID NO: 3573381 - DNA, 16 bp, Homo sapiens
ctgtacatatgtaaac

SEQ ID NO: 3573382 - DNA, 21 bp, Homo sapiens
ctgtaccaaatctgacatatt

SEQ ID NO: 3573383 - DNA, 22 bp, Homo sapiens
ctgtactaacccagtctttctt

SEQ ID NO: 3573384 - DNA, 19 bp, Homo sapiens
ctgtagaaaggggagaatg

SEQ ID NO: 3573385 - DNA, 22 bp, Homo sapiens
ctgtaggagcaggtgaataaag

SEQ ID NO: 3573386 - DNA, 22 bp, Homo sapiens
ctgtaggcctcaggtgaaactc

SEQ ID NO: 3573387 - DNA, 18 bp, Homo sapiens
ctgtaggtgttatgtatt

SEQ ID NO: 3573388 - DNA, 19 bp, Homo sapiens
ctgtaggtgttatgtattc

SEQ ID NO: 3573389 - DNA, 22 bp, Homo sapiens
ctgtaggtgttatgtattccta

SEQ ID NO: 3573390 - DNA, 21 bp, Homo sapiens
ctgtatggaaacactgatttt

SEQ ID NO: 3573391 - DNA, 13 bp, Homo sapiens
ctgtatgtcatgg

SEQ ID NO: 3573392 - DNA, 16 bp, Homo sapiens
ctgtatgtcttaaaac

SEQ ID NO: 3573393 - DNA, 15 bp, Homo sapiens
ctgtcaagagggagg

SEQ ID NO: 3573394 - DNA, 18 bp, Homo sapiens
ctgtcaagccatttttac

SEQ ID NO: 3573395 - DNA, 19 bp, Homo sapiens
ctgtcaagccatttttaca

SEQ ID NO: 3573396 - DNA, 16 bp, Homo sapiens
ctgtcacccacagacc

SEQ ID NO: 3573397 - DNA, 20 bp, Homo sapiens
ctgtcacttgtcgggggccc

SEQ ID NO: 3573398 - DNA, 23 bp, Homo sapiens
ctgtcagctcccctcggagaaga

SEQ ID NO: 3573399 - DNA, 12 bp, Homo sapiens
ctgtcagctgca

SEQ ID NO: 3573400 - DNA, 15 bp, Homo sapiens
ctgttcactctactt

SEQ ID NO: 3573401 - DNA, 17 bp, Homo sapiens
ctgttcagaaaggggct

SEQ ID NO: 3573402 - DNA, 22 bp, Homo sapiens
ctgttcagctactcccactccc

SEQ ID NO: 3573403 - DNA, 15 bp, Homo sapiens
ctgttccagattcct

SEQ ID NO: 3573404 - DNA, 15 bp, Homo sapiens
ctgttccatgcaact

SEQ ID NO: 3573405 - DNA, 17 bp, Homo sapiens
ctgttctccctttctct

SEQ ID NO: 3573406 - DNA, 20 bp, Homo sapiens
ctgttctccctttctctctc

SEQ ID NO: 3573407 - DNA, 22 bp, Homo sapiens
ctgttctccctttctctctcct

SEQ ID NO: 3573408 - DNA, 22 bp, Homo sapiens
cttatgatacttgaggtaccag

SEQ ID NO: 3573409 - DNA, 16 bp, Homo sapiens
cttatgcggttaattt

SEQ ID NO: 3573410 - DNA, 20 bp, Homo sapiens
cttatgtagaaactgaggcc

SEQ ID NO: 3573411 - DNA, 15 bp, Homo sapiens
cttatttaactgatt

SEQ ID NO: 3573412 - DNA, 22 bp, Homo sapiens
cttatttatgaaagtattaaaa

SEQ ID NO: 3573413 - DNA, 17 bp, Homo sapiens
cttatttctcagctgtg

SEQ ID NO: 3573414 - DNA, 17 bp, Homo sapiens
cttatttctgctctgga

SEQ ID NO: 3573415 - DNA, 19 bp, Homo sapiens
cttatttctgctctggaat

SEQ ID NO: 3573416 - DNA, 21 bp, Homo sapiens
cttatttgccttctactcccc

SEQ ID NO: 3573417 - DNA, 12 bp, Homo sapiens
cttattttcaag

SEQ ID NO: 3573418 - DNA, 21 bp, Homo sapiens
cttattttcagtgcatcatta

SEQ ID NO: 3573419 - DNA, 18 bp, Homo sapiens
cttattttgtaataaact

SEQ ID NO: 3573420 - DNA, 14 bp, Homo sapiens
cttatttttctgag

SEQ ID NO: 3573421 - DNA, 16 bp, Homo sapiens
cttcaaaaagccacag

SEQ ID NO: 3573422 - DNA, 16 bp, Homo sapiens
cttcaaagtgcctggg

SEQ ID NO: 3573423 - DNA, 18 bp, Homo sapiens
cttcaaagtgcctgggct

SEQ ID NO: 3573424 - DNA, 22 bp, Homo sapiens
cttcaaattcttcacatgttta

SEQ ID NO: 3573425 - DNA, 23 bp, Homo sapiens
agcatgcttgggctgacccagca

SEQ ID NO: 3573426 - DNA, 15 bp, Homo sapiens
agcatggaaaaatgg

SEQ ID NO: 3573427 - DNA, 13 bp, Homo sapiens
agcatggagacag

SEQ ID NO: 3573428 - DNA, 14 bp, Homo sapiens
agcatggagacagc

SEQ ID NO: 3573429 - DNA, 15 bp, Homo sapiens
agcatggagacagca

SEQ ID NO: 3573430 - DNA, 16 bp, Homo sapiens
agcattaaagttctag

SEQ ID NO: 3573431 - DNA, 22 bp, Homo sapiens
agcattctcactcctacctggt

SEQ ID NO: 3573432 - DNA, 20 bp, Homo sapiens
agcattgtcaccgcaggtgc

SEQ ID NO: 3573433 - DNA, 22 bp, Homo sapiens
agcatttaatggcagctagtgc

SEQ ID NO: 3573434 - DNA, 16 bp, Homo sapiens
agcatttactatgcac

SEQ ID NO: 3573435 - DNA, 11 bp, Homo sapiens
agcatttgtat

SEQ ID NO: 3573436 - DNA, 14 bp, Homo sapiens
agcatttttaaggg

SEQ ID NO: 3573437 - DNA, 18 bp, Homo sapiens
agccaaactcaggcccag

SEQ ID NO: 3573438 - DNA, 21 bp, Homo sapiens
agccaaagaaacaagctgtgc

SEQ ID NO: 3573439 - DNA, 20 bp, Homo sapiens
agccaaatgaccgagccctg

SEQ ID NO: 3573440 - DNA, 21 bp, Homo sapiens
agccaactgtttccctgctga

SEQ ID NO: 3573441 - DNA, 13 bp, Homo sapiens
agccaagctggca

SEQ ID NO: 3573442 - DNA, 16 bp, Homo sapiens
agccaagctggcacaa

SEQ ID NO: 3573443 - DNA, 22 bp, Homo sapiens
agccaaggcagcgaccccagga

SEQ ID NO: 3573444 - DNA, 11 bp, Homo sapiens
agccaagggat

SEQ ID NO: 3573445 - DNA, 14 bp, Homo sapiens
agccaagggatgga

SEQ ID NO: 3573446 - DNA, 22 bp, Homo sapiens
agccaagggatggacatcttgt

SEQ ID NO: 3573447 - DNA, 19 bp, Homo sapiens
agccaagtgccaaatgctc

SEQ ID NO: 3573448 - DNA, 15 bp, Homo sapiens
agccacagcagagca

SEQ ID NO: 3573449 - DNA, 16 bp, Homo sapiens
agccacagcagagcat

SEQ ID NO: 3573450 - DNA, 12 bp, Homo sapiens
agccaccagttc

SEQ ID NO: 3573451 - DNA, 23 bp, Homo sapiens
agccaccatgcttgcctgaagct

SEQ ID NO: 3573452 - DNA, 21 bp, Homo sapiens
agccaccgaagccgcctgtgg

SEQ ID NO: 3573453 - DNA, 17 bp, Homo sapiens
agccacctgggaacaca

SEQ ID NO: 3573454 - DNA, 14 bp, Homo sapiens
agccactccccagc

SEQ ID NO: 3573455 - DNA, 17 bp, Homo sapiens
agccactccccagccag

SEQ ID NO: 3573456 - DNA, 21 bp, Homo sapiens
agccagaacgtggctctgctg

SEQ ID NO: 3573457 - DNA, 21 bp, Homo sapiens
agccagaccccacgctgacca

SEQ ID NO: 3573458 - DNA, 16 bp, Homo sapiens
agccagattctcttga

SEQ ID NO: 3573459 - DNA, 14 bp, Homo sapiens
agccagcatcggaa

SEQ ID NO: 3573460 - DNA, 9 bp, Homo sapiens
agccagcca

SEQ ID NO: 3573461 - DNA, 11 bp, Homo sapiens
agccagccaca

SEQ ID NO: 3573462 - DNA, 19 bp, Homo sapiens
agccagcccttccctggcc

SEQ ID NO: 3573463 - DNA, 10 bp, Homo sapiens
agccagcctc

SEQ ID NO: 3573464 - DNA, 16 bp, Homo sapiens
agccagcctcagaagg

SEQ ID NO: 3573465 - DNA, 19 bp, Homo sapiens
agccagcctggctctgccc

SEQ ID NO: 3573466 - DNA, 15 bp, Homo sapiens
agccagcctggctgg

SEQ ID NO: 3573467 - DNA, 22 bp, Homo sapiens
agccagcctggctgggactggg

SEQ ID NO: 3573468 - DNA, 20 bp, Homo sapiens
agccaggaatttcccaggac

SEQ ID NO: 3573469 - DNA, 14 bp, Homo sapiens
agccaggactccca

SEQ ID NO: 3573470 - DNA, 16 bp, Homo sapiens
agccaggactcccaga

SEQ ID NO: 3573471 - DNA, 14 bp, Homo sapiens
agccaggatgccca

SEQ ID NO: 3573472 - DNA, 16 bp, Homo sapiens
agccaggctcaggaga

SEQ ID NO: 3573473 - DNA, 19 bp, Homo sapiens
agccaggtctgactccaaa

SEQ ID NO: 3573474 - DNA, 14 bp, Homo sapiens
agccataacttgaa

SEQ ID NO: 3573475 - DNA, 17 bp, Homo sapiens
agccatacataaaagaa

SEQ ID NO: 3573476 - DNA, 16 bp, Homo sapiens
agccataggtgcagtt

SEQ ID NO: 3573477 - DNA, 23 bp, Homo sapiens
agccatagtttgggtatttttgg

SEQ ID NO: 3573478 - DNA, 22 bp, Homo sapiens
agccatcgattgtgtacttttc

SEQ ID NO: 3573479 - DNA, 17 bp, Homo sapiens
agccatgtataaatgtg

SEQ ID NO: 3573480 - DNA, 20 bp, Homo sapiens
agccatgtggggttgctgaa

SEQ ID NO: 3573481 - DNA, 23 bp, Homo sapiens
agccatgtggggttgctgaagat

SEQ ID NO: 3573482 - DNA, 13 bp, Homo sapiens
agccattttccaa

SEQ ID NO: 3573483 - DNA, 14 bp, Homo sapiens
agcccaaacctggg

SEQ ID NO: 3573484 - DNA, 22 bp, Homo sapiens
agcccaaacctgggaaggccag

SEQ ID NO: 3573485 - DNA, 14 bp, Homo sapiens
agcccaacctacat

SEQ ID NO: 3573486 - DNA, 17 bp, Homo sapiens
agcccaacctacattcc

SEQ ID NO: 3573487 - DNA, 21 bp, Homo sapiens
agcccacctgggttggaggaa

SEQ ID NO: 3573488 - DNA, 18 bp, Homo sapiens
agcccactgtcctgggcc

SEQ ID NO: 3573489 - DNA, 23 bp, Homo sapiens
agcccactgtcctgggcctgcag

SEQ ID NO: 3573490 - DNA, 22 bp, Homo sapiens
agcccagagacatacttgaagg

SEQ ID NO: 3573491 - DNA, 20 bp, Homo sapiens
agcccagagtccccccactc

SEQ ID NO: 3573492 - DNA, 14 bp, Homo sapiens
agcccagccaggcc

SEQ ID NO: 3573493 - DNA, 13 bp, Homo sapiens
agcccaggggccg

SEQ ID NO: 3573494 - DNA, 14 bp, Homo sapiens
agcccagtgaagcc

SEQ ID NO: 3573495 - DNA, 15 bp, Homo sapiens
agcccagtgaagcct

SEQ ID NO: 3573496 - DNA, 14 bp, Homo sapiens
agcccagtgcaaac

SEQ ID NO: 3573497 - DNA, 16 bp, Homo sapiens
agcccattcccaaggg

SEQ ID NO: 3573498 - DNA, 21 bp, Homo sapiens
ttatctcctttgaagaaggca

SEQ ID NO: 3573499 - DNA, 14 bp, Homo sapiens
ttatctctttccac

SEQ ID NO: 3573500 - DNA, 14 bp, Homo sapiens
ttatcttatcattt

SEQ ID NO: 3573501 - DNA, 18 bp, Homo sapiens
ttatgattgaatctactt

SEQ ID NO: 3573502 - DNA, 14 bp, Homo sapiens
ttatgcaaaatgga

SEQ ID NO: 3573503 - DNA, 15 bp, Homo sapiens
ttatgcaaaatggaa

SEQ ID NO: 3573504 - DNA, 20 bp, Homo sapiens
ttatgcagtgaactattttt

SEQ ID NO: 3573505 - DNA, 23 bp, Homo sapiens
ttatgcagtgtttccctctgtgt

SEQ ID NO: 3573506 - DNA, 16 bp, Homo sapiens
ttatgcggttaatttt

SEQ ID NO: 3573507 - DNA, 13 bp, Homo sapiens
ttatgctgtttcc

SEQ ID NO: 3573508 - DNA, 18 bp, Homo sapiens
ttatggctataggtgcta

SEQ ID NO: 3573509 - DNA, 13 bp, Homo sapiens
ttatggtctaatg

SEQ ID NO: 3573510 - DNA, 21 bp, Homo sapiens
ttatgtacatacgctctcgtc

SEQ ID NO: 3573511 - DNA, 15 bp, Homo sapiens
ttatgtagaaactga

SEQ ID NO: 3573512 - DNA, 12 bp, Homo sapiens
ttatgtagctgt

SEQ ID NO: 3573513 - DNA, 19 bp, Homo sapiens
ttatgtatcagtgtccttt

SEQ ID NO: 3573514 - DNA, 22 bp, Homo sapiens
ttatgtatcagtgtcctttcca

SEQ ID NO: 3573515 - DNA, 20 bp, Homo sapiens
ttatgtgacattttacatta

SEQ ID NO: 3573516 - DNA, 14 bp, Homo sapiens
ttatgtgtgtgtgt

SEQ ID NO: 3573517 - DNA, 13 bp, Homo sapiens
ttattaattaaag

SEQ ID NO: 3573518 - DNA, 14 bp, Homo sapiens
ttattaatttgaaa

SEQ ID NO: 3573519 - DNA, 13 bp, Homo sapiens
ttattattaataa

SEQ ID NO: 3573520 - DNA, 18 bp, Homo sapiens
ttattcagttcttacaca

SEQ ID NO: 3573521 - DNA, 21 bp, Homo sapiens
ttattcattagttttgaagat

SEQ ID NO: 3573522 - DNA, 20 bp, Homo sapiens
ttattccccagtgactccag

SEQ ID NO: 3573523 - DNA, 21 bp, Homo sapiens
ttattccccagtgactccagg

SEQ ID NO: 3573524 - DNA, 22 bp, Homo sapiens
ttattgaaatgatttcacagtg

SEQ ID NO: 3573525 - DNA, 15 bp, Homo sapiens
ttattgatgttttca

SEQ ID NO: 3573526 - DNA, 22 bp, Homo sapiens
ttattgccaaaacccagctgca

SEQ ID NO: 3573527 - DNA, 13 bp, Homo sapiens
ttattggcaaagt

SEQ ID NO: 3573528 - DNA, 21 bp, Homo sapiens
ttattggcaaagtttaaatgt

SEQ ID NO: 3573529 - DNA, 15 bp, Homo sapiens
ttatttagattcact

SEQ ID NO: 3573530 - DNA, 15 bp, Homo sapiens
ttatttattaaactt

SEQ ID NO: 3573531 - DNA, 16 bp, Homo sapiens
ttatttattaaacttc

SEQ ID NO: 3573532 - DNA, 15 bp, Homo sapiens
ttatttattccccag

SEQ ID NO: 3573533 - DNA, 15 bp, Homo sapiens
ttatttattggagat

SEQ ID NO: 3573534 - DNA, 20 bp, Homo sapiens
ttatttcaataaatctttca

SEQ ID NO: 3573535 - DNA, 13 bp, Homo sapiens
ttatttcaattgt

SEQ ID NO: 3573536 - DNA, 21 bp, Homo sapiens
ttatttcctatagctacatgt

SEQ ID NO: 3573537 - DNA, 19 bp, Homo sapiens
ttatttctccatcccctcc

SEQ ID NO: 3573538 - DNA, 17 bp, Homo sapiens
ttatttctgctctggaa

SEQ ID NO: 3573539 - DNA, 12 bp, Homo sapiens
ttatttcttccc

SEQ ID NO: 3573540 - DNA, 13 bp, Homo sapiens
ttatttcttccct

SEQ ID NO: 3573541 - DNA, 19 bp, Homo sapiens
ttatttgaggtcagtgttt

SEQ ID NO: 3573542 - DNA, 12 bp, Homo sapiens
ttatttgtatta

SEQ ID NO: 3573543 - DNA, 16 bp, Homo sapiens
ttatttgtcttaaaaa

SEQ ID NO: 3573544 - DNA, 22 bp, Homo sapiens
ttattttatgacatgaaaagtt

SEQ ID NO: 3573545 - DNA, 18 bp, Homo sapiens
ttattttcttttgaattg

SEQ ID NO: 3573546 - DNA, 19 bp, Homo sapiens
ttatttttacagcaaaaga

SEQ ID NO: 3573547 - DNA, 20 bp, Homo sapiens
ttatttttagaattttgtga

SEQ ID NO: 3573548 - DNA, 22 bp, Homo sapiens
ttatttttagaattttgtgaaa

SEQ ID NO: 3573549 - DNA, 12 bp, Homo sapiens
ttatttttctga

SEQ ID NO: 3573550 - DNA, 15 bp, Homo sapiens
ttattttttaaaaag

SEQ ID NO: 3573551 - DNA, 12 bp, Homo sapiens
ttattttttcag

SEQ ID NO: 3573552 - DNA, 13 bp, Homo sapiens
ttattttttcaga

SEQ ID NO: 3573553 - DNA, 14 bp, Homo sapiens
ttattttttcagac

SEQ ID NO: 3573554 - DNA, 16 bp, Homo sapiens
ttattttttcagaccg

SEQ ID NO: 3573555 - DNA, 14 bp, Homo sapiens
ttcaaaaagccaca

SEQ ID NO: 3573556 - DNA, 20 bp, Homo sapiens
ttcaaaagtttgtttgctta

SEQ ID NO: 3573557 - DNA, 16 bp, Homo sapiens
ttcaaaataaaaagta

SEQ ID NO: 3573558 - DNA, 13 bp, Homo sapiens
ttcaaacttaaac

SEQ ID NO: 3573559 - DNA, 18 bp, Homo sapiens
ttcaaacttaaacaaaaa

SEQ ID NO: 3573560 - DNA, 18 bp, Homo sapiens
ttcaaagtgcctgggctc

SEQ ID NO: 3573561 - DNA, 21 bp, Homo sapiens
ttcaacaacgtgagagaaaga

SEQ ID NO: 3573562 - DNA, 17 bp, Homo sapiens
ttcaaccattccccatg

SEQ ID NO: 3573563 - DNA, 20 bp, Homo sapiens
ttcaacccccttaactgtat

SEQ ID NO: 3573564 - DNA, 12 bp, Homo sapiens
ttcaacttttct

SEQ ID NO: 3573565 - DNA, 20 bp, Homo sapiens
ttcaagaaactgaggaattt

SEQ ID NO: 3573566 - DNA, 12 bp, Homo sapiens
ttcaagcaaaca

SEQ ID NO: 3573567 - DNA, 16 bp, Homo sapiens
ttcaagcctctaaaca

SEQ ID NO: 3573568 - DNA, 17 bp, Homo sapiens
ttcaagcctctaaacag

SEQ ID NO: 3573569 - DNA, 18 bp, Homo sapiens
ttcaagcctctaaacaga

SEQ ID NO: 3573570 - DNA, 16 bp, Homo sapiens
ttcaaggaatttctta

SEQ ID NO: 3573571 - DNA, 17 bp, Homo sapiens
ttcaaggaatttcttaa

SEQ ID NO: 3573572 - DNA, 16 bp, Homo sapiens
ttcaagtattaagcag

SEQ ID NO: 3573573 - DNA, 18 bp, Homo sapiens
ttcaagtattaagcagtt

SEQ ID NO: 3573574 - DNA, 18 bp, Homo sapiens
ttcaataaatctttcaaa

SEQ ID NO: 3573575 - DNA, 21 bp, Homo sapiens
ttcaatacttacatatctgac

SEQ ID NO: 3573576 - DNA, 19 bp, Homo sapiens
ttcaatatgcaagcagctt

SEQ ID NO: 3573577 - DNA, 19 bp, Homo sapiens
ttcaatctggattcatatt

SEQ ID NO: 3573578 - DNA, 13 bp, Homo sapiens
ttcaatcttttaa

SEQ ID NO: 3573579 - DNA, 19 bp, Homo sapiens
ttcaattaaacggattatt

SEQ ID NO: 3573580 - DNA, 14 bp, Homo sapiens
ttcaattgtttata

SEQ ID NO: 3573581 - DNA, 19 bp, Homo sapiens
ttcaattttttttccgtaa

SEQ ID NO: 3573582 - DNA, 14 bp, Homo sapiens
ttcacaagcctcct

SEQ ID NO: 3573583 - DNA, 15 bp, Homo sapiens
ttcacaagcctcctg

SEQ ID NO: 3573584 - DNA, 19 bp, Homo sapiens
ttcacactggtaaatgtta

SEQ ID NO: 3573585 - DNA, 15 bp, Homo sapiens
ttcacagtgctcttt

SEQ ID NO: 3573586 - DNA, 21 bp, Homo sapiens
ttcacagttctttgggccaga

SEQ ID NO: 3573587 - DNA, 16 bp, Homo sapiens
ttcacatgtttaactt

SEQ ID NO: 3573588 - DNA, 19 bp, Homo sapiens
ttcacatttaaatggttct

SEQ ID NO: 3573589 - DNA, 21 bp, Homo sapiens
ttcacatttaaatggttctgt

SEQ ID NO: 3573590 - DNA, 17 bp, Homo sapiens
ttcaccccaatcccagc

SEQ ID NO: 3573591 - DNA, 20 bp, Homo sapiens
ttcacccccctctgctgccg

SEQ ID NO: 3573592 - DNA, 14 bp, Homo sapiens
ttcactaacctttt

SEQ ID NO: 3573593 - DNA, 23 bp, Homo sapiens
ttcactagaagccgtgggaagaa

SEQ ID NO: 3573594 - DNA, 23 bp, Homo sapiens
ttcactagtgaccccttccctgt

SEQ ID NO: 3573595 - DNA, 13 bp, Homo sapiens
ttcactgctggct

SEQ ID NO: 3573596 - DNA, 15 bp, Homo sapiens
ttcactgctggctgc

SEQ ID NO: 3573597 - DNA, 16 bp, Homo sapiens
ttcactgctggctgcc

SEQ ID NO: 3573598 - DNA, 18 bp, Homo sapiens
ttcactgctggctgcctt

SEQ ID NO: 3573599 - DNA, 23 bp, Homo sapiens
agcctcagaaggccccagagaga

SEQ ID NO: 3573600 - DNA, 22 bp, Homo sapiens
agcctcatgccaaccctgggct

SEQ ID NO: 3573601 - DNA, 23 bp, Homo sapiens
agcctccaaaaatggcagtgact

SEQ ID NO: 3573602 - DNA, 13 bp, Homo sapiens
agcctccaagggt

SEQ ID NO: 3573603 - DNA, 20 bp, Homo sapiens
agcctccatgctgcctccag

SEQ ID NO: 3573604 - DNA, 17 bp, Homo sapiens
agcctcccaccagagcc

SEQ ID NO: 3573605 - DNA, 21 bp, Homo sapiens
agcctcccaccagagccggga

SEQ ID NO: 3573606 - DNA, 12 bp, Homo sapiens
agcctcccctcc

SEQ ID NO: 3573607 - DNA, 16 bp, Homo sapiens
agcctccctgaagcct

SEQ ID NO: 3573608 - DNA, 16 bp, Homo sapiens
agcctccctgtctcca

SEQ ID NO: 3573609 - DNA, 19 bp, Homo sapiens
agcctccctgtctccagct

SEQ ID NO: 3573610 - DNA, 20 bp, Homo sapiens
agcctccctgtctccagctg

SEQ ID NO: 3573611 - DNA, 24 bp, Homo sapiens
agcctccctgtctccagctgcctg

SEQ ID NO: 3573612 - DNA, 15 bp, Homo sapiens
agcctccggaagctg

SEQ ID NO: 3573613 - DNA, 17 bp, Homo sapiens
agcctcctgccccctgc

SEQ ID NO: 3573614 - DNA, 20 bp, Homo sapiens
agcctcctgccccctgccag

SEQ ID NO: 3573615 - DNA, 12 bp, Homo sapiens
agcctcctggga

SEQ ID NO: 3573616 - DNA, 19 bp, Homo sapiens
agcctcctgtacctcagtg

SEQ ID NO: 3573617 - DNA, 18 bp, Homo sapiens
agcctctccgactctgca

SEQ ID NO: 3573618 - DNA, 18 bp, Homo sapiens
agcctctctccttggcca

SEQ ID NO: 3573619 - DNA, 20 bp, Homo sapiens
agcctctctggctggtcttc

SEQ ID NO: 3573620 - DNA, 23 bp, Homo sapiens
agcctctctggctggtcttcact

SEQ ID NO: 3573621 - DNA, 11 bp, Homo sapiens
agcctctggac

SEQ ID NO: 3573622 - DNA, 21 bp, Homo sapiens
agcctgcaggacctcgtgcca

SEQ ID NO: 3573623 - DNA, 13 bp, Homo sapiens
agcctgcttccca

SEQ ID NO: 3573624 - DNA, 17 bp, Homo sapiens
agcctgctttcctgcag

SEQ ID NO: 3573625 - DNA, 18 bp, Homo sapiens
agcctgctttcctgcagc

SEQ ID NO: 3573626 - DNA, 19 bp, Homo sapiens
agcctggcaacagagcgag

SEQ ID NO: 3573627 - DNA, 13 bp, Homo sapiens
agcctggccagac

SEQ ID NO: 3573628 - DNA, 18 bp, Homo sapiens
agcctggccagacacagg

SEQ ID NO: 3573629 - DNA, 21 bp, Homo sapiens
agcctggccagacacaggccc

SEQ ID NO: 3573630 - DNA, 12 bp, Homo sapiens
agcctggccagg

SEQ ID NO: 3573631 - DNA, 13 bp, Homo sapiens
agcctggctctgc

SEQ ID NO: 3573632 - DNA, 19 bp, Homo sapiens
agcctggctctgccccgca

SEQ ID NO: 3573633 - DNA, 15 bp, Homo sapiens
agcctgggagcccag

SEQ ID NO: 3573634 - DNA, 16 bp, Homo sapiens
agcctgggagcccaga

SEQ ID NO: 3573635 - DNA, 17 bp, Homo sapiens
agcctgggagcccagag

SEQ ID NO: 3573636 - DNA, 20 bp, Homo sapiens
agcctgggctcactgtgctg

SEQ ID NO: 3573637 - DNA, 20 bp, Homo sapiens
agcctggggtggggtcatgc

SEQ ID NO: 3573638 - DNA, 17 bp, Homo sapiens
agcctggttcagacaca

SEQ ID NO: 3573639 - DNA, 15 bp, Homo sapiens
agcctggtttctggg

SEQ ID NO: 3573640 - DNA, 19 bp, Homo sapiens
agcctgtgcgtcccagctg

SEQ ID NO: 3573641 - DNA, 19 bp, Homo sapiens
agccttaaaatgcattgaa

SEQ ID NO: 3573642 - DNA, 14 bp, Homo sapiens
agccttaagcaaat

SEQ ID NO: 3573643 - DNA, 15 bp, Homo sapiens
agccttaagcaaatt

SEQ ID NO: 3573644 - DNA, 18 bp, Homo sapiens
agccttaaggccctcatt

SEQ ID NO: 3573645 - DNA, 18 bp, Homo sapiens
agccttaatcaggtcctc

SEQ ID NO: 3573646 - DNA, 15 bp, Homo sapiens
agccttaccttgaaa

SEQ ID NO: 3573647 - DNA, 20 bp, Homo sapiens
agccttaccttgaaatgctg

SEQ ID NO: 3573648 - DNA, 13 bp, Homo sapiens
agccttagagctc

SEQ ID NO: 3573649 - DNA, 19 bp, Homo sapiens
agccttccaacatttcttg

SEQ ID NO: 3573650 - DNA, 19 bp, Homo sapiens
agccttccccagctccagc

SEQ ID NO: 3573651 - DNA, 12 bp, Homo sapiens
agccttcggaca

SEQ ID NO: 3573652 - DNA, 17 bp, Homo sapiens
agccttctaaattccca

SEQ ID NO: 3573653 - DNA, 19 bp, Homo sapiens
agccttcttgatgtatttc

SEQ ID NO: 3573654 - DNA, 14 bp, Homo sapiens
agccttgcagcggc

SEQ ID NO: 3573655 - DNA, 19 bp, Homo sapiens
agccttgcagcggctcctg

SEQ ID NO: 3573656 - DNA, 20 bp, Homo sapiens
agccttgcagcggctcctgc

SEQ ID NO: 3573657 - DNA, 22 bp, Homo sapiens
agccttgcagcggctcctgcaa

SEQ ID NO: 3573658 - DNA, 21 bp, Homo sapiens
agccttgcctaaatttaatgc

SEQ ID NO: 3573659 - DNA, 14 bp, Homo sapiens
agccttgtcagtgt

SEQ ID NO: 3573660 - DNA, 15 bp, Homo sapiens
agccttgtcagtgtg

SEQ ID NO: 3573661 - DNA, 22 bp, Homo sapiens
agcctttgtgctttttgtcatg

SEQ ID NO: 3573662 - DNA, 23 bp, Homo sapiens
agcctttgtgctttttgtcatgt

SEQ ID NO: 3573663 - DNA, 18 bp, Homo sapiens
agccttttatgtattttc

SEQ ID NO: 3573664 - DNA, 21 bp, Homo sapiens
agctgtagtttccgctttgct

SEQ ID NO: 3573665 - DNA, 13 bp, Homo sapiens
agctgtccctgca

SEQ ID NO: 3573666 - DNA, 11 bp, Homo sapiens
agctgtctgct

SEQ ID NO: 3573667 - DNA, 15 bp, Homo sapiens
agctgtctgtctcta

SEQ ID NO: 3573668 - DNA, 14 bp, Homo sapiens
agctgtgcaggcat

SEQ ID NO: 3573669 - DNA, 15 bp, Homo sapiens
agctgtgccagcagg

SEQ ID NO: 3573670 - DNA, 15 bp, Homo sapiens
agctgtgccttccct

SEQ ID NO: 3573671 - DNA, 19 bp, Homo sapiens
agctgtgctccacactcag

SEQ ID NO: 3573672 - DNA, 21 bp, Homo sapiens
agctgtgctccacactcagaa

SEQ ID NO: 3573673 - DNA, 22 bp, Homo sapiens
agctgtggcagagttacagttc

SEQ ID NO: 3573674 - DNA, 19 bp, Homo sapiens
agctgtgttattcctggtt

SEQ ID NO: 3573675 - DNA, 15 bp, Homo sapiens
agctgttatttcttc

SEQ ID NO: 3573676 - DNA, 17 bp, Homo sapiens
agctgttatttcttccc

SEQ ID NO: 3573677 - DNA, 14 bp, Homo sapiens
agctgttcacagcc

SEQ ID NO: 3573678 - DNA, 21 bp, Homo sapiens
agctgttccattacaccacag

SEQ ID NO: 3573679 - DNA, 19 bp, Homo sapiens
agctgtttggatacagctg

SEQ ID NO: 3573680 - DNA, 21 bp, Homo sapiens
agctgtttggatacagctgct

SEQ ID NO: 3573681 - DNA, 20 bp, Homo sapiens
agctgtttttgacagccttc

SEQ ID NO: 3573682 - DNA, 14 bp, Homo sapiens
agcttaaaacactt

SEQ ID NO: 3573683 - DNA, 16 bp, Homo sapiens
agcttaatcttaatgt

SEQ ID NO: 3573684 - DNA, 22 bp, Homo sapiens
agcttaatcttaatgtctggtg

SEQ ID NO: 3573685 - DNA, 19 bp, Homo sapiens
agcttacaagccagctgga

SEQ ID NO: 3573686 - DNA, 21 bp, Homo sapiens
agcttacaatcgcaaatcaaa

SEQ ID NO: 3573687 - DNA, 16 bp, Homo sapiens
agcttacaggagccag

SEQ ID NO: 3573688 - DNA, 13 bp, Homo sapiens
agcttacctgggc

SEQ ID NO: 3573689 - DNA, 20 bp, Homo sapiens
agcttattaaaactcatttt

SEQ ID NO: 3573690 - DNA, 21 bp, Homo sapiens
agcttattggtggctgttcct

SEQ ID NO: 3573691 - DNA, 18 bp, Homo sapiens
agcttcaacttttctctt

SEQ ID NO: 3573692 - DNA, 18 bp, Homo sapiens
agcttcaccccaatccca

SEQ ID NO: 3573693 - DNA, 15 bp, Homo sapiens
agcttcagactcaag

SEQ ID NO: 3573694 - DNA, 21 bp, Homo sapiens
agcttcagtaagttatctttg

SEQ ID NO: 3573695 - DNA, 18 bp, Homo sapiens
agcttccatgatgcacag

SEQ ID NO: 3573696 - DNA, 19 bp, Homo sapiens
agcttccatgatgcacagt

SEQ ID NO: 3573697 - DNA, 24 bp, Homo sapiens
agcttccatgatgcacagtatctg

SEQ ID NO: 3573698 - DNA, 14 bp, Homo sapiens
agcttcccaacaga

SEQ ID NO: 3573699 - DNA, 21 bp, Homo sapiens
agcttccctcccctctagttt

SEQ ID NO: 3573700 - DNA, 18 bp, Homo sapiens
agcttcctcacacccctg

SEQ ID NO: 3573701 - DNA, 19 bp, Homo sapiens
agcttcctcacacccctgt

SEQ ID NO: 3573702 - DNA, 22 bp, Homo sapiens
agcttcctcacacccctgtccc

SEQ ID NO: 3573703 - DNA, 13 bp, Homo sapiens
agcttcctgaggg

SEQ ID NO: 3573704 - DNA, 15 bp, Homo sapiens
agcttcctgagggct

SEQ ID NO: 3573705 - DNA, 16 bp, Homo sapiens
agcttcctgagggcta

SEQ ID NO: 3573706 - DNA, 14 bp, Homo sapiens
agcttccttggctt

SEQ ID NO: 3573707 - DNA, 14 bp, Homo sapiens
agcttctctctcca

SEQ ID NO: 3573708 - DNA, 16 bp, Homo sapiens
agcttctctctccagg

SEQ ID NO: 3573709 - DNA, 20 bp, Homo sapiens
agcttgctgggctttgggaa

SEQ ID NO: 3573710 - DNA, 11 bp, Homo sapiens
agcttggctca

SEQ ID NO: 3573711 - DNA, 12 bp, Homo sapiens
agcttgggaatg

SEQ ID NO: 3573712 - DNA, 14 bp, Homo sapiens
agcttgggaatgga

SEQ ID NO: 3573713 - DNA, 11 bp, Homo sapiens
agcttgggcag

SEQ ID NO: 3573714 - DNA, 17 bp, Homo sapiens
agcttgtatgcaatgga

SEQ ID NO: 3573715 - DNA, 18 bp, Homo sapiens
agcttgtatgcaatggat

SEQ ID NO: 3573716 - DNA, 17 bp, Homo sapiens
agctttccctgccaggc

SEQ ID NO: 3573717 - DNA, 16 bp, Homo sapiens
agctttgctaccaaag

SEQ ID NO: 3573718 - DNA, 10 bp, Homo sapiens
agctttgctc

SEQ ID NO: 3573719 - DNA, 13 bp, Homo sapiens
agctttgtctcca

SEQ ID NO: 3573720 - DNA, 21 bp, Homo sapiens
agctttgttctgggagttgct

SEQ ID NO: 3573721 - DNA, 18 bp, Homo sapiens
agctttgtttagtcttta

SEQ ID NO: 3573722 - DNA, 15 bp, Homo sapiens
agctttttattccct

SEQ ID NO: 3573723 - DNA, 17 bp, Homo sapiens
agctttttattccctgc

SEQ ID NO: 3573724 - DNA, 18 bp, Homo sapiens
agctttttattccctgcc

SEQ ID NO: 3573725 - DNA, 20 bp, Homo sapiens
aggaaaaccaagccgtggct

SEQ ID NO: 3573726 - DNA, 23 bp, Homo sapiens
aggaaaagaacaaacaaaactta

SEQ ID NO: 3573727 - DNA, 21 bp, Homo sapiens
aggaaaaggcccctgcaatgt

SEQ ID NO: 3573728 - DNA, 16 bp, Homo sapiens
aggaaaagtcttccta

SEQ ID NO: 3573729 - DNA, 14 bp, Homo sapiens
aggaaacaacagct

SEQ ID NO: 3573730 - DNA, 23 bp, Homo sapiens
aggaaagaagggggccctgctac

SEQ ID NO: 3573731 - DNA, 12 bp, Homo sapiens
aggaaaggagca

SEQ ID NO: 3573732 - DNA, 15 bp, Homo sapiens
aggaaaggattttac

SEQ ID NO: 3573733 - DNA, 12 bp, Homo sapiens
aggaaatattaa

SEQ ID NO: 3573734 - DNA, 19 bp, Homo sapiens
aggaaatcaaatatgcaaa

SEQ ID NO: 3573735 - DNA, 14 bp, Homo sapiens
aggaaattccaaat

SEQ ID NO: 3573736 - DNA, 16 bp, Homo sapiens
aggaacaaaaattaca

SEQ ID NO: 3573737 - DNA, 21 bp, Homo sapiens
aggaacaaaaattacaaagaa

SEQ ID NO: 3573738 - DNA, 14 bp, Homo sapiens
aggaacaaagacag

SEQ ID NO: 3573739 - DNA, 15 bp, Homo sapiens
aggaacaaagacagg

SEQ ID NO: 3573740 - DNA, 12 bp, Homo sapiens
aggaacactgac

SEQ ID NO: 3573741 - DNA, 13 bp, Homo sapiens
aggaacactgaca

SEQ ID NO: 3573742 - DNA, 13 bp, Homo sapiens
aggaaccctcagg

SEQ ID NO: 3573743 - DNA, 17 bp, Homo sapiens
aggaaccctcaggccac

SEQ ID NO: 3573744 - DNA, 16 bp, Homo sapiens
ttccccagtgactcca

SEQ ID NO: 3573745 - DNA, 19 bp, Homo sapiens
ttccccagtgactccaggg

SEQ ID NO: 3573746 - DNA, 20 bp, Homo sapiens
ttccccccattttgcctctg

SEQ ID NO: 3573747 - DNA, 19 bp, Homo sapiens
ttccccctcttcttctgaa

SEQ ID NO: 3573748 - DNA, 21 bp, Homo sapiens
ttccccctcttcttctgaaga

SEQ ID NO: 3573749 - DNA, 17 bp, Homo sapiens
ttcccccttcccatttc

SEQ ID NO: 3573750 - DNA, 15 bp, Homo sapiens
ttcccctatcattta

SEQ ID NO: 3573751 - DNA, 19 bp, Homo sapiens
ttccccttagaaacactgc

SEQ ID NO: 3573752 - DNA, 12 bp, Homo sapiens
ttccccttccct

SEQ ID NO: 3573753 - DNA, 15 bp, Homo sapiens
ttccccttcccttat

SEQ ID NO: 3573754 - DNA, 14 bp, Homo sapiens
ttcccgctcagccc

SEQ ID NO: 3573755 - DNA, 13 bp, Homo sapiens
ttccctaaactgc

SEQ ID NO: 3573756 - DNA, 13 bp, Homo sapiens
ttccctacttcct

SEQ ID NO: 3573757 - DNA, 14 bp, Homo sapiens
ttccctacttcctg

SEQ ID NO: 3573758 - DNA, 16 bp, Homo sapiens
ttccctattttgaatg

SEQ ID NO: 3573759 - DNA, 11 bp, Homo sapiens
ttccctccccc

SEQ ID NO: 3573760 - DNA, 22 bp, Homo sapiens
ttccctccccctccttgtgcct

SEQ ID NO: 3573761 - DNA, 21 bp, Homo sapiens
ttccctctctcataccctccc

SEQ ID NO: 3573762 - DNA, 14 bp, Homo sapiens
ttccctctgtgtta

SEQ ID NO: 3573763 - DNA, 22 bp, Homo sapiens
ttccctgcaggtagttgagttg

SEQ ID NO: 3573764 - DNA, 17 bp, Homo sapiens
ttccctgcccaaaccct

SEQ ID NO: 3573765 - DNA, 22 bp, Homo sapiens
ttccctgcccaaacccttaact

SEQ ID NO: 3573766 - DNA, 22 bp, Homo sapiens
aaaacttcaaagctgaatattt

SEQ ID NO: 3573767 - DNA, 12 bp, Homo sapiens
aaaacttctgct

SEQ ID NO: 3573768 - DNA, 15 bp, Homo sapiens
aaaagaaaatttttg

SEQ ID NO: 3573769 - DNA, 18 bp, Homo sapiens
aaaagaaacaccagtgtt

SEQ ID NO: 3573770 - DNA, 11 bp, Homo sapiens
aaaagaaagaa

SEQ ID NO: 3573771 - DNA, 21 bp, Homo sapiens
aaaagagcagtggtaagaata

SEQ ID NO: 3573772 - DNA, 18 bp, Homo sapiens
aaaagatgaaaaagaata

SEQ ID NO: 3573773 - DNA, 21 bp, Homo sapiens
aaaagattataggaactgagg

SEQ ID NO: 3573774 - DNA, 23 bp, Homo sapiens
aaaagattataggaactgaggtt

SEQ ID NO: 3573775 - DNA, 17 bp, Homo sapiens
aaaagattcttcttaaa

SEQ ID NO: 3573776 - DNA, 15 bp, Homo sapiens
aaaagattgccaatt

SEQ ID NO: 3573777 - DNA, 13 bp, Homo sapiens
aaaagcaacactt

SEQ ID NO: 3573778 - DNA, 17 bp, Homo sapiens
aaaagcacaagtacttt

SEQ ID NO: 3573779 - DNA, 17 bp, Homo sapiens
aaaagcagctctcccct

SEQ ID NO: 3573780 - DNA, 23 bp, Homo sapiens
aaaagccaggttccacagaggac

SEQ ID NO: 3573781 - DNA, 14 bp, Homo sapiens
aaaagcctctttct

SEQ ID NO: 3573782 - DNA, 19 bp, Homo sapiens
aaaaggacatcagcaaaca

SEQ ID NO: 3573783 - DNA, 19 bp, Homo sapiens
aaaaggatctttgtggcca

SEQ ID NO: 3573784 - DNA, 23 bp, Homo sapiens
aaaaggatctttgtggccaagga

SEQ ID NO: 3573785 - DNA, 21 bp, Homo sapiens
aaaaggctgctcacaagttct

SEQ ID NO: 3573786 - DNA, 13 bp, Homo sapiens
aaaagtaataaag

SEQ ID NO: 3573787 - DNA, 21 bp, Homo sapiens
aaaagtaatgacttagaaact

SEQ ID NO: 3573788 - DNA, 16 bp, Homo sapiens
aaaagtataaaatagt

SEQ ID NO: 3573789 - DNA, 20 bp, Homo sapiens
aaaagtcaaagtgttgctgt

SEQ ID NO: 3573790 - DNA, 18 bp, Homo sapiens
aaaagtctacctgtgttt

SEQ ID NO: 3573791 - DNA, 16 bp, Homo sapiens
aaaagttatttatgct

SEQ ID NO: 3573792 - DNA, 21 bp, Homo sapiens
aaaagttatttatgctataaa

SEQ ID NO: 3573793 - DNA, 13 bp, Homo sapiens
aaaagttcatgtt

SEQ ID NO: 3573794 - DNA, 17 bp, Homo sapiens
aaaagttgcattttaac

SEQ ID NO: 3573795 - DNA, 14 bp, Homo sapiens
aaaagttgttcttt

SEQ ID NO: 3573796 - DNA, 13 bp, Homo sapiens
aaaataaaaatgg

SEQ ID NO: 3573797 - DNA, 12 bp, Homo sapiens
aaaataaacaaa

SEQ ID NO: 3573798 - DNA, 14 bp, Homo sapiens
aaaataaaccaaat

SEQ ID NO: 3573799 - DNA, 22 bp, Homo sapiens
aaaataaaccaaatatgttaaa

SEQ ID NO: 3573800 - DNA, 21 bp, Homo sapiens
aaaataactgaaccaaattgc

SEQ ID NO: 3573801 - DNA, 22 bp, Homo sapiens
aaaataactgaaccaaattgca

SEQ ID NO: 3573802 - DNA, 14 bp, Homo sapiens
aaaataaggttatg

SEQ ID NO: 3573803 - DNA, 14 bp, Homo sapiens
aaaataataaagtc

SEQ ID NO: 3573804 - DNA, 14 bp, Homo sapiens
aaaatatatactaa

SEQ ID NO: 3573805 - DNA, 18 bp, Homo sapiens
aaaatatatttataagga

SEQ ID NO: 3573806 - DNA, 19 bp, Homo sapiens
aaaatattattttattata

SEQ ID NO: 3573807 - DNA, 20 bp, Homo sapiens
aaaatattgttttacaatag

SEQ ID NO: 3573808 - DNA, 14 bp, Homo sapiens
aaaatcaaaacaag

SEQ ID NO: 3573809 - DNA, 12 bp, Homo sapiens
aaaatcaagagt

SEQ ID NO: 3573810 - DNA, 16 bp, Homo sapiens
aaaatcaagagtgaga

SEQ ID NO: 3573811 - DNA, 14 bp, Homo sapiens
aaaatcacacctga

SEQ ID NO: 3573812 - DNA, 18 bp, Homo sapiens
aaaatcagaacaaaactt

SEQ ID NO: 3573813 - DNA, 10 bp, Homo sapiens
aaaatcattt

SEQ ID NO: 3573814 - DNA, 15 bp, Homo sapiens
aaaatccaaaaagct

SEQ ID NO: 3573815 - DNA, 21 bp, Homo sapiens
aaaatccaaaaagctctgaaa

SEQ ID NO: 3573816 - DNA, 22 bp, Homo sapiens
aaaatccaagctgctcatttca

SEQ ID NO: 3573817 - DNA, 17 bp, Homo sapiens
aaaatcccccagcactt

SEQ ID NO: 3573818 - DNA, 15 bp, Homo sapiens
aaaatcctcaggaaa

SEQ ID NO: 3573819 - DNA, 18 bp, Homo sapiens
aaaatctaaaatttcata

SEQ ID NO: 3573820 - DNA, 14 bp, Homo sapiens
aaaatcttaatgta

SEQ ID NO: 3573821 - DNA, 11 bp, Homo sapiens
aaaatcttcac

SEQ ID NO: 3573822 - DNA, 22 bp, Homo sapiens
aaaatgatttgtagtggaaaca

SEQ ID NO: 3573823 - DNA, 18 bp, Homo sapiens
aaaatgcagcagggatgc

SEQ ID NO: 3573824 - DNA, 19 bp, Homo sapiens
aaaatgctggtgaaatgct

SEQ ID NO: 3573825 - DNA, 16 bp, Homo sapiens
aaaatgcttacatttg

SEQ ID NO: 3573826 - DNA, 23 bp, Homo sapiens
aaaatggccatttgctttttcac

SEQ ID NO: 3573827 - DNA, 18 bp, Homo sapiens
aaaatggcgaacatgtgt

SEQ ID NO: 3573828 - DNA, 19 bp, Homo sapiens
aaaatggcgaacatgtgtt

SEQ ID NO: 3573829 - DNA, 16 bp, Homo sapiens
aaaatggttgatggaa

SEQ ID NO: 3573830 - DNA, 18 bp, Homo sapiens
aaaatggttgatggaaaa

SEQ ID NO: 3573831 - DNA, 19 bp, Homo sapiens
aaaatggttgatggaaaat

SEQ ID NO: 3573832 - DNA, 11 bp, Homo sapiens
aaaatgtatat

SEQ ID NO: 3573833 - DNA, 21 bp, Homo sapiens
aaaatgtattcaagcaaacat

SEQ ID NO: 3573834 - DNA, 18 bp, Homo sapiens
aaaatgtcctgcctttta

SEQ ID NO: 3573835 - DNA, 20 bp, Homo sapiens
aaaatgttacgtgaagaaat

SEQ ID NO: 3573836 - DNA, 22 bp, Homo sapiens
aaaatgttacgtgaagaaataa

SEQ ID NO: 3573837 - DNA, 21 bp, Homo sapiens
aaaatgttggggtaaaagtgt

SEQ ID NO: 3573838 - DNA, 14 bp, Homo sapiens
aaaattaattatgt

SEQ ID NO: 3573839 - DNA, 13 bp, Homo sapiens
aaaattcattttt

SEQ ID NO: 3573840 - DNA, 23 bp, Homo sapiens
aaaattccctggggtcaccttct

SEQ ID NO: 3573841 - DNA, 15 bp, Homo sapiens
aaaattgcattttta

SEQ ID NO: 3573842 - DNA, 22 bp, Homo sapiens
aaaattgcatttttacctttca

SEQ ID NO: 3573843 - DNA, 16 bp, Homo sapiens
aaaattgtgatgtgtc

SEQ ID NO: 3573844 - DNA, 13 bp, Homo sapiens
aaaattgttattt

SEQ ID NO: 3573845 - DNA, 12 bp, Homo sapiens
aaaatttataca

SEQ ID NO: 3573846 - DNA, 19 bp, Homo sapiens
aaaatttcataattctgaa

SEQ ID NO: 3573847 - DNA, 17 bp, Homo sapiens
aaaatttgtcttaaaaa

SEQ ID NO: 3573848 - DNA, 11 bp, Homo sapiens
aaacaaaacaa

SEQ ID NO: 3573849 - DNA, 13 bp, Homo sapiens
aaacaaaacttaa

SEQ ID NO: 3573850 - DNA, 13 bp, Homo sapiens
aaacaaacaaaac

SEQ ID NO: 3573851 - DNA, 12 bp, Homo sapiens
aaacaaagacat

SEQ ID NO: 3573852 - DNA, 18 bp, Homo sapiens
aaacaaagggaaaaaaga

SEQ ID NO: 3573853 - DNA, 13 bp, Homo sapiens
aaacaaatgaaat

SEQ ID NO: 3573854 - DNA, 17 bp, Homo sapiens
aaacaacgttgctattt

SEQ ID NO: 3573855 - DNA, 17 bp, Homo sapiens
aaacaagtttagaaagc

SEQ ID NO: 3573856 - DNA, 16 bp, Homo sapiens
aaacaataagaacaag

SEQ ID NO: 3573857 - DNA, 15 bp, Homo sapiens
aaacaatcccaatct

SEQ ID NO: 3573858 - DNA, 18 bp, Homo sapiens
aaacaatcccaatctttc

SEQ ID NO: 3573859 - DNA, 11 bp, Homo sapiens
aaacacacatt

SEQ ID NO: 3573860 - DNA, 17 bp, Homo sapiens
aaacaccagtgttagct

SEQ ID NO: 3573861 - DNA, 21 bp, Homo sapiens
aaacagaaacaaaaacactaa

SEQ ID NO: 3573862 - DNA, 22 bp, Homo sapiens
aaacagacttgtatattctatt

SEQ ID NO: 3573863 - DNA, 20 bp, Homo sapiens
aaacagagtccaatttaagg

SEQ ID NO: 3573864 - DNA, 15 bp, Homo sapiens
aaacagagtggcctc

SEQ ID NO: 3573865 - DNA, 19 bp, Homo sapiens
aaacagcatgaataaaaca

SEQ ID NO: 3573866 - DNA, 23 bp, Homo sapiens
aaacagcatgaataaaacactca

SEQ ID NO: 3573867 - DNA, 17 bp, Homo sapiens
aaacagctcagccagtg

SEQ ID NO: 3573868 - DNA, 13 bp, Homo sapiens
aaacagctttgtc

SEQ ID NO: 3573869 - DNA, 14 bp, Homo sapiens
aaacagctttgtct

SEQ ID NO: 3573870 - DNA, 22 bp, Homo sapiens
aaacagctttgtctccaaagaa

SEQ ID NO: 3573871 - DNA, 17 bp, Homo sapiens
aaacagggtctcactct

SEQ ID NO: 3573872 - DNA, 14 bp, Homo sapiens
aaacagtgagcctg

SEQ ID NO: 3573873 - DNA, 22 bp, Homo sapiens
aaacataataaatcacacattc

SEQ ID NO: 3573874 - DNA, 15 bp, Homo sapiens
aaacatattcaagga

SEQ ID NO: 3573875 - DNA, 18 bp, Homo sapiens
aaacatcaaataaatttc

SEQ ID NO: 3573876 - DNA, 19 bp, Homo sapiens
aaacatcaaataaatttct

SEQ ID NO: 3573877 - DNA, 13 bp, Homo sapiens
aaacatcattgtt

SEQ ID NO: 3573878 - DNA, 20 bp, Homo sapiens
aaacatcctatgaaatactt

SEQ ID NO: 3573879 - DNA, 14 bp, Homo sapiens
aaacattaaaatat

SEQ ID NO: 3573880 - DNA, 21 bp, Homo sapiens
aaacattcaattccagagaac

SEQ ID NO: 3573881 - DNA, 17 bp, Homo sapiens
aaacattcctccagcct

SEQ ID NO: 3573882 - DNA, 23 bp, Homo sapiens
aaacattcctccagcctcccctc

SEQ ID NO: 3573883 - DNA, 19 bp, Homo sapiens
aaacattttaaatgaaagt

SEQ ID NO: 3573884 - DNA, 15 bp, Homo sapiens
aaacattttgtatca

SEQ ID NO: 3573885 - DNA, 15 bp, Homo sapiens
aaacattttttcttc

SEQ ID NO: 3573886 - DNA, 22 bp, Homo sapiens
aaacattttttcttctgaagat

SEQ ID NO: 3573887 - DNA, 19 bp, Homo sapiens
aaaccaacaagaaccactc

SEQ ID NO: 3573888 - DNA, 16 bp, Homo sapiens
aaaccacagcagttga

SEQ ID NO: 3573889 - DNA, 16 bp, Homo sapiens
aaaccagaaaagcaat

SEQ ID NO: 3573890 - DNA, 17 bp, Homo sapiens
aaaccataaaataaata

SEQ ID NO: 3573891 - DNA, 20 bp, Homo sapiens
aaacccacgacctgtcctgt

SEQ ID NO: 3573892 - DNA, 22 bp, Homo sapiens
aaacccactcatgactgcatga

SEQ ID NO: 3573893 - DNA, 14 bp, Homo sapiens
aaacccagactgtc

SEQ ID NO: 3573894 - DNA, 16 bp, Homo sapiens
aaaccccaagcttccc

SEQ ID NO: 3573895 - DNA, 11 bp, Homo sapiens
aaaccccagcc

SEQ ID NO: 3573896 - DNA, 18 bp, Homo sapiens
aaaccccagccccaactc

SEQ ID NO: 3573897 - DNA, 21 bp, Homo sapiens
aaacccccaaaatccaaaact

SEQ ID NO: 3573898 - DNA, 18 bp, Homo sapiens
aaacccctcagacagttt

SEQ ID NO: 3573899 - DNA, 16 bp, Homo sapiens
aaaggattttaccaaa

SEQ ID NO: 3573900 - DNA, 14 bp, Homo sapiens
aaaggcagttttct

SEQ ID NO: 3573901 - DNA, 24 bp, Homo sapiens
aaagggaagtaacagacacacgat

SEQ ID NO: 3573902 - DNA, 20 bp, Homo sapiens
aaagggatggcaagatgtgg

SEQ ID NO: 3573903 - DNA, 20 bp, Homo sapiens
aaagggtttgatatggagaa

SEQ ID NO: 3573904 - DNA, 19 bp, Homo sapiens
aaaggtaaatggttaaatt

SEQ ID NO: 3573905 - DNA, 22 bp, Homo sapiens
aaaggtaaatggttaaatttta

SEQ ID NO: 3573906 - DNA, 23 bp, Homo sapiens
aaaggtaaatggttaaattttac

SEQ ID NO: 3573907 - DNA, 21 bp, Homo sapiens
aaaggtacactggtatttata

SEQ ID NO: 3573908 - DNA, 12 bp, Homo sapiens
aaaggtggcagc

SEQ ID NO: 3573909 - DNA, 22 bp, Homo sapiens
aaaggtgtgaggagagaggagg

SEQ ID NO: 3573910 - DNA, 20 bp, Homo sapiens
aaaggtgtgcttcctgctgt

SEQ ID NO: 3573911 - DNA, 18 bp, Homo sapiens
aaaggtgttgtcccttct

SEQ ID NO: 3573912 - DNA, 12 bp, Homo sapiens
aaagtaataaag

SEQ ID NO: 3573913 - DNA, 20 bp, Homo sapiens
aaagtaataaagagaaatat

SEQ ID NO: 3573914 - DNA, 19 bp, Homo sapiens
aaagtaatttaatttgtaa

SEQ ID NO: 3573915 - DNA, 17 bp, Homo sapiens
aaagtacatatttattt

SEQ ID NO: 3573916 - DNA, 11 bp, Homo sapiens
aaagtagaggt

SEQ ID NO: 3573917 - DNA, 16 bp, Homo sapiens
aaagtatgttttactt

SEQ ID NO: 3573918 - DNA, 20 bp, Homo sapiens
aaagtatgtttttaaatttt

SEQ ID NO: 3573919 - DNA, 15 bp, Homo sapiens
aaagtccaagtctgt

SEQ ID NO: 3573920 - DNA, 19 bp, Homo sapiens
aaagtctgttgattaaaga

SEQ ID NO: 3573921 - DNA, 20 bp, Homo sapiens
aaagtctgttgattaaagat

SEQ ID NO: 3573922 - DNA, 15 bp, Homo sapiens
aaagtcttggtttta

SEQ ID NO: 3573923 - DNA, 10 bp, Homo sapiens
aaagtgcagt

SEQ ID NO: 3573924 - DNA, 11 bp, Homo sapiens
aaagtgcagta

SEQ ID NO: 3573925 - DNA, 20 bp, Homo sapiens
aaagtgcctgagctggggaa

SEQ ID NO: 3573926 - DNA, 22 bp, Homo sapiens
aaagtgcctgggctcagcctgg

SEQ ID NO: 3573927 - DNA, 23 bp, Homo sapiens
aaagtgcctgggctcagcctggt

SEQ ID NO: 3573928 - DNA, 21 bp, Homo sapiens
aaagtgggaggtcaggaaact

SEQ ID NO: 3573929 - DNA, 22 bp, Homo sapiens
aaagttaccagtgccttaaact

SEQ ID NO: 3573930 - DNA, 14 bp, Homo sapiens
aaagttatttatgc

SEQ ID NO: 3573931 - DNA, 22 bp, Homo sapiens
aaagttatttatgctataaatt

SEQ ID NO: 3573932 - DNA, 18 bp, Homo sapiens
aaagttgtaaaatagaaa

SEQ ID NO: 3573933 - DNA, 17 bp, Homo sapiens
aaagtttaaatgtattt

SEQ ID NO: 3573934 - DNA, 23 bp, Homo sapiens
aaagtttaaatgtattttacata

SEQ ID NO: 3573935 - DNA, 19 bp, Homo sapiens
aaagtttcaatttgtttcc

SEQ ID NO: 3573936 - DNA, 18 bp, Homo sapiens
aaagttttattataaatt

SEQ ID NO: 3573937 - DNA, 21 bp, Homo sapiens
aaagttttattataaattcta

SEQ ID NO: 3573938 - DNA, 16 bp, Homo sapiens
aaagttttccagtatt

SEQ ID NO: 3573939 - DNA, 19 bp, Homo sapiens
aaataaaaagtaatgactt

SEQ ID NO: 3573940 - DNA, 14 bp, Homo sapiens
aaataaaaccagct

SEQ ID NO: 3573941 - DNA, 14 bp, Homo sapiens
aaataaaatatatc

SEQ ID NO: 3573942 - DNA, 18 bp, Homo sapiens
aaataaacaaataacaat

SEQ ID NO: 3573943 - DNA, 15 bp, Homo sapiens
aaataaataatctca

SEQ ID NO: 3573944 - DNA, 16 bp, Homo sapiens
aaataaataatctcat

SEQ ID NO: 3573945 - DNA, 19 bp, Homo sapiens
aaataaataatctcatccc

SEQ ID NO: 3573946 - DNA, 14 bp, Homo sapiens
aaataaataatttt

SEQ ID NO: 3573947 - DNA, 19 bp, Homo sapiens
aaataaatcttagtgttca

SEQ ID NO: 3573948 - DNA, 11 bp, Homo sapiens
aaataaattat

SEQ ID NO: 3573949 - DNA, 12 bp, Homo sapiens
aaataaatttct

SEQ ID NO: 3573950 - DNA, 13 bp, Homo sapiens
aaataaatttctg

SEQ ID NO: 3573951 - DNA, 14 bp, Homo sapiens
aaataaatttctgg

SEQ ID NO: 3573952 - DNA, 13 bp, Homo sapiens
aaataacacagat

SEQ ID NO: 3573953 - DNA, 19 bp, Homo sapiens
aaataactgaaccaaattg

SEQ ID NO: 3573954 - DNA, 13 bp, Homo sapiens
aaataattttgta

SEQ ID NO: 3573955 - DNA, 15 bp, Homo sapiens
aaatacacactcaaa

SEQ ID NO: 3573956 - DNA, 18 bp, Homo sapiens
aaatacaccgtttagaaa

SEQ ID NO: 3573957 - DNA, 16 bp, Homo sapiens
aaataccttctatgta

SEQ ID NO: 3573958 - DNA, 22 bp, Homo sapiens
aaatacctttgtagttactcaa

SEQ ID NO: 3573959 - DNA, 16 bp, Homo sapiens
aaataggatcctggag

SEQ ID NO: 3573960 - DNA, 19 bp, Homo sapiens
aaatagggaagatggagac

SEQ ID NO: 3573961 - DNA, 18 bp, Homo sapiens
aaatataacaggtgcttc

SEQ ID NO: 3573962 - DNA, 23 bp, Homo sapiens
aaatatcccttggacattttatg

SEQ ID NO: 3573963 - DNA, 17 bp, Homo sapiens
aaatatctatgttttac

SEQ ID NO: 3573964 - DNA, 13 bp, Homo sapiens
aaatatgcaaagc

SEQ ID NO: 3573965 - DNA, 17 bp, Homo sapiens
aaatatgttctctgaat

SEQ ID NO: 3573966 - DNA, 20 bp, Homo sapiens
aaatattaaaattgttaata

SEQ ID NO: 3573967 - DNA, 17 bp, Homo sapiens
aaatattaacatattat

SEQ ID NO: 3573968 - DNA, 20 bp, Homo sapiens
aaatattcctgcatttgtga

SEQ ID NO: 3573969 - DNA, 22 bp, Homo sapiens
aaatattgttttacaatagttc

SEQ ID NO: 3573970 - DNA, 22 bp, Homo sapiens
aaatattttccgtcacttaaat

SEQ ID NO: 3573971 - DNA, 12 bp, Homo sapiens
aaatattttgct

SEQ ID NO: 3573972 - DNA, 14 bp, Homo sapiens
aaatattttgctaa

SEQ ID NO: 3573973 - DNA, 18 bp, Homo sapiens
aaatattttgctaactgg

SEQ ID NO: 3573974 - DNA, 12 bp, Homo sapiens
aaatcaaatatg

SEQ ID NO: 3573975 - DNA, 12 bp, Homo sapiens
aaatcagaagtc

SEQ ID NO: 3573976 - DNA, 21 bp, Homo sapiens
aaatcatttctgcatcagctg

SEQ ID NO: 3573977 - DNA, 15 bp, Homo sapiens
aaatccaaaacttct

SEQ ID NO: 3573978 - DNA, 15 bp, Homo sapiens
aaatccagtggtggg

SEQ ID NO: 3573979 - DNA, 17 bp, Homo sapiens
aaatccagtggtgggta

SEQ ID NO: 3573980 - DNA, 19 bp, Homo sapiens
aaatccagtggtgggtaat

SEQ ID NO: 3573981 - DNA, 20 bp, Homo sapiens
aaatccagtggtgggtaatt

SEQ ID NO: 3573982 - DNA, 16 bp, Homo sapiens
aaatcccaccttccca

SEQ ID NO: 3573983 - DNA, 17 bp, Homo sapiens
aaatccctgcctcaggc

SEQ ID NO: 3573984 - DNA, 19 bp, Homo sapiens
aaatcctagacttgaaagt

SEQ ID NO: 3573985 - DNA, 22 bp, Homo sapiens
aaatcctattctgatgaatctc

SEQ ID NO: 3573986 - DNA, 17 bp, Homo sapiens
aaatcctgaagagcatt

SEQ ID NO: 3573987 - DNA, 23 bp, Homo sapiens
aaatccttgagagttccggggag

SEQ ID NO: 3573988 - DNA, 19 bp, Homo sapiens
aaatctaaaatttcataat

SEQ ID NO: 3573989 - DNA, 19 bp, Homo sapiens
aaatctgtaacaggtattt

SEQ ID NO: 3573990 - DNA, 22 bp, Homo sapiens
aaatctgtaacaggtattttgt

SEQ ID NO: 3573991 - DNA, 14 bp, Homo sapiens
aaatcttaacttga

SEQ ID NO: 3573992 - DNA, 15 bp, Homo sapiens
aaatcttcactttct

SEQ ID NO: 3573993 - DNA, 16 bp, Homo sapiens
aaatcttctagcatgt

SEQ ID NO: 3573994 - DNA, 15 bp, Homo sapiens
aaatcttgaatttct

SEQ ID NO: 3573995 - DNA, 14 bp, Homo sapiens
aaatctttaagaat

SEQ ID NO: 3573996 - DNA, 18 bp, Homo sapiens
aaatgaaagtattggcat

SEQ ID NO: 3573997 - DNA, 22 bp, Homo sapiens
aaatgaaatcttcccagtatta

SEQ ID NO: 3573998 - DNA, 15 bp, Homo sapiens
aaatgaaatgcatat

SEQ ID NO: 3573999 - DNA, 22 bp, Homo sapiens
aaatgaaatttaattacaaaca

SEQ ID NO: 3574000 - DNA, 23 bp, Homo sapiens
aaatgaactttcagcagtctaaa

SEQ ID NO: 3574001 - DNA, 16 bp, Homo sapiens
aaatgaagaaggaagc

SEQ ID NO: 3574002 - DNA, 14 bp, Homo sapiens
aaatgaatagtaca

SEQ ID NO: 3574003 - DNA, 20 bp, Homo sapiens
aaatgaccgagccctggaga

SEQ ID NO: 3574004 - DNA, 15 bp, Homo sapiens
aaatgacctcaagga

SEQ ID NO: 3574005 - DNA, 12 bp, Homo sapiens
aaatgacggtgt

SEQ ID NO: 3574006 - DNA, 23 bp, Homo sapiens
aaatgacggtgttaattttgcta

SEQ ID NO: 3574007 - DNA, 13 bp, Homo sapiens
aaatgagaatgaa

SEQ ID NO: 3574008 - DNA, 13 bp, Homo sapiens
aaatgaggatcca

SEQ ID NO: 3574009 - DNA, 14 bp, Homo sapiens
aaatgaggatccag

SEQ ID NO: 3574010 - DNA, 15 bp, Homo sapiens
aaatgaggatccagg

SEQ ID NO: 3574011 - DNA, 17 bp, Homo sapiens
aaatgagtcatttgttt

SEQ ID NO: 3574012 - DNA, 22 bp, Homo sapiens
aaatgagtcatttgtttaaaca

SEQ ID NO: 3574013 - DNA, 15 bp, Homo sapiens
aaatgatttcacagt

SEQ ID NO: 3574014 - DNA, 19 bp, Homo sapiens
aaatgcaggtgtcctgagc

SEQ ID NO: 3574015 - DNA, 20 bp, Homo sapiens
aaatgcattataggatcatt

SEQ ID NO: 3574016 - DNA, 23 bp, Homo sapiens
aaatgccctcctaaatgtcagct

SEQ ID NO: 3574017 - DNA, 15 bp, Homo sapiens
aaatgcctgactcag

SEQ ID NO: 3574018 - DNA, 17 bp, Homo sapiens
aaatgccttaaaatgga

SEQ ID NO: 3574019 - DNA, 18 bp, Homo sapiens
aaatgccttaaaatggaa

SEQ ID NO: 3574020 - DNA, 16 bp, Homo sapiens
aaatgctctctcaaat

SEQ ID NO: 3574021 - DNA, 22 bp, Homo sapiens
aaatgctctctcaaattgtcag

SEQ ID NO: 3574022 - DNA, 23 bp, Homo sapiens
aaatgctgtctttcttgctccct

SEQ ID NO: 3574023 - DNA, 18 bp, Homo sapiens
aaatgctgttagtaaatt

SEQ ID NO: 3574024 - DNA, 18 bp, Homo sapiens
aaatgcttgggtacactt

SEQ ID NO: 3574025 - DNA, 20 bp, Homo sapiens
aaatggaacgctaatgaaac

SEQ ID NO: 3574026 - DNA, 22 bp, Homo sapiens
aaatggaattgaaaaactcttt

SEQ ID NO: 3574027 - DNA, 16 bp, Homo sapiens
aaatggccatttgctt

SEQ ID NO: 3574028 - DNA, 19 bp, Homo sapiens
aaatggccatttgcttttt

SEQ ID NO: 3574029 - DNA, 23 bp, Homo sapiens
aaatggccatttgctttttcacc

SEQ ID NO: 3574030 - DNA, 17 bp, Homo sapiens
aaatggcccggacatgt

SEQ ID NO: 3574031 - DNA, 19 bp, Homo sapiens
aacatgtgttttcatcatt

SEQ ID NO: 3574032 - DNA, 15 bp, Homo sapiens
aacattacttattta

SEQ ID NO: 3574033 - DNA, 15 bp, Homo sapiens
aacattcagctctgg

SEQ ID NO: 3574034 - DNA, 22 bp, Homo sapiens
aacattcagctctggagaacag

SEQ ID NO: 3574035 - DNA, 16 bp, Homo sapiens
aacattccatttgctt

SEQ ID NO: 3574036 - DNA, 13 bp, Homo sapiens
aacattcctccag

SEQ ID NO: 3574037 - DNA, 16 bp, Homo sapiens
aacattcctccagcct

SEQ ID NO: 3574038 - DNA, 21 bp, Homo sapiens
aacattcctccagcctcccct

SEQ ID NO: 3574039 - DNA, 18 bp, Homo sapiens
aacattcgtgagctgggg

SEQ ID NO: 3574040 - DNA, 16 bp, Homo sapiens
aacattttaaatgaaa

SEQ ID NO: 3574041 - DNA, 17 bp, Homo sapiens
aacattttacccacaca

SEQ ID NO: 3574042 - DNA, 23 bp, Homo sapiens
aacattttttttttaaatcaagt

SEQ ID NO: 3574043 - DNA, 15 bp, Homo sapiens
aaccaaatatgttaa

SEQ ID NO: 3574044 - DNA, 23 bp, Homo sapiens
aaccaaatatgttaaagtttaag

SEQ ID NO: 3574045 - DNA, 20 bp, Homo sapiens
aaccaacaagaaccactcct

SEQ ID NO: 3574046 - DNA, 15 bp, Homo sapiens
aaccaaggaatttaa

SEQ ID NO: 3574047 - DNA, 10 bp, Homo sapiens
aaccaagttc

SEQ ID NO: 3574048 - DNA, 23 bp, Homo sapiens
aaccaatagttgccaatctaaaa

SEQ ID NO: 3574049 - DNA, 21 bp, Homo sapiens
aaccacaccacatctaagcct

SEQ ID NO: 3574050 - DNA, 21 bp, Homo sapiens
aaccacatttcctctgttctt

SEQ ID NO: 3574051 - DNA, 20 bp, Homo sapiens
aaccagcccgacagtgccat

SEQ ID NO: 3574052 - DNA, 18 bp, Homo sapiens
aaccagtccccccaccct

SEQ ID NO: 3574053 - DNA, 19 bp, Homo sapiens
aaccagtctcctcactctg

SEQ ID NO: 3574054 - DNA, 15 bp, Homo sapiens
aaccataaaataaat

SEQ ID NO: 3574055 - DNA, 18 bp, Homo sapiens
aaccataaaataaataat

SEQ ID NO: 3574056 - DNA, 15 bp, Homo sapiens
aaccatcggtccaca

SEQ ID NO: 3574057 - DNA, 16 bp, Homo sapiens
aaccatgcaggaagga

SEQ ID NO: 3574058 - DNA, 22 bp, Homo sapiens
aaccatgcaggaaggaaaacta

SEQ ID NO: 3574059 - DNA, 18 bp, Homo sapiens
aacccaaaggtggcagct

SEQ ID NO: 3574060 - DNA, 21 bp, Homo sapiens
aacccacctctcctgccctgt

SEQ ID NO: 3574061 - DNA, 16 bp, Homo sapiens
aacccactcatgactg

SEQ ID NO: 3574062 - DNA, 14 bp, Homo sapiens
aacccagactcaga

SEQ ID NO: 3574063 - DNA, 23 bp, Homo sapiens
aacccccctcccagacaggccct

SEQ ID NO: 3574064 - DNA, 17 bp, Homo sapiens
aacccctctccaggcct

SEQ ID NO: 3574065 - DNA, 20 bp, Homo sapiens
aacccctgacctaccccagc

SEQ ID NO: 3574066 - DNA, 13 bp, Homo sapiens
aaccctaccctgg

SEQ ID NO: 3574067 - DNA, 12 bp, Homo sapiens
aaccctcagagc

SEQ ID NO: 3574068 - DNA, 19 bp, Homo sapiens
aaccctcagagccacccct

SEQ ID NO: 3574069 - DNA, 21 bp, Homo sapiens
aaccctcaggccaccctccac

SEQ ID NO: 3574070 - DNA, 22 bp, Homo sapiens
aaccctgagcagggtccacagc

SEQ ID NO: 3574071 - DNA, 19 bp, Homo sapiens
aaccctgccctgccccacc

SEQ ID NO: 3574072 - DNA, 11 bp, Homo sapiens
aaccctggagg

SEQ ID NO: 3574073 - DNA, 19 bp, Homo sapiens
aaccctggcacttaagggg

SEQ ID NO: 3574074 - DNA, 19 bp, Homo sapiens
aaccctgggctattgctgc

SEQ ID NO: 3574075 - DNA, 14 bp, Homo sapiens
aaccctgtcaccca

SEQ ID NO: 3574076 - DNA, 17 bp, Homo sapiens
aaccctgtcacccacag

SEQ ID NO: 3574077 - DNA, 15 bp, Homo sapiens
aacccttaactgaca

SEQ ID NO: 3574078 - DNA, 17 bp, Homo sapiens
aacccttctctgttggt

SEQ ID NO: 3574079 - DNA, 20 bp, Homo sapiens
aacccttgctttcctgggcc

SEQ ID NO: 3574080 - DNA, 22 bp, Homo sapiens
aaccggaaggaggccaaccagc

SEQ ID NO: 3574081 - DNA, 23 bp, Homo sapiens
aaccggaaggaggccaaccagcc

SEQ ID NO: 3574082 - DNA, 21 bp, Homo sapiens
aacctaacacattaaatgtgg

SEQ ID NO: 3574083 - DNA, 22 bp, Homo sapiens
aacctaagtccttccacctgcc

SEQ ID NO: 3574084 - DNA, 16 bp, Homo sapiens
aacctacattccaccc

SEQ ID NO: 3574085 - DNA, 14 bp, Homo sapiens
aacctagcacacct

SEQ ID NO: 3574086 - DNA, 11 bp, Homo sapiens
aacctcagcct

SEQ ID NO: 3574087 - DNA, 12 bp, Homo sapiens
aacctcagcctg

SEQ ID NO: 3574088 - DNA, 16 bp, Homo sapiens
aacctcagcctggcca

SEQ ID NO: 3574089 - DNA, 19 bp, Homo sapiens
aacctccagcctccctgtc

SEQ ID NO: 3574090 - DNA, 18 bp, Homo sapiens
aacctctgtggtcaccca

SEQ ID NO: 3574091 - DNA, 20 bp, Homo sapiens
aacctgacttcagtgaatat

SEQ ID NO: 3574092 - DNA, 16 bp, Homo sapiens
aacctgcaaaatctgt

SEQ ID NO: 3574093 - DNA, 15 bp, Homo sapiens
aacctgccaaggagc

SEQ ID NO: 3574094 - DNA, 15 bp, Homo sapiens
aacctgctctcctct

SEQ ID NO: 3574095 - DNA, 17 bp, Homo sapiens
aacctgggaaggccagc

SEQ ID NO: 3574096 - DNA, 18 bp, Homo sapiens
aacctggggtgaatactt

SEQ ID NO: 3574097 - DNA, 21 bp, Homo sapiens
aacctggggtgaatacttatt

SEQ ID NO: 3574098 - DNA, 19 bp, Homo sapiens
aacctgtcttggggccact

SEQ ID NO: 3574099 - DNA, 22 bp, Homo sapiens
aacctgttcttagagtgtagct

SEQ ID NO: 3574100 - DNA, 19 bp, Homo sapiens
aaccttaaaagtaataaag

SEQ ID NO: 3574101 - DNA, 21 bp, Homo sapiens
aaccttaaaagtaataaagag

SEQ ID NO: 3574102 - DNA, 23 bp, Homo sapiens
aacgaaactccatctcaaaacaa

SEQ ID NO: 3574103 - DNA, 16 bp, Homo sapiens
aacgagcagcccaggg

SEQ ID NO: 3574104 - DNA, 24 bp, Homo sapiens
aacgagcagcccagggcctagagg

SEQ ID NO: 3574105 - DNA, 11 bp, Homo sapiens
aacgcagccct

SEQ ID NO: 3574106 - DNA, 20 bp, Homo sapiens
aacgcaggcccccaggtgcc

SEQ ID NO: 3574107 - DNA, 13 bp, Homo sapiens
aacgcccctccaa

SEQ ID NO: 3574108 - DNA, 16 bp, Homo sapiens
aacgcccctccaaacc

SEQ ID NO: 3574109 - DNA, 16 bp, Homo sapiens
aacgcccctgtggcca

SEQ ID NO: 3574110 - DNA, 13 bp, Homo sapiens
aacgcctccccct

SEQ ID NO: 3574111 - DNA, 15 bp, Homo sapiens
aacgctgatttaaag

SEQ ID NO: 3574112 - DNA, 12 bp, Homo sapiens
aacgctttcccc

SEQ ID NO: 3574113 - DNA, 21 bp, Homo sapiens
aacggattattttttcagacc

SEQ ID NO: 3574114 - DNA, 19 bp, Homo sapiens
aacggcaacgtagcctggg

SEQ ID NO: 3574115 - DNA, 14 bp, Homo sapiens
aacggtgctaaaaa

SEQ ID NO: 3574116 - DNA, 14 bp, Homo sapiens
aacggttcctggtg

SEQ ID NO: 3574117 - DNA, 16 bp, Homo sapiens
aacgtgagagaaagag

SEQ ID NO: 3574118 - DNA, 20 bp, Homo sapiens
aacgtgagagaaagagagaa

SEQ ID NO: 3574119 - DNA, 14 bp, Homo sapiens
aacgtgcaaagcca

SEQ ID NO: 3574120 - DNA, 15 bp, Homo sapiens
aacgtggattgtatt

SEQ ID NO: 3574121 - DNA, 15 bp, Homo sapiens
aactaaaatgttcta

SEQ ID NO: 3574122 - DNA, 12 bp, Homo sapiens
aactaaagaaga

SEQ ID NO: 3574123 - DNA, 14 bp, Homo sapiens
aactaaagaagagg

SEQ ID NO: 3574124 - DNA, 22 bp, Homo sapiens
aactaaaggacttgatgtacat

SEQ ID NO: 3574125 - DNA, 11 bp, Homo sapiens
aactaacatgt

SEQ ID NO: 3574126 - DNA, 14 bp, Homo sapiens
aactaacatgtcct

SEQ ID NO: 3574127 - DNA, 12 bp, Homo sapiens
aactacaaatat

SEQ ID NO: 3574128 - DNA, 13 bp, Homo sapiens
aactactctttga

SEQ ID NO: 3574129 - DNA, 17 bp, Homo sapiens
aactactgacagggagc

SEQ ID NO: 3574130 - DNA, 15 bp, Homo sapiens
aactactttataact

SEQ ID NO: 3574131 - DNA, 15 bp, Homo sapiens
aactacttttctaaa

SEQ ID NO: 3574132 - DNA, 16 bp, Homo sapiens
aactacttttctaaaa

SEQ ID NO: 3574133 - DNA, 19 bp, Homo sapiens
aactatctggccatattta

SEQ ID NO: 3574134 - DNA, 20 bp, Homo sapiens
aactatgacgtagcgagtta

SEQ ID NO: 3574135 - DNA, 17 bp, Homo sapiens
aactatgtattaattta

SEQ ID NO: 3574136 - DNA, 21 bp, Homo sapiens
aactattgtgctcagagacac

SEQ ID NO: 3574137 - DNA, 17 bp, Homo sapiens
aactatttaaagaaata

SEQ ID NO: 3574138 - DNA, 13 bp, Homo sapiens
aactatttttaag

SEQ ID NO: 3574139 - DNA, 22 bp, Homo sapiens
aactatttttaaggtctaatca

SEQ ID NO: 3574140 - DNA, 15 bp, Homo sapiens
aactcaaaatatttg

SEQ ID NO: 3574141 - DNA, 23 bp, Homo sapiens
aactcaaatggggccagatccag

SEQ ID NO: 3574142 - DNA, 24 bp, Homo sapiens
aactcatttttgttttcattatct

SEQ ID NO: 3574143 - DNA, 19 bp, Homo sapiens
aactccaccgaccaactgc

SEQ ID NO: 3574144 - DNA, 22 bp, Homo sapiens
aactccaccgaccaactgccct

SEQ ID NO: 3574145 - DNA, 12 bp, Homo sapiens
aactccaggcag

SEQ ID NO: 3574146 - DNA, 13 bp, Homo sapiens
aactccaggctgg

SEQ ID NO: 3574147 - DNA, 14 bp, Homo sapiens
aactccaggctgga

SEQ ID NO: 3574148 - DNA, 12 bp, Homo sapiens
aactcctgtccc

SEQ ID NO: 3574149 - DNA, 14 bp, Homo sapiens
aactcctgtccctt

SEQ ID NO: 3574150 - DNA, 17 bp, Homo sapiens
aactcctgtcccttttc

SEQ ID NO: 3574151 - DNA, 20 bp, Homo sapiens
aactcctgtcccttttccct

SEQ ID NO: 3574152 - DNA, 18 bp, Homo sapiens
aactcctgtcttctttct

SEQ ID NO: 3574153 - DNA, 17 bp, Homo sapiens
aactcggtgtccccacc

SEQ ID NO: 3574154 - DNA, 19 bp, Homo sapiens
aactcggtgtccccaccat

SEQ ID NO: 3574155 - DNA, 21 bp, Homo sapiens
aactcggtgtccccaccatct

SEQ ID NO: 3574156 - DNA, 22 bp, Homo sapiens
aactcggtgtccccaccatctg

SEQ ID NO: 3574157 - DNA, 24 bp, Homo sapiens
aactcggtgtccccaccatctgct

SEQ ID NO: 3574158 - DNA, 22 bp, Homo sapiens
aactctaaagccaagcacttta

SEQ ID NO: 3574159 - DNA, 19 bp, Homo sapiens
aactctagctgggggtggg

SEQ ID NO: 3574160 - DNA, 12 bp, Homo sapiens
aactctgggtct

SEQ ID NO: 3574161 - DNA, 11 bp, Homo sapiens
aactctggtgc

SEQ ID NO: 3574162 - DNA, 16 bp, Homo sapiens
aactctgttacacttt

SEQ ID NO: 3574163 - DNA, 14 bp, Homo sapiens
aagaccaatcaaat

SEQ ID NO: 3574164 - DNA, 16 bp, Homo sapiens
aagaccctttcagaat

SEQ ID NO: 3574165 - DNA, 20 bp, Homo sapiens
aagacctcatctgtggagct

SEQ ID NO: 3574166 - DNA, 20 bp, Homo sapiens
aagacctgaaagagaggact

SEQ ID NO: 3574167 - DNA, 20 bp, Homo sapiens
aagacgaggggcagggaagg

SEQ ID NO: 3574168 - DNA, 23 bp, Homo sapiens
aagacgaggggcagggaaggaca

SEQ ID NO: 3574169 - DNA, 22 bp, Homo sapiens
aagacgtctccccttctctgcc

SEQ ID NO: 3574170 - DNA, 14 bp, Homo sapiens
aagactattcaaac

SEQ ID NO: 3574171 - DNA, 14 bp, Homo sapiens
aagactccaaagaa

SEQ ID NO: 3574172 - DNA, 20 bp, Homo sapiens
aagactggcccagtgccagc

SEQ ID NO: 3574173 - DNA, 22 bp, Homo sapiens
aagactggcccagtgccagcaa

SEQ ID NO: 3574174 - DNA, 19 bp, Homo sapiens
aagactttgatccatgtat

SEQ ID NO: 3574175 - DNA, 20 bp, Homo sapiens
aagacttttggtagagaagg

SEQ ID NO: 3574176 - DNA, 16 bp, Homo sapiens
aagagaaaacctagta

SEQ ID NO: 3574177 - DNA, 22 bp, Homo sapiens
aagagaaatatatttgtcactt

SEQ ID NO: 3574178 - DNA, 20 bp, Homo sapiens
aagagaagatgcctgttaat

SEQ ID NO: 3574179 - DNA, 23 bp, Homo sapiens
aagagaagatgcctgttaattta

SEQ ID NO: 3574180 - DNA, 16 bp, Homo sapiens
aagagagggacaggca

SEQ ID NO: 3574181 - DNA, 14 bp, Homo sapiens
aagagatctgtgtg

SEQ ID NO: 3574182 - DNA, 23 bp, Homo sapiens
aagagatctgtgtggctcctggg

SEQ ID NO: 3574183 - DNA, 14 bp, Homo sapiens
aagagatctttctt

SEQ ID NO: 3574184 - DNA, 21 bp, Homo sapiens
aagagcacactgcacagggaa

SEQ ID NO: 3574185 - DNA, 13 bp, Homo sapiens
aagagcctcccac

SEQ ID NO: 3574186 - DNA, 17 bp, Homo sapiens
aagaggagaaaaagaag

SEQ ID NO: 3574187 - DNA, 21 bp, Homo sapiens
aagaggccttcccatggccat

SEQ ID NO: 3574188 - DNA, 11 bp, Homo sapiens
aagagggacag

SEQ ID NO: 3574189 - DNA, 14 bp, Homo sapiens
aagagggacaggct

SEQ ID NO: 3574190 - DNA, 17 bp, Homo sapiens
aagagggcccagcccag

SEQ ID NO: 3574191 - DNA, 21 bp, Homo sapiens
aagagggcccagcccagagcc

SEQ ID NO: 3574192 - DNA, 15 bp, Homo sapiens
aagaggtctgattgg

SEQ ID NO: 3574193 - DNA, 16 bp, Homo sapiens
aagaggtctgattggc

SEQ ID NO: 3574194 - DNA, 18 bp, Homo sapiens
aagagtcagacatttctt

SEQ ID NO: 3574195 - DNA, 18 bp, Homo sapiens
aagagtccattgtttaaa

SEQ ID NO: 3574196 - DNA, 15 bp, Homo sapiens
aagagtcctctgaat

SEQ ID NO: 3574197 - DNA, 21 bp, Homo sapiens
aagataaaaactgcccattgt

SEQ ID NO: 3574198 - DNA, 13 bp, Homo sapiens
aagataaacatta

SEQ ID NO: 3574199 - DNA, 15 bp, Homo sapiens
aagatacaaaagctt

SEQ ID NO: 3574200 - DNA, 14 bp, Homo sapiens
aagatacaaaatgt

SEQ ID NO: 3574201 - DNA, 15 bp, Homo sapiens
aagatagctctctga

SEQ ID NO: 3574202 - DNA, 17 bp, Homo sapiens
aagatagcttcacccca

SEQ ID NO: 3574203 - DNA, 22 bp, Homo sapiens
aagatcagaacattcagctctg

SEQ ID NO: 3574204 - DNA, 18 bp, Homo sapiens
aagatccaagcaaaactt

SEQ ID NO: 3574205 - DNA, 23 bp, Homo sapiens
aagatccgagtgtgatttgaatt

SEQ ID NO: 3574206 - DNA, 14 bp, Homo sapiens
aagatgacctgccc

SEQ ID NO: 3574207 - DNA, 17 bp, Homo sapiens
aagatgacctgccccaa

SEQ ID NO: 3574208 - DNA, 18 bp, Homo sapiens
aagatggagacaccctct

SEQ ID NO: 3574209 - DNA, 21 bp, Homo sapiens
aagatggagacaccctctggg

SEQ ID NO: 3574210 - DNA, 18 bp, Homo sapiens
aagatggctgtgcctctg

SEQ ID NO: 3574211 - DNA, 20 bp, Homo sapiens
aagatggctgtgcctctgcc

SEQ ID NO: 3574212 - DNA, 15 bp, Homo sapiens
aagatggcttttcct

SEQ ID NO: 3574213 - DNA, 21 bp, Homo sapiens
aagatggtggccacagactga

SEQ ID NO: 3574214 - DNA, 12 bp, Homo sapiens
aagatgtacatt

SEQ ID NO: 3574215 - DNA, 15 bp, Homo sapiens
aagatgtacatttaa

SEQ ID NO: 3574216 - DNA, 18 bp, Homo sapiens
aagatgtgcagcatttca

SEQ ID NO: 3574217 - DNA, 20 bp, Homo sapiens
aagatgtgcagcatttcact

SEQ ID NO: 3574218 - DNA, 16 bp, Homo sapiens
aagatgttctcctgat

SEQ ID NO: 3574219 - DNA, 15 bp, Homo sapiens
aagatgttctggata

SEQ ID NO: 3574220 - DNA, 20 bp, Homo sapiens
aagatgttctggataccatt

SEQ ID NO: 3574221 - DNA, 21 bp, Homo sapiens
aagattacaaatcagaagtca

SEQ ID NO: 3574222 - DNA, 12 bp, Homo sapiens
aagattctatgt

SEQ ID NO: 3574223 - DNA, 19 bp, Homo sapiens
aagattctctatgtatcaa

SEQ ID NO: 3574224 - DNA, 22 bp, Homo sapiens
aagattcttcttaaaagtttct

SEQ ID NO: 3574225 - DNA, 23 bp, Homo sapiens
aagattcttcttaaaagtttcta

SEQ ID NO: 3574226 - DNA, 13 bp, Homo sapiens
aagatttaatatt

SEQ ID NO: 3574227 - DNA, 13 bp, Homo sapiens
aagcaaaatacat

SEQ ID NO: 3574228 - DNA, 16 bp, Homo sapiens
aagcaaacatcaaata

SEQ ID NO: 3574229 - DNA, 18 bp, Homo sapiens
aagcaaacatcaaataaa

SEQ ID NO: 3574230 - DNA, 22 bp, Homo sapiens
aagcaaacatcaaataaatttc

SEQ ID NO: 3574231 - DNA, 13 bp, Homo sapiens
aagcaaaggtgca

SEQ ID NO: 3574232 - DNA, 14 bp, Homo sapiens
aagcaaatcagaaa

SEQ ID NO: 3574233 - DNA, 17 bp, Homo sapiens
aagcaacaatggatatt

SEQ ID NO: 3574234 - DNA, 16 bp, Homo sapiens
aagcaacactttttat

SEQ ID NO: 3574235 - DNA, 16 bp, Homo sapiens
aagcaagcaacacaga

SEQ ID NO: 3574236 - DNA, 13 bp, Homo sapiens
aagcacaaaggaa

SEQ ID NO: 3574237 - DNA, 18 bp, Homo sapiens
aagcacaagactggccca

SEQ ID NO: 3574238 - DNA, 15 bp, Homo sapiens
aagcacaagtacttt

SEQ ID NO: 3574239 - DNA, 17 bp, Homo sapiens
aagcacaagtacttttg

SEQ ID NO: 3574240 - DNA, 17 bp, Homo sapiens
aagcaccaacctccaga

SEQ ID NO: 3574241 - DNA, 16 bp, Homo sapiens
aagcaccttagctggc

SEQ ID NO: 3574242 - DNA, 15 bp, Homo sapiens
aagcagagcctcctg

SEQ ID NO: 3574243 - DNA, 14 bp, Homo sapiens
aagcagaggagggg

SEQ ID NO: 3574244 - DNA, 15 bp, Homo sapiens
aagcagcatggaaaa

SEQ ID NO: 3574245 - DNA, 20 bp, Homo sapiens
aagcagcatggaaaaatggt

SEQ ID NO: 3574246 - DNA, 22 bp, Homo sapiens
aagcagcccttgctttcggagc

SEQ ID NO: 3574247 - DNA, 14 bp, Homo sapiens
aagcagctctcccc

SEQ ID NO: 3574248 - DNA, 22 bp, Homo sapiens
aagcagcttgaatggtttttct

SEQ ID NO: 3574249 - DNA, 13 bp, Homo sapiens
aagcagctttaaa

SEQ ID NO: 3574250 - DNA, 15 bp, Homo sapiens
aagcatatagagatg

SEQ ID NO: 3574251 - DNA, 13 bp, Homo sapiens
aagcatccctcac

SEQ ID NO: 3574252 - DNA, 23 bp, Homo sapiens
aagcatccctcacccatcctaga

SEQ ID NO: 3574253 - DNA, 20 bp, Homo sapiens
aagcatgaacgtggattgta

SEQ ID NO: 3574254 - DNA, 20 bp, Homo sapiens
aagcatgtagactgtgccag

SEQ ID NO: 3574255 - DNA, 12 bp, Homo sapiens
aagcatttccag

SEQ ID NO: 3574256 - DNA, 19 bp, Homo sapiens
aagcattttcgttacattg

SEQ ID NO: 3574257 - DNA, 11 bp, Homo sapiens
aagccaaagaa

SEQ ID NO: 3574258 - DNA, 17 bp, Homo sapiens
aagccaaggcagcgacc

SEQ ID NO: 3574259 - DNA, 24 bp, Homo sapiens
aagccaaggcagcgaccccaggac

SEQ ID NO: 3574260 - DNA, 13 bp, Homo sapiens
aagccacagcaga

SEQ ID NO: 3574261 - DNA, 20 bp, Homo sapiens
aagccacagcagagcattgt

SEQ ID NO: 3574262 - DNA, 19 bp, Homo sapiens
aagccagccacagacccct

SEQ ID NO: 3574263 - DNA, 14 bp, Homo sapiens
aagccaggctcagg

SEQ ID NO: 3574264 - DNA, 16 bp, Homo sapiens
aagccaggctcaggag

SEQ ID NO: 3574265 - DNA, 20 bp, Homo sapiens
aagccagggcccctggatct

SEQ ID NO: 3574266 - DNA, 19 bp, Homo sapiens
aagccatgtggggttgctg

SEQ ID NO: 3574267 - DNA, 17 bp, Homo sapiens
aagccccagcttggctc

SEQ ID NO: 3574268 - DNA, 16 bp, Homo sapiens
aagcccccagctaaga

SEQ ID NO: 3574269 - DNA, 18 bp, Homo sapiens
aagcccccagggcctcca

SEQ ID NO: 3574270 - DNA, 20 bp, Homo sapiens
aagcccccagggcctccagg

SEQ ID NO: 3574271 - DNA, 13 bp, Homo sapiens
aagccccgacaca

SEQ ID NO: 3574272 - DNA, 16 bp, Homo sapiens
aagcccctcacactgc

SEQ ID NO: 3574273 - DNA, 22 bp, Homo sapiens
aagccctgttgacacaggtctt

SEQ ID NO: 3574274 - DNA, 23 bp, Homo sapiens
aagcccttggaacaccctggatg

SEQ ID NO: 3574275 - DNA, 14 bp, Homo sapiens
aagccgcagacctg

SEQ ID NO: 3574276 - DNA, 13 bp, Homo sapiens
aagccgtggcttc

SEQ ID NO: 3574277 - DNA, 14 bp, Homo sapiens
aagccgtggcttcc

SEQ ID NO: 3574278 - DNA, 15 bp, Homo sapiens
aagccgtggcttccc

SEQ ID NO: 3574279 - DNA, 15 bp, Homo sapiens
aagcctcaaaacaaa

SEQ ID NO: 3574280 - DNA, 17 bp, Homo sapiens
aagcctctctccttggc

SEQ ID NO: 3574281 - DNA, 12 bp, Homo sapiens
aagcctctttct

SEQ ID NO: 3574282 - DNA, 16 bp, Homo sapiens
aagccttaagcaaatt

SEQ ID NO: 3574283 - DNA, 12 bp, Homo sapiens
aagccttacaaa

SEQ ID NO: 3574284 - DNA, 20 bp, Homo sapiens
aagccttataaaccaatctt

SEQ ID NO: 3574285 - DNA, 15 bp, Homo sapiens
aagcgacttcaggtc

SEQ ID NO: 3574286 - DNA, 15 bp, Homo sapiens
aagcgagcacagtat

SEQ ID NO: 3574287 - DNA, 18 bp, Homo sapiens
aagcgagcacagtattat

SEQ ID NO: 3574288 - DNA, 20 bp, Homo sapiens
aagctacccctcaaactgca

SEQ ID NO: 3574289 - DNA, 21 bp, Homo sapiens
aagctacccctcaaactgcac

SEQ ID NO: 3574290 - DNA, 22 bp, Homo sapiens
aagctacccctcaaactgcaca

SEQ ID NO: 3574291 - DNA, 23 bp, Homo sapiens
aagctacccctcaaactgcacat

SEQ ID NO: 3574292 - DNA, 21 bp, Homo sapiens
aagctacttgccttgagttta

SEQ ID NO: 3574293 - DNA, 14 bp, Homo sapiens
aagctaggccccag

SEQ ID NO: 3574294 - DNA, 23 bp, Homo sapiens
aagctaggccccagaggccctgg

SEQ ID NO: 3574295 - DNA, 13 bp, Homo sapiens
aaaaaaaaagcaa

SEQ ID NO: 3574296 - DNA, 13 bp, Homo sapiens
aaaaaaagcctcc

SEQ ID NO: 3574297 - DNA, 18 bp, Homo sapiens
aaaaacagatttggaaag

SEQ ID NO: 3574298 - DNA, 22 bp, Homo sapiens
aaaaacgaaactccatctcaaa

SEQ ID NO: 3574299 - DNA, 14 bp, Homo sapiens
aaaaactctttatt

SEQ ID NO: 3574300 - DNA, 14 bp, Homo sapiens
aaaaactgacagat

SEQ ID NO: 3574301 - DNA, 14 bp, Homo sapiens
aaaaactgtgattt

SEQ ID NO: 3574302 - DNA, 22 bp, Homo sapiens
aaaaactgtgatttttatcaca

SEQ ID NO: 3574303 - DNA, 15 bp, Homo sapiens
aaaaagaaaatgtct

SEQ ID NO: 3574304 - DNA, 16 bp, Homo sapiens
aaaaagaacttttgta

SEQ ID NO: 3574305 - DNA, 14 bp, Homo sapiens
aaaaagacagggct

SEQ ID NO: 3574306 - DNA, 17 bp, Homo sapiens
aaaaagcctccaagggt

SEQ ID NO: 3574307 - DNA, 19 bp, Homo sapiens
aaaaaggcccttagaggga

SEQ ID NO: 3574308 - DNA, 20 bp, Homo sapiens
aaaaagtcaatgtacttgtt

SEQ ID NO: 3574309 - DNA, 18 bp, Homo sapiens
aaaaataaatatatctac

SEQ ID NO: 3574310 - DNA, 18 bp, Homo sapiens
aaaaatcagaacaaaact

SEQ ID NO: 3574311 - DNA, 22 bp, Homo sapiens
aaaaatggaacataaaatacaa

SEQ ID NO: 3574312 - DNA, 20 bp, Homo sapiens
aaaaatggttgatggaaaat

SEQ ID NO: 3574313 - DNA, 18 bp, Homo sapiens
aaaaatgtcctgcctttt

SEQ ID NO: 3574314 - DNA, 12 bp, Homo sapiens
aaaaatgtctta

SEQ ID NO: 3574315 - DNA, 13 bp, Homo sapiens
aaaaatgtgaaat

SEQ ID NO: 3574316 - DNA, 20 bp, Homo sapiens
aaaaatgtgaaatgctttta

SEQ ID NO: 3574317 - DNA, 13 bp, Homo sapiens
aaaaattaagtct

SEQ ID NO: 3574318 - DNA, 15 bp, Homo sapiens
aaaaattaagtcttc

SEQ ID NO: 3574319 - DNA, 19 bp, Homo sapiens
aaaacaaagcagctttaaa

SEQ ID NO: 3574320 - DNA, 12 bp, Homo sapiens
aaaacaaatgaa

SEQ ID NO: 3574321 - DNA, 18 bp, Homo sapiens
aaaacaagacagactcga

SEQ ID NO: 3574322 - DNA, 12 bp, Homo sapiens
aaaacaagtgaa

SEQ ID NO: 3574323 - DNA, 18 bp, Homo sapiens
aaaacacagcaagggtga

SEQ ID NO: 3574324 - DNA, 22 bp, Homo sapiens
aaaacaccgcttctgccttttc

SEQ ID NO: 3574325 - DNA, 15 bp, Homo sapiens
aaaacagctttgtct

SEQ ID NO: 3574326 - DNA, 21 bp, Homo sapiens
aaaacataaacacatttccat

SEQ ID NO: 3574327 - DNA, 11 bp, Homo sapiens
aaaacatttct

SEQ ID NO: 3574328 - DNA, 16 bp, Homo sapiens
aaaacattttaaatga

SEQ ID NO: 3574329 - DNA, 12 bp, Homo sapiens
aaaaccacagca

SEQ ID NO: 3574330 - DNA, 14 bp, Homo sapiens
aaaaccacagcagt

SEQ ID NO: 3574331 - DNA, 22 bp, Homo sapiens
aaaaccacctggttgaatataa

SEQ ID NO: 3574332 - DNA, 12 bp, Homo sapiens
aaaacccagact

SEQ ID NO: 3574333 - DNA, 18 bp, Homo sapiens
aaaacccagactgtctcc

SEQ ID NO: 3574334 - DNA, 12 bp, Homo sapiens
aaaacccagctg

SEQ ID NO: 3574335 - DNA, 14 bp, Homo sapiens
aaaacccagctgca

SEQ ID NO: 3574336 - DNA, 21 bp, Homo sapiens
aaaacgaagctcattcccaac

SEQ ID NO: 3574337 - DNA, 23 bp, Homo sapiens
aaaactcaggcaaagaaaatgaa

SEQ ID NO: 3574338 - DNA, 13 bp, Homo sapiens
aaaactcattttt

SEQ ID NO: 3574339 - DNA, 14 bp, Homo sapiens
aaaactctgggtct

SEQ ID NO: 3574340 - DNA, 22 bp, Homo sapiens
aaaactgctcatttcatgaagc

SEQ ID NO: 3574341 - DNA, 17 bp, Homo sapiens
aaaactggatatttcaa

SEQ ID NO: 3574342 - DNA, 11 bp, Homo sapiens
aaaacttcaaa

SEQ ID NO: 3574343 - DNA, 18 bp, Homo sapiens
aatgacaaaagatacaaa

SEQ ID NO: 3574344 - DNA, 13 bp, Homo sapiens
aatgacaacactt

SEQ ID NO: 3574345 - DNA, 22 bp, Homo sapiens
aatgacacccatgccagagagg

SEQ ID NO: 3574346 - DNA, 17 bp, Homo sapiens
aatgacataaaaagaag

SEQ ID NO: 3574347 - DNA, 14 bp, Homo sapiens
aatgacattcccct

SEQ ID NO: 3574348 - DNA, 16 bp, Homo sapiens
aatgacggtgttaatt

SEQ ID NO: 3574349 - DNA, 22 bp, Homo sapiens
aatgacggtgttaattttgcta

SEQ ID NO: 3574350 - DNA, 19 bp, Homo sapiens
aatgactccactgtttttc

SEQ ID NO: 3574351 - DNA, 13 bp, Homo sapiens
aatgacttagaaa

SEQ ID NO: 3574352 - DNA, 15 bp, Homo sapiens
aatgacttagaaact

SEQ ID NO: 3574353 - DNA, 16 bp, Homo sapiens
aatgacttagaaactg

SEQ ID NO: 3574354 - DNA, 14 bp, Homo sapiens
aatgacttatttct

SEQ ID NO: 3574355 - DNA, 15 bp, Homo sapiens
aatgacttatttctg

SEQ ID NO: 3574356 - DNA, 22 bp, Homo sapiens
aatgacttatttctgctctgga

SEQ ID NO: 3574357 - DNA, 17 bp, Homo sapiens
aatgaggatccagggca

SEQ ID NO: 3574358 - DNA, 18 bp, Homo sapiens
aatgagtcatttgtttaa

SEQ ID NO: 3574359 - DNA, 17 bp, Homo sapiens
aatgatatgcttgtaac

SEQ ID NO: 3574360 - DNA, 21 bp, Homo sapiens
aatgatgatgatgatgatgaa

SEQ ID NO: 3574361 - DNA, 18 bp, Homo sapiens
aatgattcaaatgtttta

SEQ ID NO: 3574362 - DNA, 20 bp, Homo sapiens
aatgcaactctaactctgag

SEQ ID NO: 3574363 - DNA, 18 bp, Homo sapiens
aatgcactgggaaaaagt

SEQ ID NO: 3574364 - DNA, 15 bp, Homo sapiens
aatgcagatttctct

SEQ ID NO: 3574365 - DNA, 13 bp, Homo sapiens
aatgcagcaggaa

SEQ ID NO: 3574366 - DNA, 19 bp, Homo sapiens
aatgcagcaggaaggaaca

SEQ ID NO: 3574367 - DNA, 22 bp, Homo sapiens
aatgcagcagggatgccctgga

SEQ ID NO: 3574368 - DNA, 14 bp, Homo sapiens
aatgcatatttgca

SEQ ID NO: 3574369 - DNA, 17 bp, Homo sapiens
aatgcatatttgcaaag

SEQ ID NO: 3574370 - DNA, 23 bp, Homo sapiens
aatgcatatttgcaaagtgtatt

SEQ ID NO: 3574371 - DNA, 13 bp, Homo sapiens
aatgcattcaaaa

SEQ ID NO: 3574372 - DNA, 22 bp, Homo sapiens
aatgccactgggacagctggct

SEQ ID NO: 3574373 - DNA, 13 bp, Homo sapiens
aatgccccaaact

SEQ ID NO: 3574374 - DNA, 17 bp, Homo sapiens
aatgccctcctaaatgt

SEQ ID NO: 3574375 - DNA, 18 bp, Homo sapiens
aatgccctcctaaatgtc

SEQ ID NO: 3574376 - DNA, 16 bp, Homo sapiens
aatgcctcgctccctt

SEQ ID NO: 3574377 - DNA, 16 bp, Homo sapiens
aatgccttttgaatac

SEQ ID NO: 3574378 - DNA, 16 bp, Homo sapiens
aatgctcaatttcagc

SEQ ID NO: 3574379 - DNA, 18 bp, Homo sapiens
aatgctcaatttcagcac

SEQ ID NO: 3574380 - DNA, 13 bp, Homo sapiens
aatgctgcacttc

SEQ ID NO: 3574381 - DNA, 17 bp, Homo sapiens
aatgctgcctcaggacc

SEQ ID NO: 3574382 - DNA, 20 bp, Homo sapiens
aatgctgcctcaggacccat

SEQ ID NO: 3574383 - DNA, 16 bp, Homo sapiens
aatgctggcaaatcca

SEQ ID NO: 3574384 - DNA, 17 bp, Homo sapiens
aatgctgtctttcttgc

SEQ ID NO: 3574385 - DNA, 22 bp, Homo sapiens
aatgctgtctttcttgctccct

SEQ ID NO: 3574386 - DNA, 13 bp, Homo sapiens
aatgctgttaata

SEQ ID NO: 3574387 - DNA, 20 bp, Homo sapiens
aatgctgttaatatttctaa

SEQ ID NO: 3574388 - DNA, 20 bp, Homo sapiens
aatgctgttagtaaatttct

SEQ ID NO: 3574389 - DNA, 20 bp, Homo sapiens
aatggatcaatacacacaca

SEQ ID NO: 3574390 - DNA, 13 bp, Homo sapiens
aatggcagctagt

SEQ ID NO: 3574391 - DNA, 18 bp, Homo sapiens
aatggcagtcctggaggc

SEQ ID NO: 3574392 - DNA, 21 bp, Homo sapiens
aatggcagtgactccccagcc

SEQ ID NO: 3574393 - DNA, 19 bp, Homo sapiens
aatggccacaaacctgccc

SEQ ID NO: 3574394 - DNA, 17 bp, Homo sapiens
aatggccatttgctttt

SEQ ID NO: 3574395 - DNA, 16 bp, Homo sapiens
aatggctatttttgaa

SEQ ID NO: 3574396 - DNA, 14 bp, Homo sapiens
aatggggccagatc

SEQ ID NO: 3574397 - DNA, 22 bp, Homo sapiens
aatggggccagatccagcctgg

SEQ ID NO: 3574398 - DNA, 17 bp, Homo sapiens
aatgggtcttagctctt

SEQ ID NO: 3574399 - DNA, 19 bp, Homo sapiens
aatgggttttaattttcag

SEQ ID NO: 3574400 - DNA, 15 bp, Homo sapiens
aatggtactcccaaa

SEQ ID NO: 3574401 - DNA, 17 bp, Homo sapiens
aatggtactcccaaact

SEQ ID NO: 3574402 - DNA, 17 bp, Homo sapiens
aatggttaaattttaca

SEQ ID NO: 3574403 - DNA, 16 bp, Homo sapiens
aatggttgatggaaaa

SEQ ID NO: 3574404 - DNA, 18 bp, Homo sapiens
aatggttgatggaaaata

SEQ ID NO: 3574405 - DNA, 20 bp, Homo sapiens
aatggttgatggaaaataaa

SEQ ID NO: 3574406 - DNA, 23 bp, Homo sapiens
aatggttgatggaaaataaacat

SEQ ID NO: 3574407 - DNA, 13 bp, Homo sapiens
aatggtttttaaa

SEQ ID NO: 3574408 - DNA, 21 bp, Homo sapiens
aatggtttttcttttctttat

SEQ ID NO: 3574409 - DNA, 22 bp, Homo sapiens
aatggtttttcttttctttatt

SEQ ID NO: 3574410 - DNA, 17 bp, Homo sapiens
aatgtaaaaaagaaaaa

SEQ ID NO: 3574411 - DNA, 19 bp, Homo sapiens
aatgtaaaaaagaaaaaca

SEQ ID NO: 3574412 - DNA, 13 bp, Homo sapiens
aatgtaaaaatga

SEQ ID NO: 3574413 - DNA, 17 bp, Homo sapiens
aatgtaaaaatgaagga

SEQ ID NO: 3574414 - DNA, 12 bp, Homo sapiens
aatgtaaaatga

SEQ ID NO: 3574415 - DNA, 14 bp, Homo sapiens
aatgtaaaatgatt

SEQ ID NO: 3574416 - DNA, 16 bp, Homo sapiens
aatgtaaactgtttct

SEQ ID NO: 3574417 - DNA, 15 bp, Homo sapiens
aatgtaacttttgta

SEQ ID NO: 3574418 - DNA, 21 bp, Homo sapiens
aatgtaatgtttttatttcaa

SEQ ID NO: 3574419 - DNA, 16 bp, Homo sapiens
aatgtacatgaagcaa

SEQ ID NO: 3574420 - DNA, 21 bp, Homo sapiens
aatgtacatttccaaatgaac

SEQ ID NO: 3574421 - DNA, 22 bp, Homo sapiens
aatgtacatttccaaatgaact

SEQ ID NO: 3574422 - DNA, 15 bp, Homo sapiens
aatgtactaatattt

SEQ ID NO: 3574423 - DNA, 12 bp, Homo sapiens
aatgtactgcat

SEQ ID NO: 3574424 - DNA, 14 bp, Homo sapiens
aatgtactgcatat

SEQ ID NO: 3574425 - DNA, 18 bp, Homo sapiens
aatgtactgcatatgaaa

SEQ ID NO: 3574426 - DNA, 13 bp, Homo sapiens
aatgtacttgttt

SEQ ID NO: 3574427 - DNA, 16 bp, Homo sapiens
aatgtacttgtttgaa

SEQ ID NO: 3574428 - DNA, 17 bp, Homo sapiens
aatgtacttgtttgaat

SEQ ID NO: 3574429 - DNA, 17 bp, Homo sapiens
aatgtagaataggcagg

SEQ ID NO: 3574430 - DNA, 15 bp, Homo sapiens
aatgtatatttttaa

SEQ ID NO: 3574431 - DNA, 18 bp, Homo sapiens
aatgtatcaaatacattt

SEQ ID NO: 3574432 - DNA, 19 bp, Homo sapiens
aatgtatcatagaaatgta

SEQ ID NO: 3574433 - DNA, 13 bp, Homo sapiens
aatgtatgttacc

SEQ ID NO: 3574434 - DNA, 21 bp, Homo sapiens
aatgtatgttaccaaaaataa

SEQ ID NO: 3574435 - DNA, 14 bp, Homo sapiens
aatgtattcaagca

SEQ ID NO: 3574436 - DNA, 17 bp, Homo sapiens
aatgtattcaagcaaac

SEQ ID NO: 3574437 - DNA, 13 bp, Homo sapiens
aatgtatttgaaa

SEQ ID NO: 3574438 - DNA, 15 bp, Homo sapiens
aatgtcaaatgtgaa

SEQ ID NO: 3574439 - DNA, 20 bp, Homo sapiens
aatgtcactttttgaggcaa

SEQ ID NO: 3574440 - DNA, 16 bp, Homo sapiens
aatgtcagtatgtgga

SEQ ID NO: 3574441 - DNA, 12 bp, Homo sapiens
aatgtctgcagc

SEQ ID NO: 3574442 - DNA, 18 bp, Homo sapiens
aatgtctggtgtttgtca

SEQ ID NO: 3574443 - DNA, 19 bp, Homo sapiens
aatgtctggtgtttgtcat

SEQ ID NO: 3574444 - DNA, 16 bp, Homo sapiens
aatgtctgtaataata

SEQ ID NO: 3574445 - DNA, 18 bp, Homo sapiens
aatgtctgtaataataga

SEQ ID NO: 3574446 - DNA, 19 bp, Homo sapiens
aatgtgaagaggtctgatt

SEQ ID NO: 3574447 - DNA, 23 bp, Homo sapiens
aatgtgaagaggtctgattggct

SEQ ID NO: 3574448 - DNA, 20 bp, Homo sapiens
aatgtgaagttcatcttgca

SEQ ID NO: 3574449 - DNA, 18 bp, Homo sapiens
aatgtggaaggaaaatat

SEQ ID NO: 3574450 - DNA, 14 bp, Homo sapiens
aatgtggctcctgg

SEQ ID NO: 3574451 - DNA, 17 bp, Homo sapiens
aatgtggtgacacctcc

SEQ ID NO: 3574452 - DNA, 19 bp, Homo sapiens
aatgtgtacaatgtacaca

SEQ ID NO: 3574453 - DNA, 18 bp, Homo sapiens
aatgttaaaacataaaca

SEQ ID NO: 3574454 - DNA, 12 bp, Homo sapiens
aatgttagagta

SEQ ID NO: 3574455 - DNA, 14 bp, Homo sapiens
aatgttattttcct

SEQ ID NO: 3574456 - DNA, 15 bp, Homo sapiens
aatgttattttcctt

SEQ ID NO: 3574457 - DNA, 18 bp, Homo sapiens
aatgttattttccttctg

SEQ ID NO: 3574458 - DNA, 19 bp, Homo sapiens
aatgttattttccttctga

SEQ ID NO: 3574459 - DNA, 22 bp, Homo sapiens
aatgttattttccttctgaagt

SEQ ID NO: 3574460 - DNA, 20 bp, Homo sapiens
aatgttcttatgcaaaatgg

SEQ ID NO: 3574461 - DNA, 18 bp, Homo sapiens
aatgttctttctgctcta

SEQ ID NO: 3574462 - DNA, 17 bp, Homo sapiens
aatgttgaaaagtaatt

SEQ ID NO: 3574463 - DNA, 13 bp, Homo sapiens
aatgtttccttta

SEQ ID NO: 3574464 - DNA, 16 bp, Homo sapiens
aatgttttaacaagaa

SEQ ID NO: 3574465 - DNA, 20 bp, Homo sapiens
aatgtttttatttcaattgt

SEQ ID NO: 3574466 - DNA, 14 bp, Homo sapiens
aattaaaaactgtg

SEQ ID NO: 3574467 - DNA, 12 bp, Homo sapiens
aattaaacggat

SEQ ID NO: 3574468 - DNA, 16 bp, Homo sapiens
aattaaacggattatt

SEQ ID NO: 3574469 - DNA, 18 bp, Homo sapiens
aattaaagaaaattaatt

SEQ ID NO: 3574470 - DNA, 19 bp, Homo sapiens
aattaatgcagatttctct

SEQ ID NO: 3574471 - DNA, 22 bp, Homo sapiens
aattaatggtttattctttgca

SEQ ID NO: 3574472 - DNA, 23 bp, Homo sapiens
aattaattatgtgtagttataaa

SEQ ID NO: 3574473 - DNA, 22 bp, Homo sapiens
aattacaaaacctatttttcct

SEQ ID NO: 3574474 - DNA, 13 bp, Homo sapiens
aattacaaacaat

SEQ ID NO: 3574475 - DNA, 14 bp, Homo sapiens
aattacaaagaacc

SEQ ID NO: 3574476 - DNA, 22 bp, Homo sapiens
accataaaataaataatctcat

SEQ ID NO: 3574477 - DNA, 14 bp, Homo sapiens
accataagagaaac

SEQ ID NO: 3574478 - DNA, 16 bp, Homo sapiens
accataagagaaacct

SEQ ID NO: 3574479 - DNA, 19 bp, Homo sapiens
accatatgatctgttttgt

SEQ ID NO: 3574480 - DNA, 22 bp, Homo sapiens
accatattttattgtattttga

SEQ ID NO: 3574481 - DNA, 13 bp, Homo sapiens
accatcatgtgta

SEQ ID NO: 3574482 - DNA, 14 bp, Homo sapiens
accatctgctgcag

SEQ ID NO: 3574483 - DNA, 15 bp, Homo sapiens
accatctgctgcagt

SEQ ID NO: 3574484 - DNA, 16 bp, Homo sapiens
accatctttagcagtt

SEQ ID NO: 3574485 - DNA, 22 bp, Homo sapiens
accatctttagcagtttcctca

SEQ ID NO: 3574486 - DNA, 17 bp, Homo sapiens
accatgctgctggggaa

SEQ ID NO: 3574487 - DNA, 21 bp, Homo sapiens
accatgctgctggggaagaca

SEQ ID NO: 3574488 - DNA, 22 bp, Homo sapiens
accatgtgaaactctaccctga

SEQ ID NO: 3574489 - DNA, 14 bp, Homo sapiens
accattcctgcctt

SEQ ID NO: 3574490 - DNA, 19 bp, Homo sapiens
accattctattctccagac

SEQ ID NO: 3574491 - DNA, 18 bp, Homo sapiens
accatttatgaaggtttg

SEQ ID NO: 3574492 - DNA, 11 bp, Homo sapiens
accatttcaga

SEQ ID NO: 3574493 - DNA, 18 bp, Homo sapiens
accattttaacgctgcct

SEQ ID NO: 3574494 - DNA, 21 bp, Homo sapiens
accattttgtaaatgaaactt

SEQ ID NO: 3574495 - DNA, 11 bp, Homo sapiens
acccaaaacag

SEQ ID NO: 3574496 - DNA, 18 bp, Homo sapiens
acccaaaccccctgcagc

SEQ ID NO: 3574497 - DNA, 20 bp, Homo sapiens
acccaaaccccctgcagccc

SEQ ID NO: 3574498 - DNA, 20 bp, Homo sapiens
acccaaagcggtccctgtcc

SEQ ID NO: 3574499 - DNA, 22 bp, Homo sapiens
acccaaagcggtccctgtccct

SEQ ID NO: 3574500 - DNA, 17 bp, Homo sapiens
acccaaaggtggcagct

SEQ ID NO: 3574501 - DNA, 21 bp, Homo sapiens
acccaaccctgccctgcccca

SEQ ID NO: 3574502 - DNA, 16 bp, Homo sapiens
acccaagtccaagcat

SEQ ID NO: 3574503 - DNA, 23 bp, Homo sapiens
acccaagtggacgttaggccagg

SEQ ID NO: 3574504 - DNA, 24 bp, Homo sapiens
acccaagtggacgttaggccaggc

SEQ ID NO: 3574505 - DNA, 12 bp, Homo sapiens
acccacaaactc

SEQ ID NO: 3574506 - DNA, 15 bp, Homo sapiens
acccacaaactccag

SEQ ID NO: 3574507 - DNA, 18 bp, Homo sapiens
acccacaaactccaggct

SEQ ID NO: 3574508 - DNA, 18 bp, Homo sapiens
acccacacagctgcccta

SEQ ID NO: 3574509 - DNA, 13 bp, Homo sapiens
acccacagaactt

SEQ ID NO: 3574510 - DNA, 12 bp, Homo sapiens
acccacagaccg

SEQ ID NO: 3574511 - DNA, 12 bp, Homo sapiens
acccacccagaa

SEQ ID NO: 3574512 - DNA, 15 bp, Homo sapiens
acccacccagaatga

SEQ ID NO: 3574513 - DNA, 20 bp, Homo sapiens
acccaccgccacaataaaga

SEQ ID NO: 3574514 - DNA, 14 bp, Homo sapiens
acccacctccctgc

SEQ ID NO: 3574515 - DNA, 18 bp, Homo sapiens
acccacctctcctgccct

SEQ ID NO: 3574516 - DNA, 18 bp, Homo sapiens
acccacgacctgtcctgt

SEQ ID NO: 3574517 - DNA, 18 bp, Homo sapiens
acccagaatgagacatcc

SEQ ID NO: 3574518 - DNA, 20 bp, Homo sapiens
acccagaatgagacatccag

SEQ ID NO: 3574519 - DNA, 14 bp, Homo sapiens
acccagaatggagc

SEQ ID NO: 3574520 - DNA, 20 bp, Homo sapiens
acccagactgtctccacggc

SEQ ID NO: 3574521 - DNA, 24 bp, Homo sapiens
acccagagcaccccctgctccacc

SEQ ID NO: 3574522 - DNA, 12 bp, Homo sapiens
acccagcaggca

SEQ ID NO: 3574523 - DNA, 18 bp, Homo sapiens
acccagcatctcccagca

SEQ ID NO: 3574524 - DNA, 20 bp, Homo sapiens
acccagcatctcccagcaag

SEQ ID NO: 3574525 - DNA, 17 bp, Homo sapiens
acccagccccagccagg

SEQ ID NO: 3574526 - DNA, 12 bp, Homo sapiens
acccagctctgt

SEQ ID NO: 3574527 - DNA, 11 bp, Homo sapiens
acccaggaagg

SEQ ID NO: 3574528 - DNA, 21 bp, Homo sapiens
acccagtcccacactgtggcc

SEQ ID NO: 3574529 - DNA, 18 bp, Homo sapiens
acccatccctgcctggag

SEQ ID NO: 3574530 - DNA, 19 bp, Homo sapiens
acccatccctgcctggagg

SEQ ID NO: 3574531 - DNA, 17 bp, Homo sapiens
acccatcctaggaacca

SEQ ID NO: 3574532 - DNA, 23 bp, Homo sapiens
acccattctgttttcccccagca

SEQ ID NO: 3574533 - DNA, 18 bp, Homo sapiens
accccaaaccccagcccc

SEQ ID NO: 3574534 - DNA, 19 bp, Homo sapiens
accccaagggggctgctgc

SEQ ID NO: 3574535 - DNA, 20 bp, Homo sapiens
accccaagggggctgctgct

SEQ ID NO: 3574536 - DNA, 15 bp, Homo sapiens
accccacctcacagc

SEQ ID NO: 3574537 - DNA, 16 bp, Homo sapiens
accccactcccctcac

SEQ ID NO: 3574538 - DNA, 18 bp, Homo sapiens
accccactcccctcacac

SEQ ID NO: 3574539 - DNA, 12 bp, Homo sapiens
accccagccagg

SEQ ID NO: 3574540 - DNA, 13 bp, Homo sapiens
accccagccccaa

SEQ ID NO: 3574541 - DNA, 21 bp, Homo sapiens
accccaggacctcttctggag

SEQ ID NO: 3574542 - DNA, 22 bp, Homo sapiens
accccaggacctcttctggaga

SEQ ID NO: 3574543 - DNA, 17 bp, Homo sapiens
accccatccagttcatg

SEQ ID NO: 3574544 - DNA, 22 bp, Homo sapiens
accccatctctatcagaaatac

SEQ ID NO: 3574545 - DNA, 20 bp, Homo sapiens
accccatggccggctttcag

SEQ ID NO: 3574546 - DNA, 16 bp, Homo sapiens
acccccaaattttctt

SEQ ID NO: 3574547 - DNA, 18 bp, Homo sapiens
acccccacaagctgtccc

SEQ ID NO: 3574548 - DNA, 20 bp, Homo sapiens
acccccacaagctgtccctg

SEQ ID NO: 3574549 - DNA, 21 bp, Homo sapiens
acccccacaagctgtccctgc

SEQ ID NO: 3574550 - DNA, 23 bp, Homo sapiens
acccccacaagctgtccctgcag

SEQ ID NO: 3574551 - DNA, 13 bp, Homo sapiens
acccccaggcaga

SEQ ID NO: 3574552 - DNA, 15 bp, Homo sapiens
acccccatctgagct

SEQ ID NO: 3574553 - DNA, 14 bp, Homo sapiens
acccccatgctgcc

SEQ ID NO: 3574554 - DNA, 19 bp, Homo sapiens
acccccatgctgccttcag

SEQ ID NO: 3574555 - DNA, 21 bp, Homo sapiens
acccccatgctgccttcaggg

SEQ ID NO: 3574556 - DNA, 13 bp, Homo sapiens
accccccactcag

SEQ ID NO: 3574557 - DNA, 14 bp, Homo sapiens
accccccactcagt

SEQ ID NO: 3574558 - DNA, 13 bp, Homo sapiens
acccccctcccag

SEQ ID NO: 3574559 - DNA, 14 bp, Homo sapiens
acccccctctgctg

SEQ ID NO: 3574560 - DNA, 16 bp, Homo sapiens
acccccctctgctgcc

SEQ ID NO: 3574561 - DNA, 18 bp, Homo sapiens
accccctcagccttggga

SEQ ID NO: 3574562 - DNA, 11 bp, Homo sapiens
accccctcctc

SEQ ID NO: 3574563 - DNA, 16 bp, Homo sapiens
accccctcctccccca

SEQ ID NO: 3574564 - DNA, 20 bp, Homo sapiens
accccctgcagcccaggcca

SEQ ID NO: 3574565 - DNA, 21 bp, Homo sapiens
accccctgcagcccaggccag

SEQ ID NO: 3574566 - DNA, 22 bp, Homo sapiens
accccctgctccaccagcagca

SEQ ID NO: 3574567 - DNA, 15 bp, Homo sapiens
acccccttccctggg

SEQ ID NO: 3574568 - DNA, 18 bp, Homo sapiens
accccgaccacctgccca

SEQ ID NO: 3574569 - DNA, 19 bp, Homo sapiens
accccgagaaccctgagca

SEQ ID NO: 3574570 - DNA, 20 bp, Homo sapiens
accccgagaagtgctcttgg

SEQ ID NO: 3574571 - DNA, 15 bp, Homo sapiens
accccgagggctgag

SEQ ID NO: 3574572 - DNA, 15 bp, Homo sapiens
accccgcacccggct

SEQ ID NO: 3574573 - DNA, 16 bp, Homo sapiens
acccctacatgaaaca

SEQ ID NO: 3574574 - DNA, 20 bp, Homo sapiens
acccctcaaactgcacatct

SEQ ID NO: 3574575 - DNA, 21 bp, Homo sapiens
acccctccagttttgcctgag

SEQ ID NO: 3574576 - DNA, 19 bp, Homo sapiens
acccctctccaggcctgtc

SEQ ID NO: 3574577 - DNA, 23 bp, Homo sapiens
acccctgcctgttggcaggccca

SEQ ID NO: 3574578 - DNA, 15 bp, Homo sapiens
acccctggcttttca

SEQ ID NO: 3574579 - DNA, 20 bp, Homo sapiens
acccctggcttttcactgct

SEQ ID NO: 3574580 - DNA, 21 bp, Homo sapiens
acccctggcttttcactgctg

SEQ ID NO: 3574581 - DNA, 16 bp, Homo sapiens
acccctgtaggcctca

SEQ ID NO: 3574582 - DNA, 22 bp, Homo sapiens
accccttcctgggcacacgctg

SEQ ID NO: 3574583 - DNA, 12 bp, Homo sapiens
acccctttctag

SEQ ID NO: 3574584 - DNA, 13 bp, Homo sapiens
acccgcctgacac

SEQ ID NO: 3574585 - DNA, 18 bp, Homo sapiens
acccggaggggcctggca

SEQ ID NO: 3574586 - DNA, 23 bp, Homo sapiens
acccgtcctctcggctgccaggg

SEQ ID NO: 3574587 - DNA, 15 bp, Homo sapiens
accctaaccaagttc

SEQ ID NO: 3574588 - DNA, 16 bp, Homo sapiens
accctaaccaagttcc

SEQ ID NO: 3574589 - DNA, 17 bp, Homo sapiens
accctaaccaagttcct

SEQ ID NO: 3574590 - DNA, 14 bp, Homo sapiens
accctacagacagc

SEQ ID NO: 3574591 - DNA, 15 bp, Homo sapiens
accctacagtatata

SEQ ID NO: 3574592 - DNA, 14 bp, Homo sapiens
accctacttctttt

SEQ ID NO: 3574593 - DNA, 16 bp, Homo sapiens
accctagccagagaat

SEQ ID NO: 3574594 - DNA, 19 bp, Homo sapiens
accctagccagagaataga

SEQ ID NO: 3574595 - DNA, 21 bp, Homo sapiens
accctcacctctcccccaagg

SEQ ID NO: 3574596 - DNA, 17 bp, Homo sapiens
accctcattctactgaa

SEQ ID NO: 3574597 - DNA, 22 bp, Homo sapiens
accctccaaaggaactctagag

SEQ ID NO: 3574598 - DNA, 19 bp, Homo sapiens
accctccccttttttcttc

SEQ ID NO: 3574599 - DNA, 14 bp, Homo sapiens
accctccggcgggt

SEQ ID NO: 3574600 - DNA, 15 bp, Homo sapiens
accctcctctgctgg

SEQ ID NO: 3574601 - DNA, 14 bp, Homo sapiens
accctcgagagcct

SEQ ID NO: 3574602 - DNA, 12 bp, Homo sapiens
accctctggggg

SEQ ID NO: 3574603 - DNA, 21 bp, Homo sapiens
accctctgggggtcctctctg

SEQ ID NO: 3574604 - DNA, 13 bp, Homo sapiens
accctcttcatgg

SEQ ID NO: 3574605 - DNA, 17 bp, Homo sapiens
accctgaaggggccatg

SEQ ID NO: 3574606 - DNA, 23 bp, Homo sapiens
accctgagcagggtccacagctg

SEQ ID NO: 3574607 - DNA, 22 bp, Homo sapiens
accctgatttaggagaagccag

SEQ ID NO: 3574608 - DNA, 15 bp, Homo sapiens
acttaaatttgttct

SEQ ID NO: 3574609 - DNA, 20 bp, Homo sapiens
acttaaatttgttctttgtt

SEQ ID NO: 3574610 - DNA, 21 bp, Homo sapiens
acttaagcatctggctctaat

SEQ ID NO: 3574611 - DNA, 16 bp, Homo sapiens
acttaatgtatgttac

SEQ ID NO: 3574612 - DNA, 23 bp, Homo sapiens
acttacaagtttctagctctcac

SEQ ID NO: 3574613 - DNA, 19 bp, Homo sapiens
acttacacttataaaataa

SEQ ID NO: 3574614 - DNA, 16 bp, Homo sapiens
acttacactttatgca

SEQ ID NO: 3574615 - DNA, 21 bp, Homo sapiens
acttactttaattactggaat

SEQ ID NO: 3574616 - DNA, 23 bp, Homo sapiens
acttaggagaagtcttctattta

SEQ ID NO: 3574617 - DNA, 16 bp, Homo sapiens
acttagtacaaagttt

SEQ ID NO: 3574618 - DNA, 15 bp, Homo sapiens
acttataaaataact

SEQ ID NO: 3574619 - DNA, 15 bp, Homo sapiens
acttatactgtaggt

SEQ ID NO: 3574620 - DNA, 15 bp, Homo sapiens
acttatagtacatga

SEQ ID NO: 3574621 - DNA, 22 bp, Homo sapiens
acttatgaaatgtgcactttat

SEQ ID NO: 3574622 - DNA, 16 bp, Homo sapiens
acttatgtagaaactg

SEQ ID NO: 3574623 - DNA, 12 bp, Homo sapiens
acttattattaa

SEQ ID NO: 3574624 - DNA, 17 bp, Homo sapiens
acttattgaatatatga

SEQ ID NO: 3574625 - DNA, 15 bp, Homo sapiens
acttatttaaactct

SEQ ID NO: 3574626 - DNA, 13 bp, Homo sapiens
acttatttctgct

SEQ ID NO: 3574627 - DNA, 13 bp, Homo sapiens
acttatttttctg

SEQ ID NO: 3574628 - DNA, 15 bp, Homo sapiens
acttcaaaagtttgt

SEQ ID NO: 3574629 - DNA, 17 bp, Homo sapiens
acttcaaagctgaatat

SEQ ID NO: 3574630 - DNA, 18 bp, Homo sapiens
acttcaaagctgaatatt

SEQ ID NO: 3574631 - DNA, 21 bp, Homo sapiens
acttcaaagtgcctgggctca

SEQ ID NO: 3574632 - DNA, 22 bp, Homo sapiens
acttcagcaaccctacagtata

SEQ ID NO: 3574633 - DNA, 18 bp, Homo sapiens
acttcaggctcttctcct

SEQ ID NO: 3574634 - DNA, 20 bp, Homo sapiens
acttcaggtcaggtggctgt

SEQ ID NO: 3574635 - DNA, 17 bp, Homo sapiens
acttccataatctggac

SEQ ID NO: 3574636 - DNA, 21 bp, Homo sapiens
acttccccctcttcttctgaa

SEQ ID NO: 3574637 - DNA, 22 bp, Homo sapiens
acttccccctcttcttctgaag

SEQ ID NO: 3574638 - DNA, 13 bp, Homo sapiens
acttccctcaggc

SEQ ID NO: 3574639 - DNA, 22 bp, Homo sapiens
acttccgctgaggggtctcgga

SEQ ID NO: 3574640 - DNA, 16 bp, Homo sapiens
acttcctgaggcctca

SEQ ID NO: 3574641 - DNA, 11 bp, Homo sapiens
acttcctgctg

SEQ ID NO: 3574642 - DNA, 13 bp, Homo sapiens
acttcctgctgca

SEQ ID NO: 3574643 - DNA, 16 bp, Homo sapiens
acttcctgctgcaccc

SEQ ID NO: 3574644 - DNA, 18 bp, Homo sapiens
acttcctgtccagctcca

SEQ ID NO: 3574645 - DNA, 23 bp, Homo sapiens
acttcctgtccagctccaacctg

SEQ ID NO: 3574646 - DNA, 14 bp, Homo sapiens
acttccttttaact

SEQ ID NO: 3574647 - DNA, 19 bp, Homo sapiens
acttcgcagccccgggcgg

SEQ ID NO: 3574648 - DNA, 22 bp, Homo sapiens
acttcggcagatactgtctctt

SEQ ID NO: 3574649 - DNA, 18 bp, Homo sapiens
acttctaagtaaaaccac

SEQ ID NO: 3574650 - DNA, 19 bp, Homo sapiens
acttctaagtaaaaccaca

SEQ ID NO: 3574651 - DNA, 19 bp, Homo sapiens
acttctcaaagagaattgt

SEQ ID NO: 3574652 - DNA, 18 bp, Homo sapiens
acttctcttaagtggtct

SEQ ID NO: 3574653 - DNA, 14 bp, Homo sapiens
acttctcttgcttt

SEQ ID NO: 3574654 - DNA, 13 bp, Homo sapiens
acttctgcctctt

SEQ ID NO: 3574655 - DNA, 10 bp, Homo sapiens
acttctgctc

SEQ ID NO: 3574656 - DNA, 15 bp, Homo sapiens
acttctgttttacca

SEQ ID NO: 3574657 - DNA, 18 bp, Homo sapiens
acttcttcctgtgaagtt

SEQ ID NO: 3574658 - DNA, 22 bp, Homo sapiens
acttcttggcttggtgaggaaa

SEQ ID NO: 3574659 - DNA, 19 bp, Homo sapiens
acttcttttgctcttagct

SEQ ID NO: 3574660 - DNA, 16 bp, Homo sapiens
acttgaaaagaaagaa

SEQ ID NO: 3574661 - DNA, 14 bp, Homo sapiens
acttgaagggccag

SEQ ID NO: 3574662 - DNA, 17 bp, Homo sapiens
acttgaagggccagagc

SEQ ID NO: 3574663 - DNA, 21 bp, Homo sapiens
acttgaagggccagagccagg

SEQ ID NO: 3574664 - DNA, 15 bp, Homo sapiens
acttgagattcaaga

SEQ ID NO: 3574665 - DNA, 19 bp, Homo sapiens
acttgagattcaagacaag

SEQ ID NO: 3574666 - DNA, 20 bp, Homo sapiens
acttgatatttaagcagctt

SEQ ID NO: 3574667 - DNA, 22 bp, Homo sapiens
acttgatggctaacttacaaag

SEQ ID NO: 3574668 - DNA, 17 bp, Homo sapiens
acttgatttgagatttt

SEQ ID NO: 3574669 - DNA, 23 bp, Homo sapiens
acttgccgcgtcgccctcccagg

SEQ ID NO: 3574670 - DNA, 16 bp, Homo sapiens
acttgcctatctgact

SEQ ID NO: 3574671 - DNA, 22 bp, Homo sapiens
acttgcctatgatactgtctct

SEQ ID NO: 3574672 - DNA, 20 bp, Homo sapiens
acttgctccttttgctcttt

SEQ ID NO: 3574673 - DNA, 15 bp, Homo sapiens
acttgctctttgact

SEQ ID NO: 3574674 - DNA, 15 bp, Homo sapiens
acttgctttcttctt

SEQ ID NO: 3574675 - DNA, 17 bp, Homo sapiens
acttggcccccttcagg

SEQ ID NO: 3574676 - DNA, 20 bp, Homo sapiens
acttggcccccttcaggagc

SEQ ID NO: 3574677 - DNA, 22 bp, Homo sapiens
acttgggcttcaacagccaagc

SEQ ID NO: 3574678 - DNA, 20 bp, Homo sapiens
acttgggtcacatgactctc

SEQ ID NO: 3574679 - DNA, 14 bp, Homo sapiens
acttgtaaaaccac

SEQ ID NO: 3574680 - DNA, 18 bp, Homo sapiens
acttgtatattctatttt

SEQ ID NO: 3574681 - DNA, 22 bp, Homo sapiens
acttgtatattctattttacaa

SEQ ID NO: 3574682 - DNA, 18 bp, Homo sapiens
acttgtattttgtcactt

SEQ ID NO: 3574683 - DNA, 21 bp, Homo sapiens
acttgtattttgtcacttttt

SEQ ID NO: 3574684 - DNA, 19 bp, Homo sapiens
acttgtgattggctgcagg

SEQ ID NO: 3574685 - DNA, 20 bp, Homo sapiens
acttgtgattggctgcagga

SEQ ID NO: 3574686 - DNA, 15 bp, Homo sapiens
acttgttatattata

SEQ ID NO: 3574687 - DNA, 12 bp, Homo sapiens
acttgtttgaat

SEQ ID NO: 3574688 - DNA, 16 bp, Homo sapiens
acttgtttgaatattt

SEQ ID NO: 3574689 - DNA, 18 bp, Homo sapiens
acttgtttgaatatttgt

SEQ ID NO: 3574690 - DNA, 19 bp, Homo sapiens
actttagggggtgggattc

SEQ ID NO: 3574691 - DNA, 21 bp, Homo sapiens
actttattaccttctttctaa

SEQ ID NO: 3574692 - DNA, 17 bp, Homo sapiens
actttattgccaaaacc

SEQ ID NO: 3574693 - DNA, 13 bp, Homo sapiens
actttcagagccc

SEQ ID NO: 3574694 - DNA, 21 bp, Homo sapiens
actttcagagcccccagccct

SEQ ID NO: 3574695 - DNA, 23 bp, Homo sapiens
actttcagagcccccagccctgg

SEQ ID NO: 3574696 - DNA, 16 bp, Homo sapiens
actttcagcagtctaa

SEQ ID NO: 3574697 - DNA, 17 bp, Homo sapiens
actttcagcagtctaaa

SEQ ID NO: 3574698 - DNA, 18 bp, Homo sapiens
actttcagcagtctaaat

SEQ ID NO: 3574699 - DNA, 17 bp, Homo sapiens
actttcagtaaacataa

SEQ ID NO: 3574700 - DNA, 22 bp, Homo sapiens
actttctatctcatctgtctcg

SEQ ID NO: 3574701 - DNA, 14 bp, Homo sapiens
actttctcaatgct

SEQ ID NO: 3574702 - DNA, 19 bp, Homo sapiens
actttctcataagcaccta

SEQ ID NO: 3574703 - DNA, 15 bp, Homo sapiens
actttctggcaaacg

SEQ ID NO: 3574704 - DNA, 22 bp, Homo sapiens
actttctggcaaacgtttctca

SEQ ID NO: 3574705 - DNA, 14 bp, Homo sapiens
actttcttctgaat

SEQ ID NO: 3574706 - DNA, 18 bp, Homo sapiens
actttgagcatttttaag

SEQ ID NO: 3574707 - DNA, 18 bp, Homo sapiens
actttgcactgatatatc

SEQ ID NO: 3574708 - DNA, 19 bp, Homo sapiens
actttgcactgatatatca

SEQ ID NO: 3574709 - DNA, 17 bp, Homo sapiens
actttgccaaggctctc

SEQ ID NO: 3574710 - DNA, 18 bp, Homo sapiens
actttggacagtggcctc

SEQ ID NO: 3574711 - DNA, 19 bp, Homo sapiens
actttggacagtggcctct

SEQ ID NO: 3574712 - DNA, 22 bp, Homo sapiens
actttggagagggaaaatcttc

SEQ ID NO: 3574713 - DNA, 15 bp, Homo sapiens
actttggtttttcca

SEQ ID NO: 3574714 - DNA, 23 bp, Homo sapiens
actttgtggagagaatgtgtgtg

SEQ ID NO: 3574715 - DNA, 13 bp, Homo sapiens
actttgtgtatta

SEQ ID NO: 3574716 - DNA, 16 bp, Homo sapiens
actttgtgtattaaat

SEQ ID NO: 3574717 - DNA, 15 bp, Homo sapiens
acttttaaacagtga

SEQ ID NO: 3574718 - DNA, 12 bp, Homo sapiens
acttttcctttg

SEQ ID NO: 3574719 - DNA, 18 bp, Homo sapiens
acttttctaaaatctaaa

SEQ ID NO: 3574720 - DNA, 18 bp, Homo sapiens
acttttctcaatattaag

SEQ ID NO: 3574721 - DNA, 12 bp, Homo sapiens
acttttgtaaga

SEQ ID NO: 3574722 - DNA, 17 bp, Homo sapiens
acttttgtaagacaaag

SEQ ID NO: 3574723 - DNA, 19 bp, Homo sapiens
acttttgtggagtttgaca

SEQ ID NO: 3574724 - DNA, 17 bp, Homo sapiens
acttttttaaatataaa

SEQ ID NO: 3574725 - DNA, 22 bp, Homo sapiens
acttttttattttttaaatctt

SEQ ID NO: 3574726 - DNA, 15 bp, Homo sapiens
agaaaaaaaaagcaa

SEQ ID NO: 3574727 - DNA, 20 bp, Homo sapiens
agaaaaaaaaagcaaatcag

SEQ ID NO: 3574728 - DNA, 13 bp, Homo sapiens
agaaaaaataata

SEQ ID NO: 3574729 - DNA, 14 bp, Homo sapiens
agaaaaagaagaaa

SEQ ID NO: 3574730 - DNA, 17 bp, Homo sapiens
agaaaaagaagaaaaga

SEQ ID NO: 3574731 - DNA, 13 bp, Homo sapiens
agaaaacccaccc

SEQ ID NO: 3574732 - DNA, 14 bp, Homo sapiens
agaaaacccacccc

SEQ ID NO: 3574733 - DNA, 22 bp, Homo sapiens
agaaaaccttaaaagtaataaa

SEQ ID NO: 3574734 - DNA, 23 bp, Homo sapiens
agaaaaccttaaaagtaataaag

SEQ ID NO: 3574735 - DNA, 17 bp, Homo sapiens
agaaaagcaatactgtt

SEQ ID NO: 3574736 - DNA, 18 bp, Homo sapiens
agaaaatatttttgtgga

SEQ ID NO: 3574737 - DNA, 23 bp, Homo sapiens
agaaaatgacttatttctgctct

SEQ ID NO: 3574738 - DNA, 15 bp, Homo sapiens
agaaaattcaggtct

SEQ ID NO: 3574739 - DNA, 14 bp, Homo sapiens
agaaaattccctgg

SEQ ID NO: 3574740 - DNA, 20 bp, Homo sapiens
agagtgtagcctaaagggca

SEQ ID NO: 3574741 - DNA, 21 bp, Homo sapiens
agagtgtagcctaaagggcag

SEQ ID NO: 3574742 - DNA, 22 bp, Homo sapiens
agagtgtagcctaaagggcagg

SEQ ID NO: 3574743 - DNA, 12 bp, Homo sapiens
agagtgtagctg

SEQ ID NO: 3574744 - DNA, 16 bp, Homo sapiens
agagtgtagctgtaag

SEQ ID NO: 3574745 - DNA, 11 bp, Homo sapiens
agagttacagt

SEQ ID NO: 3574746 - DNA, 18 bp, Homo sapiens
agagttccggggagaaac

SEQ ID NO: 3574747 - DNA, 18 bp, Homo sapiens
agagttctttgctgcccc

SEQ ID NO: 3574748 - DNA, 23 bp, Homo sapiens
agagttctttgctgcccctgtct

SEQ ID NO: 3574749 - DNA, 16 bp, Homo sapiens
agagttttagagaaaa

SEQ ID NO: 3574750 - DNA, 20 bp, Homo sapiens
agataaaaaaactgttacca

SEQ ID NO: 3574751 - DNA, 22 bp, Homo sapiens
agataacgaagtgcacttacac

SEQ ID NO: 3574752 - DNA, 18 bp, Homo sapiens
agataaggtggcttctca

SEQ ID NO: 3574753 - DNA, 17 bp, Homo sapiens
agataattgcttgccag

SEQ ID NO: 3574754 - DNA, 20 bp, Homo sapiens
agataatttatttcaataaa

SEQ ID NO: 3574755 - DNA, 14 bp, Homo sapiens
agatactggtggaa

SEQ ID NO: 3574756 - DNA, 18 bp, Homo sapiens
agatacttatttttctga

SEQ ID NO: 3574757 - DNA, 19 bp, Homo sapiens
agatactttgaagtgcagc

SEQ ID NO: 3574758 - DNA, 16 bp, Homo sapiens
agatattgatattgaa

SEQ ID NO: 3574759 - DNA, 14 bp, Homo sapiens
agatcaatgtgacg

SEQ ID NO: 3574760 - DNA, 18 bp, Homo sapiens
agatcagaacattcagct

SEQ ID NO: 3574761 - DNA, 16 bp, Homo sapiens
agatcaggagtgacag

SEQ ID NO: 3574762 - DNA, 13 bp, Homo sapiens
agatccagcccaa

SEQ ID NO: 3574763 - DNA, 17 bp, Homo sapiens
agatcctttcaaaagaa

SEQ ID NO: 3574764 - DNA, 15 bp, Homo sapiens
agatcgcccccacct

SEQ ID NO: 3574765 - DNA, 16 bp, Homo sapiens
agatctatgggaagat

SEQ ID NO: 3574766 - DNA, 21 bp, Homo sapiens
agatctattgtttgttgcact

SEQ ID NO: 3574767 - DNA, 17 bp, Homo sapiens
agatctggaacctcagc

SEQ ID NO: 3574768 - DNA, 17 bp, Homo sapiens
agatctgtcctcagcct

SEQ ID NO: 3574769 - DNA, 16 bp, Homo sapiens
agatctgtgtggctcc

SEQ ID NO: 3574770 - DNA, 18 bp, Homo sapiens
agatctgtgtggctcctg

SEQ ID NO: 3574771 - DNA, 21 bp, Homo sapiens
agatctttctttccaaaacat

SEQ ID NO: 3574772 - DNA, 17 bp, Homo sapiens
agatgaaatttgataaa

SEQ ID NO: 3574773 - DNA, 19 bp, Homo sapiens
agatgaccagggatgctgg

SEQ ID NO: 3574774 - DNA, 16 bp, Homo sapiens
agatgacctgccccaa

SEQ ID NO: 3574775 - DNA, 15 bp, Homo sapiens
agatgactctgtctc

SEQ ID NO: 3574776 - DNA, 23 bp, Homo sapiens
agatgactctgtctcattgacct

SEQ ID NO: 3574777 - DNA, 14 bp, Homo sapiens
agatgaggctcaga

SEQ ID NO: 3574778 - DNA, 17 bp, Homo sapiens
agatgagtgtctggagc

SEQ ID NO: 3574779 - DNA, 20 bp, Homo sapiens
agatgcaatgactcaggaca

SEQ ID NO: 3574780 - DNA, 21 bp, Homo sapiens
agatgcacgtggggcccactg

SEQ ID NO: 3574781 - DNA, 22 bp, Homo sapiens
agatgccacttctcactcacca

SEQ ID NO: 3574782 - DNA, 17 bp, Homo sapiens
agatgccagcttctctc

SEQ ID NO: 3574783 - DNA, 16 bp, Homo sapiens
agatgccccctccagg

SEQ ID NO: 3574784 - DNA, 16 bp, Homo sapiens
agatgccgcatttgga

SEQ ID NO: 3574785 - DNA, 15 bp, Homo sapiens
agatgcctgttaatt

SEQ ID NO: 3574786 - DNA, 13 bp, Homo sapiens
agatgctgagcca

SEQ ID NO: 3574787 - DNA, 14 bp, Homo sapiens
agatgctgaggccc

SEQ ID NO: 3574788 - DNA, 16 bp, Homo sapiens
agatgctgaggcccct

SEQ ID NO: 3574789 - DNA, 14 bp, Homo sapiens
agatgctggcccag

SEQ ID NO: 3574790 - DNA, 17 bp, Homo sapiens
agatgctggcccagggc

SEQ ID NO: 3574791 - DNA, 20 bp, Homo sapiens
agatgctggcccagggccca

SEQ ID NO: 3574792 - DNA, 23 bp, Homo sapiens
agatgctggcccagggcccagag

SEQ ID NO: 3574793 - DNA, 15 bp, Homo sapiens
agatgctgtgcccct

SEQ ID NO: 3574794 - DNA, 13 bp, Homo sapiens
agatggaaagagg

SEQ ID NO: 3574795 - DNA, 23 bp, Homo sapiens
agatggaaagaggtgaaaatgaa

SEQ ID NO: 3574796 - DNA, 18 bp, Homo sapiens
agatggaagcttgttgaa

SEQ ID NO: 3574797 - DNA, 19 bp, Homo sapiens
agatggaagcttgttgaaa

SEQ ID NO: 3574798 - DNA, 22 bp, Homo sapiens
agatggagacaccctctggggg

SEQ ID NO: 3574799 - DNA, 17 bp, Homo sapiens
agatggagggcttggcc

SEQ ID NO: 3574800 - DNA, 19 bp, Homo sapiens
agatggagggcttggccca

SEQ ID NO: 3574801 - DNA, 18 bp, Homo sapiens
agatggagtttctctctt

SEQ ID NO: 3574802 - DNA, 19 bp, Homo sapiens
agatggagtttctctcttg

SEQ ID NO: 3574803 - DNA, 22 bp, Homo sapiens
agatggcctcttactaatgtaa

SEQ ID NO: 3574804 - DNA, 14 bp, Homo sapiens
agatggctgtgcct

SEQ ID NO: 3574805 - DNA, 22 bp, Homo sapiens
agatggctgtgcctctgcctgt

SEQ ID NO: 3574806 - DNA, 22 bp, Homo sapiens
agatggggaataatttccttca

SEQ ID NO: 3574807 - DNA, 13 bp, Homo sapiens
agatgtaattttg

SEQ ID NO: 3574808 - DNA, 14 bp, Homo sapiens
agatgtaattttgt

SEQ ID NO: 3574809 - DNA, 19 bp, Homo sapiens
agatgtaattttgtgtaag

SEQ ID NO: 3574810 - DNA, 17 bp, Homo sapiens
agatgtacatttaataa

SEQ ID NO: 3574811 - DNA, 17 bp, Homo sapiens
agatgtgaacacatcag

SEQ ID NO: 3574812 - DNA, 16 bp, Homo sapiens
agatgtgcagtttgga

SEQ ID NO: 3574813 - DNA, 17 bp, Homo sapiens
agattaggtcgttttcc

SEQ ID NO: 3574814 - DNA, 15 bp, Homo sapiens
agattattttttaaa

SEQ ID NO: 3574815 - DNA, 17 bp, Homo sapiens
agattattttttaaaaa

SEQ ID NO: 3574816 - DNA, 15 bp, Homo sapiens
agattcaagacaaga

SEQ ID NO: 3574817 - DNA, 22 bp, Homo sapiens
agattcaagacaagagctgtta

SEQ ID NO: 3574818 - DNA, 14 bp, Homo sapiens
agattcagagaaat

SEQ ID NO: 3574819 - DNA, 13 bp, Homo sapiens
agattcatattta

SEQ ID NO: 3574820 - DNA, 22 bp, Homo sapiens
agattcatatttacttcttata

SEQ ID NO: 3574821 - DNA, 22 bp, Homo sapiens
agattcatgcaagtggagctgt

SEQ ID NO: 3574822 - DNA, 21 bp, Homo sapiens
agattctatgttaatatttta

SEQ ID NO: 3574823 - DNA, 22 bp, Homo sapiens
agattctatgttaatattttat

SEQ ID NO: 3574824 - DNA, 22 bp, Homo sapiens
agattcttgtatttattacaac

SEQ ID NO: 3574825 - DNA, 21 bp, Homo sapiens
agattggcttgtctcacgcag

SEQ ID NO: 3574826 - DNA, 20 bp, Homo sapiens
agattgtgatcccttgagat

SEQ ID NO: 3574827 - DNA, 19 bp, Homo sapiens
agatttaagccttacaaag

SEQ ID NO: 3574828 - DNA, 16 bp, Homo sapiens
agatttaatattacag

SEQ ID NO: 3574829 - DNA, 19 bp, Homo sapiens
agatttagtgtaataagac

SEQ ID NO: 3574830 - DNA, 15 bp, Homo sapiens
agatttattcctttg

SEQ ID NO: 3574831 - DNA, 17 bp, Homo sapiens
agatttattcctttgtt

SEQ ID NO: 3574832 - DNA, 17 bp, Homo sapiens
agatttgaactcttcaa

SEQ ID NO: 3574833 - DNA, 13 bp, Homo sapiens
agcaaaaatctcc

SEQ ID NO: 3574834 - DNA, 21 bp, Homo sapiens
agcaaaaatctcccagtgaca

SEQ ID NO: 3574835 - DNA, 15 bp, Homo sapiens
agcaaaatcagaagt

SEQ ID NO: 3574836 - DNA, 13 bp, Homo sapiens
agcaaactctgct

SEQ ID NO: 3574837 - DNA, 15 bp, Homo sapiens
agcaaactctgctgt

SEQ ID NO: 3574838 - DNA, 22 bp, Homo sapiens
agcaaagaaggccagcaacatt

SEQ ID NO: 3574839 - DNA, 20 bp, Homo sapiens
agcaaataaacttacagatc

SEQ ID NO: 3574840 - DNA, 18 bp, Homo sapiens
agcaaatcagaaaaccca

SEQ ID NO: 3574841 - DNA, 20 bp, Homo sapiens
agcaaatggcctcatgtcaa

SEQ ID NO: 3574842 - DNA, 15 bp, Homo sapiens
agcaacacagaggaa

SEQ ID NO: 3574843 - DNA, 22 bp, Homo sapiens
agcaaccatatagaaagctttg

SEQ ID NO: 3574844 - DNA, 18 bp, Homo sapiens
agcaaccctacagtatat

SEQ ID NO: 3574845 - DNA, 14 bp, Homo sapiens
agcaacgcaggccc

SEQ ID NO: 3574846 - DNA, 14 bp, Homo sapiens
agcaacgcccctcc

SEQ ID NO: 3574847 - DNA, 15 bp, Homo sapiens
agcaacgcccctcca

SEQ ID NO: 3574848 - DNA, 19 bp, Homo sapiens
agcaacgcccctccaaacc

SEQ ID NO: 3574849 - DNA, 20 bp, Homo sapiens
agcaacgcccctccaaacct

SEQ ID NO: 3574850 - DNA, 11 bp, Homo sapiens
agcaactgtga

SEQ ID NO: 3574851 - DNA, 17 bp, Homo sapiens
agcaagacacgtggcct

SEQ ID NO: 3574852 - DNA, 22 bp, Homo sapiens
agcaagacctcatctgtggagc

SEQ ID NO: 3574853 - DNA, 17 bp, Homo sapiens
agcaagataaacattat

SEQ ID NO: 3574854 - DNA, 15 bp, Homo sapiens
agcaagcaccaacct

SEQ ID NO: 3574855 - DNA, 21 bp, Homo sapiens
agcaagcaccaacctccagac

SEQ ID NO: 3574856 - DNA, 14 bp, Homo sapiens
agcaagcaggagtg

SEQ ID NO: 3574857 - DNA, 13 bp, Homo sapiens
agcaagcgggagc

SEQ ID NO: 3574858 - DNA, 15 bp, Homo sapiens
agcaaggcagagcct

SEQ ID NO: 3574859 - DNA, 20 bp, Homo sapiens
agcaagggtgatgggaaagc

SEQ ID NO: 3574860 - DNA, 22 bp, Homo sapiens
agcaagggtgatgggaaagcat

SEQ ID NO: 3574861 - DNA, 15 bp, Homo sapiens
agcaataaatgcttt

SEQ ID NO: 3574862 - DNA, 18 bp, Homo sapiens
agcaatactgtttccatt

SEQ ID NO: 3574863 - DNA, 20 bp, Homo sapiens
agcaataggtagctggggag

SEQ ID NO: 3574864 - DNA, 21 bp, Homo sapiens
agcaatattcttggagattga

SEQ ID NO: 3574865 - DNA, 21 bp, Homo sapiens
agcaatgccccaaactttctc

SEQ ID NO: 3574866 - DNA, 23 bp, Homo sapiens
agcaatgggtcttagctctttct

SEQ ID NO: 3574867 - DNA, 16 bp, Homo sapiens
agcaatgtgttttttc

SEQ ID NO: 3574868 - DNA, 17 bp, Homo sapiens
agcaattcatggttcaa

SEQ ID NO: 3574869 - DNA, 19 bp, Homo sapiens
agcaattcatggttcaagt

SEQ ID NO: 3574870 - DNA, 16 bp, Homo sapiens
agcaattctttcaagt

SEQ ID NO: 3574871 - DNA, 13 bp, Homo sapiens
agcaattggcagc

SEQ ID NO: 3574872 - DNA, 12 bp, Homo sapiens
aggaactctaga

SEQ ID NO: 3574873 - DNA, 13 bp, Homo sapiens
aggaactctagag

SEQ ID NO: 3574874 - DNA, 17 bp, Homo sapiens
aggaactctagagggcg

SEQ ID NO: 3574875 - DNA, 16 bp, Homo sapiens
aggaactgctgggctt

SEQ ID NO: 3574876 - DNA, 19 bp, Homo sapiens
aggaagctgtgttgaaaca

SEQ ID NO: 3574877 - DNA, 13 bp, Homo sapiens
aggaaggaaaact

SEQ ID NO: 3574878 - DNA, 14 bp, Homo sapiens
aggaaggaaaacta

SEQ ID NO: 3574879 - DNA, 16 bp, Homo sapiens
aggaaggaacaaagac

SEQ ID NO: 3574880 - DNA, 21 bp, Homo sapiens
aggaaggccaaaatcaagagt

SEQ ID NO: 3574881 - DNA, 22 bp, Homo sapiens
aggaagtgagcagtcgcctgcc

SEQ ID NO: 3574882 - DNA, 23 bp, Homo sapiens
aggaagttgacttatagtacatg

SEQ ID NO: 3574883 - DNA, 16 bp, Homo sapiens
aggaatggccctcatt

SEQ ID NO: 3574884 - DNA, 15 bp, Homo sapiens
aggaatgtcagggcc

SEQ ID NO: 3574885 - DNA, 20 bp, Homo sapiens
aggaatgtcagggccaggtg

SEQ ID NO: 3574886 - DNA, 19 bp, Homo sapiens
aggaatttcccaggaccct

SEQ ID NO: 3574887 - DNA, 20 bp, Homo sapiens
aggaatttcccaggaccctg

SEQ ID NO: 3574888 - DNA, 13 bp, Homo sapiens
aggaatttcttaa

SEQ ID NO: 3574889 - DNA, 14 bp, Homo sapiens
aggacaaataagaa

SEQ ID NO: 3574890 - DNA, 18 bp, Homo sapiens
aggacaggaccctcagga

SEQ ID NO: 3574891 - DNA, 22 bp, Homo sapiens
aggacatcagcaaacaggatca

SEQ ID NO: 3574892 - DNA, 20 bp, Homo sapiens
aggacatttgtgggcaagca

SEQ ID NO: 3574893 - DNA, 12 bp, Homo sapiens
aggaccagctca

SEQ ID NO: 3574894 - DNA, 14 bp, Homo sapiens
aggaccagctcagg

SEQ ID NO: 3574895 - DNA, 15 bp, Homo sapiens
aggaccagctcagga

SEQ ID NO: 3574896 - DNA, 18 bp, Homo sapiens
aggaccagctcaggacag

SEQ ID NO: 3574897 - DNA, 22 bp, Homo sapiens
aggaccagggttggcaccttcc

SEQ ID NO: 3574898 - DNA, 20 bp, Homo sapiens
aggacccatccctgcctgga

SEQ ID NO: 3574899 - DNA, 22 bp, Homo sapiens
aggacccatccctgcctggagg

SEQ ID NO: 3574900 - DNA, 14 bp, Homo sapiens
aggaccccagctct

SEQ ID NO: 3574901 - DNA, 16 bp, Homo sapiens
aggaccccagctctgc

SEQ ID NO: 3574902 - DNA, 21 bp, Homo sapiens
aggacccggaggggcctggca

SEQ ID NO: 3574903 - DNA, 17 bp, Homo sapiens
aggaccctcaggaattc

SEQ ID NO: 3574904 - DNA, 20 bp, Homo sapiens
aggaccctcaggaattcagt

SEQ ID NO: 3574905 - DNA, 19 bp, Homo sapiens
aggaccctgaaggggccat

SEQ ID NO: 3574906 - DNA, 22 bp, Homo sapiens
aggaccctgacctccgcccctg

SEQ ID NO: 3574907 - DNA, 18 bp, Homo sapiens
aggaccctgtcctgcagt

SEQ ID NO: 3574908 - DNA, 13 bp, Homo sapiens
aggaccgtgccct

SEQ ID NO: 3574909 - DNA, 19 bp, Homo sapiens
aggacctccggagcgccct

SEQ ID NO: 3574910 - DNA, 14 bp, Homo sapiens
aggacctcgtgcca

SEQ ID NO: 3574911 - DNA, 19 bp, Homo sapiens
aggaccttcgggctgtgcc

SEQ ID NO: 3574912 - DNA, 20 bp, Homo sapiens
aggaccttcgggctgtgccc

SEQ ID NO: 3574913 - DNA, 13 bp, Homo sapiens
aggacgggccaca

SEQ ID NO: 3574914 - DNA, 14 bp, Homo sapiens
aggacgggccacac

SEQ ID NO: 3574915 - DNA, 23 bp, Homo sapiens
aggacgggccacacgtggctggc

SEQ ID NO: 3574916 - DNA, 17 bp, Homo sapiens
aggactccatttctttc

SEQ ID NO: 3574917 - DNA, 16 bp, Homo sapiens
aggactcccagaacct

SEQ ID NO: 3574918 - DNA, 17 bp, Homo sapiens
aggactcccagaacctc

SEQ ID NO: 3574919 - DNA, 15 bp, Homo sapiens
aggactcctggcagg

SEQ ID NO: 3574920 - DNA, 15 bp, Homo sapiens
aggactctctccagg

SEQ ID NO: 3574921 - DNA, 19 bp, Homo sapiens
aggactctctccaggaggg

SEQ ID NO: 3574922 - DNA, 16 bp, Homo sapiens
aggactctgcctcctc

SEQ ID NO: 3574923 - DNA, 21 bp, Homo sapiens
aggactggttctgaggccaga

SEQ ID NO: 3574924 - DNA, 19 bp, Homo sapiens
aggacttatttaaactctg

SEQ ID NO: 3574925 - DNA, 17 bp, Homo sapiens
aggacttgatgtacata

SEQ ID NO: 3574926 - DNA, 17 bp, Homo sapiens
aggagaaaaagaagaaa

SEQ ID NO: 3574927 - DNA, 20 bp, Homo sapiens
aggagaaaaagaagaaaaga

SEQ ID NO: 3574928 - DNA, 21 bp, Homo sapiens
aggagaaaaagaagaaaagat

SEQ ID NO: 3574929 - DNA, 19 bp, Homo sapiens
aggagaacttgctgcctcg

SEQ ID NO: 3574930 - DNA, 11 bp, Homo sapiens
aggagaagcca

SEQ ID NO: 3574931 - DNA, 12 bp, Homo sapiens
aggagaagccag

SEQ ID NO: 3574932 - DNA, 15 bp, Homo sapiens
aggagaagccaggaa

SEQ ID NO: 3574933 - DNA, 22 bp, Homo sapiens
aggagaagtcttctatttattt

SEQ ID NO: 3574934 - DNA, 20 bp, Homo sapiens
aggagaatcacttgaaccca

SEQ ID NO: 3574935 - DNA, 11 bp, Homo sapiens
aggagagagac

SEQ ID NO: 3574936 - DNA, 14 bp, Homo sapiens
aggagagagacccc

SEQ ID NO: 3574937 - DNA, 13 bp, Homo sapiens
aggagagcctggg

SEQ ID NO: 3574938 - DNA, 13 bp, Homo sapiens
aggagaggcagca

SEQ ID NO: 3574939 - DNA, 15 bp, Homo sapiens
aggagaggcagcatg

SEQ ID NO: 3574940 - DNA, 17 bp, Homo sapiens
aggagataaggtggctt

SEQ ID NO: 3574941 - DNA, 18 bp, Homo sapiens
aggagataaggtggcttc

SEQ ID NO: 3574942 - DNA, 18 bp, Homo sapiens
aggagatgaccagggatg

SEQ ID NO: 3574943 - DNA, 14 bp, Homo sapiens
aggagatggggaat

SEQ ID NO: 3574944 - DNA, 13 bp, Homo sapiens
aggagcaggcttg

SEQ ID NO: 3574945 - DNA, 14 bp, Homo sapiens
aggagcaggcttgt

SEQ ID NO: 3574946 - DNA, 19 bp, Homo sapiens
aggagcatccttggcagtg

SEQ ID NO: 3574947 - DNA, 15 bp, Homo sapiens
aggagccagcctgct

SEQ ID NO: 3574948 - DNA, 16 bp, Homo sapiens
aggagccagcctgctt

SEQ ID NO: 3574949 - DNA, 19 bp, Homo sapiens
aggagcctagcggagccca

SEQ ID NO: 3574950 - DNA, 11 bp, Homo sapiens
aggagcctctg

SEQ ID NO: 3574951 - DNA, 12 bp, Homo sapiens
aggagcctctgg

SEQ ID NO: 3574952 - DNA, 13 bp, Homo sapiens
aggagcctctggc

SEQ ID NO: 3574953 - DNA, 16 bp, Homo sapiens
aggagcctctggcttc

SEQ ID NO: 3574954 - DNA, 13 bp, Homo sapiens
aggagcctggcca

SEQ ID NO: 3574955 - DNA, 16 bp, Homo sapiens
aggagcctggccaggc

SEQ ID NO: 3574956 - DNA, 20 bp, Homo sapiens
aggagcctggccaggcaggg

SEQ ID NO: 3574957 - DNA, 21 bp, Homo sapiens
aggagcctgtgcgtcccagct

SEQ ID NO: 3574958 - DNA, 16 bp, Homo sapiens
aggagccttttgctct

SEQ ID NO: 3574959 - DNA, 15 bp, Homo sapiens
aggagcgcaggcagc

SEQ ID NO: 3574960 - DNA, 21 bp, Homo sapiens
aggagctgctatagcctgggg

SEQ ID NO: 3574961 - DNA, 21 bp, Homo sapiens
aggagctggggatccctcccc

SEQ ID NO: 3574962 - DNA, 15 bp, Homo sapiens
aggagcttctcccag

SEQ ID NO: 3574963 - DNA, 22 bp, Homo sapiens
aggagcttctcccagtgtgaga

SEQ ID NO: 3574964 - DNA, 13 bp, Homo sapiens
aggaggaaaagtc

SEQ ID NO: 3574965 - DNA, 18 bp, Homo sapiens
aggaggccaaccagcccg

SEQ ID NO: 3574966 - DNA, 19 bp, Homo sapiens
aggaggccaaccagcccga

SEQ ID NO: 3574967 - DNA, 16 bp, Homo sapiens
aggaggccccctcctc

SEQ ID NO: 3574968 - DNA, 21 bp, Homo sapiens
aggaggcctgggccgcccaga

SEQ ID NO: 3574969 - DNA, 15 bp, Homo sapiens
aggaggcctgtccca

SEQ ID NO: 3574970 - DNA, 17 bp, Homo sapiens
aggaggctgaggcagga

SEQ ID NO: 3574971 - DNA, 16 bp, Homo sapiens
aggaggggggagggaa

SEQ ID NO: 3574972 - DNA, 21 bp, Homo sapiens
aggaggggggagggaagggag

SEQ ID NO: 3574973 - DNA, 23 bp, Homo sapiens
aggaggggggagggaagggagcc

SEQ ID NO: 3574974 - DNA, 16 bp, Homo sapiens
aggagtctctgccagt

SEQ ID NO: 3574975 - DNA, 20 bp, Homo sapiens
aggagtctctgccagttact

SEQ ID NO: 3574976 - DNA, 21 bp, Homo sapiens
aggagtgacagatcacagggt

SEQ ID NO: 3574977 - DNA, 21 bp, Homo sapiens
aggagtgatcgtcagatgtgt

SEQ ID NO: 3574978 - DNA, 14 bp, Homo sapiens
aggagtgggctctg

SEQ ID NO: 3574979 - DNA, 15 bp, Homo sapiens
aggatacagaggaga

SEQ ID NO: 3574980 - DNA, 14 bp, Homo sapiens
aggatccagggcag

SEQ ID NO: 3574981 - DNA, 13 bp, Homo sapiens
aggatccagtgac

SEQ ID NO: 3574982 - DNA, 14 bp, Homo sapiens
aggatcctggaggc

SEQ ID NO: 3574983 - DNA, 20 bp, Homo sapiens
aggatctccactggaccctt

SEQ ID NO: 3574984 - DNA, 17 bp, Homo sapiens
aggatctctaaagagca

SEQ ID NO: 3574985 - DNA, 16 bp, Homo sapiens
aggatctgtgattggc

SEQ ID NO: 3574986 - DNA, 18 bp, Homo sapiens
aggatctgtgattggctg

SEQ ID NO: 3574987 - DNA, 19 bp, Homo sapiens
aggatctgtgattggctgg

SEQ ID NO: 3574988 - DNA, 20 bp, Homo sapiens
aggatctgtgattggctggt

SEQ ID NO: 3574989 - DNA, 15 bp, Homo sapiens
aggatctttgtggcc

SEQ ID NO: 3574990 - DNA, 17 bp, Homo sapiens
aggatctttgtggccaa

SEQ ID NO: 3574991 - DNA, 23 bp, Homo sapiens
aggatgacaaaattctttctggt

SEQ ID NO: 3574992 - DNA, 19 bp, Homo sapiens
aggatgctaacatctaaaa

SEQ ID NO: 3574993 - DNA, 22 bp, Homo sapiens
aggatgctaacatctaaaaata

SEQ ID NO: 3574994 - DNA, 23 bp, Homo sapiens
aggatggttttgggactagaggc

SEQ ID NO: 3574995 - DNA, 18 bp, Homo sapiens
aggattacagaaactgat

SEQ ID NO: 3574996 - DNA, 14 bp, Homo sapiens
aggattattggaaa

SEQ ID NO: 3574997 - DNA, 13 bp, Homo sapiens
aggattctctgca

SEQ ID NO: 3574998 - DNA, 22 bp, Homo sapiens
aggattctctgcagcccattcc

SEQ ID NO: 3574999 - DNA, 20 bp, Homo sapiens
aggattgttgaatctatttc

SEQ ID NO: 3575000 - DNA, 22 bp, Homo sapiens
aggcaaagataatttatttcaa

SEQ ID NO: 3575001 - DNA, 13 bp, Homo sapiens
aggcaaggccctg

SEQ ID NO: 3575002 - DNA, 18 bp, Homo sapiens
aggcaaggccctgccctg

SEQ ID NO: 3575003 - DNA, 19 bp, Homo sapiens
aggcaaggccctgccctgc

SEQ ID NO: 3575004 - DNA, 21 bp, Homo sapiens
aggcaattagacactttggaa

SEQ ID NO: 3575005 - DNA, 15 bp, Homo sapiens
agtgaaaactttgta

SEQ ID NO: 3575006 - DNA, 16 bp, Homo sapiens
agtgaaaactttgtag

SEQ ID NO: 3575007 - DNA, 19 bp, Homo sapiens
agtgaaataacaaaatgga

SEQ ID NO: 3575008 - DNA, 22 bp, Homo sapiens
agtgaatacattaacggtgcta

SEQ ID NO: 3575009 - DNA, 17 bp, Homo sapiens
agtgacaaagcaattta

SEQ ID NO: 3575010 - DNA, 14 bp, Homo sapiens
agtgacatgcagtt

SEQ ID NO: 3575011 - DNA, 17 bp, Homo sapiens
agtgacatgcagttata

SEQ ID NO: 3575012 - DNA, 20 bp, Homo sapiens
agtgactccccagcccagca

SEQ ID NO: 3575013 - DNA, 22 bp, Homo sapiens
agtgactccccagcccagcacc

SEQ ID NO: 3575014 - DNA, 15 bp, Homo sapiens
agtgactccctggga

SEQ ID NO: 3575015 - DNA, 17 bp, Homo sapiens
agtgactccctgggagc

SEQ ID NO: 3575016 - DNA, 21 bp, Homo sapiens
agtgactgatggctaatgtac

SEQ ID NO: 3575017 - DNA, 13 bp, Homo sapiens
agtgagacagact

SEQ ID NO: 3575018 - DNA, 18 bp, Homo sapiens
agtgagatgtagaaagtt

SEQ ID NO: 3575019 - DNA, 17 bp, Homo sapiens
agtgagcccctccccag

SEQ ID NO: 3575020 - DNA, 19 bp, Homo sapiens
agtgagcccctccccagcc

SEQ ID NO: 3575021 - DNA, 21 bp, Homo sapiens
agtgagcccctccccagccag

SEQ ID NO: 3575022 - DNA, 15 bp, Homo sapiens
agtgagtcacctgct

SEQ ID NO: 3575023 - DNA, 18 bp, Homo sapiens
agtgagtcacctgctcca

SEQ ID NO: 3575024 - DNA, 19 bp, Homo sapiens
agtgagtcacctgctccag

SEQ ID NO: 3575025 - DNA, 10 bp, Homo sapiens
agtgagttca

SEQ ID NO: 3575026 - DNA, 14 bp, Homo sapiens
agtgagttcaacta

SEQ ID NO: 3575027 - DNA, 14 bp, Homo sapiens
agtgatataaatca

SEQ ID NO: 3575028 - DNA, 13 bp, Homo sapiens
agtgatcttgaga

SEQ ID NO: 3575029 - DNA, 22 bp, Homo sapiens
agtgatgtttgccatttgctgg

SEQ ID NO: 3575030 - DNA, 15 bp, Homo sapiens
agtgattatttttcc

SEQ ID NO: 3575031 - DNA, 20 bp, Homo sapiens
agtgatttttggtcttctgt

SEQ ID NO: 3575032 - DNA, 15 bp, Homo sapiens
agtgcacaggagcca

SEQ ID NO: 3575033 - DNA, 23 bp, Homo sapiens
agtgcacatttggaattgacgga

SEQ ID NO: 3575034 - DNA, 13 bp, Homo sapiens
agtgcactgcatt

SEQ ID NO: 3575035 - DNA, 21 bp, Homo sapiens
agtgcactgcattcctgtgcc

SEQ ID NO: 3575036 - DNA, 19 bp, Homo sapiens
agtgcacttacacttataa

SEQ ID NO: 3575037 - DNA, 14 bp, Homo sapiens
agtgcagccactgg

SEQ ID NO: 3575038 - DNA, 17 bp, Homo sapiens
agtgcagctcatgtttt

SEQ ID NO: 3575039 - DNA, 22 bp, Homo sapiens
agtgcagtcagcagatgctgtt

SEQ ID NO: 3575040 - DNA, 12 bp, Homo sapiens
agtgcatcatta

SEQ ID NO: 3575041 - DNA, 14 bp, Homo sapiens
agtgcatcattact

SEQ ID NO: 3575042 - DNA, 16 bp, Homo sapiens
agtgccacttaatgta

SEQ ID NO: 3575043 - DNA, 17 bp, Homo sapiens
agtgccacttaatgtat

SEQ ID NO: 3575044 - DNA, 18 bp, Homo sapiens
agtgccacttaatgtatg

SEQ ID NO: 3575045 - DNA, 18 bp, Homo sapiens
agtgccaggatggaatga

SEQ ID NO: 3575046 - DNA, 14 bp, Homo sapiens
agtgcctcggacag

SEQ ID NO: 3575047 - DNA, 12 bp, Homo sapiens
agtgcctgagct

SEQ ID NO: 3575048 - DNA, 12 bp, Homo sapiens
agtgcctggagt

SEQ ID NO: 3575049 - DNA, 13 bp, Homo sapiens
agtgcctgggctc

SEQ ID NO: 3575050 - DNA, 19 bp, Homo sapiens
agtgcctgtgagcatgggg

SEQ ID NO: 3575051 - DNA, 23 bp, Homo sapiens
agtgcctgtgagcatggggccag

SEQ ID NO: 3575052 - DNA, 16 bp, Homo sapiens
agtgccttctaaaggt

SEQ ID NO: 3575053 - DNA, 14 bp, Homo sapiens
agtgctattgcaga

SEQ ID NO: 3575054 - DNA, 19 bp, Homo sapiens
agtgctcttcccactccag

SEQ ID NO: 3575055 - DNA, 23 bp, Homo sapiens
agtgctcttcccactccagctga

SEQ ID NO: 3575056 - DNA, 16 bp, Homo sapiens
agtgctcttggctgac

SEQ ID NO: 3575057 - DNA, 22 bp, Homo sapiens
agtgctcttggctgacccctct

SEQ ID NO: 3575058 - DNA, 19 bp, Homo sapiens
agtgctgaatttccctctc

SEQ ID NO: 3575059 - DNA, 13 bp, Homo sapiens
agtgctgctgtgg

SEQ ID NO: 3575060 - DNA, 16 bp, Homo sapiens
agtgctgctgtggagt

SEQ ID NO: 3575061 - DNA, 20 bp, Homo sapiens
agtgctgtttattaatctta

SEQ ID NO: 3575062 - DNA, 23 bp, Homo sapiens
agtgctttctttccgtcaccctg

SEQ ID NO: 3575063 - DNA, 14 bp, Homo sapiens
agtggaagcttcta

SEQ ID NO: 3575064 - DNA, 20 bp, Homo sapiens
agtggaagtatgtatattaa

SEQ ID NO: 3575065 - DNA, 17 bp, Homo sapiens
agtggaatagtatcctc

SEQ ID NO: 3575066 - DNA, 21 bp, Homo sapiens
agtggacgttaggccaggcct

SEQ ID NO: 3575067 - DNA, 14 bp, Homo sapiens
agtggagagagcag

SEQ ID NO: 3575068 - DNA, 17 bp, Homo sapiens
agtggagttttataaat

SEQ ID NO: 3575069 - DNA, 14 bp, Homo sapiens
agtggatcttcaga

SEQ ID NO: 3575070 - DNA, 21 bp, Homo sapiens
agtggatcttcagaactgccc

SEQ ID NO: 3575071 - DNA, 13 bp, Homo sapiens
agtggcagcagcc

SEQ ID NO: 3575072 - DNA, 14 bp, Homo sapiens
agtggcagcagccc

SEQ ID NO: 3575073 - DNA, 12 bp, Homo sapiens
agtggcctccct

SEQ ID NO: 3575074 - DNA, 14 bp, Homo sapiens
agtggcctccctgc

SEQ ID NO: 3575075 - DNA, 17 bp, Homo sapiens
agtggcctccctgctgt

SEQ ID NO: 3575076 - DNA, 17 bp, Homo sapiens
agtggccttccccagca

SEQ ID NO: 3575077 - DNA, 18 bp, Homo sapiens
agtggcgtggcctcccca

SEQ ID NO: 3575078 - DNA, 15 bp, Homo sapiens
agtggcgttgttgca

SEQ ID NO: 3575079 - DNA, 16 bp, Homo sapiens
agtggctcacacctgt

SEQ ID NO: 3575080 - DNA, 21 bp, Homo sapiens
agtggctcctcccggtgccca

SEQ ID NO: 3575081 - DNA, 15 bp, Homo sapiens
agtggctgccttctt

SEQ ID NO: 3575082 - DNA, 16 bp, Homo sapiens
agtggctggggtggag

SEQ ID NO: 3575083 - DNA, 16 bp, Homo sapiens
agtggctgtccctgtg

SEQ ID NO: 3575084 - DNA, 15 bp, Homo sapiens
agtggcttctttcca

SEQ ID NO: 3575085 - DNA, 10 bp, Homo sapiens
agtgggaagg

SEQ ID NO: 3575086 - DNA, 16 bp, Homo sapiens
agtgggaagggagcat

SEQ ID NO: 3575087 - DNA, 21 bp, Homo sapiens
agtgggccccgggctggagaa

SEQ ID NO: 3575088 - DNA, 22 bp, Homo sapiens
agtgggccccgggctggagaaa

SEQ ID NO: 3575089 - DNA, 12 bp, Homo sapiens
agtgggcgcagt

SEQ ID NO: 3575090 - DNA, 21 bp, Homo sapiens
agtggggatgaggtcaccagg

SEQ ID NO: 3575091 - DNA, 13 bp, Homo sapiens
agtggggctggca

SEQ ID NO: 3575092 - DNA, 16 bp, Homo sapiens
agtggggtaggttggg

SEQ ID NO: 3575093 - DNA, 13 bp, Homo sapiens
agtggtctcccca

SEQ ID NO: 3575094 - DNA, 13 bp, Homo sapiens
agtggtgggtaat

SEQ ID NO: 3575095 - DNA, 20 bp, Homo sapiens
agtggtgggtaattgtacaa

SEQ ID NO: 3575096 - DNA, 19 bp, Homo sapiens
agtggtggtaaccctggtg

SEQ ID NO: 3575097 - DNA, 19 bp, Homo sapiens
agtggtgtgactcttactc

SEQ ID NO: 3575098 - DNA, 14 bp, Homo sapiens
agtggttgcctggg

SEQ ID NO: 3575099 - DNA, 15 bp, Homo sapiens
agtggttgcctgggg

SEQ ID NO: 3575100 - DNA, 15 bp, Homo sapiens
agtgtaaaatgtata

SEQ ID NO: 3575101 - DNA, 13 bp, Homo sapiens
agtgtaataagac

SEQ ID NO: 3575102 - DNA, 22 bp, Homo sapiens
agtgtacccatctttaatttat

SEQ ID NO: 3575103 - DNA, 12 bp, Homo sapiens
agtgtagcctaa

SEQ ID NO: 3575104 - DNA, 19 bp, Homo sapiens
agtgtagcctaaagggcag

SEQ ID NO: 3575105 - DNA, 14 bp, Homo sapiens
agtgtatgattact

SEQ ID NO: 3575106 - DNA, 14 bp, Homo sapiens
agtgtcagggtcca

SEQ ID NO: 3575107 - DNA, 12 bp, Homo sapiens
agtgtcctgccc

SEQ ID NO: 3575108 - DNA, 15 bp, Homo sapiens
agtgtcctgcccatg

SEQ ID NO: 3575109 - DNA, 13 bp, Homo sapiens
agtgtcctttcca

SEQ ID NO: 3575110 - DNA, 21 bp, Homo sapiens
agtgtcttaattaaaagaata

SEQ ID NO: 3575111 - DNA, 13 bp, Homo sapiens
agtgtgactcctt

SEQ ID NO: 3575112 - DNA, 21 bp, Homo sapiens
agtgtgactccttatctcttt

SEQ ID NO: 3575113 - DNA, 15 bp, Homo sapiens
agtgtgagctcttcc

SEQ ID NO: 3575114 - DNA, 19 bp, Homo sapiens
agtgtgagctcttccctta

SEQ ID NO: 3575115 - DNA, 17 bp, Homo sapiens
agtgtgcactaaggggc

SEQ ID NO: 3575116 - DNA, 22 bp, Homo sapiens
agtgtgcactaaggggcccggc

SEQ ID NO: 3575117 - DNA, 15 bp, Homo sapiens
agtgtgctgggcaga

SEQ ID NO: 3575118 - DNA, 19 bp, Homo sapiens
agtgtgggtctgtgtgtgt

SEQ ID NO: 3575119 - DNA, 23 bp, Homo sapiens
agtgtggtgtttcctgcaggcca

SEQ ID NO: 3575120 - DNA, 9 bp, Homo sapiens
agtgtgtaa

SEQ ID NO: 3575121 - DNA, 18 bp, Homo sapiens
agtgtgtcagtttttcct

SEQ ID NO: 3575122 - DNA, 13 bp, Homo sapiens
agtgtgtgccaag

SEQ ID NO: 3575123 - DNA, 19 bp, Homo sapiens
agtgtgtggtcaacatttc

SEQ ID NO: 3575124 - DNA, 21 bp, Homo sapiens
agtgtgtggtcaacatttctc

SEQ ID NO: 3575125 - DNA, 22 bp, Homo sapiens
agtgtgtggtcaacatttctca

SEQ ID NO: 3575126 - DNA, 23 bp, Homo sapiens
agtgtgtggtctctgccccagcc

SEQ ID NO: 3575127 - DNA, 17 bp, Homo sapiens
agtgttatttatttctt

SEQ ID NO: 3575128 - DNA, 18 bp, Homo sapiens
agtgttcctgaagctgct

SEQ ID NO: 3575129 - DNA, 15 bp, Homo sapiens
agtgttctgctcctg

SEQ ID NO: 3575130 - DNA, 22 bp, Homo sapiens
agtgttctgctcctgcttttct

SEQ ID NO: 3575131 - DNA, 19 bp, Homo sapiens
agtgttctgtttgaaacta

SEQ ID NO: 3575132 - DNA, 17 bp, Homo sapiens
agtgttgaaaatgttca

SEQ ID NO: 3575133 - DNA, 14 bp, Homo sapiens
agtgttgctgtggc

SEQ ID NO: 3575134 - DNA, 16 bp, Homo sapiens
agtgttgtatttctat

SEQ ID NO: 3575135 - DNA, 17 bp, Homo sapiens
agtgtttccctctgtgt

SEQ ID NO: 3575136 - DNA, 16 bp, Homo sapiens
agtgtttggacagctg

SEQ ID NO: 3575137 - DNA, 22 bp, Homo sapiens
agtgttttattattatcgcttt

SEQ ID NO: 3575138 - DNA, 15 bp, Homo sapiens
ataggtgctacaaaa

SEQ ID NO: 3575139 - DNA, 21 bp, Homo sapiens
ataggtgctacaaaaacacag

SEQ ID NO: 3575140 - DNA, 23 bp, Homo sapiens
ataggtgctacaaaaacacagca

SEQ ID NO: 3575141 - DNA, 19 bp, Homo sapiens
atagtaagacccccatctc

SEQ ID NO: 3575142 - DNA, 15 bp, Homo sapiens
atagtagatttgaac

SEQ ID NO: 3575143 - DNA, 21 bp, Homo sapiens
atagtcaagacgaacatgtag

SEQ ID NO: 3575144 - DNA, 20 bp, Homo sapiens
atagtctagatggctcctct

SEQ ID NO: 3575145 - DNA, 13 bp, Homo sapiens
atagtgacatgca

SEQ ID NO: 3575146 - DNA, 17 bp, Homo sapiens
atagtgttctgctcctg

SEQ ID NO: 3575147 - DNA, 20 bp, Homo sapiens
atagtgttctgctcctgctt

SEQ ID NO: 3575148 - DNA, 23 bp, Homo sapiens
atagtgttctgctcctgcttttc

SEQ ID NO: 3575149 - DNA, 14 bp, Homo sapiens
atagttactgtgta

SEQ ID NO: 3575150 - DNA, 21 bp, Homo sapiens
atagttgccaatctaaaatgg

SEQ ID NO: 3575151 - DNA, 17 bp, Homo sapiens
atagttttttcttttta

SEQ ID NO: 3575152 - DNA, 20 bp, Homo sapiens
atataaaatgtattcaagca

SEQ ID NO: 3575153 - DNA, 17 bp, Homo sapiens
atataaattattacttt

SEQ ID NO: 3575154 - DNA, 16 bp, Homo sapiens
atataagactattcca

SEQ ID NO: 3575155 - DNA, 14 bp, Homo sapiens
atataagtgtacat

SEQ ID NO: 3575156 - DNA, 19 bp, Homo sapiens
atataatgaataaatcatt

SEQ ID NO: 3575157 - DNA, 17 bp, Homo sapiens
atatactgctatttaca

SEQ ID NO: 3575158 - DNA, 19 bp, Homo sapiens
atatactgctatttacact

SEQ ID NO: 3575159 - DNA, 19 bp, Homo sapiens
atatagaccaattgaagca

SEQ ID NO: 3575160 - DNA, 23 bp, Homo sapiens
atatagatcagttataagtagca

SEQ ID NO: 3575161 - DNA, 22 bp, Homo sapiens
atataggctattttctaaagac

SEQ ID NO: 3575162 - DNA, 17 bp, Homo sapiens
atatataaagtcagtga

SEQ ID NO: 3575163 - DNA, 16 bp, Homo sapiens
atatataagtgtacat

SEQ ID NO: 3575164 - DNA, 18 bp, Homo sapiens
atatatatgcacacatat

SEQ ID NO: 3575165 - DNA, 15 bp, Homo sapiens
atatatcatgagtga

SEQ ID NO: 3575166 - DNA, 24 bp, Homo sapiens
atatatctaccccagactagatgt

SEQ ID NO: 3575167 - DNA, 20 bp, Homo sapiens
atatatctgttggagaaaga

SEQ ID NO: 3575168 - DNA, 15 bp, Homo sapiens
atatatgcacacata

SEQ ID NO: 3575169 - DNA, 19 bp, Homo sapiens
atatatggaaggttcctgt

SEQ ID NO: 3575170 - DNA, 20 bp, Homo sapiens
atatatggaaggttcctgtg

SEQ ID NO: 3575171 - DNA, 14 bp, Homo sapiens
atatattgaattaa

SEQ ID NO: 3575172 - DNA, 18 bp, Homo sapiens
atatatttaaaatatatt

SEQ ID NO: 3575173 - DNA, 20 bp, Homo sapiens
atatatttaagcaacatctt

SEQ ID NO: 3575174 - DNA, 23 bp, Homo sapiens
atatatttatggccgggcagggt

SEQ ID NO: 3575175 - DNA, 13 bp, Homo sapiens
atatatttgtcac

SEQ ID NO: 3575176 - DNA, 18 bp, Homo sapiens
atatattttatttttaga

SEQ ID NO: 3575177 - DNA, 22 bp, Homo sapiens
atatcaccaaaaacctattcca

SEQ ID NO: 3575178 - DNA, 15 bp, Homo sapiens
atatcaggtgtataa

SEQ ID NO: 3575179 - DNA, 20 bp, Homo sapiens
atatcaggtgtataaatgta

SEQ ID NO: 3575180 - DNA, 18 bp, Homo sapiens
atatcatgtaaagaaatg

SEQ ID NO: 3575181 - DNA, 21 bp, Homo sapiens
atatcatgtaaagaaatgtct

SEQ ID NO: 3575182 - DNA, 22 bp, Homo sapiens
atatcatgtaaagaaatgtctt

SEQ ID NO: 3575183 - DNA, 20 bp, Homo sapiens
atatccacccagcaggcaga

SEQ ID NO: 3575184 - DNA, 20 bp, Homo sapiens
atatccttaaccattctgtc

SEQ ID NO: 3575185 - DNA, 23 bp, Homo sapiens
atatctaccccagactagatgta

SEQ ID NO: 3575186 - DNA, 13 bp, Homo sapiens
atatctagtgaca

SEQ ID NO: 3575187 - DNA, 15 bp, Homo sapiens
atatgagtacaaatg

SEQ ID NO: 3575188 - DNA, 13 bp, Homo sapiens
atatgatctgttt

SEQ ID NO: 3575189 - DNA, 14 bp, Homo sapiens
atatgatctgtttt

SEQ ID NO: 3575190 - DNA, 13 bp, Homo sapiens
atatgattgtttc

SEQ ID NO: 3575191 - DNA, 22 bp, Homo sapiens
atatgattgtttctcaaatctt

SEQ ID NO: 3575192 - DNA, 14 bp, Homo sapiens
atatgcaagcagct

SEQ ID NO: 3575193 - DNA, 16 bp, Homo sapiens
atatgcaagcagcttt

SEQ ID NO: 3575194 - DNA, 19 bp, Homo sapiens
atatgcacaaaactacttt

SEQ ID NO: 3575195 - DNA, 15 bp, Homo sapiens
atatgcatgtagcat

SEQ ID NO: 3575196 - DNA, 17 bp, Homo sapiens
atatgcatgtagcatat

SEQ ID NO: 3575197 - DNA, 21 bp, Homo sapiens
atatgcatgtagcatataaat

SEQ ID NO: 3575198 - DNA, 21 bp, Homo sapiens
atatgccctcaagtaaaagaa

SEQ ID NO: 3575199 - DNA, 14 bp, Homo sapiens
atatgcttatacac

SEQ ID NO: 3575200 - DNA, 16 bp, Homo sapiens
atatgcttatacactt

SEQ ID NO: 3575201 - DNA, 19 bp, Homo sapiens
atatgcttgtaactaaaat

SEQ ID NO: 3575202 - DNA, 17 bp, Homo sapiens
atatggatttgttacag

SEQ ID NO: 3575203 - DNA, 14 bp, Homo sapiens
atatggcaggactc

SEQ ID NO: 3575204 - DNA, 11 bp, Homo sapiens
atatggctgcc

SEQ ID NO: 3575205 - DNA, 15 bp, Homo sapiens
atatggctgcccagg

SEQ ID NO: 3575206 - DNA, 20 bp, Homo sapiens
atatgggtgggattttgcaa

SEQ ID NO: 3575207 - DNA, 13 bp, Homo sapiens
atatggtaggacc

SEQ ID NO: 3575208 - DNA, 15 bp, Homo sapiens
atatggtaggaccct

SEQ ID NO: 3575209 - DNA, 13 bp, Homo sapiens
atatgtacagttt

SEQ ID NO: 3575210 - DNA, 22 bp, Homo sapiens
atatgtacagtttattgatatt

SEQ ID NO: 3575211 - DNA, 14 bp, Homo sapiens
atatgttaaagttt

SEQ ID NO: 3575212 - DNA, 15 bp, Homo sapiens
atatgttaaagttta

SEQ ID NO: 3575213 - DNA, 19 bp, Homo sapiens
atattaacatattatttca

SEQ ID NO: 3575214 - DNA, 12 bp, Homo sapiens
atattacaatga

SEQ ID NO: 3575215 - DNA, 15 bp, Homo sapiens
atattacaatgatca

SEQ ID NO: 3575216 - DNA, 23 bp, Homo sapiens
atattataaaggataaagaagga

SEQ ID NO: 3575217 - DNA, 17 bp, Homo sapiens
atattataattggaagt

SEQ ID NO: 3575218 - DNA, 16 bp, Homo sapiens
atattcagatgtatgt

SEQ ID NO: 3575219 - DNA, 17 bp, Homo sapiens
atattcattctttataa

SEQ ID NO: 3575220 - DNA, 16 bp, Homo sapiens
atattctattttacaa

SEQ ID NO: 3575221 - DNA, 15 bp, Homo sapiens
atattgacttgtata

SEQ ID NO: 3575222 - DNA, 16 bp, Homo sapiens
atattgacttgtatat

SEQ ID NO: 3575223 - DNA, 18 bp, Homo sapiens
atattgatattgaaggaa

SEQ ID NO: 3575224 - DNA, 17 bp, Homo sapiens
atattgccattatgctt

SEQ ID NO: 3575225 - DNA, 18 bp, Homo sapiens
atattgccctaattaaaa

SEQ ID NO: 3575226 - DNA, 22 bp, Homo sapiens
atattgccctaattaaaaactg

SEQ ID NO: 3575227 - DNA, 19 bp, Homo sapiens
atattgtttttgtatttat

SEQ ID NO: 3575228 - DNA, 18 bp, Homo sapiens
atatttaagcaacatctt

SEQ ID NO: 3575229 - DNA, 20 bp, Homo sapiens
atatttagatgtaattttgt

SEQ ID NO: 3575230 - DNA, 17 bp, Homo sapiens
atatttattgatgtttt

SEQ ID NO: 3575231 - DNA, 16 bp, Homo sapiens
atatttattgttagaa

SEQ ID NO: 3575232 - DNA, 19 bp, Homo sapiens
atatttattgttagaaaat

SEQ ID NO: 3575233 - DNA, 22 bp, Homo sapiens
atatttattttcttttgaattg

SEQ ID NO: 3575234 - DNA, 23 bp, Homo sapiens
atatttgaaaaaaacttcattct

SEQ ID NO: 3575235 - DNA, 19 bp, Homo sapiens
atatttgacttgaaaagaa

SEQ ID NO: 3575236 - DNA, 23 bp, Homo sapiens
atatttgcattgaggaaatatta

SEQ ID NO: 3575237 - DNA, 22 bp, Homo sapiens
atatttgtatcacaaatcttaa

SEQ ID NO: 3575238 - DNA, 14 bp, Homo sapiens
atattttaaacaga

SEQ ID NO: 3575239 - DNA, 14 bp, Homo sapiens
atattttatgtgta

SEQ ID NO: 3575240 - DNA, 15 bp, Homo sapiens
atattttatgtgtaa

SEQ ID NO: 3575241 - DNA, 15 bp, Homo sapiens
atattttgagaaact

SEQ ID NO: 3575242 - DNA, 16 bp, Homo sapiens
atattttgagaaactg

SEQ ID NO: 3575243 - DNA, 18 bp, Homo sapiens
atattttgagaaactgct

SEQ ID NO: 3575244 - DNA, 14 bp, Homo sapiens
atattttgctaact

SEQ ID NO: 3575245 - DNA, 15 bp, Homo sapiens
atattttgctaactg

SEQ ID NO: 3575246 - DNA, 17 bp, Homo sapiens
atattttgctaactggt

SEQ ID NO: 3575247 - DNA, 19 bp, Homo sapiens
atatttttaaaaaatgaaa

SEQ ID NO: 3575248 - DNA, 14 bp, Homo sapiens
atatttttatattg

SEQ ID NO: 3575249 - DNA, 14 bp, Homo sapiens
atatttttgtattt

SEQ ID NO: 3575250 - DNA, 15 bp, Homo sapiens
atatttttgtctgca

SEQ ID NO: 3575251 - DNA, 18 bp, Homo sapiens
atatttttgtctgcagct

SEQ ID NO: 3575252 - DNA, 20 bp, Homo sapiens
atatttttgtctgcagctgt

SEQ ID NO: 3575253 - DNA, 17 bp, Homo sapiens
atcaaaactttcgttgt

SEQ ID NO: 3575254 - DNA, 22 bp, Homo sapiens
atcaaagtcattaaagacagga

SEQ ID NO: 3575255 - DNA, 14 bp, Homo sapiens
atcaaataaatttc

SEQ ID NO: 3575256 - DNA, 18 bp, Homo sapiens
atcaaatatattatttag

SEQ ID NO: 3575257 - DNA, 16 bp, Homo sapiens
atcaaatatgcaaagc

SEQ ID NO: 3575258 - DNA, 17 bp, Homo sapiens
atcaaatatgcaaagca

SEQ ID NO: 3575259 - DNA, 20 bp, Homo sapiens
atcaaatatgcaaagcactg

SEQ ID NO: 3575260 - DNA, 21 bp, Homo sapiens
atcaactcccaacttcttcct

SEQ ID NO: 3575261 - DNA, 12 bp, Homo sapiens
atcaagagaaac

SEQ ID NO: 3575262 - DNA, 15 bp, Homo sapiens
atcaagagaaacttc

SEQ ID NO: 3575263 - DNA, 16 bp, Homo sapiens
atcaagagaaacttca

SEQ ID NO: 3575264 - DNA, 17 bp, Homo sapiens
atcaagatttttttcct

SEQ ID NO: 3575265 - DNA, 18 bp, Homo sapiens
atcaagggagacaccagt

SEQ ID NO: 3575266 - DNA, 17 bp, Homo sapiens
atcaattttaccctgag

SEQ ID NO: 3575267 - DNA, 14 bp, Homo sapiens
atcaatttttctta

SEQ ID NO: 3575268 - DNA, 19 bp, Homo sapiens
atcaatttttcttatttca

SEQ ID NO: 3575269 - DNA, 15 bp, Homo sapiens
atcacacccatttaa

SEQ ID NO: 3575270 - DNA, 16 bp, Homo sapiens
atgggaatcaggcatg

SEQ ID NO: 3575271 - DNA, 15 bp, Homo sapiens
atgggagccgggcaa

SEQ ID NO: 3575272 - DNA, 19 bp, Homo sapiens
atgggcccttggaaaaaca

SEQ ID NO: 3575273 - DNA, 22 bp, Homo sapiens
atgggcggaagtacttccctca

SEQ ID NO: 3575274 - DNA, 14 bp, Homo sapiens
atgggctgtgtcct

SEQ ID NO: 3575275 - DNA, 17 bp, Homo sapiens
atgggctgtgtcctaag

SEQ ID NO: 3575276 - DNA, 17 bp, Homo sapiens
atggggaggacaaaatg

SEQ ID NO: 3575277 - DNA, 19 bp, Homo sapiens
atggggaggttgtggggcc

SEQ ID NO: 3575278 - DNA, 21 bp, Homo sapiens
atggggcaagacagaaaagtg

SEQ ID NO: 3575279 - DNA, 21 bp, Homo sapiens
atggggccagatccagcctgg

SEQ ID NO: 3575280 - DNA, 22 bp, Homo sapiens
atggggccagatccagcctggg

SEQ ID NO: 3575281 - DNA, 19 bp, Homo sapiens
atgggggaactcagatcca

SEQ ID NO: 3575282 - DNA, 17 bp, Homo sapiens
atgggggcactgaggac

SEQ ID NO: 3575283 - DNA, 18 bp, Homo sapiens
atgggggcaggaaagcca

SEQ ID NO: 3575284 - DNA, 17 bp, Homo sapiens
atggggtcctggccatc

SEQ ID NO: 3575285 - DNA, 14 bp, Homo sapiens
atggtaattgttgc

SEQ ID NO: 3575286 - DNA, 17 bp, Homo sapiens
atggtactcccaaactg

SEQ ID NO: 3575287 - DNA, 20 bp, Homo sapiens
atggtactcccaaactgaca

SEQ ID NO: 3575288 - DNA, 22 bp, Homo sapiens
atggtactcccaaactgacaat

SEQ ID NO: 3575289 - DNA, 23 bp, Homo sapiens
atggtaggaccctcgagagcctt

SEQ ID NO: 3575290 - DNA, 22 bp, Homo sapiens
atggtcggatctcacaggctga

SEQ ID NO: 3575291 - DNA, 15 bp, Homo sapiens
atggtgccccaggac

SEQ ID NO: 3575292 - DNA, 21 bp, Homo sapiens
atggtgccccaggaccagctc

SEQ ID NO: 3575293 - DNA, 14 bp, Homo sapiens
atggtggccctgaa

SEQ ID NO: 3575294 - DNA, 17 bp, Homo sapiens
atggtggctcatgcctg

SEQ ID NO: 3575295 - DNA, 16 bp, Homo sapiens
atggtggggtctcctc

SEQ ID NO: 3575296 - DNA, 13 bp, Homo sapiens
atggttcaagtat

SEQ ID NO: 3575297 - DNA, 17 bp, Homo sapiens
atggttgatgatacttc

SEQ ID NO: 3575298 - DNA, 19 bp, Homo sapiens
atggttgatggaaaataaa

SEQ ID NO: 3575299 - DNA, 15 bp, Homo sapiens
atggtttgtcctgat

SEQ ID NO: 3575300 - DNA, 19 bp, Homo sapiens
atgtaaaaaagaaaaacac

SEQ ID NO: 3575301 - DNA, 21 bp, Homo sapiens
atgtaaaaggtattaaattga

SEQ ID NO: 3575302 - DNA, 13 bp, Homo sapiens
atgtaaaatgatt

SEQ ID NO: 3575303 - DNA, 22 bp, Homo sapiens
atgtaaactgtttctttaaaat

SEQ ID NO: 3575304 - DNA, 14 bp, Homo sapiens
atgtaacttttgta

SEQ ID NO: 3575305 - DNA, 17 bp, Homo sapiens
atgtaacttttgtaaga

SEQ ID NO: 3575306 - DNA, 16 bp, Homo sapiens
atgtaagggaaactgc

SEQ ID NO: 3575307 - DNA, 21 bp, Homo sapiens
atgtaagggaaactgccagca

SEQ ID NO: 3575308 - DNA, 20 bp, Homo sapiens
atgtaatgtttttatttcaa

SEQ ID NO: 3575309 - DNA, 22 bp, Homo sapiens
atgtaatgtttttatttcaatt

SEQ ID NO: 3575310 - DNA, 13 bp, Homo sapiens
atgtacataactc

SEQ ID NO: 3575311 - DNA, 14 bp, Homo sapiens
atgtacataactcc

SEQ ID NO: 3575312 - DNA, 12 bp, Homo sapiens
atgtacatttaa

SEQ ID NO: 3575313 - DNA, 16 bp, Homo sapiens
atgtacatttaataat

SEQ ID NO: 3575314 - DNA, 17 bp, Homo sapiens
atgtacatttaataata

SEQ ID NO: 3575315 - DNA, 19 bp, Homo sapiens
atgtaccatatgatctgtt

SEQ ID NO: 3575316 - DNA, 16 bp, Homo sapiens
atgtaccgtaggcttt

SEQ ID NO: 3575317 - DNA, 23 bp, Homo sapiens
atgtacttgtttgaatatttgtt

SEQ ID NO: 3575318 - DNA, 12 bp, Homo sapiens
atgtagaaactg

SEQ ID NO: 3575319 - DNA, 21 bp, Homo sapiens
atgtagaaactgaggcccaga

SEQ ID NO: 3575320 - DNA, 15 bp, Homo sapiens
atgtagcatataaat

SEQ ID NO: 3575321 - DNA, 14 bp, Homo sapiens
atgtagccagctgt

SEQ ID NO: 3575322 - DNA, 16 bp, Homo sapiens
atgtagccagctgtgc

SEQ ID NO: 3575323 - DNA, 23 bp, Homo sapiens
atgtataaatgtaaaaatgaagg

SEQ ID NO: 3575324 - DNA, 14 bp, Homo sapiens
atgtataaatgtga

SEQ ID NO: 3575325 - DNA, 16 bp, Homo sapiens
atgtataaatgtgata

SEQ ID NO: 3575326 - DNA, 14 bp, Homo sapiens
atgtataaattttt

SEQ ID NO: 3575327 - DNA, 12 bp, Homo sapiens
atgtataatgta

SEQ ID NO: 3575328 - DNA, 14 bp, Homo sapiens
atgtatataaactg

SEQ ID NO: 3575329 - DNA, 21 bp, Homo sapiens
atgtatgtgtgtctattttgt

SEQ ID NO: 3575330 - DNA, 12 bp, Homo sapiens
atgtatgttacc

SEQ ID NO: 3575331 - DNA, 14 bp, Homo sapiens
atgtatgttaccaa

SEQ ID NO: 3575332 - DNA, 20 bp, Homo sapiens
atgtattcaagcaaacatca

SEQ ID NO: 3575333 - DNA, 21 bp, Homo sapiens
atgtattcaagcaaacatcaa

SEQ ID NO: 3575334 - DNA, 21 bp, Homo sapiens
atgtatttaagatgtacattt

SEQ ID NO: 3575335 - DNA, 23 bp, Homo sapiens
atgtatttgaaaattacatgttt

SEQ ID NO: 3575336 - DNA, 19 bp, Homo sapiens
atgtattttattattttct

SEQ ID NO: 3575337 - DNA, 13 bp, Homo sapiens
atgtattttccaa

SEQ ID NO: 3575338 - DNA, 20 bp, Homo sapiens
atgtattttccaagtaaaat

SEQ ID NO: 3575339 - DNA, 14 bp, Homo sapiens
atgtcaaatgtgaa

SEQ ID NO: 3575340 - DNA, 14 bp, Homo sapiens
atgtcactagaatg

SEQ ID NO: 3575341 - DNA, 16 bp, Homo sapiens
atgtcactagaatgga

SEQ ID NO: 3575342 - DNA, 10 bp, Homo sapiens
atgtcacttt

SEQ ID NO: 3575343 - DNA, 21 bp, Homo sapiens
atgtcactttttgaggcaaaa

SEQ ID NO: 3575344 - DNA, 16 bp, Homo sapiens
atgtcagccactgtga

SEQ ID NO: 3575345 - DNA, 17 bp, Homo sapiens
atgtcagccactgtgat

SEQ ID NO: 3575346 - DNA, 13 bp, Homo sapiens
atgtcagtatttc

SEQ ID NO: 3575347 - DNA, 16 bp, Homo sapiens
atgtcagtatttcaac

SEQ ID NO: 3575348 - DNA, 16 bp, Homo sapiens
atgtccacttaaaata

SEQ ID NO: 3575349 - DNA, 17 bp, Homo sapiens
atgtccagtgagcagtg

SEQ ID NO: 3575350 - DNA, 24 bp, Homo sapiens
atgtccctaccgagtctcttctcc

SEQ ID NO: 3575351 - DNA, 16 bp, Homo sapiens
atgtcctgcctattat

SEQ ID NO: 3575352 - DNA, 21 bp, Homo sapiens
atgtcctgcctattatctgtc

SEQ ID NO: 3575353 - DNA, 13 bp, Homo sapiens
atgtcctgccttt

SEQ ID NO: 3575354 - DNA, 19 bp, Homo sapiens
atgtctgcactgaggattt

SEQ ID NO: 3575355 - DNA, 20 bp, Homo sapiens
atgtctgctgagttggcctg

SEQ ID NO: 3575356 - DNA, 19 bp, Homo sapiens
atgtctggtgtttgtcatg

SEQ ID NO: 3575357 - DNA, 13 bp, Homo sapiens
atgtcttgtcata

SEQ ID NO: 3575358 - DNA, 17 bp, Homo sapiens
atgtcttgtcatacaaa

SEQ ID NO: 3575359 - DNA, 13 bp, Homo sapiens
atgtgaaatgctt

SEQ ID NO: 3575360 - DNA, 18 bp, Homo sapiens
atgtgaaatgcttttata

SEQ ID NO: 3575361 - DNA, 23 bp, Homo sapiens
atgtgaagaggtctgattggctg

SEQ ID NO: 3575362 - DNA, 19 bp, Homo sapiens
atgtgaagttcatcttgca

SEQ ID NO: 3575363 - DNA, 18 bp, Homo sapiens
atgtgactcagcatcacc

SEQ ID NO: 3575364 - DNA, 14 bp, Homo sapiens
atgtgagaagccag

SEQ ID NO: 3575365 - DNA, 15 bp, Homo sapiens
atgtgagaagccagc

SEQ ID NO: 3575366 - DNA, 21 bp, Homo sapiens
atgtgagctgtaaaaatgtta

SEQ ID NO: 3575367 - DNA, 17 bp, Homo sapiens
atgtgagtcattatgta

SEQ ID NO: 3575368 - DNA, 20 bp, Homo sapiens
atgtgagtcattatgtagct

SEQ ID NO: 3575369 - DNA, 14 bp, Homo sapiens
atgtgagtctggga

SEQ ID NO: 3575370 - DNA, 16 bp, Homo sapiens
atgtgcagtttggaat

SEQ ID NO: 3575371 - DNA, 11 bp, Homo sapiens
atgtgcctttc

SEQ ID NO: 3575372 - DNA, 14 bp, Homo sapiens
atgtgcctttcttt

SEQ ID NO: 3575373 - DNA, 19 bp, Homo sapiens
atgtgcctttctttgcctc

SEQ ID NO: 3575374 - DNA, 20 bp, Homo sapiens
atgtgcctttctttgcctct

SEQ ID NO: 3575375 - DNA, 22 bp, Homo sapiens
atgtgcctttctttgcctctgc

SEQ ID NO: 3575376 - DNA, 20 bp, Homo sapiens
atgtgctgtgtgagtgagca

SEQ ID NO: 3575377 - DNA, 22 bp, Homo sapiens
atgtggaaggaaaatatttcat

SEQ ID NO: 3575378 - DNA, 13 bp, Homo sapiens
atgtggaagtgtg

SEQ ID NO: 3575379 - DNA, 22 bp, Homo sapiens
atgtggaagtgtgggtctgtgt

SEQ ID NO: 3575380 - DNA, 22 bp, Homo sapiens
atgtggctgtaatgacaaaaga

SEQ ID NO: 3575381 - DNA, 15 bp, Homo sapiens
atgtgtagagcccct

SEQ ID NO: 3575382 - DNA, 13 bp, Homo sapiens
atgtgtcccttcc

SEQ ID NO: 3575383 - DNA, 17 bp, Homo sapiens
atgtgtctcccagaact

SEQ ID NO: 3575384 - DNA, 15 bp, Homo sapiens
atgtgtgtctatttt

SEQ ID NO: 3575385 - DNA, 10 bp, Homo sapiens
atgtgtgtgt

SEQ ID NO: 3575386 - DNA, 15 bp, Homo sapiens
atgtgtttactttaa

SEQ ID NO: 3575387 - DNA, 21 bp, Homo sapiens
atgtgtttccttttcaggaga

SEQ ID NO: 3575388 - DNA, 20 bp, Homo sapiens
atgtgtttgagcatcactta

SEQ ID NO: 3575389 - DNA, 12 bp, Homo sapiens
atgttaaaacat

SEQ ID NO: 3575390 - DNA, 14 bp, Homo sapiens
atgttaaagtttaa

SEQ ID NO: 3575391 - DNA, 15 bp, Homo sapiens
atgttaaagtttaag

SEQ ID NO: 3575392 - DNA, 20 bp, Homo sapiens
atgttaatattttatgtgta

SEQ ID NO: 3575393 - DNA, 21 bp, Homo sapiens
atgttatatgttgttcttaca

SEQ ID NO: 3575394 - DNA, 14 bp, Homo sapiens
atgttatgcagtga

SEQ ID NO: 3575395 - DNA, 13 bp, Homo sapiens
atgttcctttttt

SEQ ID NO: 3575396 - DNA, 22 bp, Homo sapiens
atgttccttttttcaatatgca

SEQ ID NO: 3575397 - DNA, 20 bp, Homo sapiens
atgttcttatgcaaaatgga

SEQ ID NO: 3575398 - DNA, 15 bp, Homo sapiens
atgttctttgtacct

SEQ ID NO: 3575399 - DNA, 16 bp, Homo sapiens
atgttgctatagtgac

SEQ ID NO: 3575400 - DNA, 19 bp, Homo sapiens
atgttgctatagtgacatg

SEQ ID NO: 3575401 - DNA, 16 bp, Homo sapiens
atgttggagcagcagg

SEQ ID NO: 3575402 - DNA, 17 bp, Homo sapiens
atgttggagcagcaggc

SEQ ID NO: 3575403 - DNA, 14 bp, Homo sapiens
attttgtaactgta

SEQ ID NO: 3575404 - DNA, 19 bp, Homo sapiens
attttgtaactgtaaagat

SEQ ID NO: 3575405 - DNA, 22 bp, Homo sapiens
attttgtaactgtaaagatgaa

SEQ ID NO: 3575406 - DNA, 10 bp, Homo sapiens
attttgtaat

SEQ ID NO: 3575407 - DNA, 14 bp, Homo sapiens
attttgtaataaac

SEQ ID NO: 3575408 - DNA, 19 bp, Homo sapiens
attttgtaataaactctct

SEQ ID NO: 3575409 - DNA, 14 bp, Homo sapiens
attttgtaataata

SEQ ID NO: 3575410 - DNA, 14 bp, Homo sapiens
attttgtactttgt

SEQ ID NO: 3575411 - DNA, 21 bp, Homo sapiens
attttgtgaaacagacttgta

SEQ ID NO: 3575412 - DNA, 16 bp, Homo sapiens
attttgtgtaagaaat

SEQ ID NO: 3575413 - DNA, 22 bp, Homo sapiens
attttgtgtcttttaaactgga

SEQ ID NO: 3575414 - DNA, 18 bp, Homo sapiens
attttgttcaagtttgct

SEQ ID NO: 3575415 - DNA, 19 bp, Homo sapiens
attttgttgctgttttgat

SEQ ID NO: 3575416 - DNA, 16 bp, Homo sapiens
attttgtttcttttaa

SEQ ID NO: 3575417 - DNA, 22 bp, Homo sapiens
atttttaaaaaatgaaatcctt

SEQ ID NO: 3575418 - DNA, 13 bp, Homo sapiens
atttttaaattgt

SEQ ID NO: 3575419 - DNA, 22 bp, Homo sapiens
atttttaaggtctaatcagtga

SEQ ID NO: 3575420 - DNA, 16 bp, Homo sapiens
atttttaggcaaagat

SEQ ID NO: 3575421 - DNA, 23 bp, Homo sapiens
atttttatacactgtaagctttg

SEQ ID NO: 3575422 - DNA, 22 bp, Homo sapiens
atttttatattgtttttgtatt

SEQ ID NO: 3575423 - DNA, 13 bp, Homo sapiens
atttttatcacaa

SEQ ID NO: 3575424 - DNA, 17 bp, Homo sapiens
atttttatttgtaaagt

SEQ ID NO: 3575425 - DNA, 21 bp, Homo sapiens
atttttccagctccgtgtttc

SEQ ID NO: 3575426 - DNA, 12 bp, Homo sapiens
atttttctcatg

SEQ ID NO: 3575427 - DNA, 16 bp, Homo sapiens
atttttctcccaagaa

SEQ ID NO: 3575428 - DNA, 19 bp, Homo sapiens
atttttctgaggtccttat

SEQ ID NO: 3575429 - DNA, 19 bp, Homo sapiens
atttttcttatttcatttc

SEQ ID NO: 3575430 - DNA, 19 bp, Homo sapiens
atttttgaagcaaagaagg

SEQ ID NO: 3575431 - DNA, 10 bp, Homo sapiens
atttttgctt

SEQ ID NO: 3575432 - DNA, 14 bp, Homo sapiens
atttttgcttttga

SEQ ID NO: 3575433 - DNA, 15 bp, Homo sapiens
atttttgtagtagcg

SEQ ID NO: 3575434 - DNA, 13 bp, Homo sapiens
attttttaaattc

SEQ ID NO: 3575435 - DNA, 16 bp, Homo sapiens
attttttactgccctt

SEQ ID NO: 3575436 - DNA, 14 bp, Homo sapiens
attttttcagaccg

SEQ ID NO: 3575437 - DNA, 22 bp, Homo sapiens
attttttcccttctcttctaac

SEQ ID NO: 3575438 - DNA, 12 bp, Homo sapiens
attttttcttct

SEQ ID NO: 3575439 - DNA, 20 bp, Homo sapiens
attttttggtggtgaaattg

SEQ ID NO: 3575440 - DNA, 13 bp, Homo sapiens
atttttttcccat

SEQ ID NO: 3575441 - DNA, 14 bp, Homo sapiens
atttttttgtaatt

SEQ ID NO: 3575442 - DNA, 18 bp, Homo sapiens
atttttttgtaattgctt

SEQ ID NO: 3575443 - DNA, 14 bp, Homo sapiens
attttttttatatt

SEQ ID NO: 3575444 - DNA, 19 bp, Homo sapiens
attttttttccgtaaatgt

SEQ ID NO: 3575445 - DNA, 16 bp, Homo sapiens
attttttttctttgaa

SEQ ID NO: 3575446 - DNA, 13 bp, Homo sapiens
caaaaaaagcctc

SEQ ID NO: 3575447 - DNA, 14 bp, Homo sapiens
caaaaaaagcctcc

SEQ ID NO: 3575448 - DNA, 15 bp, Homo sapiens
caaaaaaagcctcca

SEQ ID NO: 3575449 - DNA, 19 bp, Homo sapiens
caaaaaaagcctccaaggg

SEQ ID NO: 3575450 - DNA, 13 bp, Homo sapiens
caaaaaattagct

SEQ ID NO: 3575451 - DNA, 15 bp, Homo sapiens
caaaaacacagcaag

SEQ ID NO: 3575452 - DNA, 17 bp, Homo sapiens
caaaaacctattccact

SEQ ID NO: 3575453 - DNA, 16 bp, Homo sapiens
caaaaagagtcagaca

SEQ ID NO: 3575454 - DNA, 22 bp, Homo sapiens
caaaaagagtcagacatttctt

SEQ ID NO: 3575455 - DNA, 11 bp, Homo sapiens
caaaaagccac

SEQ ID NO: 3575456 - DNA, 19 bp, Homo sapiens
caaaaagccacagcagagc

SEQ ID NO: 3575457 - DNA, 14 bp, Homo sapiens
caaaaagctctgaa

SEQ ID NO: 3575458 - DNA, 16 bp, Homo sapiens
caaaaagctctgaaaa

SEQ ID NO: 3575459 - DNA, 16 bp, Homo sapiens
caaaacaaaacaaaac

SEQ ID NO: 3575460 - DNA, 15 bp, Homo sapiens
caaaacaaaacaaac

SEQ ID NO: 3575461 - DNA, 12 bp, Homo sapiens
caaaacaaaggc

SEQ ID NO: 3575462 - DNA, 14 bp, Homo sapiens
caaaacctattttt

SEQ ID NO: 3575463 - DNA, 18 bp, Homo sapiens
caaaacctatttttcctt

SEQ ID NO: 3575464 - DNA, 19 bp, Homo sapiens
caaaactactgacagggag

SEQ ID NO: 3575465 - DNA, 15 bp, Homo sapiens
caaaactccaggcag

SEQ ID NO: 3575466 - DNA, 17 bp, Homo sapiens
caaaactccaggcagga

SEQ ID NO: 3575467 - DNA, 17 bp, Homo sapiens
caaaactgcactgtcaa

SEQ ID NO: 3575468 - DNA, 13 bp, Homo sapiens
caaaacttctctt

SEQ ID NO: 3575469 - DNA, 21 bp, Homo sapiens
caaaacttctcttgaaaagtt

SEQ ID NO: 3575470 - DNA, 19 bp, Homo sapiens
caaaactttcgttgttatt

SEQ ID NO: 3575471 - DNA, 18 bp, Homo sapiens
caaaagaaacaccagtgt

SEQ ID NO: 3575472 - DNA, 16 bp, Homo sapiens
caaaagacattagaga

SEQ ID NO: 3575473 - DNA, 21 bp, Homo sapiens
caaaagatgtgcaaaatcact

SEQ ID NO: 3575474 - DNA, 18 bp, Homo sapiens
caaaagccataacttgaa

SEQ ID NO: 3575475 - DNA, 14 bp, Homo sapiens
caaaagctgctcag

SEQ ID NO: 3575476 - DNA, 16 bp, Homo sapiens
caaaagctttttaaaa

SEQ ID NO: 3575477 - DNA, 14 bp, Homo sapiens
caaaaggaacaaaa

SEQ ID NO: 3575478 - DNA, 24 bp, Homo sapiens
caaaagggggattccctgatggaa

SEQ ID NO: 3575479 - DNA, 16 bp, Homo sapiens
caaaatatttgtacat

SEQ ID NO: 3575480 - DNA, 13 bp, Homo sapiens
caaaatcaagagt

SEQ ID NO: 3575481 - DNA, 21 bp, Homo sapiens
caaaatccaaaacttctcttg

SEQ ID NO: 3575482 - DNA, 22 bp, Homo sapiens
caaaatcctgaactttctccct

SEQ ID NO: 3575483 - DNA, 17 bp, Homo sapiens
caaaatctgttctaaca

SEQ ID NO: 3575484 - DNA, 10 bp, Homo sapiens
caaaattgct

SEQ ID NO: 3575485 - DNA, 10 bp, Homo sapiens
caaacaaaac

SEQ ID NO: 3575486 - DNA, 13 bp, Homo sapiens
caaacaaaactta

SEQ ID NO: 3575487 - DNA, 18 bp, Homo sapiens
caaacaaaacttgcatct

SEQ ID NO: 3575488 - DNA, 13 bp, Homo sapiens
caaacaaacaaaa

SEQ ID NO: 3575489 - DNA, 14 bp, Homo sapiens
caaacaaacaaaac

SEQ ID NO: 3575490 - DNA, 15 bp, Homo sapiens
caaacaaacaaaact

SEQ ID NO: 3575491 - DNA, 16 bp, Homo sapiens
caaacaataagaacaa

SEQ ID NO: 3575492 - DNA, 19 bp, Homo sapiens
caaacaataagaacaagtt

SEQ ID NO: 3575493 - DNA, 22 bp, Homo sapiens
caaacatcaaataaatttctgg

SEQ ID NO: 3575494 - DNA, 14 bp, Homo sapiens
caaacatcattgtt

SEQ ID NO: 3575495 - DNA, 19 bp, Homo sapiens
caaacattcgtgagctggg

SEQ ID NO: 3575496 - DNA, 22 bp, Homo sapiens
caaaccccctgcagcccaggcc

SEQ ID NO: 3575497 - DNA, 23 bp, Homo sapiens
caaaccccctgcagcccaggcca

SEQ ID NO: 3575498 - DNA, 21 bp, Homo sapiens
caaaccccgaccacctgccca

SEQ ID NO: 3575499 - DNA, 18 bp, Homo sapiens
caaacccttaactgacat

SEQ ID NO: 3575500 - DNA, 21 bp, Homo sapiens
caaacctaagtccttccacct

SEQ ID NO: 3575501 - DNA, 13 bp, Homo sapiens
caaacctgggaag

SEQ ID NO: 3575502 - DNA, 22 bp, Homo sapiens
caaacctgggaaggccagcctt

SEQ ID NO: 3575503 - DNA, 15 bp, Homo sapiens
caaactcaggcccag

SEQ ID NO: 3575504 - DNA, 14 bp, Homo sapiens
caaactctctgaac

SEQ ID NO: 3575505 - DNA, 19 bp, Homo sapiens
caaactgtagtaattgtta

SEQ ID NO: 3575506 - DNA, 22 bp, Homo sapiens
caaactgtagtaattgttacaa

SEQ ID NO: 3575507 - DNA, 23 bp, Homo sapiens
caaactgtagtaattgttacaat

SEQ ID NO: 3575508 - DNA, 13 bp, Homo sapiens
caaacttaaacaa

SEQ ID NO: 3575509 - DNA, 16 bp, Homo sapiens
caaacttaaacaaaaa

SEQ ID NO: 3575510 - DNA, 16 bp, Homo sapiens
caaagaaaatgaaatg

SEQ ID NO: 3575511 - DNA, 13 bp, Homo sapiens
caaagaaaatgtt

SEQ ID NO: 3575512 - DNA, 13 bp, Homo sapiens
caaagaaacaagc

SEQ ID NO: 3575513 - DNA, 13 bp, Homo sapiens
caaagaaagtgta

SEQ ID NO: 3575514 - DNA, 15 bp, Homo sapiens
caaagaacttgctgc

SEQ ID NO: 3575515 - DNA, 16 bp, Homo sapiens
caaagaacttgctgct

SEQ ID NO: 3575516 - DNA, 18 bp, Homo sapiens
caaagaacttgctgctgc

SEQ ID NO: 3575517 - DNA, 15 bp, Homo sapiens
caaagaagatagctc

SEQ ID NO: 3575518 - DNA, 13 bp, Homo sapiens
caaagacaggcaa

SEQ ID NO: 3575519 - DNA, 14 bp, Homo sapiens
caaagacaggcaaa

SEQ ID NO: 3575520 - DNA, 17 bp, Homo sapiens
caaagacattgacagca

SEQ ID NO: 3575521 - DNA, 15 bp, Homo sapiens
caaagactctggagg

SEQ ID NO: 3575522 - DNA, 16 bp, Homo sapiens
caaagagaagatgcct

SEQ ID NO: 3575523 - DNA, 23 bp, Homo sapiens
caaagagaagatgcctgttaatt

SEQ ID NO: 3575524 - DNA, 14 bp, Homo sapiens
caaagagaattgta

SEQ ID NO: 3575525 - DNA, 19 bp, Homo sapiens
caaagagcctcccaccaga

SEQ ID NO: 3575526 - DNA, 16 bp, Homo sapiens
caaagaggtatttatc

SEQ ID NO: 3575527 - DNA, 17 bp, Homo sapiens
caaagattaggtcgttt

SEQ ID NO: 3575528 - DNA, 12 bp, Homo sapiens
caaagccaaggc

SEQ ID NO: 3575529 - DNA, 15 bp, Homo sapiens
caaagccaaggcagc

SEQ ID NO: 3575530 - DNA, 22 bp, Homo sapiens
caaagcccttggaacaccctgg

SEQ ID NO: 3575531 - DNA, 20 bp, Homo sapiens
caaagctcaaataaaaataa

SEQ ID NO: 3575532 - DNA, 16 bp, Homo sapiens
caaagctgaatatttt

SEQ ID NO: 3575533 - DNA, 13 bp, Homo sapiens
caaagctgttcca

SEQ ID NO: 3575534 - DNA, 18 bp, Homo sapiens
caaagcttgtcaaagatg

SEQ ID NO: 3575535 - DNA, 17 bp, Homo sapiens
caaaggaaaatgtctgt

SEQ ID NO: 3575536 - DNA, 13 bp, Homo sapiens
caaaggatgtgat

SEQ ID NO: 3575537 - DNA, 13 bp, Homo sapiens
cacctccacaccc

SEQ ID NO: 3575538 - DNA, 16 bp, Homo sapiens
cacctccacacccacc

SEQ ID NO: 3575539 - DNA, 21 bp, Homo sapiens
cacctccacacccaccccctc

SEQ ID NO: 3575540 - DNA, 11 bp, Homo sapiens
cacctcccagg

SEQ ID NO: 3575541 - DNA, 22 bp, Homo sapiens
cacctcccccttcccctaccca

SEQ ID NO: 3575542 - DNA, 16 bp, Homo sapiens
cacctccccgctggga

SEQ ID NO: 3575543 - DNA, 16 bp, Homo sapiens
cacctcctcccactgc

SEQ ID NO: 3575544 - DNA, 20 bp, Homo sapiens
cacctcctcccgaaaaatgt

SEQ ID NO: 3575545 - DNA, 16 bp, Homo sapiens
cacctcgagaagtaat

SEQ ID NO: 3575546 - DNA, 13 bp, Homo sapiens
cacctcggaggga

SEQ ID NO: 3575547 - DNA, 15 bp, Homo sapiens
cacctcggcacacac

SEQ ID NO: 3575548 - DNA, 20 bp, Homo sapiens
cacctcgtcaagagcatgca

SEQ ID NO: 3575549 - DNA, 22 bp, Homo sapiens
cacctcttaaagaaaacccacc

SEQ ID NO: 3575550 - DNA, 19 bp, Homo sapiens
cacctgaatcagctggaca

SEQ ID NO: 3575551 - DNA, 17 bp, Homo sapiens
cacctgacacaccaggc

SEQ ID NO: 3575552 - DNA, 15 bp, Homo sapiens
cacctgcaggaccct

SEQ ID NO: 3575553 - DNA, 23 bp, Homo sapiens
cacctgcaggaccctgtcctgca

SEQ ID NO: 3575554 - DNA, 19 bp, Homo sapiens
cacctgcccaacctgctct

SEQ ID NO: 3575555 - DNA, 16 bp, Homo sapiens
cacctgcctccaccag

SEQ ID NO: 3575556 - DNA, 17 bp, Homo sapiens
cacctgcctccaccagc

SEQ ID NO: 3575557 - DNA, 13 bp, Homo sapiens
cacctgctccaga

SEQ ID NO: 3575558 - DNA, 13 bp, Homo sapiens
cacctggccttaa

SEQ ID NO: 3575559 - DNA, 12 bp, Homo sapiens
cacctggctgcc

SEQ ID NO: 3575560 - DNA, 13 bp, Homo sapiens
cacctggctgcca

SEQ ID NO: 3575561 - DNA, 15 bp, Homo sapiens
cacctggctgccaac

SEQ ID NO: 3575562 - DNA, 23 bp, Homo sapiens
cacctgggcagggatgatggcag

SEQ ID NO: 3575563 - DNA, 19 bp, Homo sapiens
cacctggtcgccaatccat

SEQ ID NO: 3575564 - DNA, 22 bp, Homo sapiens
cacctgtggaacataaaaagga

SEQ ID NO: 3575565 - DNA, 23 bp, Homo sapiens
caccttagagaagctacccctca

SEQ ID NO: 3575566 - DNA, 16 bp, Homo sapiens
caccttccagcccggg

SEQ ID NO: 3575567 - DNA, 19 bp, Homo sapiens
caccttccccctcccccag

SEQ ID NO: 3575568 - DNA, 11 bp, Homo sapiens
caccttgcaga

SEQ ID NO: 3575569 - DNA, 23 bp, Homo sapiens
caccttgcagaaggcaaggccct

SEQ ID NO: 3575570 - DNA, 19 bp, Homo sapiens
cacgacctgtcctgtcttt

SEQ ID NO: 3575571 - DNA, 13 bp, Homo sapiens
cacgagagcccgg

SEQ ID NO: 3575572 - DNA, 20 bp, Homo sapiens
cacgagcaggctactgtcag

SEQ ID NO: 3575573 - DNA, 15 bp, Homo sapiens
cacgccttggcctcc

SEQ ID NO: 3575574 - DNA, 17 bp, Homo sapiens
cacggatggtgcatggg

SEQ ID NO: 3575575 - DNA, 14 bp, Homo sapiens
cacggcctggctgg

SEQ ID NO: 3575576 - DNA, 17 bp, Homo sapiens
cacggcgggatcctcca

SEQ ID NO: 3575577 - DNA, 13 bp, Homo sapiens
cactaaagcttca

SEQ ID NO: 3575578 - DNA, 13 bp, Homo sapiens
cactaagcagagg

SEQ ID NO: 3575579 - DNA, 18 bp, Homo sapiens
cactaagcagaggagggg

SEQ ID NO: 3575580 - DNA, 14 bp, Homo sapiens
cactaccaaaagac

SEQ ID NO: 3575581 - DNA, 14 bp, Homo sapiens
cactaccagccagc

SEQ ID NO: 3575582 - DNA, 15 bp, Homo sapiens
cactaccagccagcc

SEQ ID NO: 3575583 - DNA, 18 bp, Homo sapiens
cactaccagccagcctca

SEQ ID NO: 3575584 - DNA, 13 bp, Homo sapiens
cactacctggctg

SEQ ID NO: 3575585 - DNA, 13 bp, Homo sapiens
cactagaatggat

SEQ ID NO: 3575586 - DNA, 21 bp, Homo sapiens
cactagtgaccccttccctgt

SEQ ID NO: 3575587 - DNA, 12 bp, Homo sapiens
cactagtggaaa

SEQ ID NO: 3575588 - DNA, 20 bp, Homo sapiens
cactcagaaaattccctggg

SEQ ID NO: 3575589 - DNA, 21 bp, Homo sapiens
cactcagaaaattccctgggg

SEQ ID NO: 3575590 - DNA, 14 bp, Homo sapiens
cactcaggccacag

SEQ ID NO: 3575591 - DNA, 18 bp, Homo sapiens
cactcaggggaccccact

SEQ ID NO: 3575592 - DNA, 20 bp, Homo sapiens
cactcaggggaccccactcc

SEQ ID NO: 3575593 - DNA, 22 bp, Homo sapiens
cactcaggggaccccactcccc

SEQ ID NO: 3575594 - DNA, 18 bp, Homo sapiens
cactcagtctctcttctc

SEQ ID NO: 3575595 - DNA, 22 bp, Homo sapiens
cactcagtgcctccacatgctg

SEQ ID NO: 3575596 - DNA, 16 bp, Homo sapiens
cactcagtttatgctg

SEQ ID NO: 3575597 - DNA, 14 bp, Homo sapiens
cactcatacacatg

SEQ ID NO: 3575598 - DNA, 16 bp, Homo sapiens
cactcatcccctcact

SEQ ID NO: 3575599 - DNA, 16 bp, Homo sapiens
cactccagacccctgg

SEQ ID NO: 3575600 - DNA, 17 bp, Homo sapiens
cactccagacccctggc

SEQ ID NO: 3575601 - DNA, 13 bp, Homo sapiens
cactccagactct

SEQ ID NO: 3575602 - DNA, 17 bp, Homo sapiens
cactccagactctgggg

SEQ ID NO: 3575603 - DNA, 13 bp, Homo sapiens
cactccagctgac

SEQ ID NO: 3575604 - DNA, 22 bp, Homo sapiens
cactcccacctgacacaccagg

SEQ ID NO: 3575605 - DNA, 23 bp, Homo sapiens
cactcccacctgacacaccaggc

SEQ ID NO: 3575606 - DNA, 12 bp, Homo sapiens
cactcccagcat

SEQ ID NO: 3575607 - DNA, 17 bp, Homo sapiens
cactccccagagctgtg

SEQ ID NO: 3575608 - DNA, 16 bp, Homo sapiens
cactccccagccagcc

SEQ ID NO: 3575609 - DNA, 21 bp, Homo sapiens
cactccccagccagcctggct

SEQ ID NO: 3575610 - DNA, 22 bp, Homo sapiens
cactccccagccagcctggctg

SEQ ID NO: 3575611 - DNA, 12 bp, Homo sapiens
cactccccaggg

SEQ ID NO: 3575612 - DNA, 15 bp, Homo sapiens
cactccttcatgttt

SEQ ID NO: 3575613 - DNA, 13 bp, Homo sapiens
cactccttgtccc

SEQ ID NO: 3575614 - DNA, 18 bp, Homo sapiens
cactcgtggtgaggctga

SEQ ID NO: 3575615 - DNA, 19 bp, Homo sapiens
cactctcagagtgttttga

SEQ ID NO: 3575616 - DNA, 20 bp, Homo sapiens
cactctcccattatatttat

SEQ ID NO: 3575617 - DNA, 13 bp, Homo sapiens
cactctgcactgg

SEQ ID NO: 3575618 - DNA, 22 bp, Homo sapiens
cactctggcagcaccgcctctt

SEQ ID NO: 3575619 - DNA, 19 bp, Homo sapiens
cactctgggcaaagcccct

SEQ ID NO: 3575620 - DNA, 14 bp, Homo sapiens
cactctgggctcca

SEQ ID NO: 3575621 - DNA, 17 bp, Homo sapiens
cactctgggctccagag

SEQ ID NO: 3575622 - DNA, 17 bp, Homo sapiens
cactctgttgcccaggc

SEQ ID NO: 3575623 - DNA, 18 bp, Homo sapiens
cactcttgatctctcttg

SEQ ID NO: 3575624 - DNA, 20 bp, Homo sapiens
cactcttgatctctcttgtc

SEQ ID NO: 3575625 - DNA, 12 bp, Homo sapiens
cactcttttgat

SEQ ID NO: 3575626 - DNA, 15 bp, Homo sapiens
cactcttttgatggt

SEQ ID NO: 3575627 - DNA, 16 bp, Homo sapiens
cactgaactcctattt

SEQ ID NO: 3575628 - DNA, 19 bp, Homo sapiens
cactgaagtttttgaaata

SEQ ID NO: 3575629 - DNA, 14 bp, Homo sapiens
cactgacttctaag

SEQ ID NO: 3575630 - DNA, 20 bp, Homo sapiens
cactgacttctaagtaaaac

SEQ ID NO: 3575631 - DNA, 13 bp, Homo sapiens
cactgagcaggga

SEQ ID NO: 3575632 - DNA, 18 bp, Homo sapiens
cactgcaaacacaccttg

SEQ ID NO: 3575633 - DNA, 20 bp, Homo sapiens
cactgcaaacacaccttgga

SEQ ID NO: 3575634 - DNA, 22 bp, Homo sapiens
cactgcaaacacaccttggaga

SEQ ID NO: 3575635 - DNA, 20 bp, Homo sapiens
cactgcagcctcaacctcct

SEQ ID NO: 3575636 - DNA, 18 bp, Homo sapiens
cactgcattattctcttt

SEQ ID NO: 3575637 - DNA, 19 bp, Homo sapiens
cactgcattattctctttt

SEQ ID NO: 3575638 - DNA, 17 bp, Homo sapiens
cactgcattcctgtgcc

SEQ ID NO: 3575639 - DNA, 14 bp, Homo sapiens
cactgccaacccct

SEQ ID NO: 3575640 - DNA, 14 bp, Homo sapiens
cactgccggcagga

SEQ ID NO: 3575641 - DNA, 20 bp, Homo sapiens
cactgcctgcatgagctggc

SEQ ID NO: 3575642 - DNA, 20 bp, Homo sapiens
cactgccttcgatacaccgg

SEQ ID NO: 3575643 - DNA, 22 bp, Homo sapiens
cactgccttcgatacaccgggc

SEQ ID NO: 3575644 - DNA, 22 bp, Homo sapiens
cactgcgttttcctagctgtgt

SEQ ID NO: 3575645 - DNA, 21 bp, Homo sapiens
cactgctagagacgctgatcc

SEQ ID NO: 3575646 - DNA, 15 bp, Homo sapiens
cactgctctaacagc

SEQ ID NO: 3575647 - DNA, 13 bp, Homo sapiens
cactgctggctgc

SEQ ID NO: 3575648 - DNA, 20 bp, Homo sapiens
cactggagccatctcttcct

SEQ ID NO: 3575649 - DNA, 13 bp, Homo sapiens
cactggcctgcca

SEQ ID NO: 3575650 - DNA, 18 bp, Homo sapiens
cactggcctgccatgcca

SEQ ID NO: 3575651 - DNA, 13 bp, Homo sapiens
cactggcgaggag

SEQ ID NO: 3575652 - DNA, 13 bp, Homo sapiens
cactgggaaacag

SEQ ID NO: 3575653 - DNA, 14 bp, Homo sapiens
cactgggacagctg

SEQ ID NO: 3575654 - DNA, 18 bp, Homo sapiens
cactgggacagctggctg

SEQ ID NO: 3575655 - DNA, 20 bp, Homo sapiens
cactgggacagctggctggg

SEQ ID NO: 3575656 - DNA, 23 bp, Homo sapiens
cactgggacagctggctgggcct

SEQ ID NO: 3575657 - DNA, 18 bp, Homo sapiens
cactggggcgtttcctac

SEQ ID NO: 3575658 - DNA, 15 bp, Homo sapiens
cactggtaaatgtta

SEQ ID NO: 3575659 - DNA, 14 bp, Homo sapiens
cactggtatttata

SEQ ID NO: 3575660 - DNA, 13 bp, Homo sapiens
cactggtggcccg

SEQ ID NO: 3575661 - DNA, 20 bp, Homo sapiens
cactggtgtgaactcaccct

SEQ ID NO: 3575662 - DNA, 14 bp, Homo sapiens
cactgtcaagatga

SEQ ID NO: 3575663 - DNA, 18 bp, Homo sapiens
cactgtcctccaagccag

SEQ ID NO: 3575664 - DNA, 14 bp, Homo sapiens
cactgtgaaggacc

SEQ ID NO: 3575665 - DNA, 16 bp, Homo sapiens
cactgtgcagacccag

SEQ ID NO: 3575666 - DNA, 12 bp, Homo sapiens
cactgtgcccca

SEQ ID NO: 3575667 - DNA, 13 bp, Homo sapiens
cactgtgccccac

SEQ ID NO: 3575668 - DNA, 15 bp, Homo sapiens
cactgtggccaggcc

SEQ ID NO: 3575669 - DNA, 12 bp, Homo sapiens
cacttaacaaac

SEQ ID NO: 3575670 - DNA, 18 bp, Homo sapiens
caggcacagcagctgcag

SEQ ID NO: 3575671 - DNA, 20 bp, Homo sapiens
caggcacatacacctcgtca

SEQ ID NO: 3575672 - DNA, 22 bp, Homo sapiens
caggcacatacacctcgtcaag

SEQ ID NO: 3575673 - DNA, 20 bp, Homo sapiens
caggcaccgccacgtcccag

SEQ ID NO: 3575674 - DNA, 17 bp, Homo sapiens
caggcactgctgcccag

SEQ ID NO: 3575675 - DNA, 21 bp, Homo sapiens
caggcagagtggcgtggcctc

SEQ ID NO: 3575676 - DNA, 17 bp, Homo sapiens
caggcagatccaggact

SEQ ID NO: 3575677 - DNA, 16 bp, Homo sapiens
caggcagctatttcag

SEQ ID NO: 3575678 - DNA, 20 bp, Homo sapiens
caggcagcttctactcctgc

SEQ ID NO: 3575679 - DNA, 21 bp, Homo sapiens
caggcagcttctactcctgcc

SEQ ID NO: 3575680 - DNA, 14 bp, Homo sapiens
caggcaggagccct

SEQ ID NO: 3575681 - DNA, 17 bp, Homo sapiens
caggcaggcggctcctc

SEQ ID NO: 3575682 - DNA, 19 bp, Homo sapiens
caggcaggcggctcctcct

SEQ ID NO: 3575683 - DNA, 18 bp, Homo sapiens
caggcatgtgtcccttcc

SEQ ID NO: 3575684 - DNA, 18 bp, Homo sapiens
caggcatgtgtctggccc

SEQ ID NO: 3575685 - DNA, 19 bp, Homo sapiens
caggcatgtgtctggccct

SEQ ID NO: 3575686 - DNA, 16 bp, Homo sapiens
caggccaagggaccag

SEQ ID NO: 3575687 - DNA, 14 bp, Homo sapiens
caggccagagaaag

SEQ ID NO: 3575688 - DNA, 15 bp, Homo sapiens
caggccagcccagcc

SEQ ID NO: 3575689 - DNA, 18 bp, Homo sapiens
caggccagcccagccagg

SEQ ID NO: 3575690 - DNA, 20 bp, Homo sapiens
caggccagcccagccaggcc

SEQ ID NO: 3575691 - DNA, 15 bp, Homo sapiens
caggccagctgcctc

SEQ ID NO: 3575692 - DNA, 22 bp, Homo sapiens
caggccagggcagttgacaggt

SEQ ID NO: 3575693 - DNA, 23 bp, Homo sapiens
caggccagtcagacgccaggcac

SEQ ID NO: 3575694 - DNA, 16 bp, Homo sapiens
caggcccaatgctgct

SEQ ID NO: 3575695 - DNA, 14 bp, Homo sapiens
caggcccactcccc

SEQ ID NO: 3575696 - DNA, 15 bp, Homo sapiens
caggcccactcccca

SEQ ID NO: 3575697 - DNA, 19 bp, Homo sapiens
caggcccactccccagccc

SEQ ID NO: 3575698 - DNA, 21 bp, Homo sapiens
caggcccagctttccctgcca

SEQ ID NO: 3575699 - DNA, 21 bp, Homo sapiens
caggcccatgggaggctggag

SEQ ID NO: 3575700 - DNA, 15 bp, Homo sapiens
caggccccaccggcc

SEQ ID NO: 3575701 - DNA, 18 bp, Homo sapiens
caggccccaccggccagg

SEQ ID NO: 3575702 - DNA, 17 bp, Homo sapiens
caggcccctccctctcc

SEQ ID NO: 3575703 - DNA, 23 bp, Homo sapiens
caggcccctccctctccagcagg

SEQ ID NO: 3575704 - DNA, 17 bp, Homo sapiens
caggccctccctgtctc

SEQ ID NO: 3575705 - DNA, 15 bp, Homo sapiens
caggcccttcctctc

SEQ ID NO: 3575706 - DNA, 17 bp, Homo sapiens
caggcccttcctctcca

SEQ ID NO: 3575707 - DNA, 15 bp, Homo sapiens
caggccgcgcccagc

SEQ ID NO: 3575708 - DNA, 16 bp, Homo sapiens
caggccgcgcccagca

SEQ ID NO: 3575709 - DNA, 19 bp, Homo sapiens
caggcctaggtgcagctcc

SEQ ID NO: 3575710 - DNA, 23 bp, Homo sapiens
caggcctaggtgcagctcctcag

SEQ ID NO: 3575711 - DNA, 23 bp, Homo sapiens
caggcctccaacgcccctgtggc

SEQ ID NO: 3575712 - DNA, 17 bp, Homo sapiens
caggcctctgggaccca

SEQ ID NO: 3575713 - DNA, 18 bp, Homo sapiens
caggcctctgggacccac

SEQ ID NO: 3575714 - DNA, 21 bp, Homo sapiens
caggccttatctgaaaggcca

SEQ ID NO: 3575715 - DNA, 22 bp, Homo sapiens
caggcgatggggcaagacagaa

SEQ ID NO: 3575716 - DNA, 15 bp, Homo sapiens
caggcgccccttccc

SEQ ID NO: 3575717 - DNA, 17 bp, Homo sapiens
caggcgccccttccccc

SEQ ID NO: 3575718 - DNA, 15 bp, Homo sapiens
caggcgtgagccact

SEQ ID NO: 3575719 - DNA, 15 bp, Homo sapiens
caggctaagaccctg

SEQ ID NO: 3575720 - DNA, 18 bp, Homo sapiens
caggctaagaccctgtgt

SEQ ID NO: 3575721 - DNA, 14 bp, Homo sapiens
caggctactagaat

SEQ ID NO: 3575722 - DNA, 11 bp, Homo sapiens
caggctactgt

SEQ ID NO: 3575723 - DNA, 16 bp, Homo sapiens
caggctagctgtgctg

SEQ ID NO: 3575724 - DNA, 11 bp, Homo sapiens
caggctcagga

SEQ ID NO: 3575725 - DNA, 12 bp, Homo sapiens
caggctcaggag

SEQ ID NO: 3575726 - DNA, 16 bp, Homo sapiens
caggctcaggagaagc

SEQ ID NO: 3575727 - DNA, 19 bp, Homo sapiens
caggctcaggagaagccag

SEQ ID NO: 3575728 - DNA, 21 bp, Homo sapiens
caggctccgggcaccaggggc

SEQ ID NO: 3575729 - DNA, 14 bp, Homo sapiens
caggctccgggctt

SEQ ID NO: 3575730 - DNA, 23 bp, Homo sapiens
caggctcctgaccccgccatgca

SEQ ID NO: 3575731 - DNA, 21 bp, Homo sapiens
caggctcgtcagccacctggg

SEQ ID NO: 3575732 - DNA, 14 bp, Homo sapiens
caggctctcaacag

SEQ ID NO: 3575733 - DNA, 15 bp, Homo sapiens
caggctcttctcctt

SEQ ID NO: 3575734 - DNA, 16 bp, Homo sapiens
caggctgaagagaggg

SEQ ID NO: 3575735 - DNA, 21 bp, Homo sapiens
caggctgagggtcgtgggaaa

SEQ ID NO: 3575736 - DNA, 20 bp, Homo sapiens
caggctgcctcctgccctta

SEQ ID NO: 3575737 - DNA, 12 bp, Homo sapiens
caggctgggccc

SEQ ID NO: 3575738 - DNA, 22 bp, Homo sapiens
caggctggtctcgaactcctga

SEQ ID NO: 3575739 - DNA, 19 bp, Homo sapiens
caggctgtggggcagctga

SEQ ID NO: 3575740 - DNA, 16 bp, Homo sapiens
caggcttagggacagg

SEQ ID NO: 3575741 - DNA, 21 bp, Homo sapiens
caggcttgtggcagcctgatt

SEQ ID NO: 3575742 - DNA, 15 bp, Homo sapiens
cagggaaaagcagct

SEQ ID NO: 3575743 - DNA, 21 bp, Homo sapiens
cagggaaaagcagctctcccc

SEQ ID NO: 3575744 - DNA, 17 bp, Homo sapiens
cagggaaaattgcccca

SEQ ID NO: 3575745 - DNA, 19 bp, Homo sapiens
cagggaactgaccctcagg

SEQ ID NO: 3575746 - DNA, 17 bp, Homo sapiens
cagggaagctgtcctgg

SEQ ID NO: 3575747 - DNA, 15 bp, Homo sapiens
cagggaaggacagga

SEQ ID NO: 3575748 - DNA, 17 bp, Homo sapiens
cagggaaggacaggacc

SEQ ID NO: 3575749 - DNA, 15 bp, Homo sapiens
cagggaaggagacac

SEQ ID NO: 3575750 - DNA, 22 bp, Homo sapiens
cagggaaggagacaccaagctc

SEQ ID NO: 3575751 - DNA, 17 bp, Homo sapiens
cagggaatgcagcagga

SEQ ID NO: 3575752 - DNA, 18 bp, Homo sapiens
cagggaatgcagcaggaa

SEQ ID NO: 3575753 - DNA, 16 bp, Homo sapiens
cagggaatggccacaa

SEQ ID NO: 3575754 - DNA, 21 bp, Homo sapiens
cagggaatggccacaaacctg

SEQ ID NO: 3575755 - DNA, 20 bp, Homo sapiens
cagggaccactgggtgagag

SEQ ID NO: 3575756 - DNA, 22 bp, Homo sapiens
cagggaccactgggtgagagag

SEQ ID NO: 3575757 - DNA, 23 bp, Homo sapiens
cagggaccggcggaccccagcca

SEQ ID NO: 3575758 - DNA, 16 bp, Homo sapiens
cagggaccgggcgcag

SEQ ID NO: 3575759 - DNA, 18 bp, Homo sapiens
cagggaccggtgctgcag

SEQ ID NO: 3575760 - DNA, 18 bp, Homo sapiens
cagggaccgtccagggga

SEQ ID NO: 3575761 - DNA, 13 bp, Homo sapiens
cagggacctgaga

SEQ ID NO: 3575762 - DNA, 16 bp, Homo sapiens
cagggacctgagagca

SEQ ID NO: 3575763 - DNA, 22 bp, Homo sapiens
cagggagcatttaatggcagct

SEQ ID NO: 3575764 - DNA, 20 bp, Homo sapiens
cagggagggcttggggctgc

SEQ ID NO: 3575765 - DNA, 17 bp, Homo sapiens
cagggatgatggcagag

SEQ ID NO: 3575766 - DNA, 23 bp, Homo sapiens
cagggatgatggcagagccaggc

SEQ ID NO: 3575767 - DNA, 14 bp, Homo sapiens
cagggatgccctgg

SEQ ID NO: 3575768 - DNA, 18 bp, Homo sapiens
cagggatgctgggctggg

SEQ ID NO: 3575769 - DNA, 21 bp, Homo sapiens
cagggatggagggaagacctg

SEQ ID NO: 3575770 - DNA, 18 bp, Homo sapiens
cagggcagcaggccagag

SEQ ID NO: 3575771 - DNA, 22 bp, Homo sapiens
cagggcagtccttactccccca

SEQ ID NO: 3575772 - DNA, 12 bp, Homo sapiens
cagggcagtggc

SEQ ID NO: 3575773 - DNA, 20 bp, Homo sapiens
cagggcatggccaggtggcc

SEQ ID NO: 3575774 - DNA, 17 bp, Homo sapiens
cagggcatggctgggaa

SEQ ID NO: 3575775 - DNA, 18 bp, Homo sapiens
cagggccacctgcaggac

SEQ ID NO: 3575776 - DNA, 20 bp, Homo sapiens
cagggccacctgcaggaccc

SEQ ID NO: 3575777 - DNA, 12 bp, Homo sapiens
cagggccaggtg

SEQ ID NO: 3575778 - DNA, 20 bp, Homo sapiens
cagggccaggtgcagacctt

SEQ ID NO: 3575779 - DNA, 14 bp, Homo sapiens
cagggcccacgtgt

SEQ ID NO: 3575780 - DNA, 12 bp, Homo sapiens
cagggcccagag

SEQ ID NO: 3575781 - DNA, 14 bp, Homo sapiens
cagggcccagagcc

SEQ ID NO: 3575782 - DNA, 15 bp, Homo sapiens
cagggcccagagccc

SEQ ID NO: 3575783 - DNA, 16 bp, Homo sapiens
cagggcccagagccca

SEQ ID NO: 3575784 - DNA, 19 bp, Homo sapiens
cagggcccagagcccagct

SEQ ID NO: 3575785 - DNA, 20 bp, Homo sapiens
cagggcccaggttcgagacc

SEQ ID NO: 3575786 - DNA, 16 bp, Homo sapiens
cagggccgggcagggg

SEQ ID NO: 3575787 - DNA, 19 bp, Homo sapiens
cagggcctgacaccccctc

SEQ ID NO: 3575788 - DNA, 20 bp, Homo sapiens
cagggcctgacaccccctcc

SEQ ID NO: 3575789 - DNA, 15 bp, Homo sapiens
cagggcctggagccc

SEQ ID NO: 3575790 - DNA, 16 bp, Homo sapiens
cagggcctggagcccc

SEQ ID NO: 3575791 - DNA, 17 bp, Homo sapiens
cagggcctggagcccca

SEQ ID NO: 3575792 - DNA, 18 bp, Homo sapiens
cagggcctggagccccat

SEQ ID NO: 3575793 - DNA, 20 bp, Homo sapiens
cagggcgcccagcgccgtcc

SEQ ID NO: 3575794 - DNA, 16 bp, Homo sapiens
cagggctaaataaaga

SEQ ID NO: 3575795 - DNA, 22 bp, Homo sapiens
cagggctggcacgtgacaggct

SEQ ID NO: 3575796 - DNA, 11 bp, Homo sapiens
cagggctgggg

SEQ ID NO: 3575797 - DNA, 12 bp, Homo sapiens
cagggctgggga

SEQ ID NO: 3575798 - DNA, 15 bp, Homo sapiens
cagggctggggacag

SEQ ID NO: 3575799 - DNA, 17 bp, Homo sapiens
cagggctggggacagag

SEQ ID NO: 3575800 - DNA, 20 bp, Homo sapiens
cagggctggggacagagggt

SEQ ID NO: 3575801 - DNA, 17 bp, Homo sapiens
caggggaattccctccc

SEQ ID NO: 3575802 - DNA, 12 bp, Homo sapiens
catgttgtaatg

SEQ ID NO: 3575803 - DNA, 17 bp, Homo sapiens
catgttgtaatgctgca

SEQ ID NO: 3575804 - DNA, 19 bp, Homo sapiens
catgttgtaatgctgcact

SEQ ID NO: 3575805 - DNA, 23 bp, Homo sapiens
catgttgttgtgtgtatatgtat

SEQ ID NO: 3575806 - DNA, 19 bp, Homo sapiens
catgtttccatcatttctg

SEQ ID NO: 3575807 - DNA, 23 bp, Homo sapiens
catgtttgatgtatctgagcagg

SEQ ID NO: 3575808 - DNA, 12 bp, Homo sapiens
catgtttggaaa

SEQ ID NO: 3575809 - DNA, 14 bp, Homo sapiens
catgtttggaaaat

SEQ ID NO: 3575810 - DNA, 15 bp, Homo sapiens
catgttttcaactgc

SEQ ID NO: 3575811 - DNA, 10 bp, Homo sapiens
catgttttcc

SEQ ID NO: 3575812 - DNA, 17 bp, Homo sapiens
catgtttttaactttta

SEQ ID NO: 3575813 - DNA, 19 bp, Homo sapiens
catgttttttcatttgtaa

SEQ ID NO: 3575814 - DNA, 16 bp, Homo sapiens
catgttttttcttcaa

SEQ ID NO: 3575815 - DNA, 23 bp, Homo sapiens
cattaaaaagttgttctttgttt

SEQ ID NO: 3575816 - DNA, 13 bp, Homo sapiens
cattaaattgata

SEQ ID NO: 3575817 - DNA, 16 bp, Homo sapiens
cattaccagcttaaaa

SEQ ID NO: 3575818 - DNA, 16 bp, Homo sapiens
cattaccctacagaca

SEQ ID NO: 3575819 - DNA, 16 bp, Homo sapiens
cattactgttccagat

SEQ ID NO: 3575820 - DNA, 18 bp, Homo sapiens
cattagagaaaaccttaa

SEQ ID NO: 3575821 - DNA, 20 bp, Homo sapiens
cattagcaaggcagagcctt

SEQ ID NO: 3575822 - DNA, 21 bp, Homo sapiens
cattagcaaggcagagccttt

SEQ ID NO: 3575823 - DNA, 18 bp, Homo sapiens
cattagcagtttgctttg

SEQ ID NO: 3575824 - DNA, 19 bp, Homo sapiens
cattaggctgttggttcaa

SEQ ID NO: 3575825 - DNA, 15 bp, Homo sapiens
cattagtactttgtg

SEQ ID NO: 3575826 - DNA, 13 bp, Homo sapiens
cattagttttgaa

SEQ ID NO: 3575827 - DNA, 16 bp, Homo sapiens
cattatatttattgtt

SEQ ID NO: 3575828 - DNA, 16 bp, Homo sapiens
cattatctcacttagt

SEQ ID NO: 3575829 - DNA, 19 bp, Homo sapiens
cattatctcacttagtcct

SEQ ID NO: 3575830 - DNA, 18 bp, Homo sapiens
cattatcttatcatttat

SEQ ID NO: 3575831 - DNA, 16 bp, Homo sapiens
cattatgccacttcct

SEQ ID NO: 3575832 - DNA, 18 bp, Homo sapiens
cattatgccacttccttt

SEQ ID NO: 3575833 - DNA, 14 bp, Homo sapiens
cattatgttaatat

SEQ ID NO: 3575834 - DNA, 15 bp, Homo sapiens
cattatgttaatatt

SEQ ID NO: 3575835 - DNA, 21 bp, Homo sapiens
cattattaagtaacttattta

SEQ ID NO: 3575836 - DNA, 15 bp, Homo sapiens
cattattctctttta

SEQ ID NO: 3575837 - DNA, 14 bp, Homo sapiens
cattattttccaga

SEQ ID NO: 3575838 - DNA, 22 bp, Homo sapiens
cattcaaaaagacagcagacaa

SEQ ID NO: 3575839 - DNA, 24 bp, Homo sapiens
cattcaaaaagacagcagacaaaa

SEQ ID NO: 3575840 - DNA, 21 bp, Homo sapiens
cattcacaagcctcctgtacc

SEQ ID NO: 3575841 - DNA, 15 bp, Homo sapiens
cattcagactaaaaa

SEQ ID NO: 3575842 - DNA, 21 bp, Homo sapiens
cattcagctctggagaacagt

SEQ ID NO: 3575843 - DNA, 15 bp, Homo sapiens
cattcagtaagttct

SEQ ID NO: 3575844 - DNA, 17 bp, Homo sapiens
cattcagtaagttctgt

SEQ ID NO: 3575845 - DNA, 20 bp, Homo sapiens
cattcagtaagttctgtggt

SEQ ID NO: 3575846 - DNA, 15 bp, Homo sapiens
cattcagttctaggc

SEQ ID NO: 3575847 - DNA, 17 bp, Homo sapiens
cattccaccttcccatg

SEQ ID NO: 3575848 - DNA, 15 bp, Homo sapiens
cattccataaatgtc

SEQ ID NO: 3575849 - DNA, 13 bp, Homo sapiens
cattccatttgct

SEQ ID NO: 3575850 - DNA, 21 bp, Homo sapiens
cattcccaacgtgcaaagcca

SEQ ID NO: 3575851 - DNA, 13 bp, Homo sapiens
cattccccatggg

SEQ ID NO: 3575852 - DNA, 23 bp, Homo sapiens
cattcccctcccacctctccttt

SEQ ID NO: 3575853 - DNA, 13 bp, Homo sapiens
cattcctgaagaa

SEQ ID NO: 3575854 - DNA, 20 bp, Homo sapiens
cattcctgaagaaccagtcc

SEQ ID NO: 3575855 - DNA, 19 bp, Homo sapiens
cattcgtgagctggggact

SEQ ID NO: 3575856 - DNA, 21 bp, Homo sapiens
cattctaccaagctgtcacag

SEQ ID NO: 3575857 - DNA, 16 bp, Homo sapiens
cattctattttagaat

SEQ ID NO: 3575858 - DNA, 11 bp, Homo sapiens
cattctcacat

SEQ ID NO: 3575859 - DNA, 14 bp, Homo sapiens
cattctcccagctc

SEQ ID NO: 3575860 - DNA, 15 bp, Homo sapiens
cattctcccagctct

SEQ ID NO: 3575861 - DNA, 19 bp, Homo sapiens
cattctcgtgagtcattta

SEQ ID NO: 3575862 - DNA, 23 bp, Homo sapiens
cattctcgtgagtcatttaaatg

SEQ ID NO: 3575863 - DNA, 18 bp, Homo sapiens
cattctgaaccctccaaa

SEQ ID NO: 3575864 - DNA, 20 bp, Homo sapiens
cattctgaaggccttgttaa

SEQ ID NO: 3575865 - DNA, 14 bp, Homo sapiens
cattctgcctagag

SEQ ID NO: 3575866 - DNA, 20 bp, Homo sapiens
cattctggttccctgctgcg

SEQ ID NO: 3575867 - DNA, 18 bp, Homo sapiens
cattctgttttcccccag

SEQ ID NO: 3575868 - DNA, 19 bp, Homo sapiens
cattcttactaaaaagtat

SEQ ID NO: 3575869 - DNA, 21 bp, Homo sapiens
cattcttcctagttttctcct

SEQ ID NO: 3575870 - DNA, 13 bp, Homo sapiens
cattcttggccca

SEQ ID NO: 3575871 - DNA, 16 bp, Homo sapiens
cattcttggcccagga

SEQ ID NO: 3575872 - DNA, 14 bp, Homo sapiens
cattctttactgca

SEQ ID NO: 3575873 - DNA, 18 bp, Homo sapiens
cattctttactgcactca

SEQ ID NO: 3575874 - DNA, 19 bp, Homo sapiens
cattcttttttttatatat

SEQ ID NO: 3575875 - DNA, 12 bp, Homo sapiens
cattgaaataat

SEQ ID NO: 3575876 - DNA, 13 bp, Homo sapiens
cattgaaataata

SEQ ID NO: 3575877 - DNA, 22 bp, Homo sapiens
cattgaagaatgttagagtaat

SEQ ID NO: 3575878 - DNA, 15 bp, Homo sapiens
cattgacagcaattc

SEQ ID NO: 3575879 - DNA, 20 bp, Homo sapiens
cattgactttcagtaaacat

SEQ ID NO: 3575880 - DNA, 19 bp, Homo sapiens
cattgaggaaatattaatt

SEQ ID NO: 3575881 - DNA, 21 bp, Homo sapiens
cattgaggaaatattaatttt

SEQ ID NO: 3575882 - DNA, 20 bp, Homo sapiens
cattgatacaatcatagcat

SEQ ID NO: 3575883 - DNA, 21 bp, Homo sapiens
cattgcacctatctcagccat

SEQ ID NO: 3575884 - DNA, 23 bp, Homo sapiens
cattgcagcctaagaagaaggcc

SEQ ID NO: 3575885 - DNA, 22 bp, Homo sapiens
cattgccgctgtataaagcatg

SEQ ID NO: 3575886 - DNA, 16 bp, Homo sapiens
cattgcctgtaacaat

SEQ ID NO: 3575887 - DNA, 12 bp, Homo sapiens
cattgctgcctt

SEQ ID NO: 3575888 - DNA, 22 bp, Homo sapiens
cattggcaaagtgacaaagcaa

SEQ ID NO: 3575889 - DNA, 21 bp, Homo sapiens
cattggcacctaatccaggca

SEQ ID NO: 3575890 - DNA, 23 bp, Homo sapiens
cattggtacacgtgtaacaagaa

SEQ ID NO: 3575891 - DNA, 16 bp, Homo sapiens
cattggttcacctgtg

SEQ ID NO: 3575892 - DNA, 18 bp, Homo sapiens
cattggttcacctgtgac

SEQ ID NO: 3575893 - DNA, 20 bp, Homo sapiens
cattggttcacctgtgactc

SEQ ID NO: 3575894 - DNA, 22 bp, Homo sapiens
cattgtaaaagcattttgtaat

SEQ ID NO: 3575895 - DNA, 21 bp, Homo sapiens
cattgtaaatgtgcttttaaa

SEQ ID NO: 3575896 - DNA, 15 bp, Homo sapiens
cattgtagagcttct

SEQ ID NO: 3575897 - DNA, 18 bp, Homo sapiens
cattgtccctctgcccca

SEQ ID NO: 3575898 - DNA, 21 bp, Homo sapiens
cattgtccctctgccccatcc

SEQ ID NO: 3575899 - DNA, 13 bp, Homo sapiens
cattgtgtggaat

SEQ ID NO: 3575900 - DNA, 20 bp, Homo sapiens
cattgtttagatgaggctca

SEQ ID NO: 3575901 - DNA, 19 bp, Homo sapiens
catttaaagcttattaaaa

SEQ ID NO: 3575902 - DNA, 18 bp, Homo sapiens
catttaaatggttctgtg

SEQ ID NO: 3575903 - DNA, 20 bp, Homo sapiens
catttaaatgtgtacaatgt

SEQ ID NO: 3575904 - DNA, 22 bp, Homo sapiens
catttaatggggaggacaaaat

SEQ ID NO: 3575905 - DNA, 14 bp, Homo sapiens
catttactatgcac

SEQ ID NO: 3575906 - DNA, 19 bp, Homo sapiens
catttactatgcacaacag

SEQ ID NO: 3575907 - DNA, 22 bp, Homo sapiens
catttagaaaatagagctttta

SEQ ID NO: 3575908 - DNA, 21 bp, Homo sapiens
catttagcattgaaataataa

SEQ ID NO: 3575909 - DNA, 20 bp, Homo sapiens
catttagcttttttatttta

SEQ ID NO: 3575910 - DNA, 15 bp, Homo sapiens
catttagtcatgtga

SEQ ID NO: 3575911 - DNA, 17 bp, Homo sapiens
catttagtcatgtgacc

SEQ ID NO: 3575912 - DNA, 13 bp, Homo sapiens
catttagtgtgaa

SEQ ID NO: 3575913 - DNA, 12 bp, Homo sapiens
catttcagccaa

SEQ ID NO: 3575914 - DNA, 13 bp, Homo sapiens
catttcaggactc

SEQ ID NO: 3575915 - DNA, 22 bp, Homo sapiens
catttcaggactctctccagga

SEQ ID NO: 3575916 - DNA, 19 bp, Homo sapiens
catttcagggtcttggctg

SEQ ID NO: 3575917 - DNA, 15 bp, Homo sapiens
catttcataaactaa

SEQ ID NO: 3575918 - DNA, 23 bp, Homo sapiens
catttcatacaacagaaaccaga

SEQ ID NO: 3575919 - DNA, 13 bp, Homo sapiens
catttcatgaaaa

SEQ ID NO: 3575920 - DNA, 17 bp, Homo sapiens
catttcatgaaaaagct

SEQ ID NO: 3575921 - DNA, 23 bp, Homo sapiens
catttcatgaaaaagctgcttct

SEQ ID NO: 3575922 - DNA, 16 bp, Homo sapiens
catttcatgaagcaag

SEQ ID NO: 3575923 - DNA, 18 bp, Homo sapiens
catttccaagaggctgta

SEQ ID NO: 3575924 - DNA, 23 bp, Homo sapiens
catttcccctctgcacccagaac

SEQ ID NO: 3575925 - DNA, 18 bp, Homo sapiens
catttcctcacactaaga

SEQ ID NO: 3575926 - DNA, 13 bp, Homo sapiens
catttcctgacag

SEQ ID NO: 3575927 - DNA, 15 bp, Homo sapiens
catttctaaaatgtt

SEQ ID NO: 3575928 - DNA, 21 bp, Homo sapiens
catttctatattcctccagct

SEQ ID NO: 3575929 - DNA, 13 bp, Homo sapiens
catttctcatgtt

SEQ ID NO: 3575930 - DNA, 16 bp, Homo sapiens
catttctcatgttgaa

SEQ ID NO: 3575931 - DNA, 11 bp, Homo sapiens
catttctgatt

SEQ ID NO: 3575932 - DNA, 16 bp, Homo sapiens
catttctgattctgat

SEQ ID NO: 3575933 - DNA, 23 bp, Homo sapiens
catttctgcatcagctgctgaaa

SEQ ID NO: 3575934 - DNA, 13 bp, Homo sapiens
ccagtaactgtgc

SEQ ID NO: 3575935 - DNA, 19 bp, Homo sapiens
ccagtagctgggattacag

SEQ ID NO: 3575936 - DNA, 17 bp, Homo sapiens
ccagtattgaaaacttc

SEQ ID NO: 3575937 - DNA, 13 bp, Homo sapiens
ccagtcccacact

SEQ ID NO: 3575938 - DNA, 17 bp, Homo sapiens
ccagtccccccaccctc

SEQ ID NO: 3575939 - DNA, 13 bp, Homo sapiens
ccagtcctccact

SEQ ID NO: 3575940 - DNA, 14 bp, Homo sapiens
ccagtcgaccccaa

SEQ ID NO: 3575941 - DNA, 19 bp, Homo sapiens
ccagtcgaccccaaaggaa

SEQ ID NO: 3575942 - DNA, 16 bp, Homo sapiens
ccagtctcctcactct

SEQ ID NO: 3575943 - DNA, 17 bp, Homo sapiens
ccagtctcctcactctg

SEQ ID NO: 3575944 - DNA, 12 bp, Homo sapiens
ccagtctgaccc

SEQ ID NO: 3575945 - DNA, 13 bp, Homo sapiens
ccagtctgaccct

SEQ ID NO: 3575946 - DNA, 21 bp, Homo sapiens
ccagtctttcttcactctggc

SEQ ID NO: 3575947 - DNA, 22 bp, Homo sapiens
ccagtctttcttcactctggct

SEQ ID NO: 3575948 - DNA, 15 bp, Homo sapiens
ccagtgaagcctctg

SEQ ID NO: 3575949 - DNA, 13 bp, Homo sapiens
ccagtgaagtcct

SEQ ID NO: 3575950 - DNA, 18 bp, Homo sapiens
ccagtgacagtcagggaa

SEQ ID NO: 3575951 - DNA, 10 bp, Homo sapiens
ccagtgactc

SEQ ID NO: 3575952 - DNA, 11 bp, Homo sapiens
ccagtgactcc

SEQ ID NO: 3575953 - DNA, 14 bp, Homo sapiens
ccagtgactccagg

SEQ ID NO: 3575954 - DNA, 18 bp, Homo sapiens
ccagtgagatcaatgtga

SEQ ID NO: 3575955 - DNA, 15 bp, Homo sapiens
ccagtgcagccactg

SEQ ID NO: 3575956 - DNA, 16 bp, Homo sapiens
ccagtgcagccactgg

SEQ ID NO: 3575957 - DNA, 11 bp, Homo sapiens
ccagtgcagtc

SEQ ID NO: 3575958 - DNA, 14 bp, Homo sapiens
ccagtgcccccact

SEQ ID NO: 3575959 - DNA, 18 bp, Homo sapiens
ccagtgcccccactgacc

SEQ ID NO: 3575960 - DNA, 23 bp, Homo sapiens
ccagtgcctgtgagcatggggcc

SEQ ID NO: 3575961 - DNA, 22 bp, Homo sapiens
ccagtggaggagttcatggaag

SEQ ID NO: 3575962 - DNA, 21 bp, Homo sapiens
ccagtggcggcacgtccttgg

SEQ ID NO: 3575963 - DNA, 16 bp, Homo sapiens
ccagtgggaccctctc

SEQ ID NO: 3575964 - DNA, 16 bp, Homo sapiens
ccagtgggtctgggat

SEQ ID NO: 3575965 - DNA, 23 bp, Homo sapiens
ccagtggtgggtaattgtacaat

SEQ ID NO: 3575966 - DNA, 21 bp, Homo sapiens
ccagtgtcagggtccaggaga

SEQ ID NO: 3575967 - DNA, 18 bp, Homo sapiens
ccagtgtgagaccccaaa

SEQ ID NO: 3575968 - DNA, 12 bp, Homo sapiens
ccagtgttagct

SEQ ID NO: 3575969 - DNA, 13 bp, Homo sapiens
ccagtgttcctga

SEQ ID NO: 3575970 - DNA, 14 bp, Homo sapiens
ccagttatggctat

SEQ ID NO: 3575971 - DNA, 21 bp, Homo sapiens
ccagttatggctataggtgct

SEQ ID NO: 3575972 - DNA, 18 bp, Homo sapiens
ccagttctgaataacttg

SEQ ID NO: 3575973 - DNA, 21 bp, Homo sapiens
ccagtttaagccgcagacctg

SEQ ID NO: 3575974 - DNA, 22 bp, Homo sapiens
ccagtttaagccgcagacctgg

SEQ ID NO: 3575975 - DNA, 12 bp, Homo sapiens
ccagttttccct

SEQ ID NO: 3575976 - DNA, 14 bp, Homo sapiens
ccagttttccctgg

SEQ ID NO: 3575977 - DNA, 16 bp, Homo sapiens
ccagttttccctggaa

SEQ ID NO: 3575978 - DNA, 11 bp, Homo sapiens
ccagttttccg

SEQ ID NO: 3575979 - DNA, 13 bp, Homo sapiens
ccagttttccgaa

SEQ ID NO: 3575980 - DNA, 14 bp, Homo sapiens
ccataaaataaata

SEQ ID NO: 3575981 - DNA, 16 bp, Homo sapiens
ccataaacggttcctg

SEQ ID NO: 3575982 - DNA, 17 bp, Homo sapiens
ccataaacggttcctgg

SEQ ID NO: 3575983 - DNA, 13 bp, Homo sapiens
ccataacttgaaa

SEQ ID NO: 3575984 - DNA, 21 bp, Homo sapiens
ccataccttttctcttttctt

SEQ ID NO: 3575985 - DNA, 21 bp, Homo sapiens
ccatagtttgggtatttttgg

SEQ ID NO: 3575986 - DNA, 13 bp, Homo sapiens
ccatatataaatt

SEQ ID NO: 3575987 - DNA, 17 bp, Homo sapiens
ccatatataaattatta

SEQ ID NO: 3575988 - DNA, 21 bp, Homo sapiens
ccatatataaattattacttt

SEQ ID NO: 3575989 - DNA, 23 bp, Homo sapiens
ccatatataaattattactttaa

SEQ ID NO: 3575990 - DNA, 21 bp, Homo sapiens
ccatatggaggactgtgacag

SEQ ID NO: 3575991 - DNA, 15 bp, Homo sapiens
ccatattacctggat

SEQ ID NO: 3575992 - DNA, 21 bp, Homo sapiens
ccatattttattgtattttga

SEQ ID NO: 3575993 - DNA, 22 bp, Homo sapiens
ccatattttattgtattttgat

SEQ ID NO: 3575994 - DNA, 22 bp, Homo sapiens
ccatcaagaacctacagactcc

SEQ ID NO: 3575995 - DNA, 15 bp, Homo sapiens
ccatcatctctgaag

SEQ ID NO: 3575996 - DNA, 13 bp, Homo sapiens
ccatcatgccctc

SEQ ID NO: 3575997 - DNA, 18 bp, Homo sapiens
ccatcatgtgtagagccc

SEQ ID NO: 3575998 - DNA, 19 bp, Homo sapiens
ccatcatgtgtagagcccc

SEQ ID NO: 3575999 - DNA, 18 bp, Homo sapiens
ccatccacttacatatat

SEQ ID NO: 3576000 - DNA, 16 bp, Homo sapiens
ccatccagacctggct

SEQ ID NO: 3576001 - DNA, 12 bp, Homo sapiens
ccatccagccag

SEQ ID NO: 3576002 - DNA, 14 bp, Homo sapiens
ccatccagccagac

SEQ ID NO: 3576003 - DNA, 17 bp, Homo sapiens
ccatccccgcagtgtgc

SEQ ID NO: 3576004 - DNA, 11 bp, Homo sapiens
ccatcccctcc

SEQ ID NO: 3576005 - DNA, 21 bp, Homo sapiens
ccatcccctccctgcctgctc

SEQ ID NO: 3576006 - DNA, 22 bp, Homo sapiens
ccatcccctccctgcctgctcc

SEQ ID NO: 3576007 - DNA, 16 bp, Homo sapiens
ccatccctgcctggag

SEQ ID NO: 3576008 - DNA, 17 bp, Homo sapiens
ccatccctgcctggagg

SEQ ID NO: 3576009 - DNA, 19 bp, Homo sapiens
ccatccctgcctggaggct

SEQ ID NO: 3576010 - DNA, 12 bp, Homo sapiens
ccatccctgctt

SEQ ID NO: 3576011 - DNA, 23 bp, Homo sapiens
ccatccctgcttgcccgctccca

SEQ ID NO: 3576012 - DNA, 17 bp, Homo sapiens
ccatccctttttttaca

SEQ ID NO: 3576013 - DNA, 23 bp, Homo sapiens
ccatccggtttgccatgttgcca

SEQ ID NO: 3576014 - DNA, 17 bp, Homo sapiens
ccatcctcatccctgac

SEQ ID NO: 3576015 - DNA, 13 bp, Homo sapiens
ccatcctccagca

SEQ ID NO: 3576016 - DNA, 15 bp, Homo sapiens
ccatcctggggcagc

SEQ ID NO: 3576017 - DNA, 12 bp, Homo sapiens
ccatctcaggag

SEQ ID NO: 3576018 - DNA, 13 bp, Homo sapiens
ccatctcaggaga

SEQ ID NO: 3576019 - DNA, 14 bp, Homo sapiens
ccatctctgctcca

SEQ ID NO: 3576020 - DNA, 11 bp, Homo sapiens
ccatctgctgc

SEQ ID NO: 3576021 - DNA, 14 bp, Homo sapiens
ccatctgctgcagt

SEQ ID NO: 3576022 - DNA, 20 bp, Homo sapiens
ccatctgctgcagttaccac

SEQ ID NO: 3576023 - DNA, 22 bp, Homo sapiens
ccatctggagagcccagagtcc

SEQ ID NO: 3576024 - DNA, 17 bp, Homo sapiens
ccatcttctttcttcca

SEQ ID NO: 3576025 - DNA, 19 bp, Homo sapiens
ccatctttagcagtttcct

SEQ ID NO: 3576026 - DNA, 21 bp, Homo sapiens
ccatgataataggtcatatgt

SEQ ID NO: 3576027 - DNA, 22 bp, Homo sapiens
ccatgataataggtcatatgtt

SEQ ID NO: 3576028 - DNA, 14 bp, Homo sapiens
ccatgatggcaaca

SEQ ID NO: 3576029 - DNA, 16 bp, Homo sapiens
ccatgatggcaacaga

SEQ ID NO: 3576030 - DNA, 19 bp, Homo sapiens
ccatgatggcaacagatct

SEQ ID NO: 3576031 - DNA, 12 bp, Homo sapiens
ccatgcaactgg

SEQ ID NO: 3576032 - DNA, 16 bp, Homo sapiens
ccatgcatcttccact

SEQ ID NO: 3576033 - DNA, 11 bp, Homo sapiens
ccatgcatttc

SEQ ID NO: 3576034 - DNA, 13 bp, Homo sapiens
ccatgccagagag

SEQ ID NO: 3576035 - DNA, 14 bp, Homo sapiens
ccatgccagagagg

SEQ ID NO: 3576036 - DNA, 13 bp, Homo sapiens
ccatgccccagtc

SEQ ID NO: 3576037 - DNA, 21 bp, Homo sapiens
ccatgctcaacccccctccca

SEQ ID NO: 3576038 - DNA, 19 bp, Homo sapiens
ccatgctgccttcagggag

SEQ ID NO: 3576039 - DNA, 19 bp, Homo sapiens
ccatgctgctggggaagac

SEQ ID NO: 3576040 - DNA, 20 bp, Homo sapiens
ccatgctgctggggaagaca

SEQ ID NO: 3576041 - DNA, 17 bp, Homo sapiens
ccatgctgggccactgg

SEQ ID NO: 3576042 - DNA, 20 bp, Homo sapiens
ccatgctgggccactgggga

SEQ ID NO: 3576043 - DNA, 19 bp, Homo sapiens
ccatgcttgcctgaagctt

SEQ ID NO: 3576044 - DNA, 18 bp, Homo sapiens
ccatggccggctttcagg

SEQ ID NO: 3576045 - DNA, 21 bp, Homo sapiens
ccatggccggctttcaggagc

SEQ ID NO: 3576046 - DNA, 21 bp, Homo sapiens
ccatgggaaatgtcaacaagt

SEQ ID NO: 3576047 - DNA, 20 bp, Homo sapiens
ccatggtactgtagcagggg

SEQ ID NO: 3576048 - DNA, 23 bp, Homo sapiens
ccatggtgaaagggtttgatatg

SEQ ID NO: 3576049 - DNA, 20 bp, Homo sapiens
ccatgtaaatactttccatg

SEQ ID NO: 3576050 - DNA, 12 bp, Homo sapiens
ccatgtcgcctc

SEQ ID NO: 3576051 - DNA, 13 bp, Homo sapiens
ccatgtctgcatt

SEQ ID NO: 3576052 - DNA, 15 bp, Homo sapiens
ccatgtgcctttctt

SEQ ID NO: 3576053 - DNA, 18 bp, Homo sapiens
ccatgtgcctttctttgc

SEQ ID NO: 3576054 - DNA, 21 bp, Homo sapiens
ccatgtggggttgctgaagat

SEQ ID NO: 3576055 - DNA, 23 bp, Homo sapiens
ccatgtgtctttacacctcgctg

SEQ ID NO: 3576056 - DNA, 17 bp, Homo sapiens
ccatgttgtaatgctgc

SEQ ID NO: 3576057 - DNA, 22 bp, Homo sapiens
ccatgttgtaatgctgcacttc

SEQ ID NO: 3576058 - DNA, 20 bp, Homo sapiens
ccattaaaaagttgttcttt

SEQ ID NO: 3576059 - DNA, 15 bp, Homo sapiens
ccattatatttattg

SEQ ID NO: 3576060 - DNA, 23 bp, Homo sapiens
ccattatgactgttgttcttata

SEQ ID NO: 3576061 - DNA, 16 bp, Homo sapiens
ccattcacaagcctcc

SEQ ID NO: 3576062 - DNA, 17 bp, Homo sapiens
ccattcacaagcctcct

SEQ ID NO: 3576063 - DNA, 11 bp, Homo sapiens
ccattcccagc

SEQ ID NO: 3576064 - DNA, 18 bp, Homo sapiens
ccattccctccatttttc

SEQ ID NO: 3576065 - DNA, 16 bp, Homo sapiens
ccattcctgaagaacc

SEQ ID NO: 3576066 - DNA, 11 bp, Homo sapiens
ccattccttca

SEQ ID NO: 3576067 - DNA, 18 bp, Homo sapiens
ccctcacacacacccccc

SEQ ID NO: 3576068 - DNA, 22 bp, Homo sapiens
ccctcacacacacccccccaca

SEQ ID NO: 3576069 - DNA, 11 bp, Homo sapiens
ccctcacccat

SEQ ID NO: 3576070 - DNA, 21 bp, Homo sapiens
ccctcacctgtagcagccagt

SEQ ID NO: 3576071 - DNA, 16 bp, Homo sapiens
ccctcactccccaggg

SEQ ID NO: 3576072 - DNA, 13 bp, Homo sapiens
ccctcagagccac

SEQ ID NO: 3576073 - DNA, 15 bp, Homo sapiens
ccctcagagtgcaag

SEQ ID NO: 3576074 - DNA, 20 bp, Homo sapiens
ccctcagccccaccccaggt

SEQ ID NO: 3576075 - DNA, 21 bp, Homo sapiens
ccctcaggaattcagtgcctt

SEQ ID NO: 3576076 - DNA, 16 bp, Homo sapiens
ccctcaggcacacctt

SEQ ID NO: 3576077 - DNA, 15 bp, Homo sapiens
ccctcattctcattt

SEQ ID NO: 3576078 - DNA, 15 bp, Homo sapiens
ccctccaaacctcca

SEQ ID NO: 3576079 - DNA, 24 bp, Homo sapiens
ccctccaaacctccagcctccctg

SEQ ID NO: 3576080 - DNA, 20 bp, Homo sapiens
ccctccaaaggaactctaga

SEQ ID NO: 3576081 - DNA, 14 bp, Homo sapiens
ccctccaccccaca

SEQ ID NO: 3576082 - DNA, 22 bp, Homo sapiens
ccctccaccccccactcagtgc

SEQ ID NO: 3576083 - DNA, 19 bp, Homo sapiens
ccctccaggagagagccag

SEQ ID NO: 3576084 - DNA, 23 bp, Homo sapiens
ccctccaggagagagccaggatg

SEQ ID NO: 3576085 - DNA, 16 bp, Homo sapiens
ccctccagttttgcct

SEQ ID NO: 3576086 - DNA, 14 bp, Homo sapiens
ccctccatccaccc

SEQ ID NO: 3576087 - DNA, 12 bp, Homo sapiens
ccctcccagaca

SEQ ID NO: 3576088 - DNA, 21 bp, Homo sapiens
ccctcccagacaggccctccc

SEQ ID NO: 3576089 - DNA, 16 bp, Homo sapiens
ccctccccagccagcc

SEQ ID NO: 3576090 - DNA, 20 bp, Homo sapiens
ccctccccagccagcccttc

SEQ ID NO: 3576091 - DNA, 15 bp, Homo sapiens
ccctcccccagccac

SEQ ID NO: 3576092 - DNA, 21 bp, Homo sapiens
ccctcccccattccctccatt

SEQ ID NO: 3576093 - DNA, 13 bp, Homo sapiens
ccctccccctcct

SEQ ID NO: 3576094 - DNA, 12 bp, Homo sapiens
ccctcccctggg

SEQ ID NO: 3576095 - DNA, 22 bp, Homo sapiens
ccctccccttcgtgtttccccc

SEQ ID NO: 3576096 - DNA, 16 bp, Homo sapiens
ccctccctgcctgctc

SEQ ID NO: 3576097 - DNA, 23 bp, Homo sapiens
ccctccctgtctccagggccccc

SEQ ID NO: 3576098 - DNA, 14 bp, Homo sapiens
ccctcccttcaacc

SEQ ID NO: 3576099 - DNA, 13 bp, Homo sapiens
ccctcctcagctc

SEQ ID NO: 3576100 - DNA, 21 bp, Homo sapiens
ccctcctcagggatcacactg

SEQ ID NO: 3576101 - DNA, 20 bp, Homo sapiens
ccctcctccaggtcggagtg

SEQ ID NO: 3576102 - DNA, 13 bp, Homo sapiens
ccctcctctgctg

SEQ ID NO: 3576103 - DNA, 15 bp, Homo sapiens
ccctcctctgctggg

SEQ ID NO: 3576104 - DNA, 19 bp, Homo sapiens
ccctcctgagtgccccact

SEQ ID NO: 3576105 - DNA, 12 bp, Homo sapiens
ccctccttgtct

SEQ ID NO: 3576106 - DNA, 15 bp, Homo sapiens
ccctcgagagcctta

SEQ ID NO: 3576107 - DNA, 19 bp, Homo sapiens
ccctcgggccccatcctca

SEQ ID NO: 3576108 - DNA, 17 bp, Homo sapiens
ccctctagtgccttctt

SEQ ID NO: 3576109 - DNA, 12 bp, Homo sapiens
ccctctatttat

SEQ ID NO: 3576110 - DNA, 16 bp, Homo sapiens
ccctctcgccccatcc

SEQ ID NO: 3576111 - DNA, 22 bp, Homo sapiens
ccctctcgccccatccctgctt

SEQ ID NO: 3576112 - DNA, 16 bp, Homo sapiens
ccctctgcacccagaa

SEQ ID NO: 3576113 - DNA, 23 bp, Homo sapiens
ccctctgccggtcgggcagccag

SEQ ID NO: 3576114 - DNA, 19 bp, Homo sapiens
ccctctggagaaggcctgg

SEQ ID NO: 3576115 - DNA, 23 bp, Homo sapiens
ccctctggagaaggcctggaaga

SEQ ID NO: 3576116 - DNA, 22 bp, Homo sapiens
ccctctggagtggccactaagc

SEQ ID NO: 3576117 - DNA, 17 bp, Homo sapiens
ccctctgggggtcctct

SEQ ID NO: 3576118 - DNA, 19 bp, Homo sapiens
ccctctgggggtcctctct

SEQ ID NO: 3576119 - DNA, 21 bp, Homo sapiens
ccctctgggggtcctctctga

SEQ ID NO: 3576120 - DNA, 12 bp, Homo sapiens
ccctctggtgtg

SEQ ID NO: 3576121 - DNA, 20 bp, Homo sapiens
ccctcttgtccctttcccta

SEQ ID NO: 3576122 - DNA, 12 bp, Homo sapiens
ccctctttccct

SEQ ID NO: 3576123 - DNA, 16 bp, Homo sapiens
ccctctttccctgcga

SEQ ID NO: 3576124 - DNA, 18 bp, Homo sapiens
ccctctttcgtctactgc

SEQ ID NO: 3576125 - DNA, 17 bp, Homo sapiens
ccctgaacgccctggta

SEQ ID NO: 3576126 - DNA, 20 bp, Homo sapiens
ccctgacctaccccagccag

SEQ ID NO: 3576127 - DNA, 22 bp, Homo sapiens
ccctgacctccgcccctgcccc

SEQ ID NO: 3576128 - DNA, 20 bp, Homo sapiens
ccctgactgggggcagacat

SEQ ID NO: 3576129 - DNA, 16 bp, Homo sapiens
ccctgagccagcaggg

SEQ ID NO: 3576130 - DNA, 16 bp, Homo sapiens
ccctgaggtcactgct

SEQ ID NO: 3576131 - DNA, 17 bp, Homo sapiens
ccctgaggtcactgcta

SEQ ID NO: 3576132 - DNA, 9 bp, Homo sapiens
ccctgcaat

SEQ ID NO: 3576133 - DNA, 23 bp, Homo sapiens
ccctgcaccatgctgctggggaa

SEQ ID NO: 3576134 - DNA, 13 bp, Homo sapiens
ccctgcagcccag

SEQ ID NO: 3576135 - DNA, 15 bp, Homo sapiens
ccctgcagcccaggc

SEQ ID NO: 3576136 - DNA, 21 bp, Homo sapiens
ccctgcagcccaggccagtca

SEQ ID NO: 3576137 - DNA, 22 bp, Homo sapiens
ccctgcagggccatctgactgc

SEQ ID NO: 3576138 - DNA, 14 bp, Homo sapiens
ccctgcagggccgg

SEQ ID NO: 3576139 - DNA, 16 bp, Homo sapiens
ccctgcatctgaccag

SEQ ID NO: 3576140 - DNA, 21 bp, Homo sapiens
ccctgcatctgaccagcagcg

SEQ ID NO: 3576141 - DNA, 22 bp, Homo sapiens
ccctgccagtgaagtccttcag

SEQ ID NO: 3576142 - DNA, 20 bp, Homo sapiens
ccctgcccaaacccttaact

SEQ ID NO: 3576143 - DNA, 16 bp, Homo sapiens
ccctgccccaccccac

SEQ ID NO: 3576144 - DNA, 23 bp, Homo sapiens
ccctgccccaccccacctcacag

SEQ ID NO: 3576145 - DNA, 17 bp, Homo sapiens
ccctgcccctcccttca

SEQ ID NO: 3576146 - DNA, 18 bp, Homo sapiens
ccctgcccctcccttcaa

SEQ ID NO: 3576147 - DNA, 23 bp, Homo sapiens
ccctgcctcaggccaagggacca

SEQ ID NO: 3576148 - DNA, 23 bp, Homo sapiens
ccctgcctggaggctcctctagg

SEQ ID NO: 3576149 - DNA, 23 bp, Homo sapiens
ccctgcctgtgcccgcatgtgtg

SEQ ID NO: 3576150 - DNA, 14 bp, Homo sapiens
ccctgcggcctcca

SEQ ID NO: 3576151 - DNA, 13 bp, Homo sapiens
ccctgctacctgt

SEQ ID NO: 3576152 - DNA, 14 bp, Homo sapiens
ccctgctccaccag

SEQ ID NO: 3576153 - DNA, 17 bp, Homo sapiens
ccctgctgaatgcctcg

SEQ ID NO: 3576154 - DNA, 10 bp, Homo sapiens
ccctgctgcg

SEQ ID NO: 3576155 - DNA, 17 bp, Homo sapiens
ccctgctgcgctgcttg

SEQ ID NO: 3576156 - DNA, 17 bp, Homo sapiens
ccctgctgtgccatgct

SEQ ID NO: 3576157 - DNA, 18 bp, Homo sapiens
ccctgctgtgctgctcaa

SEQ ID NO: 3576158 - DNA, 19 bp, Homo sapiens
ccctgctttggcggcccgg

SEQ ID NO: 3576159 - DNA, 22 bp, Homo sapiens
ccctggaaaccttccacccagt

SEQ ID NO: 3576160 - DNA, 19 bp, Homo sapiens
ccctggaagctctccgagc

SEQ ID NO: 3576161 - DNA, 14 bp, Homo sapiens
ccctggacacagct

SEQ ID NO: 3576162 - DNA, 16 bp, Homo sapiens
ccctggacacagctct

SEQ ID NO: 3576163 - DNA, 19 bp, Homo sapiens
ccctggacacagctcttca

SEQ ID NO: 3576164 - DNA, 20 bp, Homo sapiens
ccctggacacagctcttcat

SEQ ID NO: 3576165 - DNA, 14 bp, Homo sapiens
ccctggagcaggag

SEQ ID NO: 3576166 - DNA, 18 bp, Homo sapiens
ccctggaggtctccaggg

SEQ ID NO: 3576167 - DNA, 21 bp, Homo sapiens
ccctggaggtctccaggggcc

SEQ ID NO: 3576168 - DNA, 13 bp, Homo sapiens
ccctggaggtggc

SEQ ID NO: 3576169 - DNA, 19 bp, Homo sapiens
ccctggatccatcaggcca

SEQ ID NO: 3576170 - DNA, 11 bp, Homo sapiens
ccctggcaccc

SEQ ID NO: 3576171 - DNA, 22 bp, Homo sapiens
ccctggccactaaagcttcaga

SEQ ID NO: 3576172 - DNA, 14 bp, Homo sapiens
ccctggccccgccg

SEQ ID NO: 3576173 - DNA, 18 bp, Homo sapiens
ccctggcctgaactgagg

SEQ ID NO: 3576174 - DNA, 20 bp, Homo sapiens
ccctggcctgaactgaggag

SEQ ID NO: 3576175 - DNA, 19 bp, Homo sapiens
ccctggcttttcactgctg

SEQ ID NO: 3576176 - DNA, 17 bp, Homo sapiens
ccctgggctattgctgc

SEQ ID NO: 3576177 - DNA, 13 bp, Homo sapiens
ccctgggggtctg

SEQ ID NO: 3576178 - DNA, 15 bp, Homo sapiens
ccctgggtctgggga

SEQ ID NO: 3576179 - DNA, 20 bp, Homo sapiens
ccctgggtttgggagccagg

SEQ ID NO: 3576180 - DNA, 14 bp, Homo sapiens
ccctggtctgtgga

SEQ ID NO: 3576181 - DNA, 18 bp, Homo sapiens
ccctggtctgtggagatg

SEQ ID NO: 3576182 - DNA, 16 bp, Homo sapiens
ccctggtgctgccaca

SEQ ID NO: 3576183 - DNA, 16 bp, Homo sapiens
ccctggtgggccaaca

SEQ ID NO: 3576184 - DNA, 23 bp, Homo sapiens
ccctggtgggccaacaaagaaca

SEQ ID NO: 3576185 - DNA, 16 bp, Homo sapiens
ccctggtggttgctgt

SEQ ID NO: 3576186 - DNA, 16 bp, Homo sapiens
ccctggttagctgaca

SEQ ID NO: 3576187 - DNA, 18 bp, Homo sapiens
ccctgtcacccacagacc

SEQ ID NO: 3576188 - DNA, 22 bp, Homo sapiens
ccctgtcccacccacacagctg

SEQ ID NO: 3576189 - DNA, 14 bp, Homo sapiens
ccctgtcctgcagt

SEQ ID NO: 3576190 - DNA, 16 bp, Homo sapiens
ccctgtctagagaggg

SEQ ID NO: 3576191 - DNA, 20 bp, Homo sapiens
ccctgtctagagagggaggc

SEQ ID NO: 3576192 - DNA, 14 bp, Homo sapiens
ccctgtctccagct

SEQ ID NO: 3576193 - DNA, 18 bp, Homo sapiens
ccctgtctccagctgcct

SEQ ID NO: 3576194 - DNA, 19 bp, Homo sapiens
ccctgtctccagctgcctg

SEQ ID NO: 3576195 - DNA, 22 bp, Homo sapiens
ccctgtctccagctgcctgggc

SEQ ID NO: 3576196 - DNA, 18 bp, Homo sapiens
ccctgtggccctggccac

SEQ ID NO: 3576197 - DNA, 19 bp, Homo sapiens
ccctgtgtcctccaccatg

SEQ ID NO: 3576198 - DNA, 19 bp, Homo sapiens
ccctgttcagctactccca

SEQ ID NO: 3576199 - DNA, 13 bp, Homo sapiens
cctctccactgcc

SEQ ID NO: 3576200 - DNA, 16 bp, Homo sapiens
cctctccactgccttc

SEQ ID NO: 3576201 - DNA, 19 bp, Homo sapiens
cctctccactgccttcgat

SEQ ID NO: 3576202 - DNA, 22 bp, Homo sapiens
cctctccagcaggcccatggga

SEQ ID NO: 3576203 - DNA, 14 bp, Homo sapiens
cctctccaggcctg

SEQ ID NO: 3576204 - DNA, 15 bp, Homo sapiens
cctctccaggcctgt

SEQ ID NO: 3576205 - DNA, 19 bp, Homo sapiens
cctctcccattgtccctct

SEQ ID NO: 3576206 - DNA, 12 bp, Homo sapiens
cctctccccagc

SEQ ID NO: 3576207 - DNA, 14 bp, Homo sapiens
cctctccccagccc

SEQ ID NO: 3576208 - DNA, 18 bp, Homo sapiens
cctctcctcatgttctgc

SEQ ID NO: 3576209 - DNA, 13 bp, Homo sapiens
cctctcctgaccc

SEQ ID NO: 3576210 - DNA, 16 bp, Homo sapiens
cctctcctgacccctg

SEQ ID NO: 3576211 - DNA, 15 bp, Homo sapiens
cctctccttcctgtg

SEQ ID NO: 3576212 - DNA, 13 bp, Homo sapiens
cctctccttttga

SEQ ID NO: 3576213 - DNA, 16 bp, Homo sapiens
cctctcgccccatccc

SEQ ID NO: 3576214 - DNA, 13 bp, Homo sapiens
cctctctgagtca

SEQ ID NO: 3576215 - DNA, 16 bp, Homo sapiens
cctctctgagtcaaat

SEQ ID NO: 3576216 - DNA, 19 bp, Homo sapiens
cctctctgagtcaaatcca

SEQ ID NO: 3576217 - DNA, 20 bp, Homo sapiens
cctctctgagtcaaatccag

SEQ ID NO: 3576218 - DNA, 15 bp, Homo sapiens
cctctcttccccttc

SEQ ID NO: 3576219 - DNA, 17 bp, Homo sapiens
cctctgacagtccacag

SEQ ID NO: 3576220 - DNA, 13 bp, Homo sapiens
cctctgcacgctc

SEQ ID NO: 3576221 - DNA, 13 bp, Homo sapiens
cctctgcagtctc

SEQ ID NO: 3576222 - DNA, 14 bp, Homo sapiens
cctctgcagtctca

SEQ ID NO: 3576223 - DNA, 19 bp, Homo sapiens
cctctgcagtctcatttct

SEQ ID NO: 3576224 - DNA, 22 bp, Homo sapiens
cctctgccaaaggatgtgatat

SEQ ID NO: 3576225 - DNA, 14 bp, Homo sapiens
cctctgccagcgcc

SEQ ID NO: 3576226 - DNA, 22 bp, Homo sapiens
cctctgccccatcctccagcag

SEQ ID NO: 3576227 - DNA, 13 bp, Homo sapiens
cctctgccctgga

SEQ ID NO: 3576228 - DNA, 12 bp, Homo sapiens
cctctgcctggg

SEQ ID NO: 3576229 - DNA, 13 bp, Homo sapiens
cctctgcctgggc

SEQ ID NO: 3576230 - DNA, 14 bp, Homo sapiens
cctctgcctgggct

SEQ ID NO: 3576231 - DNA, 12 bp, Homo sapiens
cctctgctgccg

SEQ ID NO: 3576232 - DNA, 13 bp, Homo sapiens
cctctgctgccgg

SEQ ID NO: 3576233 - DNA, 19 bp, Homo sapiens
cctctgctgccggctctgg

SEQ ID NO: 3576234 - DNA, 17 bp, Homo sapiens
cctctggagaaggcctg

SEQ ID NO: 3576235 - DNA, 20 bp, Homo sapiens
cctctggagaaggcctggaa

SEQ ID NO: 3576236 - DNA, 14 bp, Homo sapiens
cctctgggggtcct

SEQ ID NO: 3576237 - DNA, 23 bp, Homo sapiens
cctctgggggtcctctctgagtc

SEQ ID NO: 3576238 - DNA, 20 bp, Homo sapiens
cctctgggtccttggctccc

SEQ ID NO: 3576239 - DNA, 22 bp, Homo sapiens
cctctggtaaacattcctccag

SEQ ID NO: 3576240 - DNA, 19 bp, Homo sapiens
cctctggtgtgtggtgagg

SEQ ID NO: 3576241 - DNA, 17 bp, Homo sapiens
cctctgtctgagacagg

SEQ ID NO: 3576242 - DNA, 22 bp, Homo sapiens
cctctgtctgagacaggtgcct

SEQ ID NO: 3576243 - DNA, 18 bp, Homo sapiens
cctctgtggtcacccatg

SEQ ID NO: 3576244 - DNA, 20 bp, Homo sapiens
cctcttaccagtatttaact

SEQ ID NO: 3576245 - DNA, 19 bp, Homo sapiens
cctcttcctccctcattcc

SEQ ID NO: 3576246 - DNA, 21 bp, Homo sapiens
cctcttctgctcttttcctgg

SEQ ID NO: 3576247 - DNA, 15 bp, Homo sapiens
cctcttgagagaaac

SEQ ID NO: 3576248 - DNA, 15 bp, Homo sapiens
cctcttggccatcct

SEQ ID NO: 3576249 - DNA, 16 bp, Homo sapiens
cctctttcgtctactg

SEQ ID NO: 3576250 - DNA, 21 bp, Homo sapiens
cctctttgacatttttgccaa

SEQ ID NO: 3576251 - DNA, 21 bp, Homo sapiens
cctctttgctttgctttctgc

SEQ ID NO: 3576252 - DNA, 12 bp, Homo sapiens
cctcttttcctg

SEQ ID NO: 3576253 - DNA, 19 bp, Homo sapiens
cctcttttcctggcagctg

SEQ ID NO: 3576254 - DNA, 15 bp, Homo sapiens
cctgaaatttcagat

SEQ ID NO: 3576255 - DNA, 13 bp, Homo sapiens
cctgaactgagga

SEQ ID NO: 3576256 - DNA, 13 bp, Homo sapiens
cctgaagaaccag

SEQ ID NO: 3576257 - DNA, 13 bp, Homo sapiens
cctgaagctgctg

SEQ ID NO: 3576258 - DNA, 17 bp, Homo sapiens
cctgaagctgctgtgtc

SEQ ID NO: 3576259 - DNA, 14 bp, Homo sapiens
cctgaaggggcgtc

SEQ ID NO: 3576260 - DNA, 20 bp, Homo sapiens
cctgaagggtgcctagttga

SEQ ID NO: 3576261 - DNA, 17 bp, Homo sapiens
cctgaagtgacctcact

SEQ ID NO: 3576262 - DNA, 21 bp, Homo sapiens
cctgaagtgacctcactggcc

SEQ ID NO: 3576263 - DNA, 23 bp, Homo sapiens
cctgaagtgacctcactggcctg

SEQ ID NO: 3576264 - DNA, 14 bp, Homo sapiens
cctgaatcagctgg

SEQ ID NO: 3576265 - DNA, 15 bp, Homo sapiens
cctgaatcagctgga

SEQ ID NO: 3576266 - DNA, 19 bp, Homo sapiens
cctgaatctgtgcaaacag

SEQ ID NO: 3576267 - DNA, 18 bp, Homo sapiens
cctgaatttcttcttttc

SEQ ID NO: 3576268 - DNA, 15 bp, Homo sapiens
cctgacacaccaggc

SEQ ID NO: 3576269 - DNA, 13 bp, Homo sapiens
cctgacaccccct

SEQ ID NO: 3576270 - DNA, 16 bp, Homo sapiens
cctgacaccccctccc

SEQ ID NO: 3576271 - DNA, 15 bp, Homo sapiens
cctgacagccttccc

SEQ ID NO: 3576272 - DNA, 15 bp, Homo sapiens
cctgacctaccccag

SEQ ID NO: 3576273 - DNA, 16 bp, Homo sapiens
cctgacctaccccagc

SEQ ID NO: 3576274 - DNA, 17 bp, Homo sapiens
cctgacctaccccagcc

SEQ ID NO: 3576275 - DNA, 22 bp, Homo sapiens
cctgacctaccccagccaggct

SEQ ID NO: 3576276 - DNA, 17 bp, Homo sapiens
cctgactagaactcctg

SEQ ID NO: 3576277 - DNA, 21 bp, Homo sapiens
cctgactagaactcctgtctt

SEQ ID NO: 3576278 - DNA, 17 bp, Homo sapiens
cctgactcaattatttg

SEQ ID NO: 3576279 - DNA, 21 bp, Homo sapiens
cctgacttcagtgaatatttt

SEQ ID NO: 3576280 - DNA, 14 bp, Homo sapiens
cctgagagcatctc

SEQ ID NO: 3576281 - DNA, 16 bp, Homo sapiens
cctgagagcatctcag

SEQ ID NO: 3576282 - DNA, 22 bp, Homo sapiens
cctgagagcatctcaggagggg

SEQ ID NO: 3576283 - DNA, 12 bp, Homo sapiens
cctgagcagggt

SEQ ID NO: 3576284 - DNA, 13 bp, Homo sapiens
cctgagcagggtc

SEQ ID NO: 3576285 - DNA, 16 bp, Homo sapiens
cctgagcagggtccac

SEQ ID NO: 3576286 - DNA, 20 bp, Homo sapiens
cctgagcagggtccacagct

SEQ ID NO: 3576287 - DNA, 21 bp, Homo sapiens
cctgagcagggtccacagctg

SEQ ID NO: 3576288 - DNA, 15 bp, Homo sapiens
cctgagcggcaccct

SEQ ID NO: 3576289 - DNA, 14 bp, Homo sapiens
cctgagctggcctg

SEQ ID NO: 3576290 - DNA, 15 bp, Homo sapiens
cctgagctggcctgt

SEQ ID NO: 3576291 - DNA, 15 bp, Homo sapiens
cctgagctggggaag

SEQ ID NO: 3576292 - DNA, 16 bp, Homo sapiens
cctgagggtccacctg

SEQ ID NO: 3576293 - DNA, 21 bp, Homo sapiens
cctgagggtccacctggagag

SEQ ID NO: 3576294 - DNA, 24 bp, Homo sapiens
cctgagtgtcatgaagtgcacagg

SEQ ID NO: 3576295 - DNA, 23 bp, Homo sapiens
cctgataccattctattctccag

SEQ ID NO: 3576296 - DNA, 15 bp, Homo sapiens
cctgatcccaccccc

SEQ ID NO: 3576297 - DNA, 21 bp, Homo sapiens
cctgatcccaccccctcctcc

SEQ ID NO: 3576298 - DNA, 20 bp, Homo sapiens
cctgatcctggaggcccagt

SEQ ID NO: 3576299 - DNA, 13 bp, Homo sapiens
cctgatgtagctt

SEQ ID NO: 3576300 - DNA, 20 bp, Homo sapiens
cctgatgttttgccgtggct

SEQ ID NO: 3576301 - DNA, 18 bp, Homo sapiens
cctgatttaggagaagcc

SEQ ID NO: 3576302 - DNA, 19 bp, Homo sapiens
cctgatttaggagaagcca

SEQ ID NO: 3576303 - DNA, 20 bp, Homo sapiens
cctgatttaggagaagccag

SEQ ID NO: 3576304 - DNA, 21 bp, Homo sapiens
cctgatttaggagaagccagg

SEQ ID NO: 3576305 - DNA, 16 bp, Homo sapiens
cctgatttcattcctc

SEQ ID NO: 3576306 - DNA, 20 bp, Homo sapiens
cctgatttctacaactggag

SEQ ID NO: 3576307 - DNA, 19 bp, Homo sapiens
cctgcaaaactccaggcag

SEQ ID NO: 3576308 - DNA, 21 bp, Homo sapiens
cctgcaaaactccaggcagga

SEQ ID NO: 3576309 - DNA, 19 bp, Homo sapiens
cctgcaacttccgctgagg

SEQ ID NO: 3576310 - DNA, 18 bp, Homo sapiens
cctgcaagaccacggagg

SEQ ID NO: 3576311 - DNA, 17 bp, Homo sapiens
cctgcaagtcagtccag

SEQ ID NO: 3576312 - DNA, 23 bp, Homo sapiens
cctgcacaaagcccttccatgtc

SEQ ID NO: 3576313 - DNA, 12 bp, Homo sapiens
cctgcacacagg

SEQ ID NO: 3576314 - DNA, 13 bp, Homo sapiens
cctgcacacaggg

SEQ ID NO: 3576315 - DNA, 17 bp, Homo sapiens
cctgcagaaggaaagaa

SEQ ID NO: 3576316 - DNA, 12 bp, Homo sapiens
cctgcagcaggc

SEQ ID NO: 3576317 - DNA, 12 bp, Homo sapiens
cctgcagcccag

SEQ ID NO: 3576318 - DNA, 15 bp, Homo sapiens
cctgcagcccaggcc

SEQ ID NO: 3576319 - DNA, 16 bp, Homo sapiens
cctgcagcctgcagga

SEQ ID NO: 3576320 - DNA, 16 bp, Homo sapiens
cctgcaggccaggcca

SEQ ID NO: 3576321 - DNA, 15 bp, Homo sapiens
cctgcagggccaagc

SEQ ID NO: 3576322 - DNA, 21 bp, Homo sapiens
cctgcagggccatctgactgc

SEQ ID NO: 3576323 - DNA, 19 bp, Homo sapiens
cctgcagggccgggcaggg

SEQ ID NO: 3576324 - DNA, 20 bp, Homo sapiens
cctgcagtactttacctcct

SEQ ID NO: 3576325 - DNA, 21 bp, Homo sapiens
cctgcagtcccacactgtgca

SEQ ID NO: 3576326 - DNA, 22 bp, Homo sapiens
cctgcagtcccacactgtgcag

SEQ ID NO: 3576327 - DNA, 21 bp, Homo sapiens
cctgcagtctggctgagccct

SEQ ID NO: 3576328 - DNA, 16 bp, Homo sapiens
cctgccaaggagcatc

SEQ ID NO: 3576329 - DNA, 20 bp, Homo sapiens
cctgccaaggagcatccttg

SEQ ID NO: 3576330 - DNA, 18 bp, Homo sapiens
cctgccacccagccccag

SEQ ID NO: 3576331 - DNA, 21 bp, Homo sapiens
cctgccacccccttccctggg

SEQ ID NO: 3576332 - DNA, 17 bp, Homo sapiens
cgactggtccagctctg

SEQ ID NO: 3576333 - DNA, 13 bp, Homo sapiens
cgagaccagcctg

SEQ ID NO: 3576334 - DNA, 17 bp, Homo sapiens
cgagaccatcctggcca

SEQ ID NO: 3576335 - DNA, 19 bp, Homo sapiens
cgagagtcagactgataga

SEQ ID NO: 3576336 - DNA, 13 bp, Homo sapiens
cgagcagcccagg

SEQ ID NO: 3576337 - DNA, 14 bp, Homo sapiens
cgagcagcccaggg

SEQ ID NO: 3576338 - DNA, 20 bp, Homo sapiens
cgagccaccatgcttgcctg

SEQ ID NO: 3576339 - DNA, 16 bp, Homo sapiens
cgagcccaggcagcta

SEQ ID NO: 3576340 - DNA, 15 bp, Homo sapiens
cgagcctccagtcca

SEQ ID NO: 3576341 - DNA, 14 bp, Homo sapiens
cgagctctggtgct

SEQ ID NO: 3576342 - DNA, 18 bp, Homo sapiens
cgaggaaaggattttacc

SEQ ID NO: 3576343 - DNA, 15 bp, Homo sapiens
cgagggatgatgagg

SEQ ID NO: 3576344 - DNA, 15 bp, Homo sapiens
cgaggggcagggaag

SEQ ID NO: 3576345 - DNA, 19 bp, Homo sapiens
cgagggtctcccctcctgc

SEQ ID NO: 3576346 - DNA, 21 bp, Homo sapiens
cgagggtctcccctcctgcac

SEQ ID NO: 3576347 - DNA, 21 bp, Homo sapiens
cgaggttcccagggctggaga

SEQ ID NO: 3576348 - DNA, 22 bp, Homo sapiens
cgagtgcactgcattcctgtgc

SEQ ID NO: 3576349 - DNA, 12 bp, Homo sapiens
cgatgcgtgtgt

SEQ ID NO: 3576350 - DNA, 20 bp, Homo sapiens
cgatggggcaagacagaaaa

SEQ ID NO: 3576351 - DNA, 17 bp, Homo sapiens
cgatgtgtctcccagaa

SEQ ID NO: 3576352 - DNA, 19 bp, Homo sapiens
cgatgtgtctcccagaact

SEQ ID NO: 3576353 - DNA, 21 bp, Homo sapiens
cgattgcaggagtccctgcca

SEQ ID NO: 3576354 - DNA, 19 bp, Homo sapiens
cgattgtgtacttttcctt

SEQ ID NO: 3576355 - DNA, 13 bp, Homo sapiens
cgcactctggcag

SEQ ID NO: 3576356 - DNA, 11 bp, Homo sapiens
cgcagacctgg

SEQ ID NO: 3576357 - DNA, 24 bp, Homo sapiens
cgcagccctgctttgggctgccct

SEQ ID NO: 3576358 - DNA, 12 bp, Homo sapiens
cgcagctgccta

SEQ ID NO: 3576359 - DNA, 18 bp, Homo sapiens
cgcaggcacagcagctgc

SEQ ID NO: 3576360 - DNA, 16 bp, Homo sapiens
cgcaggcagcgcaggg

SEQ ID NO: 3576361 - DNA, 21 bp, Homo sapiens
cgcaggcagcgcagggctggc

SEQ ID NO: 3576362 - DNA, 15 bp, Homo sapiens
cgcagggctggcacg

SEQ ID NO: 3576363 - DNA, 22 bp, Homo sapiens
cgcagggctggcacgtgacagg

SEQ ID NO: 3576364 - DNA, 13 bp, Homo sapiens
cgcaggtgctcat

SEQ ID NO: 3576365 - DNA, 17 bp, Homo sapiens
cgcagtgtgcactaagg

SEQ ID NO: 3576366 - DNA, 22 bp, Homo sapiens
cgcagtgtgcactaaggggccc

SEQ ID NO: 3576367 - DNA, 16 bp, Homo sapiens
cgcagttgtagcagaa

SEQ ID NO: 3576368 - DNA, 19 bp, Homo sapiens
cgcagttgtagcagaaacc

SEQ ID NO: 3576369 - DNA, 16 bp, Homo sapiens
cgccaatccatgctct

SEQ ID NO: 3576370 - DNA, 19 bp, Homo sapiens
cgccacaaaaatagagaaa

SEQ ID NO: 3576371 - DNA, 16 bp, Homo sapiens
cgccacggcctggctg

SEQ ID NO: 3576372 - DNA, 21 bp, Homo sapiens
cgccacgtcccagcatccctg

SEQ ID NO: 3576373 - DNA, 22 bp, Homo sapiens
cgccagctcaccccatcatccc

SEQ ID NO: 3576374 - DNA, 12 bp, Homo sapiens
cgccagggctgg

SEQ ID NO: 3576375 - DNA, 16 bp, Homo sapiens
cgccagggctggggac

SEQ ID NO: 3576376 - DNA, 20 bp, Homo sapiens
cgccaggtgcccgcgccagg

SEQ ID NO: 3576377 - DNA, 12 bp, Homo sapiens
cgcccaaggccc

SEQ ID NO: 3576378 - DNA, 13 bp, Homo sapiens
cgcccactcctgg

SEQ ID NO: 3576379 - DNA, 22 bp, Homo sapiens
cgccccatccctgcttgcccgc

SEQ ID NO: 3576380 - DNA, 13 bp, Homo sapiens
cgccccgccccag

SEQ ID NO: 3576381 - DNA, 12 bp, Homo sapiens
cgcccctccaaa

SEQ ID NO: 3576382 - DNA, 15 bp, Homo sapiens
cgcccctccaaacct

SEQ ID NO: 3576383 - DNA, 19 bp, Homo sapiens
cgcccctccaaacctccag

SEQ ID NO: 3576384 - DNA, 18 bp, Homo sapiens
cgcccctcccacgcctca

SEQ ID NO: 3576385 - DNA, 15 bp, Homo sapiens
cgcccctgcctgtgc

SEQ ID NO: 3576386 - DNA, 13 bp, Homo sapiens
cgcccctgtggcc

SEQ ID NO: 3576387 - DNA, 15 bp, Homo sapiens
cgcccctgtggccaa

SEQ ID NO: 3576388 - DNA, 17 bp, Homo sapiens
cgcccctgtggccctgg

SEQ ID NO: 3576389 - DNA, 18 bp, Homo sapiens
cgcccctgtggccctggc

SEQ ID NO: 3576390 - DNA, 11 bp, Homo sapiens
cgccctcaggc

SEQ ID NO: 3576391 - DNA, 12 bp, Homo sapiens
cgccctcccagg

SEQ ID NO: 3576392 - DNA, 13 bp, Homo sapiens
cgccctcccaggc

SEQ ID NO: 3576393 - DNA, 12 bp, Homo sapiens
cgccctcccgga

SEQ ID NO: 3576394 - DNA, 13 bp, Homo sapiens
cgccctcccggag

SEQ ID NO: 3576395 - DNA, 16 bp, Homo sapiens
cgccctggtaaggctg

SEQ ID NO: 3576396 - DNA, 19 bp, Homo sapiens
cgccctggtaaggctggtg

SEQ ID NO: 3576397 - DNA, 22 bp, Homo sapiens
cgcccttccatgtgcctttctt

SEQ ID NO: 3576398 - DNA, 15 bp, Homo sapiens
cgccgcccagcccac

SEQ ID NO: 3576399 - DNA, 13 bp, Homo sapiens
cgccgccgccgct

SEQ ID NO: 3576400 - DNA, 14 bp, Homo sapiens
cgccgccgccgctg

SEQ ID NO: 3576401 - DNA, 23 bp, Homo sapiens
cgccggagtccactcccagtgct

SEQ ID NO: 3576402 - DNA, 15 bp, Homo sapiens
cgccggatctgaggg

SEQ ID NO: 3576403 - DNA, 18 bp, Homo sapiens
cgcctcggtatctggctt

SEQ ID NO: 3576404 - DNA, 16 bp, Homo sapiens
cgcctctttgacattt

SEQ ID NO: 3576405 - DNA, 15 bp, Homo sapiens
cgcctgcctgcagca

SEQ ID NO: 3576406 - DNA, 19 bp, Homo sapiens
cgcctggctgcagcctgcg

SEQ ID NO: 3576407 - DNA, 14 bp, Homo sapiens
cgcctttcccaact

SEQ ID NO: 3576408 - DNA, 16 bp, Homo sapiens
cgcgccaggccctcag

SEQ ID NO: 3576409 - DNA, 14 bp, Homo sapiens
cgcgctcgcccagc

SEQ ID NO: 3576410 - DNA, 21 bp, Homo sapiens
cgcgctggaatccagaaggaa

SEQ ID NO: 3576411 - DNA, 22 bp, Homo sapiens
cgcgctggaatccagaaggaag

SEQ ID NO: 3576412 - DNA, 21 bp, Homo sapiens
cgcgtcgccctcccaggctct

SEQ ID NO: 3576413 - DNA, 19 bp, Homo sapiens
cgctaaagggaccatctgc

SEQ ID NO: 3576414 - DNA, 12 bp, Homo sapiens
cgctcagccctc

SEQ ID NO: 3576415 - DNA, 16 bp, Homo sapiens
cgctcagccctccctg

SEQ ID NO: 3576416 - DNA, 18 bp, Homo sapiens
cgctcccacagcttcctg

SEQ ID NO: 3576417 - DNA, 24 bp, Homo sapiens
cgctcccaggttcccccagcaagc

SEQ ID NO: 3576418 - DNA, 13 bp, Homo sapiens
cgctcgcccagca

SEQ ID NO: 3576419 - DNA, 16 bp, Homo sapiens
cgctcgcccagcagga

SEQ ID NO: 3576420 - DNA, 22 bp, Homo sapiens
cgctctgttgcccaggctggag

SEQ ID NO: 3576421 - DNA, 16 bp, Homo sapiens
cgctgccacccacctc

SEQ ID NO: 3576422 - DNA, 17 bp, Homo sapiens
cgctgccacccacctcc

SEQ ID NO: 3576423 - DNA, 20 bp, Homo sapiens
cgctgcccttgggtcccccc

SEQ ID NO: 3576424 - DNA, 15 bp, Homo sapiens
cgctgctctgcccca

SEQ ID NO: 3576425 - DNA, 23 bp, Homo sapiens
cgctggcgacacactccgtccat

SEQ ID NO: 3576426 - DNA, 17 bp, Homo sapiens
cgctgtatgtcttaaaa

SEQ ID NO: 3576427 - DNA, 20 bp, Homo sapiens
cgctgtctctgaggggtggg

SEQ ID NO: 3576428 - DNA, 18 bp, Homo sapiens
cggaaacaacgttgctat

SEQ ID NO: 3576429 - DNA, 19 bp, Homo sapiens
cggaacggaggcttcagaa

SEQ ID NO: 3576430 - DNA, 23 bp, Homo sapiens
cggaaggaatgtcagggccaggt

SEQ ID NO: 3576431 - DNA, 21 bp, Homo sapiens
cggaagggctttggttccttc

SEQ ID NO: 3576432 - DNA, 18 bp, Homo sapiens
cggaagtacttccctcag

SEQ ID NO: 3576433 - DNA, 20 bp, Homo sapiens
cggaattcaccagtgttcct

SEQ ID NO: 3576434 - DNA, 15 bp, Homo sapiens
cggaccccagccatc

SEQ ID NO: 3576435 - DNA, 19 bp, Homo sapiens
cggacccttctgggtccag

SEQ ID NO: 3576436 - DNA, 13 bp, Homo sapiens
cggacgcagctgg

SEQ ID NO: 3576437 - DNA, 16 bp, Homo sapiens
cggactgcccccagaa

SEQ ID NO: 3576438 - DNA, 19 bp, Homo sapiens
cggactgcccccagaaagc

SEQ ID NO: 3576439 - DNA, 17 bp, Homo sapiens
cggagagcagcagcacc

SEQ ID NO: 3576440 - DNA, 18 bp, Homo sapiens
cggagaggtggccgccat

SEQ ID NO: 3576441 - DNA, 14 bp, Homo sapiens
cggagcccagcctg

SEQ ID NO: 3576442 - DNA, 16 bp, Homo sapiens
cggagccgagccatgt

SEQ ID NO: 3576443 - DNA, 15 bp, Homo sapiens
cggaggcccatgccc

SEQ ID NO: 3576444 - DNA, 16 bp, Homo sapiens
cggagggatggagaaa

SEQ ID NO: 3576445 - DNA, 17 bp, Homo sapiens
cggagggatggagaaag

SEQ ID NO: 3576446 - DNA, 12 bp, Homo sapiens
cggagggcagga

SEQ ID NO: 3576447 - DNA, 15 bp, Homo sapiens
cggaggggatccagc

SEQ ID NO: 3576448 - DNA, 23 bp, Homo sapiens
cggagggtgccgtgcgggcgagg

SEQ ID NO: 3576449 - DNA, 21 bp, Homo sapiens
cggaggtctctgggagcccag

SEQ ID NO: 3576450 - DNA, 14 bp, Homo sapiens
cggagtgcctggag

SEQ ID NO: 3576451 - DNA, 13 bp, Homo sapiens
cggatcctgctgg

SEQ ID NO: 3576452 - DNA, 15 bp, Homo sapiens
cggatgacaccctgg

SEQ ID NO: 3576453 - DNA, 18 bp, Homo sapiens
cggatgacaccctggcct

SEQ ID NO: 3576454 - DNA, 21 bp, Homo sapiens
cggatgctactactgcagtct

SEQ ID NO: 3576455 - DNA, 14 bp, Homo sapiens
cggatgtataaatg

SEQ ID NO: 3576456 - DNA, 15 bp, Homo sapiens
cggatgtataaatgt

SEQ ID NO: 3576457 - DNA, 14 bp, Homo sapiens
cggattattttttc

SEQ ID NO: 3576458 - DNA, 17 bp, Homo sapiens
cggattattttttcaga

SEQ ID NO: 3576459 - DNA, 18 bp, Homo sapiens
cggattattttttcagac

SEQ ID NO: 3576460 - DNA, 22 bp, Homo sapiens
cggattattttttcagaccgaa

SEQ ID NO: 3576461 - DNA, 23 bp, Homo sapiens
cggattattttttcagaccgaaa

SEQ ID NO: 3576462 - DNA, 19 bp, Homo sapiens
cggcaacgtagcctgggct

SEQ ID NO: 3576463 - DNA, 16 bp, Homo sapiens
cggcagggaaatgtat

SEQ ID NO: 3576464 - DNA, 23 bp, Homo sapiens
cggccaaggtgccaccaccctgc

SEQ ID NO: 3576465 - DNA, 19 bp, Homo sapiens
ctcagggctggagcctggg

SEQ ID NO: 3576466 - DNA, 20 bp, Homo sapiens
ctcagggctggagcctgggg

SEQ ID NO: 3576467 - DNA, 17 bp, Homo sapiens
ctcagggcttctagttt

SEQ ID NO: 3576468 - DNA, 17 bp, Homo sapiens
ctcagtactttggaggc

SEQ ID NO: 3576469 - DNA, 19 bp, Homo sapiens
ctcagtactttggaggccc

SEQ ID NO: 3576470 - DNA, 20 bp, Homo sapiens
ctcagtactttggaggcccc

SEQ ID NO: 3576471 - DNA, 12 bp, Homo sapiens
ctcagtgcctcc

SEQ ID NO: 3576472 - DNA, 16 bp, Homo sapiens
ctcagtggatcttcag

SEQ ID NO: 3576473 - DNA, 17 bp, Homo sapiens
ctcataccctccctccc

SEQ ID NO: 3576474 - DNA, 23 bp, Homo sapiens
ctcatagcatgatattgttctcc

SEQ ID NO: 3576475 - DNA, 15 bp, Homo sapiens
ctcatccccaaactg

SEQ ID NO: 3576476 - DNA, 21 bp, Homo sapiens
ctcatccccaaactgtagtaa

SEQ ID NO: 3576477 - DNA, 22 bp, Homo sapiens
ctcatccgaagatggtggccac

SEQ ID NO: 3576478 - DNA, 17 bp, Homo sapiens
ctcatcggaggcccatg

SEQ ID NO: 3576479 - DNA, 18 bp, Homo sapiens
ctcatcggaggcccatgc

SEQ ID NO: 3576480 - DNA, 16 bp, Homo sapiens
ctcatctgagaggctc

SEQ ID NO: 3576481 - DNA, 24 bp, Homo sapiens
ctcatctgagaggctctccgtgca

SEQ ID NO: 3576482 - DNA, 19 bp, Homo sapiens
ctcatctgggggagtggaa

SEQ ID NO: 3576483 - DNA, 13 bp, Homo sapiens
ctcatctgtctcg

SEQ ID NO: 3576484 - DNA, 21 bp, Homo sapiens
ctcatctgtggagctgccaca

SEQ ID NO: 3576485 - DNA, 23 bp, Homo sapiens
ctcatctgtggagctgccacaga

SEQ ID NO: 3576486 - DNA, 21 bp, Homo sapiens
ctcatcttggccctcctcagc

SEQ ID NO: 3576487 - DNA, 22 bp, Homo sapiens
ctcatcttggccctcctcagct

SEQ ID NO: 3576488 - DNA, 14 bp, Homo sapiens
ctcatgactgcatg

SEQ ID NO: 3576489 - DNA, 15 bp, Homo sapiens
ctcatgactgcatga

SEQ ID NO: 3576490 - DNA, 15 bp, Homo sapiens
ctcatggggaagctt

SEQ ID NO: 3576491 - DNA, 19 bp, Homo sapiens
ctcatggggaagcttccat

SEQ ID NO: 3576492 - DNA, 20 bp, Homo sapiens
ctcatggggaagcttccatg

SEQ ID NO: 3576493 - DNA, 14 bp, Homo sapiens
ctcatgggtggcac

SEQ ID NO: 3576494 - DNA, 14 bp, Homo sapiens
ctcatgttgaagct

SEQ ID NO: 3576495 - DNA, 16 bp, Homo sapiens
ctcatgttttcaactg

SEQ ID NO: 3576496 - DNA, 17 bp, Homo sapiens
ctcatgttttcaactgc

SEQ ID NO: 3576497 - DNA, 20 bp, Homo sapiens
ctcatgtttttaacttttaa

SEQ ID NO: 3576498 - DNA, 19 bp, Homo sapiens
ctcattcagtaagttctgt

SEQ ID NO: 3576499 - DNA, 23 bp, Homo sapiens
ctcattcagtaagttctgtggtt

SEQ ID NO: 3576500 - DNA, 15 bp, Homo sapiens
ctcattccagaggaa

SEQ ID NO: 3576501 - DNA, 17 bp, Homo sapiens
ctcattccataaatgtc

SEQ ID NO: 3576502 - DNA, 21 bp, Homo sapiens
ctcattcccaacgtgcaaagc

SEQ ID NO: 3576503 - DNA, 13 bp, Homo sapiens
ctcattgcttctg

SEQ ID NO: 3576504 - DNA, 20 bp, Homo sapiens
ctcatttagcattgaaataa

SEQ ID NO: 3576505 - DNA, 19 bp, Homo sapiens
ctcattttgggggtcatct

SEQ ID NO: 3576506 - DNA, 14 bp, Homo sapiens
ctccaaacctccag

SEQ ID NO: 3576507 - DNA, 15 bp, Homo sapiens
ctccaaacctgtctt

SEQ ID NO: 3576508 - DNA, 12 bp, Homo sapiens
ctccaaagaaat

SEQ ID NO: 3576509 - DNA, 22 bp, Homo sapiens
ctccaaccgggatgggagccgg

SEQ ID NO: 3576510 - DNA, 13 bp, Homo sapiens
ctccaacctgcaa

SEQ ID NO: 3576511 - DNA, 20 bp, Homo sapiens
ctccaagatgttctcctgat

SEQ ID NO: 3576512 - DNA, 20 bp, Homo sapiens
ctccaaggggaatcagaact

SEQ ID NO: 3576513 - DNA, 22 bp, Homo sapiens
ctccaatcccaccaaccctcag

SEQ ID NO: 3576514 - DNA, 11 bp, Homo sapiens
ctccaatgtcg

SEQ ID NO: 3576515 - DNA, 15 bp, Homo sapiens
ctccaattttttaag

SEQ ID NO: 3576516 - DNA, 15 bp, Homo sapiens
ctccacactcagaaa

SEQ ID NO: 3576517 - DNA, 17 bp, Homo sapiens
ctccacatgctgcctgg

SEQ ID NO: 3576518 - DNA, 14 bp, Homo sapiens
ctccaccagcaagg

SEQ ID NO: 3576519 - DNA, 13 bp, Homo sapiens
ctccaccagcagc

SEQ ID NO: 3576520 - DNA, 14 bp, Homo sapiens
ctccaccagcagca

SEQ ID NO: 3576521 - DNA, 18 bp, Homo sapiens
ctccaccccacagaacct

SEQ ID NO: 3576522 - DNA, 18 bp, Homo sapiens
ctccaccccccactcagt

SEQ ID NO: 3576523 - DNA, 18 bp, Homo sapiens
ctccaccgaccaactgcc

SEQ ID NO: 3576524 - DNA, 19 bp, Homo sapiens
ctccaccgaccaactgccc

SEQ ID NO: 3576525 - DNA, 20 bp, Homo sapiens
ctccaccgaccaactgccct

SEQ ID NO: 3576526 - DNA, 17 bp, Homo sapiens
ctccactccactgcctt

SEQ ID NO: 3576527 - DNA, 23 bp, Homo sapiens
ctccactcttgatctctcttgtc

SEQ ID NO: 3576528 - DNA, 24 bp, Homo sapiens
ctccactcttgatctctcttgtcc

SEQ ID NO: 3576529 - DNA, 13 bp, Homo sapiens
ctccactgccttc

SEQ ID NO: 3576530 - DNA, 16 bp, Homo sapiens
ctccactgccttcgat

SEQ ID NO: 3576531 - DNA, 16 bp, Homo sapiens
ctccactggatggagg

SEQ ID NO: 3576532 - DNA, 17 bp, Homo sapiens
ctccactttctcatccg

SEQ ID NO: 3576533 - DNA, 14 bp, Homo sapiens
ctccagaagatagc

SEQ ID NO: 3576534 - DNA, 23 bp, Homo sapiens
ctccagaagatagcttcacccca

SEQ ID NO: 3576535 - DNA, 21 bp, Homo sapiens
ctccagaagatgccagcttct

SEQ ID NO: 3576536 - DNA, 23 bp, Homo sapiens
ctccagaagatgccagcttctct

SEQ ID NO: 3576537 - DNA, 14 bp, Homo sapiens
ctccagaagtccct

SEQ ID NO: 3576538 - DNA, 20 bp, Homo sapiens
ctccagacatggaggggatg

SEQ ID NO: 3576539 - DNA, 14 bp, Homo sapiens
ctccagacccctgg

SEQ ID NO: 3576540 - DNA, 19 bp, Homo sapiens
ctccagacccctggctttt

SEQ ID NO: 3576541 - DNA, 21 bp, Homo sapiens
ctccagacccctggcttttca

SEQ ID NO: 3576542 - DNA, 12 bp, Homo sapiens
ctccagacctga

SEQ ID NO: 3576543 - DNA, 14 bp, Homo sapiens
ctccagactcagca

SEQ ID NO: 3576544 - DNA, 20 bp, Homo sapiens
ctccagagatgagtgtctgg

SEQ ID NO: 3576545 - DNA, 21 bp, Homo sapiens
ctccagcctcccctcccctgg

SEQ ID NO: 3576546 - DNA, 15 bp, Homo sapiens
ctccagcctccctgt

SEQ ID NO: 3576547 - DNA, 19 bp, Homo sapiens
ctccagcctccctgtctcc

SEQ ID NO: 3576548 - DNA, 20 bp, Homo sapiens
ctccagcctccctgtctcca

SEQ ID NO: 3576549 - DNA, 20 bp, Homo sapiens
ctccagctaaacaccaaccc

SEQ ID NO: 3576550 - DNA, 18 bp, Homo sapiens
ctccagctgacagccaca

SEQ ID NO: 3576551 - DNA, 19 bp, Homo sapiens
ctccagctgacagccacac

SEQ ID NO: 3576552 - DNA, 12 bp, Homo sapiens
ctccagctgcct

SEQ ID NO: 3576553 - DNA, 12 bp, Homo sapiens
ctccaggaacca

SEQ ID NO: 3576554 - DNA, 18 bp, Homo sapiens
ctccaggagagagccagg

SEQ ID NO: 3576555 - DNA, 14 bp, Homo sapiens
ctccaggcaggact

SEQ ID NO: 3576556 - DNA, 16 bp, Homo sapiens
ctccaggcatgtgtct

SEQ ID NO: 3576557 - DNA, 10 bp, Homo sapiens
ctccaggctg

SEQ ID NO: 3576558 - DNA, 15 bp, Homo sapiens
ctccaggctggaagt

SEQ ID NO: 3576559 - DNA, 19 bp, Homo sapiens
ctccaggctggaagtactt

SEQ ID NO: 3576560 - DNA, 15 bp, Homo sapiens
ctccagggcccccac

SEQ ID NO: 3576561 - DNA, 17 bp, Homo sapiens
ctccagggcccccaccg

SEQ ID NO: 3576562 - DNA, 18 bp, Homo sapiens
ctccagggcccccaccga

SEQ ID NO: 3576563 - DNA, 22 bp, Homo sapiens
ctccaggggcctgcagaaggaa

SEQ ID NO: 3576564 - DNA, 16 bp, Homo sapiens
ctccagggtgacaagg

SEQ ID NO: 3576565 - DNA, 18 bp, Homo sapiens
ctccagggtgacaaggcc

SEQ ID NO: 3576566 - DNA, 20 bp, Homo sapiens
ctccagggtgacaaggcctg

SEQ ID NO: 3576567 - DNA, 21 bp, Homo sapiens
ctccagggtgacaaggcctgc

SEQ ID NO: 3576568 - DNA, 16 bp, Homo sapiens
ctccaggtcagcctgg

SEQ ID NO: 3576569 - DNA, 17 bp, Homo sapiens
ctccaggtcagcctgga

SEQ ID NO: 3576570 - DNA, 23 bp, Homo sapiens
ctccaggtcggagtgcctggagt

SEQ ID NO: 3576571 - DNA, 15 bp, Homo sapiens
ctccaggtttttcaa

SEQ ID NO: 3576572 - DNA, 17 bp, Homo sapiens
ctccaggtttttcaatt

SEQ ID NO: 3576573 - DNA, 18 bp, Homo sapiens
ctccaggtttttcaatta

SEQ ID NO: 3576574 - DNA, 19 bp, Homo sapiens
ctccaggtttttcaattaa

SEQ ID NO: 3576575 - DNA, 22 bp, Homo sapiens
ctccaggtttttcaattaaacg

SEQ ID NO: 3576576 - DNA, 23 bp, Homo sapiens
ctccaggtttttcaattaaacgg

SEQ ID NO: 3576577 - DNA, 22 bp, Homo sapiens
ctccagtcattatgttaatatt

SEQ ID NO: 3576578 - DNA, 21 bp, Homo sapiens
ctccagttttgcctgagaagg

SEQ ID NO: 3576579 - DNA, 14 bp, Homo sapiens
ctccataccttttc

SEQ ID NO: 3576580 - DNA, 17 bp, Homo sapiens
ctccataccttttctct

SEQ ID NO: 3576581 - DNA, 18 bp, Homo sapiens
ctccataccttttctctt

SEQ ID NO: 3576582 - DNA, 21 bp, Homo sapiens
ctccataccttttctcttttc

SEQ ID NO: 3576583 - DNA, 15 bp, Homo sapiens
ctccatactccactc

SEQ ID NO: 3576584 - DNA, 23 bp, Homo sapiens
ctccatattaaaacatatgacca

SEQ ID NO: 3576585 - DNA, 12 bp, Homo sapiens
ctccatcccctc

SEQ ID NO: 3576586 - DNA, 13 bp, Homo sapiens
ctccatcccctcc

SEQ ID NO: 3576587 - DNA, 14 bp, Homo sapiens
ctccatcccctccc

SEQ ID NO: 3576588 - DNA, 16 bp, Homo sapiens
ctccatctcaaaacaa

SEQ ID NO: 3576589 - DNA, 13 bp, Homo sapiens
ctccatctccact

SEQ ID NO: 3576590 - DNA, 14 bp, Homo sapiens
ctccatctcttctg

SEQ ID NO: 3576591 - DNA, 16 bp, Homo sapiens
ctccatctcttctgca

SEQ ID NO: 3576592 - DNA, 16 bp, Homo sapiens
ctccatgatatttaag

SEQ ID NO: 3576593 - DNA, 14 bp, Homo sapiens
ctccatgctgcctc

SEQ ID NO: 3576594 - DNA, 15 bp, Homo sapiens
ctccatgctgcctcc

SEQ ID NO: 3576595 - DNA, 13 bp, Homo sapiens
ctccatggaaaag

SEQ ID NO: 3576596 - DNA, 14 bp, Homo sapiens
ctccatggaaaagc

SEQ ID NO: 3576597 - DNA, 13 bp, Homo sapiens
ctctttccctgcg

SEQ ID NO: 3576598 - DNA, 19 bp, Homo sapiens
ctctttctctattatgtta

SEQ ID NO: 3576599 - DNA, 21 bp, Homo sapiens
ctctttcttattttgtaataa

SEQ ID NO: 3576600 - DNA, 17 bp, Homo sapiens
ctctttgacatttttgc

SEQ ID NO: 3576601 - DNA, 20 bp, Homo sapiens
ctctttgacatttttgccaa

SEQ ID NO: 3576602 - DNA, 15 bp, Homo sapiens
ctctttgctttgctt

SEQ ID NO: 3576603 - DNA, 20 bp, Homo sapiens
ctctttgctttgctttctgc

SEQ ID NO: 3576604 - DNA, 20 bp, Homo sapiens
ctctttgttcttcctgtctc

SEQ ID NO: 3576605 - DNA, 11 bp, Homo sapiens
ctcttttccta

SEQ ID NO: 3576606 - DNA, 20 bp, Homo sapiens
ctcttttcctggcagctgct

SEQ ID NO: 3576607 - DNA, 19 bp, Homo sapiens
ctcttttcctggtgctctt

SEQ ID NO: 3576608 - DNA, 22 bp, Homo sapiens
ctcttttcctttggtccttcaa

SEQ ID NO: 3576609 - DNA, 14 bp, Homo sapiens
ctcttttctttctg

SEQ ID NO: 3576610 - DNA, 15 bp, Homo sapiens
ctgaaaaagacataa

SEQ ID NO: 3576611 - DNA, 21 bp, Homo sapiens
ctgaaaaagacataaaacaga

SEQ ID NO: 3576612 - DNA, 15 bp, Homo sapiens
ctgaaacaacaaata

SEQ ID NO: 3576613 - DNA, 20 bp, Homo sapiens
ctgaaactggcttccccact

SEQ ID NO: 3576614 - DNA, 22 bp, Homo sapiens
ctgaaactggcttccccactcc

SEQ ID NO: 3576615 - DNA, 14 bp, Homo sapiens
ctgaaagagaggac

SEQ ID NO: 3576616 - DNA, 17 bp, Homo sapiens
ctgaaagagaggactgg

SEQ ID NO: 3576617 - DNA, 18 bp, Homo sapiens
ctgaaaggaaggtttcta

SEQ ID NO: 3576618 - DNA, 23 bp, Homo sapiens
ctgaaaggccagcagctgatgct

SEQ ID NO: 3576619 - DNA, 18 bp, Homo sapiens
ctgaaatatccacccagc

SEQ ID NO: 3576620 - DNA, 14 bp, Homo sapiens
ctgaaatatccagg

SEQ ID NO: 3576621 - DNA, 13 bp, Homo sapiens
ctgaaatccttga

SEQ ID NO: 3576622 - DNA, 14 bp, Homo sapiens
ctgaaatccttgag

SEQ ID NO: 3576623 - DNA, 17 bp, Homo sapiens
ctgaaatgaaatcttcc

SEQ ID NO: 3576624 - DNA, 18 bp, Homo sapiens
ctgaaatgtgtttccttt

SEQ ID NO: 3576625 - DNA, 21 bp, Homo sapiens
ctgaaatttgttatacttcaa

SEQ ID NO: 3576626 - DNA, 22 bp, Homo sapiens
ctgaaatttgttatacttcaaa

SEQ ID NO: 3576627 - DNA, 14 bp, Homo sapiens
ctgaacaagaattg

SEQ ID NO: 3576628 - DNA, 13 bp, Homo sapiens
ctgaacaggaaag

SEQ ID NO: 3576629 - DNA, 20 bp, Homo sapiens
ctgaacaggaaagagctagg

SEQ ID NO: 3576630 - DNA, 17 bp, Homo sapiens
ctgaaccaaattgcact

SEQ ID NO: 3576631 - DNA, 19 bp, Homo sapiens
ctgaaccaaattgcactga

SEQ ID NO: 3576632 - DNA, 20 bp, Homo sapiens
ctgaaccaaattgcactgaa

SEQ ID NO: 3576633 - DNA, 22 bp, Homo sapiens
ctgaaccaaattgcactgaagt

SEQ ID NO: 3576634 - DNA, 18 bp, Homo sapiens
ctgaaccacattcaggga

SEQ ID NO: 3576635 - DNA, 15 bp, Homo sapiens
ctgaaccctccaaag

SEQ ID NO: 3576636 - DNA, 18 bp, Homo sapiens
ctgaacgccctggtaagg

SEQ ID NO: 3576637 - DNA, 23 bp, Homo sapiens
ctgaactgaggagatgaccaggg

SEQ ID NO: 3576638 - DNA, 14 bp, Homo sapiens
ctgaactttctccc

SEQ ID NO: 3576639 - DNA, 15 bp, Homo sapiens
ctgaactttctccct

SEQ ID NO: 3576640 - DNA, 17 bp, Homo sapiens
ctgaacttttgtggagt

SEQ ID NO: 3576641 - DNA, 18 bp, Homo sapiens
ctgaacttttgtggagtt

SEQ ID NO: 3576642 - DNA, 14 bp, Homo sapiens
ctgaagaaccagtc

SEQ ID NO: 3576643 - DNA, 15 bp, Homo sapiens
ctgaagaaccagtcc

SEQ ID NO: 3576644 - DNA, 22 bp, Homo sapiens
ctgaagaaccagtccccccacc

SEQ ID NO: 3576645 - DNA, 14 bp, Homo sapiens
ctgaagaactattt

SEQ ID NO: 3576646 - DNA, 21 bp, Homo sapiens
ctgaagagaagggcagggctg

SEQ ID NO: 3576647 - DNA, 14 bp, Homo sapiens
ctgaagagtcctct

SEQ ID NO: 3576648 - DNA, 16 bp, Homo sapiens
ctgaagagtcctctga

SEQ ID NO: 3576649 - DNA, 15 bp, Homo sapiens
ctgaagatcagaaca

SEQ ID NO: 3576650 - DNA, 13 bp, Homo sapiens
ctgaagatggctt

SEQ ID NO: 3576651 - DNA, 16 bp, Homo sapiens
ctgaagctgctgcagc

SEQ ID NO: 3576652 - DNA, 13 bp, Homo sapiens
ctgaagctgctgt

SEQ ID NO: 3576653 - DNA, 15 bp, Homo sapiens
ctgaagctgctgtgt

SEQ ID NO: 3576654 - DNA, 17 bp, Homo sapiens
ctgaaggaaaagcaaga

SEQ ID NO: 3576655 - DNA, 22 bp, Homo sapiens
ctgaaggaaaagcaagaaacag

SEQ ID NO: 3576656 - DNA, 11 bp, Homo sapiens
ctgaaggcagt

SEQ ID NO: 3576657 - DNA, 20 bp, Homo sapiens
ctgaaggcagtggcagggga

SEQ ID NO: 3576658 - DNA, 21 bp, Homo sapiens
ctgaaggcagtggcaggggag

SEQ ID NO: 3576659 - DNA, 16 bp, Homo sapiens
ctgaaggggttttctt

SEQ ID NO: 3576660 - DNA, 18 bp, Homo sapiens
ctgaaggggttttcttga

SEQ ID NO: 3576661 - DNA, 15 bp, Homo sapiens
ctgaagtcactgcac

SEQ ID NO: 3576662 - DNA, 23 bp, Homo sapiens
ctgaagtctgagcccatttctgg

SEQ ID NO: 3576663 - DNA, 18 bp, Homo sapiens
ctgaagtttttgaaatac

SEQ ID NO: 3576664 - DNA, 21 bp, Homo sapiens
ctgaagtttttgaaatacctt

SEQ ID NO: 3576665 - DNA, 13 bp, Homo sapiens
ctgaataaagcaa

SEQ ID NO: 3576666 - DNA, 14 bp, Homo sapiens
ctgaataacttgaa

SEQ ID NO: 3576667 - DNA, 15 bp, Homo sapiens
ctgaatctgtgcaaa

SEQ ID NO: 3576668 - DNA, 17 bp, Homo sapiens
ctgaatctgtgcaaaca

SEQ ID NO: 3576669 - DNA, 19 bp, Homo sapiens
ctgaatgaaaataactgaa

SEQ ID NO: 3576670 - DNA, 22 bp, Homo sapiens
ctgaatgaaccttctggcctcc

SEQ ID NO: 3576671 - DNA, 17 bp, Homo sapiens
ctgaattcacctgtgga

SEQ ID NO: 3576672 - DNA, 19 bp, Homo sapiens
ctgaatttcttcttttcct

SEQ ID NO: 3576673 - DNA, 15 bp, Homo sapiens
ctgaattttttttaa

SEQ ID NO: 3576674 - DNA, 17 bp, Homo sapiens
ctgacaactgtgaagcc

SEQ ID NO: 3576675 - DNA, 23 bp, Homo sapiens
ctgacaagattataatattttaa

SEQ ID NO: 3576676 - DNA, 19 bp, Homo sapiens
ctgacaatttgtgatatct

SEQ ID NO: 3576677 - DNA, 14 bp, Homo sapiens
ctgacacaccaggc

SEQ ID NO: 3576678 - DNA, 23 bp, Homo sapiens
ctgacacaccaggcgctaattca

SEQ ID NO: 3576679 - DNA, 14 bp, Homo sapiens
ctgacaccccctcc

SEQ ID NO: 3576680 - DNA, 14 bp, Homo sapiens
ctgacagaaggact

SEQ ID NO: 3576681 - DNA, 18 bp, Homo sapiens
ctgacagatgcttttgct

SEQ ID NO: 3576682 - DNA, 13 bp, Homo sapiens
ctgacagccacac

SEQ ID NO: 3576683 - DNA, 18 bp, Homo sapiens
ctgacagccttccccagc

SEQ ID NO: 3576684 - DNA, 17 bp, Homo sapiens
ctgacagctgctcctag

SEQ ID NO: 3576685 - DNA, 17 bp, Homo sapiens
ctgacagtcagctgtgg

SEQ ID NO: 3576686 - DNA, 18 bp, Homo sapiens
ctgacagtcagctgtggg

SEQ ID NO: 3576687 - DNA, 19 bp, Homo sapiens
ctgacagtcagctgtgggg

SEQ ID NO: 3576688 - DNA, 13 bp, Homo sapiens
ctgacagtccaca

SEQ ID NO: 3576689 - DNA, 17 bp, Homo sapiens
ctgacagtccacagggg

SEQ ID NO: 3576690 - DNA, 20 bp, Homo sapiens
ctgacatcaattttaccctg

SEQ ID NO: 3576691 - DNA, 12 bp, Homo sapiens
ctgacatccctt

SEQ ID NO: 3576692 - DNA, 16 bp, Homo sapiens
ctgacatcccttcctg

SEQ ID NO: 3576693 - DNA, 19 bp, Homo sapiens
ctgacatcccttcctggaa

SEQ ID NO: 3576694 - DNA, 13 bp, Homo sapiens
ctgaccagcagcg

SEQ ID NO: 3576695 - DNA, 21 bp, Homo sapiens
ctgaccagcagcgcctttccc

SEQ ID NO: 3576696 - DNA, 21 bp, Homo sapiens
ctgaccagcctccatgctgcc

SEQ ID NO: 3576697 - DNA, 22 bp, Homo sapiens
ctgaccatcatgccctctctcg

SEQ ID NO: 3576698 - DNA, 15 bp, Homo sapiens
ctgaccatgcgtcag

SEQ ID NO: 3576699 - DNA, 21 bp, Homo sapiens
ctgacccagattcccttccgg

SEQ ID NO: 3576700 - DNA, 18 bp, Homo sapiens
ctgacccagcatctccca

SEQ ID NO: 3576701 - DNA, 21 bp, Homo sapiens
ctgacccagcatctcccagca

SEQ ID NO: 3576702 - DNA, 12 bp, Homo sapiens
ctgacccagtgc

SEQ ID NO: 3576703 - DNA, 13 bp, Homo sapiens
ctgaccccaaggg

SEQ ID NO: 3576704 - DNA, 20 bp, Homo sapiens
ctgaccccaagggggctgct

SEQ ID NO: 3576705 - DNA, 23 bp, Homo sapiens
ctgaccccaagggggctgctgct

SEQ ID NO: 3576706 - DNA, 16 bp, Homo sapiens
ctgacccccatctgag

SEQ ID NO: 3576707 - DNA, 20 bp, Homo sapiens
ctgacccccatctgagctgg

SEQ ID NO: 3576708 - DNA, 18 bp, Homo sapiens
ctgaccccgagaagtgct

SEQ ID NO: 3576709 - DNA, 16 bp, Homo sapiens
ctgaccccgccatgca

SEQ ID NO: 3576710 - DNA, 13 bp, Homo sapiens
ctgacccctctgg

SEQ ID NO: 3576711 - DNA, 22 bp, Homo sapiens
ctgacccctgcctgttggcagg

SEQ ID NO: 3576712 - DNA, 23 bp, Homo sapiens
ctgacccttacagcctctgactt

SEQ ID NO: 3576713 - DNA, 22 bp, Homo sapiens
ctgaccgatgtgtctcccagaa

SEQ ID NO: 3576714 - DNA, 19 bp, Homo sapiens
ctgacctgagcggcaccct

SEQ ID NO: 3576715 - DNA, 17 bp, Homo sapiens
ctgaccttgggtcctga

SEQ ID NO: 3576716 - DNA, 15 bp, Homo sapiens
ctgacgctgacaata

SEQ ID NO: 3576717 - DNA, 15 bp, Homo sapiens
ctgactaaacttttt

SEQ ID NO: 3576718 - DNA, 19 bp, Homo sapiens
ctgactaaactttttttct

SEQ ID NO: 3576719 - DNA, 20 bp, Homo sapiens
ctgactagaactcctgtctt

SEQ ID NO: 3576720 - DNA, 14 bp, Homo sapiens
ctgactcagtgacc

SEQ ID NO: 3576721 - DNA, 15 bp, Homo sapiens
ctgactccaaagctg

SEQ ID NO: 3576722 - DNA, 12 bp, Homo sapiens
ctgactcttatt

SEQ ID NO: 3576723 - DNA, 17 bp, Homo sapiens
ctgactgccaagccaga

SEQ ID NO: 3576724 - DNA, 16 bp, Homo sapiens
ctgactggaggaggcc

SEQ ID NO: 3576725 - DNA, 22 bp, Homo sapiens
ctgacttatggcatgactcttc

SEQ ID NO: 3576726 - DNA, 23 bp, Homo sapiens
ctgacttcagtgaatatttttgt

SEQ ID NO: 3576727 - DNA, 15 bp, Homo sapiens
ctgacttctaagtaa

SEQ ID NO: 3576728 - DNA, 21 bp, Homo sapiens
ctgacttttaatgtcatttgt

SEQ ID NO: 3576729 - DNA, 14 bp, Homo sapiens
ctggactattgtgc

SEQ ID NO: 3576730 - DNA, 21 bp, Homo sapiens
ctggactattgtgccaactgc

SEQ ID NO: 3576731 - DNA, 17 bp, Homo sapiens
ctggactcctctgtcca

SEQ ID NO: 3576732 - DNA, 19 bp, Homo sapiens
ctggactcctgccaccagc

SEQ ID NO: 3576733 - DNA, 20 bp, Homo sapiens
ctggactcctgccaccagca

SEQ ID NO: 3576734 - DNA, 21 bp, Homo sapiens
ctggactggaaagcacaagac

SEQ ID NO: 3576735 - DNA, 19 bp, Homo sapiens
ctggactgtcatagaaatt

SEQ ID NO: 3576736 - DNA, 23 bp, Homo sapiens
ctggacttaagcatctggctcta

SEQ ID NO: 3576737 - DNA, 23 bp, Homo sapiens
ctggagaaagagctgcctggatg

SEQ ID NO: 3576738 - DNA, 24 bp, Homo sapiens
ctggagaaagagctgcctggatga

SEQ ID NO: 3576739 - DNA, 15 bp, Homo sapiens
ctggagaaggcctgg

SEQ ID NO: 3576740 - DNA, 16 bp, Homo sapiens
ctggagacaaggtgct

SEQ ID NO: 3576741 - DNA, 18 bp, Homo sapiens
ctggagacttcctctggt

SEQ ID NO: 3576742 - DNA, 16 bp, Homo sapiens
ctggagagaagtggaa

SEQ ID NO: 3576743 - DNA, 22 bp, Homo sapiens
ctggagaggccctctggagtgg

SEQ ID NO: 3576744 - DNA, 22 bp, Homo sapiens
ctggagatggaagcttgttgaa

SEQ ID NO: 3576745 - DNA, 23 bp, Homo sapiens
ctggagcagaggaggggaaagtc

SEQ ID NO: 3576746 - DNA, 13 bp, Homo sapiens
ctggagcaggagc

SEQ ID NO: 3576747 - DNA, 14 bp, Homo sapiens
ctggagcaggagcc

SEQ ID NO: 3576748 - DNA, 16 bp, Homo sapiens
ctggagcaggagcccc

SEQ ID NO: 3576749 - DNA, 19 bp, Homo sapiens
ctggagcaggcccaatgct

SEQ ID NO: 3576750 - DNA, 22 bp, Homo sapiens
ctggagcaggcccaatgctgct

SEQ ID NO: 3576751 - DNA, 22 bp, Homo sapiens
ctggagcattgtgtatagaact

SEQ ID NO: 3576752 - DNA, 12 bp, Homo sapiens
ctggagcctggg

SEQ ID NO: 3576753 - DNA, 13 bp, Homo sapiens
ctggagcctgggg

SEQ ID NO: 3576754 - DNA, 15 bp, Homo sapiens
ctggagcctggggtg

SEQ ID NO: 3576755 - DNA, 20 bp, Homo sapiens
ctggagcgcttcagttcagc

SEQ ID NO: 3576756 - DNA, 16 bp, Homo sapiens
ctggagcttcagccag

SEQ ID NO: 3576757 - DNA, 18 bp, Homo sapiens
ctggagcttcagccaggt

SEQ ID NO: 3576758 - DNA, 23 bp, Homo sapiens
ctggaggcaaaggcctggacagc

SEQ ID NO: 3576759 - DNA, 20 bp, Homo sapiens
ctggaggcagggggtgaggg

SEQ ID NO: 3576760 - DNA, 21 bp, Homo sapiens
ctggaggcagggggtgagggg

SEQ ID NO: 3576761 - DNA, 14 bp, Homo sapiens
ctggaggcccagtt

SEQ ID NO: 3576762 - DNA, 12 bp, Homo sapiens
ctggaggggcag

SEQ ID NO: 3576763 - DNA, 16 bp, Homo sapiens
ctggaggtctccaggg

SEQ ID NO: 3576764 - DNA, 23 bp, Homo sapiens
ctggaggtctccaggggcctgca

SEQ ID NO: 3576765 - DNA, 17 bp, Homo sapiens
ctggaggtctggctgag

SEQ ID NO: 3576766 - DNA, 24 bp, Homo sapiens
ctggaggtctggctgagcccctgg

SEQ ID NO: 3576767 - DNA, 12 bp, Homo sapiens
ctggaggtttgt

SEQ ID NO: 3576768 - DNA, 13 bp, Homo sapiens
ctggagtccagtg

SEQ ID NO: 3576769 - DNA, 16 bp, Homo sapiens
ctggagtgagcactca

SEQ ID NO: 3576770 - DNA, 14 bp, Homo sapiens
ctggagtggccact

SEQ ID NO: 3576771 - DNA, 24 bp, Homo sapiens
ctggagtggccactaagcagagga

SEQ ID NO: 3576772 - DNA, 23 bp, Homo sapiens
ctggagtgtgagggtcctgcagc

SEQ ID NO: 3576773 - DNA, 20 bp, Homo sapiens
ctggagttccttatccctct

SEQ ID NO: 3576774 - DNA, 16 bp, Homo sapiens
ctggagttgatctgga

SEQ ID NO: 3576775 - DNA, 18 bp, Homo sapiens
ctggatatttcaatcttt

SEQ ID NO: 3576776 - DNA, 19 bp, Homo sapiens
ctggatatttcaatctttt

SEQ ID NO: 3576777 - DNA, 23 bp, Homo sapiens
ctggatatttcaatcttttaaat

SEQ ID NO: 3576778 - DNA, 17 bp, Homo sapiens
ctggatccagcactggt

SEQ ID NO: 3576779 - DNA, 22 bp, Homo sapiens
ctggatccatcttgagccacag

SEQ ID NO: 3576780 - DNA, 14 bp, Homo sapiens
ctggatctgtgagg

SEQ ID NO: 3576781 - DNA, 16 bp, Homo sapiens
ctggatgagaaacagc

SEQ ID NO: 3576782 - DNA, 21 bp, Homo sapiens
ctggatgagaaacagctcagc

SEQ ID NO: 3576783 - DNA, 13 bp, Homo sapiens
ctggatgcccagg

SEQ ID NO: 3576784 - DNA, 16 bp, Homo sapiens
ctggatgcccaggaat

SEQ ID NO: 3576785 - DNA, 21 bp, Homo sapiens
ctggatggaggaaaaccaagc

SEQ ID NO: 3576786 - DNA, 19 bp, Homo sapiens
ctggattgcgcctaatgtg

SEQ ID NO: 3576787 - DNA, 16 bp, Homo sapiens
ctggcaaatccaggct

SEQ ID NO: 3576788 - DNA, 22 bp, Homo sapiens
ctggcacaaaagacagctggcg

SEQ ID NO: 3576789 - DNA, 19 bp, Homo sapiens
ctggcacagaccaggcctt

SEQ ID NO: 3576790 - DNA, 15 bp, Homo sapiens
ctggcacagggcagt

SEQ ID NO: 3576791 - DNA, 17 bp, Homo sapiens
ctggcacagggcagtgg

SEQ ID NO: 3576792 - DNA, 20 bp, Homo sapiens
ctggcacagttttctgagaa

SEQ ID NO: 3576793 - DNA, 18 bp, Homo sapiens
ctggcaccatcagcctgt

SEQ ID NO: 3576794 - DNA, 17 bp, Homo sapiens
ctggcacccccacaagc

SEQ ID NO: 3576795 - DNA, 16 bp, Homo sapiens
ctggcacgtgacaggc

SEQ ID NO: 3576796 - DNA, 18 bp, Homo sapiens
ctggcacgtgacaggctc

SEQ ID NO: 3576797 - DNA, 21 bp, Homo sapiens
ctggcacttggagacttgtat

SEQ ID NO: 3576798 - DNA, 19 bp, Homo sapiens
ctggcacttttttaaatat

SEQ ID NO: 3576799 - DNA, 19 bp, Homo sapiens
ctggcagcaccgcctcttc

SEQ ID NO: 3576800 - DNA, 21 bp, Homo sapiens
ctggcagccgtgccttcagct

SEQ ID NO: 3576801 - DNA, 22 bp, Homo sapiens
ctggcagccgtgccttcagctc

SEQ ID NO: 3576802 - DNA, 12 bp, Homo sapiens
ctggcagctctg

SEQ ID NO: 3576803 - DNA, 17 bp, Homo sapiens
ctggcagctctggacag

SEQ ID NO: 3576804 - DNA, 11 bp, Homo sapiens
ctggcagctgc

SEQ ID NO: 3576805 - DNA, 18 bp, Homo sapiens
ctggcagggacctgagag

SEQ ID NO: 3576806 - DNA, 20 bp, Homo sapiens
ctggcagggacctgagagca

SEQ ID NO: 3576807 - DNA, 21 bp, Homo sapiens
ctggcagggccacctgcagga

SEQ ID NO: 3576808 - DNA, 21 bp, Homo sapiens
ctggcaggggagacaggagcc

SEQ ID NO: 3576809 - DNA, 17 bp, Homo sapiens
ctggcatcgtggtgggg

SEQ ID NO: 3576810 - DNA, 18 bp, Homo sapiens
ctggccaaacccttgctt

SEQ ID NO: 3576811 - DNA, 17 bp, Homo sapiens
ctggccaacatggtaaa

SEQ ID NO: 3576812 - DNA, 23 bp, Homo sapiens
ctggccacatcagccccacagga

SEQ ID NO: 3576813 - DNA, 20 bp, Homo sapiens
ctggccactaaagcttcaga

SEQ ID NO: 3576814 - DNA, 22 bp, Homo sapiens
ctggccactaaagcttcagact

SEQ ID NO: 3576815 - DNA, 13 bp, Homo sapiens
ctggccagacaca

SEQ ID NO: 3576816 - DNA, 12 bp, Homo sapiens
ctggccaggcag

SEQ ID NO: 3576817 - DNA, 21 bp, Homo sapiens
ctggccagtggctggatctgt

SEQ ID NO: 3576818 - DNA, 12 bp, Homo sapiens
ctggcccagggc

SEQ ID NO: 3576819 - DNA, 15 bp, Homo sapiens
ctggcccagggccca

SEQ ID NO: 3576820 - DNA, 16 bp, Homo sapiens
ctggcccagggcccag

SEQ ID NO: 3576821 - DNA, 20 bp, Homo sapiens
ctggcccagggcccagagcc

SEQ ID NO: 3576822 - DNA, 21 bp, Homo sapiens
ctggcccagggcccagagccc

SEQ ID NO: 3576823 - DNA, 17 bp, Homo sapiens
ctggcccagtgccagca

SEQ ID NO: 3576824 - DNA, 20 bp, Homo sapiens
ctggcccagtgccagcaagt

SEQ ID NO: 3576825 - DNA, 23 bp, Homo sapiens
ctggccccagtgcggttcctcat

SEQ ID NO: 3576826 - DNA, 16 bp, Homo sapiens
ctggcccccagccctg

SEQ ID NO: 3576827 - DNA, 23 bp, Homo sapiens
ctggccctatgcttccggcctcc

SEQ ID NO: 3576828 - DNA, 22 bp, Homo sapiens
ctggccggagcaaactctgctg

SEQ ID NO: 3576829 - DNA, 23 bp, Homo sapiens
ctggccggagtcagtgccaggtc

SEQ ID NO: 3576830 - DNA, 13 bp, Homo sapiens
ctggcctcccaca

SEQ ID NO: 3576831 - DNA, 19 bp, Homo sapiens
ctggcctcccacagactca

SEQ ID NO: 3576832 - DNA, 15 bp, Homo sapiens
ctggcctgccatgcc

SEQ ID NO: 3576833 - DNA, 13 bp, Homo sapiens
ctggcctggctgg

SEQ ID NO: 3576834 - DNA, 20 bp, Homo sapiens
ctggccttaaagagggacag

SEQ ID NO: 3576835 - DNA, 14 bp, Homo sapiens
ctggcgacacactc

SEQ ID NO: 3576836 - DNA, 17 bp, Homo sapiens
ctggcgcccctgcctgt

SEQ ID NO: 3576837 - DNA, 16 bp, Homo sapiens
ctggcggacgcagctg

SEQ ID NO: 3576838 - DNA, 17 bp, Homo sapiens
ctggcggacgcagctgg

SEQ ID NO: 3576839 - DNA, 17 bp, Homo sapiens
ctggcggaggtctctgg

SEQ ID NO: 3576840 - DNA, 19 bp, Homo sapiens
ctggcggaggtctctggga

SEQ ID NO: 3576841 - DNA, 16 bp, Homo sapiens
ctggctccactcttga

SEQ ID NO: 3576842 - DNA, 15 bp, Homo sapiens
ctggctccccaaggc

SEQ ID NO: 3576843 - DNA, 20 bp, Homo sapiens
ctggctccgtccaggagcct

SEQ ID NO: 3576844 - DNA, 20 bp, Homo sapiens
ctggctctaattcacagtgc

SEQ ID NO: 3576845 - DNA, 18 bp, Homo sapiens
ctggctctgccccctccc

SEQ ID NO: 3576846 - DNA, 12 bp, Homo sapiens
ctggctgagccc

SEQ ID NO: 3576847 - DNA, 16 bp, Homo sapiens
ctggctgagcccctgg

SEQ ID NO: 3576848 - DNA, 19 bp, Homo sapiens
ctggctgagcccctgggga

SEQ ID NO: 3576849 - DNA, 14 bp, Homo sapiens
ctggctgagccctg

SEQ ID NO: 3576850 - DNA, 17 bp, Homo sapiens
ctggctgcacaggctga

SEQ ID NO: 3576851 - DNA, 14 bp, Homo sapiens
ctggctgccttaga

SEQ ID NO: 3576852 - DNA, 13 bp, Homo sapiens
ctggctggagtga

SEQ ID NO: 3576853 - DNA, 15 bp, Homo sapiens
ctggctgggactggg

SEQ ID NO: 3576854 - DNA, 21 bp, Homo sapiens
ctggctgggccttcaccaagc

SEQ ID NO: 3576855 - DNA, 23 bp, Homo sapiens
ctggctgggccttcaccaagcaa

SEQ ID NO: 3576856 - DNA, 21 bp, Homo sapiens
ctggcttcaaaaagccacagc

SEQ ID NO: 3576857 - DNA, 20 bp, Homo sapiens
ctggcttccctaaactgcag

SEQ ID NO: 3576858 - DNA, 21 bp, Homo sapiens
ctggcttccctaaactgcagc

SEQ ID NO: 3576859 - DNA, 13 bp, Homo sapiens
ctggcttccctgg

SEQ ID NO: 3576860 - DNA, 14 bp, Homo sapiens
ctggcttccctgga

SEQ ID NO: 3576861 - DNA, 16 bp, Homo sapiens
ctggcttccctggaag

SEQ ID NO: 3576862 - DNA, 18 bp, Homo sapiens
ctggcttccctggaagct

SEQ ID NO: 3576863 - DNA, 20 bp, Homo sapiens
ctggctttgcctcttctttg

SEQ ID NO: 3576864 - DNA, 21 bp, Homo sapiens
ctggctttgcctcttctttgt

SEQ ID NO: 3576865 - DNA, 20 bp, Homo sapiens
ctggcttttcactgctggct

SEQ ID NO: 3576866 - DNA, 14 bp, Homo sapiens
ctgggaacagaact

SEQ ID NO: 3576867 - DNA, 16 bp, Homo sapiens
ctgggaaccactccca

SEQ ID NO: 3576868 - DNA, 20 bp, Homo sapiens
ctgggaaccactcccaccac

SEQ ID NO: 3576869 - DNA, 14 bp, Homo sapiens
ctgggaagcccttt

SEQ ID NO: 3576870 - DNA, 15 bp, Homo sapiens
ctgggaaggccagcc

SEQ ID NO: 3576871 - DNA, 16 bp, Homo sapiens
ctgggaatgggagagg

SEQ ID NO: 3576872 - DNA, 18 bp, Homo sapiens
ctgggacccacagaactt

SEQ ID NO: 3576873 - DNA, 14 bp, Homo sapiens
ctgggacctgtggt

SEQ ID NO: 3576874 - DNA, 13 bp, Homo sapiens
ctgggactgggaa

SEQ ID NO: 3576875 - DNA, 13 bp, Homo sapiens
ctgggagccagtc

SEQ ID NO: 3576876 - DNA, 15 bp, Homo sapiens
ctgggagccagtcct

SEQ ID NO: 3576877 - DNA, 16 bp, Homo sapiens
ctgggagccgcctgct

SEQ ID NO: 3576878 - DNA, 19 bp, Homo sapiens
ctgggattggggggtgggc

SEQ ID NO: 3576879 - DNA, 13 bp, Homo sapiens
ctgggcacaaaca

SEQ ID NO: 3576880 - DNA, 14 bp, Homo sapiens
ctgggcacacgctg

SEQ ID NO: 3576881 - DNA, 22 bp, Homo sapiens
ctgggcacacgctgctctgccc

SEQ ID NO: 3576882 - DNA, 22 bp, Homo sapiens
ctgggcaccacctctgtgggca

SEQ ID NO: 3576883 - DNA, 14 bp, Homo sapiens
ctgggcactggggc

SEQ ID NO: 3576884 - DNA, 18 bp, Homo sapiens
ctgggcactggggcctca

SEQ ID NO: 3576885 - DNA, 19 bp, Homo sapiens
ctgggcactggggcctcag

SEQ ID NO: 3576886 - DNA, 20 bp, Homo sapiens
ctgggcagggatgatggcag

SEQ ID NO: 3576887 - DNA, 19 bp, Homo sapiens
ctgggcattagcaaggcag

SEQ ID NO: 3576888 - DNA, 14 bp, Homo sapiens
ctgggcatttcaat

SEQ ID NO: 3576889 - DNA, 15 bp, Homo sapiens
ctgggcatttcaatc

SEQ ID NO: 3576890 - DNA, 16 bp, Homo sapiens
ctgggcatttcaatcc

SEQ ID NO: 3576891 - DNA, 17 bp, Homo sapiens
ctgggccactggggact

SEQ ID NO: 3576892 - DNA, 22 bp, Homo sapiens
ctgggccctgacattggagcct

SEQ ID NO: 3576893 - DNA, 14 bp, Homo sapiens
ctgggccggctgag

SEQ ID NO: 3576894 - DNA, 16 bp, Homo sapiens
ctgggccggctgagtg

SEQ ID NO: 3576895 - DNA, 18 bp, Homo sapiens
ctgggccggctgagtggc

SEQ ID NO: 3576896 - DNA, 20 bp, Homo sapiens
ctgggccgtggcacagctgg

SEQ ID NO: 3576897 - DNA, 21 bp, Homo sapiens
ctgggccgtggcacagctggg

SEQ ID NO: 3576898 - DNA, 22 bp, Homo sapiens
ctgggcctgagggtccacctgg

SEQ ID NO: 3576899 - DNA, 13 bp, Homo sapiens
ctgggcctgcaga

SEQ ID NO: 3576900 - DNA, 18 bp, Homo sapiens
ctgggcgacaaaaacgaa

SEQ ID NO: 3576901 - DNA, 16 bp, Homo sapiens
ctgggctacagaaacc

SEQ ID NO: 3576902 - DNA, 19 bp, Homo sapiens
ctgggctacagaaaccaca

SEQ ID NO: 3576903 - DNA, 22 bp, Homo sapiens
ctgggctattgctgctgcccct

SEQ ID NO: 3576904 - DNA, 23 bp, Homo sapiens
ctgggctattgctgctgcccctt

SEQ ID NO: 3576905 - DNA, 15 bp, Homo sapiens
ctgggctcagacatc

SEQ ID NO: 3576906 - DNA, 16 bp, Homo sapiens
ctgggctcagacatcc

SEQ ID NO: 3576907 - DNA, 23 bp, Homo sapiens
ctgggctcagcctggtttctggg

SEQ ID NO: 3576908 - DNA, 22 bp, Homo sapiens
ctgggcttagggtcctgtcgaa

SEQ ID NO: 3576909 - DNA, 14 bp, Homo sapiens
ctggggaagacagt

SEQ ID NO: 3576910 - DNA, 13 bp, Homo sapiens
ctggggacagagg

SEQ ID NO: 3576911 - DNA, 14 bp, Homo sapiens
ctggggacagcttc

SEQ ID NO: 3576912 - DNA, 22 bp, Homo sapiens
ctggggacccaaaccccctgca

SEQ ID NO: 3576913 - DNA, 13 bp, Homo sapiens
ctggggactcagg

SEQ ID NO: 3576914 - DNA, 15 bp, Homo sapiens
ctggggactcaggga

SEQ ID NO: 3576915 - DNA, 18 bp, Homo sapiens
ctggggagagcggctgga

SEQ ID NO: 3576916 - DNA, 19 bp, Homo sapiens
ctggggagagcggctggag

SEQ ID NO: 3576917 - DNA, 21 bp, Homo sapiens
ctggggagagcggctggagaa

SEQ ID NO: 3576918 - DNA, 19 bp, Homo sapiens
ctggggagtggttaggcag

SEQ ID NO: 3576919 - DNA, 12 bp, Homo sapiens
ctggggatgcgc

SEQ ID NO: 3576920 - DNA, 12 bp, Homo sapiens
ctggggcacggc

SEQ ID NO: 3576921 - DNA, 14 bp, Homo sapiens
ctggggcagcactc

SEQ ID NO: 3576922 - DNA, 18 bp, Homo sapiens
ctggggcagcactcccca

SEQ ID NO: 3576923 - DNA, 19 bp, Homo sapiens
ctggggcagcactccccag

SEQ ID NO: 3576924 - DNA, 13 bp, Homo sapiens
ctggggccgccac

SEQ ID NO: 3576925 - DNA, 19 bp, Homo sapiens
ctggggccgccacggcctg

SEQ ID NO: 3576926 - DNA, 19 bp, Homo sapiens
ctgggggaggtccaagcag

SEQ ID NO: 3576927 - DNA, 13 bp, Homo sapiens
ctgggggagtgga

SEQ ID NO: 3576928 - DNA, 18 bp, Homo sapiens
ctgggggattcctgagct

SEQ ID NO: 3576929 - DNA, 22 bp, Homo sapiens
ctgggggattcctgagctggcc

SEQ ID NO: 3576930 - DNA, 15 bp, Homo sapiens
ctgggggcccgacag

SEQ ID NO: 3576931 - DNA, 20 bp, Homo sapiens
ctgggggctgccgagccacc

SEQ ID NO: 3576932 - DNA, 20 bp, Homo sapiens
ctgggggcttttgccactcc

SEQ ID NO: 3576933 - DNA, 21 bp, Homo sapiens
ctgggggtggacatctgaccc

SEQ ID NO: 3576934 - DNA, 14 bp, Homo sapiens
ctgggggtgggcca

SEQ ID NO: 3576935 - DNA, 15 bp, Homo sapiens
ctgggggtgggccag

SEQ ID NO: 3576936 - DNA, 20 bp, Homo sapiens
ctgggggttctttcttcctc

SEQ ID NO: 3576937 - DNA, 23 bp, Homo sapiens
ctgggggttctttcttcctctgc

SEQ ID NO: 3576938 - DNA, 22 bp, Homo sapiens
ctggggtctggagttgatctgg

SEQ ID NO: 3576939 - DNA, 14 bp, Homo sapiens
ctggggtgcatctc

SEQ ID NO: 3576940 - DNA, 20 bp, Homo sapiens
ctggggtggggatagggagc

SEQ ID NO: 3576941 - DNA, 14 bp, Homo sapiens
ctgggtccttggct

SEQ ID NO: 3576942 - DNA, 13 bp, Homo sapiens
ctgggtctctaat

SEQ ID NO: 3576943 - DNA, 15 bp, Homo sapiens
ctgggtcttggccat

SEQ ID NO: 3576944 - DNA, 14 bp, Homo sapiens
ctgggtgagaccca

SEQ ID NO: 3576945 - DNA, 21 bp, Homo sapiens
ctgggttaaatattttgctaa

SEQ ID NO: 3576946 - DNA, 23 bp, Homo sapiens
ctgggttaaatattttgctaact

SEQ ID NO: 3576947 - DNA, 15 bp, Homo sapiens
ctgggtttgggagcc

SEQ ID NO: 3576948 - DNA, 20 bp, Homo sapiens
ctgggtttgggagccaggac

SEQ ID NO: 3576949 - DNA, 21 bp, Homo sapiens
ctgggtttgggagccaggact

SEQ ID NO: 3576950 - DNA, 20 bp, Homo sapiens
ctggtaaacattcctccagc

SEQ ID NO: 3576951 - DNA, 22 bp, Homo sapiens
ctggtaataaatgtgactcagc

SEQ ID NO: 3576952 - DNA, 21 bp, Homo sapiens
ctggtagatgctgaggcccct

SEQ ID NO: 3576953 - DNA, 15 bp, Homo sapiens
ctggtagcagcaggc

SEQ ID NO: 3576954 - DNA, 19 bp, Homo sapiens
ctggtagcagcaggctcag

SEQ ID NO: 3576955 - DNA, 19 bp, Homo sapiens
ctggtattattatgttctt

SEQ ID NO: 3576956 - DNA, 16 bp, Homo sapiens
ctggtattggaatagc

SEQ ID NO: 3576957 - DNA, 18 bp, Homo sapiens
ctggtcaaacaaactctc

SEQ ID NO: 3576958 - DNA, 18 bp, Homo sapiens
ctggtcacaggactctgc

SEQ ID NO: 3576959 - DNA, 14 bp, Homo sapiens
ctggtccagctctg

SEQ ID NO: 3576960 - DNA, 18 bp, Homo sapiens
ctggtccagctctgacat

SEQ ID NO: 3576961 - DNA, 22 bp, Homo sapiens
ctggtccagctctgacatccct

SEQ ID NO: 3576962 - DNA, 23 bp, Homo sapiens
ctggtccagctctgacatccctt

SEQ ID NO: 3576963 - DNA, 14 bp, Homo sapiens
ctggtcccacgagg

SEQ ID NO: 3576964 - DNA, 19 bp, Homo sapiens
ctggtcccacgagggtgcc

SEQ ID NO: 3576965 - DNA, 15 bp, Homo sapiens
ctggtccccactgct

SEQ ID NO: 3576966 - DNA, 17 bp, Homo sapiens
ctggtccccactgctga

SEQ ID NO: 3576967 - DNA, 22 bp, Homo sapiens
ctggtcctacccatccccgcag

SEQ ID NO: 3576968 - DNA, 12 bp, Homo sapiens
ctggtcctgcac

SEQ ID NO: 3576969 - DNA, 18 bp, Homo sapiens
ctggtcctgcacatgagt

SEQ ID NO: 3576970 - DNA, 15 bp, Homo sapiens
ctggtcggagaggga

SEQ ID NO: 3576971 - DNA, 18 bp, Homo sapiens
ctggtctcaaactcctga

SEQ ID NO: 3576972 - DNA, 14 bp, Homo sapiens
ctggtcttgaactg

SEQ ID NO: 3576973 - DNA, 18 bp, Homo sapiens
ctggtcttgtggaattgg

SEQ ID NO: 3576974 - DNA, 24 bp, Homo sapiens
ctggtgagtcaccacttcagggct

SEQ ID NO: 3576975 - DNA, 19 bp, Homo sapiens
ctggtgcctatctgcctgg

SEQ ID NO: 3576976 - DNA, 12 bp, Homo sapiens
ctggtgctgcca

SEQ ID NO: 3576977 - DNA, 20 bp, Homo sapiens
ctggtgctgccacacttcag

SEQ ID NO: 3576978 - DNA, 19 bp, Homo sapiens
ctggtggatacctggttga

SEQ ID NO: 3576979 - DNA, 15 bp, Homo sapiens
ctggtggctcccgga

SEQ ID NO: 3576980 - DNA, 19 bp, Homo sapiens
ctggtgggaaggccggcag

SEQ ID NO: 3576981 - DNA, 13 bp, Homo sapiens
ctggtgggccaac

SEQ ID NO: 3576982 - DNA, 22 bp, Homo sapiens
ctggtgtttaggtgaattaatt

SEQ ID NO: 3576983 - DNA, 14 bp, Homo sapiens
ctggtgtttgtcat

SEQ ID NO: 3576984 - DNA, 17 bp, Homo sapiens
ctggtgtttgtcatggt

SEQ ID NO: 3576985 - DNA, 16 bp, Homo sapiens
ctggttacctggagaa

SEQ ID NO: 3576986 - DNA, 14 bp, Homo sapiens
ctggttagaaatgc

SEQ ID NO: 3576987 - DNA, 23 bp, Homo sapiens
ctggttagaaatgcagaatccta

SEQ ID NO: 3576988 - DNA, 17 bp, Homo sapiens
ctggttcagacacagct

SEQ ID NO: 3576989 - DNA, 15 bp, Homo sapiens
ctggttccctgctgc

SEQ ID NO: 3576990 - DNA, 20 bp, Homo sapiens
ctggttctgaggccagaaag

SEQ ID NO: 3576991 - DNA, 14 bp, Homo sapiens
ctggttgagtgtgt

SEQ ID NO: 3576992 - DNA, 13 bp, Homo sapiens
cttccgctgaggg

SEQ ID NO: 3576993 - DNA, 17 bp, Homo sapiens
cttccgctttgaaagaa

SEQ ID NO: 3576994 - DNA, 22 bp, Homo sapiens
cttcctaattgtgcccctaaag

SEQ ID NO: 3576995 - DNA, 17 bp, Homo sapiens
cttcctcacacccctgt

SEQ ID NO: 3576996 - DNA, 20 bp, Homo sapiens
cttcctcagctgcctcctgc

SEQ ID NO: 3576997 - DNA, 18 bp, Homo sapiens
cttcctcgtgggtcccag

SEQ ID NO: 3576998 - DNA, 16 bp, Homo sapiens
cttcctctccactgcc

SEQ ID NO: 3576999 - DNA, 12 bp, Homo sapiens
cttcctgagggc

SEQ ID NO: 3577000 - DNA, 23 bp, Homo sapiens
cttcctgagggctaattctggga

SEQ ID NO: 3577001 - DNA, 12 bp, Homo sapiens
cttcctgccggt

SEQ ID NO: 3577002 - DNA, 10 bp, Homo sapiens
cttcctgctg

SEQ ID NO: 3577003 - DNA, 14 bp, Homo sapiens
cttcctggaaacag

SEQ ID NO: 3577004 - DNA, 17 bp, Homo sapiens
cttcctggaaacagcat

SEQ ID NO: 3577005 - DNA, 19 bp, Homo sapiens
cttcctgggcacacgctgc

SEQ ID NO: 3577006 - DNA, 20 bp, Homo sapiens
cttcctgggcacacgctgct

SEQ ID NO: 3577007 - DNA, 21 bp, Homo sapiens
cttcctgggcacacgctgctc

SEQ ID NO: 3577008 - DNA, 16 bp, Homo sapiens
cttcctgtccagctcc

SEQ ID NO: 3577009 - DNA, 18 bp, Homo sapiens
cttcctgtccagctccaa

SEQ ID NO: 3577010 - DNA, 21 bp, Homo sapiens
cttcctgtgaagtttaattgt

SEQ ID NO: 3577011 - DNA, 15 bp, Homo sapiens
cttcctgtgcctttc

SEQ ID NO: 3577012 - DNA, 19 bp, Homo sapiens
cttcctgtgcctttcctat

SEQ ID NO: 3577013 - DNA, 15 bp, Homo sapiens
cttcctgtgtgtcca

SEQ ID NO: 3577014 - DNA, 20 bp, Homo sapiens
cttcctgtttcagacccccc

SEQ ID NO: 3577015 - DNA, 15 bp, Homo sapiens
cttcctttgtaaaaa

SEQ ID NO: 3577016 - DNA, 13 bp, Homo sapiens
cttccttttaact

SEQ ID NO: 3577017 - DNA, 21 bp, Homo sapiens
cttcgatacaccgggcctgga

SEQ ID NO: 3577018 - DNA, 23 bp, Homo sapiens
cttcgcagccccgggcggagcct

SEQ ID NO: 3577019 - DNA, 15 bp, Homo sapiens
cttcgcgctggaatc

SEQ ID NO: 3577020 - DNA, 24 bp, Homo sapiens
cttcgcgctggaatccagaaggaa

SEQ ID NO: 3577021 - DNA, 21 bp, Homo sapiens
cttctaaaggtgttgtccctt

SEQ ID NO: 3577022 - DNA, 17 bp, Homo sapiens
cttctaagtaaaaccac

SEQ ID NO: 3577023 - DNA, 21 bp, Homo sapiens
cttctaagtaaaaccacagca

SEQ ID NO: 3577024 - DNA, 23 bp, Homo sapiens
cttctaagtaaaaccacagcagt

SEQ ID NO: 3577025 - DNA, 14 bp, Homo sapiens
cttctactcctgcc

SEQ ID NO: 3577026 - DNA, 13 bp, Homo sapiens
cttctagttgccc

SEQ ID NO: 3577027 - DNA, 18 bp, Homo sapiens
cttctatacccacccaga

SEQ ID NO: 3577028 - DNA, 23 bp, Homo sapiens
cttctatagtgatgatgatctca

SEQ ID NO: 3577029 - DNA, 19 bp, Homo sapiens
cttctattaatcaagagaa

SEQ ID NO: 3577030 - DNA, 23 bp, Homo sapiens
cttctattaatcaagagaaactt

SEQ ID NO: 3577031 - DNA, 15 bp, Homo sapiens
cttctatttatttat

SEQ ID NO: 3577032 - DNA, 19 bp, Homo sapiens
cttctcaaagagaattgta

SEQ ID NO: 3577033 - DNA, 14 bp, Homo sapiens
cttctcagatttct

SEQ ID NO: 3577034 - DNA, 15 bp, Homo sapiens
cttctccactggatg

SEQ ID NO: 3577035 - DNA, 14 bp, Homo sapiens
cttctcccagtgtg

SEQ ID NO: 3577036 - DNA, 15 bp, Homo sapiens
cttctcccagtgtga

SEQ ID NO: 3577037 - DNA, 19 bp, Homo sapiens
cttctcctcctctgtcttt

SEQ ID NO: 3577038 - DNA, 17 bp, Homo sapiens
cttctcctttcacaacc

SEQ ID NO: 3577039 - DNA, 20 bp, Homo sapiens
cttctctaattcttcctttg

SEQ ID NO: 3577040 - DNA, 23 bp, Homo sapiens
cttctctaattcttcctttgtaa

SEQ ID NO: 3577041 - DNA, 22 bp, Homo sapiens
cttctctccacatggaagccca

SEQ ID NO: 3577042 - DNA, 14 bp, Homo sapiens
cttctctccagctg

SEQ ID NO: 3577043 - DNA, 15 bp, Homo sapiens
cttctctccagctga

SEQ ID NO: 3577044 - DNA, 17 bp, Homo sapiens
cttctctccagctgact

SEQ ID NO: 3577045 - DNA, 18 bp, Homo sapiens
cttctctccagctgacta

SEQ ID NO: 3577046 - DNA, 19 bp, Homo sapiens
cttctctccagctgactaa

SEQ ID NO: 3577047 - DNA, 14 bp, Homo sapiens
cttctctctccagg

SEQ ID NO: 3577048 - DNA, 21 bp, Homo sapiens
cttctctgcagtaaaacacat

SEQ ID NO: 3577049 - DNA, 14 bp, Homo sapiens
cttctctgcctcac

SEQ ID NO: 3577050 - DNA, 17 bp, Homo sapiens
cttctctgttggtctgc

SEQ ID NO: 3577051 - DNA, 17 bp, Homo sapiens
cttctcttgaaaagttc

SEQ ID NO: 3577052 - DNA, 15 bp, Homo sapiens
cttctcttgctttct

SEQ ID NO: 3577053 - DNA, 22 bp, Homo sapiens
cttctctttcttattttgtaat

SEQ ID NO: 3577054 - DNA, 15 bp, Homo sapiens
cttctgaagaggaaa

SEQ ID NO: 3577055 - DNA, 19 bp, Homo sapiens
cttctgaagatcagaacat

SEQ ID NO: 3577056 - DNA, 15 bp, Homo sapiens
cttctgaagctgctg

SEQ ID NO: 3577057 - DNA, 17 bp, Homo sapiens
cttctgaagtctgagcc

SEQ ID NO: 3577058 - DNA, 21 bp, Homo sapiens
cttctgaagtctgagcccatt

SEQ ID NO: 3577059 - DNA, 13 bp, Homo sapiens
cttctgccttttc

SEQ ID NO: 3577060 - DNA, 17 bp, Homo sapiens
cttctgctcgtttacac

SEQ ID NO: 3577061 - DNA, 17 bp, Homo sapiens
cttctgctcttttcctg

SEQ ID NO: 3577062 - DNA, 11 bp, Homo sapiens
cttctgctgaa

SEQ ID NO: 3577063 - DNA, 14 bp, Homo sapiens
cttctggcctccca

SEQ ID NO: 3577064 - DNA, 16 bp, Homo sapiens
cttctgggtccaggga

SEQ ID NO: 3577065 - DNA, 18 bp, Homo sapiens
cttctgtcttcacaacag

SEQ ID NO: 3577066 - DNA, 21 bp, Homo sapiens
cttctgtcttcacaacagatt

SEQ ID NO: 3577067 - DNA, 16 bp, Homo sapiens
cttctgttttcttctt

SEQ ID NO: 3577068 - DNA, 16 bp, Homo sapiens
cttcttatacatttga

SEQ ID NO: 3577069 - DNA, 21 bp, Homo sapiens
cttcttgatgtatttctccat

SEQ ID NO: 3577070 - DNA, 20 bp, Homo sapiens
cttcttgcttctttctagaa

SEQ ID NO: 3577071 - DNA, 22 bp, Homo sapiens
cttctttataattctactttga

SEQ ID NO: 3577072 - DNA, 15 bp, Homo sapiens
cttctttctccatgg

SEQ ID NO: 3577073 - DNA, 13 bp, Homo sapiens
cttctttcttcca

SEQ ID NO: 3577074 - DNA, 11 bp, Homo sapiens
cttctttcttt

SEQ ID NO: 3577075 - DNA, 15 bp, Homo sapiens
cttctttctttcttt

SEQ ID NO: 3577076 - DNA, 13 bp, Homo sapiens
cttctttgtgcct

SEQ ID NO: 3577077 - DNA, 16 bp, Homo sapiens
cttctttgtgcctttg

SEQ ID NO: 3577078 - DNA, 18 bp, Homo sapiens
cttcttttcctgcagggg

SEQ ID NO: 3577079 - DNA, 17 bp, Homo sapiens
cttctttttttgtgatg

SEQ ID NO: 3577080 - DNA, 11 bp, Homo sapiens
cttgaaaagtt

SEQ ID NO: 3577081 - DNA, 19 bp, Homo sapiens
cttgaaaagttcagggacc

SEQ ID NO: 3577082 - DNA, 20 bp, Homo sapiens
cttgaaacagattcaggcca

SEQ ID NO: 3577083 - DNA, 21 bp, Homo sapiens
cttgaaacagattcaggccag

SEQ ID NO: 3577084 - DNA, 19 bp, Homo sapiens
cttgaacctgggaggcaga

SEQ ID NO: 3577085 - DNA, 23 bp, Homo sapiens
cttgaacgagcagcccagggcct

SEQ ID NO: 3577086 - DNA, 14 bp, Homo sapiens
cttgaactgggctc

SEQ ID NO: 3577087 - DNA, 15 bp, Homo sapiens
cttgaactgggctca

SEQ ID NO: 3577088 - DNA, 22 bp, Homo sapiens
cttgaagaaacagagtggcctc

SEQ ID NO: 3577089 - DNA, 18 bp, Homo sapiens
cttgaagggccagagcca

SEQ ID NO: 3577090 - DNA, 20 bp, Homo sapiens
cttgaagggccagagccagg

SEQ ID NO: 3577091 - DNA, 14 bp, Homo sapiens
cttgaaggtgctga

SEQ ID NO: 3577092 - DNA, 16 bp, Homo sapiens
cttgaatggtttttct

SEQ ID NO: 3577093 - DNA, 19 bp, Homo sapiens
cttgactgcattgccgctg

SEQ ID NO: 3577094 - DNA, 19 bp, Homo sapiens
cttgactgggtgagaccca

SEQ ID NO: 3577095 - DNA, 15 bp, Homo sapiens
cttgactttccagaa

SEQ ID NO: 3577096 - DNA, 21 bp, Homo sapiens
cttgactttccagaatgacct

SEQ ID NO: 3577097 - DNA, 20 bp, Homo sapiens
cttgagaaccagtctcctca

SEQ ID NO: 3577098 - DNA, 21 bp, Homo sapiens
cttgagaaccagtctcctcac

SEQ ID NO: 3577099 - DNA, 22 bp, Homo sapiens
cttgagagttccggggagaaac

SEQ ID NO: 3577100 - DNA, 19 bp, Homo sapiens
cttgagattcaagacaaga

SEQ ID NO: 3577101 - DNA, 20 bp, Homo sapiens
cttgaggaaacaacagcttt

SEQ ID NO: 3577102 - DNA, 22 bp, Homo sapiens
cttgagtgtcaagctgaccttg

SEQ ID NO: 3577103 - DNA, 17 bp, Homo sapiens
cttgagttaacaggaca

SEQ ID NO: 3577104 - DNA, 22 bp, Homo sapiens
cttgagttaacaggacagttga

SEQ ID NO: 3577105 - DNA, 23 bp, Homo sapiens
cttgagttgaagatctttgacat

SEQ ID NO: 3577106 - DNA, 23 bp, Homo sapiens
cttgatagcctcattaaagcatt

SEQ ID NO: 3577107 - DNA, 17 bp, Homo sapiens
cttgatctctcttgtcc

SEQ ID NO: 3577108 - DNA, 22 bp, Homo sapiens
cttgatctctcttgtcctcttc

SEQ ID NO: 3577109 - DNA, 23 bp, Homo sapiens
cttgatctctcttgtcctcttct

SEQ ID NO: 3577110 - DNA, 16 bp, Homo sapiens
cttgatggctaactta

SEQ ID NO: 3577111 - DNA, 21 bp, Homo sapiens
cttgatggctaacttacaaag

SEQ ID NO: 3577112 - DNA, 23 bp, Homo sapiens
cttgcagaaggcaaggccctgcc

SEQ ID NO: 3577113 - DNA, 15 bp, Homo sapiens
cttgcagcatttact

SEQ ID NO: 3577114 - DNA, 22 bp, Homo sapiens
cttgcagcatttactatgcaca

SEQ ID NO: 3577115 - DNA, 18 bp, Homo sapiens
cttgcagcggctcctgca

SEQ ID NO: 3577116 - DNA, 19 bp, Homo sapiens
cttgcagcggctcctgcaa

SEQ ID NO: 3577117 - DNA, 21 bp, Homo sapiens
cttgcataggctcttaagcag

SEQ ID NO: 3577118 - DNA, 12 bp, Homo sapiens
cttgccagagat

SEQ ID NO: 3577119 - DNA, 23 bp, Homo sapiens
cttgccagagatccaaaagaagc

SEQ ID NO: 3577120 - DNA, 17 bp, Homo sapiens
cttgcccgctcccacag

SEQ ID NO: 3577121 - DNA, 23 bp, Homo sapiens
cttgcctaaatttaatgctgcct

SEQ ID NO: 3577122 - DNA, 21 bp, Homo sapiens
cttgcctatctgacttcatac

SEQ ID NO: 3577123 - DNA, 21 bp, Homo sapiens
gaaatttgttatacttcaaaa

SEQ ID NO: 3577124 - DNA, 16 bp, Homo sapiens
gaacaaagaaaatgtt

SEQ ID NO: 3577125 - DNA, 18 bp, Homo sapiens
gaacaagttttggcagcc

SEQ ID NO: 3577126 - DNA, 11 bp, Homo sapiens
gaacacagcta

SEQ ID NO: 3577127 - DNA, 23 bp, Homo sapiens
gaacaccttggggtccctccacc

SEQ ID NO: 3577128 - DNA, 22 bp, Homo sapiens
gaacactgagaaagaggcaggg

SEQ ID NO: 3577129 - DNA, 22 bp, Homo sapiens
gaacagaactcggtgtccccac

SEQ ID NO: 3577130 - DNA, 18 bp, Homo sapiens
gaacagataatccctgta

SEQ ID NO: 3577131 - DNA, 13 bp, Homo sapiens
gaacagccttaga

SEQ ID NO: 3577132 - DNA, 18 bp, Homo sapiens
gaacagtggttgcctggg

SEQ ID NO: 3577133 - DNA, 19 bp, Homo sapiens
gaacagtggttgcctgggg

SEQ ID NO: 3577134 - DNA, 20 bp, Homo sapiens
gaacagtggttgcctggggg

SEQ ID NO: 3577135 - DNA, 22 bp, Homo sapiens
gaacataaaaaggacatcagca

SEQ ID NO: 3577136 - DNA, 22 bp, Homo sapiens
gaacatgtgttttcatcatttc

SEQ ID NO: 3577137 - DNA, 23 bp, Homo sapiens
gaacatgtgttttcatcatttca

SEQ ID NO: 3577138 - DNA, 17 bp, Homo sapiens
gaacattcagctctgga

SEQ ID NO: 3577139 - DNA, 22 bp, Homo sapiens
gaacattcagctctggagaaca

SEQ ID NO: 3577140 - DNA, 20 bp, Homo sapiens
gaaccaaattgcactgaagt

SEQ ID NO: 3577141 - DNA, 15 bp, Homo sapiens
gaaccacattcaggg

SEQ ID NO: 3577142 - DNA, 19 bp, Homo sapiens
gaaccacattgaagaatgt

SEQ ID NO: 3577143 - DNA, 22 bp, Homo sapiens
gaaccactcccaccacaggcat

SEQ ID NO: 3577144 - DNA, 21 bp, Homo sapiens
gaaccagccaaccatcatgtg

SEQ ID NO: 3577145 - DNA, 20 bp, Homo sapiens
gaaccagccgtattttacat

SEQ ID NO: 3577146 - DNA, 18 bp, Homo sapiens
gaaccagggctcttctca

SEQ ID NO: 3577147 - DNA, 19 bp, Homo sapiens
gaaccatgcaggaaggaaa

SEQ ID NO: 3577148 - DNA, 17 bp, Homo sapiens
gaacccaccaaccagaa

SEQ ID NO: 3577149 - DNA, 19 bp, Homo sapiens
gaacccagactcagacatt

SEQ ID NO: 3577150 - DNA, 11 bp, Homo sapiens
gaaccctcagg

SEQ ID NO: 3577151 - DNA, 18 bp, Homo sapiens
gaaccctcaggccaccct

SEQ ID NO: 3577152 - DNA, 12 bp, Homo sapiens
gaaccctggagg

SEQ ID NO: 3577153 - DNA, 16 bp, Homo sapiens
gaaccctggaggtaaa

SEQ ID NO: 3577154 - DNA, 20 bp, Homo sapiens
gaacctacagactccatctc

SEQ ID NO: 3577155 - DNA, 18 bp, Homo sapiens
gaacctacctgccttgga

SEQ ID NO: 3577156 - DNA, 14 bp, Homo sapiens
gaacctcagcctgg

SEQ ID NO: 3577157 - DNA, 21 bp, Homo sapiens
gaacctcagcctggccagaca

SEQ ID NO: 3577158 - DNA, 16 bp, Homo sapiens
gaacctctaagtgctg

SEQ ID NO: 3577159 - DNA, 20 bp, Homo sapiens
gaacctctaagtgctgctgt

SEQ ID NO: 3577160 - DNA, 21 bp, Homo sapiens
gaacctctaagtgctgctgtg

SEQ ID NO: 3577161 - DNA, 23 bp, Homo sapiens
gaacctctaagtgctgctgtgga

SEQ ID NO: 3577162 - DNA, 18 bp, Homo sapiens
gaacctgaagaactattt

SEQ ID NO: 3577163 - DNA, 17 bp, Homo sapiens
gaacctgctacttaaaa

SEQ ID NO: 3577164 - DNA, 21 bp, Homo sapiens
gaacctgtcttattaagactg

SEQ ID NO: 3577165 - DNA, 22 bp, Homo sapiens
gaacctgtcttattaagactgg

SEQ ID NO: 3577166 - DNA, 14 bp, Homo sapiens
gaaccttaatgaca

SEQ ID NO: 3577167 - DNA, 19 bp, Homo sapiens
gaaccttaatgacaacact

SEQ ID NO: 3577168 - DNA, 13 bp, Homo sapiens
gaacgagcagccc

SEQ ID NO: 3577169 - DNA, 14 bp, Homo sapiens
gaacgagcagccca

SEQ ID NO: 3577170 - DNA, 16 bp, Homo sapiens
gaacgagcagcccagg

SEQ ID NO: 3577171 - DNA, 19 bp, Homo sapiens
gaacgagcagcccagggcc

SEQ ID NO: 3577172 - DNA, 15 bp, Homo sapiens
gaacgcaccccactg

SEQ ID NO: 3577173 - DNA, 20 bp, Homo sapiens
gaacgcaccccactgggaga

SEQ ID NO: 3577174 - DNA, 18 bp, Homo sapiens
gaacgcccccccccaccc

SEQ ID NO: 3577175 - DNA, 20 bp, Homo sapiens
gaacgcccccccccacccct

SEQ ID NO: 3577176 - DNA, 19 bp, Homo sapiens
gaacgttttaataattttt

SEQ ID NO: 3577177 - DNA, 17 bp, Homo sapiens
gaactaccatgctttgt

SEQ ID NO: 3577178 - DNA, 16 bp, Homo sapiens
gaactcaaatggggcc

SEQ ID NO: 3577179 - DNA, 17 bp, Homo sapiens
gaactcaccctgggagc

SEQ ID NO: 3577180 - DNA, 22 bp, Homo sapiens
gaactcaccctgggagccagtc

SEQ ID NO: 3577181 - DNA, 13 bp, Homo sapiens
gaactcagatcca

SEQ ID NO: 3577182 - DNA, 15 bp, Homo sapiens
gaactcagatccagg

SEQ ID NO: 3577183 - DNA, 16 bp, Homo sapiens
gaactcagatccaggg

SEQ ID NO: 3577184 - DNA, 18 bp, Homo sapiens
gaactcagatccagggac

SEQ ID NO: 3577185 - DNA, 21 bp, Homo sapiens
gaactcagatccagggacaga

SEQ ID NO: 3577186 - DNA, 19 bp, Homo sapiens
gaactcctgtcttctttct

SEQ ID NO: 3577187 - DNA, 23 bp, Homo sapiens
gaactcgcagggaatgcagcagg

SEQ ID NO: 3577188 - DNA, 14 bp, Homo sapiens
gaactctcagaaat

SEQ ID NO: 3577189 - DNA, 19 bp, Homo sapiens
gaactctggtgctcctgca

SEQ ID NO: 3577190 - DNA, 12 bp, Homo sapiens
gaactcttcctc

SEQ ID NO: 3577191 - DNA, 20 bp, Homo sapiens
gaactcttcctcctcccaag

SEQ ID NO: 3577192 - DNA, 16 bp, Homo sapiens
gaactgaccctcaggc

SEQ ID NO: 3577193 - DNA, 16 bp, Homo sapiens
gaactgactgaaggaa

SEQ ID NO: 3577194 - DNA, 23 bp, Homo sapiens
gaactgaggagatgaccagggat

SEQ ID NO: 3577195 - DNA, 16 bp, Homo sapiens
gaactgagtatgtgta

SEQ ID NO: 3577196 - DNA, 17 bp, Homo sapiens
gaactgctgggcttggc

SEQ ID NO: 3577197 - DNA, 20 bp, Homo sapiens
gaactgctgggcttggcagc

SEQ ID NO: 3577198 - DNA, 23 bp, Homo sapiens
gaactggacacaataggtctttc

SEQ ID NO: 3577199 - DNA, 19 bp, Homo sapiens
gaactgggcatatttctaa

SEQ ID NO: 3577200 - DNA, 14 bp, Homo sapiens
gaacttgctgcctc

SEQ ID NO: 3577201 - DNA, 22 bp, Homo sapiens
gaacttggggagttaagacctg

SEQ ID NO: 3577202 - DNA, 14 bp, Homo sapiens
gaactttctccctc

SEQ ID NO: 3577203 - DNA, 22 bp, Homo sapiens
gaacttttcctctgtatcactg

SEQ ID NO: 3577204 - DNA, 13 bp, Homo sapiens
gaactttttcctc

SEQ ID NO: 3577205 - DNA, 23 bp, Homo sapiens
gaagaaaaataataaagtcagaa

SEQ ID NO: 3577206 - DNA, 14 bp, Homo sapiens
gaagaaaagattct

SEQ ID NO: 3577207 - DNA, 14 bp, Homo sapiens
gaagaaaggactga

SEQ ID NO: 3577208 - DNA, 20 bp, Homo sapiens
gaagaactagtagaagaagc

SEQ ID NO: 3577209 - DNA, 15 bp, Homo sapiens
gaagaagaaaggact

SEQ ID NO: 3577210 - DNA, 20 bp, Homo sapiens
gaagaagaggcctagcctga

SEQ ID NO: 3577211 - DNA, 12 bp, Homo sapiens
gaagaaggcaag

SEQ ID NO: 3577212 - DNA, 13 bp, Homo sapiens
gaagaagtgtgtc

SEQ ID NO: 3577213 - DNA, 15 bp, Homo sapiens
gaagaataaattcta

SEQ ID NO: 3577214 - DNA, 20 bp, Homo sapiens
gaagaataagtcatggagcc

SEQ ID NO: 3577215 - DNA, 14 bp, Homo sapiens
gaagaatcttcctg

SEQ ID NO: 3577216 - DNA, 17 bp, Homo sapiens
gaagaatgcattcaaaa

SEQ ID NO: 3577217 - DNA, 19 bp, Homo sapiens
gaagaatgttagagtaatg

SEQ ID NO: 3577218 - DNA, 12 bp, Homo sapiens
gaagacacagac

SEQ ID NO: 3577219 - DNA, 15 bp, Homo sapiens
gaagacccaaaacag

SEQ ID NO: 3577220 - DNA, 18 bp, Homo sapiens
gaagacccaaaacagctt

SEQ ID NO: 3577221 - DNA, 21 bp, Homo sapiens
gaagacccaaaacagctttgt

SEQ ID NO: 3577222 - DNA, 23 bp, Homo sapiens
gaagacccaaaacagctttgtct

SEQ ID NO: 3577223 - DNA, 14 bp, Homo sapiens
gaagaccctccccg

SEQ ID NO: 3577224 - DNA, 13 bp, Homo sapiens
gaagacctgaaag

SEQ ID NO: 3577225 - DNA, 24 bp, Homo sapiens
gaagagaagtgaccgagagaacct

SEQ ID NO: 3577226 - DNA, 22 bp, Homo sapiens
gaagagagggacaggcactcca

SEQ ID NO: 3577227 - DNA, 15 bp, Homo sapiens
gaagagctgagacct

SEQ ID NO: 3577228 - DNA, 13 bp, Homo sapiens
gaagagctgttca

SEQ ID NO: 3577229 - DNA, 20 bp, Homo sapiens
gaagagctgttcacagccag

SEQ ID NO: 3577230 - DNA, 14 bp, Homo sapiens
gaagaggagaaaaa

SEQ ID NO: 3577231 - DNA, 21 bp, Homo sapiens
gaagaggagaaaaagaagaaa

SEQ ID NO: 3577232 - DNA, 18 bp, Homo sapiens
gaagagggcccagcccag

SEQ ID NO: 3577233 - DNA, 19 bp, Homo sapiens
gaagagggcccagcccaga

SEQ ID NO: 3577234 - DNA, 14 bp, Homo sapiens
gaagataaaaaaac

SEQ ID NO: 3577235 - DNA, 13 bp, Homo sapiens
gaagatattattt

SEQ ID NO: 3577236 - DNA, 14 bp, Homo sapiens
gaagatcagaacat

SEQ ID NO: 3577237 - DNA, 12 bp, Homo sapiens
gaagatgaaatt

SEQ ID NO: 3577238 - DNA, 18 bp, Homo sapiens
gaagatgacctgccccaa

SEQ ID NO: 3577239 - DNA, 16 bp, Homo sapiens
gaagatgccagcttct

SEQ ID NO: 3577240 - DNA, 20 bp, Homo sapiens
gaagatgccagcttctctct

SEQ ID NO: 3577241 - DNA, 16 bp, Homo sapiens
gaagatgcctgttaat

SEQ ID NO: 3577242 - DNA, 21 bp, Homo sapiens
gaagatggagacaccctctgg

SEQ ID NO: 3577243 - DNA, 13 bp, Homo sapiens
gaagattatatga

SEQ ID NO: 3577244 - DNA, 21 bp, Homo sapiens
gaagattggggacactcatat

SEQ ID NO: 3577245 - DNA, 14 bp, Homo sapiens
gaagcaacatttta

SEQ ID NO: 3577246 - DNA, 18 bp, Homo sapiens
gaagcaagaatggaggaa

SEQ ID NO: 3577247 - DNA, 12 bp, Homo sapiens
gaagcagaacct

SEQ ID NO: 3577248 - DNA, 20 bp, Homo sapiens
gaagcatgaacgtggattgt

SEQ ID NO: 3577249 - DNA, 14 bp, Homo sapiens
gaagccaccctggg

SEQ ID NO: 3577250 - DNA, 10 bp, Homo sapiens
gaagccagcc

SEQ ID NO: 3577251 - DNA, 12 bp, Homo sapiens
gaagccagccac

SEQ ID NO: 3577252 - DNA, 17 bp, Homo sapiens
gaagccagccacagacc

SEQ ID NO: 3577253 - DNA, 19 bp, Homo sapiens
gaagccaggaatttcccag

SEQ ID NO: 3577254 - DNA, 24 bp, Homo sapiens
gaagccaggaatttcccaggaccc

SEQ ID NO: 3577255 - DNA, 22 bp, Homo sapiens
gacttcctgtccagctccaacc

SEQ ID NO: 3577256 - DNA, 13 bp, Homo sapiens
gacttgaaaagaa

SEQ ID NO: 3577257 - DNA, 18 bp, Homo sapiens
gacttgtatattctattt

SEQ ID NO: 3577258 - DNA, 21 bp, Homo sapiens
gacttgtatattctattttac

SEQ ID NO: 3577259 - DNA, 19 bp, Homo sapiens
gacttgtatattttaagaa

SEQ ID NO: 3577260 - DNA, 15 bp, Homo sapiens
gacttgtgattggct

SEQ ID NO: 3577261 - DNA, 12 bp, Homo sapiens
gacttgtttccc

SEQ ID NO: 3577262 - DNA, 21 bp, Homo sapiens
gactttatttatttctagttc

SEQ ID NO: 3577263 - DNA, 19 bp, Homo sapiens
gactttgatactaccaggg

SEQ ID NO: 3577264 - DNA, 17 bp, Homo sapiens
gactttgcagatggaaa

SEQ ID NO: 3577265 - DNA, 20 bp, Homo sapiens
gactttgcagatggaaagag

SEQ ID NO: 3577266 - DNA, 17 bp, Homo sapiens
gactttgtttttaaaat

SEQ ID NO: 3577267 - DNA, 21 bp, Homo sapiens
gacttttaatgtcatttgtta

SEQ ID NO: 3577268 - DNA, 14 bp, Homo sapiens
gagaaaaagaagaa

SEQ ID NO: 3577269 - DNA, 17 bp, Homo sapiens
gagaaaaagaagaaaag

SEQ ID NO: 3577270 - DNA, 18 bp, Homo sapiens
gagaaaaagaagaaaaga

SEQ ID NO: 3577271 - DNA, 15 bp, Homo sapiens
gagaaaacctgttct

SEQ ID NO: 3577272 - DNA, 18 bp, Homo sapiens
gagaaaaccttaaaagta

SEQ ID NO: 3577273 - DNA, 16 bp, Homo sapiens
gagaaaataaatttaa

SEQ ID NO: 3577274 - DNA, 18 bp, Homo sapiens
gagaaaataaatttaact

SEQ ID NO: 3577275 - DNA, 17 bp, Homo sapiens
gagaaacagctcagcca

SEQ ID NO: 3577276 - DNA, 18 bp, Homo sapiens
gagaaacagttggtaact

SEQ ID NO: 3577277 - DNA, 22 bp, Homo sapiens
gagaaacccacgacctgtcctg

SEQ ID NO: 3577278 - DNA, 12 bp, Homo sapiens
gagaaacccaga

SEQ ID NO: 3577279 - DNA, 13 bp, Homo sapiens
gagaaacctgcca

SEQ ID NO: 3577280 - DNA, 21 bp, Homo sapiens
gagaaacctgccaaggagcat

SEQ ID NO: 3577281 - DNA, 13 bp, Homo sapiens
gagaaagactatt

SEQ ID NO: 3577282 - DNA, 15 bp, Homo sapiens
gagaaagagagaagc

SEQ ID NO: 3577283 - DNA, 19 bp, Homo sapiens
gagaaagagagaagccagc

SEQ ID NO: 3577284 - DNA, 18 bp, Homo sapiens
gagaaagagctgcctgga

SEQ ID NO: 3577285 - DNA, 19 bp, Homo sapiens
gagaaagtggaaaatgacc

SEQ ID NO: 3577286 - DNA, 20 bp, Homo sapiens
gagaaatatatttgtcactt

SEQ ID NO: 3577287 - DNA, 13 bp, Homo sapiens
gagaaatgcccca

SEQ ID NO: 3577288 - DNA, 22 bp, Homo sapiens
gagaacaacaaatatgttctct

SEQ ID NO: 3577289 - DNA, 19 bp, Homo sapiens
gagaacagtggttgcctgg

SEQ ID NO: 3577290 - DNA, 21 bp, Homo sapiens
gagaacagtggttgcctgggg

SEQ ID NO: 3577291 - DNA, 21 bp, Homo sapiens
gagaaccagtctcctcactct

SEQ ID NO: 3577292 - DNA, 14 bp, Homo sapiens
gagaaccctgagca

SEQ ID NO: 3577293 - DNA, 15 bp, Homo sapiens
gagaaccttttcaaa

SEQ ID NO: 3577294 - DNA, 14 bp, Homo sapiens
gagaacttgctgcc

SEQ ID NO: 3577295 - DNA, 13 bp, Homo sapiens
gagaagagctgtt

SEQ ID NO: 3577296 - DNA, 15 bp, Homo sapiens
gagaagagctgttca

SEQ ID NO: 3577297 - DNA, 19 bp, Homo sapiens
gagaagagggcccagccca

SEQ ID NO: 3577298 - DNA, 13 bp, Homo sapiens
gagaagccagcca

SEQ ID NO: 3577299 - DNA, 15 bp, Homo sapiens
gagaagccagccaca

SEQ ID NO: 3577300 - DNA, 16 bp, Homo sapiens
gagaagccagccacag

SEQ ID NO: 3577301 - DNA, 23 bp, Homo sapiens
gagaaggacccggaggggcctgg

SEQ ID NO: 3577302 - DNA, 21 bp, Homo sapiens
gagaagtgctcttggctgacc

SEQ ID NO: 3577303 - DNA, 20 bp, Homo sapiens
gagaagtttgtagccaggta

SEQ ID NO: 3577304 - DNA, 19 bp, Homo sapiens
gagaatagatcagtatttc

SEQ ID NO: 3577305 - DNA, 18 bp, Homo sapiens
gagaatgggacgaggaca

SEQ ID NO: 3577306 - DNA, 22 bp, Homo sapiens
gagaatgtgtgtgtgtggcagg

SEQ ID NO: 3577307 - DNA, 14 bp, Homo sapiens
gagaattatctcaa

SEQ ID NO: 3577308 - DNA, 22 bp, Homo sapiens
gagaattatctcaagtaaaaca

SEQ ID NO: 3577309 - DNA, 21 bp, Homo sapiens
gagaatttctaccatttcaga

SEQ ID NO: 3577310 - DNA, 18 bp, Homo sapiens
gagacacatacagagtgg

SEQ ID NO: 3577311 - DNA, 21 bp, Homo sapiens
gagacacatacagagtgggcc

SEQ ID NO: 3577312 - DNA, 21 bp, Homo sapiens
gagacaccaagctcacccttc

SEQ ID NO: 3577313 - DNA, 20 bp, Homo sapiens
gagacactgttgataaaaac

SEQ ID NO: 3577314 - DNA, 22 bp, Homo sapiens
gagacagaccacttgccacgct

SEQ ID NO: 3577315 - DNA, 17 bp, Homo sapiens
gagacagactagaagtt

SEQ ID NO: 3577316 - DNA, 15 bp, Homo sapiens
gagacagatcactcc

SEQ ID NO: 3577317 - DNA, 18 bp, Homo sapiens
gagacagatcactcctgg

SEQ ID NO: 3577318 - DNA, 23 bp, Homo sapiens
gagacaggtgcctaacctgggac

SEQ ID NO: 3577319 - DNA, 18 bp, Homo sapiens
gagacagttcaagaaagc

SEQ ID NO: 3577320 - DNA, 20 bp, Homo sapiens
gagacatacttgaagggcca

SEQ ID NO: 3577321 - DNA, 17 bp, Homo sapiens
gagaccataagagaaac

SEQ ID NO: 3577322 - DNA, 20 bp, Homo sapiens
gagaccataagagaaacctg

SEQ ID NO: 3577323 - DNA, 22 bp, Homo sapiens
gagaccccaaagactctggagg

SEQ ID NO: 3577324 - DNA, 16 bp, Homo sapiens
gagaccccgcacccgg

SEQ ID NO: 3577325 - DNA, 16 bp, Homo sapiens
gagaccctgcaagacc

SEQ ID NO: 3577326 - DNA, 23 bp, Homo sapiens
gagaccctgcaagaccacggagg

SEQ ID NO: 3577327 - DNA, 14 bp, Homo sapiens
gagacctccagcta

SEQ ID NO: 3577328 - DNA, 22 bp, Homo sapiens
gagaccttgctttgagactcct

SEQ ID NO: 3577329 - DNA, 15 bp, Homo sapiens
gagactgagcagccg

SEQ ID NO: 3577330 - DNA, 17 bp, Homo sapiens
gagactgagcagccgcc

SEQ ID NO: 3577331 - DNA, 22 bp, Homo sapiens
gagactgtctcaagagggcact

SEQ ID NO: 3577332 - DNA, 19 bp, Homo sapiens
gagactttgatactaccag

SEQ ID NO: 3577333 - DNA, 22 bp, Homo sapiens
gagactttgatactaccagggt

SEQ ID NO: 3577334 - DNA, 13 bp, Homo sapiens
gagagaaagagag

SEQ ID NO: 3577335 - DNA, 17 bp, Homo sapiens
gagagaaagagagaagc

SEQ ID NO: 3577336 - DNA, 20 bp, Homo sapiens
gagagaaagagagaagccag

SEQ ID NO: 3577337 - DNA, 21 bp, Homo sapiens
gagagaaagagagaagccagc

SEQ ID NO: 3577338 - DNA, 15 bp, Homo sapiens
gagagaagccagcca

SEQ ID NO: 3577339 - DNA, 18 bp, Homo sapiens
gagagaagccagccacag

SEQ ID NO: 3577340 - DNA, 20 bp, Homo sapiens
gagagaccccgcacccggct

SEQ ID NO: 3577341 - DNA, 14 bp, Homo sapiens
gagagaccctgcaa

SEQ ID NO: 3577342 - DNA, 15 bp, Homo sapiens
gagagactgagcagc

SEQ ID NO: 3577343 - DNA, 17 bp, Homo sapiens
gagagactgagcagccg

SEQ ID NO: 3577344 - DNA, 13 bp, Homo sapiens
gagagcagcagca

SEQ ID NO: 3577345 - DNA, 18 bp, Homo sapiens
gagagccaggatgcccag

SEQ ID NO: 3577346 - DNA, 19 bp, Homo sapiens
gagagccaggatgcccaga

SEQ ID NO: 3577347 - DNA, 15 bp, Homo sapiens
gagagcccgggagct

SEQ ID NO: 3577348 - DNA, 15 bp, Homo sapiens
gagagcggctggaga

SEQ ID NO: 3577349 - DNA, 20 bp, Homo sapiens
gagagcggctggagaaagat

SEQ ID NO: 3577350 - DNA, 14 bp, Homo sapiens
gagagctttctgcc

SEQ ID NO: 3577351 - DNA, 20 bp, Homo sapiens
gagagctttctgccttagcc

SEQ ID NO: 3577352 - DNA, 18 bp, Homo sapiens
gagaggcagcatgcttgg

SEQ ID NO: 3577353 - DNA, 16 bp, Homo sapiens
gagaggccctctggag

SEQ ID NO: 3577354 - DNA, 20 bp, Homo sapiens
gagaggccctctggagtggc

SEQ ID NO: 3577355 - DNA, 13 bp, Homo sapiens
gagagggaaaagg

SEQ ID NO: 3577356 - DNA, 15 bp, Homo sapiens
gagagggaagatgac

SEQ ID NO: 3577357 - DNA, 15 bp, Homo sapiens
gagagggacaggcac

SEQ ID NO: 3577358 - DNA, 18 bp, Homo sapiens
gagagggaggcaagccct

SEQ ID NO: 3577359 - DNA, 19 bp, Homo sapiens
gagagggcccaggtcccaa

SEQ ID NO: 3577360 - DNA, 15 bp, Homo sapiens
gagaggggaaagtgt

SEQ ID NO: 3577361 - DNA, 19 bp, Homo sapiens
gagaggtgattctcagggc

SEQ ID NO: 3577362 - DNA, 22 bp, Homo sapiens
gagaggtgattctcagggctgg

SEQ ID NO: 3577363 - DNA, 19 bp, Homo sapiens
gagaggtttcgatatttat

SEQ ID NO: 3577364 - DNA, 17 bp, Homo sapiens
gagagtagctgcagcct

SEQ ID NO: 3577365 - DNA, 23 bp, Homo sapiens
gagagtagctgcagccttcatca

SEQ ID NO: 3577366 - DNA, 17 bp, Homo sapiens
gagagtggagagagcag

SEQ ID NO: 3577367 - DNA, 18 bp, Homo sapiens
gagagtggagagagcagg

SEQ ID NO: 3577368 - DNA, 15 bp, Homo sapiens
gagagttccggggag

SEQ ID NO: 3577369 - DNA, 14 bp, Homo sapiens
gagagtttcctgaa

SEQ ID NO: 3577370 - DNA, 17 bp, Homo sapiens
gagataaggtggcttct

SEQ ID NO: 3577371 - DNA, 14 bp, Homo sapiens
gagatactggtgga

SEQ ID NO: 3577372 - DNA, 15 bp, Homo sapiens
gagatagttttttct

SEQ ID NO: 3577373 - DNA, 14 bp, Homo sapiens
gagatattgatatt

SEQ ID NO: 3577374 - DNA, 23 bp, Homo sapiens
gagatcaggagtgacagatcaca

SEQ ID NO: 3577375 - DNA, 18 bp, Homo sapiens
gagatctgtgtggctcct

SEQ ID NO: 3577376 - DNA, 21 bp, Homo sapiens
gagatctgtgtggctcctggg

SEQ ID NO: 3577377 - DNA, 22 bp, Homo sapiens
gagatctttctttccaaaacat

SEQ ID NO: 3577378 - DNA, 17 bp, Homo sapiens
gagatgaccagggatgc

SEQ ID NO: 3577379 - DNA, 16 bp, Homo sapiens
gagatgagtgtctgga

SEQ ID NO: 3577380 - DNA, 17 bp, Homo sapiens
gagatgagtgtctggag

SEQ ID NO: 3577381 - DNA, 17 bp, Homo sapiens
gagatgctgtgcccctg

SEQ ID NO: 3577382 - DNA, 16 bp, Homo sapiens
gagatggagtttctct

SEQ ID NO: 3577383 - DNA, 16 bp, Homo sapiens
gagatggccatgctca

SEQ ID NO: 3577384 - DNA, 15 bp, Homo sapiens
gagatgtagaaagtt

SEQ ID NO: 3577385 - DNA, 18 bp, Homo sapiens
gagattcaagacaagagc

SEQ ID NO: 3577386 - DNA, 22 bp, Homo sapiens
gagattcaagacaagagctgtt

SEQ ID NO: 3577387 - DNA, 17 bp, Homo sapiens
gagtggcctccctgctg

SEQ ID NO: 3577388 - DNA, 15 bp, Homo sapiens
gagtgggctctgagc

SEQ ID NO: 3577389 - DNA, 21 bp, Homo sapiens
gagtgtagcctaaagggcagg

SEQ ID NO: 3577390 - DNA, 22 bp, Homo sapiens
gagtgtagcctaaagggcaggg

SEQ ID NO: 3577391 - DNA, 23 bp, Homo sapiens
gagtgtagctgtaagggcagtgc

SEQ ID NO: 3577392 - DNA, 18 bp, Homo sapiens
gagtgtcctgcccatgcc

SEQ ID NO: 3577393 - DNA, 19 bp, Homo sapiens
gagtgtcttaattaaaaga

SEQ ID NO: 3577394 - DNA, 12 bp, Homo sapiens
gagttaagacct

SEQ ID NO: 3577395 - DNA, 21 bp, Homo sapiens
gagttaagacctggcagctct

SEQ ID NO: 3577396 - DNA, 23 bp, Homo sapiens
gagttccggggagaaacccagag

SEQ ID NO: 3577397 - DNA, 12 bp, Homo sapiens
gagttcctctgc

SEQ ID NO: 3577398 - DNA, 23 bp, Homo sapiens
gagttccttatccctctcttccc

SEQ ID NO: 3577399 - DNA, 18 bp, Homo sapiens
gagttcgagaccagcctg

SEQ ID NO: 3577400 - DNA, 22 bp, Homo sapiens
gagttctctcatcggaggccca

SEQ ID NO: 3577401 - DNA, 22 bp, Homo sapiens
gagttcttagctatccttggct

SEQ ID NO: 3577402 - DNA, 20 bp, Homo sapiens
gagttgatctggaacccaga

SEQ ID NO: 3577403 - DNA, 21 bp, Homo sapiens
gagttgatctggaacccagac

SEQ ID NO: 3577404 - DNA, 21 bp, Homo sapiens
gagttgctgttaatctgatgt

SEQ ID NO: 3577405 - DNA, 14 bp, Homo sapiens
gagtttaaacaaaa

SEQ ID NO: 3577406 - DNA, 20 bp, Homo sapiens
gagtttgtggtaacttgaga

SEQ ID NO: 3577407 - DNA, 16 bp, Homo sapiens
gagttttaacaatcca

SEQ ID NO: 3577408 - DNA, 18 bp, Homo sapiens
gagttttaacaatccatt

SEQ ID NO: 3577409 - DNA, 12 bp, Homo sapiens
gataaaaatcat

SEQ ID NO: 3577410 - DNA, 11 bp, Homo sapiens
gataaactgac

SEQ ID NO: 3577411 - DNA, 21 bp, Homo sapiens
gataaatattgagcagatcta

SEQ ID NO: 3577412 - DNA, 15 bp, Homo sapiens
gataaatgatagaca

SEQ ID NO: 3577413 - DNA, 18 bp, Homo sapiens
gataacttgctttcttct

SEQ ID NO: 3577414 - DNA, 14 bp, Homo sapiens
gataaggtggcttc

SEQ ID NO: 3577415 - DNA, 16 bp, Homo sapiens
gataaggtggcttctc

SEQ ID NO: 3577416 - DNA, 12 bp, Homo sapiens
gataataatggg

SEQ ID NO: 3577417 - DNA, 13 bp, Homo sapiens
gataatctgagca

SEQ ID NO: 3577418 - DNA, 14 bp, Homo sapiens
gataatctgagcag

SEQ ID NO: 3577419 - DNA, 22 bp, Homo sapiens
gataatttatttcaataaatct

SEQ ID NO: 3577420 - DNA, 22 bp, Homo sapiens
gataattttcctttaatatgaa

SEQ ID NO: 3577421 - DNA, 16 bp, Homo sapiens
gatacaaaatgttact

SEQ ID NO: 3577422 - DNA, 21 bp, Homo sapiens
gatacatacaccagcattcct

SEQ ID NO: 3577423 - DNA, 21 bp, Homo sapiens
gataccattctattctccaga

SEQ ID NO: 3577424 - DNA, 13 bp, Homo sapiens
gatacctggagca

SEQ ID NO: 3577425 - DNA, 17 bp, Homo sapiens
gatactgtctctttcat

SEQ ID NO: 3577426 - DNA, 20 bp, Homo sapiens
gatactttgaagtgcagctc

SEQ ID NO: 3577427 - DNA, 21 bp, Homo sapiens
gatagacacatatgaggggga

SEQ ID NO: 3577428 - DNA, 17 bp, Homo sapiens
gatagacctgacaattt

SEQ ID NO: 3577429 - DNA, 14 bp, Homo sapiens
gatagagtgcagtg

SEQ ID NO: 3577430 - DNA, 22 bp, Homo sapiens
gatagatgtgtggacacattgg

SEQ ID NO: 3577431 - DNA, 15 bp, Homo sapiens
gatagctattaagat

SEQ ID NO: 3577432 - DNA, 21 bp, Homo sapiens
gataggactccatttctttct

SEQ ID NO: 3577433 - DNA, 13 bp, Homo sapiens
gataggtaaattt

SEQ ID NO: 3577434 - DNA, 18 bp, Homo sapiens
gatagtccttcctggcat

SEQ ID NO: 3577435 - DNA, 16 bp, Homo sapiens
gatagtgttctgctcc

SEQ ID NO: 3577436 - DNA, 22 bp, Homo sapiens
gatagtgttctgctcctgcttt

SEQ ID NO: 3577437 - DNA, 16 bp, Homo sapiens
gatataaaactctggg

SEQ ID NO: 3577438 - DNA, 24 bp, Homo sapiens
gatatacgccctctttcatctgta

SEQ ID NO: 3577439 - DNA, 23 bp, Homo sapiens
gatatgattgtttctcaaatctt

SEQ ID NO: 3577440 - DNA, 18 bp, Homo sapiens
gatatgcagttttcctta

SEQ ID NO: 3577441 - DNA, 18 bp, Homo sapiens
gatatgcatgtagcatat

SEQ ID NO: 3577442 - DNA, 22 bp, Homo sapiens
gatatgcttgtaactaaaataa

SEQ ID NO: 3577443 - DNA, 21 bp, Homo sapiens
gatatggagtgagtcacctgc

SEQ ID NO: 3577444 - DNA, 22 bp, Homo sapiens
gatatggagtgagtcacctgct

SEQ ID NO: 3577445 - DNA, 23 bp, Homo sapiens
gatatggagtgagtcacctgctc

SEQ ID NO: 3577446 - DNA, 22 bp, Homo sapiens
gatatggcaggactcctggcag

SEQ ID NO: 3577447 - DNA, 12 bp, Homo sapiens
gatatggctgcc

SEQ ID NO: 3577448 - DNA, 20 bp, Homo sapiens
gatatggctgcccaggagac

SEQ ID NO: 3577449 - DNA, 22 bp, Homo sapiens
gatatgtctgctgagttggcct

SEQ ID NO: 3577450 - DNA, 15 bp, Homo sapiens
gatattcagatgtat

SEQ ID NO: 3577451 - DNA, 17 bp, Homo sapiens
gatattgttataaataa

SEQ ID NO: 3577452 - DNA, 18 bp, Homo sapiens
gatattgttataaataaa

SEQ ID NO: 3577453 - DNA, 20 bp, Homo sapiens
gatattgttataaataaaat

SEQ ID NO: 3577454 - DNA, 16 bp, Homo sapiens
gatatttattgatgtt

SEQ ID NO: 3577455 - DNA, 20 bp, Homo sapiens
gatatttattgatgttttca

SEQ ID NO: 3577456 - DNA, 12 bp, Homo sapiens
gatatttcaatc

SEQ ID NO: 3577457 - DNA, 14 bp, Homo sapiens
gatatttgcattga

SEQ ID NO: 3577458 - DNA, 22 bp, Homo sapiens
gatatttgcattgaggaaatat

SEQ ID NO: 3577459 - DNA, 19 bp, Homo sapiens
gatattttcaacgcagccc

SEQ ID NO: 3577460 - DNA, 15 bp, Homo sapiens
gatcaccagaataaa

SEQ ID NO: 3577461 - DNA, 13 bp, Homo sapiens
gatcactcctgga

SEQ ID NO: 3577462 - DNA, 20 bp, Homo sapiens
gatcagcattttagaaacta

SEQ ID NO: 3577463 - DNA, 14 bp, Homo sapiens
gatcagttaactat

SEQ ID NO: 3577464 - DNA, 20 bp, Homo sapiens
gatccaaaagaagcccccag

SEQ ID NO: 3577465 - DNA, 22 bp, Homo sapiens
gatccaaaagaagcccccagct

SEQ ID NO: 3577466 - DNA, 14 bp, Homo sapiens
gatccagcactggt

SEQ ID NO: 3577467 - DNA, 13 bp, Homo sapiens
gatccagccactt

SEQ ID NO: 3577468 - DNA, 21 bp, Homo sapiens
gatccagcccaaacctgggaa

SEQ ID NO: 3577469 - DNA, 12 bp, Homo sapiens
gatccagcctgg

SEQ ID NO: 3577470 - DNA, 12 bp, Homo sapiens
gatccagggcag

SEQ ID NO: 3577471 - DNA, 15 bp, Homo sapiens
gatccagggcagcag

SEQ ID NO: 3577472 - DNA, 20 bp, Homo sapiens
gatccagggcagcaggccag

SEQ ID NO: 3577473 - DNA, 21 bp, Homo sapiens
gatccagggcagcaggccaga

SEQ ID NO: 3577474 - DNA, 11 bp, Homo sapiens
gatcccacccc

SEQ ID NO: 3577475 - DNA, 20 bp, Homo sapiens
gatcccaccccctcctcccc

SEQ ID NO: 3577476 - DNA, 13 bp, Homo sapiens
gatccctcccccc

SEQ ID NO: 3577477 - DNA, 23 bp, Homo sapiens
gatccctcccccccatgcactgt

SEQ ID NO: 3577478 - DNA, 23 bp, Homo sapiens
gatccgagtgtgatttgaattct

SEQ ID NO: 3577479 - DNA, 18 bp, Homo sapiens
gatcctcacgccttggcc

SEQ ID NO: 3577480 - DNA, 15 bp, Homo sapiens
gatcctccacagaga

SEQ ID NO: 3577481 - DNA, 16 bp, Homo sapiens
gatcctccacagagag

SEQ ID NO: 3577482 - DNA, 17 bp, Homo sapiens
gatcctccacagagagg

SEQ ID NO: 3577483 - DNA, 19 bp, Homo sapiens
gatcctgctggggccgcca

SEQ ID NO: 3577484 - DNA, 22 bp, Homo sapiens
gatcctgctggggccgccacgg

SEQ ID NO: 3577485 - DNA, 16 bp, Homo sapiens
gatcctgttctgcgct

SEQ ID NO: 3577486 - DNA, 14 bp, Homo sapiens
gatcgcccccacct

SEQ ID NO: 3577487 - DNA, 20 bp, Homo sapiens
gatcgtctggttagaaaaca

SEQ ID NO: 3577488 - DNA, 13 bp, Homo sapiens
gatctctcttgtc

SEQ ID NO: 3577489 - DNA, 18 bp, Homo sapiens
gatctctcttgtcctctt

SEQ ID NO: 3577490 - DNA, 20 bp, Homo sapiens
gatctgcagggggtgtgtct

SEQ ID NO: 3577491 - DNA, 18 bp, Homo sapiens
gatctgctgggctctgcc

SEQ ID NO: 3577492 - DNA, 12 bp, Homo sapiens
gatctggaaccc

SEQ ID NO: 3577493 - DNA, 17 bp, Homo sapiens
gatctggaacctcagcc

SEQ ID NO: 3577494 - DNA, 18 bp, Homo sapiens
gatctggaacctcagcct

SEQ ID NO: 3577495 - DNA, 19 bp, Homo sapiens
gatctggaacctcagcctg

SEQ ID NO: 3577496 - DNA, 20 bp, Homo sapiens
gatctggggagagcggctgg

SEQ ID NO: 3577497 - DNA, 14 bp, Homo sapiens
gatctgtgattggc

SEQ ID NO: 3577498 - DNA, 15 bp, Homo sapiens
gatctgtgattggct

SEQ ID NO: 3577499 - DNA, 16 bp, Homo sapiens
gatctgtgattggctg

SEQ ID NO: 3577500 - DNA, 18 bp, Homo sapiens
gatctgtgattggctggt

SEQ ID NO: 3577501 - DNA, 16 bp, Homo sapiens
gatctgtgtggctcct

SEQ ID NO: 3577502 - DNA, 13 bp, Homo sapiens
gatcttcagaact

SEQ ID NO: 3577503 - DNA, 18 bp, Homo sapiens
gatctttctttccaaaac

SEQ ID NO: 3577504 - DNA, 11 bp, Homo sapiens
gatctttgtgg

SEQ ID NO: 3577505 - DNA, 13 bp, Homo sapiens
gatgaaaaagaat

SEQ ID NO: 3577506 - DNA, 14 bp, Homo sapiens
gatgaaaagaaaac

SEQ ID NO: 3577507 - DNA, 19 bp, Homo sapiens
gatgaaatttgataaactg

SEQ ID NO: 3577508 - DNA, 18 bp, Homo sapiens
gatgaactgactgaagga

SEQ ID NO: 3577509 - DNA, 23 bp, Homo sapiens
gatgacaacctgtgtgagagaat

SEQ ID NO: 3577510 - DNA, 15 bp, Homo sapiens
gatgacaccctggcc

SEQ ID NO: 3577511 - DNA, 16 bp, Homo sapiens
gatgacaccctggcct

SEQ ID NO: 3577512 - DNA, 17 bp, Homo sapiens
gatgacaccctggcctg

SEQ ID NO: 3577513 - DNA, 14 bp, Homo sapiens
gatgaccagggatg

SEQ ID NO: 3577514 - DNA, 23 bp, Homo sapiens
gatgaccagggatgctgggctgg

SEQ ID NO: 3577515 - DNA, 16 bp, Homo sapiens
gatgaccccggcctgt

SEQ ID NO: 3577516 - DNA, 12 bp, Homo sapiens
gatgacctccag

SEQ ID NO: 3577517 - DNA, 16 bp, Homo sapiens
gatgacctccagaagt

SEQ ID NO: 3577518 - DNA, 18 bp, Homo sapiens
gatgactaaaatatttat

SEQ ID NO: 3577519 - DNA, 13 bp, Homo sapiens
gcattttaagtaa

SEQ ID NO: 3577520 - DNA, 16 bp, Homo sapiens
gcattttagaaactac

SEQ ID NO: 3577521 - DNA, 21 bp, Homo sapiens
gcattttagaaactacaaata

SEQ ID NO: 3577522 - DNA, 22 bp, Homo sapiens
gcattttggagagtttcctgaa

SEQ ID NO: 3577523 - DNA, 12 bp, Homo sapiens
gcattttgtaat

SEQ ID NO: 3577524 - DNA, 16 bp, Homo sapiens
gcatttttaagggagt

SEQ ID NO: 3577525 - DNA, 17 bp, Homo sapiens
gcatttttacctttcat

SEQ ID NO: 3577526 - DNA, 14 bp, Homo sapiens
gccaaaaaaagaca

SEQ ID NO: 3577527 - DNA, 19 bp, Homo sapiens
gccaaaacaagccaaagag

SEQ ID NO: 3577528 - DNA, 19 bp, Homo sapiens
gccaaaacccagctgcacc

SEQ ID NO: 3577529 - DNA, 20 bp, Homo sapiens
gccaaacccttgctttcctg

SEQ ID NO: 3577530 - DNA, 16 bp, Homo sapiens
gccaaaggatgtgata

SEQ ID NO: 3577531 - DNA, 22 bp, Homo sapiens
gccaaatgctctctcaaattgt

SEQ ID NO: 3577532 - DNA, 15 bp, Homo sapiens
gccaacagcacctcc

SEQ ID NO: 3577533 - DNA, 17 bp, Homo sapiens
gccaaccagcccgacag

SEQ ID NO: 3577534 - DNA, 22 bp, Homo sapiens
gccaaccagcccgacagtgcca

SEQ ID NO: 3577535 - DNA, 14 bp, Homo sapiens
gccaaccctgggct

SEQ ID NO: 3577536 - DNA, 16 bp, Homo sapiens
gccaacctcaggctcc

SEQ ID NO: 3577537 - DNA, 18 bp, Homo sapiens
gccaactatgattattaa

SEQ ID NO: 3577538 - DNA, 19 bp, Homo sapiens
gccaactgcaaaaaaagcc

SEQ ID NO: 3577539 - DNA, 22 bp, Homo sapiens
gccaactgcaaaaaaagcctcc

SEQ ID NO: 3577540 - DNA, 22 bp, Homo sapiens
gccaactgccaggctgcctcct

SEQ ID NO: 3577541 - DNA, 19 bp, Homo sapiens
gccaactgtttccctgctg

SEQ ID NO: 3577542 - DNA, 13 bp, Homo sapiens
gccaagaatactt

SEQ ID NO: 3577543 - DNA, 11 bp, Homo sapiens
gccaagccaga

SEQ ID NO: 3577544 - DNA, 13 bp, Homo sapiens
gccaaggagctgc

SEQ ID NO: 3577545 - DNA, 20 bp, Homo sapiens
gccaagggcccaaagaaaga

SEQ ID NO: 3577546 - DNA, 20 bp, Homo sapiens
gccaataaagcttttggaag

SEQ ID NO: 3577547 - DNA, 19 bp, Homo sapiens
gccacaaaaatagagaaaa

SEQ ID NO: 3577548 - DNA, 21 bp, Homo sapiens
gccacaaggacttcctgtcca

SEQ ID NO: 3577549 - DNA, 14 bp, Homo sapiens
gccacacctggcct

SEQ ID NO: 3577550 - DNA, 16 bp, Homo sapiens
gccacacgtggctggc

SEQ ID NO: 3577551 - DNA, 16 bp, Homo sapiens
gccacagacccctggg

SEQ ID NO: 3577552 - DNA, 23 bp, Homo sapiens
gccacagaggactcacttgccca

SEQ ID NO: 3577553 - DNA, 13 bp, Homo sapiens
gccacagcagagc

SEQ ID NO: 3577554 - DNA, 15 bp, Homo sapiens
gccacagcagagcat

SEQ ID NO: 3577555 - DNA, 17 bp, Homo sapiens
gccacagtggggctgca

SEQ ID NO: 3577556 - DNA, 20 bp, Homo sapiens
gccacagtggggctgcaggc

SEQ ID NO: 3577557 - DNA, 23 bp, Homo sapiens
gccacagtggggctgcaggcagg

SEQ ID NO: 3577558 - DNA, 14 bp, Homo sapiens
gccacatcagcccc

SEQ ID NO: 3577559 - DNA, 17 bp, Homo sapiens
gccacattgctggctgc

SEQ ID NO: 3577560 - DNA, 18 bp, Homo sapiens
gccacattgctggctgcc

SEQ ID NO: 3577561 - DNA, 14 bp, Homo sapiens
gccaccaccctgcc

SEQ ID NO: 3577562 - DNA, 13 bp, Homo sapiens
gccaccagttctc

SEQ ID NO: 3577563 - DNA, 19 bp, Homo sapiens
gccaccagttctcatgggt

SEQ ID NO: 3577564 - DNA, 16 bp, Homo sapiens
gccacccacctccctg

SEQ ID NO: 3577565 - DNA, 18 bp, Homo sapiens
gccaccccaaaccccagc

SEQ ID NO: 3577566 - DNA, 21 bp, Homo sapiens
gccaccccaaaccccagcccc

SEQ ID NO: 3577567 - DNA, 14 bp, Homo sapiens
gccacccccttccc

SEQ ID NO: 3577568 - DNA, 19 bp, Homo sapiens
gccacccccttccctggga

SEQ ID NO: 3577569 - DNA, 20 bp, Homo sapiens
gccacccccttccctgggag

SEQ ID NO: 3577570 - DNA, 15 bp, Homo sapiens
gccacccgggcaagg

SEQ ID NO: 3577571 - DNA, 17 bp, Homo sapiens
gccaccggtgggcagtg

SEQ ID NO: 3577572 - DNA, 23 bp, Homo sapiens
gccacctggaagccgcgcggccg

SEQ ID NO: 3577573 - DNA, 15 bp, Homo sapiens
gccacgtcccagcat

SEQ ID NO: 3577574 - DNA, 18 bp, Homo sapiens
gccactaaagcttcagac

SEQ ID NO: 3577575 - DNA, 20 bp, Homo sapiens
gccactaaagcttcagactc

SEQ ID NO: 3577576 - DNA, 22 bp, Homo sapiens
gccactaaagcttcagactcaa

SEQ ID NO: 3577577 - DNA, 14 bp, Homo sapiens
gccactaagcagag

SEQ ID NO: 3577578 - DNA, 20 bp, Homo sapiens
gccactccagacccctggct

SEQ ID NO: 3577579 - DNA, 12 bp, Homo sapiens
gccactccttgt

SEQ ID NO: 3577580 - DNA, 19 bp, Homo sapiens
gccactgcataccaacctg

SEQ ID NO: 3577581 - DNA, 13 bp, Homo sapiens
gccactgcctctt

SEQ ID NO: 3577582 - DNA, 16 bp, Homo sapiens
gccactgcctcttcct

SEQ ID NO: 3577583 - DNA, 17 bp, Homo sapiens
gccactgggacagctgg

SEQ ID NO: 3577584 - DNA, 23 bp, Homo sapiens
gccactggggactttatttattt

SEQ ID NO: 3577585 - DNA, 18 bp, Homo sapiens
gccacttaatgtatgtta

SEQ ID NO: 3577586 - DNA, 21 bp, Homo sapiens
gccacttccccctcttcttct

SEQ ID NO: 3577587 - DNA, 21 bp, Homo sapiens
gccacttctcactcaccacta

SEQ ID NO: 3577588 - DNA, 23 bp, Homo sapiens
gccacttctcactcaccactacc

SEQ ID NO: 3577589 - DNA, 19 bp, Homo sapiens
gccagaaaggtgtgaggag

SEQ ID NO: 3577590 - DNA, 20 bp, Homo sapiens
gccagaacgtggctctgctg

SEQ ID NO: 3577591 - DNA, 16 bp, Homo sapiens
gccagacacaggccct

SEQ ID NO: 3577592 - DNA, 21 bp, Homo sapiens
gccagacccacgggctcatgc

SEQ ID NO: 3577593 - DNA, 16 bp, Homo sapiens
gccagagagggaaaag

SEQ ID NO: 3577594 - DNA, 20 bp, Homo sapiens
gccagagatccaaaagaagc

SEQ ID NO: 3577595 - DNA, 21 bp, Homo sapiens
gccagagatccaaaagaagcc

SEQ ID NO: 3577596 - DNA, 22 bp, Homo sapiens
gccagagatccaaaagaagccc

SEQ ID NO: 3577597 - DNA, 19 bp, Homo sapiens
gccagaggaccaatgcttg

SEQ ID NO: 3577598 - DNA, 16 bp, Homo sapiens
gccagatccagcctgg

SEQ ID NO: 3577599 - DNA, 22 bp, Homo sapiens
gccagatgcacatccctggaag

SEQ ID NO: 3577600 - DNA, 16 bp, Homo sapiens
gccagattctcttgaa

SEQ ID NO: 3577601 - DNA, 21 bp, Homo sapiens
gccagattctcttgaataaag

SEQ ID NO: 3577602 - DNA, 16 bp, Homo sapiens
gccagcaaataaatac

SEQ ID NO: 3577603 - DNA, 15 bp, Homo sapiens
gccagcaacattggc

SEQ ID NO: 3577604 - DNA, 12 bp, Homo sapiens
gccagcagctga

SEQ ID NO: 3577605 - DNA, 13 bp, Homo sapiens
gccagcagctgat

SEQ ID NO: 3577606 - DNA, 19 bp, Homo sapiens
gccagcaggggggctgtgc

SEQ ID NO: 3577607 - DNA, 22 bp, Homo sapiens
gccagccacagacccctgggag

SEQ ID NO: 3577608 - DNA, 13 bp, Homo sapiens
gccagccatgtct

SEQ ID NO: 3577609 - DNA, 14 bp, Homo sapiens
gccagcccagccag

SEQ ID NO: 3577610 - DNA, 17 bp, Homo sapiens
gccagcccatttgggca

SEQ ID NO: 3577611 - DNA, 18 bp, Homo sapiens
gccagcccatttgggcag

SEQ ID NO: 3577612 - DNA, 19 bp, Homo sapiens
gccagcccatttgggcaga

SEQ ID NO: 3577613 - DNA, 22 bp, Homo sapiens
gccagcccatttgggcagagag

SEQ ID NO: 3577614 - DNA, 15 bp, Homo sapiens
gccagcccttccctg

SEQ ID NO: 3577615 - DNA, 21 bp, Homo sapiens
gccagcccttccctggccccg

SEQ ID NO: 3577616 - DNA, 16 bp, Homo sapiens
gccagcctcagaaggc

SEQ ID NO: 3577617 - DNA, 19 bp, Homo sapiens
gccagcctcagaaggcccc

SEQ ID NO: 3577618 - DNA, 23 bp, Homo sapiens
gccagcctcagaaggccccagag

SEQ ID NO: 3577619 - DNA, 18 bp, Homo sapiens
gccagcctggctctgccc

SEQ ID NO: 3577620 - DNA, 19 bp, Homo sapiens
gccagcctggctctgcccc

SEQ ID NO: 3577621 - DNA, 21 bp, Homo sapiens
gccagccttgtacagtctgct

SEQ ID NO: 3577622 - DNA, 13 bp, Homo sapiens
gccagcgctgtgg

SEQ ID NO: 3577623 - DNA, 17 bp, Homo sapiens
gccagctgggagcactg

SEQ ID NO: 3577624 - DNA, 12 bp, Homo sapiens
gccagctgtgca

SEQ ID NO: 3577625 - DNA, 14 bp, Homo sapiens
gccagctgtgcact

SEQ ID NO: 3577626 - DNA, 15 bp, Homo sapiens
gccagcttggcaggg

SEQ ID NO: 3577627 - DNA, 17 bp, Homo sapiens
gccaggaatttcccagg

SEQ ID NO: 3577628 - DNA, 22 bp, Homo sapiens
gccaggaatttcccaggaccct

SEQ ID NO: 3577629 - DNA, 15 bp, Homo sapiens
gccaggactcccaga

SEQ ID NO: 3577630 - DNA, 18 bp, Homo sapiens
gccaggactcccagaacc

SEQ ID NO: 3577631 - DNA, 21 bp, Homo sapiens
gccaggactcccagaacctct

SEQ ID NO: 3577632 - DNA, 14 bp, Homo sapiens
gccaggatgcccag

SEQ ID NO: 3577633 - DNA, 16 bp, Homo sapiens
gccaggcaccacagcc

SEQ ID NO: 3577634 - DNA, 18 bp, Homo sapiens
gccaggcaccacagcctc

SEQ ID NO: 3577635 - DNA, 15 bp, Homo sapiens
gccaggcagggagag

SEQ ID NO: 3577636 - DNA, 12 bp, Homo sapiens
gccaggccagct

SEQ ID NO: 3577637 - DNA, 21 bp, Homo sapiens
gccaggccctttgcactgagg

SEQ ID NO: 3577638 - DNA, 18 bp, Homo sapiens
gccaggccgcgcccagca

SEQ ID NO: 3577639 - DNA, 19 bp, Homo sapiens
gccaggccgcgcccagcag

SEQ ID NO: 3577640 - DNA, 15 bp, Homo sapiens
gccaggctcaggaga

SEQ ID NO: 3577641 - DNA, 16 bp, Homo sapiens
gccaggctcaggagaa

SEQ ID NO: 3577642 - DNA, 17 bp, Homo sapiens
gccaggctcaggagaag

SEQ ID NO: 3577643 - DNA, 21 bp, Homo sapiens
gccaggctcctacctgtctgc

SEQ ID NO: 3577644 - DNA, 22 bp, Homo sapiens
gccaggctcctacctgtctgct

SEQ ID NO: 3577645 - DNA, 16 bp, Homo sapiens
gccaggctgcctcctg

SEQ ID NO: 3577646 - DNA, 14 bp, Homo sapiens
gccaggctgttgga

SEQ ID NO: 3577647 - DNA, 16 bp, Homo sapiens
gccagggagaagctcc

SEQ ID NO: 3577648 - DNA, 19 bp, Homo sapiens
gccagggcccctggatctc

SEQ ID NO: 3577649 - DNA, 19 bp, Homo sapiens
gccaggggggtgaggagct

SEQ ID NO: 3577650 - DNA, 21 bp, Homo sapiens
gccaggggggtgaggagctgg

SEQ ID NO: 3577651 - DNA, 15 bp, Homo sapiens
gcccctactgtgggc

SEQ ID NO: 3577652 - DNA, 21 bp, Homo sapiens
gcccctaggtgcccagggcca

SEQ ID NO: 3577653 - DNA, 14 bp, Homo sapiens
gcccctcacactgc

SEQ ID NO: 3577654 - DNA, 21 bp, Homo sapiens
gcccctcatctctctgcccaa

SEQ ID NO: 3577655 - DNA, 17 bp, Homo sapiens
gcccctccaaacctcca

SEQ ID NO: 3577656 - DNA, 16 bp, Homo sapiens
gcccctccatccaccc

SEQ ID NO: 3577657 - DNA, 13 bp, Homo sapiens
gcccctcccacgc

SEQ ID NO: 3577658 - DNA, 14 bp, Homo sapiens
gcccctccccagcc

SEQ ID NO: 3577659 - DNA, 22 bp, Homo sapiens
gcccctccccagccagcccttc

SEQ ID NO: 3577660 - DNA, 12 bp, Homo sapiens
gcccctcccttc

SEQ ID NO: 3577661 - DNA, 14 bp, Homo sapiens
gcccctgaggagct

SEQ ID NO: 3577662 - DNA, 15 bp, Homo sapiens
gcccctgaggagctt

SEQ ID NO: 3577663 - DNA, 20 bp, Homo sapiens
gcccctgcctgacagccttc

SEQ ID NO: 3577664 - DNA, 19 bp, Homo sapiens
gcccctgcctgtgcccgca

SEQ ID NO: 3577665 - DNA, 16 bp, Homo sapiens
gcccctgctgtgctgc

SEQ ID NO: 3577666 - DNA, 11 bp, Homo sapiens
gcccctggctt

SEQ ID NO: 3577667 - DNA, 20 bp, Homo sapiens
gcccctggctttgcctcttc

SEQ ID NO: 3577668 - DNA, 22 bp, Homo sapiens
gcccctggctttgcctcttctt

SEQ ID NO: 3577669 - DNA, 19 bp, Homo sapiens
gcccctgtctagagaggga

SEQ ID NO: 3577670 - DNA, 11 bp, Homo sapiens
gcccctgtggc

SEQ ID NO: 3577671 - DNA, 15 bp, Homo sapiens
gcccctgtggccaac

SEQ ID NO: 3577672 - DNA, 17 bp, Homo sapiens
gcccctgtggccaactg

SEQ ID NO: 3577673 - DNA, 21 bp, Homo sapiens
gcccctgtggccaactgcaaa

SEQ ID NO: 3577674 - DNA, 19 bp, Homo sapiens
gccccttaaacacaggctg

SEQ ID NO: 3577675 - DNA, 20 bp, Homo sapiens
gccccttcatccgcctgtgg

SEQ ID NO: 3577676 - DNA, 15 bp, Homo sapiens
gcccgacagcctggc

SEQ ID NO: 3577677 - DNA, 17 bp, Homo sapiens
gcccgacagcctggcac

SEQ ID NO: 3577678 - DNA, 17 bp, Homo sapiens
gcccgacaggtgggcct

SEQ ID NO: 3577679 - DNA, 18 bp, Homo sapiens
gcccgacaggtgggcctg

SEQ ID NO: 3577680 - DNA, 16 bp, Homo sapiens
gcccgacagtgccatc

SEQ ID NO: 3577681 - DNA, 19 bp, Homo sapiens
gcccgcatgtgcattcttt

SEQ ID NO: 3577682 - DNA, 23 bp, Homo sapiens
gcccgcgggagacagcttctctg

SEQ ID NO: 3577683 - DNA, 20 bp, Homo sapiens
gcccggccgccccgccccag

SEQ ID NO: 3577684 - DNA, 22 bp, Homo sapiens
gcccggccgccccgccccagag

SEQ ID NO: 3577685 - DNA, 14 bp, Homo sapiens
gcccggccggaggg

SEQ ID NO: 3577686 - DNA, 20 bp, Homo sapiens
gcccggcgctgattcctcgt

SEQ ID NO: 3577687 - DNA, 19 bp, Homo sapiens
gcccgggagctgctgccct

SEQ ID NO: 3577688 - DNA, 22 bp, Homo sapiens
gcccgtggtggcggtggctgcc

SEQ ID NO: 3577689 - DNA, 16 bp, Homo sapiens
gcccgtgtccaggagc

SEQ ID NO: 3577690 - DNA, 15 bp, Homo sapiens
gccctaaaagcacac

SEQ ID NO: 3577691 - DNA, 15 bp, Homo sapiens
gccctaagcccccag

SEQ ID NO: 3577692 - DNA, 17 bp, Homo sapiens
gccctaagcccccaggg

SEQ ID NO: 3577693 - DNA, 20 bp, Homo sapiens
gccctaagcccccagggcct

SEQ ID NO: 3577694 - DNA, 23 bp, Homo sapiens
gccctaagcccccagggcctcca

SEQ ID NO: 3577695 - DNA, 17 bp, Homo sapiens
gccctaagtggctgcct

SEQ ID NO: 3577696 - DNA, 20 bp, Homo sapiens
gccctaagtggctgccttct

SEQ ID NO: 3577697 - DNA, 17 bp, Homo sapiens
gccctagactggtgcta

SEQ ID NO: 3577698 - DNA, 13 bp, Homo sapiens
gccctagccctgc

SEQ ID NO: 3577699 - DNA, 16 bp, Homo sapiens
gccctagccctgctcc

SEQ ID NO: 3577700 - DNA, 15 bp, Homo sapiens
gccctattgctgcta

SEQ ID NO: 3577701 - DNA, 12 bp, Homo sapiens
gccctcccaggc

SEQ ID NO: 3577702 - DNA, 21 bp, Homo sapiens
gccctcccaggctctcaacag

SEQ ID NO: 3577703 - DNA, 21 bp, Homo sapiens
gccctccctgcccctcccttc

SEQ ID NO: 3577704 - DNA, 20 bp, Homo sapiens
gccctccctgtctccagggc

SEQ ID NO: 3577705 - DNA, 22 bp, Homo sapiens
gccctccctgtctccagggccc

SEQ ID NO: 3577706 - DNA, 18 bp, Homo sapiens
gccctcctcagctccctg

SEQ ID NO: 3577707 - DNA, 14 bp, Homo sapiens
gccctcctctccca

SEQ ID NO: 3577708 - DNA, 12 bp, Homo sapiens
gccctcctgagg

SEQ ID NO: 3577709 - DNA, 17 bp, Homo sapiens
gccctctatttattagc

SEQ ID NO: 3577710 - DNA, 15 bp, Homo sapiens
gccctctctcgggag

SEQ ID NO: 3577711 - DNA, 20 bp, Homo sapiens
gccctctggagtggccacta

SEQ ID NO: 3577712 - DNA, 22 bp, Homo sapiens
gccctctggagtggccactaag

SEQ ID NO: 3577713 - DNA, 17 bp, Homo sapiens
gccctctttccctgcga

SEQ ID NO: 3577714 - DNA, 23 bp, Homo sapiens
gccctgaatttcttcttttcctg

SEQ ID NO: 3577715 - DNA, 22 bp, Homo sapiens
gccctgcaccatgctgctgggg

SEQ ID NO: 3577716 - DNA, 16 bp, Homo sapiens
gccctgcagggccggg

SEQ ID NO: 3577717 - DNA, 20 bp, Homo sapiens
gccctgcagggccgggcagg

SEQ ID NO: 3577718 - DNA, 15 bp, Homo sapiens
gccctgccccacccc

SEQ ID NO: 3577719 - DNA, 16 bp, Homo sapiens
gccctgccccacccca

SEQ ID NO: 3577720 - DNA, 23 bp, Homo sapiens
gccctgccccaccccacctcaca

SEQ ID NO: 3577721 - DNA, 23 bp, Homo sapiens
gccctgccccaccccatccagcc

SEQ ID NO: 3577722 - DNA, 13 bp, Homo sapiens
gccctgctacctg

SEQ ID NO: 3577723 - DNA, 17 bp, Homo sapiens
gccctgctccaactcca

SEQ ID NO: 3577724 - DNA, 15 bp, Homo sapiens
gccctggagagcccc

SEQ ID NO: 3577725 - DNA, 17 bp, Homo sapiens
gccctggagagccccat

SEQ ID NO: 3577726 - DNA, 20 bp, Homo sapiens
gccctggatgcccaggaatc

SEQ ID NO: 3577727 - DNA, 23 bp, Homo sapiens
gccctggattggttggcaaacta

SEQ ID NO: 3577728 - DNA, 17 bp, Homo sapiens
gccctggcacccccaca

SEQ ID NO: 3577729 - DNA, 13 bp, Homo sapiens
gccctggcctggc

SEQ ID NO: 3577730 - DNA, 14 bp, Homo sapiens
gccctggcctggct

SEQ ID NO: 3577731 - DNA, 20 bp, Homo sapiens
gccctggctcccacaggccc

SEQ ID NO: 3577732 - DNA, 21 bp, Homo sapiens
gccctgggaaccactcccacc

SEQ ID NO: 3577733 - DNA, 13 bp, Homo sapiens
gccctgggctcct

SEQ ID NO: 3577734 - DNA, 22 bp, Homo sapiens
gccctgggggtctgggcgtcca

SEQ ID NO: 3577735 - DNA, 15 bp, Homo sapiens
gccctggtgctgcca

SEQ ID NO: 3577736 - DNA, 22 bp, Homo sapiens
gccctgtgagcacaaagaagaa

SEQ ID NO: 3577737 - DNA, 13 bp, Homo sapiens
gccctgttaaaag

SEQ ID NO: 3577738 - DNA, 20 bp, Homo sapiens
gccctgttcagctactccca

SEQ ID NO: 3577739 - DNA, 23 bp, Homo sapiens
gcccttacagccctaagtggctg

SEQ ID NO: 3577740 - DNA, 12 bp, Homo sapiens
gcccttccatgt

SEQ ID NO: 3577741 - DNA, 18 bp, Homo sapiens
gcccttccatgtgccttt

SEQ ID NO: 3577742 - DNA, 22 bp, Homo sapiens
gcccttcctctccactgccttc

SEQ ID NO: 3577743 - DNA, 20 bp, Homo sapiens
gcccttggaacaccctggat

SEQ ID NO: 3577744 - DNA, 22 bp, Homo sapiens
gcccttggaacaccctggatgc

SEQ ID NO: 3577745 - DNA, 19 bp, Homo sapiens
gcccttgggtccccccgag

SEQ ID NO: 3577746 - DNA, 17 bp, Homo sapiens
gccctttcaaagcactt

SEQ ID NO: 3577747 - DNA, 22 bp, Homo sapiens
gccgaccttccctccgccttct

SEQ ID NO: 3577748 - DNA, 11 bp, Homo sapiens
gccgactcagg

SEQ ID NO: 3577749 - DNA, 15 bp, Homo sapiens
gccgactcagggacc

SEQ ID NO: 3577750 - DNA, 16 bp, Homo sapiens
gccgagccatgtgtct

SEQ ID NO: 3577751 - DNA, 21 bp, Homo sapiens
gccgaggtcactctgggcctg

SEQ ID NO: 3577752 - DNA, 13 bp, Homo sapiens
gccgcagagaaat

SEQ ID NO: 3577753 - DNA, 15 bp, Homo sapiens
gccgcagagaaatgc

SEQ ID NO: 3577754 - DNA, 19 bp, Homo sapiens
gccgcagagaaatgcccca

SEQ ID NO: 3577755 - DNA, 18 bp, Homo sapiens
gccgcagggcggggctgg

SEQ ID NO: 3577756 - DNA, 16 bp, Homo sapiens
gccgccaccctcccct

SEQ ID NO: 3577757 - DNA, 16 bp, Homo sapiens
gccgccacggcctggc

SEQ ID NO: 3577758 - DNA, 17 bp, Homo sapiens
gccgccacggcctggct

SEQ ID NO: 3577759 - DNA, 14 bp, Homo sapiens
gccgcccaaggccc

SEQ ID NO: 3577760 - DNA, 18 bp, Homo sapiens
gccgccccgccccagagc

SEQ ID NO: 3577761 - DNA, 19 bp, Homo sapiens
gccgccccgccccagagct

SEQ ID NO: 3577762 - DNA, 20 bp, Homo sapiens
gccgccccgccccagagctc

SEQ ID NO: 3577763 - DNA, 14 bp, Homo sapiens
gccgcccggcagtg

SEQ ID NO: 3577764 - DNA, 16 bp, Homo sapiens
gccgcccggcagtgca

SEQ ID NO: 3577765 - DNA, 13 bp, Homo sapiens
gccgcctgcagcc

SEQ ID NO: 3577766 - DNA, 22 bp, Homo sapiens
gccgctggctggtgggccccca

SEQ ID NO: 3577767 - DNA, 14 bp, Homo sapiens
gccgctgtctctga

SEQ ID NO: 3577768 - DNA, 21 bp, Homo sapiens
gccgctgtctctgaggggtgg

SEQ ID NO: 3577769 - DNA, 16 bp, Homo sapiens
gccgctttctctgagg

SEQ ID NO: 3577770 - DNA, 23 bp, Homo sapiens
gccggaaggaatgtcagggccag

SEQ ID NO: 3577771 - DNA, 16 bp, Homo sapiens
gccggaagtggctccg

SEQ ID NO: 3577772 - DNA, 14 bp, Homo sapiens
gccggagggcagga

SEQ ID NO: 3577773 - DNA, 15 bp, Homo sapiens
gccggatctgaggga

SEQ ID NO: 3577774 - DNA, 17 bp, Homo sapiens
gccggccagtggccttc

SEQ ID NO: 3577775 - DNA, 13 bp, Homo sapiens
gccggctctgggc

SEQ ID NO: 3577776 - DNA, 15 bp, Homo sapiens
gccggctctgggcct

SEQ ID NO: 3577777 - DNA, 19 bp, Homo sapiens
gccggctgagtggcagcag

SEQ ID NO: 3577778 - DNA, 22 bp, Homo sapiens
gccggctgagtggcagcagccc

SEQ ID NO: 3577779 - DNA, 22 bp, Homo sapiens
gccgggagcgagtaaagtctgg

SEQ ID NO: 3577780 - DNA, 13 bp, Homo sapiens
gccgggcaggggg

SEQ ID NO: 3577781 - DNA, 18 bp, Homo sapiens
gccggggtgtaacttcct

SEQ ID NO: 3577782 - DNA, 16 bp, Homo sapiens
gccggtaactgtcctg

SEQ ID NO: 3577783 - DNA, 20 bp, Homo sapiens
gctcgtcagccacctgggaa

SEQ ID NO: 3577784 - DNA, 17 bp, Homo sapiens
gctcgtgtatttattac

SEQ ID NO: 3577785 - DNA, 19 bp, Homo sapiens
gctcgtttacactgcacat

SEQ ID NO: 3577786 - DNA, 18 bp, Homo sapiens
gctctaattcacagtgct

SEQ ID NO: 3577787 - DNA, 19 bp, Homo sapiens
gctctaattcacagtgctc

SEQ ID NO: 3577788 - DNA, 20 bp, Homo sapiens
gctctaccaaatagtgattg

SEQ ID NO: 3577789 - DNA, 12 bp, Homo sapiens
gctctagcctct

SEQ ID NO: 3577790 - DNA, 16 bp, Homo sapiens
gctctagcctctggac

SEQ ID NO: 3577791 - DNA, 21 bp, Homo sapiens
gctctagcctctggactggaa

SEQ ID NO: 3577792 - DNA, 23 bp, Homo sapiens
gctctagggactgccaggctgtt

SEQ ID NO: 3577793 - DNA, 15 bp, Homo sapiens
gctctagtgccttct

SEQ ID NO: 3577794 - DNA, 15 bp, Homo sapiens
gctctatactgtggc

SEQ ID NO: 3577795 - DNA, 22 bp, Homo sapiens
gctctcatgtacttttaaatta

SEQ ID NO: 3577796 - DNA, 18 bp, Homo sapiens
gctctcccctctcgcccc

SEQ ID NO: 3577797 - DNA, 16 bp, Homo sapiens
gctctccgagctctgg

SEQ ID NO: 3577798 - DNA, 16 bp, Homo sapiens
gctctcctcatctcca

SEQ ID NO: 3577799 - DNA, 17 bp, Homo sapiens
gctctcctccacctcaa

SEQ ID NO: 3577800 - DNA, 17 bp, Homo sapiens
gctctcgtctctcgttt

SEQ ID NO: 3577801 - DNA, 15 bp, Homo sapiens
gctctctgactgctt

SEQ ID NO: 3577802 - DNA, 23 bp, Homo sapiens
gctctctttcttttctctgtcta

SEQ ID NO: 3577803 - DNA, 17 bp, Homo sapiens
gctctcttttattctgt

SEQ ID NO: 3577804 - DNA, 20 bp, Homo sapiens
gctctgacatcccttcctgg

SEQ ID NO: 3577805 - DNA, 21 bp, Homo sapiens
gctctgagcaaatgtggctcc

SEQ ID NO: 3577806 - DNA, 18 bp, Homo sapiens
gctctgagcagttgttat

SEQ ID NO: 3577807 - DNA, 15 bp, Homo sapiens
gctctgcatgttttc

SEQ ID NO: 3577808 - DNA, 16 bp, Homo sapiens
gctctgcatgttttcc

SEQ ID NO: 3577809 - DNA, 17 bp, Homo sapiens
gctctgccccctccccc

SEQ ID NO: 3577810 - DNA, 20 bp, Homo sapiens
gctctgcgtcggtcctggtg

SEQ ID NO: 3577811 - DNA, 11 bp, Homo sapiens
gctctgctgct

SEQ ID NO: 3577812 - DNA, 16 bp, Homo sapiens
gctctggacagcccca

SEQ ID NO: 3577813 - DNA, 20 bp, Homo sapiens
gctctggacagccccaccct

SEQ ID NO: 3577814 - DNA, 14 bp, Homo sapiens
gctctggcaccatc

SEQ ID NO: 3577815 - DNA, 13 bp, Homo sapiens
gctctggctgctt

SEQ ID NO: 3577816 - DNA, 16 bp, Homo sapiens
gctctgggcctgaggg

SEQ ID NO: 3577817 - DNA, 20 bp, Homo sapiens
gctctgggcctgagggtcca

SEQ ID NO: 3577818 - DNA, 22 bp, Homo sapiens
gctctgggcctgagggtccacc

SEQ ID NO: 3577819 - DNA, 20 bp, Homo sapiens
gctctggggacagcttcctc

SEQ ID NO: 3577820 - DNA, 19 bp, Homo sapiens
gctctggggtgggcagttt

SEQ ID NO: 3577821 - DNA, 21 bp, Homo sapiens
gctctggggtgggcagttttt

SEQ ID NO: 3577822 - DNA, 18 bp, Homo sapiens
gctctgggtgaggtaggc

SEQ ID NO: 3577823 - DNA, 16 bp, Homo sapiens
gctctgggtgctgccc

SEQ ID NO: 3577824 - DNA, 17 bp, Homo sapiens
gctctgggtgctgccct

SEQ ID NO: 3577825 - DNA, 22 bp, Homo sapiens
gctctgtaacatcgcacagttt

SEQ ID NO: 3577826 - DNA, 22 bp, Homo sapiens
gctctgtggcaaaaagagtcag

SEQ ID NO: 3577827 - DNA, 20 bp, Homo sapiens
gctctgttaataatctcaca

SEQ ID NO: 3577828 - DNA, 17 bp, Homo sapiens
gctcttaagcagcatgg

SEQ ID NO: 3577829 - DNA, 18 bp, Homo sapiens
gctcttaagcagcatgga

SEQ ID NO: 3577830 - DNA, 23 bp, Homo sapiens
gctcttaagcagcatggaaaaat

SEQ ID NO: 3577831 - DNA, 14 bp, Homo sapiens
gctcttcattccat

SEQ ID NO: 3577832 - DNA, 11 bp, Homo sapiens
gctcttcccac

SEQ ID NO: 3577833 - DNA, 17 bp, Homo sapiens
gctcttcccactccagc

SEQ ID NO: 3577834 - DNA, 19 bp, Homo sapiens
gctcttcccactccagctg

SEQ ID NO: 3577835 - DNA, 20 bp, Homo sapiens
gctcttcccactccagctga

SEQ ID NO: 3577836 - DNA, 13 bp, Homo sapiens
gctcttctcaggg

SEQ ID NO: 3577837 - DNA, 17 bp, Homo sapiens
gctcttctcctttcaca

SEQ ID NO: 3577838 - DNA, 21 bp, Homo sapiens
gctcttctcctttcacaacct

SEQ ID NO: 3577839 - DNA, 22 bp, Homo sapiens
gctcttggctgacccctctggt

SEQ ID NO: 3577840 - DNA, 18 bp, Homo sapiens
gctctttggtagaaaagg

SEQ ID NO: 3577841 - DNA, 12 bp, Homo sapiens
gctcttttccta

SEQ ID NO: 3577842 - DNA, 21 bp, Homo sapiens
gctcttttcctggtgctcttt

SEQ ID NO: 3577843 - DNA, 12 bp, Homo sapiens
gctgaaagactc

SEQ ID NO: 3577844 - DNA, 13 bp, Homo sapiens
gctgaaatttacc

SEQ ID NO: 3577845 - DNA, 16 bp, Homo sapiens
gctgaacaggaaagag

SEQ ID NO: 3577846 - DNA, 19 bp, Homo sapiens
gctgaacaggaaagagcta

SEQ ID NO: 3577847 - DNA, 23 bp, Homo sapiens
gctgaacaggaaagagctaggaa

SEQ ID NO: 3577848 - DNA, 17 bp, Homo sapiens
gctgaagagagggacag

SEQ ID NO: 3577849 - DNA, 15 bp, Homo sapiens
gctgaatgcctcgct

SEQ ID NO: 3577850 - DNA, 21 bp, Homo sapiens
gctgaattcctttacaactaa

SEQ ID NO: 3577851 - DNA, 14 bp, Homo sapiens
gctgacagctgctc

SEQ ID NO: 3577852 - DNA, 16 bp, Homo sapiens
gctgacagtcagctgt

SEQ ID NO: 3577853 - DNA, 19 bp, Homo sapiens
gctgacagtcagctgtggg

SEQ ID NO: 3577854 - DNA, 17 bp, Homo sapiens
gctgaccatgcgtcagg

SEQ ID NO: 3577855 - DNA, 15 bp, Homo sapiens
gctgacccagcatct

SEQ ID NO: 3577856 - DNA, 20 bp, Homo sapiens
gctgacccagcatctcccag

SEQ ID NO: 3577857 - DNA, 15 bp, Homo sapiens
gctgacccctctggt

SEQ ID NO: 3577858 - DNA, 21 bp, Homo sapiens
gctgacccctctggtgtgtgg

SEQ ID NO: 3577859 - DNA, 14 bp, Homo sapiens
gctgaccttgctga

SEQ ID NO: 3577860 - DNA, 20 bp, Homo sapiens
gctgactaaactttttttct

SEQ ID NO: 3577861 - DNA, 15 bp, Homo sapiens
gctgagagaccctgg

SEQ ID NO: 3577862 - DNA, 20 bp, Homo sapiens
gctgagagaccctggcctca

SEQ ID NO: 3577863 - DNA, 21 bp, Homo sapiens
gctgagcaaatattaaaattg

SEQ ID NO: 3577864 - DNA, 16 bp, Homo sapiens
gctgagcatggagaca

SEQ ID NO: 3577865 - DNA, 20 bp, Homo sapiens
gctgagcatggagacagcag

SEQ ID NO: 3577866 - DNA, 21 bp, Homo sapiens
gctgagcatggagacagcagt

SEQ ID NO: 3577867 - DNA, 15 bp, Homo sapiens
gctgagcccctgggg

SEQ ID NO: 3577868 - DNA, 17 bp, Homo sapiens
gctgagcccctggggaa

SEQ ID NO: 3577869 - DNA, 16 bp, Homo sapiens
gctgagccctcctgag

SEQ ID NO: 3577870 - DNA, 19 bp, Homo sapiens
gctgaggcaccgtccaggc

SEQ ID NO: 3577871 - DNA, 16 bp, Homo sapiens
gctgaggcccctaggt

SEQ ID NO: 3577872 - DNA, 22 bp, Homo sapiens
gctgaggcccctaggtgcccag

SEQ ID NO: 3577873 - DNA, 17 bp, Homo sapiens
gctgaggggtctcggat

SEQ ID NO: 3577874 - DNA, 16 bp, Homo sapiens
gctgagggtcgtggga

SEQ ID NO: 3577875 - DNA, 19 bp, Homo sapiens
gctgatactgggtctgcga

SEQ ID NO: 3577876 - DNA, 16 bp, Homo sapiens
gctgatatcaacagct

SEQ ID NO: 3577877 - DNA, 18 bp, Homo sapiens
gctgatatcaacagcttc

SEQ ID NO: 3577878 - DNA, 22 bp, Homo sapiens
gctgcaaagcaaaacagactgt

SEQ ID NO: 3577879 - DNA, 20 bp, Homo sapiens
gctgcaaggtactctggtga

SEQ ID NO: 3577880 - DNA, 21 bp, Homo sapiens
gctgcaaggtttaggctggtg

SEQ ID NO: 3577881 - DNA, 22 bp, Homo sapiens
gctgcacaacagccctgcctga

SEQ ID NO: 3577882 - DNA, 21 bp, Homo sapiens
gctgcaccccttcctgggcac

SEQ ID NO: 3577883 - DNA, 20 bp, Homo sapiens
gctgcacctcctaccctccc

SEQ ID NO: 3577884 - DNA, 23 bp, Homo sapiens
gctgcagatttgatatttgcatt

SEQ ID NO: 3577885 - DNA, 21 bp, Homo sapiens
gctgcagcctgcgccaccgcc

SEQ ID NO: 3577886 - DNA, 21 bp, Homo sapiens
gctgcagccttcatcagaact

SEQ ID NO: 3577887 - DNA, 23 bp, Homo sapiens
gctgcagccttcatcagaactct

SEQ ID NO: 3577888 - DNA, 23 bp, Homo sapiens
gctgcaggaagaaacttttttat

SEQ ID NO: 3577889 - DNA, 14 bp, Homo sapiens
gctgccacccacct

SEQ ID NO: 3577890 - DNA, 19 bp, Homo sapiens
gctgccacccacctccctg

SEQ ID NO: 3577891 - DNA, 12 bp, Homo sapiens
gctgccagggct

SEQ ID NO: 3577892 - DNA, 15 bp, Homo sapiens
gctgccaggggctct

SEQ ID NO: 3577893 - DNA, 20 bp, Homo sapiens
gctgccagtgcagccactgg

SEQ ID NO: 3577894 - DNA, 19 bp, Homo sapiens
gctgccccacaggtgtgtt

SEQ ID NO: 3577895 - DNA, 17 bp, Homo sapiens
gctgccccggcctcctc

SEQ ID NO: 3577896 - DNA, 13 bp, Homo sapiens
gctgcccctgtct

SEQ ID NO: 3577897 - DNA, 13 bp, Homo sapiens
gctgccctagctg

SEQ ID NO: 3577898 - DNA, 16 bp, Homo sapiens
gctgccctagctgacc

SEQ ID NO: 3577899 - DNA, 17 bp, Homo sapiens
gctgccctagctgaccc

SEQ ID NO: 3577900 - DNA, 15 bp, Homo sapiens
gctgccctgcggccc

SEQ ID NO: 3577901 - DNA, 17 bp, Homo sapiens
gctgccctggtgctgcc

SEQ ID NO: 3577902 - DNA, 22 bp, Homo sapiens
gctgccctggtgctgccacact

SEQ ID NO: 3577903 - DNA, 14 bp, Homo sapiens
gctgcctcaggacc

SEQ ID NO: 3577904 - DNA, 20 bp, Homo sapiens
gctgcctcaggacccatccc

SEQ ID NO: 3577905 - DNA, 21 bp, Homo sapiens
gctgcctcccctctccttcct

SEQ ID NO: 3577906 - DNA, 11 bp, Homo sapiens
gctgcctggca

SEQ ID NO: 3577907 - DNA, 17 bp, Homo sapiens
gctgcctggcacagacc

SEQ ID NO: 3577908 - DNA, 20 bp, Homo sapiens
gctgcctggcacagaccagg

SEQ ID NO: 3577909 - DNA, 22 bp, Homo sapiens
gctgcctggcacagaccaggcc

SEQ ID NO: 3577910 - DNA, 16 bp, Homo sapiens
gctgcctgggcccgga

SEQ ID NO: 3577911 - DNA, 15 bp, Homo sapiens
gctgccttcagggag

SEQ ID NO: 3577912 - DNA, 16 bp, Homo sapiens
gctgccttcagggaga

SEQ ID NO: 3577913 - DNA, 20 bp, Homo sapiens
gctgccttcggtacccacca

SEQ ID NO: 3577914 - DNA, 12 bp, Homo sapiens
ggagcctgctct

SEQ ID NO: 3577915 - DNA, 14 bp, Homo sapiens
ggagcctgctctcc

SEQ ID NO: 3577916 - DNA, 14 bp, Homo sapiens
ggagcctggccagg

SEQ ID NO: 3577917 - DNA, 16 bp, Homo sapiens
ggagcctggccaggca

SEQ ID NO: 3577918 - DNA, 18 bp, Homo sapiens
ggagcctggccaggcagg

SEQ ID NO: 3577919 - DNA, 12 bp, Homo sapiens
ggagcctggggt

SEQ ID NO: 3577920 - DNA, 22 bp, Homo sapiens
ggagcctgtgcgtcccagctga

SEQ ID NO: 3577921 - DNA, 14 bp, Homo sapiens
ggagcgccctgcag

SEQ ID NO: 3577922 - DNA, 15 bp, Homo sapiens
ggagcgccctgcagg

SEQ ID NO: 3577923 - DNA, 19 bp, Homo sapiens
ggagcgccctgcagggccg

SEQ ID NO: 3577924 - DNA, 22 bp, Homo sapiens
ggagcgccctgcagggccgggc

SEQ ID NO: 3577925 - DNA, 20 bp, Homo sapiens
ggagctgctgggtggcaggg

SEQ ID NO: 3577926 - DNA, 23 bp, Homo sapiens
ggagctgtctgtctctaatttaa

SEQ ID NO: 3577927 - DNA, 17 bp, Homo sapiens
ggagcttctcccagtgt

SEQ ID NO: 3577928 - DNA, 20 bp, Homo sapiens
ggaggaaaaccaagccgtgg

SEQ ID NO: 3577929 - DNA, 12 bp, Homo sapiens
ggaggacctggc

SEQ ID NO: 3577930 - DNA, 12 bp, Homo sapiens
ggaggagagaga

SEQ ID NO: 3577931 - DNA, 13 bp, Homo sapiens
ggaggagagagac

SEQ ID NO: 3577932 - DNA, 14 bp, Homo sapiens
ggaggagagagacc

SEQ ID NO: 3577933 - DNA, 16 bp, Homo sapiens
ggaggagcctctggct

SEQ ID NO: 3577934 - DNA, 22 bp, Homo sapiens
ggaggagcctgtgcgtcccagc

SEQ ID NO: 3577935 - DNA, 14 bp, Homo sapiens
ggaggatacagagg

SEQ ID NO: 3577936 - DNA, 17 bp, Homo sapiens
ggaggatacagaggaga

SEQ ID NO: 3577937 - DNA, 20 bp, Homo sapiens
ggaggatcttttgaacccag

SEQ ID NO: 3577938 - DNA, 17 bp, Homo sapiens
ggaggattcgagcatca

SEQ ID NO: 3577939 - DNA, 16 bp, Homo sapiens
ggaggcaaaggcctgg

SEQ ID NO: 3577940 - DNA, 17 bp, Homo sapiens
ggaggcaaaggcctgga

SEQ ID NO: 3577941 - DNA, 14 bp, Homo sapiens
ggaggcaagccctg

SEQ ID NO: 3577942 - DNA, 18 bp, Homo sapiens
ggaggccaaccagcccga

SEQ ID NO: 3577943 - DNA, 23 bp, Homo sapiens
ggaggccgtatgaagacagaggc

SEQ ID NO: 3577944 - DNA, 12 bp, Homo sapiens
ggaggcctgggc

SEQ ID NO: 3577945 - DNA, 19 bp, Homo sapiens
ggaggctacctcacctggg

SEQ ID NO: 3577946 - DNA, 15 bp, Homo sapiens
ggagggaagggagcc

SEQ ID NO: 3577947 - DNA, 23 bp, Homo sapiens
ggagggaagggagccaagggatg

SEQ ID NO: 3577948 - DNA, 17 bp, Homo sapiens
ggagggcttggcccagc

SEQ ID NO: 3577949 - DNA, 15 bp, Homo sapiens
ggaggggcctaggcc

SEQ ID NO: 3577950 - DNA, 21 bp, Homo sapiens
ggaggggcctggcagccgtgc

SEQ ID NO: 3577951 - DNA, 18 bp, Homo sapiens
ggagggggcaggctgagg

SEQ ID NO: 3577952 - DNA, 15 bp, Homo sapiens
ggaggggggagggaa

SEQ ID NO: 3577953 - DNA, 19 bp, Homo sapiens
ggaggtcatctggcggagg

SEQ ID NO: 3577954 - DNA, 18 bp, Homo sapiens
ggaggtccaagcagagtg

SEQ ID NO: 3577955 - DNA, 14 bp, Homo sapiens
ggaggtctccaggg

SEQ ID NO: 3577956 - DNA, 12 bp, Homo sapiens
ggaggtctctgg

SEQ ID NO: 3577957 - DNA, 15 bp, Homo sapiens
ggaggtctctgggag

SEQ ID NO: 3577958 - DNA, 17 bp, Homo sapiens
ggaggtctctgggagcc

SEQ ID NO: 3577959 - DNA, 23 bp, Homo sapiens
ggaggtctggctgagcccctggg

SEQ ID NO: 3577960 - DNA, 22 bp, Homo sapiens
ggaggtcttggccgactcaggg

SEQ ID NO: 3577961 - DNA, 23 bp, Homo sapiens
ggaggtgggccacacccaggaag

SEQ ID NO: 3577962 - DNA, 15 bp, Homo sapiens
ggagtcagtgccagg

SEQ ID NO: 3577963 - DNA, 15 bp, Homo sapiens
ggagtccactcccag

SEQ ID NO: 3577964 - DNA, 23 bp, Homo sapiens
ggagtgagtcacctgctccagaa

SEQ ID NO: 3577965 - DNA, 14 bp, Homo sapiens
ggagtgcctggagt

SEQ ID NO: 3577966 - DNA, 14 bp, Homo sapiens
ggagtgctcttccc

SEQ ID NO: 3577967 - DNA, 17 bp, Homo sapiens
ggagtgctcttcccact

SEQ ID NO: 3577968 - DNA, 23 bp, Homo sapiens
ggagtggaatagtatcctccagg

SEQ ID NO: 3577969 - DNA, 15 bp, Homo sapiens
ggagtgtcctgccca

SEQ ID NO: 3577970 - DNA, 11 bp, Homo sapiens
ggagtgtgtaa

SEQ ID NO: 3577971 - DNA, 16 bp, Homo sapiens
ggagttaagacctggc

SEQ ID NO: 3577972 - DNA, 18 bp, Homo sapiens
ggagttaagacctggcag

SEQ ID NO: 3577973 - DNA, 22 bp, Homo sapiens
ggagttggtgaatcggttgttc

SEQ ID NO: 3577974 - DNA, 13 bp, Homo sapiens
ggagtttctctct

SEQ ID NO: 3577975 - DNA, 15 bp, Homo sapiens
ggataattatatcag

SEQ ID NO: 3577976 - DNA, 13 bp, Homo sapiens
ggatacagctgct

SEQ ID NO: 3577977 - DNA, 13 bp, Homo sapiens
ggatagatgctgg

SEQ ID NO: 3577978 - DNA, 19 bp, Homo sapiens
ggatagatgctggcccagg

SEQ ID NO: 3577979 - DNA, 13 bp, Homo sapiens
ggatagatgtgtg

SEQ ID NO: 3577980 - DNA, 15 bp, Homo sapiens
ggatagatgtgtgga

SEQ ID NO: 3577981 - DNA, 18 bp, Homo sapiens
ggatagtgttctgctcct

SEQ ID NO: 3577982 - DNA, 19 bp, Homo sapiens
ggatagtgttctgctcctg

SEQ ID NO: 3577983 - DNA, 16 bp, Homo sapiens
ggatatctactgtggt

SEQ ID NO: 3577984 - DNA, 19 bp, Homo sapiens
ggatatggcaggactcctg

SEQ ID NO: 3577985 - DNA, 14 bp, Homo sapiens
ggatatggctgccc

SEQ ID NO: 3577986 - DNA, 20 bp, Homo sapiens
ggatatggctgcccaggaga

SEQ ID NO: 3577987 - DNA, 16 bp, Homo sapiens
ggatatgggctaccag

SEQ ID NO: 3577988 - DNA, 23 bp, Homo sapiens
ggatattctttagcttacctggg

SEQ ID NO: 3577989 - DNA, 13 bp, Homo sapiens
ggatatttcaatc

SEQ ID NO: 3577990 - DNA, 19 bp, Homo sapiens
ggatatttgtcaacagatt

SEQ ID NO: 3577991 - DNA, 23 bp, Homo sapiens
ggatcagcaacccttcctgctgc

SEQ ID NO: 3577992 - DNA, 16 bp, Homo sapiens
ggatcagcattttaga

SEQ ID NO: 3577993 - DNA, 12 bp, Homo sapiens
ggatccaggccc

SEQ ID NO: 3577994 - DNA, 17 bp, Homo sapiens
ggatccagggcagcagg

SEQ ID NO: 3577995 - DNA, 16 bp, Homo sapiens
ggatccagtgacatga

SEQ ID NO: 3577996 - DNA, 17 bp, Homo sapiens
ggatccctcccccccat

SEQ ID NO: 3577997 - DNA, 15 bp, Homo sapiens
ggatcctccacagag

SEQ ID NO: 3577998 - DNA, 13 bp, Homo sapiens
ggatcctgctggg

SEQ ID NO: 3577999 - DNA, 19 bp, Homo sapiens
ggatcgtgttggtattttc

SEQ ID NO: 3578000 - DNA, 15 bp, Homo sapiens
ggatcttcccacagg

SEQ ID NO: 3578001 - DNA, 16 bp, Homo sapiens
ggatgaccttcccagg

SEQ ID NO: 3578002 - DNA, 17 bp, Homo sapiens
ggatgagaaacagctca

SEQ ID NO: 3578003 - DNA, 21 bp, Homo sapiens
ggatgagaaacagctcagcca

SEQ ID NO: 3578004 - DNA, 22 bp, Homo sapiens
ggatgagaaacagctcagccag

SEQ ID NO: 3578005 - DNA, 17 bp, Homo sapiens
ggatgatggcagagcca

SEQ ID NO: 3578006 - DNA, 13 bp, Homo sapiens
ggatgccctggag

SEQ ID NO: 3578007 - DNA, 15 bp, Homo sapiens
ggatgccctggaggt

SEQ ID NO: 3578008 - DNA, 20 bp, Homo sapiens
ggatgcggatcctgctgggg

SEQ ID NO: 3578009 - DNA, 22 bp, Homo sapiens
ggatgctgttgagggccaagag

SEQ ID NO: 3578010 - DNA, 18 bp, Homo sapiens
ggatggagaaagaagtgg

SEQ ID NO: 3578011 - DNA, 12 bp, Homo sapiens
ggatggcaagat

SEQ ID NO: 3578012 - DNA, 21 bp, Homo sapiens
ggatgggggaactcagatcca

SEQ ID NO: 3578013 - DNA, 22 bp, Homo sapiens
ggatgggggaactcagatccag

SEQ ID NO: 3578014 - DNA, 23 bp, Homo sapiens
ggatgggggaactcagatccagg

SEQ ID NO: 3578015 - DNA, 11 bp, Homo sapiens
ggatggtttgt

SEQ ID NO: 3578016 - DNA, 21 bp, Homo sapiens
ggatgtacttaagagtggcat

SEQ ID NO: 3578017 - DNA, 22 bp, Homo sapiens
ggatgtacttaagagtggcata

SEQ ID NO: 3578018 - DNA, 13 bp, Homo sapiens
ggatgttgctata

SEQ ID NO: 3578019 - DNA, 17 bp, Homo sapiens
ggattaactaaagaaga

SEQ ID NO: 3578020 - DNA, 17 bp, Homo sapiens
ggattattttttcagac

SEQ ID NO: 3578021 - DNA, 18 bp, Homo sapiens
ggattattttttcagacc

SEQ ID NO: 3578022 - DNA, 19 bp, Homo sapiens
ggattattttttcagaccg

SEQ ID NO: 3578023 - DNA, 15 bp, Homo sapiens
ggattctctgcagcc

SEQ ID NO: 3578024 - DNA, 17 bp, Homo sapiens
ggattgcccctggcttt

SEQ ID NO: 3578025 - DNA, 23 bp, Homo sapiens
ggatttcaaacttaaacaaaaaa

SEQ ID NO: 3578026 - DNA, 15 bp, Homo sapiens
ggattttaccaaagc

SEQ ID NO: 3578027 - DNA, 16 bp, Homo sapiens
ggcaaaatccttgctt

SEQ ID NO: 3578028 - DNA, 15 bp, Homo sapiens
ggcaaagaggatccg

SEQ ID NO: 3578029 - DNA, 18 bp, Homo sapiens
ggcaaagtgacaaagcaa

SEQ ID NO: 3578030 - DNA, 15 bp, Homo sapiens
ggcaacagatctgga

SEQ ID NO: 3578031 - DNA, 16 bp, Homo sapiens
ggcaacgtagcctggg

SEQ ID NO: 3578032 - DNA, 24 bp, Homo sapiens
ggcaagacagaaaagtgcctgagc

SEQ ID NO: 3578033 - DNA, 22 bp, Homo sapiens
ggcaagctaggccccagaggcc

SEQ ID NO: 3578034 - DNA, 19 bp, Homo sapiens
ggcacaaaagacagctggc

SEQ ID NO: 3578035 - DNA, 16 bp, Homo sapiens
ggcacaactggaagct

SEQ ID NO: 3578036 - DNA, 18 bp, Homo sapiens
ggcacaactggaagcttt

SEQ ID NO: 3578037 - DNA, 12 bp, Homo sapiens
ggcacacactgt

SEQ ID NO: 3578038 - DNA, 16 bp, Homo sapiens
ggcacaccttgcagaa

SEQ ID NO: 3578039 - DNA, 20 bp, Homo sapiens
ggcacacgcctgtagtccca

SEQ ID NO: 3578040 - DNA, 20 bp, Homo sapiens
ggcacacgctgctctgcccc

SEQ ID NO: 3578041 - DNA, 22 bp, Homo sapiens
ggcacacgctgctctgccccag

SEQ ID NO: 3578042 - DNA, 15 bp, Homo sapiens
ggcacagaccaggcc

SEQ ID NO: 3578043 - DNA, 13 bp, Homo sapiens
ggcacagcagctg

SEQ ID NO: 3578044 - DNA, 13 bp, Homo sapiens
ggcacagccttct

SEQ ID NO: 3578045 - DNA, 15 bp, Homo sapiens
ggcacagctgggagc

SEQ ID NO: 3578046 - DNA, 16 bp, Homo sapiens
ggcacagggcagtggg

SEQ ID NO: 3578047 - DNA, 16 bp, Homo sapiens
gggagctctggggaca

SEQ ID NO: 3578048 - DNA, 17 bp, Homo sapiens
gggagctctggggacag

SEQ ID NO: 3578049 - DNA, 23 bp, Homo sapiens
gggagctctggggacagcttcct

SEQ ID NO: 3578050 - DNA, 22 bp, Homo sapiens
gggagctgagctggaaggggcc

SEQ ID NO: 3578051 - DNA, 15 bp, Homo sapiens
gggaggagcctctgg

SEQ ID NO: 3578052 - DNA, 13 bp, Homo sapiens
gggaggatacaga

SEQ ID NO: 3578053 - DNA, 18 bp, Homo sapiens
gggaggatacagaggaga

SEQ ID NO: 3578054 - DNA, 20 bp, Homo sapiens
gggaggcacactttctggca

SEQ ID NO: 3578055 - DNA, 15 bp, Homo sapiens
gggagggaagggagc

SEQ ID NO: 3578056 - DNA, 16 bp, Homo sapiens
gggagggcagctggcc

SEQ ID NO: 3578057 - DNA, 14 bp, Homo sapiens
gggaggggcctagg

SEQ ID NO: 3578058 - DNA, 21 bp, Homo sapiens
gggagtggaatagtatcctcc

SEQ ID NO: 3578059 - DNA, 15 bp, Homo sapiens
gggagttaagacctg

SEQ ID NO: 3578060 - DNA, 21 bp, Homo sapiens
gggagttgctgttaatctgat

SEQ ID NO: 3578061 - DNA, 14 bp, Homo sapiens
gggatagatgtgtg

SEQ ID NO: 3578062 - DNA, 19 bp, Homo sapiens
gggatagtgttctgctcct

SEQ ID NO: 3578063 - DNA, 22 bp, Homo sapiens
gggatagtgttctgctcctgct

SEQ ID NO: 3578064 - DNA, 18 bp, Homo sapiens
gggatatcacttccatga

SEQ ID NO: 3578065 - DNA, 22 bp, Homo sapiens
gggatatggcaggactcctggc

SEQ ID NO: 3578066 - DNA, 13 bp, Homo sapiens
gggatccagccac

SEQ ID NO: 3578067 - DNA, 14 bp, Homo sapiens
gggatcctccacag

SEQ ID NO: 3578068 - DNA, 18 bp, Homo sapiens
gggatcctccacagagag

SEQ ID NO: 3578069 - DNA, 15 bp, Homo sapiens
gggatgacctccaga

SEQ ID NO: 3578070 - DNA, 16 bp, Homo sapiens
gggatgacctccagaa

SEQ ID NO: 3578071 - DNA, 17 bp, Homo sapiens
gggatgacctccagaag

SEQ ID NO: 3578072 - DNA, 23 bp, Homo sapiens
gggatgacctccagaagtccctt

SEQ ID NO: 3578073 - DNA, 20 bp, Homo sapiens
gggatgactaaaatatttat

SEQ ID NO: 3578074 - DNA, 18 bp, Homo sapiens
gggatgatggcagagcca

SEQ ID NO: 3578075 - DNA, 15 bp, Homo sapiens
gggatgctgggctgg

SEQ ID NO: 3578076 - DNA, 18 bp, Homo sapiens
gggattcctgagctggcc

SEQ ID NO: 3578077 - DNA, 20 bp, Homo sapiens
gggattcctgagctggcctg

SEQ ID NO: 3578078 - DNA, 16 bp, Homo sapiens
gggattgctgaggcac

SEQ ID NO: 3578079 - DNA, 23 bp, Homo sapiens
gggatttcaaacttaaacaaaaa

SEQ ID NO: 3578080 - DNA, 22 bp, Homo sapiens
gggattttttactgccctttca

SEQ ID NO: 3578081 - DNA, 16 bp, Homo sapiens
gggcaaagcccctcac

SEQ ID NO: 3578082 - DNA, 13 bp, Homo sapiens
gggcaaagcttgt

SEQ ID NO: 3578083 - DNA, 16 bp, Homo sapiens
gggcaagctaggcccc

SEQ ID NO: 3578084 - DNA, 22 bp, Homo sapiens
gggcaagctaggccccagaggc

SEQ ID NO: 3578085 - DNA, 13 bp, Homo sapiens
gggcacacgctgc

SEQ ID NO: 3578086 - DNA, 20 bp, Homo sapiens
gggcacacgctgctctgccc

SEQ ID NO: 3578087 - DNA, 16 bp, Homo sapiens
gggcactggtggcccg

SEQ ID NO: 3578088 - DNA, 22 bp, Homo sapiens
gggcagactgtgaacttgactg

SEQ ID NO: 3578089 - DNA, 11 bp, Homo sapiens
gggcagagagg

SEQ ID NO: 3578090 - DNA, 14 bp, Homo sapiens
gggcagagaggctg

SEQ ID NO: 3578091 - DNA, 18 bp, Homo sapiens
gggcagagaggctgtggt

SEQ ID NO: 3578092 - DNA, 23 bp, Homo sapiens
gggcagaggagaacttgctgcct

SEQ ID NO: 3578093 - DNA, 19 bp, Homo sapiens
gggcagcaggccagagaaa

SEQ ID NO: 3578094 - DNA, 22 bp, Homo sapiens
gggcagcaggccagagaaagca

SEQ ID NO: 3578095 - DNA, 12 bp, Homo sapiens
gggcagccagca

SEQ ID NO: 3578096 - DNA, 23 bp, Homo sapiens
gggcagccccgttttggggacgt

SEQ ID NO: 3578097 - DNA, 12 bp, Homo sapiens
gggcagctggcc

SEQ ID NO: 3578098 - DNA, 20 bp, Homo sapiens
gggcaggattctctgcagcc

SEQ ID NO: 3578099 - DNA, 12 bp, Homo sapiens
gggcaggctgag

SEQ ID NO: 3578100 - DNA, 17 bp, Homo sapiens
gggcagggaaggagaca

SEQ ID NO: 3578101 - DNA, 18 bp, Homo sapiens
gggcagggggacagcagg

SEQ ID NO: 3578102 - DNA, 20 bp, Homo sapiens
gggcagtccttactccccca

SEQ ID NO: 3578103 - DNA, 15 bp, Homo sapiens
gggcagtggcttctt

SEQ ID NO: 3578104 - DNA, 14 bp, Homo sapiens
gggcataaagtaaa

SEQ ID NO: 3578105 - DNA, 20 bp, Homo sapiens
gggcatggccaggtggccac

SEQ ID NO: 3578106 - DNA, 15 bp, Homo sapiens
gggcattagcaaggc

SEQ ID NO: 3578107 - DNA, 16 bp, Homo sapiens
gggcattagcaaggca

SEQ ID NO: 3578108 - DNA, 18 bp, Homo sapiens
gggcattagcaaggcaga

SEQ ID NO: 3578109 - DNA, 15 bp, Homo sapiens
gggcatttggtgaga

SEQ ID NO: 3578110 - DNA, 20 bp, Homo sapiens
gggccaacctcaggctccta

SEQ ID NO: 3578111 - DNA, 18 bp, Homo sapiens
gggccacacccaggaagg

SEQ ID NO: 3578112 - DNA, 11 bp, Homo sapiens
gggccactggg

SEQ ID NO: 3578113 - DNA, 13 bp, Homo sapiens
gggccagatccag

SEQ ID NO: 3578114 - DNA, 14 bp, Homo sapiens
gggccagatccagc

SEQ ID NO: 3578115 - DNA, 21 bp, Homo sapiens
gggccataaacggttcctggt

SEQ ID NO: 3578116 - DNA, 22 bp, Homo sapiens
gggccataaacggttcctggtg

SEQ ID NO: 3578117 - DNA, 17 bp, Homo sapiens
gggccatctgactgcca

SEQ ID NO: 3578118 - DNA, 23 bp, Homo sapiens
gggccatgatggcaacagatctg

SEQ ID NO: 3578119 - DNA, 22 bp, Homo sapiens
gggccatgcctcctcaggagcc

SEQ ID NO: 3578120 - DNA, 12 bp, Homo sapiens
gggcccagagcc

SEQ ID NO: 3578121 - DNA, 17 bp, Homo sapiens
gggcccagagcccagct

SEQ ID NO: 3578122 - DNA, 19 bp, Homo sapiens
gggcccagagcccagctcc

SEQ ID NO: 3578123 - DNA, 12 bp, Homo sapiens
gggcccagccca

SEQ ID NO: 3578124 - DNA, 12 bp, Homo sapiens
gggcccaggttc

SEQ ID NO: 3578125 - DNA, 17 bp, Homo sapiens
gggccccacctcggcac

SEQ ID NO: 3578126 - DNA, 21 bp, Homo sapiens
gggccccatcctcatccctga

SEQ ID NO: 3578127 - DNA, 22 bp, Homo sapiens
gggccccatcctcatccctgac

SEQ ID NO: 3578128 - DNA, 16 bp, Homo sapiens
gggccccgccagggct

SEQ ID NO: 3578129 - DNA, 18 bp, Homo sapiens
gggccccgccagggctgg

SEQ ID NO: 3578130 - DNA, 19 bp, Homo sapiens
gggccccgccagggctggg

SEQ ID NO: 3578131 - DNA, 15 bp, Homo sapiens
gggccccgggctgga

SEQ ID NO: 3578132 - DNA, 17 bp, Homo sapiens
gggccccgggctggaga

SEQ ID NO: 3578133 - DNA, 14 bp, Homo sapiens
gggcccctgaggag

SEQ ID NO: 3578134 - DNA, 16 bp, Homo sapiens
gggcccgacaggtggg

SEQ ID NO: 3578135 - DNA, 21 bp, Homo sapiens
gggcccgggttgggtcaccag

SEQ ID NO: 3578136 - DNA, 22 bp, Homo sapiens
gggcccgggttgggtcaccaga

SEQ ID NO: 3578137 - DNA, 17 bp, Homo sapiens
gggccctctttccctgc

SEQ ID NO: 3578138 - DNA, 18 bp, Homo sapiens
gggccctctttccctgcg

SEQ ID NO: 3578139 - DNA, 21 bp, Homo sapiens
gggccgctgccacccacctcc

SEQ ID NO: 3578140 - DNA, 14 bp, Homo sapiens
gggccggctgagtg

SEQ ID NO: 3578141 - DNA, 20 bp, Homo sapiens
gggccggctgagtggcagca

SEQ ID NO: 3578142 - DNA, 14 bp, Homo sapiens
gggccgggcagggg

SEQ ID NO: 3578143 - DNA, 19 bp, Homo sapiens
gggccggttctaaggctca

SEQ ID NO: 3578144 - DNA, 17 bp, Homo sapiens
gggccgtggcacagctg

SEQ ID NO: 3578145 - DNA, 22 bp, Homo sapiens
gggcctcagaccccctcagcct

SEQ ID NO: 3578146 - DNA, 15 bp, Homo sapiens
gggcctcaggctccg

SEQ ID NO: 3578147 - DNA, 12 bp, Homo sapiens
gggcctccaggg

SEQ ID NO: 3578148 - DNA, 21 bp, Homo sapiens
gggcctctgttcctttctctg

SEQ ID NO: 3578149 - DNA, 22 bp, Homo sapiens
gggcctctgttcctttctctgg

SEQ ID NO: 3578150 - DNA, 23 bp, Homo sapiens
gggcctgagggtccacctggaga

SEQ ID NO: 3578151 - DNA, 13 bp, Homo sapiens
gggcctgcccctg

SEQ ID NO: 3578152 - DNA, 20 bp, Homo sapiens
gggcctgcggaggcggtggc

SEQ ID NO: 3578153 - DNA, 14 bp, Homo sapiens
gggcctgctccaga

SEQ ID NO: 3578154 - DNA, 17 bp, Homo sapiens
gggcctgctccagacct

SEQ ID NO: 3578155 - DNA, 18 bp, Homo sapiens
gggcctgctccagacctg

SEQ ID NO: 3578156 - DNA, 22 bp, Homo sapiens
gggcctggcagccgtgccttca

SEQ ID NO: 3578157 - DNA, 15 bp, Homo sapiens
gggcctttgcaagat

SEQ ID NO: 3578158 - DNA, 20 bp, Homo sapiens
gggcgaccccgtcacagcct

SEQ ID NO: 3578159 - DNA, 21 bp, Homo sapiens
gggcgagggatgatgagggaa

SEQ ID NO: 3578160 - DNA, 13 bp, Homo sapiens
gggcggagccttc

SEQ ID NO: 3578161 - DNA, 13 bp, Homo sapiens
gggcgggcgtggg

SEQ ID NO: 3578162 - DNA, 15 bp, Homo sapiens
gggcgggcgtgggag

SEQ ID NO: 3578163 - DNA, 15 bp, Homo sapiens
gggcgtccagctcag

SEQ ID NO: 3578164 - DNA, 16 bp, Homo sapiens
gggcgtccagctcagc

SEQ ID NO: 3578165 - DNA, 21 bp, Homo sapiens
gggcgtccagctcagccctgg

SEQ ID NO: 3578166 - DNA, 17 bp, Homo sapiens
gggcgtctgttccccct

SEQ ID NO: 3578167 - DNA, 17 bp, Homo sapiens
gggcgttctcccaaaga

SEQ ID NO: 3578168 - DNA, 23 bp, Homo sapiens
gggctcctcttagctcagctgag

SEQ ID NO: 3578169 - DNA, 23 bp, Homo sapiens
gggctcgccgtgtctcagcctct

SEQ ID NO: 3578170 - DNA, 23 bp, Homo sapiens
gggctctcatgttttcaactgcc

SEQ ID NO: 3578171 - DNA, 22 bp, Homo sapiens
gggctcttctcaggggctctag

SEQ ID NO: 3578172 - DNA, 13 bp, Homo sapiens
gggctgagcctgg

SEQ ID NO: 3578173 - DNA, 18 bp, Homo sapiens
gggctgaggagcagcagg

SEQ ID NO: 3578174 - DNA, 23 bp, Homo sapiens
gggctgagtgagttcaactacat

SEQ ID NO: 3578175 - DNA, 22 bp, Homo sapiens
gggctgcccacctggctgccaa

SEQ ID NO: 3578176 - DNA, 13 bp, Homo sapiens
gggctgctgctcc

SEQ ID NO: 3578177 - DNA, 14 bp, Homo sapiens
gggctggagaaaga

SEQ ID NO: 3578178 - DNA, 19 bp, Homo sapiens
gggctggagaaagagctgc

SEQ ID NO: 3578179 - DNA, 20 bp, Homo sapiens
gtacataactcctgtccctt

SEQ ID NO: 3578180 - DNA, 16 bp, Homo sapiens
gtacatatgtgctgga

SEQ ID NO: 3578181 - DNA, 12 bp, Homo sapiens
gtacattctgcc

SEQ ID NO: 3578182 - DNA, 13 bp, Homo sapiens
gtacatttaataa

SEQ ID NO: 3578183 - DNA, 18 bp, Homo sapiens
gtacatttaataatatca

SEQ ID NO: 3578184 - DNA, 19 bp, Homo sapiens
gtacatttctgattctgat

SEQ ID NO: 3578185 - DNA, 20 bp, Homo sapiens
gtaccaaatctgacatatta

SEQ ID NO: 3578186 - DNA, 16 bp, Homo sapiens
gtaccagttaattttt

SEQ ID NO: 3578187 - DNA, 23 bp, Homo sapiens
gtaccatttaatggggaggacaa

SEQ ID NO: 3578188 - DNA, 20 bp, Homo sapiens
gtacctcagtggatcttcag

SEQ ID NO: 3578189 - DNA, 17 bp, Homo sapiens
gtacctggtccccactg

SEQ ID NO: 3578190 - DNA, 15 bp, Homo sapiens
gtacctgttcctccc

SEQ ID NO: 3578191 - DNA, 17 bp, Homo sapiens
gtacctgttcctccccc

SEQ ID NO: 3578192 - DNA, 12 bp, Homo sapiens
gtacgtcccaca

SEQ ID NO: 3578193 - DNA, 20 bp, Homo sapiens
gtactaacccagtctttctt

SEQ ID NO: 3578194 - DNA, 17 bp, Homo sapiens
gtactaatatttctgta

SEQ ID NO: 3578195 - DNA, 18 bp, Homo sapiens
gtactcccaaactgacaa

SEQ ID NO: 3578196 - DNA, 18 bp, Homo sapiens
gtactgcattctctccca

SEQ ID NO: 3578197 - DNA, 20 bp, Homo sapiens
gtactgcattctctcccatc

SEQ ID NO: 3578198 - DNA, 22 bp, Homo sapiens
gtactgcattctctcccatcct

SEQ ID NO: 3578199 - DNA, 14 bp, Homo sapiens
gtactgtagcaggg

SEQ ID NO: 3578200 - DNA, 23 bp, Homo sapiens
gtactgtatggaaacactgattt

SEQ ID NO: 3578201 - DNA, 19 bp, Homo sapiens
gtacttagagtttctgttt

SEQ ID NO: 3578202 - DNA, 16 bp, Homo sapiens
gtacttggagggctca

SEQ ID NO: 3578203 - DNA, 18 bp, Homo sapiens
gtacttggagggctcagg

SEQ ID NO: 3578204 - DNA, 10 bp, Homo sapiens
gtactttgtg

SEQ ID NO: 3578205 - DNA, 17 bp, Homo sapiens
gtagaataaagaaaaac

SEQ ID NO: 3578206 - DNA, 14 bp, Homo sapiens
gtagaccaaaataa

SEQ ID NO: 3578207 - DNA, 15 bp, Homo sapiens
gtagaccaaaataaa

SEQ ID NO: 3578208 - DNA, 16 bp, Homo sapiens
gtagaccaaaataaaa

SEQ ID NO: 3578209 - DNA, 15 bp, Homo sapiens
gtagactgtgccaga

SEQ ID NO: 3578210 - DNA, 18 bp, Homo sapiens
gtagagacggggtttctc

SEQ ID NO: 3578211 - DNA, 13 bp, Homo sapiens
gtagcagaaacca

SEQ ID NO: 3578212 - DNA, 17 bp, Homo sapiens
gtagcagcaggctcagg

SEQ ID NO: 3578213 - DNA, 12 bp, Homo sapiens
gtagcaggggaa

SEQ ID NO: 3578214 - DNA, 16 bp, Homo sapiens
gtagcatataaatgtt

SEQ ID NO: 3578215 - DNA, 14 bp, Homo sapiens
gtagccagctgtgc

SEQ ID NO: 3578216 - DNA, 16 bp, Homo sapiens
gtagcctaaagggcag

SEQ ID NO: 3578217 - DNA, 19 bp, Homo sapiens
gtagcctgggctcactgtg

SEQ ID NO: 3578218 - DNA, 18 bp, Homo sapiens
gtagctatttttatacac

SEQ ID NO: 3578219 - DNA, 14 bp, Homo sapiens
gtagctctgctgct

SEQ ID NO: 3578220 - DNA, 13 bp, Homo sapiens
gtagctgcagcct

SEQ ID NO: 3578221 - DNA, 16 bp, Homo sapiens
gtagctggggagccct

SEQ ID NO: 3578222 - DNA, 14 bp, Homo sapiens
gtagctgtaagggc

SEQ ID NO: 3578223 - DNA, 16 bp, Homo sapiens
gtagctgtaagggcag

SEQ ID NO: 3578224 - DNA, 20 bp, Homo sapiens
gtagggatatggcaggactc

SEQ ID NO: 3578225 - DNA, 22 bp, Homo sapiens
gtagggatatggcaggactcct

SEQ ID NO: 3578226 - DNA, 20 bp, Homo sapiens
gtagggatgcggatcctgct

SEQ ID NO: 3578227 - DNA, 23 bp, Homo sapiens
gtagggatgcggatcctgctggg

SEQ ID NO: 3578228 - DNA, 15 bp, Homo sapiens
gtaggggctcctgag

SEQ ID NO: 3578229 - DNA, 22 bp, Homo sapiens
gtaggggcttataataaaggac

SEQ ID NO: 3578230 - DNA, 15 bp, Homo sapiens
gtaggggtggcccga

SEQ ID NO: 3578231 - DNA, 16 bp, Homo sapiens
gtagggttataataat

SEQ ID NO: 3578232 - DNA, 23 bp, Homo sapiens
gtagggttttttcttctttcttt

SEQ ID NO: 3578233 - DNA, 14 bp, Homo sapiens
gtaggttgggagaa

SEQ ID NO: 3578234 - DNA, 22 bp, Homo sapiens
gtagtatgataggttattttga

SEQ ID NO: 3578235 - DNA, 19 bp, Homo sapiens
gtagtattttttgtataat

SEQ ID NO: 3578236 - DNA, 20 bp, Homo sapiens
gtagtattttttgtataatt

SEQ ID NO: 3578237 - DNA, 16 bp, Homo sapiens
gtagtccgtgctgaca

SEQ ID NO: 3578238 - DNA, 21 bp, Homo sapiens
gtagttataaaccaatgaaat

SEQ ID NO: 3578239 - DNA, 23 bp, Homo sapiens
gtataaatgtacatttccaaatg

SEQ ID NO: 3578240 - DNA, 19 bp, Homo sapiens
gtataatgtaatgttttta

SEQ ID NO: 3578241 - DNA, 19 bp, Homo sapiens
gtataattggatttcctaa

SEQ ID NO: 3578242 - DNA, 23 bp, Homo sapiens
gtatacaccatatactgttcttc

SEQ ID NO: 3578243 - DNA, 23 bp, Homo sapiens
gtatacagagaagaaaacctcaa

SEQ ID NO: 3578244 - DNA, 15 bp, Homo sapiens
gtatactatagtacc

SEQ ID NO: 3578245 - DNA, 15 bp, Homo sapiens
gtatactgtaggcac

SEQ ID NO: 3578246 - DNA, 14 bp, Homo sapiens
gtatagaccaaagc

SEQ ID NO: 3578247 - DNA, 22 bp, Homo sapiens
gtatagttatatgtacagttta

SEQ ID NO: 3578248 - DNA, 13 bp, Homo sapiens
gtatataaactgg

SEQ ID NO: 3578249 - DNA, 17 bp, Homo sapiens
gtatataaactgggatg

SEQ ID NO: 3578250 - DNA, 18 bp, Homo sapiens
gtatataagttgctgtgt

SEQ ID NO: 3578251 - DNA, 13 bp, Homo sapiens
gtatatgtattta

SEQ ID NO: 3578252 - DNA, 13 bp, Homo sapiens
gtatatgtctcag

SEQ ID NO: 3578253 - DNA, 15 bp, Homo sapiens
gtatatgtctcaggt

SEQ ID NO: 3578254 - DNA, 16 bp, Homo sapiens
gtatatgttgggtgca

SEQ ID NO: 3578255 - DNA, 13 bp, Homo sapiens
gtatattaaaaaa

SEQ ID NO: 3578256 - DNA, 18 bp, Homo sapiens
gtatattacaatgatcac

SEQ ID NO: 3578257 - DNA, 17 bp, Homo sapiens
gtatattctattttaca

SEQ ID NO: 3578258 - DNA, 14 bp, Homo sapiens
gtatcagtgtcctt

SEQ ID NO: 3578259 - DNA, 15 bp, Homo sapiens
gtatcatagaaatgt

SEQ ID NO: 3578260 - DNA, 20 bp, Homo sapiens
gtatccaggttccctcccag

SEQ ID NO: 3578261 - DNA, 19 bp, Homo sapiens
gtatcctccaggtttttca

SEQ ID NO: 3578262 - DNA, 12 bp, Homo sapiens
gtatctgagcag

SEQ ID NO: 3578263 - DNA, 21 bp, Homo sapiens
gtatctgctgttcttcagtcc

SEQ ID NO: 3578264 - DNA, 17 bp, Homo sapiens
gtatctggcttccctgg

SEQ ID NO: 3578265 - DNA, 18 bp, Homo sapiens
gtatctgtgcttctaata

SEQ ID NO: 3578266 - DNA, 16 bp, Homo sapiens
gtatgaataattgcat

SEQ ID NO: 3578267 - DNA, 15 bp, Homo sapiens
gtatgagtgtatgtg

SEQ ID NO: 3578268 - DNA, 20 bp, Homo sapiens
gtatgccacacctggcctta

SEQ ID NO: 3578269 - DNA, 17 bp, Homo sapiens
gtatgtgaagatataag

SEQ ID NO: 3578270 - DNA, 15 bp, Homo sapiens
gtatgtggaagtgtg

SEQ ID NO: 3578271 - DNA, 17 bp, Homo sapiens
gtatgtggaagtgtggg

SEQ ID NO: 3578272 - DNA, 19 bp, Homo sapiens
gtatgtgggggtctgtgtg

SEQ ID NO: 3578273 - DNA, 22 bp, Homo sapiens
gtattaacactaaattgcagtt

SEQ ID NO: 3578274 - DNA, 15 bp, Homo sapiens
gtattaagcagttca

SEQ ID NO: 3578275 - DNA, 23 bp, Homo sapiens
gtattaagcagttcattctacca

SEQ ID NO: 3578276 - DNA, 18 bp, Homo sapiens
gtattaatcttattgttt

SEQ ID NO: 3578277 - DNA, 18 bp, Homo sapiens
gtattcaagcaaacatca

SEQ ID NO: 3578278 - DNA, 15 bp, Homo sapiens
gtattgaaaacttca

SEQ ID NO: 3578279 - DNA, 17 bp, Homo sapiens
gtattgaaaacttcaaa

SEQ ID NO: 3578280 - DNA, 17 bp, Homo sapiens
gtattgatttttaagaa

SEQ ID NO: 3578281 - DNA, 19 bp, Homo sapiens
gtattgatttttaagaaag

SEQ ID NO: 3578282 - DNA, 18 bp, Homo sapiens
gtattgcacattgtaaaa

SEQ ID NO: 3578283 - DNA, 21 bp, Homo sapiens
gtattgcacattgtaaaaagt

SEQ ID NO: 3578284 - DNA, 14 bp, Homo sapiens
gtattgccccctct

SEQ ID NO: 3578285 - DNA, 22 bp, Homo sapiens
gtattggtgttgcagccgcaga

SEQ ID NO: 3578286 - DNA, 14 bp, Homo sapiens
gtatttagaagcca

SEQ ID NO: 3578287 - DNA, 13 bp, Homo sapiens
gtatttattaatt

SEQ ID NO: 3578288 - DNA, 19 bp, Homo sapiens
gtatttggaaataaagtca

SEQ ID NO: 3578289 - DNA, 20 bp, Homo sapiens
gtatttggaaataaagtcag

SEQ ID NO: 3578290 - DNA, 15 bp, Homo sapiens
gtattttaatcctgt

SEQ ID NO: 3578291 - DNA, 18 bp, Homo sapiens
gtattttattattttctt

SEQ ID NO: 3578292 - DNA, 17 bp, Homo sapiens
gtcaaaaaagaatctgt

SEQ ID NO: 3578293 - DNA, 13 bp, Homo sapiens
gtcaaaactgaag

SEQ ID NO: 3578294 - DNA, 22 bp, Homo sapiens
gtcaaaaggaacaaaaattaca

SEQ ID NO: 3578295 - DNA, 20 bp, Homo sapiens
gtcaaacattcgtgagctgg

SEQ ID NO: 3578296 - DNA, 21 bp, Homo sapiens
gtcaaagtgttgctgtggctc

SEQ ID NO: 3578297 - DNA, 16 bp, Homo sapiens
gtcaaatccagtggtg

SEQ ID NO: 3578298 - DNA, 22 bp, Homo sapiens
gtcaaatccagtggtgggtaat

SEQ ID NO: 3578299 - DNA, 21 bp, Homo sapiens
gtcaacaagtatgaataaaga

SEQ ID NO: 3578300 - DNA, 17 bp, Homo sapiens
gtcaacacaaactggct

SEQ ID NO: 3578301 - DNA, 13 bp, Homo sapiens
gtcaacatttctc

SEQ ID NO: 3578302 - DNA, 18 bp, Homo sapiens
gtcaacatttctcatgtt

SEQ ID NO: 3578303 - DNA, 21 bp, Homo sapiens
gtcaagaatagcattgtaaaa

SEQ ID NO: 3578304 - DNA, 18 bp, Homo sapiens
gtcaagccatttttacat

SEQ ID NO: 3578305 - DNA, 13 bp, Homo sapiens
gtcaagctcctcc

SEQ ID NO: 3578306 - DNA, 15 bp, Homo sapiens
gtcaagctcctcctc

SEQ ID NO: 3578307 - DNA, 20 bp, Homo sapiens
gtcaagctcctcctccctgc

SEQ ID NO: 3578308 - DNA, 12 bp, Homo sapiens
gtcaatgtactt

SEQ ID NO: 3578309 - DNA, 18 bp, Homo sapiens
gtcacaacccttctctgt

SEQ ID NO: 3578310 - DNA, 17 bp, Homo sapiens
gtcacaattatgtgcaa

SEQ ID NO: 3578311 - DNA, 23 bp, Homo sapiens
gtggccaactgcaaaaaaagcct

SEQ ID NO: 3578312 - DNA, 19 bp, Homo sapiens
gtggccaaggagctgctat

SEQ ID NO: 3578313 - DNA, 13 bp, Homo sapiens
gtggcccaggacc

SEQ ID NO: 3578314 - DNA, 17 bp, Homo sapiens
gtggccgcccaaggccc

SEQ ID NO: 3578315 - DNA, 15 bp, Homo sapiens
gtggcctatgaaact

SEQ ID NO: 3578316 - DNA, 22 bp, Homo sapiens
gtggcctccctgctgtgccatg

SEQ ID NO: 3578317 - DNA, 15 bp, Homo sapiens
gtggcctgcaggagg

SEQ ID NO: 3578318 - DNA, 20 bp, Homo sapiens
gtggcctttatgttctttca

SEQ ID NO: 3578319 - DNA, 15 bp, Homo sapiens
gtggcggcacgtcct

SEQ ID NO: 3578320 - DNA, 19 bp, Homo sapiens
gtggcggctgcacaacagc

SEQ ID NO: 3578321 - DNA, 18 bp, Homo sapiens
gtggctagtcaagctcct

SEQ ID NO: 3578322 - DNA, 19 bp, Homo sapiens
gtggctagtcaagctcctc

SEQ ID NO: 3578323 - DNA, 19 bp, Homo sapiens
gtggctcctgggccggctg

SEQ ID NO: 3578324 - DNA, 21 bp, Homo sapiens
gtggctcctgggccggctgag

SEQ ID NO: 3578325 - DNA, 15 bp, Homo sapiens
gtggctgccccggcc

SEQ ID NO: 3578326 - DNA, 18 bp, Homo sapiens
gtggcttcccgctcagcc

SEQ ID NO: 3578327 - DNA, 14 bp, Homo sapiens
gtggcttctttcca

SEQ ID NO: 3578328 - DNA, 16 bp, Homo sapiens
gtgggaaaggggagta

SEQ ID NO: 3578329 - DNA, 15 bp, Homo sapiens
gtgggaatgttcttt

SEQ ID NO: 3578330 - DNA, 18 bp, Homo sapiens
gtgggaatgttctttctg

SEQ ID NO: 3578331 - DNA, 17 bp, Homo sapiens
gtgggagctgagctgga

SEQ ID NO: 3578332 - DNA, 13 bp, Homo sapiens
gtgggagtgtgta

SEQ ID NO: 3578333 - DNA, 20 bp, Homo sapiens
gtgggcaaagtcctcctttc

SEQ ID NO: 3578334 - DNA, 20 bp, Homo sapiens
gtgggcatttcttgcgagcc

SEQ ID NO: 3578335 - DNA, 17 bp, Homo sapiens
gtgggccaacaaagaac

SEQ ID NO: 3578336 - DNA, 20 bp, Homo sapiens
gtgggccccgggctggagaa

SEQ ID NO: 3578337 - DNA, 20 bp, Homo sapiens
gtgggcgttgggagcctagc

SEQ ID NO: 3578338 - DNA, 14 bp, Homo sapiens
gtgggctctgagca

SEQ ID NO: 3578339 - DNA, 18 bp, Homo sapiens
gtggggaacacagctaca

SEQ ID NO: 3578340 - DNA, 14 bp, Homo sapiens
gtggggcccactgc

SEQ ID NO: 3578341 - DNA, 24 bp, Homo sapiens
gtggggcccagacaccagcctagc

SEQ ID NO: 3578342 - DNA, 18 bp, Homo sapiens
gtggggcctcaggctccg

SEQ ID NO: 3578343 - DNA, 20 bp, Homo sapiens
gtgggggaacactgagaaag

SEQ ID NO: 3578344 - DNA, 11 bp, Homo sapiens
gtgggggaggg

SEQ ID NO: 3578345 - DNA, 17 bp, Homo sapiens
gtggggggtctgtgtca

SEQ ID NO: 3578346 - DNA, 14 bp, Homo sapiens
gtgggggtctgtgt

SEQ ID NO: 3578347 - DNA, 16 bp, Homo sapiens
gtgggggtctgtgtgt

SEQ ID NO: 3578348 - DNA, 17 bp, Homo sapiens
gtgggtaattgtacaat

SEQ ID NO: 3578349 - DNA, 21 bp, Homo sapiens
gtgggtaattgtacaataaat

SEQ ID NO: 3578350 - DNA, 13 bp, Homo sapiens
gtgggtctgggat

SEQ ID NO: 3578351 - DNA, 13 bp, Homo sapiens
gtgggtctgtgtg

SEQ ID NO: 3578352 - DNA, 19 bp, Homo sapiens
gtggtctctgccccagcct

SEQ ID NO: 3578353 - DNA, 16 bp, Homo sapiens
gtggtctgtggatcag

SEQ ID NO: 3578354 - DNA, 16 bp, Homo sapiens
gtggtgaccccaggag

SEQ ID NO: 3578355 - DNA, 13 bp, Homo sapiens
gtggtgagcaagc

SEQ ID NO: 3578356 - DNA, 17 bp, Homo sapiens
gtggtgcagccttcccc

SEQ ID NO: 3578357 - DNA, 20 bp, Homo sapiens
gtggtgcagccttcccctcc

SEQ ID NO: 3578358 - DNA, 23 bp, Homo sapiens
gtggtgcgtttataattggctta

SEQ ID NO: 3578359 - DNA, 20 bp, Homo sapiens
gtggtgtgtccctggacaca

SEQ ID NO: 3578360 - DNA, 21 bp, Homo sapiens
gtggtgtgtccctggacacag

SEQ ID NO: 3578361 - DNA, 19 bp, Homo sapiens
gtggttgctgttttcctcc

SEQ ID NO: 3578362 - DNA, 13 bp, Homo sapiens
gtgtaaaatgtat

SEQ ID NO: 3578363 - DNA, 16 bp, Homo sapiens
gtgtaaaggaaaataa

SEQ ID NO: 3578364 - DNA, 16 bp, Homo sapiens
gtgtaacaggatacag

SEQ ID NO: 3578365 - DNA, 16 bp, Homo sapiens
gtgtaacttcctgctg

SEQ ID NO: 3578366 - DNA, 18 bp, Homo sapiens
gtgtaagaaatacagact

SEQ ID NO: 3578367 - DNA, 12 bp, Homo sapiens
gtgtaataagac

SEQ ID NO: 3578368 - DNA, 16 bp, Homo sapiens
gtgtaccacttcctga

SEQ ID NO: 3578369 - DNA, 19 bp, Homo sapiens
gtgtacttttcctttgcta

SEQ ID NO: 3578370 - DNA, 20 bp, Homo sapiens
gtgtagcctaaagggcaggg

SEQ ID NO: 3578371 - DNA, 12 bp, Homo sapiens
gtgtataaatgt

SEQ ID NO: 3578372 - DNA, 19 bp, Homo sapiens
gtgtataaatgtacatttc

SEQ ID NO: 3578373 - DNA, 14 bp, Homo sapiens
gtgtatatgtattt

SEQ ID NO: 3578374 - DNA, 12 bp, Homo sapiens
gtgtatcctggc

SEQ ID NO: 3578375 - DNA, 13 bp, Homo sapiens
gtgtatgtggggg

SEQ ID NO: 3578376 - DNA, 18 bp, Homo sapiens
gtgtatttaaaaaaaaga

SEQ ID NO: 3578377 - DNA, 19 bp, Homo sapiens
gtgtatttggaaataaagt

SEQ ID NO: 3578378 - DNA, 17 bp, Homo sapiens
gtgtcagggtccaggag

SEQ ID NO: 3578379 - DNA, 16 bp, Homo sapiens
gtgtcagtttttcctc

SEQ ID NO: 3578380 - DNA, 11 bp, Homo sapiens
gtgtccccacc

SEQ ID NO: 3578381 - DNA, 13 bp, Homo sapiens
gtgtccccaccat

SEQ ID NO: 3578382 - DNA, 17 bp, Homo sapiens
gtgtccccaccatctgc

SEQ ID NO: 3578383 - DNA, 20 bp, Homo sapiens
gtgtccccaccatctgctgt

SEQ ID NO: 3578384 - DNA, 22 bp, Homo sapiens
gtgtccccaccatctgctgtct

SEQ ID NO: 3578385 - DNA, 14 bp, Homo sapiens
gtgtccctggacac

SEQ ID NO: 3578386 - DNA, 20 bp, Homo sapiens
gtgtccctggacacagctct

SEQ ID NO: 3578387 - DNA, 22 bp, Homo sapiens
gtgtccctggacacagctcttc

SEQ ID NO: 3578388 - DNA, 20 bp, Homo sapiens
gtgtcccttcccagcgctgc

SEQ ID NO: 3578389 - DNA, 19 bp, Homo sapiens
gtgtcctccaccatgcact

SEQ ID NO: 3578390 - DNA, 20 bp, Homo sapiens
gtgtcctcctggggttcttt

SEQ ID NO: 3578391 - DNA, 21 bp, Homo sapiens
gtgtcctctgcctgggctctg

SEQ ID NO: 3578392 - DNA, 16 bp, Homo sapiens
gtgtcctgcccatgcc

SEQ ID NO: 3578393 - DNA, 22 bp, Homo sapiens
gtgtcgaggccacattgctggc

SEQ ID NO: 3578394 - DNA, 18 bp, Homo sapiens
gtgtcgtcttgaacgagc

SEQ ID NO: 3578395 - DNA, 22 bp, Homo sapiens
gtgtcgtcttgaacgagcagcc

SEQ ID NO: 3578396 - DNA, 15 bp, Homo sapiens
gtgtctgctcagtaa

SEQ ID NO: 3578397 - DNA, 23 bp, Homo sapiens
gtgtgaacctacctgccttggag

SEQ ID NO: 3578398 - DNA, 22 bp, Homo sapiens
gtgtgaagacccaaaacagctt

SEQ ID NO: 3578399 - DNA, 19 bp, Homo sapiens
gtgtgaatattcctttatt

SEQ ID NO: 3578400 - DNA, 17 bp, Homo sapiens
gtgtgaatttgccagag

SEQ ID NO: 3578401 - DNA, 14 bp, Homo sapiens
gtgtgactaactat

SEQ ID NO: 3578402 - DNA, 23 bp, Homo sapiens
gtgtgagaccccaaagactctgg

SEQ ID NO: 3578403 - DNA, 17 bp, Homo sapiens
gtgtgagggtcctgcag

SEQ ID NO: 3578404 - DNA, 19 bp, Homo sapiens
gtgtgagtaattgaggaaa

SEQ ID NO: 3578405 - DNA, 20 bp, Homo sapiens
gtgtgcacaaatatttattt

SEQ ID NO: 3578406 - DNA, 22 bp, Homo sapiens
gtgtgcacactcatacacatgt

SEQ ID NO: 3578407 - DNA, 17 bp, Homo sapiens
gtgtgcactaaggggcc

SEQ ID NO: 3578408 - DNA, 15 bp, Homo sapiens
gtgtgctgtttgaaa

SEQ ID NO: 3578409 - DNA, 17 bp, Homo sapiens
gtgtggggggctggggg

SEQ ID NO: 3578410 - DNA, 23 bp, Homo sapiens
gtgtggtctctgccccagcctgt

SEQ ID NO: 3578411 - DNA, 14 bp, Homo sapiens
gtgtgtaatttaaa

SEQ ID NO: 3578412 - DNA, 12 bp, Homo sapiens
gtgtgtatgtgg

SEQ ID NO: 3578413 - DNA, 20 bp, Homo sapiens
gtgtgtcacccttaggccag

SEQ ID NO: 3578414 - DNA, 20 bp, Homo sapiens
gtgtgtccctggacacagct

SEQ ID NO: 3578415 - DNA, 23 bp, Homo sapiens
gtgtgtccctggacacagctctt

SEQ ID NO: 3578416 - DNA, 15 bp, Homo sapiens
gtgtgtctgctcagt

SEQ ID NO: 3578417 - DNA, 15 bp, Homo sapiens
gtgtgtctgttcact

SEQ ID NO: 3578418 - DNA, 15 bp, Homo sapiens
gtgtgtgccaagagc

SEQ ID NO: 3578419 - DNA, 14 bp, Homo sapiens
gtgtgtggcagggg

SEQ ID NO: 3578420 - DNA, 23 bp, Homo sapiens
gtgtgtggtcaacatttctcatg

SEQ ID NO: 3578421 - DNA, 18 bp, Homo sapiens
gtgtgtggtgaggggctt

SEQ ID NO: 3578422 - DNA, 14 bp, Homo sapiens
gtgtgtgtatgtgg

SEQ ID NO: 3578423 - DNA, 15 bp, Homo sapiens
gtgtgtgtggcaggg

SEQ ID NO: 3578424 - DNA, 13 bp, Homo sapiens
gtgtgtgtgtggc

SEQ ID NO: 3578425 - DNA, 17 bp, Homo sapiens
gtgtgtgttgtgtgtgg

SEQ ID NO: 3578426 - DNA, 12 bp, Homo sapiens
gtgtgttgtgtg

SEQ ID NO: 3578427 - DNA, 14 bp, Homo sapiens
gtgtgttgtgtgtg

SEQ ID NO: 3578428 - DNA, 14 bp, Homo sapiens
gtgtgtttatgtgt

SEQ ID NO: 3578429 - DNA, 16 bp, Homo sapiens
gtgtgtttatgtgtgt

SEQ ID NO: 3578430 - DNA, 16 bp, Homo sapiens
gtgttaattttgctaa

SEQ ID NO: 3578431 - DNA, 17 bp, Homo sapiens
gtgttcaaaacaaaatg

SEQ ID NO: 3578432 - DNA, 13 bp, Homo sapiens
gtgttctgctcct

SEQ ID NO: 3578433 - DNA, 18 bp, Homo sapiens
gtgttctgctcctgcttt

SEQ ID NO: 3578434 - DNA, 14 bp, Homo sapiens
gtgttgcactgaac

SEQ ID NO: 3578435 - DNA, 16 bp, Homo sapiens
gtgttgcactgaacag

SEQ ID NO: 3578436 - DNA, 20 bp, Homo sapiens
gtgttgcagccgcagagaaa

SEQ ID NO: 3578437 - DNA, 17 bp, Homo sapiens
gtgttgctgtggctcca

SEQ ID NO: 3578438 - DNA, 19 bp, Homo sapiens
gtgtttaactgctgcaggg

SEQ ID NO: 3578439 - DNA, 12 bp, Homo sapiens
gtgtttatgtgt

SEQ ID NO: 3578440 - DNA, 16 bp, Homo sapiens
gtgtttatgtgtgtgt

SEQ ID NO: 3578441 - DNA, 16 bp, Homo sapiens
gtgtttccctctgtgt

SEQ ID NO: 3578442 - DNA, 20 bp, Homo sapiens
gtgtttccttttcaggagat

SEQ ID NO: 3578443 - DNA, 13 bp, Homo sapiens
gtgtttctctaag

SEQ ID NO: 3578444 - DNA, 15 bp, Homo sapiens
taaagagcatcctga

SEQ ID NO: 3578445 - DNA, 21 bp, Homo sapiens
taaagaggagataaggtggct

SEQ ID NO: 3578446 - DNA, 23 bp, Homo sapiens
taaagaggagataaggtggcttc

SEQ ID NO: 3578447 - DNA, 14 bp, Homo sapiens
taaagatgaatgtc

SEQ ID NO: 3578448 - DNA, 19 bp, Homo sapiens
taaagatgagctttgtcta

SEQ ID NO: 3578449 - DNA, 21 bp, Homo sapiens
taaagattttgttttgttgga

SEQ ID NO: 3578450 - DNA, 15 bp, Homo sapiens
taaagatttttgttt

SEQ ID NO: 3578451 - DNA, 19 bp, Homo sapiens
taaagcaaccaaaaagaaa

SEQ ID NO: 3578452 - DNA, 21 bp, Homo sapiens
taaagcaaccaaaaagaaaaa

SEQ ID NO: 3578453 - DNA, 13 bp, Homo sapiens
taaagcagttaat

SEQ ID NO: 3578454 - DNA, 19 bp, Homo sapiens
taaagcagttcctgtccca

SEQ ID NO: 3578455 - DNA, 20 bp, Homo sapiens
taaagcagttcctgtcccac

SEQ ID NO: 3578456 - DNA, 23 bp, Homo sapiens
taaagcatatccattcagaatga

SEQ ID NO: 3578457 - DNA, 18 bp, Homo sapiens
taaagccaggctcaggag

SEQ ID NO: 3578458 - DNA, 17 bp, Homo sapiens
taaaggaaaataatgtt

SEQ ID NO: 3578459 - DNA, 20 bp, Homo sapiens
taaaggaaaataatgtttga

SEQ ID NO: 3578460 - DNA, 20 bp, Homo sapiens
taaaggaaataggatctcca

SEQ ID NO: 3578461 - DNA, 12 bp, Homo sapiens
taaaggactgta

SEQ ID NO: 3578462 - DNA, 14 bp, Homo sapiens
taaaggataaagaa

SEQ ID NO: 3578463 - DNA, 16 bp, Homo sapiens
taaaggctaactatga

SEQ ID NO: 3578464 - DNA, 16 bp, Homo sapiens
taaagggaccatctgc

SEQ ID NO: 3578465 - DNA, 22 bp, Homo sapiens
taaagggactacctctgtgcct

SEQ ID NO: 3578466 - DNA, 13 bp, Homo sapiens
taaagggcagggc

SEQ ID NO: 3578467 - DNA, 23 bp, Homo sapiens
taaaggtacactggtatttatat

SEQ ID NO: 3578468 - DNA, 14 bp, Homo sapiens
taaagtctgggcca

SEQ ID NO: 3578469 - DNA, 14 bp, Homo sapiens
taaagtgatttttg

SEQ ID NO: 3578470 - DNA, 19 bp, Homo sapiens
taaagtttttaaagtgtgt

SEQ ID NO: 3578471 - DNA, 15 bp, Homo sapiens
taaataaaaatgtct

SEQ ID NO: 3578472 - DNA, 13 bp, Homo sapiens
taaataaaagcac

SEQ ID NO: 3578473 - DNA, 13 bp, Homo sapiens
taaataacacaga

SEQ ID NO: 3578474 - DNA, 20 bp, Homo sapiens
taaataacacagatattgtt

SEQ ID NO: 3578475 - DNA, 20 bp, Homo sapiens
taaatatatctaccccagac

SEQ ID NO: 3578476 - DNA, 18 bp, Homo sapiens
taaatattagttaatgga

SEQ ID NO: 3578477 - DNA, 19 bp, Homo sapiens
taaatattagttaatggat

SEQ ID NO: 3578478 - DNA, 13 bp, Homo sapiens
taaatattttgct

SEQ ID NO: 3578479 - DNA, 16 bp, Homo sapiens
taaatattttgctaac

SEQ ID NO: 3578480 - DNA, 19 bp, Homo sapiens
taaatattttgctaactgg

SEQ ID NO: 3578481 - DNA, 21 bp, Homo sapiens
taaatattttgctaactggtt

SEQ ID NO: 3578482 - DNA, 14 bp, Homo sapiens
taaatcacacattc

SEQ ID NO: 3578483 - DNA, 17 bp, Homo sapiens
taaatcacacattcagt

SEQ ID NO: 3578484 - DNA, 23 bp, Homo sapiens
taaatcacagatgcatatagaca

SEQ ID NO: 3578485 - DNA, 12 bp, Homo sapiens
taaatcagacca

SEQ ID NO: 3578486 - DNA, 17 bp, Homo sapiens
taaatcattcttactaa

SEQ ID NO: 3578487 - DNA, 22 bp, Homo sapiens
taaatcctagacttgaaagttt

SEQ ID NO: 3578488 - DNA, 18 bp, Homo sapiens
taaatcctgaagagcatt

SEQ ID NO: 3578489 - DNA, 16 bp, Homo sapiens
taaatctgacccagtg

SEQ ID NO: 3578490 - DNA, 16 bp, Homo sapiens
taaatcttagtgttca

SEQ ID NO: 3578491 - DNA, 17 bp, Homo sapiens
taaatcttgaccaacag

SEQ ID NO: 3578492 - DNA, 18 bp, Homo sapiens
taaatgaaacttaagaat

SEQ ID NO: 3578493 - DNA, 22 bp, Homo sapiens
taaatggcccggacatgtcttg

SEQ ID NO: 3578494 - DNA, 18 bp, Homo sapiens
taaatggttaaattttac

SEQ ID NO: 3578495 - DNA, 13 bp, Homo sapiens
taaatgtaaaaat

SEQ ID NO: 3578496 - DNA, 13 bp, Homo sapiens
taaatgtatacta

SEQ ID NO: 3578497 - DNA, 13 bp, Homo sapiens
taaatgtatttta

SEQ ID NO: 3578498 - DNA, 17 bp, Homo sapiens
taaatgtcactttttga

SEQ ID NO: 3578499 - DNA, 20 bp, Homo sapiens
taaatgtccacttaaaatac

SEQ ID NO: 3578500 - DNA, 19 bp, Homo sapiens
taaatgtctgcactgagga

SEQ ID NO: 3578501 - DNA, 22 bp, Homo sapiens
taaatgtctgcactgaggattt

SEQ ID NO: 3578502 - DNA, 16 bp, Homo sapiens
taaatgtgccttcatt

SEQ ID NO: 3578503 - DNA, 16 bp, Homo sapiens
taaatgtgcttttaaa

SEQ ID NO: 3578504 - DNA, 19 bp, Homo sapiens
taaatgttatgactatgta

SEQ ID NO: 3578505 - DNA, 23 bp, Homo sapiens
taaatgttatgactatgtaaact

SEQ ID NO: 3578506 - DNA, 13 bp, Homo sapiens
taaattaggcagt

SEQ ID NO: 3578507 - DNA, 19 bp, Homo sapiens
taaattatatgatatgcat

SEQ ID NO: 3578508 - DNA, 22 bp, Homo sapiens
taaattatatgatatgcatgta

SEQ ID NO: 3578509 - DNA, 13 bp, Homo sapiens
taaattattactt

SEQ ID NO: 3578510 - DNA, 20 bp, Homo sapiens
taaattatttgattatttaa

SEQ ID NO: 3578511 - DNA, 23 bp, Homo sapiens
taaattatttgattatttaagac

SEQ ID NO: 3578512 - DNA, 16 bp, Homo sapiens
taaattccactgaaaa

SEQ ID NO: 3578513 - DNA, 17 bp, Homo sapiens
taaattcccaacttctc

SEQ ID NO: 3578514 - DNA, 18 bp, Homo sapiens
taaattcccaacttctct

SEQ ID NO: 3578515 - DNA, 20 bp, Homo sapiens
taaattcctctttgctttgc

SEQ ID NO: 3578516 - DNA, 19 bp, Homo sapiens
taaattctacctccttgtg

SEQ ID NO: 3578517 - DNA, 14 bp, Homo sapiens
taaattctactaag

SEQ ID NO: 3578518 - DNA, 12 bp, Homo sapiens
taaattgcaata

SEQ ID NO: 3578519 - DNA, 19 bp, Homo sapiens
taaattgcagtttacagta

SEQ ID NO: 3578520 - DNA, 15 bp, Homo sapiens
taaattgtgtattta

SEQ ID NO: 3578521 - DNA, 22 bp, Homo sapiens
taaatttaatccttctttgtaa

SEQ ID NO: 3578522 - DNA, 15 bp, Homo sapiens
taaatttaattcttc

SEQ ID NO: 3578523 - DNA, 13 bp, Homo sapiens
taaatttatgtga

SEQ ID NO: 3578524 - DNA, 13 bp, Homo sapiens
taaatttgattta

SEQ ID NO: 3578525 - DNA, 13 bp, Homo sapiens
taaattttacatg

SEQ ID NO: 3578526 - DNA, 16 bp, Homo sapiens
taaattttttgaaaca

SEQ ID NO: 3578527 - DNA, 16 bp, Homo sapiens
taacaagaaagtggtc

SEQ ID NO: 3578528 - DNA, 19 bp, Homo sapiens
taacaatattaattcaggt

SEQ ID NO: 3578529 - DNA, 17 bp, Homo sapiens
taacaatccattcacaa

SEQ ID NO: 3578530 - DNA, 10 bp, Homo sapiens
taacaatgat

SEQ ID NO: 3578531 - DNA, 15 bp, Homo sapiens
taacaatgtaataaa

SEQ ID NO: 3578532 - DNA, 20 bp, Homo sapiens
taacaattcagtaacaaagg

SEQ ID NO: 3578533 - DNA, 13 bp, Homo sapiens
taacacagatatt

SEQ ID NO: 3578534 - DNA, 17 bp, Homo sapiens
taacagatcctttcaaa

SEQ ID NO: 3578535 - DNA, 23 bp, Homo sapiens
taacaggtattttgtttctttta

SEQ ID NO: 3578536 - DNA, 17 bp, Homo sapiens
taacatattatttcatt

SEQ ID NO: 3578537 - DNA, 18 bp, Homo sapiens
taacatggacatgatctt

SEQ ID NO: 3578538 - DNA, 19 bp, Homo sapiens
taacatgtgaaaagaatag

SEQ ID NO: 3578539 - DNA, 20 bp, Homo sapiens
taaccatggagtagaggtac

SEQ ID NO: 3578540 - DNA, 15 bp, Homo sapiens
taacccacctctcct

SEQ ID NO: 3578541 - DNA, 16 bp, Homo sapiens
taacccacctctcctg

SEQ ID NO: 3578542 - DNA, 16 bp, Homo sapiens
taacccagtctttctt

SEQ ID NO: 3578543 - DNA, 22 bp, Homo sapiens
taacgaagtgcacttacactta

SEQ ID NO: 3578544 - DNA, 14 bp, Homo sapiens
taacgatgttgtat

SEQ ID NO: 3578545 - DNA, 20 bp, Homo sapiens
taacgctctatctggttttg

SEQ ID NO: 3578546 - DNA, 18 bp, Homo sapiens
taactaaaataattttgt

SEQ ID NO: 3578547 - DNA, 19 bp, Homo sapiens
taactaaaataattttgta

SEQ ID NO: 3578548 - DNA, 12 bp, Homo sapiens
taactaaagaag

SEQ ID NO: 3578549 - DNA, 16 bp, Homo sapiens
taactaacatgtcctg

SEQ ID NO: 3578550 - DNA, 13 bp, Homo sapiens
taactactttata

SEQ ID NO: 3578551 - DNA, 17 bp, Homo sapiens
taactactttataacta

SEQ ID NO: 3578552 - DNA, 16 bp, Homo sapiens
taactattacagtgtt

SEQ ID NO: 3578553 - DNA, 17 bp, Homo sapiens
taactattacagtgttg

SEQ ID NO: 3578554 - DNA, 15 bp, Homo sapiens
taactcattgctctg

SEQ ID NO: 3578555 - DNA, 16 bp, Homo sapiens
taactcctataaagtg

SEQ ID NO: 3578556 - DNA, 13 bp, Homo sapiens
taactctgagagc

SEQ ID NO: 3578557 - DNA, 20 bp, Homo sapiens
taactgaaccaaattgcact

SEQ ID NO: 3578558 - DNA, 17 bp, Homo sapiens
taactgattaaaaatac

SEQ ID NO: 3578559 - DNA, 14 bp, Homo sapiens
taactgctgcaggg

SEQ ID NO: 3578560 - DNA, 13 bp, Homo sapiens
taactgggttaaa

SEQ ID NO: 3578561 - DNA, 14 bp, Homo sapiens
taactgggttaaat

SEQ ID NO: 3578562 - DNA, 16 bp, Homo sapiens
taactgggttaaatat

SEQ ID NO: 3578563 - DNA, 21 bp, Homo sapiens
taactgggttaaatattttgc

SEQ ID NO: 3578564 - DNA, 22 bp, Homo sapiens
taactgtaaagatgaatgtcag

SEQ ID NO: 3578565 - DNA, 19 bp, Homo sapiens
taactgtattttctttcac

SEQ ID NO: 3578566 - DNA, 20 bp, Homo sapiens
taactgtattttctttcact

SEQ ID NO: 3578567 - DNA, 14 bp, Homo sapiens
taactgtcctgtcc

SEQ ID NO: 3578568 - DNA, 22 bp, Homo sapiens
taactgttaactatgacagata

SEQ ID NO: 3578569 - DNA, 14 bp, Homo sapiens
taacttattgctag

SEQ ID NO: 3578570 - DNA, 15 bp, Homo sapiens
taacttattgctaga

SEQ ID NO: 3578571 - DNA, 19 bp, Homo sapiens
taacttccaaataaataat

SEQ ID NO: 3578572 - DNA, 10 bp, Homo sapiens
taacttcctg

SEQ ID NO: 3578573 - DNA, 21 bp, Homo sapiens
taacttccttggactcatttt

SEQ ID NO: 3578574 - DNA, 13 bp, Homo sapiens
taacttcttgctt

SEQ ID NO: 3578575 - DNA, 16 bp, Homo sapiens
taacttgagattcaag

SEQ ID NO: 3578576 - DNA, 19 bp, Homo sapiens
taacttgagattcaagaca

SEQ ID NO: 3578577 - DNA, 20 bp, Homo sapiens
tagaaactgaggcccagaga

SEQ ID NO: 3578578 - DNA, 17 bp, Homo sapiens
tagaaagagatacagag

SEQ ID NO: 3578579 - DNA, 20 bp, Homo sapiens
tagaaatgtgaagaggtctg

SEQ ID NO: 3578580 - DNA, 18 bp, Homo sapiens
tagaactcctgtcttctt

SEQ ID NO: 3578581 - DNA, 21 bp, Homo sapiens
tagaactcctgtcttctttct

SEQ ID NO: 3578582 - DNA, 14 bp, Homo sapiens
tagaagaagtgtgt

SEQ ID NO: 3578583 - DNA, 15 bp, Homo sapiens
tagaagattctatgt

SEQ ID NO: 3578584 - DNA, 16 bp, Homo sapiens
tagaataaagaaaaac

SEQ ID NO: 3578585 - DNA, 19 bp, Homo sapiens
tagaataaaggcagttttc

SEQ ID NO: 3578586 - DNA, 21 bp, Homo sapiens
tagaataaaggcagttttcta

SEQ ID NO: 3578587 - DNA, 19 bp, Homo sapiens
tagaatctgtgacctctga

SEQ ID NO: 3578588 - DNA, 14 bp, Homo sapiens
tagaatgagatctg

SEQ ID NO: 3578589 - DNA, 22 bp, Homo sapiens
tagaatgtcaataaatttgctt

SEQ ID NO: 3578590 - DNA, 18 bp, Homo sapiens
tagaatgttttcaaatgt

SEQ ID NO: 3578591 - DNA, 21 bp, Homo sapiens
tagaattctgtattggatata

SEQ ID NO: 3578592 - DNA, 17 bp, Homo sapiens
tagacacacatacataa

SEQ ID NO: 3578593 - DNA, 15 bp, Homo sapiens
tagacactttggaag

SEQ ID NO: 3578594 - DNA, 21 bp, Homo sapiens
tagacatttgctatgagctgg

SEQ ID NO: 3578595 - DNA, 12 bp, Homo sapiens
tagaccaaagca

SEQ ID NO: 3578596 - DNA, 20 bp, Homo sapiens
tagaccaaagcaaagaaaat

SEQ ID NO: 3578597 - DNA, 16 bp, Homo sapiens
tagaccaattgaagca

SEQ ID NO: 3578598 - DNA, 18 bp, Homo sapiens
tagactgctcctgggcat

SEQ ID NO: 3578599 - DNA, 21 bp, Homo sapiens
tagacttgaaagttttccagt

SEQ ID NO: 3578600 - DNA, 17 bp, Homo sapiens
tagagaaaattcaggtc

SEQ ID NO: 3578601 - DNA, 14 bp, Homo sapiens
tagagataattgct

SEQ ID NO: 3578602 - DNA, 16 bp, Homo sapiens
tagagataggaaactg

SEQ ID NO: 3578603 - DNA, 15 bp, Homo sapiens
tagagcttctggcac

SEQ ID NO: 3578604 - DNA, 22 bp, Homo sapiens
tagaggcaacaggattgatcat

SEQ ID NO: 3578605 - DNA, 19 bp, Homo sapiens
tagagggacctctcccagg

SEQ ID NO: 3578606 - DNA, 23 bp, Homo sapiens
tagagggaggagaatgagcctcg

SEQ ID NO: 3578607 - DNA, 13 bp, Homo sapiens
tagagggaggggc

SEQ ID NO: 3578608 - DNA, 11 bp, Homo sapiens
tagagtgtagc

SEQ ID NO: 3578609 - DNA, 23 bp, Homo sapiens
tagagtgtagcctaaagggcagg

SEQ ID NO: 3578610 - DNA, 15 bp, Homo sapiens
tagagtgtagctgta

SEQ ID NO: 3578611 - DNA, 18 bp, Homo sapiens
tagagtgtagctgtaagg

SEQ ID NO: 3578612 - DNA, 18 bp, Homo sapiens
tagataacactgacttgt

SEQ ID NO: 3578613 - DNA, 20 bp, Homo sapiens
tagatgaatgtcagttgtta

SEQ ID NO: 3578614 - DNA, 21 bp, Homo sapiens
tagatgctggcccagggccca

SEQ ID NO: 3578615 - DNA, 18 bp, Homo sapiens
tagatggcctcttactaa

SEQ ID NO: 3578616 - DNA, 15 bp, Homo sapiens
tagatgtagtatttt

SEQ ID NO: 3578617 - DNA, 21 bp, Homo sapiens
tagatgtgcagtttggaatta

SEQ ID NO: 3578618 - DNA, 12 bp, Homo sapiens
tagattcagaga

SEQ ID NO: 3578619 - DNA, 21 bp, Homo sapiens
tagcaaagattaaatgtgtca

SEQ ID NO: 3578620 - DNA, 13 bp, Homo sapiens
tagcaccatggca

SEQ ID NO: 3578621 - DNA, 19 bp, Homo sapiens
tagcagaaaccaacaagaa

SEQ ID NO: 3578622 - DNA, 20 bp, Homo sapiens
tagcagggcatggctgggaa

SEQ ID NO: 3578623 - DNA, 14 bp, Homo sapiens
tagcatataaatgt

SEQ ID NO: 3578624 - DNA, 15 bp, Homo sapiens
tagcatcatcctgca

SEQ ID NO: 3578625 - DNA, 23 bp, Homo sapiens
tagcatgttcctccttttcttca

SEQ ID NO: 3578626 - DNA, 16 bp, Homo sapiens
tagcattaaagttcta

SEQ ID NO: 3578627 - DNA, 14 bp, Homo sapiens
tagcattgaaataa

SEQ ID NO: 3578628 - DNA, 15 bp, Homo sapiens
tagcattgaaataat

SEQ ID NO: 3578629 - DNA, 18 bp, Homo sapiens
tagcattgtaaaagcatt

SEQ ID NO: 3578630 - DNA, 16 bp, Homo sapiens
tagccaggtactgcat

SEQ ID NO: 3578631 - DNA, 17 bp, Homo sapiens
tagccctgctccaactc

SEQ ID NO: 3578632 - DNA, 21 bp, Homo sapiens
tagccctggttagctgacagt

SEQ ID NO: 3578633 - DNA, 15 bp, Homo sapiens
tagcctaaagggcag

SEQ ID NO: 3578634 - DNA, 11 bp, Homo sapiens
tagcctaccat

SEQ ID NO: 3578635 - DNA, 19 bp, Homo sapiens
tagcctctggactggaaag

SEQ ID NO: 3578636 - DNA, 19 bp, Homo sapiens
tagcctggcaacagagcga

SEQ ID NO: 3578637 - DNA, 20 bp, Homo sapiens
tagcctgggctcactgtgct

SEQ ID NO: 3578638 - DNA, 18 bp, Homo sapiens
tagcctgtgcctctggga

SEQ ID NO: 3578639 - DNA, 16 bp, Homo sapiens
tagccttccaacattt

SEQ ID NO: 3578640 - DNA, 18 bp, Homo sapiens
tagcgttttttaaatgta

SEQ ID NO: 3578641 - DNA, 22 bp, Homo sapiens
tagcgttttttaaatgtatact

SEQ ID NO: 3578642 - DNA, 14 bp, Homo sapiens
tagctaagtacaca

SEQ ID NO: 3578643 - DNA, 19 bp, Homo sapiens
tagctaataacatgtgaaa

SEQ ID NO: 3578644 - DNA, 18 bp, Homo sapiens
tagctagcaccatggcat

SEQ ID NO: 3578645 - DNA, 12 bp, Homo sapiens
tagctaggagca

SEQ ID NO: 3578646 - DNA, 17 bp, Homo sapiens
tagctaggagcaggctt

SEQ ID NO: 3578647 - DNA, 22 bp, Homo sapiens
tagctaggagcaggcttgtggc

SEQ ID NO: 3578648 - DNA, 23 bp, Homo sapiens
tagctaggagcaggcttgtggca

SEQ ID NO: 3578649 - DNA, 17 bp, Homo sapiens
tagctatttttatacac

SEQ ID NO: 3578650 - DNA, 14 bp, Homo sapiens
tagctctaaaatct

SEQ ID NO: 3578651 - DNA, 12 bp, Homo sapiens
tagctctgctgc

SEQ ID NO: 3578652 - DNA, 23 bp, Homo sapiens
tagctctggggtgggcagttttt

SEQ ID NO: 3578653 - DNA, 15 bp, Homo sapiens
tagctgacagtcagc

SEQ ID NO: 3578654 - DNA, 19 bp, Homo sapiens
tagctgacagtcagctgtg

SEQ ID NO: 3578655 - DNA, 20 bp, Homo sapiens
tagctgcagccttcatcaga

SEQ ID NO: 3578656 - DNA, 19 bp, Homo sapiens
tagctgtaagggcagtgcc

SEQ ID NO: 3578657 - DNA, 17 bp, Homo sapiens
tagcttaatcttaatgt

SEQ ID NO: 3578658 - DNA, 13 bp, Homo sapiens
tagcttgaaattg

SEQ ID NO: 3578659 - DNA, 20 bp, Homo sapiens
taggaaactgaagcataaag

SEQ ID NO: 3578660 - DNA, 23 bp, Homo sapiens
taggaaccagccaaccatcatgt

SEQ ID NO: 3578661 - DNA, 18 bp, Homo sapiens
taggaactgctgggcttg

SEQ ID NO: 3578662 - DNA, 17 bp, Homo sapiens
taggaagttgacttata

SEQ ID NO: 3578663 - DNA, 22 bp, Homo sapiens
taggaagttgacttatagtaca

SEQ ID NO: 3578664 - DNA, 20 bp, Homo sapiens
taggagacagatcactcctg

SEQ ID NO: 3578665 - DNA, 20 bp, Homo sapiens
taggatcatttgttggaatg

SEQ ID NO: 3578666 - DNA, 15 bp, Homo sapiens
taggatcctggaggc

SEQ ID NO: 3578667 - DNA, 12 bp, Homo sapiens
taggatttattg

SEQ ID NO: 3578668 - DNA, 13 bp, Homo sapiens
taggcaagaagag

SEQ ID NO: 3578669 - DNA, 20 bp, Homo sapiens
taggcactgagcagggatct

SEQ ID NO: 3578670 - DNA, 18 bp, Homo sapiens
taggcatacttttcaaag

SEQ ID NO: 3578671 - DNA, 20 bp, Homo sapiens
taggcatacttttcaaagct

SEQ ID NO: 3578672 - DNA, 14 bp, Homo sapiens
taggccaggcctta

SEQ ID NO: 3578673 - DNA, 23 bp, Homo sapiens
taggccaggccttatctgaaagg

SEQ ID NO: 3578674 - DNA, 14 bp, Homo sapiens
taggccccagaggc

SEQ ID NO: 3578675 - DNA, 22 bp, Homo sapiens
taggccccagaggccctggagg

SEQ ID NO: 3578676 - DNA, 19 bp, Homo sapiens
taggcctcaggtgaaactc

SEQ ID NO: 3578677 - DNA, 17 bp, Homo sapiens
taggcctgtcccttgcc

SEQ ID NO: 3578678 - DNA, 22 bp, Homo sapiens
taggcctttcctctgcacgctc

SEQ ID NO: 3578679 - DNA, 20 bp, Homo sapiens
taggctactgtaatgctgcc

SEQ ID NO: 3578680 - DNA, 21 bp, Homo sapiens
taggctactgtaatgctgcct

SEQ ID NO: 3578681 - DNA, 15 bp, Homo sapiens
taggctcttaagcag

SEQ ID NO: 3578682 - DNA, 19 bp, Homo sapiens
taggctcttaagcagcatg

SEQ ID NO: 3578683 - DNA, 15 bp, Homo sapiens
taggctggtggccca

SEQ ID NO: 3578684 - DNA, 19 bp, Homo sapiens
taggctggtggcccaggac

SEQ ID NO: 3578685 - DNA, 17 bp, Homo sapiens
taggcttttccaaatca

SEQ ID NO: 3578686 - DNA, 22 bp, Homo sapiens
tagggatatggcaggactcctg

SEQ ID NO: 3578687 - DNA, 20 bp, Homo sapiens
tagggtccctgaacgccctg

SEQ ID NO: 3578688 - DNA, 17 bp, Homo sapiens
tagggttataataatgt

SEQ ID NO: 3578689 - DNA, 23 bp, Homo sapiens
tagggttttcagatgaaaagaaa

SEQ ID NO: 3578690 - DNA, 23 bp, Homo sapiens
taggtagccttgtgttctgagta

SEQ ID NO: 3578691 - DNA, 17 bp, Homo sapiens
taggtatgatctcttct

SEQ ID NO: 3578692 - DNA, 22 bp, Homo sapiens
taggtatgatctcttctggtgt

SEQ ID NO: 3578693 - DNA, 15 bp, Homo sapiens
taggtcatatgttgt

SEQ ID NO: 3578694 - DNA, 15 bp, Homo sapiens
taggtcattgcacct

SEQ ID NO: 3578695 - DNA, 18 bp, Homo sapiens
taggtcccggccagctct

SEQ ID NO: 3578696 - DNA, 15 bp, Homo sapiens
taggtctttctctca

SEQ ID NO: 3578697 - DNA, 17 bp, Homo sapiens
taggtgcagctcctcag

SEQ ID NO: 3578698 - DNA, 17 bp, Homo sapiens
taggtgcccagggccag

SEQ ID NO: 3578699 - DNA, 20 bp, Homo sapiens
taggtgctacaaaaacacag

SEQ ID NO: 3578700 - DNA, 22 bp, Homo sapiens
taggtgctacaaaaacacagca

SEQ ID NO: 3578701 - DNA, 20 bp, Homo sapiens
taggtggctctgggaatggg

SEQ ID NO: 3578702 - DNA, 22 bp, Homo sapiens
taggttattttgatgtaaagat

SEQ ID NO: 3578703 - DNA, 18 bp, Homo sapiens
taggttttctatgtgact

SEQ ID NO: 3578704 - DNA, 14 bp, Homo sapiens
tagtaattgttaca

SEQ ID NO: 3578705 - DNA, 16 bp, Homo sapiens
tagtacaaagtttcaa

SEQ ID NO: 3578706 - DNA, 17 bp, Homo sapiens
tagtacaaagtttcaat

SEQ ID NO: 3578707 - DNA, 11 bp, Homo sapiens
tagtagaagaa

SEQ ID NO: 3578708 - DNA, 22 bp, Homo sapiens
tattttgtaataaactctctag

SEQ ID NO: 3578709 - DNA, 17 bp, Homo sapiens
tattttgttgctttctt

SEQ ID NO: 3578710 - DNA, 21 bp, Homo sapiens
tattttgttttgtgcagagat

SEQ ID NO: 3578711 - DNA, 17 bp, Homo sapiens
tatttttaaagaatgtt

SEQ ID NO: 3578712 - DNA, 19 bp, Homo sapiens
tatttttgtattttacatg

SEQ ID NO: 3578713 - DNA, 17 bp, Homo sapiens
tatttttgtctgcagct

SEQ ID NO: 3578714 - DNA, 17 bp, Homo sapiens
tattttttaaatcttga

SEQ ID NO: 3578715 - DNA, 13 bp, Homo sapiens
tatttttttccca

SEQ ID NO: 3578716 - DNA, 21 bp, Homo sapiens
tcaaaaaaaagaaaatgtctt

SEQ ID NO: 3578717 - DNA, 14 bp, Homo sapiens
tcaaaaagccacag

SEQ ID NO: 3578718 - DNA, 18 bp, Homo sapiens
tcaaaaagccacagcaga

SEQ ID NO: 3578719 - DNA, 18 bp, Homo sapiens
tcaaaacaaaacaaaaca

SEQ ID NO: 3578720 - DNA, 16 bp, Homo sapiens
tcaaaacaaaggccta

SEQ ID NO: 3578721 - DNA, 18 bp, Homo sapiens
tcaaaactcacaagtgct

SEQ ID NO: 3578722 - DNA, 22 bp, Homo sapiens
tcaaaaggaacaaaaattacaa

SEQ ID NO: 3578723 - DNA, 13 bp, Homo sapiens
tcaaaataaaaag

SEQ ID NO: 3578724 - DNA, 23 bp, Homo sapiens
tcaaaattgcttctaaaacaata

SEQ ID NO: 3578725 - DNA, 19 bp, Homo sapiens
tcaaacaaactctctgaac

SEQ ID NO: 3578726 - DNA, 21 bp, Homo sapiens
tcaaacagtctcaggaaatca

SEQ ID NO: 3578727 - DNA, 22 bp, Homo sapiens
tcaaacagtctcaggaaatcaa

SEQ ID NO: 3578728 - DNA, 17 bp, Homo sapiens
tcaaacccaagttagtt

SEQ ID NO: 3578729 - DNA, 19 bp, Homo sapiens
tcaaaccccgaccacctgc

SEQ ID NO: 3578730 - DNA, 20 bp, Homo sapiens
tcaaaccccgaccacctgcc

SEQ ID NO: 3578731 - DNA, 16 bp, Homo sapiens
tcaaacttaaacaaaa

SEQ ID NO: 3578732 - DNA, 12 bp, Homo sapiens
tcaaagaaagtg

SEQ ID NO: 3578733 - DNA, 14 bp, Homo sapiens
tcaaagaaagtgta

SEQ ID NO: 3578734 - DNA, 14 bp, Homo sapiens
tcaaagagaattgt

SEQ ID NO: 3578735 - DNA, 18 bp, Homo sapiens
tcaaagcacttaagtgtt

SEQ ID NO: 3578736 - DNA, 20 bp, Homo sapiens
tcaaagctgaatatttttta

SEQ ID NO: 3578737 - DNA, 23 bp, Homo sapiens
tcaaagctgggaagaccctttca

SEQ ID NO: 3578738 - DNA, 17 bp, Homo sapiens
tcaaagtcattaaagac

SEQ ID NO: 3578739 - DNA, 21 bp, Homo sapiens
tcaaagtctgctctcatataa

SEQ ID NO: 3578740 - DNA, 11 bp, Homo sapiens
tcaaagtttta

SEQ ID NO: 3578741 - DNA, 16 bp, Homo sapiens
tcaaataaatttctgg

SEQ ID NO: 3578742 - DNA, 16 bp, Homo sapiens
tcaaatatgcaaagca

SEQ ID NO: 3578743 - DNA, 19 bp, Homo sapiens
tcaaatatgcaaagcactg

SEQ ID NO: 3578744 - DNA, 14 bp, Homo sapiens
tcaaatatttcttg

SEQ ID NO: 3578745 - DNA, 23 bp, Homo sapiens
tcaaatatttcttgctgcttcta

SEQ ID NO: 3578746 - DNA, 12 bp, Homo sapiens
tcaaatccagtg

SEQ ID NO: 3578747 - DNA, 16 bp, Homo sapiens
tcaaatccagtggtgg

SEQ ID NO: 3578748 - DNA, 20 bp, Homo sapiens
tcaaatccagtggtgggtaa

SEQ ID NO: 3578749 - DNA, 19 bp, Homo sapiens
tcaaatgctcagaccagct

SEQ ID NO: 3578750 - DNA, 15 bp, Homo sapiens
tcaaatgtaaagttt

SEQ ID NO: 3578751 - DNA, 19 bp, Homo sapiens
tcaaatgtttaaaccacta

SEQ ID NO: 3578752 - DNA, 12 bp, Homo sapiens
tcaaatgtttta

SEQ ID NO: 3578753 - DNA, 14 bp, Homo sapiens
tcaaattctgtctg

SEQ ID NO: 3578754 - DNA, 17 bp, Homo sapiens
tcaaattctgtctgggg

SEQ ID NO: 3578755 - DNA, 17 bp, Homo sapiens
tcaacaacgtgagagaa

SEQ ID NO: 3578756 - DNA, 21 bp, Homo sapiens
tcaacaacgtgagagaaagag

SEQ ID NO: 3578757 - DNA, 14 bp, Homo sapiens
tcaacacaaactgg

SEQ ID NO: 3578758 - DNA, 12 bp, Homo sapiens
tcaacagccaag

SEQ ID NO: 3578759 - DNA, 15 bp, Homo sapiens
tcaacccccctccca

SEQ ID NO: 3578760 - DNA, 15 bp, Homo sapiens
tcaacctcctgggtt

SEQ ID NO: 3578761 - DNA, 16 bp, Homo sapiens
tcaacctcctgggttc

SEQ ID NO: 3578762 - DNA, 23 bp, Homo sapiens
tcaactaaaaatatatctgttgg

SEQ ID NO: 3578763 - DNA, 20 bp, Homo sapiens
tcaactgccaaaatgctcta

SEQ ID NO: 3578764 - DNA, 12 bp, Homo sapiens
tcaacttaacat

SEQ ID NO: 3578765 - DNA, 13 bp, Homo sapiens
tcaacttaacatg

SEQ ID NO: 3578766 - DNA, 19 bp, Homo sapiens
tcaacttaactatcatctt

SEQ ID NO: 3578767 - DNA, 14 bp, Homo sapiens
tcaacttttaactt

SEQ ID NO: 3578768 - DNA, 13 bp, Homo sapiens
tcaagaaactgag

SEQ ID NO: 3578769 - DNA, 18 bp, Homo sapiens
tcaagaaactgaggaatt

SEQ ID NO: 3578770 - DNA, 22 bp, Homo sapiens
tcaagaaactgaggaattttct

SEQ ID NO: 3578771 - DNA, 16 bp, Homo sapiens
tcaagacgaggggcag

SEQ ID NO: 3578772 - DNA, 12 bp, Homo sapiens
tcaagagaaact

SEQ ID NO: 3578773 - DNA, 16 bp, Homo sapiens
tcaagagaaacttcaa

SEQ ID NO: 3578774 - DNA, 16 bp, Homo sapiens
tcaagagatctttctt

SEQ ID NO: 3578775 - DNA, 21 bp, Homo sapiens
tcaagagatctttctttccaa

SEQ ID NO: 3578776 - DNA, 23 bp, Homo sapiens
tcaagagtgagatgtagaaagtt

SEQ ID NO: 3578777 - DNA, 16 bp, Homo sapiens
tcaagccatgtataaa

SEQ ID NO: 3578778 - DNA, 22 bp, Homo sapiens
tcaagcctagatgttttataca

SEQ ID NO: 3578779 - DNA, 15 bp, Homo sapiens
tcaagcctctaaaca

SEQ ID NO: 3578780 - DNA, 23 bp, Homo sapiens
tcaagctaaatattgtttacatt

SEQ ID NO: 3578781 - DNA, 14 bp, Homo sapiens
tcaagctcctcctc

SEQ ID NO: 3578782 - DNA, 18 bp, Homo sapiens
tcaagctcctcctccctg

SEQ ID NO: 3578783 - DNA, 20 bp, Homo sapiens
tcaagctgttatttcttccc

SEQ ID NO: 3578784 - DNA, 21 bp, Homo sapiens
tcaagctgttatttcttccct

SEQ ID NO: 3578785 - DNA, 22 bp, Homo sapiens
tcaagctgttatttcttccctg

SEQ ID NO: 3578786 - DNA, 22 bp, Homo sapiens
tcaaggatggttttgggactag

SEQ ID NO: 3578787 - DNA, 17 bp, Homo sapiens
tcaagtaaaagaaaagc

SEQ ID NO: 3578788 - DNA, 23 bp, Homo sapiens
tcaagtaataggcattttaagta

SEQ ID NO: 3578789 - DNA, 20 bp, Homo sapiens
tcaagtattaagcagttcat

SEQ ID NO: 3578790 - DNA, 18 bp, Homo sapiens
tcaagtgattctcctgcc

SEQ ID NO: 3578791 - DNA, 16 bp, Homo sapiens
tcaataatccatgaaa

SEQ ID NO: 3578792 - DNA, 18 bp, Homo sapiens
tcaatatttactatttca

SEQ ID NO: 3578793 - DNA, 19 bp, Homo sapiens
tcaatctggattcatattt

SEQ ID NO: 3578794 - DNA, 13 bp, Homo sapiens
tcaatgagagcat

SEQ ID NO: 3578795 - DNA, 15 bp, Homo sapiens
tcaatgcccagtaaa

SEQ ID NO: 3578796 - DNA, 21 bp, Homo sapiens
tcaatgcccagtaaaatttca

SEQ ID NO: 3578797 - DNA, 22 bp, Homo sapiens
tcaatgggttttaattttcagt

SEQ ID NO: 3578798 - DNA, 19 bp, Homo sapiens
tcaatgtacttgtttgaat

SEQ ID NO: 3578799 - DNA, 17 bp, Homo sapiens
tcaattaaacggattat

SEQ ID NO: 3578800 - DNA, 17 bp, Homo sapiens
tcaattggacaattatt

SEQ ID NO: 3578801 - DNA, 23 bp, Homo sapiens
tcaatttttcttatttcatttct

SEQ ID NO: 3578802 - DNA, 15 bp, Homo sapiens
tcacaaagcccaagg

SEQ ID NO: 3578803 - DNA, 20 bp, Homo sapiens
tcacaacccttctctgttgg

SEQ ID NO: 3578804 - DNA, 16 bp, Homo sapiens
tcacaagcctcctgta

SEQ ID NO: 3578805 - DNA, 13 bp, Homo sapiens
tcacaaggcccag

SEQ ID NO: 3578806 - DNA, 20 bp, Homo sapiens
tcacaaggcccaggagacct

SEQ ID NO: 3578807 - DNA, 11 bp, Homo sapiens
tcacacattca

SEQ ID NO: 3578808 - DNA, 14 bp, Homo sapiens
tcacacccctgtcc

SEQ ID NO: 3578809 - DNA, 11 bp, Homo sapiens
tcacagctact

SEQ ID NO: 3578810 - DNA, 14 bp, Homo sapiens
tcacaggctgagaa

SEQ ID NO: 3578811 - DNA, 16 bp, Homo sapiens
tcacaggctgagaact

SEQ ID NO: 3578812 - DNA, 23 bp, Homo sapiens
tcacagggactgaaaacctctcc

SEQ ID NO: 3578813 - DNA, 17 bp, Homo sapiens
tcacagtgctcttttct

SEQ ID NO: 3578814 - DNA, 14 bp, Homo sapiens
tcacatctcaggga

SEQ ID NO: 3578815 - DNA, 22 bp, Homo sapiens
tcacatctcagggaactgaccc

SEQ ID NO: 3578816 - DNA, 21 bp, Homo sapiens
tcacatgagtcaaaacaaagc

SEQ ID NO: 3578817 - DNA, 18 bp, Homo sapiens
tcacatgtcagccactgt

SEQ ID NO: 3578818 - DNA, 15 bp, Homo sapiens
tcacatgtttaactt

SEQ ID NO: 3578819 - DNA, 13 bp, Homo sapiens
tcacatttaaatg

SEQ ID NO: 3578820 - DNA, 18 bp, Homo sapiens
tcaccaagaacagcgggt

SEQ ID NO: 3578821 - DNA, 15 bp, Homo sapiens
tcaccaatcatagtg

SEQ ID NO: 3578822 - DNA, 16 bp, Homo sapiens
tcaccacagccttcta

SEQ ID NO: 3578823 - DNA, 17 bp, Homo sapiens
tcaccactaccagccag

SEQ ID NO: 3578824 - DNA, 19 bp, Homo sapiens
tcaccactaccagccagcc

SEQ ID NO: 3578825 - DNA, 13 bp, Homo sapiens
tcaccagaataaa

SEQ ID NO: 3578826 - DNA, 17 bp, Homo sapiens
tcaccagtgttcctgaa

SEQ ID NO: 3578827 - DNA, 20 bp, Homo sapiens
tcaccagtgttcctgaagct

SEQ ID NO: 3578828 - DNA, 23 bp, Homo sapiens
tcaccagtgttcctgaagctgct

SEQ ID NO: 3578829 - DNA, 15 bp, Homo sapiens
tcaccatgttggcca

SEQ ID NO: 3578830 - DNA, 21 bp, Homo sapiens
tcaccatgttggccaggctgg

SEQ ID NO: 3578831 - DNA, 17 bp, Homo sapiens
tcacccactctgcactg

SEQ ID NO: 3578832 - DNA, 17 bp, Homo sapiens
tcacccatcctaggaac

SEQ ID NO: 3578833 - DNA, 23 bp, Homo sapiens
tcacccatcctaggaaccagcca

SEQ ID NO: 3578834 - DNA, 16 bp, Homo sapiens
tcacccccctctgctg

SEQ ID NO: 3578835 - DNA, 17 bp, Homo sapiens
tcacccccctctgctgc

SEQ ID NO: 3578836 - DNA, 19 bp, Homo sapiens
tcacccctttctgtcccac

SEQ ID NO: 3578837 - DNA, 17 bp, Homo sapiens
tcaccctacctgtgcct

SEQ ID NO: 3578838 - DNA, 13 bp, Homo sapiens
tcaccctgggagc

SEQ ID NO: 3578839 - DNA, 20 bp, Homo sapiens
tcaccgcaggtgctcatgct

SEQ ID NO: 3578840 - DNA, 13 bp, Homo sapiens
tccactgccttcg

SEQ ID NO: 3578841 - DNA, 14 bp, Homo sapiens
tccactggaccctt

SEQ ID NO: 3578842 - DNA, 22 bp, Homo sapiens
tccactggccggagtcagtgcc

SEQ ID NO: 3578843 - DNA, 21 bp, Homo sapiens
tccacttagaaattgcatttc

SEQ ID NO: 3578844 - DNA, 16 bp, Homo sapiens
tccagaagatgccagc

SEQ ID NO: 3578845 - DNA, 19 bp, Homo sapiens
tccagaagatgccagcttc

SEQ ID NO: 3578846 - DNA, 14 bp, Homo sapiens
tccagaaggaagct

SEQ ID NO: 3578847 - DNA, 21 bp, Homo sapiens
tccagaagttttaacttccag

SEQ ID NO: 3578848 - DNA, 17 bp, Homo sapiens
tccagaatgaccttgag

SEQ ID NO: 3578849 - DNA, 18 bp, Homo sapiens
tccagaatggtctttcta

SEQ ID NO: 3578850 - DNA, 18 bp, Homo sapiens
tccagacctgatcctgga

SEQ ID NO: 3578851 - DNA, 14 bp, Homo sapiens
tccagacctggctc

SEQ ID NO: 3578852 - DNA, 12 bp, Homo sapiens
tccagactcagc

SEQ ID NO: 3578853 - DNA, 13 bp, Homo sapiens
tccagactcagca

SEQ ID NO: 3578854 - DNA, 15 bp, Homo sapiens
tccagactcagcaga

SEQ ID NO: 3578855 - DNA, 17 bp, Homo sapiens
tccagactcagcagagt

SEQ ID NO: 3578856 - DNA, 22 bp, Homo sapiens
tccagactgcttccaattttct

SEQ ID NO: 3578857 - DNA, 21 bp, Homo sapiens
tccagagagtggagagagcag

SEQ ID NO: 3578858 - DNA, 16 bp, Homo sapiens
tccagagagtggctcc

SEQ ID NO: 3578859 - DNA, 19 bp, Homo sapiens
tccagagagtggctcctcc

SEQ ID NO: 3578860 - DNA, 20 bp, Homo sapiens
tccagagcaaccagaaggag

SEQ ID NO: 3578861 - DNA, 14 bp, Homo sapiens
tccagaggtcctcc

SEQ ID NO: 3578862 - DNA, 19 bp, Homo sapiens
tccagattcctatgatgga

SEQ ID NO: 3578863 - DNA, 22 bp, Homo sapiens
tccagattttttacagctgcct

SEQ ID NO: 3578864 - DNA, 22 bp, Homo sapiens
tccagcaggcccatgggaggct

SEQ ID NO: 3578865 - DNA, 11 bp, Homo sapiens
tccagccactt

SEQ ID NO: 3578866 - DNA, 18 bp, Homo sapiens
tccagcccaaacctggga

SEQ ID NO: 3578867 - DNA, 19 bp, Homo sapiens
tccagcccaaacctgggaa

SEQ ID NO: 3578868 - DNA, 21 bp, Homo sapiens
tccagcccaaacctgggaagg

SEQ ID NO: 3578869 - DNA, 21 bp, Homo sapiens
tccagcctccctgtctccagc

SEQ ID NO: 3578870 - DNA, 21 bp, Homo sapiens
tccagctaaacaccaacccct

SEQ ID NO: 3578871 - DNA, 13 bp, Homo sapiens
tccagctcagccc

SEQ ID NO: 3578872 - DNA, 15 bp, Homo sapiens
tccagctcagccctg

SEQ ID NO: 3578873 - DNA, 21 bp, Homo sapiens
tccagctcagccctggcctgg

SEQ ID NO: 3578874 - DNA, 13 bp, Homo sapiens
tccagctctgaca

SEQ ID NO: 3578875 - DNA, 20 bp, Homo sapiens
tccagctctgacatcccttc

SEQ ID NO: 3578876 - DNA, 21 bp, Homo sapiens
tccagctctgacatcccttcc

SEQ ID NO: 3578877 - DNA, 23 bp, Homo sapiens
tccagctctgacatcccttcctg

SEQ ID NO: 3578878 - DNA, 16 bp, Homo sapiens
tccagctctttagaat

SEQ ID NO: 3578879 - DNA, 13 bp, Homo sapiens
tccagctgcctgg

SEQ ID NO: 3578880 - DNA, 14 bp, Homo sapiens
tccagctgcctggg

SEQ ID NO: 3578881 - DNA, 21 bp, Homo sapiens
tccaggactgtttcaaacatg

SEQ ID NO: 3578882 - DNA, 17 bp, Homo sapiens
tccaggagagcctgggg

SEQ ID NO: 3578883 - DNA, 14 bp, Homo sapiens
tccaggagggctcg

SEQ ID NO: 3578884 - DNA, 19 bp, Homo sapiens
tccaggatgctaacatcta

SEQ ID NO: 3578885 - DNA, 15 bp, Homo sapiens
tccaggcagatccag

SEQ ID NO: 3578886 - DNA, 20 bp, Homo sapiens
tccaggccccaccggccagg

SEQ ID NO: 3578887 - DNA, 17 bp, Homo sapiens
tccaggcccctccctct

SEQ ID NO: 3578888 - DNA, 11 bp, Homo sapiens
tccaggcctgt

SEQ ID NO: 3578889 - DNA, 11 bp, Homo sapiens
tccaggctgga

SEQ ID NO: 3578890 - DNA, 14 bp, Homo sapiens
tccaggctggaagt

SEQ ID NO: 3578891 - DNA, 21 bp, Homo sapiens
tccaggctggtgttctgtctg

SEQ ID NO: 3578892 - DNA, 22 bp, Homo sapiens
tccagggaccactgggtgagag

SEQ ID NO: 3578893 - DNA, 20 bp, Homo sapiens
tccagggaggggtccctgca

SEQ ID NO: 3578894 - DNA, 17 bp, Homo sapiens
tccagggcagcggctcc

SEQ ID NO: 3578895 - DNA, 14 bp, Homo sapiens
tccagggcccaggt

SEQ ID NO: 3578896 - DNA, 14 bp, Homo sapiens
tccagggcctgaca

SEQ ID NO: 3578897 - DNA, 22 bp, Homo sapiens
tccagggcctgacaccccctcc

SEQ ID NO: 3578898 - DNA, 18 bp, Homo sapiens
tccaggtcagcctggaag

SEQ ID NO: 3578899 - DNA, 17 bp, Homo sapiens
tccaggttccctcccag

SEQ ID NO: 3578900 - DNA, 20 bp, Homo sapiens
tccaggttccctcccagagg

SEQ ID NO: 3578901 - DNA, 23 bp, Homo sapiens
tccaggtttttcaattaaacgga

SEQ ID NO: 3578902 - DNA, 24 bp, Homo sapiens
tccaggtttttcaattaaacggat

SEQ ID NO: 3578903 - DNA, 16 bp, Homo sapiens
tccagtattgaaaact

SEQ ID NO: 3578904 - DNA, 21 bp, Homo sapiens
tccagtattgaaaacttcaaa

SEQ ID NO: 3578905 - DNA, 14 bp, Homo sapiens
tccagtcattatgt

SEQ ID NO: 3578906 - DNA, 21 bp, Homo sapiens
tccagtcattatgttaatatt

SEQ ID NO: 3578907 - DNA, 17 bp, Homo sapiens
tccagtgagcagtgttg

SEQ ID NO: 3578908 - DNA, 19 bp, Homo sapiens
tccagtggctggtttctga

SEQ ID NO: 3578909 - DNA, 20 bp, Homo sapiens
tccagtggctggtttctgag

SEQ ID NO: 3578910 - DNA, 13 bp, Homo sapiens
tccagtggtgggt

SEQ ID NO: 3578911 - DNA, 16 bp, Homo sapiens
tccagtggtgggtaat

SEQ ID NO: 3578912 - DNA, 19 bp, Homo sapiens
tccagtgtgagatactgtg

SEQ ID NO: 3578913 - DNA, 19 bp, Homo sapiens
tccagtttgaagaccaatc

SEQ ID NO: 3578914 - DNA, 23 bp, Homo sapiens
tccagtttgaagaccaatcaaat

SEQ ID NO: 3578915 - DNA, 17 bp, Homo sapiens
tccagtttgtcttggat

SEQ ID NO: 3578916 - DNA, 20 bp, Homo sapiens
tccataaagacaatcactgc

SEQ ID NO: 3578917 - DNA, 14 bp, Homo sapiens
tccatacacacgct

SEQ ID NO: 3578918 - DNA, 16 bp, Homo sapiens
tccatacctgcccctg

SEQ ID NO: 3578919 - DNA, 14 bp, Homo sapiens
tccataccttttct

SEQ ID NO: 3578920 - DNA, 16 bp, Homo sapiens
tccatatttttacaac

SEQ ID NO: 3578921 - DNA, 13 bp, Homo sapiens
tccatcatttctg

SEQ ID NO: 3578922 - DNA, 12 bp, Homo sapiens
tccatcccctcc

SEQ ID NO: 3578923 - DNA, 18 bp, Homo sapiens
tccatcccctccctgcct

SEQ ID NO: 3578924 - DNA, 21 bp, Homo sapiens
tccatcccctccctgcctgct

SEQ ID NO: 3578925 - DNA, 23 bp, Homo sapiens
tccatcccctccctgcctgctcc

SEQ ID NO: 3578926 - DNA, 13 bp, Homo sapiens
aaagtttgctcta

SEQ ID NO: 3578927 - DNA, 19 bp, Homo sapiens
aaagttttattataaattc

SEQ ID NO: 3578928 - DNA, 15 bp, Homo sapiens
aaagttttccagtat

SEQ ID NO: 3578929 - DNA, 14 bp, Homo sapiens
aaagtttttagaat

SEQ ID NO: 3578930 - DNA, 13 bp, Homo sapiens
aaataaaagcaca

SEQ ID NO: 3578931 - DNA, 14 bp, Homo sapiens
aaataaaagcacaa

SEQ ID NO: 3578932 - DNA, 16 bp, Homo sapiens
aaataaaagcacaagt

SEQ ID NO: 3578933 - DNA, 14 bp, Homo sapiens
aaataaacatcagt

SEQ ID NO: 3578934 - DNA, 20 bp, Homo sapiens
aaataaatcttagtgttcaa

SEQ ID NO: 3578935 - DNA, 12 bp, Homo sapiens
aaataaatgaaa

SEQ ID NO: 3578936 - DNA, 21 bp, Homo sapiens
aaataaatgtatcatagaaat

SEQ ID NO: 3578937 - DNA, 16 bp, Homo sapiens
aaataaatttctggga

SEQ ID NO: 3578938 - DNA, 14 bp, Homo sapiens
aaataacaatgtgc

SEQ ID NO: 3578939 - DNA, 18 bp, Homo sapiens
aaataacacagatattgt

SEQ ID NO: 3578940 - DNA, 23 bp, Homo sapiens
aaataacacagatattgttataa

SEQ ID NO: 3578941 - DNA, 14 bp, Homo sapiens
aaataactgaacca

SEQ ID NO: 3578942 - DNA, 15 bp, Homo sapiens
aaataactgaaccaa

SEQ ID NO: 3578943 - DNA, 18 bp, Homo sapiens
aaataactgaaccaaatt

SEQ ID NO: 3578944 - DNA, 21 bp, Homo sapiens
aaataactgaaccaaattgca

SEQ ID NO: 3578945 - DNA, 15 bp, Homo sapiens
aaataataatattta

SEQ ID NO: 3578946 - DNA, 23 bp, Homo sapiens
aaataatctcatccccaaactgt

SEQ ID NO: 3578947 - DNA, 14 bp, Homo sapiens
aaataattgccaca

SEQ ID NO: 3578948 - DNA, 20 bp, Homo sapiens
aaataattttaaacaaaggt

SEQ ID NO: 3578949 - DNA, 15 bp, Homo sapiens
aaatacagactggat

SEQ ID NO: 3578950 - DNA, 17 bp, Homo sapiens
aaatacatttaaaacat

SEQ ID NO: 3578951 - DNA, 23 bp, Homo sapiens
aaataccaaaccttctgactttg

SEQ ID NO: 3578952 - DNA, 15 bp, Homo sapiens
aaataccactagtgg

SEQ ID NO: 3578953 - DNA, 14 bp, Homo sapiens
aaatacctttgtag

SEQ ID NO: 3578954 - DNA, 15 bp, Homo sapiens
aaatagagcttttaa

SEQ ID NO: 3578955 - DNA, 15 bp, Homo sapiens
aaataggatcctgga

SEQ ID NO: 3578956 - DNA, 19 bp, Homo sapiens
aaataggatctccactgga

SEQ ID NO: 3578957 - DNA, 19 bp, Homo sapiens
aaataggtttatattattg

SEQ ID NO: 3578958 - DNA, 23 bp, Homo sapiens
aaatataacaggtgcttctttgt

SEQ ID NO: 3578959 - DNA, 12 bp, Homo sapiens
aaatatatacta

SEQ ID NO: 3578960 - DNA, 19 bp, Homo sapiens
aaatatatctgttggagaa

SEQ ID NO: 3578961 - DNA, 16 bp, Homo sapiens
aaatatatttgtcact

SEQ ID NO: 3578962 - DNA, 19 bp, Homo sapiens
aaatatattttctcttttt

SEQ ID NO: 3578963 - DNA, 12 bp, Homo sapiens
aaatatcaaagt

SEQ ID NO: 3578964 - DNA, 14 bp, Homo sapiens
aaatatcaaagtca

SEQ ID NO: 3578965 - DNA, 21 bp, Homo sapiens
aaatatcaaagtcattaaaga

SEQ ID NO: 3578966 - DNA, 16 bp, Homo sapiens
aaatatgcaaagcact

SEQ ID NO: 3578967 - DNA, 17 bp, Homo sapiens
aaatatgcaaagcactg

SEQ ID NO: 3578968 - DNA, 17 bp, Homo sapiens
aaatatgtataacttta

SEQ ID NO: 3578969 - DNA, 15 bp, Homo sapiens
aaatatgttaaagtt

SEQ ID NO: 3578970 - DNA, 14 bp, Homo sapiens
aaatattaaaattg

SEQ ID NO: 3578971 - DNA, 18 bp, Homo sapiens
aaatattaacatattatt

SEQ ID NO: 3578972 - DNA, 19 bp, Homo sapiens
aaatattcctttgcatatt

SEQ ID NO: 3578973 - DNA, 17 bp, Homo sapiens
aaatatttcatttagct

SEQ ID NO: 3578974 - DNA, 14 bp, Homo sapiens
aaatatttgtacat

SEQ ID NO: 3578975 - DNA, 13 bp, Homo sapiens
aaatattttgcta

SEQ ID NO: 3578976 - DNA, 16 bp, Homo sapiens
aaatattttgctaact

SEQ ID NO: 3578977 - DNA, 20 bp, Homo sapiens
aaatattttgctaactggtt

SEQ ID NO: 3578978 - DNA, 14 bp, Homo sapiens
aaatcaaatatgca

SEQ ID NO: 3578979 - DNA, 22 bp, Homo sapiens
aaatcaaatgtggctgtatcca

SEQ ID NO: 3578980 - DNA, 12 bp, Homo sapiens
aaatcaagtatt

SEQ ID NO: 3578981 - DNA, 14 bp, Homo sapiens
aaatcacacattca

SEQ ID NO: 3578982 - DNA, 19 bp, Homo sapiens
aaatcaccatctttgtcaa

SEQ ID NO: 3578983 - DNA, 15 bp, Homo sapiens
aaatcatatagacca

SEQ ID NO: 3578984 - DNA, 17 bp, Homo sapiens
aaatcatgttgttgtgt

SEQ ID NO: 3578985 - DNA, 21 bp, Homo sapiens
aaatcattcttactaaaaagt

SEQ ID NO: 3578986 - DNA, 12 bp, Homo sapiens
aaatcatttctg

SEQ ID NO: 3578987 - DNA, 22 bp, Homo sapiens
aaatcatttctgcatcagctgc

SEQ ID NO: 3578988 - DNA, 23 bp, Homo sapiens
aaatcatttctgcatcagctgct

SEQ ID NO: 3578989 - DNA, 18 bp, Homo sapiens
aaatccaaaacttctctt

SEQ ID NO: 3578990 - DNA, 17 bp, Homo sapiens
aaatccagaagttttaa

SEQ ID NO: 3578991 - DNA, 16 bp, Homo sapiens
aaatccagtggtgggt

SEQ ID NO: 3578992 - DNA, 15 bp, Homo sapiens
aaatcctgaagagca

SEQ ID NO: 3578993 - DNA, 17 bp, Homo sapiens
aaatctaaaatttcata

SEQ ID NO: 3578994 - DNA, 20 bp, Homo sapiens
aaatctgacccagtgccccc

SEQ ID NO: 3578995 - DNA, 23 bp, Homo sapiens
aaatctgcttcatccaatgtgaa

SEQ ID NO: 3578996 - DNA, 17 bp, Homo sapiens
aaatctgtaacaggtat

SEQ ID NO: 3578997 - DNA, 23 bp, Homo sapiens
aaatctgtaacaggtattttgtt

SEQ ID NO: 3578998 - DNA, 15 bp, Homo sapiens
aaatctgttctaaca

SEQ ID NO: 3578999 - DNA, 17 bp, Homo sapiens
aaatcttgaatttctgc

SEQ ID NO: 3579000 - DNA, 13 bp, Homo sapiens
aaatctttaagaa

SEQ ID NO: 3579001 - DNA, 13 bp, Homo sapiens
aaatctttcaaaa

SEQ ID NO: 3579002 - DNA, 14 bp, Homo sapiens
aaatgaaacaaaaa

SEQ ID NO: 3579003 - DNA, 16 bp, Homo sapiens
aaatgaaacttggcca

SEQ ID NO: 3579004 - DNA, 22 bp, Homo sapiens
aaatgaaacttggccagtttgt

SEQ ID NO: 3579005 - DNA, 12 bp, Homo sapiens
aaatgaaatgca

SEQ ID NO: 3579006 - DNA, 22 bp, Homo sapiens
aaatgaacttgcacttgttata

SEQ ID NO: 3579007 - DNA, 16 bp, Homo sapiens
aaatgacctcaaggaa

SEQ ID NO: 3579008 - DNA, 18 bp, Homo sapiens
aaatgacggtgttaattt

SEQ ID NO: 3579009 - DNA, 21 bp, Homo sapiens
aaatgacggtgttaattttgc

SEQ ID NO: 3579010 - DNA, 22 bp, Homo sapiens
aaatgacggtgttaattttgct

SEQ ID NO: 3579011 - DNA, 13 bp, Homo sapiens
aaatgacttattt

SEQ ID NO: 3579012 - DNA, 22 bp, Homo sapiens
aaatgaggatccagggcagcag

SEQ ID NO: 3579013 - DNA, 14 bp, Homo sapiens
aaatgagtcatttg

SEQ ID NO: 3579014 - DNA, 24 bp, Homo sapiens
aaatgcacttgcctatgatactgt

SEQ ID NO: 3579015 - DNA, 15 bp, Homo sapiens
aaatgcataaatgca

SEQ ID NO: 3579016 - DNA, 19 bp, Homo sapiens
aaatgccctcctaaatgtc

SEQ ID NO: 3579017 - DNA, 17 bp, Homo sapiens
aaatgctcaatttcagc

SEQ ID NO: 3579018 - DNA, 22 bp, Homo sapiens
aaatgctgtctttcttgctccc

SEQ ID NO: 3579019 - DNA, 15 bp, Homo sapiens
aaatgcttttatatt

SEQ ID NO: 3579020 - DNA, 19 bp, Homo sapiens
aaatgcttttatattctaa

SEQ ID NO: 3579021 - DNA, 20 bp, Homo sapiens
aaatgcttttatattctaat

SEQ ID NO: 3579022 - DNA, 12 bp, Homo sapiens
aaatggaaattt

SEQ ID NO: 3579023 - DNA, 20 bp, Homo sapiens
aaatggaggatctctaaaga

SEQ ID NO: 3579024 - DNA, 22 bp, Homo sapiens
aaatggaggatctctaaagagc

SEQ ID NO: 3579025 - DNA, 23 bp, Homo sapiens
aaatggaggatctctaaagagca

SEQ ID NO: 3579026 - DNA, 23 bp, Homo sapiens
aaatggcagagaagatgaaattt

SEQ ID NO: 3579027 - DNA, 11 bp, Homo sapiens
aaatggccatt

SEQ ID NO: 3579028 - DNA, 22 bp, Homo sapiens
aaatggccatttgctttttcac

SEQ ID NO: 3579029 - DNA, 19 bp, Homo sapiens
aaatggccattttaaaatg

SEQ ID NO: 3579030 - DNA, 14 bp, Homo sapiens
aaatggcgaacatg

SEQ ID NO: 3579031 - DNA, 13 bp, Homo sapiens
aaatggggccaga

SEQ ID NO: 3579032 - DNA, 21 bp, Homo sapiens
aaatggggccagatccagcct

SEQ ID NO: 3579033 - DNA, 22 bp, Homo sapiens
aaatggggccagatccagcctg

SEQ ID NO: 3579034 - DNA, 21 bp, Homo sapiens
aaatggttaaattttacatga

SEQ ID NO: 3579035 - DNA, 17 bp, Homo sapiens
aaatggttgatggaaaa

SEQ ID NO: 3579036 - DNA, 15 bp, Homo sapiens
aaatgtaaaaatgaa

SEQ ID NO: 3579037 - DNA, 21 bp, Homo sapiens
aaatgtaaaaatgaaggaatt

SEQ ID NO: 3579038 - DNA, 19 bp, Homo sapiens
aaatgtaaactgtttcttt

SEQ ID NO: 3579039 - DNA, 15 bp, Homo sapiens
aaatgtaatagccaa

SEQ ID NO: 3579040 - DNA, 22 bp, Homo sapiens
aaatgtacatttccaaatgaac

SEQ ID NO: 3579041 - DNA, 11 bp, Homo sapiens
aaatgtatact

SEQ ID NO: 3579042 - DNA, 18 bp, Homo sapiens
aaatgtatgtgtgtctat

SEQ ID NO: 3579043 - DNA, 17 bp, Homo sapiens
aaatgtattcaagcaaa

SEQ ID NO: 3579044 - DNA, 16 bp, Homo sapiens
aaatgtattttacata

SEQ ID NO: 3579045 - DNA, 15 bp, Homo sapiens
aaatgtcactttttg

SEQ ID NO: 3579046 - DNA, 16 bp, Homo sapiens
aaatgtcactttttga

SEQ ID NO: 3579047 - DNA, 22 bp, Homo sapiens
aaatgtcactttttgaggcaaa

SEQ ID NO: 3579048 - DNA, 18 bp, Homo sapiens
aaatgtcttaatttttga

SEQ ID NO: 3579049 - DNA, 18 bp, Homo sapiens
aaatgtgaaatgctttta

SEQ ID NO: 3579050 - DNA, 13 bp, Homo sapiens
aaatgtgactcag

SEQ ID NO: 3579051 - DNA, 15 bp, Homo sapiens
aaatgtgcttttaaa

SEQ ID NO: 3579052 - DNA, 13 bp, Homo sapiens
aaatgttaaaaca

SEQ ID NO: 3579053 - DNA, 20 bp, Homo sapiens
aaatgttacgtgaagaaata

SEQ ID NO: 3579054 - DNA, 23 bp, Homo sapiens
aaatgttagtattttaatcctgt

SEQ ID NO: 3579055 - DNA, 22 bp, Homo sapiens
aaatgttgttctcttctttaaa

SEQ ID NO: 3579056 - DNA, 20 bp, Homo sapiens
aaatgtttatattgttttta

SEQ ID NO: 3579057 - DNA, 17 bp, Homo sapiens
aaattaaacatattcaa

SEQ ID NO: 3579058 - DNA, 14 bp, Homo sapiens
aagagcatctgatt

SEQ ID NO: 3579059 - DNA, 19 bp, Homo sapiens
aagagcatgtaagaaataa

SEQ ID NO: 3579060 - DNA, 14 bp, Homo sapiens
aagagctgagacct

SEQ ID NO: 3579061 - DNA, 14 bp, Homo sapiens
aagagctgcctgga

SEQ ID NO: 3579062 - DNA, 18 bp, Homo sapiens
aagagctgcctggatgag

SEQ ID NO: 3579063 - DNA, 23 bp, Homo sapiens
aagagctgttatgctgtttccta

SEQ ID NO: 3579064 - DNA, 19 bp, Homo sapiens
aagagctgttcacagccag

SEQ ID NO: 3579065 - DNA, 13 bp, Homo sapiens
aagaggaaaagaa

SEQ ID NO: 3579066 - DNA, 16 bp, Homo sapiens
aagaggaaaagaaatc

SEQ ID NO: 3579067 - DNA, 22 bp, Homo sapiens
aagaggacataatggggtcctg

SEQ ID NO: 3579068 - DNA, 15 bp, Homo sapiens
aagaggagaaaaaga

SEQ ID NO: 3579069 - DNA, 22 bp, Homo sapiens
aagaggagaaaaagaagaaaag

SEQ ID NO: 3579070 - DNA, 19 bp, Homo sapiens
aagaggcagggacctaaag

SEQ ID NO: 3579071 - DNA, 16 bp, Homo sapiens
aagagggaatggtcaa

SEQ ID NO: 3579072 - DNA, 21 bp, Homo sapiens
aagaggtatttatctttactt

SEQ ID NO: 3579073 - DNA, 13 bp, Homo sapiens
aagagtcagacat

SEQ ID NO: 3579074 - DNA, 15 bp, Homo sapiens
aagagtcgctgtgcc

SEQ ID NO: 3579075 - DNA, 22 bp, Homo sapiens
aagagtcgctgtgccacaggct

SEQ ID NO: 3579076 - DNA, 23 bp, Homo sapiens
aagagttttagagaaaataaatt

SEQ ID NO: 3579077 - DNA, 24 bp, Homo sapiens
aagataaaaaaactgttaccagat

SEQ ID NO: 3579078 - DNA, 16 bp, Homo sapiens
aagataatttatttca

SEQ ID NO: 3579079 - DNA, 15 bp, Homo sapiens
aagatagcagggcat

SEQ ID NO: 3579080 - DNA, 17 bp, Homo sapiens
aagatccaagcaaaact

SEQ ID NO: 3579081 - DNA, 17 bp, Homo sapiens
aagatcgttctctgcct

SEQ ID NO: 3579082 - DNA, 23 bp, Homo sapiens
aagatctgcagggggtgtgtctg

SEQ ID NO: 3579083 - DNA, 17 bp, Homo sapiens
aagatctgtcctcagcc

SEQ ID NO: 3579084 - DNA, 19 bp, Homo sapiens
aagatctttggcatgattt

SEQ ID NO: 3579085 - DNA, 13 bp, Homo sapiens
aagatgaaaatat

SEQ ID NO: 3579086 - DNA, 21 bp, Homo sapiens
aagatgccagcttctctctcc

SEQ ID NO: 3579087 - DNA, 23 bp, Homo sapiens
aagatgcctgttaatttataatg

SEQ ID NO: 3579088 - DNA, 12 bp, Homo sapiens
aagatgcttggt

SEQ ID NO: 3579089 - DNA, 19 bp, Homo sapiens
aagatggagacaccctctg

SEQ ID NO: 3579090 - DNA, 19 bp, Homo sapiens
aagatgtacatttaataat

SEQ ID NO: 3579091 - DNA, 17 bp, Homo sapiens
aagatgtgcaaaatcac

SEQ ID NO: 3579092 - DNA, 21 bp, Homo sapiens
aagatgtgcagcatttcactt

SEQ ID NO: 3579093 - DNA, 21 bp, Homo sapiens
aagattaggtcgttttccaaa

SEQ ID NO: 3579094 - DNA, 19 bp, Homo sapiens
aagattctatgttaatatt

SEQ ID NO: 3579095 - DNA, 20 bp, Homo sapiens
aagattctctatgtatcaaa

SEQ ID NO: 3579096 - DNA, 22 bp, Homo sapiens
aagattggggacactcatattg

SEQ ID NO: 3579097 - DNA, 19 bp, Homo sapiens
aagattttgaaatttttat

SEQ ID NO: 3579098 - DNA, 20 bp, Homo sapiens
aagattttgttttgttggac

SEQ ID NO: 3579099 - DNA, 18 bp, Homo sapiens
aagatttttgtttgttta

SEQ ID NO: 3579100 - DNA, 13 bp, Homo sapiens
aagcaaacatcaa

SEQ ID NO: 3579101 - DNA, 20 bp, Homo sapiens
aagcaaaggtgcactccaga

SEQ ID NO: 3579102 - DNA, 21 bp, Homo sapiens
aagcaaaggtgcactccagac

SEQ ID NO: 3579103 - DNA, 22 bp, Homo sapiens
aagcaaaggtgcactccagact

SEQ ID NO: 3579104 - DNA, 12 bp, Homo sapiens
aagcaacaatgg

SEQ ID NO: 3579105 - DNA, 16 bp, Homo sapiens
aagcaacaatggatat

SEQ ID NO: 3579106 - DNA, 13 bp, Homo sapiens
aagcaagaaacag

SEQ ID NO: 3579107 - DNA, 15 bp, Homo sapiens
aagcaagaatggagg

SEQ ID NO: 3579108 - DNA, 22 bp, Homo sapiens
aagcaagtcccttcagactggc

SEQ ID NO: 3579109 - DNA, 14 bp, Homo sapiens
aagcaatactgttt

SEQ ID NO: 3579110 - DNA, 18 bp, Homo sapiens
aagcaataggtagctggg

SEQ ID NO: 3579111 - DNA, 17 bp, Homo sapiens
aagcaatgtgttttttc

SEQ ID NO: 3579112 - DNA, 13 bp, Homo sapiens
aagcacaagactg

SEQ ID NO: 3579113 - DNA, 17 bp, Homo sapiens
aagcactgacttctaag

SEQ ID NO: 3579114 - DNA, 20 bp, Homo sapiens
aagcactgacttctaagtaa

SEQ ID NO: 3579115 - DNA, 17 bp, Homo sapiens
aagcagacagccctggc

SEQ ID NO: 3579116 - DNA, 18 bp, Homo sapiens
aagcagagcctcctggga

SEQ ID NO: 3579117 - DNA, 20 bp, Homo sapiens
aagcagaggaggggccgctg

SEQ ID NO: 3579118 - DNA, 22 bp, Homo sapiens
aagcagaggaggggccgctgcc

SEQ ID NO: 3579119 - DNA, 15 bp, Homo sapiens
aagcagcccttgctt

SEQ ID NO: 3579120 - DNA, 16 bp, Homo sapiens
aagcagctaaattttc

SEQ ID NO: 3579121 - DNA, 17 bp, Homo sapiens
aagcagctctcccctca

SEQ ID NO: 3579122 - DNA, 16 bp, Homo sapiens
aagcagttaatttata

SEQ ID NO: 3579123 - DNA, 17 bp, Homo sapiens
aagcagttaatttatat

SEQ ID NO: 3579124 - DNA, 23 bp, Homo sapiens
aagcagttcattctaccaagctg

SEQ ID NO: 3579125 - DNA, 16 bp, Homo sapiens
aagcataggaattgga

SEQ ID NO: 3579126 - DNA, 18 bp, Homo sapiens
aagcatatcccaccaacc

SEQ ID NO: 3579127 - DNA, 22 bp, Homo sapiens
aagcatcatcacgacacatttg

SEQ ID NO: 3579128 - DNA, 13 bp, Homo sapiens
aagcatctggctc

SEQ ID NO: 3579129 - DNA, 17 bp, Homo sapiens
aagcatctggctctaat

SEQ ID NO: 3579130 - DNA, 21 bp, Homo sapiens
aagcatgaacgtggattgtat

SEQ ID NO: 3579131 - DNA, 23 bp, Homo sapiens
aagcatgtggtcttatagtgttt

SEQ ID NO: 3579132 - DNA, 13 bp, Homo sapiens
aagcattgtaaat

SEQ ID NO: 3579133 - DNA, 12 bp, Homo sapiens
aagcatttcatg

SEQ ID NO: 3579134 - DNA, 19 bp, Homo sapiens
aagcatttcatgaaaaagc

SEQ ID NO: 3579135 - DNA, 21 bp, Homo sapiens
aagcatttcatgaaaaagctg

SEQ ID NO: 3579136 - DNA, 17 bp, Homo sapiens
aagcatttccagcctat

SEQ ID NO: 3579137 - DNA, 12 bp, Homo sapiens
aagcattttgta

SEQ ID NO: 3579138 - DNA, 14 bp, Homo sapiens
aagcattttgtaat

SEQ ID NO: 3579139 - DNA, 17 bp, Homo sapiens
aagccaaactcaggccc

SEQ ID NO: 3579140 - DNA, 18 bp, Homo sapiens
aagccaaactcaggccca

SEQ ID NO: 3579141 - DNA, 19 bp, Homo sapiens
aagccaaactcaggcccag

SEQ ID NO: 3579142 - DNA, 21 bp, Homo sapiens
aagccaaactcaggcccagaa

SEQ ID NO: 3579143 - DNA, 14 bp, Homo sapiens
aagccaaagaaaca

SEQ ID NO: 3579144 - DNA, 22 bp, Homo sapiens
aagccaaagaaacaagctgtgc

SEQ ID NO: 3579145 - DNA, 19 bp, Homo sapiens
aagccaaagagcctcccac

SEQ ID NO: 3579146 - DNA, 11 bp, Homo sapiens
aagccacatct

SEQ ID NO: 3579147 - DNA, 12 bp, Homo sapiens
aagccacatctt

SEQ ID NO: 3579148 - DNA, 16 bp, Homo sapiens
aagccacatcttgctc

SEQ ID NO: 3579149 - DNA, 22 bp, Homo sapiens
aagccacatcttgctctgcatt

SEQ ID NO: 3579150 - DNA, 12 bp, Homo sapiens
aagccagccaca

SEQ ID NO: 3579151 - DNA, 14 bp, Homo sapiens
aagccagccacaga

SEQ ID NO: 3579152 - DNA, 20 bp, Homo sapiens
aagccaggaatttcccagga

SEQ ID NO: 3579153 - DNA, 23 bp, Homo sapiens
aagccaggaatttcccaggaccc

SEQ ID NO: 3579154 - DNA, 24 bp, Homo sapiens
aagccaggaatttcccaggaccct

SEQ ID NO: 3579155 - DNA, 13 bp, Homo sapiens
aagccaggctcag

SEQ ID NO: 3579156 - DNA, 15 bp, Homo sapiens
aagccaggctcagga

SEQ ID NO: 3579157 - DNA, 17 bp, Homo sapiens
aagccaggctcaggaga

SEQ ID NO: 3579158 - DNA, 18 bp, Homo sapiens
aagccatgtataaatgtg

SEQ ID NO: 3579159 - DNA, 21 bp, Homo sapiens
aagccatgtggggttgctgaa

SEQ ID NO: 3579160 - DNA, 18 bp, Homo sapiens
aagccccagcttggctca

SEQ ID NO: 3579161 - DNA, 15 bp, Homo sapiens
aagccccatttcctc

SEQ ID NO: 3579162 - DNA, 16 bp, Homo sapiens
aagccccatttcctca

SEQ ID NO: 3579163 - DNA, 14 bp, Homo sapiens
aagcccccagggcc

SEQ ID NO: 3579164 - DNA, 21 bp, Homo sapiens
aagcccccagggcctccaggg

SEQ ID NO: 3579165 - DNA, 15 bp, Homo sapiens
aagcccttccatgtc

SEQ ID NO: 3579166 - DNA, 20 bp, Homo sapiens
aagcccttccatgtcgcctc

SEQ ID NO: 3579167 - DNA, 16 bp, Homo sapiens
aagccctttttatcag

SEQ ID NO: 3579168 - DNA, 15 bp, Homo sapiens
aagccgcagacctgg

SEQ ID NO: 3579169 - DNA, 16 bp, Homo sapiens
aagccgcagacctgga

SEQ ID NO: 3579170 - DNA, 17 bp, Homo sapiens
aagccgcagacctggag

SEQ ID NO: 3579171 - DNA, 19 bp, Homo sapiens
aagccgcagacctggagct

SEQ ID NO: 3579172 - DNA, 22 bp, Homo sapiens
aagccggggtgtaacttcctgc

SEQ ID NO: 3579173 - DNA, 23 bp, Homo sapiens
aagccggggtgtaacttcctgct

SEQ ID NO: 3579174 - DNA, 14 bp, Homo sapiens
aagcctaagaatct

SEQ ID NO: 3579175 - DNA, 16 bp, Homo sapiens
aagcctcaaaacaaag

SEQ ID NO: 3579176 - DNA, 13 bp, Homo sapiens
aagcctccaaggg

SEQ ID NO: 3579177 - DNA, 16 bp, Homo sapiens
aagcctcctgccccct

SEQ ID NO: 3579178 - DNA, 14 bp, Homo sapiens
aagcctcctgtacc

SEQ ID NO: 3579179 - DNA, 14 bp, Homo sapiens
aagcctctctcctt

SEQ ID NO: 3579180 - DNA, 23 bp, Homo sapiens
aagcctctctccttggccacaga

SEQ ID NO: 3579181 - DNA, 22 bp, Homo sapiens
aagcctctggccgtcacacgta

SEQ ID NO: 3579182 - DNA, 24 bp, Homo sapiens
aagcctgaaggggcgtctgttccc

SEQ ID NO: 3579183 - DNA, 14 bp, Homo sapiens
aagccttaaaatgc

SEQ ID NO: 3579184 - DNA, 15 bp, Homo sapiens
aagccttaagcaaat

SEQ ID NO: 3579185 - DNA, 19 bp, Homo sapiens
aagccttataaaccaatct

SEQ ID NO: 3579186 - DNA, 13 bp, Homo sapiens
aagctaatgtcac

SEQ ID NO: 3579187 - DNA, 20 bp, Homo sapiens
aagctaatgtcacaattatg

SEQ ID NO: 3579188 - DNA, 15 bp, Homo sapiens
aagctaggccccaga

SEQ ID NO: 3579189 - DNA, 13 bp, Homo sapiens
aagctcccacccc

SEQ ID NO: 3579190 - DNA, 21 bp, Homo sapiens
aattaatgtcagtatttcaac

SEQ ID NO: 3579191 - DNA, 22 bp, Homo sapiens
aattaatgttccagtttgaaga

SEQ ID NO: 3579192 - DNA, 18 bp, Homo sapiens
aattacaaacaataagaa

SEQ ID NO: 3579193 - DNA, 20 bp, Homo sapiens
aattacaaacaataagaaca

SEQ ID NO: 3579194 - DNA, 14 bp, Homo sapiens
aattacgtgctctg

SEQ ID NO: 3579195 - DNA, 24 bp, Homo sapiens
aattagttttaaaatgatattgtt

SEQ ID NO: 3579196 - DNA, 13 bp, Homo sapiens
aattataactatt

SEQ ID NO: 3579197 - DNA, 21 bp, Homo sapiens
aattataactattacagtgtt

SEQ ID NO: 3579198 - DNA, 22 bp, Homo sapiens
aattataactattacagtgttg

SEQ ID NO: 3579199 - DNA, 16 bp, Homo sapiens
aattatatgatatgca

SEQ ID NO: 3579200 - DNA, 19 bp, Homo sapiens
aattatatgatatgcatgt

SEQ ID NO: 3579201 - DNA, 15 bp, Homo sapiens
aattatctcaagtaa

SEQ ID NO: 3579202 - DNA, 15 bp, Homo sapiens
aattatgaagattta

SEQ ID NO: 3579203 - DNA, 20 bp, Homo sapiens
aattatgtgacattttacat

SEQ ID NO: 3579204 - DNA, 22 bp, Homo sapiens
aattatgtgacattttacatta

SEQ ID NO: 3579205 - DNA, 20 bp, Homo sapiens
aattatgtgtagttataaac

SEQ ID NO: 3579206 - DNA, 23 bp, Homo sapiens
aattatgtgtagttataaaccaa

SEQ ID NO: 3579207 - DNA, 18 bp, Homo sapiens
aattattactttaaatta

SEQ ID NO: 3579208 - DNA, 22 bp, Homo sapiens
aattattactttaaattatatg

SEQ ID NO: 3579209 - DNA, 14 bp, Homo sapiens
aattattggcaaag

SEQ ID NO: 3579210 - DNA, 17 bp, Homo sapiens
aattattggcaaagttt

SEQ ID NO: 3579211 - DNA, 21 bp, Homo sapiens
aattatttgttactgtatcct

SEQ ID NO: 3579212 - DNA, 18 bp, Homo sapiens
aattcaagcctctaaaca

SEQ ID NO: 3579213 - DNA, 20 bp, Homo sapiens
aattcaagcctctaaacaga

SEQ ID NO: 3579214 - DNA, 17 bp, Homo sapiens
aattcaaggaatttctt

SEQ ID NO: 3579215 - DNA, 23 bp, Homo sapiens
aattcaaggaatttcttaacttc

SEQ ID NO: 3579216 - DNA, 20 bp, Homo sapiens
aattcacagtgctcttttct

SEQ ID NO: 3579217 - DNA, 16 bp, Homo sapiens
aattcaccagtgttcc

SEQ ID NO: 3579218 - DNA, 15 bp, Homo sapiens
aattcaccttcccct

SEQ ID NO: 3579219 - DNA, 22 bp, Homo sapiens
aattcagggtggtaaagtatgt

SEQ ID NO: 3579220 - DNA, 20 bp, Homo sapiens
aattcaggtgctagaagcct

SEQ ID NO: 3579221 - DNA, 16 bp, Homo sapiens
aattcagtgccttcaa

SEQ ID NO: 3579222 - DNA, 17 bp, Homo sapiens
aattcatggttcaagta

SEQ ID NO: 3579223 - DNA, 18 bp, Homo sapiens
aattcatggttcaagtat

SEQ ID NO: 3579224 - DNA, 14 bp, Homo sapiens
aattccactgaaaa

SEQ ID NO: 3579225 - DNA, 20 bp, Homo sapiens
aattccactgaaaatttaac

SEQ ID NO: 3579226 - DNA, 21 bp, Homo sapiens
aattcccgttttgtcactttt

SEQ ID NO: 3579227 - DNA, 13 bp, Homo sapiens
aattccctccccc

SEQ ID NO: 3579228 - DNA, 22 bp, Homo sapiens
aattccctggggtcaccttcta

SEQ ID NO: 3579229 - DNA, 17 bp, Homo sapiens
aattcctctttgctttg

SEQ ID NO: 3579230 - DNA, 22 bp, Homo sapiens
aattcctgtaaccttctatttt

SEQ ID NO: 3579231 - DNA, 21 bp, Homo sapiens
aattcctttacaactaaataa

SEQ ID NO: 3579232 - DNA, 16 bp, Homo sapiens
aattctaaattacaaa

SEQ ID NO: 3579233 - DNA, 14 bp, Homo sapiens
aattctaacccaag

SEQ ID NO: 3579234 - DNA, 16 bp, Homo sapiens
aattctactaagttat

SEQ ID NO: 3579235 - DNA, 13 bp, Homo sapiens
aattctatgcctg

SEQ ID NO: 3579236 - DNA, 17 bp, Homo sapiens
aattctcccctccctcc

SEQ ID NO: 3579237 - DNA, 15 bp, Homo sapiens
aattctcttatccaa

SEQ ID NO: 3579238 - DNA, 15 bp, Homo sapiens
aattctgaaacaact

SEQ ID NO: 3579239 - DNA, 17 bp, Homo sapiens
aattcttcacatgttta

SEQ ID NO: 3579240 - DNA, 22 bp, Homo sapiens
aattcttctgcaacatttgaca

SEQ ID NO: 3579241 - DNA, 22 bp, Homo sapiens
aattctttgacctgttgggagt

SEQ ID NO: 3579242 - DNA, 20 bp, Homo sapiens
aattgaagcatgaacgtgga

SEQ ID NO: 3579243 - DNA, 20 bp, Homo sapiens
aattgacctgatttccattt

SEQ ID NO: 3579244 - DNA, 14 bp, Homo sapiens
aattgactgtcact

SEQ ID NO: 3579245 - DNA, 21 bp, Homo sapiens
aattgagcttacaattaggaa

SEQ ID NO: 3579246 - DNA, 16 bp, Homo sapiens
aattgcactgaagttt

SEQ ID NO: 3579247 - DNA, 18 bp, Homo sapiens
aattgcactgaagttttt

SEQ ID NO: 3579248 - DNA, 21 bp, Homo sapiens
aattgcactgaagtttttgaa

SEQ ID NO: 3579249 - DNA, 13 bp, Homo sapiens
aattgcagtttac

SEQ ID NO: 3579250 - DNA, 23 bp, Homo sapiens
aattgcagtttacagtatttcta

SEQ ID NO: 3579251 - DNA, 15 bp, Homo sapiens
aattgccagcaaata

SEQ ID NO: 3579252 - DNA, 17 bp, Homo sapiens
aattgccagcaaataaa

SEQ ID NO: 3579253 - DNA, 19 bp, Homo sapiens
aattgccagcaaataaata

SEQ ID NO: 3579254 - DNA, 13 bp, Homo sapiens
aattgccccatcc

SEQ ID NO: 3579255 - DNA, 12 bp, Homo sapiens
aattgctccttg

SEQ ID NO: 3579256 - DNA, 21 bp, Homo sapiens
aattgcttactgatattatct

SEQ ID NO: 3579257 - DNA, 18 bp, Homo sapiens
aattgcttctaaaacaat

SEQ ID NO: 3579258 - DNA, 16 bp, Homo sapiens
aattggaaggagaggg

SEQ ID NO: 3579259 - DNA, 21 bp, Homo sapiens
aattggagattggcttgtctc

SEQ ID NO: 3579260 - DNA, 14 bp, Homo sapiens
aattggccatgtcg

SEQ ID NO: 3579261 - DNA, 12 bp, Homo sapiens
aattgtgcccct

SEQ ID NO: 3579262 - DNA, 18 bp, Homo sapiens
aatttaaaaacacaaaaa

SEQ ID NO: 3579263 - DNA, 23 bp, Homo sapiens
aatttaaaactgttatttttaca

SEQ ID NO: 3579264 - DNA, 16 bp, Homo sapiens
aatttaaactgtgttt

SEQ ID NO: 3579265 - DNA, 18 bp, Homo sapiens
aatttaatccttctttgt

SEQ ID NO: 3579266 - DNA, 15 bp, Homo sapiens
aatttaatgctgcct

SEQ ID NO: 3579267 - DNA, 17 bp, Homo sapiens
aatttaatgctgccttt

SEQ ID NO: 3579268 - DNA, 18 bp, Homo sapiens
aatttaattacaaacaat

SEQ ID NO: 3579269 - DNA, 19 bp, Homo sapiens
aatttaatttgtaaaactt

SEQ ID NO: 3579270 - DNA, 17 bp, Homo sapiens
aatttacctaagattac

SEQ ID NO: 3579271 - DNA, 18 bp, Homo sapiens
aatttacctaagattaca

SEQ ID NO: 3579272 - DNA, 19 bp, Homo sapiens
aatttactgatgagagaat

SEQ ID NO: 3579273 - DNA, 17 bp, Homo sapiens
aatttagttcatgcatt

SEQ ID NO: 3579274 - DNA, 19 bp, Homo sapiens
aatttataatgtatttgaa

SEQ ID NO: 3579275 - DNA, 20 bp, Homo sapiens
aatttatatcaggtgtataa

SEQ ID NO: 3579276 - DNA, 23 bp, Homo sapiens
aatttatatcaggtgtataaatg

SEQ ID NO: 3579277 - DNA, 19 bp, Homo sapiens
aatttatcctgaaatttca

SEQ ID NO: 3579278 - DNA, 19 bp, Homo sapiens
aatttattaattgctttga

SEQ ID NO: 3579279 - DNA, 19 bp, Homo sapiens
aatttatttcaataaatct

SEQ ID NO: 3579280 - DNA, 13 bp, Homo sapiens
aatttcagactcc

SEQ ID NO: 3579281 - DNA, 19 bp, Homo sapiens
aatttcataattctgaaac

SEQ ID NO: 3579282 - DNA, 20 bp, Homo sapiens
aatttcataattctgaaaca

SEQ ID NO: 3579283 - DNA, 14 bp, Homo sapiens
aatttcccaggacc

SEQ ID NO: 3579284 - DNA, 17 bp, Homo sapiens
aatttcccaggaccctg

SEQ ID NO: 3579285 - DNA, 21 bp, Homo sapiens
aatttcccaggaccctgaagg

SEQ ID NO: 3579286 - DNA, 17 bp, Homo sapiens
aatttcgggagccttgt

SEQ ID NO: 3579287 - DNA, 21 bp, Homo sapiens
aatttctagtacctgtgactc

SEQ ID NO: 3579288 - DNA, 14 bp, Homo sapiens
aatttgaggacaac

SEQ ID NO: 3579289 - DNA, 23 bp, Homo sapiens
aatttgcgcctcggtatctggct

SEQ ID NO: 3579290 - DNA, 16 bp, Homo sapiens
aatttgtaaaacttct

SEQ ID NO: 3579291 - DNA, 19 bp, Homo sapiens
aatttgtaaaacttctgct

SEQ ID NO: 3579292 - DNA, 16 bp, Homo sapiens
aatttgttataatgaa

SEQ ID NO: 3579293 - DNA, 19 bp, Homo sapiens
aatttgttatacttcaaaa

SEQ ID NO: 3579294 - DNA, 14 bp, Homo sapiens
aattttaaacaaag

SEQ ID NO: 3579295 - DNA, 20 bp, Homo sapiens
aattttatccctcacctgta

SEQ ID NO: 3579296 - DNA, 21 bp, Homo sapiens
aattttcacttttggcaatga

SEQ ID NO: 3579297 - DNA, 17 bp, Homo sapiens
aattttcagttctattt

SEQ ID NO: 3579298 - DNA, 20 bp, Homo sapiens
aattttcagttctatttaaa

SEQ ID NO: 3579299 - DNA, 23 bp, Homo sapiens
aattttcctttaatatgaaattt

SEQ ID NO: 3579300 - DNA, 12 bp, Homo sapiens
aattttctttca

SEQ ID NO: 3579301 - DNA, 17 bp, Homo sapiens
aattttgtgtaagaaat

SEQ ID NO: 3579302 - DNA, 13 bp, Homo sapiens
aattttgttgctg

SEQ ID NO: 3579303 - DNA, 18 bp, Homo sapiens
aatttttattaaattatg

SEQ ID NO: 3579304 - DNA, 12 bp, Homo sapiens
aatttttccttt

SEQ ID NO: 3579305 - DNA, 21 bp, Homo sapiens
aatttttcttatttcatttct

SEQ ID NO: 3579306 - DNA, 13 bp, Homo sapiens
aatttttgtagta

SEQ ID NO: 3579307 - DNA, 19 bp, Homo sapiens
aattttttacgtagctatt

SEQ ID NO: 3579308 - DNA, 20 bp, Homo sapiens
aatttttttcacctagattt

SEQ ID NO: 3579309 - DNA, 21 bp, Homo sapiens
aattttttttccgtaaatgtc

SEQ ID NO: 3579310 - DNA, 23 bp, Homo sapiens
aattttttttccgtaaatgtctg

SEQ ID NO: 3579311 - DNA, 19 bp, Homo sapiens
aattttttttggtcaaatt

SEQ ID NO: 3579312 - DNA, 15 bp, Homo sapiens
acaaaaaaaatttta

SEQ ID NO: 3579313 - DNA, 16 bp, Homo sapiens
acaaaaacacagcaag

SEQ ID NO: 3579314 - DNA, 14 bp, Homo sapiens
acaaaaagaaaaga

SEQ ID NO: 3579315 - DNA, 10 bp, Homo sapiens
acaaaacaaa

SEQ ID NO: 3579316 - DNA, 12 bp, Homo sapiens
acaaaacaaaac

SEQ ID NO: 3579317 - DNA, 13 bp, Homo sapiens
acaaaacaaaaca

SEQ ID NO: 3579318 - DNA, 15 bp, Homo sapiens
acaaaacctattttt

SEQ ID NO: 3579319 - DNA, 20 bp, Homo sapiens
acaaaacttaaaagtattca

SEQ ID NO: 3579320 - DNA, 23 bp, Homo sapiens
acaaaacttaaaagtattcatac

SEQ ID NO: 3579321 - DNA, 14 bp, Homo sapiens
accaaatatgttaa

SEQ ID NO: 3579322 - DNA, 13 bp, Homo sapiens
accaaatctgaca

SEQ ID NO: 3579323 - DNA, 17 bp, Homo sapiens
accaaatgtagttttgt

SEQ ID NO: 3579324 - DNA, 12 bp, Homo sapiens
accaacctccag

SEQ ID NO: 3579325 - DNA, 14 bp, Homo sapiens
accaacctccagac

SEQ ID NO: 3579326 - DNA, 20 bp, Homo sapiens
accaactgccctaagccccc

SEQ ID NO: 3579327 - DNA, 15 bp, Homo sapiens
accaagccgtggctt

SEQ ID NO: 3579328 - DNA, 16 bp, Homo sapiens
accaagccgtggcttc

SEQ ID NO: 3579329 - DNA, 18 bp, Homo sapiens
accaagccgtggcttccc

SEQ ID NO: 3579330 - DNA, 19 bp, Homo sapiens
accaagctgtcacaggttt

SEQ ID NO: 3579331 - DNA, 15 bp, Homo sapiens
accaataaaagtggt

SEQ ID NO: 3579332 - DNA, 14 bp, Homo sapiens
accaatcaaatata

SEQ ID NO: 3579333 - DNA, 17 bp, Homo sapiens
accaattgtcaaattac

SEQ ID NO: 3579334 - DNA, 21 bp, Homo sapiens
accacacttgttttctttgtt

SEQ ID NO: 3579335 - DNA, 14 bp, Homo sapiens
accacagcaactga

SEQ ID NO: 3579336 - DNA, 17 bp, Homo sapiens
accacagccggtcagag

SEQ ID NO: 3579337 - DNA, 19 bp, Homo sapiens
accacagccggtcagagga

SEQ ID NO: 3579338 - DNA, 20 bp, Homo sapiens
accacatctaagcctgaagg

SEQ ID NO: 3579339 - DNA, 19 bp, Homo sapiens
accaccaactactacctgt

SEQ ID NO: 3579340 - DNA, 15 bp, Homo sapiens
accacctaatgttta

SEQ ID NO: 3579341 - DNA, 15 bp, Homo sapiens
accacctctgtgggc

SEQ ID NO: 3579342 - DNA, 15 bp, Homo sapiens
accacctttggctgg

SEQ ID NO: 3579343 - DNA, 17 bp, Homo sapiens
accacgccccaggacct

SEQ ID NO: 3579344 - DNA, 16 bp, Homo sapiens
accactaccagccagc

SEQ ID NO: 3579345 - DNA, 22 bp, Homo sapiens
accactaccagccagcctcaga

SEQ ID NO: 3579346 - DNA, 13 bp, Homo sapiens
accactcaggcca

SEQ ID NO: 3579347 - DNA, 15 bp, Homo sapiens
accacttcctgaggc

SEQ ID NO: 3579348 - DNA, 13 bp, Homo sapiens
accagaaaagcaa

SEQ ID NO: 3579349 - DNA, 17 bp, Homo sapiens
accagaaaagcccaagt

SEQ ID NO: 3579350 - DNA, 18 bp, Homo sapiens
accagaacgcaccccact

SEQ ID NO: 3579351 - DNA, 17 bp, Homo sapiens
accagaactttttcctc

SEQ ID NO: 3579352 - DNA, 14 bp, Homo sapiens
accagacacccagg

SEQ ID NO: 3579353 - DNA, 15 bp, Homo sapiens
accagacacccagga

SEQ ID NO: 3579354 - DNA, 15 bp, Homo sapiens
accagcattcctttt

SEQ ID NO: 3579355 - DNA, 18 bp, Homo sapiens
accagccccccgcgcgcc

SEQ ID NO: 3579356 - DNA, 19 bp, Homo sapiens
accagcccgacagtgccat

SEQ ID NO: 3579357 - DNA, 21 bp, Homo sapiens
accagcccgacagtgccatcc

SEQ ID NO: 3579358 - DNA, 16 bp, Homo sapiens
accagccgtattttac

SEQ ID NO: 3579359 - DNA, 14 bp, Homo sapiens
accagcctagcctg

SEQ ID NO: 3579360 - DNA, 19 bp, Homo sapiens
accagcgaactctcagaaa

SEQ ID NO: 3579361 - DNA, 23 bp, Homo sapiens
accagctcaggacagatgccaca

SEQ ID NO: 3579362 - DNA, 16 bp, Homo sapiens
accagcttaaaacact

SEQ ID NO: 3579363 - DNA, 20 bp, Homo sapiens
accagcttaaaacacttctt

SEQ ID NO: 3579364 - DNA, 20 bp, Homo sapiens
accagcttagccaacatagt

SEQ ID NO: 3579365 - DNA, 18 bp, Homo sapiens
accaggatttattttgag

SEQ ID NO: 3579366 - DNA, 18 bp, Homo sapiens
accagggatgctgggctg

SEQ ID NO: 3579367 - DNA, 22 bp, Homo sapiens
accagggatgctgggctgggcc

SEQ ID NO: 3579368 - DNA, 23 bp, Homo sapiens
accagggatgctgggctgggccc

SEQ ID NO: 3579369 - DNA, 16 bp, Homo sapiens
accaggggaggagcct

SEQ ID NO: 3579370 - DNA, 21 bp, Homo sapiens
accagggtccttttgacactg

SEQ ID NO: 3579371 - DNA, 16 bp, Homo sapiens
accagggtctctcagg

SEQ ID NO: 3579372 - DNA, 18 bp, Homo sapiens
accagggtctctcaggga

SEQ ID NO: 3579373 - DNA, 19 bp, Homo sapiens
accagggttggcaccttcc

SEQ ID NO: 3579374 - DNA, 21 bp, Homo sapiens
accagggttggcaccttcccc

SEQ ID NO: 3579375 - DNA, 18 bp, Homo sapiens
accagtatttaacttctg

SEQ ID NO: 3579376 - DNA, 14 bp, Homo sapiens
accagtatttagaa

SEQ ID NO: 3579377 - DNA, 17 bp, Homo sapiens
accagtccccccaccct

SEQ ID NO: 3579378 - DNA, 13 bp, Homo sapiens
accagtctcctca

SEQ ID NO: 3579379 - DNA, 14 bp, Homo sapiens
accagtctgaccct

SEQ ID NO: 3579380 - DNA, 12 bp, Homo sapiens
accagtgcctta

SEQ ID NO: 3579381 - DNA, 21 bp, Homo sapiens
accagtggcgttgttgcatgt

SEQ ID NO: 3579382 - DNA, 22 bp, Homo sapiens
accagtggcgttgttgcatgtt

SEQ ID NO: 3579383 - DNA, 23 bp, Homo sapiens
accagtggcgttgttgcatgttt

SEQ ID NO: 3579384 - DNA, 20 bp, Homo sapiens
accagtgttcctgaagctgc

SEQ ID NO: 3579385 - DNA, 23 bp, Homo sapiens
accagtgttcctgaagctgctgt

SEQ ID NO: 3579386 - DNA, 14 bp, Homo sapiens
accagttaattttt

SEQ ID NO: 3579387 - DNA, 16 bp, Homo sapiens
accagttaatttttcc

SEQ ID NO: 3579388 - DNA, 16 bp, Homo sapiens
accagttctcatgggt

SEQ ID NO: 3579389 - DNA, 21 bp, Homo sapiens
accagttctcatgggtggcac

SEQ ID NO: 3579390 - DNA, 15 bp, Homo sapiens
accagttgtatttaa

SEQ ID NO: 3579391 - DNA, 16 bp, Homo sapiens
accataaaataaataa

SEQ ID NO: 3579392 - DNA, 12 bp, Homo sapiens
accatactgaaa

SEQ ID NO: 3579393 - DNA, 14 bp, Homo sapiens
accatattacctgg

SEQ ID NO: 3579394 - DNA, 13 bp, Homo sapiens
accatcagcctgt

SEQ ID NO: 3579395 - DNA, 14 bp, Homo sapiens
accatctctttacc

SEQ ID NO: 3579396 - DNA, 23 bp, Homo sapiens
accatctgtttgaagattatatg

SEQ ID NO: 3579397 - DNA, 12 bp, Homo sapiens
accatgcactca

SEQ ID NO: 3579398 - DNA, 18 bp, Homo sapiens
accatgcaggaaggaaaa

SEQ ID NO: 3579399 - DNA, 22 bp, Homo sapiens
accatgcccagctaattttgta

SEQ ID NO: 3579400 - DNA, 22 bp, Homo sapiens
accatgcgtcaggggcctagag

SEQ ID NO: 3579401 - DNA, 18 bp, Homo sapiens
accatgcttgcctgaagc

SEQ ID NO: 3579402 - DNA, 12 bp, Homo sapiens
accattccccat

SEQ ID NO: 3579403 - DNA, 21 bp, Homo sapiens
accattcctgcctttaagcca

SEQ ID NO: 3579404 - DNA, 21 bp, Homo sapiens
accattctattctccagacat

SEQ ID NO: 3579405 - DNA, 20 bp, Homo sapiens
accatttcagagaggccttt

SEQ ID NO: 3579406 - DNA, 16 bp, Homo sapiens
acccaaaaggaagagc

SEQ ID NO: 3579407 - DNA, 14 bp, Homo sapiens
acccaaaccccctg

SEQ ID NO: 3579408 - DNA, 17 bp, Homo sapiens
acccaaaccccctgcag

SEQ ID NO: 3579409 - DNA, 19 bp, Homo sapiens
acccaaaccccctgcagcc

SEQ ID NO: 3579410 - DNA, 17 bp, Homo sapiens
acccaaagcggtccctg

SEQ ID NO: 3579411 - DNA, 15 bp, Homo sapiens
acccaaccctgccct

SEQ ID NO: 3579412 - DNA, 16 bp, Homo sapiens
acccaagacatgacat

SEQ ID NO: 3579413 - DNA, 16 bp, Homo sapiens
acccaagtccctgtca

SEQ ID NO: 3579414 - DNA, 17 bp, Homo sapiens
acccacaaactccaggc

SEQ ID NO: 3579415 - DNA, 19 bp, Homo sapiens
acccacacagctgccctag

SEQ ID NO: 3579416 - DNA, 20 bp, Homo sapiens
acccacacagctgccctagc

SEQ ID NO: 3579417 - DNA, 12 bp, Homo sapiens
acccacagaact

SEQ ID NO: 3579418 - DNA, 14 bp, Homo sapiens
acccacagaacttg

SEQ ID NO: 3579419 - DNA, 21 bp, Homo sapiens
acccacataaaagccccagct

SEQ ID NO: 3579420 - DNA, 15 bp, Homo sapiens
acccacctccctgcc

SEQ ID NO: 3579421 - DNA, 18 bp, Homo sapiens
acccacctccctgcctcc

SEQ ID NO: 3579422 - DNA, 16 bp, Homo sapiens
acccacctctcctgcc

SEQ ID NO: 3579423 - DNA, 18 bp, Homo sapiens
acccagaatggagcctgc

SEQ ID NO: 3579424 - DNA, 21 bp, Homo sapiens
acccagaatggagcctgctct

SEQ ID NO: 3579425 - DNA, 23 bp, Homo sapiens
acccagaatggagcctgctctcc

SEQ ID NO: 3579426 - DNA, 11 bp, Homo sapiens
acccagactgt

SEQ ID NO: 3579427 - DNA, 17 bp, Homo sapiens
acccagagatgcctgat

SEQ ID NO: 3579428 - DNA, 23 bp, Homo sapiens
acccagagatgcctgatttcatt

SEQ ID NO: 3579429 - DNA, 21 bp, Homo sapiens
acccagagggttgctggtcct

SEQ ID NO: 3579430 - DNA, 22 bp, Homo sapiens
acccagcatctcccagcaagac

SEQ ID NO: 3579431 - DNA, 22 bp, Homo sapiens
acccagctatggttctctcgca

SEQ ID NO: 3579432 - DNA, 13 bp, Homo sapiens
acccaggaaggga

SEQ ID NO: 3579433 - DNA, 21 bp, Homo sapiens
acccaggaagggaaagcgggc

SEQ ID NO: 3579434 - DNA, 16 bp, Homo sapiens
acccagtcccacactg

SEQ ID NO: 3579435 - DNA, 13 bp, Homo sapiens
acccagtctttct

SEQ ID NO: 3579436 - DNA, 14 bp, Homo sapiens
acccagtctttctt

SEQ ID NO: 3579437 - DNA, 14 bp, Homo sapiens
acccagtgctgaat

SEQ ID NO: 3579438 - DNA, 17 bp, Homo sapiens
acccatccctgcctgga

SEQ ID NO: 3579439 - DNA, 20 bp, Homo sapiens
acccatccctgcctggaggc

SEQ ID NO: 3579440 - DNA, 21 bp, Homo sapiens
acccatccctgcctggaggct

SEQ ID NO: 3579441 - DNA, 14 bp, Homo sapiens
acccatcctaggaa

SEQ ID NO: 3579442 - DNA, 15 bp, Homo sapiens
acccatcctaggaac

SEQ ID NO: 3579443 - DNA, 22 bp, Homo sapiens
acccatcctaggaaccagccaa

SEQ ID NO: 3579444 - DNA, 16 bp, Homo sapiens
accccaaaccccagcc

SEQ ID NO: 3579445 - DNA, 17 bp, Homo sapiens
accccaaaccccagccc

SEQ ID NO: 3579446 - DNA, 20 bp, Homo sapiens
accccaaagactctggaggt

SEQ ID NO: 3579447 - DNA, 20 bp, Homo sapiens
accccaaaggaacactgaca

SEQ ID NO: 3579448 - DNA, 17 bp, Homo sapiens
accccaagggggctgct

SEQ ID NO: 3579449 - DNA, 14 bp, Homo sapiens
accccaatcccagc

SEQ ID NO: 3579450 - DNA, 14 bp, Homo sapiens
accccacagaacct

SEQ ID NO: 3579451 - DNA, 17 bp, Homo sapiens
accccacctcacagcta

SEQ ID NO: 3579452 - DNA, 15 bp, Homo sapiens
accccactcccctca

SEQ ID NO: 3579453 - DNA, 16 bp, Homo sapiens
acccccagctttgcta

SEQ ID NO: 3579454 - DNA, 15 bp, Homo sapiens
actccaggctggaag

SEQ ID NO: 3579455 - DNA, 20 bp, Homo sapiens
actccagggtgacaaggcct

SEQ ID NO: 3579456 - DNA, 16 bp, Homo sapiens
actccatctcaaaaca

SEQ ID NO: 3579457 - DNA, 14 bp, Homo sapiens
actccatctcttct

SEQ ID NO: 3579458 - DNA, 15 bp, Homo sapiens
actccatctcttctg

SEQ ID NO: 3579459 - DNA, 18 bp, Homo sapiens
actccatctcttctgcaa

SEQ ID NO: 3579460 - DNA, 14 bp, Homo sapiens
actcccaccacagg

SEQ ID NO: 3579461 - DNA, 20 bp, Homo sapiens
actccccaacccctctccag

SEQ ID NO: 3579462 - DNA, 23 bp, Homo sapiens
actccccaacccctctccaggcc

SEQ ID NO: 3579463 - DNA, 17 bp, Homo sapiens
actccccagagctgtgc

SEQ ID NO: 3579464 - DNA, 21 bp, Homo sapiens
actccccagccagcctggctg

SEQ ID NO: 3579465 - DNA, 16 bp, Homo sapiens
actccccagcccagca

SEQ ID NO: 3579466 - DNA, 21 bp, Homo sapiens
actccccagcccagcacccct

SEQ ID NO: 3579467 - DNA, 17 bp, Homo sapiens
actccccagccccagcc

SEQ ID NO: 3579468 - DNA, 18 bp, Homo sapiens
actcccccaccactcagg

SEQ ID NO: 3579469 - DNA, 21 bp, Homo sapiens
actcccccaccactcaggcca

SEQ ID NO: 3579470 - DNA, 14 bp, Homo sapiens
actccctacactga

SEQ ID NO: 3579471 - DNA, 19 bp, Homo sapiens
actccctacactgatgcaa

SEQ ID NO: 3579472 - DNA, 16 bp, Homo sapiens
actcctataaagtgcc

SEQ ID NO: 3579473 - DNA, 17 bp, Homo sapiens
actcctataaagtgcct

SEQ ID NO: 3579474 - DNA, 14 bp, Homo sapiens
actcctcagcaccc

SEQ ID NO: 3579475 - DNA, 18 bp, Homo sapiens
actcctccattactctat

SEQ ID NO: 3579476 - DNA, 14 bp, Homo sapiens
actcctctgtccag

SEQ ID NO: 3579477 - DNA, 14 bp, Homo sapiens
actcctgcctcatg

SEQ ID NO: 3579478 - DNA, 18 bp, Homo sapiens
actcctgctggtacctgc

SEQ ID NO: 3579479 - DNA, 21 bp, Homo sapiens
actcctgctggtacctgccct

SEQ ID NO: 3579480 - DNA, 12 bp, Homo sapiens
actcctggcagg

SEQ ID NO: 3579481 - DNA, 22 bp, Homo sapiens
actcctggcagggccacctgca

SEQ ID NO: 3579482 - DNA, 23 bp, Homo sapiens
actcctggcagggccacctgcag

SEQ ID NO: 3579483 - DNA, 16 bp, Homo sapiens
actcctgtcttctttc

SEQ ID NO: 3579484 - DNA, 17 bp, Homo sapiens
actccttcatgtttgga

SEQ ID NO: 3579485 - DNA, 18 bp, Homo sapiens
actccttcatgtttggaa

SEQ ID NO: 3579486 - DNA, 17 bp, Homo sapiens
actcctttatctgtaat

SEQ ID NO: 3579487 - DNA, 13 bp, Homo sapiens
actcgacccagaa

SEQ ID NO: 3579488 - DNA, 17 bp, Homo sapiens
actcggaatctattttc

SEQ ID NO: 3579489 - DNA, 14 bp, Homo sapiens
actcggtgtcccca

SEQ ID NO: 3579490 - DNA, 14 bp, Homo sapiens
actcgtatatgtct

SEQ ID NO: 3579491 - DNA, 22 bp, Homo sapiens
actcgtgcattaaaatttctta

SEQ ID NO: 3579492 - DNA, 22 bp, Homo sapiens
actcgttcacctccaagcattt

SEQ ID NO: 3579493 - DNA, 19 bp, Homo sapiens
actctaaagccaagcactt

SEQ ID NO: 3579494 - DNA, 16 bp, Homo sapiens
actctaactctgagag

SEQ ID NO: 3579495 - DNA, 16 bp, Homo sapiens
actctagagggcgagg

SEQ ID NO: 3579496 - DNA, 15 bp, Homo sapiens
actctattgatacaa

SEQ ID NO: 3579497 - DNA, 21 bp, Homo sapiens
actctcaccatgatgtgaaga

SEQ ID NO: 3579498 - DNA, 15 bp, Homo sapiens
actctcagaaataaa

SEQ ID NO: 3579499 - DNA, 21 bp, Homo sapiens
actctcccattatatttattg

SEQ ID NO: 3579500 - DNA, 15 bp, Homo sapiens
actctccccgctcag

SEQ ID NO: 3579501 - DNA, 22 bp, Homo sapiens
actctccccgctcaggggcctg

SEQ ID NO: 3579502 - DNA, 23 bp, Homo sapiens
actctcctgcctcagcctcccca

SEQ ID NO: 3579503 - DNA, 18 bp, Homo sapiens
actctctgaacccctccc

SEQ ID NO: 3579504 - DNA, 19 bp, Homo sapiens
actctcttcctccacttca

SEQ ID NO: 3579505 - DNA, 9 bp, Homo sapiens
actctgctg

SEQ ID NO: 3579506 - DNA, 22 bp, Homo sapiens
actctggaggtcatctggcgga

SEQ ID NO: 3579507 - DNA, 23 bp, Homo sapiens
actctggcttcaaaaagccacag

SEQ ID NO: 3579508 - DNA, 14 bp, Homo sapiens
actctgggcctggg

SEQ ID NO: 3579509 - DNA, 22 bp, Homo sapiens
actctgtccctgtccttccctg

SEQ ID NO: 3579510 - DNA, 11 bp, Homo sapiens
actctgtgaaa

SEQ ID NO: 3579511 - DNA, 13 bp, Homo sapiens
actcttaagagaa

SEQ ID NO: 3579512 - DNA, 14 bp, Homo sapiens
actcttactcctta

SEQ ID NO: 3579513 - DNA, 20 bp, Homo sapiens
actcttcagtgactcctgct

SEQ ID NO: 3579514 - DNA, 21 bp, Homo sapiens
actcttcagtgactcctgctg

SEQ ID NO: 3579515 - DNA, 19 bp, Homo sapiens
actcttgatctctcttgtc

SEQ ID NO: 3579516 - DNA, 21 bp, Homo sapiens
actcttgatctctcttgtcct

SEQ ID NO: 3579517 - DNA, 16 bp, Homo sapiens
actctttgaaagcttt

SEQ ID NO: 3579518 - DNA, 21 bp, Homo sapiens
actcttttgatggtggccctg

SEQ ID NO: 3579519 - DNA, 15 bp, Homo sapiens
actgaaaacctctcc

SEQ ID NO: 3579520 - DNA, 15 bp, Homo sapiens
actgaaatccttgag

SEQ ID NO: 3579521 - DNA, 16 bp, Homo sapiens
actgaaatccttgaga

SEQ ID NO: 3579522 - DNA, 10 bp, Homo sapiens
actgaacagg

SEQ ID NO: 3579523 - DNA, 12 bp, Homo sapiens
actgaaccaaat

SEQ ID NO: 3579524 - DNA, 19 bp, Homo sapiens
actgaaccaaattgcactg

SEQ ID NO: 3579525 - DNA, 20 bp, Homo sapiens
actgaaccaaattgcactga

SEQ ID NO: 3579526 - DNA, 15 bp, Homo sapiens
actgaaccacattca

SEQ ID NO: 3579527 - DNA, 15 bp, Homo sapiens
actgaagatggcttt

SEQ ID NO: 3579528 - DNA, 15 bp, Homo sapiens
actgaagtttttgaa

SEQ ID NO: 3579529 - DNA, 16 bp, Homo sapiens
actgaagtttttgaaa

SEQ ID NO: 3579530 - DNA, 15 bp, Homo sapiens
actgaatgctgttaa

SEQ ID NO: 3579531 - DNA, 14 bp, Homo sapiens
actgacagatgctt

SEQ ID NO: 3579532 - DNA, 15 bp, Homo sapiens
actgaccagcctcca

SEQ ID NO: 3579533 - DNA, 23 bp, Homo sapiens
actgaccagcctccatgctgcct

SEQ ID NO: 3579534 - DNA, 21 bp, Homo sapiens
actgaccctcaggcacacctt

SEQ ID NO: 3579535 - DNA, 22 bp, Homo sapiens
actgactgaatgctgttaatat

SEQ ID NO: 3579536 - DNA, 13 bp, Homo sapiens
actgacttctaag

SEQ ID NO: 3579537 - DNA, 15 bp, Homo sapiens
actgacttctaagta

SEQ ID NO: 3579538 - DNA, 16 bp, Homo sapiens
actgacttctaagtaa

SEQ ID NO: 3579539 - DNA, 22 bp, Homo sapiens
actgacttctaagtaaaaccac

SEQ ID NO: 3579540 - DNA, 12 bp, Homo sapiens
actgagaaagag

SEQ ID NO: 3579541 - DNA, 19 bp, Homo sapiens
actgagaaagaggcaggga

SEQ ID NO: 3579542 - DNA, 23 bp, Homo sapiens
actgagagggcaatctttgcctt

SEQ ID NO: 3579543 - DNA, 17 bp, Homo sapiens
actgagatgtgaacaca

SEQ ID NO: 3579544 - DNA, 13 bp, Homo sapiens
actgagcactgaa

SEQ ID NO: 3579545 - DNA, 18 bp, Homo sapiens
actgagcagccgccagct

SEQ ID NO: 3579546 - DNA, 20 bp, Homo sapiens
actgaggaattttctttgtg

SEQ ID NO: 3579547 - DNA, 18 bp, Homo sapiens
actgaggagatgaccagg

SEQ ID NO: 3579548 - DNA, 23 bp, Homo sapiens
actgaggatattcagatgtatgt

SEQ ID NO: 3579549 - DNA, 12 bp, Homo sapiens
actgaggatttc

SEQ ID NO: 3579550 - DNA, 14 bp, Homo sapiens
actgaggcccagag

SEQ ID NO: 3579551 - DNA, 17 bp, Homo sapiens
actgaggcccagagagg

SEQ ID NO: 3579552 - DNA, 19 bp, Homo sapiens
actgaggcccagagaggga

SEQ ID NO: 3579553 - DNA, 21 bp, Homo sapiens
actgaggcccagagagggaag

SEQ ID NO: 3579554 - DNA, 22 bp, Homo sapiens
actgatatatcatgagtgaata

SEQ ID NO: 3579555 - DNA, 16 bp, Homo sapiens
actgatgagagaatgt

SEQ ID NO: 3579556 - DNA, 17 bp, Homo sapiens
actgatgattttccttt

SEQ ID NO: 3579557 - DNA, 13 bp, Homo sapiens
actgatgcaagga

SEQ ID NO: 3579558 - DNA, 16 bp, Homo sapiens
actgatgcaaggatta

SEQ ID NO: 3579559 - DNA, 17 bp, Homo sapiens
actgatgcaaggattac

SEQ ID NO: 3579560 - DNA, 22 bp, Homo sapiens
actgatgcaaggattacagaaa

SEQ ID NO: 3579561 - DNA, 19 bp, Homo sapiens
actgatgctgcccctcatc

SEQ ID NO: 3579562 - DNA, 20 bp, Homo sapiens
actgatgctgcccctcatct

SEQ ID NO: 3579563 - DNA, 16 bp, Homo sapiens
actgattaaaaatacc

SEQ ID NO: 3579564 - DNA, 16 bp, Homo sapiens
actgcaaaaaaagcct

SEQ ID NO: 3579565 - DNA, 19 bp, Homo sapiens
actgcaaaaaaagcctcca

SEQ ID NO: 3579566 - DNA, 20 bp, Homo sapiens
actgcaaaaaaagcctccaa

SEQ ID NO: 3579567 - DNA, 15 bp, Homo sapiens
actgcaaacacacct

SEQ ID NO: 3579568 - DNA, 17 bp, Homo sapiens
actgcaaacacaccttg

SEQ ID NO: 3579569 - DNA, 20 bp, Homo sapiens
actgcaaacacaccttggag

SEQ ID NO: 3579570 - DNA, 14 bp, Homo sapiens
actgcaaattttaa

SEQ ID NO: 3579571 - DNA, 16 bp, Homo sapiens
actgcaaattttaact

SEQ ID NO: 3579572 - DNA, 18 bp, Homo sapiens
actgcacagtgcatctca

SEQ ID NO: 3579573 - DNA, 23 bp, Homo sapiens
actgcacagtgcatctcagccca

SEQ ID NO: 3579574 - DNA, 12 bp, Homo sapiens
actgcacatcta

SEQ ID NO: 3579575 - DNA, 9 bp, Homo sapiens
actgcactc

SEQ ID NO: 3579576 - DNA, 13 bp, Homo sapiens
actgcactcagat

SEQ ID NO: 3579577 - DNA, 17 bp, Homo sapiens
actgcagcctctctggc

SEQ ID NO: 3579578 - DNA, 18 bp, Homo sapiens
actgcagcctctctggct

SEQ ID NO: 3579579 - DNA, 17 bp, Homo sapiens
actgcagggactgccag

SEQ ID NO: 3579580 - DNA, 18 bp, Homo sapiens
actgcagggactgccagt

SEQ ID NO: 3579581 - DNA, 23 bp, Homo sapiens
actgcagtctttatttttttccc

SEQ ID NO: 3579582 - DNA, 16 bp, Homo sapiens
actgcataccaacctg

SEQ ID NO: 3579583 - DNA, 16 bp, Homo sapiens
actgcatatgaaagga

SEQ ID NO: 3579584 - DNA, 14 bp, Homo sapiens
actgcatccagcct

SEQ ID NO: 3579585 - DNA, 15 bp, Homo sapiens
actgcatccagcctg

SEQ ID NO: 3579586 - DNA, 18 bp, Homo sapiens
actgccaaaatgctctag

SEQ ID NO: 3579587 - DNA, 19 bp, Homo sapiens
agaccaaagcaaagaaaat

SEQ ID NO: 3579588 - DNA, 17 bp, Homo sapiens
agaccaatcaaatatat

SEQ ID NO: 3579589 - DNA, 18 bp, Homo sapiens
agaccaattgaagcatga

SEQ ID NO: 3579590 - DNA, 16 bp, Homo sapiens
agaccacttgccacgc

SEQ ID NO: 3579591 - DNA, 15 bp, Homo sapiens
agaccagcctggcca

SEQ ID NO: 3579592 - DNA, 15 bp, Homo sapiens
agaccataagagaaa

SEQ ID NO: 3579593 - DNA, 16 bp, Homo sapiens
agacccaaaacagctt

SEQ ID NO: 3579594 - DNA, 21 bp, Homo sapiens
agacccaaaacagctttgtct

SEQ ID NO: 3579595 - DNA, 22 bp, Homo sapiens
agacccaaagcggtccctgtcc

SEQ ID NO: 3579596 - DNA, 20 bp, Homo sapiens
agacccccccatttcccgca

SEQ ID NO: 3579597 - DNA, 23 bp, Homo sapiens
agacccccccatttcccgcacat

SEQ ID NO: 3579598 - DNA, 20 bp, Homo sapiens
agaccccctcagccttggga

SEQ ID NO: 3579599 - DNA, 21 bp, Homo sapiens
agacccctggcttttcactgc

SEQ ID NO: 3579600 - DNA, 12 bp, Homo sapiens
agaccctgtgtc

SEQ ID NO: 3579601 - DNA, 21 bp, Homo sapiens
agaccctgtgtcctccaccat

SEQ ID NO: 3579602 - DNA, 18 bp, Homo sapiens
agacccttgacacctgct

SEQ ID NO: 3579603 - DNA, 18 bp, Homo sapiens
agaccgccgtctaactca

SEQ ID NO: 3579604 - DNA, 20 bp, Homo sapiens
agacctcatcagccttggga

SEQ ID NO: 3579605 - DNA, 20 bp, Homo sapiens
agacctgacaatttgtgata

SEQ ID NO: 3579606 - DNA, 16 bp, Homo sapiens
agacctgatcctggag

SEQ ID NO: 3579607 - DNA, 18 bp, Homo sapiens
agacctggcagctctgga

SEQ ID NO: 3579608 - DNA, 17 bp, Homo sapiens
agacctggctccactct

SEQ ID NO: 3579609 - DNA, 21 bp, Homo sapiens
agaccttgctttgagactcct

SEQ ID NO: 3579610 - DNA, 20 bp, Homo sapiens
agacgcacacagctgagcac

SEQ ID NO: 3579611 - DNA, 20 bp, Homo sapiens
agacgccaggcaccacagcc

SEQ ID NO: 3579612 - DNA, 22 bp, Homo sapiens
agacgccaggcaccacagcctc

SEQ ID NO: 3579613 - DNA, 13 bp, Homo sapiens
agacggggctgga

SEQ ID NO: 3579614 - DNA, 16 bp, Homo sapiens
agactaaaaatacacc

SEQ ID NO: 3579615 - DNA, 13 bp, Homo sapiens
agactagatgtag

SEQ ID NO: 3579616 - DNA, 14 bp, Homo sapiens
agactattcaaaca

SEQ ID NO: 3579617 - DNA, 14 bp, Homo sapiens
agactcaatgtgct

SEQ ID NO: 3579618 - DNA, 13 bp, Homo sapiens
agactccaaagaa

SEQ ID NO: 3579619 - DNA, 19 bp, Homo sapiens
agactccaaagaaatgtaa

SEQ ID NO: 3579620 - DNA, 23 bp, Homo sapiens
agactcccattcctgaagaacca

SEQ ID NO: 3579621 - DNA, 13 bp, Homo sapiens
agactcctcagca

SEQ ID NO: 3579622 - DNA, 16 bp, Homo sapiens
agactcctcagcaccc

SEQ ID NO: 3579623 - DNA, 18 bp, Homo sapiens
agactcggaatctatttt

SEQ ID NO: 3579624 - DNA, 20 bp, Homo sapiens
agactctttaataaattgct

SEQ ID NO: 3579625 - DNA, 17 bp, Homo sapiens
agactgaactcgcaggg

SEQ ID NO: 3579626 - DNA, 18 bp, Homo sapiens
agactgacagacttagaa

SEQ ID NO: 3579627 - DNA, 15 bp, Homo sapiens
agactgagcagccgc

SEQ ID NO: 3579628 - DNA, 17 bp, Homo sapiens
agactgagcagccgcca

SEQ ID NO: 3579629 - DNA, 17 bp, Homo sapiens
agactgatagacaccat

SEQ ID NO: 3579630 - DNA, 18 bp, Homo sapiens
agactgatagacaccata

SEQ ID NO: 3579631 - DNA, 23 bp, Homo sapiens
agactgcgatttgtcccaggtcc

SEQ ID NO: 3579632 - DNA, 16 bp, Homo sapiens
agactgctcctgggca

SEQ ID NO: 3579633 - DNA, 15 bp, Homo sapiens
agactggcacagttt

SEQ ID NO: 3579634 - DNA, 23 bp, Homo sapiens
agactggcacagttttctgagaa

SEQ ID NO: 3579635 - DNA, 18 bp, Homo sapiens
agactggcccagtgccag

SEQ ID NO: 3579636 - DNA, 21 bp, Homo sapiens
agactggcccagtgccagcaa

SEQ ID NO: 3579637 - DNA, 21 bp, Homo sapiens
agactgtaacttccaaataaa

SEQ ID NO: 3579638 - DNA, 21 bp, Homo sapiens
agacttcctctggctccccaa

SEQ ID NO: 3579639 - DNA, 21 bp, Homo sapiens
agacttctcaaagagaattgt

SEQ ID NO: 3579640 - DNA, 20 bp, Homo sapiens
agacttctctttcttatttt

SEQ ID NO: 3579641 - DNA, 12 bp, Homo sapiens
agacttgaaagt

SEQ ID NO: 3579642 - DNA, 15 bp, Homo sapiens
agacttgaaagtttt

SEQ ID NO: 3579643 - DNA, 19 bp, Homo sapiens
agacttgaaagttttccag

SEQ ID NO: 3579644 - DNA, 18 bp, Homo sapiens
agactttgatactaccag

SEQ ID NO: 3579645 - DNA, 19 bp, Homo sapiens
agactttgtttttaaaatg

SEQ ID NO: 3579646 - DNA, 14 bp, Homo sapiens
agagaaaaaagcca

SEQ ID NO: 3579647 - DNA, 17 bp, Homo sapiens
agagaaaacccggagca

SEQ ID NO: 3579648 - DNA, 13 bp, Homo sapiens
agagaaaacctta

SEQ ID NO: 3579649 - DNA, 12 bp, Homo sapiens
agagaaaataaa

SEQ ID NO: 3579650 - DNA, 16 bp, Homo sapiens
agagaaaattcaggtc

SEQ ID NO: 3579651 - DNA, 16 bp, Homo sapiens
agagaaacagttggta

SEQ ID NO: 3579652 - DNA, 14 bp, Homo sapiens
agagaaacctgcca

SEQ ID NO: 3579653 - DNA, 16 bp, Homo sapiens
agagaaacttcaaagt

SEQ ID NO: 3579654 - DNA, 14 bp, Homo sapiens
agagaaagagagaa

SEQ ID NO: 3579655 - DNA, 15 bp, Homo sapiens
agagaaagagagaag

SEQ ID NO: 3579656 - DNA, 20 bp, Homo sapiens
agagaaagagagaagccagc

SEQ ID NO: 3579657 - DNA, 19 bp, Homo sapiens
agagaaaggggagcccact

SEQ ID NO: 3579658 - DNA, 18 bp, Homo sapiens
agagaaatcagctgctat

SEQ ID NO: 3579659 - DNA, 15 bp, Homo sapiens
agagaaatgccccag

SEQ ID NO: 3579660 - DNA, 16 bp, Homo sapiens
agagaaatgccccagt

SEQ ID NO: 3579661 - DNA, 21 bp, Homo sapiens
agagaacatcccgcttctgaa

SEQ ID NO: 3579662 - DNA, 20 bp, Homo sapiens
agagaacctcagattcttca

SEQ ID NO: 3579663 - DNA, 13 bp, Homo sapiens
agagaactgcctt

SEQ ID NO: 3579664 - DNA, 16 bp, Homo sapiens
agagaagccagccaca

SEQ ID NO: 3579665 - DNA, 18 bp, Homo sapiens
agagaagtatacataagt

SEQ ID NO: 3579666 - DNA, 14 bp, Homo sapiens
agagaatgtggaaa

SEQ ID NO: 3579667 - DNA, 15 bp, Homo sapiens
agagaattatctcaa

SEQ ID NO: 3579668 - DNA, 17 bp, Homo sapiens
agagaattatctcaagt

SEQ ID NO: 3579669 - DNA, 22 bp, Homo sapiens
agagaatttctaccatttcaga

SEQ ID NO: 3579670 - DNA, 21 bp, Homo sapiens
agagacaaacacctcccagga

SEQ ID NO: 3579671 - DNA, 18 bp, Homo sapiens
agagacaaatctttaaga

SEQ ID NO: 3579672 - DNA, 23 bp, Homo sapiens
agagacacatacagagtgggccc

SEQ ID NO: 3579673 - DNA, 22 bp, Homo sapiens
agagacatacttgaagggccag

SEQ ID NO: 3579674 - DNA, 23 bp, Homo sapiens
agagacatacttgaagggccaga

SEQ ID NO: 3579675 - DNA, 20 bp, Homo sapiens
agagaccataagagaaacct

SEQ ID NO: 3579676 - DNA, 16 bp, Homo sapiens
agagaccctggcctca

SEQ ID NO: 3579677 - DNA, 21 bp, Homo sapiens
agagactttgatactaccagg

SEQ ID NO: 3579678 - DNA, 21 bp, Homo sapiens
agagagaccccgcacccggct

SEQ ID NO: 3579679 - DNA, 12 bp, Homo sapiens
agagagccagga

SEQ ID NO: 3579680 - DNA, 20 bp, Homo sapiens
agagaggccttttggaatgt

SEQ ID NO: 3579681 - DNA, 19 bp, Homo sapiens
agagaggggcagggaagga

SEQ ID NO: 3579682 - DNA, 19 bp, Homo sapiens
agagaggtagcactctcag

SEQ ID NO: 3579683 - DNA, 14 bp, Homo sapiens
agagaggtttcgat

SEQ ID NO: 3579684 - DNA, 13 bp, Homo sapiens
agagagtggagag

SEQ ID NO: 3579685 - DNA, 14 bp, Homo sapiens
agagataattgctt

SEQ ID NO: 3579686 - DNA, 16 bp, Homo sapiens
agagatattgatattg

SEQ ID NO: 3579687 - DNA, 23 bp, Homo sapiens
agagatcgagaccatcctggcca

SEQ ID NO: 3579688 - DNA, 13 bp, Homo sapiens
agagatctgtgtg

SEQ ID NO: 3579689 - DNA, 14 bp, Homo sapiens
agagatctgtgtgg

SEQ ID NO: 3579690 - DNA, 13 bp, Homo sapiens
agagatgtaccaa

SEQ ID NO: 3579691 - DNA, 17 bp, Homo sapiens
agagattttttttccct

SEQ ID NO: 3579692 - DNA, 18 bp, Homo sapiens
agagcaaaataattttaa

SEQ ID NO: 3579693 - DNA, 20 bp, Homo sapiens
agagcagggctaaataaaga

SEQ ID NO: 3579694 - DNA, 21 bp, Homo sapiens
agagcataatttaaaaatata

SEQ ID NO: 3579695 - DNA, 13 bp, Homo sapiens
agagcatcctgat

SEQ ID NO: 3579696 - DNA, 16 bp, Homo sapiens
agagcatctcaggagg

SEQ ID NO: 3579697 - DNA, 19 bp, Homo sapiens
agagcatctcaggaggggc

SEQ ID NO: 3579698 - DNA, 24 bp, Homo sapiens
agagcattgtcaccgcaggtgctc

SEQ ID NO: 3579699 - DNA, 21 bp, Homo sapiens
agagccacaaaagaaaagact

SEQ ID NO: 3579700 - DNA, 17 bp, Homo sapiens
agagccagcctggctct

SEQ ID NO: 3579701 - DNA, 19 bp, Homo sapiens
agagccagcctggctctgc

SEQ ID NO: 3579702 - DNA, 22 bp, Homo sapiens
agagccagcctggctctgcccc

SEQ ID NO: 3579703 - DNA, 21 bp, Homo sapiens
agagccaggatgcccagatga

SEQ ID NO: 3579704 - DNA, 15 bp, Homo sapiens
agagccatacataaa

SEQ ID NO: 3579705 - DNA, 18 bp, Homo sapiens
agagccatacataaaaga

SEQ ID NO: 3579706 - DNA, 19 bp, Homo sapiens
agagccatacataaaagaa

SEQ ID NO: 3579707 - DNA, 12 bp, Homo sapiens
agagcccagctc

SEQ ID NO: 3579708 - DNA, 15 bp, Homo sapiens
agagcccagctccaa

SEQ ID NO: 3579709 - DNA, 15 bp, Homo sapiens
agagcccccagccct

SEQ ID NO: 3579710 - DNA, 17 bp, Homo sapiens
agagcccccagccctgg

SEQ ID NO: 3579711 - DNA, 13 bp, Homo sapiens
agagcctcctggg

SEQ ID NO: 3579712 - DNA, 20 bp, Homo sapiens
agagcctttttacctggcct

SEQ ID NO: 3579713 - DNA, 21 bp, Homo sapiens
agagcctttttacctggccta

SEQ ID NO: 3579714 - DNA, 12 bp, Homo sapiens
agagcggctgga

SEQ ID NO: 3579715 - DNA, 14 bp, Homo sapiens
agagcggctggaga

SEQ ID NO: 3579716 - DNA, 17 bp, Homo sapiens
agagctaaaaaggccct

SEQ ID NO: 3579717 - DNA, 19 bp, Homo sapiens
agagctatatccttaacca

SEQ ID NO: 3579718 - DNA, 17 bp, Homo sapiens
agagctatcaggagaaa

SEQ ID NO: 3579719 - DNA, 16 bp, Homo sapiens
agccatgtataaatgt

SEQ ID NO: 3579720 - DNA, 18 bp, Homo sapiens
agccatgtataaatgtga

SEQ ID NO: 3579721 - DNA, 23 bp, Homo sapiens
agcccaaacctgggaaggccagc

SEQ ID NO: 3579722 - DNA, 16 bp, Homo sapiens
agcccaagggatctgg

SEQ ID NO: 3579723 - DNA, 22 bp, Homo sapiens
agcccaagggatctggtcctac

SEQ ID NO: 3579724 - DNA, 23 bp, Homo sapiens
agcccaagttcatgcagctgtgg

SEQ ID NO: 3579725 - DNA, 14 bp, Homo sapiens
agcccactgtcctg

SEQ ID NO: 3579726 - DNA, 15 bp, Homo sapiens
agcccactgtcctgg

SEQ ID NO: 3579727 - DNA, 17 bp, Homo sapiens
agcccactgtcctgggc

SEQ ID NO: 3579728 - DNA, 19 bp, Homo sapiens
agcccactgtcctgggcct

SEQ ID NO: 3579729 - DNA, 12 bp, Homo sapiens
agcccagagaca

SEQ ID NO: 3579730 - DNA, 14 bp, Homo sapiens
agcccagagccacc

SEQ ID NO: 3579731 - DNA, 18 bp, Homo sapiens
agcccagcaccccttcct

SEQ ID NO: 3579732 - DNA, 12 bp, Homo sapiens
agcccagccagg

SEQ ID NO: 3579733 - DNA, 13 bp, Homo sapiens
agcccagcctggg

SEQ ID NO: 3579734 - DNA, 16 bp, Homo sapiens
agcccagcctgggagc

SEQ ID NO: 3579735 - DNA, 19 bp, Homo sapiens
agcccaggcagctatttca

SEQ ID NO: 3579736 - DNA, 14 bp, Homo sapiens
agccccagccaggg

SEQ ID NO: 3579737 - DNA, 16 bp, Homo sapiens
agccccagccccttcc

SEQ ID NO: 3579738 - DNA, 13 bp, Homo sapiens
agccccagcttgg

SEQ ID NO: 3579739 - DNA, 19 bp, Homo sapiens
agccccagcttggctcaca

SEQ ID NO: 3579740 - DNA, 12 bp, Homo sapiens
agccccaggaga

SEQ ID NO: 3579741 - DNA, 17 bp, Homo sapiens
agccccatcggccaaga

SEQ ID NO: 3579742 - DNA, 17 bp, Homo sapiens
agcccccagccctggga

SEQ ID NO: 3579743 - DNA, 19 bp, Homo sapiens
agcccccagctaagaacct

SEQ ID NO: 3579744 - DNA, 17 bp, Homo sapiens
agcccccagggcctcca

SEQ ID NO: 3579745 - DNA, 20 bp, Homo sapiens
agccccccttgccccacctc

SEQ ID NO: 3579746 - DNA, 16 bp, Homo sapiens
agccccctccttgtct

SEQ ID NO: 3579747 - DNA, 12 bp, Homo sapiens
agcccctcacac

SEQ ID NO: 3579748 - DNA, 17 bp, Homo sapiens
agcccctccccagccag

SEQ ID NO: 3579749 - DNA, 20 bp, Homo sapiens
agcccctgtctagagaggga

SEQ ID NO: 3579750 - DNA, 16 bp, Homo sapiens
agcccgacagtgccat

SEQ ID NO: 3579751 - DNA, 16 bp, Homo sapiens
agccctaagtggctgc

SEQ ID NO: 3579752 - DNA, 14 bp, Homo sapiens
agccctagccctgc

SEQ ID NO: 3579753 - DNA, 17 bp, Homo sapiens
agccctagccctgctcc

SEQ ID NO: 3579754 - DNA, 14 bp, Homo sapiens
agccctcaccacag

SEQ ID NO: 3579755 - DNA, 19 bp, Homo sapiens
agccctccctgcccctccc

SEQ ID NO: 3579756 - DNA, 12 bp, Homo sapiens
agccctcctgag

SEQ ID NO: 3579757 - DNA, 19 bp, Homo sapiens
agccctgaatttcttcttt

SEQ ID NO: 3579758 - DNA, 14 bp, Homo sapiens
agccctgcaccatg

SEQ ID NO: 3579759 - DNA, 22 bp, Homo sapiens
agccctgcaccatgctgctggg

SEQ ID NO: 3579760 - DNA, 18 bp, Homo sapiens
agccctgctccaactcca

SEQ ID NO: 3579761 - DNA, 19 bp, Homo sapiens
agccctgctttgggctgcc

SEQ ID NO: 3579762 - DNA, 21 bp, Homo sapiens
agccctgctttgggctgccct

SEQ ID NO: 3579763 - DNA, 22 bp, Homo sapiens
agccctgctttgggctgccctg

SEQ ID NO: 3579764 - DNA, 18 bp, Homo sapiens
agccctggcaaatgcctg

SEQ ID NO: 3579765 - DNA, 23 bp, Homo sapiens
agccctggcaaatgcctgactca

SEQ ID NO: 3579766 - DNA, 14 bp, Homo sapiens
agccctgggaacca

SEQ ID NO: 3579767 - DNA, 19 bp, Homo sapiens
agccctgggaaccactccc

SEQ ID NO: 3579768 - DNA, 21 bp, Homo sapiens
agccctgttgacacaggtctt

SEQ ID NO: 3579769 - DNA, 23 bp, Homo sapiens
agccctgttgacacaggtctttc

SEQ ID NO: 3579770 - DNA, 21 bp, Homo sapiens
agcccttatgcggttaatttt

SEQ ID NO: 3579771 - DNA, 22 bp, Homo sapiens
agcccttggaacaccctggatg

SEQ ID NO: 3579772 - DNA, 15 bp, Homo sapiens
agccgaccttccctc

SEQ ID NO: 3579773 - DNA, 22 bp, Homo sapiens
agccgcagagaaatgccccagt

SEQ ID NO: 3579774 - DNA, 14 bp, Homo sapiens
agccgccagctggg

SEQ ID NO: 3579775 - DNA, 23 bp, Homo sapiens
agccgccagctgggagcactggt

SEQ ID NO: 3579776 - DNA, 22 bp, Homo sapiens
agccgccggaagtggctccgtg

SEQ ID NO: 3579777 - DNA, 20 bp, Homo sapiens
agccggcaagcgagcacagt

SEQ ID NO: 3579778 - DNA, 16 bp, Homo sapiens
agccggcttgatttcc

SEQ ID NO: 3579779 - DNA, 23 bp, Homo sapiens
agccgggaggaaaaggcccctgc

SEQ ID NO: 3579780 - DNA, 16 bp, Homo sapiens
agccggtaactgtcct

SEQ ID NO: 3579781 - DNA, 17 bp, Homo sapiens
agccggtaactgtcctg

SEQ ID NO: 3579782 - DNA, 17 bp, Homo sapiens
agccgtgccttcagctc

SEQ ID NO: 3579783 - DNA, 13 bp, Homo sapiens
agccgtggcttcc

SEQ ID NO: 3579784 - DNA, 23 bp, Homo sapiens
agccgtggcttcccgctcagccc

SEQ ID NO: 3579785 - DNA, 13 bp, Homo sapiens
agcctaagaagaa

SEQ ID NO: 3579786 - DNA, 19 bp, Homo sapiens
agcctaagaagaaggccag

SEQ ID NO: 3579787 - DNA, 20 bp, Homo sapiens
agcctaagaagaaggccaga

SEQ ID NO: 3579788 - DNA, 19 bp, Homo sapiens
agcctaccgctggccctgc

SEQ ID NO: 3579789 - DNA, 15 bp, Homo sapiens
agcctacctctgtct

SEQ ID NO: 3579790 - DNA, 16 bp, Homo sapiens
agcctacctctgtctg

SEQ ID NO: 3579791 - DNA, 17 bp, Homo sapiens
agcctacctctgtctga

SEQ ID NO: 3579792 - DNA, 18 bp, Homo sapiens
agcctacctctgtctgag

SEQ ID NO: 3579793 - DNA, 17 bp, Homo sapiens
agcctagcggagcccag

SEQ ID NO: 3579794 - DNA, 20 bp, Homo sapiens
agcctagcggagcccagcct

SEQ ID NO: 3579795 - DNA, 22 bp, Homo sapiens
agcctagcggagcccagcctgg

SEQ ID NO: 3579796 - DNA, 13 bp, Homo sapiens
agcctatagtaaa

SEQ ID NO: 3579797 - DNA, 17 bp, Homo sapiens
agcctatagtaaatgtg

SEQ ID NO: 3579798 - DNA, 18 bp, Homo sapiens
agcctatagtaaatgtgt

SEQ ID NO: 3579799 - DNA, 18 bp, Homo sapiens
agcctccaagggtttcga

SEQ ID NO: 3579800 - DNA, 14 bp, Homo sapiens
agcctccaattttt

SEQ ID NO: 3579801 - DNA, 17 bp, Homo sapiens
agcctccatgctgcctc

SEQ ID NO: 3579802 - DNA, 10 bp, Homo sapiens
agcctcccct

SEQ ID NO: 3579803 - DNA, 20 bp, Homo sapiens
agcctcccctcccctgggga

SEQ ID NO: 3579804 - DNA, 17 bp, Homo sapiens
agcctccctgtctccag

SEQ ID NO: 3579805 - DNA, 22 bp, Homo sapiens
agcctccctgtctccagctgcc

SEQ ID NO: 3579806 - DNA, 23 bp, Homo sapiens
agcctccctgtctccagctgcct

SEQ ID NO: 3579807 - DNA, 18 bp, Homo sapiens
agcctcctgccccctgcc

SEQ ID NO: 3579808 - DNA, 11 bp, Homo sapiens
agcctcctggg

SEQ ID NO: 3579809 - DNA, 13 bp, Homo sapiens
agcctcctgggta

SEQ ID NO: 3579810 - DNA, 16 bp, Homo sapiens
agcctctaaacagaca

SEQ ID NO: 3579811 - DNA, 19 bp, Homo sapiens
agcctctccgactctgcac

SEQ ID NO: 3579812 - DNA, 13 bp, Homo sapiens
agcctctctcctt

SEQ ID NO: 3579813 - DNA, 20 bp, Homo sapiens
agcctctctccttggccaca

SEQ ID NO: 3579814 - DNA, 16 bp, Homo sapiens
agcctctggactggaa

SEQ ID NO: 3579815 - DNA, 23 bp, Homo sapiens
agcctctggactggaaagcacaa

SEQ ID NO: 3579816 - DNA, 20 bp, Homo sapiens
agcctgaattttgttgctgt

SEQ ID NO: 3579817 - DNA, 21 bp, Homo sapiens
agcctgaattttgttgctgtt

SEQ ID NO: 3579818 - DNA, 21 bp, Homo sapiens
agcctgattcggggctgacct

SEQ ID NO: 3579819 - DNA, 17 bp, Homo sapiens
agcctggcacagggcag

SEQ ID NO: 3579820 - DNA, 18 bp, Homo sapiens
agcctggcacagggcagt

SEQ ID NO: 3579821 - DNA, 16 bp, Homo sapiens
agcctggccaggcagg

SEQ ID NO: 3579822 - DNA, 17 bp, Homo sapiens
agcctggccaggcaggg

SEQ ID NO: 3579823 - DNA, 23 bp, Homo sapiens
agcctggctctgccccctccccc

SEQ ID NO: 3579824 - DNA, 17 bp, Homo sapiens
agcctggctctgccccg

SEQ ID NO: 3579825 - DNA, 23 bp, Homo sapiens
agcctgggcgacaaaaacgaaac

SEQ ID NO: 3579826 - DNA, 15 bp, Homo sapiens
agcctgggctcactg

SEQ ID NO: 3579827 - DNA, 15 bp, Homo sapiens
agcctggggtctgga

SEQ ID NO: 3579828 - DNA, 19 bp, Homo sapiens
agcctggggtggggtcatg

SEQ ID NO: 3579829 - DNA, 22 bp, Homo sapiens
agcctggtcccacgagggtgcc

SEQ ID NO: 3579830 - DNA, 23 bp, Homo sapiens
agcctggttcagacacagctctt

SEQ ID NO: 3579831 - DNA, 22 bp, Homo sapiens
agcctggtttctgggtgctaga

SEQ ID NO: 3579832 - DNA, 18 bp, Homo sapiens
agcctgtcctgggctggt

SEQ ID NO: 3579833 - DNA, 17 bp, Homo sapiens
agcctgtgcctctggga

SEQ ID NO: 3579834 - DNA, 18 bp, Homo sapiens
agcctgtgcctctgggac

SEQ ID NO: 3579835 - DNA, 17 bp, Homo sapiens
agcctgtgcgtcccagc

SEQ ID NO: 3579836 - DNA, 19 bp, Homo sapiens
agcctgtgggtttggtcct

SEQ ID NO: 3579837 - DNA, 15 bp, Homo sapiens
agccttaaaatgcat

SEQ ID NO: 3579838 - DNA, 16 bp, Homo sapiens
agccttagagctcttg

SEQ ID NO: 3579839 - DNA, 21 bp, Homo sapiens
agccttataaaccaatcttaa

SEQ ID NO: 3579840 - DNA, 14 bp, Homo sapiens
agccttcatcagaa

SEQ ID NO: 3579841 - DNA, 17 bp, Homo sapiens
agccttcatcagaactc

SEQ ID NO: 3579842 - DNA, 22 bp, Homo sapiens
agccttcatcagaactcttcct

SEQ ID NO: 3579843 - DNA, 23 bp, Homo sapiens
agccttcatcagaactcttcctc

SEQ ID NO: 3579844 - DNA, 13 bp, Homo sapiens
agccttccaacat

SEQ ID NO: 3579845 - DNA, 15 bp, Homo sapiens
agccttccccagctc

SEQ ID NO: 3579846 - DNA, 14 bp, Homo sapiens
agccttcccctccc

SEQ ID NO: 3579847 - DNA, 17 bp, Homo sapiens
agccttcccctccctgt

SEQ ID NO: 3579848 - DNA, 18 bp, Homo sapiens
agccttctaaattcccaa

SEQ ID NO: 3579849 - DNA, 19 bp, Homo sapiens
agccttctaaattcccaaa

SEQ ID NO: 3579850 - DNA, 19 bp, Homo sapiens
agccttgcaacccaaggtg

SEQ ID NO: 3579851 - DNA, 13 bp, Homo sapiens
aggccaggccagc

SEQ ID NO: 3579852 - DNA, 13 bp, Homo sapiens
aggccagggcagt

SEQ ID NO: 3579853 - DNA, 19 bp, Homo sapiens
aggccagtagttctcaaag

SEQ ID NO: 3579854 - DNA, 22 bp, Homo sapiens
aggccagtcagacgccaggcac

SEQ ID NO: 3579855 - DNA, 15 bp, Homo sapiens
aggccatctcaggag

SEQ ID NO: 3579856 - DNA, 18 bp, Homo sapiens
aggccatctcaggagatg

SEQ ID NO: 3579857 - DNA, 10 bp, Homo sapiens
aggccatctg

SEQ ID NO: 3579858 - DNA, 20 bp, Homo sapiens
aggccatctggagagcccag

SEQ ID NO: 3579859 - DNA, 16 bp, Homo sapiens
aggcccaatgctgctt

SEQ ID NO: 3579860 - DNA, 12 bp, Homo sapiens
aggcccactccc

SEQ ID NO: 3579861 - DNA, 18 bp, Homo sapiens
aggcccactccccagccc

SEQ ID NO: 3579862 - DNA, 21 bp, Homo sapiens
aggcccactccccagccccag

SEQ ID NO: 3579863 - DNA, 22 bp, Homo sapiens
aggcccagctttccctgccagg

SEQ ID NO: 3579864 - DNA, 21 bp, Homo sapiens
aggcccaggagacctccagct

SEQ ID NO: 3579865 - DNA, 17 bp, Homo sapiens
aggcccagttcaccctg

SEQ ID NO: 3579866 - DNA, 19 bp, Homo sapiens
aggcccatttgagaagctg

SEQ ID NO: 3579867 - DNA, 14 bp, Homo sapiens
aggccccagaggcc

SEQ ID NO: 3579868 - DNA, 17 bp, Homo sapiens
aggccccagaggccctg

SEQ ID NO: 3579869 - DNA, 21 bp, Homo sapiens
aggccccagaggccctggagg

SEQ ID NO: 3579870 - DNA, 13 bp, Homo sapiens
aggccccagcctc

SEQ ID NO: 3579871 - DNA, 15 bp, Homo sapiens
aggcccccaggtgcc

SEQ ID NO: 3579872 - DNA, 19 bp, Homo sapiens
aggcccctaggtgcccagg

SEQ ID NO: 3579873 - DNA, 23 bp, Homo sapiens
aggcccctaggtgcccagggcca

SEQ ID NO: 3579874 - DNA, 20 bp, Homo sapiens
aggcccctccctctccagca

SEQ ID NO: 3579875 - DNA, 22 bp, Homo sapiens
aggccctcagtcttcctgccgg

SEQ ID NO: 3579876 - DNA, 16 bp, Homo sapiens
aggccctccctgtctc

SEQ ID NO: 3579877 - DNA, 21 bp, Homo sapiens
aggccctctggagtggccact

SEQ ID NO: 3579878 - DNA, 13 bp, Homo sapiens
aggccctggaggt

SEQ ID NO: 3579879 - DNA, 21 bp, Homo sapiens
aggccctggaggtctccaggg

SEQ ID NO: 3579880 - DNA, 14 bp, Homo sapiens
aggccctgtgagca

SEQ ID NO: 3579881 - DNA, 13 bp, Homo sapiens
aggcccttcctct

SEQ ID NO: 3579882 - DNA, 15 bp, Homo sapiens
aggcccttcctctcc

SEQ ID NO: 3579883 - DNA, 18 bp, Homo sapiens
aggcccttcctctccact

SEQ ID NO: 3579884 - DNA, 16 bp, Homo sapiens
aggccgaggtgggcag

SEQ ID NO: 3579885 - DNA, 17 bp, Homo sapiens
aggccgaggtgggcaga

SEQ ID NO: 3579886 - DNA, 12 bp, Homo sapiens
aggccgcgccca

SEQ ID NO: 3579887 - DNA, 17 bp, Homo sapiens
aggccgcgcccagcaga

SEQ ID NO: 3579888 - DNA, 19 bp, Homo sapiens
aggcctaattctatgcctg

SEQ ID NO: 3579889 - DNA, 13 bp, Homo sapiens
aggcctcagccag

SEQ ID NO: 3579890 - DNA, 20 bp, Homo sapiens
aggcctccaacgcccctgtg

SEQ ID NO: 3579891 - DNA, 23 bp, Homo sapiens
aggcctccaacgcccctgtggcc

SEQ ID NO: 3579892 - DNA, 23 bp, Homo sapiens
aggcctctgggacccacagaact

SEQ ID NO: 3579893 - DNA, 13 bp, Homo sapiens
aggcctgcctgtt

SEQ ID NO: 3579894 - DNA, 20 bp, Homo sapiens
aggcctgctgccagtgcagc

SEQ ID NO: 3579895 - DNA, 21 bp, Homo sapiens
aggcctgcttgactttccaga

SEQ ID NO: 3579896 - DNA, 22 bp, Homo sapiens
aggcctgcttgactttccagaa

SEQ ID NO: 3579897 - DNA, 22 bp, Homo sapiens
aggcctggaagagctgagacct

SEQ ID NO: 3579898 - DNA, 13 bp, Homo sapiens
aggcctgtcccaa

SEQ ID NO: 3579899 - DNA, 18 bp, Homo sapiens
aggcctgtcccaattctg

SEQ ID NO: 3579900 - DNA, 22 bp, Homo sapiens
aggcctgtcccaattctgcccg

SEQ ID NO: 3579901 - DNA, 20 bp, Homo sapiens
aggcctgtcccttgcctctg

SEQ ID NO: 3579902 - DNA, 17 bp, Homo sapiens
aggccttatctccaaga

SEQ ID NO: 3579903 - DNA, 17 bp, Homo sapiens
aggccttatctgaaagg

SEQ ID NO: 3579904 - DNA, 21 bp, Homo sapiens
aggccttatctgaaaggccag

SEQ ID NO: 3579905 - DNA, 18 bp, Homo sapiens
aggccttcccatggccat

SEQ ID NO: 3579906 - DNA, 17 bp, Homo sapiens
aggcctttcctctgcac

SEQ ID NO: 3579907 - DNA, 18 bp, Homo sapiens
aggcctttcctctgcacg

SEQ ID NO: 3579908 - DNA, 21 bp, Homo sapiens
aggcctttcctctgcacgctc

SEQ ID NO: 3579909 - DNA, 20 bp, Homo sapiens
aggcgatggggcaagacaga

SEQ ID NO: 3579910 - DNA, 19 bp, Homo sapiens
aggcgcacagtgtgagccc

SEQ ID NO: 3579911 - DNA, 16 bp, Homo sapiens
aggcggctcctcctca

SEQ ID NO: 3579912 - DNA, 14 bp, Homo sapiens
aggctaagctgccg

SEQ ID NO: 3579913 - DNA, 17 bp, Homo sapiens
aggctacctcacctggg

SEQ ID NO: 3579914 - DNA, 15 bp, Homo sapiens
aggctactgtaatgc

SEQ ID NO: 3579915 - DNA, 21 bp, Homo sapiens
aggctactgtaatgctgcctc

SEQ ID NO: 3579916 - DNA, 17 bp, Homo sapiens
aggctactgtcagctcc

SEQ ID NO: 3579917 - DNA, 17 bp, Homo sapiens
aggctagagtgcaatgg

SEQ ID NO: 3579918 - DNA, 15 bp, Homo sapiens
aggctagctgtgctg

SEQ ID NO: 3579919 - DNA, 21 bp, Homo sapiens
aggctatggggatagatgtgt

SEQ ID NO: 3579920 - DNA, 22 bp, Homo sapiens
aggctatggggatagatgtgtg

SEQ ID NO: 3579921 - DNA, 18 bp, Homo sapiens
aggctattttctaaagac

SEQ ID NO: 3579922 - DNA, 19 bp, Homo sapiens
aggctcagactgggcactg

SEQ ID NO: 3579923 - DNA, 13 bp, Homo sapiens
aggctcagagagg

SEQ ID NO: 3579924 - DNA, 14 bp, Homo sapiens
aggctcaggagaag

SEQ ID NO: 3579925 - DNA, 16 bp, Homo sapiens
aggctcaggagaagcc

SEQ ID NO: 3579926 - DNA, 17 bp, Homo sapiens
aggctcaggagaagcca

SEQ ID NO: 3579927 - DNA, 12 bp, Homo sapiens
aggctcatttta

SEQ ID NO: 3579928 - DNA, 18 bp, Homo sapiens
aggctccgggcaccaggg

SEQ ID NO: 3579929 - DNA, 23 bp, Homo sapiens
aggctccgggctttcccccaggc

SEQ ID NO: 3579930 - DNA, 18 bp, Homo sapiens
aggctcctctaggccctg

SEQ ID NO: 3579931 - DNA, 11 bp, Homo sapiens
aggctctcccc

SEQ ID NO: 3579932 - DNA, 20 bp, Homo sapiens
aggctgaaatatccacccag

SEQ ID NO: 3579933 - DNA, 14 bp, Homo sapiens
aggctgaagagagg

SEQ ID NO: 3579934 - DNA, 19 bp, Homo sapiens
aggctgaagagagggacag

SEQ ID NO: 3579935 - DNA, 14 bp, Homo sapiens
aggctgaggcagga

SEQ ID NO: 3579936 - DNA, 21 bp, Homo sapiens
aggctgagggtcgtgggaaag

SEQ ID NO: 3579937 - DNA, 22 bp, Homo sapiens
aggctgcctgctgtgctgggag

SEQ ID NO: 3579938 - DNA, 18 bp, Homo sapiens
aggctgctcggctactgg

SEQ ID NO: 3579939 - DNA, 19 bp, Homo sapiens
aggctggtaagagaagtga

SEQ ID NO: 3579940 - DNA, 21 bp, Homo sapiens
aggctggtctcgaactcctga

SEQ ID NO: 3579941 - DNA, 23 bp, Homo sapiens
aggctggtcttgaactgggctca

SEQ ID NO: 3579942 - DNA, 13 bp, Homo sapiens
aggctggtggccc

SEQ ID NO: 3579943 - DNA, 14 bp, Homo sapiens
aggctggtggccca

SEQ ID NO: 3579944 - DNA, 15 bp, Homo sapiens
aggctggtggcccag

SEQ ID NO: 3579945 - DNA, 17 bp, Homo sapiens
aggctggtggcccagga

SEQ ID NO: 3579946 - DNA, 21 bp, Homo sapiens
aggctgtaactgagagaaaga

SEQ ID NO: 3579947 - DNA, 18 bp, Homo sapiens
aggctgtagaaaggggag

SEQ ID NO: 3579948 - DNA, 16 bp, Homo sapiens
aggctgtctgttgtat

SEQ ID NO: 3579949 - DNA, 19 bp, Homo sapiens
aggctgttgaatggaattt

SEQ ID NO: 3579950 - DNA, 16 bp, Homo sapiens
aggcttctccttctcc

SEQ ID NO: 3579951 - DNA, 14 bp, Homo sapiens
aggctttaaagctg

SEQ ID NO: 3579952 - DNA, 13 bp, Homo sapiens
agggaaaaaagag

SEQ ID NO: 3579953 - DNA, 15 bp, Homo sapiens
agggaaaaggcaggt

SEQ ID NO: 3579954 - DNA, 18 bp, Homo sapiens
agggaaaaggcaggtgct

SEQ ID NO: 3579955 - DNA, 14 bp, Homo sapiens
agggaaaatcttca

SEQ ID NO: 3579956 - DNA, 16 bp, Homo sapiens
agggaaaatcttcact

SEQ ID NO: 3579957 - DNA, 21 bp, Homo sapiens
agggaaaatcttcactttctt

SEQ ID NO: 3579958 - DNA, 17 bp, Homo sapiens
agggaaaatgcagcagg

SEQ ID NO: 3579959 - DNA, 16 bp, Homo sapiens
agggaaaattgcccca

SEQ ID NO: 3579960 - DNA, 15 bp, Homo sapiens
agggaaactgccagc

SEQ ID NO: 3579961 - DNA, 21 bp, Homo sapiens
agggaaactgccagcaacgca

SEQ ID NO: 3579962 - DNA, 23 bp, Homo sapiens
agggaaactgccagcaacgcagg

SEQ ID NO: 3579963 - DNA, 15 bp, Homo sapiens
agggaaagcctctgg

SEQ ID NO: 3579964 - DNA, 14 bp, Homo sapiens
agggaaagcgggca

SEQ ID NO: 3579965 - DNA, 10 bp, Homo sapiens
agggaaaggg

SEQ ID NO: 3579966 - DNA, 14 bp, Homo sapiens
agggaaagggaggg

SEQ ID NO: 3579967 - DNA, 17 bp, Homo sapiens
agggaaatgtatgtgtg

SEQ ID NO: 3579968 - DNA, 19 bp, Homo sapiens
agggaactgaccctcaggc

SEQ ID NO: 3579969 - DNA, 17 bp, Homo sapiens
agggaagctgtcctgga

SEQ ID NO: 3579970 - DNA, 12 bp, Homo sapiens
agggaagggagc

SEQ ID NO: 3579971 - DNA, 13 bp, Homo sapiens
agggaagggagcc

SEQ ID NO: 3579972 - DNA, 13 bp, Homo sapiens
agggaagtggtct

SEQ ID NO: 3579973 - DNA, 16 bp, Homo sapiens
agggacagaggcccca

SEQ ID NO: 3579974 - DNA, 18 bp, Homo sapiens
agggacaggaccccagct

SEQ ID NO: 3579975 - DNA, 17 bp, Homo sapiens
agggacatagaatctgt

SEQ ID NO: 3579976 - DNA, 20 bp, Homo sapiens
agggacatgaaatttacaaa

SEQ ID NO: 3579977 - DNA, 23 bp, Homo sapiens
agggaccactgggtgagagagga

SEQ ID NO: 3579978 - DNA, 20 bp, Homo sapiens
agggaccaggtttgcaggag

SEQ ID NO: 3579979 - DNA, 14 bp, Homo sapiens
agggaccatctgct

SEQ ID NO: 3579980 - DNA, 17 bp, Homo sapiens
agggaccatctgctgca

SEQ ID NO: 3579981 - DNA, 21 bp, Homo sapiens
agggaccatctgctgcagtta

SEQ ID NO: 3579982 - DNA, 22 bp, Homo sapiens
agggaccggtgctgcaggagtg

SEQ ID NO: 3579983 - DNA, 15 bp, Homo sapiens
agggtgccgtgtccc

SEQ ID NO: 3579984 - DNA, 22 bp, Homo sapiens
agggtgggggtgctctctctga

SEQ ID NO: 3579985 - DNA, 19 bp, Homo sapiens
agggtgtagcctacagaca

SEQ ID NO: 3579986 - DNA, 13 bp, Homo sapiens
agggttataataa

SEQ ID NO: 3579987 - DNA, 23 bp, Homo sapiens
agggttgctggtcctgcacatga

SEQ ID NO: 3579988 - DNA, 17 bp, Homo sapiens
agggtttcgactggtcc

SEQ ID NO: 3579989 - DNA, 19 bp, Homo sapiens
agggtttcgactggtccag

SEQ ID NO: 3579990 - DNA, 20 bp, Homo sapiens
agggttttttcttctttctt

SEQ ID NO: 3579991 - DNA, 21 bp, Homo sapiens
agggttttttcttctttcttt

SEQ ID NO: 3579992 - DNA, 13 bp, Homo sapiens
aggtaaacaaaga

SEQ ID NO: 3579993 - DNA, 14 bp, Homo sapiens
aggtaaatggttaa

SEQ ID NO: 3579994 - DNA, 22 bp, Homo sapiens
aggtaaatggttaaattttaca

SEQ ID NO: 3579995 - DNA, 23 bp, Homo sapiens
aggtaaatggttaaattttacat

SEQ ID NO: 3579996 - DNA, 13 bp, Homo sapiens
aggtaagtttttt

SEQ ID NO: 3579997 - DNA, 14 bp, Homo sapiens
aggtacatttctga

SEQ ID NO: 3579998 - DNA, 16 bp, Homo sapiens
aggtactagaatgctt

SEQ ID NO: 3579999 - DNA, 23 bp, Homo sapiens
aggtactttcatattttaaacag

SEQ ID NO: 3580000 - DNA, 22 bp, Homo sapiens
aggtagcactctcagagtgttt

SEQ ID NO: 3580001 - DNA, 14 bp, Homo sapiens
aggtagctggggag

SEQ ID NO: 3580002 - DNA, 23 bp, Homo sapiens
aggtataggggtcctgggggcag

SEQ ID NO: 3580003 - DNA, 16 bp, Homo sapiens
aggtattattatcttt

SEQ ID NO: 3580004 - DNA, 15 bp, Homo sapiens
aggtcaaaactgaag

SEQ ID NO: 3580005 - DNA, 22 bp, Homo sapiens
aggtcacaacccttctctgttg

SEQ ID NO: 3580006 - DNA, 20 bp, Homo sapiens
aggtcaccaggggaggagcc

SEQ ID NO: 3580007 - DNA, 21 bp, Homo sapiens
aggtcagcctggaagggacag

SEQ ID NO: 3580008 - DNA, 12 bp, Homo sapiens
aggtcagtgttt

SEQ ID NO: 3580009 - DNA, 13 bp, Homo sapiens
aggtcccggccag

SEQ ID NO: 3580010 - DNA, 16 bp, Homo sapiens
aggtcctacagggcca

SEQ ID NO: 3580011 - DNA, 21 bp, Homo sapiens
aggtcctccgtagggtctttc

SEQ ID NO: 3580012 - DNA, 21 bp, Homo sapiens
aggtcctgcagtctggctgag

SEQ ID NO: 3580013 - DNA, 12 bp, Homo sapiens
aggtccttgccc

SEQ ID NO: 3580014 - DNA, 15 bp, Homo sapiens
aggtcggagtgcctg

SEQ ID NO: 3580015 - DNA, 17 bp, Homo sapiens
aggtcggagtgcctgga

SEQ ID NO: 3580016 - DNA, 18 bp, Homo sapiens
aggtcgttttccaaagag

SEQ ID NO: 3580017 - DNA, 21 bp, Homo sapiens
aggtctccaggggcctgcaga

SEQ ID NO: 3580018 - DNA, 19 bp, Homo sapiens
aggtctctgggagcccaga

SEQ ID NO: 3580019 - DNA, 13 bp, Homo sapiens
aggtctgactcca

SEQ ID NO: 3580020 - DNA, 14 bp, Homo sapiens
aggtctgattggct

SEQ ID NO: 3580021 - DNA, 15 bp, Homo sapiens
aggtctgattggctg

SEQ ID NO: 3580022 - DNA, 18 bp, Homo sapiens
aggtctgattggctgctt

SEQ ID NO: 3580023 - DNA, 22 bp, Homo sapiens
aggtctgcactcctttatctgt

SEQ ID NO: 3580024 - DNA, 21 bp, Homo sapiens
aggtctggctgagcccctggg

SEQ ID NO: 3580025 - DNA, 15 bp, Homo sapiens
aggtctgtatgtcat

SEQ ID NO: 3580026 - DNA, 18 bp, Homo sapiens
aggtctgtatgtcatgga

SEQ ID NO: 3580027 - DNA, 14 bp, Homo sapiens
aggtctgtggtgca

SEQ ID NO: 3580028 - DNA, 17 bp, Homo sapiens
aggtctgtggtgcagtg

SEQ ID NO: 3580029 - DNA, 18 bp, Homo sapiens
aggtctgtggtgcagtgt

SEQ ID NO: 3580030 - DNA, 14 bp, Homo sapiens
aggtcttggccgac

SEQ ID NO: 3580031 - DNA, 19 bp, Homo sapiens
aggtcttggccgactcagg

SEQ ID NO: 3580032 - DNA, 20 bp, Homo sapiens
aggtgaaaatgaagaaggaa

SEQ ID NO: 3580033 - DNA, 20 bp, Homo sapiens
aggtgaaactccagatgcca

SEQ ID NO: 3580034 - DNA, 21 bp, Homo sapiens
aggtgaaatccctgcctcagg

SEQ ID NO: 3580035 - DNA, 14 bp, Homo sapiens
aggtgaacattggt

SEQ ID NO: 3580036 - DNA, 17 bp, Homo sapiens
aggtgaactccaggcat

SEQ ID NO: 3580037 - DNA, 18 bp, Homo sapiens
aggtgaactccaggcatg

SEQ ID NO: 3580038 - DNA, 19 bp, Homo sapiens
aggtgaactccaggcatgt

SEQ ID NO: 3580039 - DNA, 23 bp, Homo sapiens
aggtgaactccaggcatgtgtct

SEQ ID NO: 3580040 - DNA, 13 bp, Homo sapiens
aggtgacagtgaa

SEQ ID NO: 3580041 - DNA, 19 bp, Homo sapiens
aggtgataggtaaattttt

SEQ ID NO: 3580042 - DNA, 15 bp, Homo sapiens
aggtgattctcaggg

SEQ ID NO: 3580043 - DNA, 17 bp, Homo sapiens
aggtgattctcagggct

SEQ ID NO: 3580044 - DNA, 18 bp, Homo sapiens
aggtgattctcagggctg

SEQ ID NO: 3580045 - DNA, 22 bp, Homo sapiens
aggtgattctcagggctggagc

SEQ ID NO: 3580046 - DNA, 13 bp, Homo sapiens
aggtgcactccag

SEQ ID NO: 3580047 - DNA, 17 bp, Homo sapiens
aggtgcactccagactc

SEQ ID NO: 3580048 - DNA, 16 bp, Homo sapiens
aggtgcagctcctcag

SEQ ID NO: 3580049 - DNA, 17 bp, Homo sapiens
aggtgcagctcctcagc

SEQ ID NO: 3580050 - DNA, 14 bp, Homo sapiens
aggtgccaccaccc

SEQ ID NO: 3580051 - DNA, 18 bp, Homo sapiens
aggtgccaccaccctgcc

SEQ ID NO: 3580052 - DNA, 20 bp, Homo sapiens
aggtgccaccaccctgcccc

SEQ ID NO: 3580053 - DNA, 16 bp, Homo sapiens
aggtgcccagggccag

SEQ ID NO: 3580054 - DNA, 18 bp, Homo sapiens
aggtgctaacatagattt

SEQ ID NO: 3580055 - DNA, 21 bp, Homo sapiens
aggtgctacaaaaacacagca

SEQ ID NO: 3580056 - DNA, 22 bp, Homo sapiens
aggtgctacaaaaacacagcaa

SEQ ID NO: 3580057 - DNA, 23 bp, Homo sapiens
aggtgctacaaaaacacagcaag

SEQ ID NO: 3580058 - DNA, 16 bp, Homo sapiens
aggtgcttttggcaga

SEQ ID NO: 3580059 - DNA, 17 bp, Homo sapiens
aggtgcttttggcagag

SEQ ID NO: 3580060 - DNA, 21 bp, Homo sapiens
aggtggacacaacagcagtct

SEQ ID NO: 3580061 - DNA, 17 bp, Homo sapiens
aggtggcaggtgagcaa

SEQ ID NO: 3580062 - DNA, 14 bp, Homo sapiens
aggtggctgagccc

SEQ ID NO: 3580063 - DNA, 19 bp, Homo sapiens
aggtggctgagcccctgtc

SEQ ID NO: 3580064 - DNA, 21 bp, Homo sapiens
aggtgggagatttggaataca

SEQ ID NO: 3580065 - DNA, 22 bp, Homo sapiens
aggtgggatatcacttccatga

SEQ ID NO: 3580066 - DNA, 22 bp, Homo sapiens
aggtggggattgcccctggctt

SEQ ID NO: 3580067 - DNA, 16 bp, Homo sapiens
aggtggtgtgatctta

SEQ ID NO: 3580068 - DNA, 23 bp, Homo sapiens
aggtgtatgccacacctggcctt

SEQ ID NO: 3580069 - DNA, 22 bp, Homo sapiens
aggtgtattggtgttgcagccg

SEQ ID NO: 3580070 - DNA, 19 bp, Homo sapiens
aggtgtcctgagcaccaca

SEQ ID NO: 3580071 - DNA, 19 bp, Homo sapiens
aggtgtgaacctacctgcc

SEQ ID NO: 3580072 - DNA, 13 bp, Homo sapiens
aggtgtgaggaga

SEQ ID NO: 3580073 - DNA, 21 bp, Homo sapiens
aggtgtgaggagagaggagga

SEQ ID NO: 3580074 - DNA, 18 bp, Homo sapiens
aggtgtgggatctgggga

SEQ ID NO: 3580075 - DNA, 19 bp, Homo sapiens
aggtgtgggatctggggag

SEQ ID NO: 3580076 - DNA, 16 bp, Homo sapiens
aggtgttatgtattcc

SEQ ID NO: 3580077 - DNA, 20 bp, Homo sapiens
aggtgttatgtattcctatg

SEQ ID NO: 3580078 - DNA, 14 bp, Homo sapiens
aggttatgattgaa

SEQ ID NO: 3580079 - DNA, 19 bp, Homo sapiens
aggttcccagggctggaga

SEQ ID NO: 3580080 - DNA, 23 bp, Homo sapiens
aggttccccaagggccctggcac

SEQ ID NO: 3580081 - DNA, 20 bp, Homo sapiens
aggttcctgaaatatccagg

SEQ ID NO: 3580082 - DNA, 15 bp, Homo sapiens
aggttcttcagaagt

SEQ ID NO: 3580083 - DNA, 17 bp, Homo sapiens
aggttgagtatgtgaag

SEQ ID NO: 3580084 - DNA, 12 bp, Homo sapiens
aggttggttttg

SEQ ID NO: 3580085 - DNA, 22 bp, Homo sapiens
aggttgtggggcctcaggctcc

SEQ ID NO: 3580086 - DNA, 18 bp, Homo sapiens
aggtttaggctggtggcc

SEQ ID NO: 3580087 - DNA, 20 bp, Homo sapiens
aggtttaggctggtggccca

SEQ ID NO: 3580088 - DNA, 16 bp, Homo sapiens
aggtttcgatatttat

SEQ ID NO: 3580089 - DNA, 17 bp, Homo sapiens
aggtttgaaggagaatg

SEQ ID NO: 3580090 - DNA, 19 bp, Homo sapiens
aggtttgaaggagaatggc

SEQ ID NO: 3580091 - DNA, 18 bp, Homo sapiens
aggtttgcagatattctc

SEQ ID NO: 3580092 - DNA, 13 bp, Homo sapiens
aggtttgcaggag

SEQ ID NO: 3580093 - DNA, 23 bp, Homo sapiens
aggtttgtttagaagaagtgtgt

SEQ ID NO: 3580094 - DNA, 13 bp, Homo sapiens
aggttttacagat

SEQ ID NO: 3580095 - DNA, 14 bp, Homo sapiens
aggttttacagatt

SEQ ID NO: 3580096 - DNA, 14 bp, Homo sapiens
aggttttcagagaa

SEQ ID NO: 3580097 - DNA, 17 bp, Homo sapiens
aggttttctatgtgact

SEQ ID NO: 3580098 - DNA, 14 bp, Homo sapiens
aggtttttcaatta

SEQ ID NO: 3580099 - DNA, 19 bp, Homo sapiens
aggtttttgtttgtttcct

SEQ ID NO: 3580100 - DNA, 19 bp, Homo sapiens
aggtttttttccttctgaa

SEQ ID NO: 3580101 - DNA, 13 bp, Homo sapiens
agtaaaaatacaa

SEQ ID NO: 3580102 - DNA, 13 bp, Homo sapiens
agtaaaacaaatg

SEQ ID NO: 3580103 - DNA, 13 bp, Homo sapiens
agtaaaacacatt

SEQ ID NO: 3580104 - DNA, 17 bp, Homo sapiens
agtaaaaccacagcagt

SEQ ID NO: 3580105 - DNA, 20 bp, Homo sapiens
agtaaaaccacagcagttga

SEQ ID NO: 3580106 - DNA, 11 bp, Homo sapiens
agtaaaatttc

SEQ ID NO: 3580107 - DNA, 13 bp, Homo sapiens
agtaaagtctggg

SEQ ID NO: 3580108 - DNA, 19 bp, Homo sapiens
agtaaatgtgtttcttgct

SEQ ID NO: 3580109 - DNA, 13 bp, Homo sapiens
agtaactgtgact

SEQ ID NO: 3580110 - DNA, 24 bp, Homo sapiens
agtaactgtgctgtactgagcact

SEQ ID NO: 3580111 - DNA, 16 bp, Homo sapiens
agtaacttttaaaatt

SEQ ID NO: 3580112 - DNA, 14 bp, Homo sapiens
agtaagcatttcca

SEQ ID NO: 3580113 - DNA, 18 bp, Homo sapiens
agtaagttctgtggttcc

SEQ ID NO: 3580114 - DNA, 17 bp, Homo sapiens
agtaataggcattttaa

SEQ ID NO: 3580115 - DNA, 18 bp, Homo sapiens
ataagtcatggagcctga

SEQ ID NO: 3580116 - DNA, 14 bp, Homo sapiens
ataagtgaaaatct

SEQ ID NO: 3580117 - DNA, 16 bp, Homo sapiens
ataagtgaaaatctta

SEQ ID NO: 3580118 - DNA, 14 bp, Homo sapiens
ataagtgaatattt

SEQ ID NO: 3580119 - DNA, 13 bp, Homo sapiens
ataagtgtacata

SEQ ID NO: 3580120 - DNA, 17 bp, Homo sapiens
ataagttaacttccaat

SEQ ID NO: 3580121 - DNA, 22 bp, Homo sapiens
ataagttaacttccaatttaca

SEQ ID NO: 3580122 - DNA, 14 bp, Homo sapiens
ataagttgctgtgt

SEQ ID NO: 3580123 - DNA, 16 bp, Homo sapiens
ataagtttctattctg

SEQ ID NO: 3580124 - DNA, 13 bp, Homo sapiens
ataataaaaatat

SEQ ID NO: 3580125 - DNA, 15 bp, Homo sapiens
ataataaaaatatat

SEQ ID NO: 3580126 - DNA, 19 bp, Homo sapiens
ataataaaaatatattttc

SEQ ID NO: 3580127 - DNA, 13 bp, Homo sapiens
ataataaacataa

SEQ ID NO: 3580128 - DNA, 20 bp, Homo sapiens
ataataaactcttaagagaa

SEQ ID NO: 3580129 - DNA, 23 bp, Homo sapiens
ataataaagaatagctttaatga

SEQ ID NO: 3580130 - DNA, 11 bp, Homo sapiens
ataataaagga

SEQ ID NO: 3580131 - DNA, 13 bp, Homo sapiens
ataatagactgta

SEQ ID NO: 3580132 - DNA, 16 bp, Homo sapiens
ataatattaataagaa

SEQ ID NO: 3580133 - DNA, 14 bp, Homo sapiens
ataatatttaggca

SEQ ID NO: 3580134 - DNA, 18 bp, Homo sapiens
ataatcacaacccttcag

SEQ ID NO: 3580135 - DNA, 12 bp, Homo sapiens
ataatctgagca

SEQ ID NO: 3580136 - DNA, 18 bp, Homo sapiens
ataatctgagcaggtaca

SEQ ID NO: 3580137 - DNA, 22 bp, Homo sapiens
ataatctggactcctctgtcca

SEQ ID NO: 3580138 - DNA, 14 bp, Homo sapiens
ataatgaataaatc

SEQ ID NO: 3580139 - DNA, 15 bp, Homo sapiens
ataatgaatgaaaca

SEQ ID NO: 3580140 - DNA, 16 bp, Homo sapiens
ataatgatgatgatga

SEQ ID NO: 3580141 - DNA, 19 bp, Homo sapiens
ataatggggtcctggccat

SEQ ID NO: 3580142 - DNA, 13 bp, Homo sapiens
ataatgtatttga

SEQ ID NO: 3580143 - DNA, 14 bp, Homo sapiens
ataatgtatttgaa

SEQ ID NO: 3580144 - DNA, 11 bp, Homo sapiens
ataatgtgtat

SEQ ID NO: 3580145 - DNA, 21 bp, Homo sapiens
ataatgttttgggaaacactg

SEQ ID NO: 3580146 - DNA, 16 bp, Homo sapiens
ataattaattgtcatt

SEQ ID NO: 3580147 - DNA, 12 bp, Homo sapiens
ataattatgctt

SEQ ID NO: 3580148 - DNA, 14 bp, Homo sapiens
ataattctactttg

SEQ ID NO: 3580149 - DNA, 17 bp, Homo sapiens
ataattggatttcctaa

SEQ ID NO: 3580150 - DNA, 17 bp, Homo sapiens
ataatttaaaaatatat

SEQ ID NO: 3580151 - DNA, 16 bp, Homo sapiens
ataatttacctaagat

SEQ ID NO: 3580152 - DNA, 15 bp, Homo sapiens
ataatttatttcaat

SEQ ID NO: 3580153 - DNA, 14 bp, Homo sapiens
ataatttccttcag

SEQ ID NO: 3580154 - DNA, 16 bp, Homo sapiens
ataatttccttcaggc

SEQ ID NO: 3580155 - DNA, 13 bp, Homo sapiens
ataattttccttt

SEQ ID NO: 3580156 - DNA, 21 bp, Homo sapiens
atacaatcagcccagtgcaaa

SEQ ID NO: 3580157 - DNA, 16 bp, Homo sapiens
atacacacgctgcctt

SEQ ID NO: 3580158 - DNA, 23 bp, Homo sapiens
atacaccgtttagaaaaaacaat

SEQ ID NO: 3580159 - DNA, 22 bp, Homo sapiens
atacacttacactttatgcaca

SEQ ID NO: 3580160 - DNA, 20 bp, Homo sapiens
atacacttgtgattataaaa

SEQ ID NO: 3580161 - DNA, 20 bp, Homo sapiens
atacagcctatagtaaatgt

SEQ ID NO: 3580162 - DNA, 14 bp, Homo sapiens
atacataaaagaaa

SEQ ID NO: 3580163 - DNA, 20 bp, Homo sapiens
atacataaaagaaataaacc

SEQ ID NO: 3580164 - DNA, 21 bp, Homo sapiens
atacataatggtactcccaaa

SEQ ID NO: 3580165 - DNA, 15 bp, Homo sapiens
atacatacaccagca

SEQ ID NO: 3580166 - DNA, 17 bp, Homo sapiens
atacatccctcagtttc

SEQ ID NO: 3580167 - DNA, 13 bp, Homo sapiens
atacatgcatata

SEQ ID NO: 3580168 - DNA, 21 bp, Homo sapiens
atacatgcatataatgaataa

SEQ ID NO: 3580169 - DNA, 17 bp, Homo sapiens
atacattaacggtgcta

SEQ ID NO: 3580170 - DNA, 19 bp, Homo sapiens
atacattaacggtgctaaa

SEQ ID NO: 3580171 - DNA, 13 bp, Homo sapiens
atacatttgtatt

SEQ ID NO: 3580172 - DNA, 14 bp, Homo sapiens
atacatttgtattt

SEQ ID NO: 3580173 - DNA, 16 bp, Homo sapiens
ataccacagctattta

SEQ ID NO: 3580174 - DNA, 24 bp, Homo sapiens
ataccacagctatttagaagcatc

SEQ ID NO: 3580175 - DNA, 21 bp, Homo sapiens
ataccattctattctccagac

SEQ ID NO: 3580176 - DNA, 17 bp, Homo sapiens
atacctacaataaactg

SEQ ID NO: 3580177 - DNA, 18 bp, Homo sapiens
atacctacaataaactgg

SEQ ID NO: 3580178 - DNA, 12 bp, Homo sapiens
atacctgcccct

SEQ ID NO: 3580179 - DNA, 11 bp, Homo sapiens
atacctggagc

SEQ ID NO: 3580180 - DNA, 18 bp, Homo sapiens
atacctggttgagtgtgt

SEQ ID NO: 3580181 - DNA, 17 bp, Homo sapiens
ataccttctatgtatta

SEQ ID NO: 3580182 - DNA, 22 bp, Homo sapiens
atacctttgtagttactcaagc

SEQ ID NO: 3580183 - DNA, 12 bp, Homo sapiens
atactaccaggg

SEQ ID NO: 3580184 - DNA, 14 bp, Homo sapiens
atactaccagggtc

SEQ ID NO: 3580185 - DNA, 19 bp, Homo sapiens
atactacttatgaaatgtg

SEQ ID NO: 3580186 - DNA, 14 bp, Homo sapiens
atactatagtacca

SEQ ID NO: 3580187 - DNA, 13 bp, Homo sapiens
atactccactcca

SEQ ID NO: 3580188 - DNA, 16 bp, Homo sapiens
atactctgcttagaat

SEQ ID NO: 3580189 - DNA, 19 bp, Homo sapiens
atactgccttgtttaatgt

SEQ ID NO: 3580190 - DNA, 22 bp, Homo sapiens
atactgccttgtttaatgttaa

SEQ ID NO: 3580191 - DNA, 18 bp, Homo sapiens
atactgtaggtgttatgt

SEQ ID NO: 3580192 - DNA, 21 bp, Homo sapiens
atactgtaggtgttatgtatt

SEQ ID NO: 3580193 - DNA, 19 bp, Homo sapiens
atactgtggcctgcaggag

SEQ ID NO: 3580194 - DNA, 20 bp, Homo sapiens
atacttacatatctgacttc

SEQ ID NO: 3580195 - DNA, 16 bp, Homo sapiens
atacttcaaaagccat

SEQ ID NO: 3580196 - DNA, 17 bp, Homo sapiens
atacttcaaaagccata

SEQ ID NO: 3580197 - DNA, 16 bp, Homo sapiens
atacttgaagggccag

SEQ ID NO: 3580198 - DNA, 18 bp, Homo sapiens
atacttgaagggccagag

SEQ ID NO: 3580199 - DNA, 20 bp, Homo sapiens
atacttgaagggccagagcc

SEQ ID NO: 3580200 - DNA, 16 bp, Homo sapiens
atactttccatgtttt

SEQ ID NO: 3580201 - DNA, 20 bp, Homo sapiens
atactttgaagtgcagctca

SEQ ID NO: 3580202 - DNA, 22 bp, Homo sapiens
atactttgcagcacagctgaga

SEQ ID NO: 3580203 - DNA, 15 bp, Homo sapiens
atagaaagctttgtt

SEQ ID NO: 3580204 - DNA, 18 bp, Homo sapiens
atagaactggattttcag

SEQ ID NO: 3580205 - DNA, 19 bp, Homo sapiens
atagaaggctatggggata

SEQ ID NO: 3580206 - DNA, 12 bp, Homo sapiens
atagaataaagg

SEQ ID NO: 3580207 - DNA, 20 bp, Homo sapiens
atagaataaaggcagttttc

SEQ ID NO: 3580208 - DNA, 12 bp, Homo sapiens
atagaatgctgc

SEQ ID NO: 3580209 - DNA, 13 bp, Homo sapiens
atagaatgctgca

SEQ ID NO: 3580210 - DNA, 13 bp, Homo sapiens
atagacacacata

SEQ ID NO: 3580211 - DNA, 15 bp, Homo sapiens
atagacttaaatctc

SEQ ID NO: 3580212 - DNA, 20 bp, Homo sapiens
atagagaaaattcaggtctg

SEQ ID NO: 3580213 - DNA, 12 bp, Homo sapiens
atagagctttta

SEQ ID NO: 3580214 - DNA, 12 bp, Homo sapiens
atagagtgcagt

SEQ ID NO: 3580215 - DNA, 16 bp, Homo sapiens
atagatcagtatttca

SEQ ID NO: 3580216 - DNA, 21 bp, Homo sapiens
atagatgtaatttttcaaaat

SEQ ID NO: 3580217 - DNA, 13 bp, Homo sapiens
atagatgtgtgga

SEQ ID NO: 3580218 - DNA, 17 bp, Homo sapiens
atagattcagagaaatt

SEQ ID NO: 3580219 - DNA, 15 bp, Homo sapiens
atagcaaactccagg

SEQ ID NO: 3580220 - DNA, 15 bp, Homo sapiens
atagcaacagagcac

SEQ ID NO: 3580221 - DNA, 14 bp, Homo sapiens
atagcaccagggct

SEQ ID NO: 3580222 - DNA, 15 bp, Homo sapiens
atagcattgtctatt

SEQ ID NO: 3580223 - DNA, 21 bp, Homo sapiens
atagccattgatcataaactg

SEQ ID NO: 3580224 - DNA, 16 bp, Homo sapiens
atagctacatgttctt

SEQ ID NO: 3580225 - DNA, 21 bp, Homo sapiens
atagctacatgttctttgtac

SEQ ID NO: 3580226 - DNA, 15 bp, Homo sapiens
atagctcatgtgcat

SEQ ID NO: 3580227 - DNA, 12 bp, Homo sapiens
atagctctctga

SEQ ID NO: 3580228 - DNA, 13 bp, Homo sapiens
atagctctggggt

SEQ ID NO: 3580229 - DNA, 14 bp, Homo sapiens
ataggacagaggga

SEQ ID NO: 3580230 - DNA, 14 bp, Homo sapiens
ataggatcctggag

SEQ ID NO: 3580231 - DNA, 11 bp, Homo sapiens
ataggcagggg

SEQ ID NO: 3580232 - DNA, 16 bp, Homo sapiens
ataggcagggggccct

SEQ ID NO: 3580233 - DNA, 21 bp, Homo sapiens
ataggcctgtcccttgcctct

SEQ ID NO: 3580234 - DNA, 18 bp, Homo sapiens
ataggctattttctaaag

SEQ ID NO: 3580235 - DNA, 20 bp, Homo sapiens
ataggctattttctaaagac

SEQ ID NO: 3580236 - DNA, 13 bp, Homo sapiens
ataggggtcctgg

SEQ ID NO: 3580237 - DNA, 23 bp, Homo sapiens
ataggtaaatttttaggcaaaga

SEQ ID NO: 3580238 - DNA, 14 bp, Homo sapiens
ataggtgctacaaa

SEQ ID NO: 3580239 - DNA, 12 bp, Homo sapiens
ataggttatttt

SEQ ID NO: 3580240 - DNA, 20 bp, Homo sapiens
atagtacatgataaatgata

SEQ ID NO: 3580241 - DNA, 17 bp, Homo sapiens
atagtatcctccaggtt

SEQ ID NO: 3580242 - DNA, 18 bp, Homo sapiens
atagtatcctccaggttt

SEQ ID NO: 3580243 - DNA, 14 bp, Homo sapiens
atagtgtgaagatc

SEQ ID NO: 3580244 - DNA, 18 bp, Homo sapiens
atagtgttctgctcctgc

SEQ ID NO: 3580245 - DNA, 22 bp, Homo sapiens
atagttaagcgtgcataagtta

SEQ ID NO: 3580246 - DNA, 17 bp, Homo sapiens
atagttactgtgtaatt

SEQ ID NO: 3580247 - DNA, 15 bp, Homo sapiens
atagttatatgtaca

SEQ ID NO: 3580248 - DNA, 18 bp, Homo sapiens
atagttatatgtacagtt

SEQ ID NO: 3580249 - DNA, 14 bp, Homo sapiens
atctttgctgcaga

SEQ ID NO: 3580250 - DNA, 13 bp, Homo sapiens
atctttgtcaaac

SEQ ID NO: 3580251 - DNA, 22 bp, Homo sapiens
atcttttaaattgcaatatata

SEQ ID NO: 3580252 - DNA, 14 bp, Homo sapiens
atcttttgaagagc

SEQ ID NO: 3580253 - DNA, 23 bp, Homo sapiens
atgaaaaagaataaaaacttttg

SEQ ID NO: 3580254 - DNA, 16 bp, Homo sapiens
atgaaaaagctgcttc

SEQ ID NO: 3580255 - DNA, 22 bp, Homo sapiens
atgaaaagttatttatgctata

SEQ ID NO: 3580256 - DNA, 12 bp, Homo sapiens
atgaaaatggaa

SEQ ID NO: 3580257 - DNA, 17 bp, Homo sapiens
atgaaacaatcttccaa

SEQ ID NO: 3580258 - DNA, 18 bp, Homo sapiens
atgaaacaatcttccaaa

SEQ ID NO: 3580259 - DNA, 20 bp, Homo sapiens
atgaaacaatcttccaaaga

SEQ ID NO: 3580260 - DNA, 15 bp, Homo sapiens
atgaaacttaagaat

SEQ ID NO: 3580261 - DNA, 15 bp, Homo sapiens
atgaaacttggccag

SEQ ID NO: 3580262 - DNA, 14 bp, Homo sapiens
atgaaatactttat

SEQ ID NO: 3580263 - DNA, 16 bp, Homo sapiens
atgaaatatattttct

SEQ ID NO: 3580264 - DNA, 15 bp, Homo sapiens
atgaaatcttcccag

SEQ ID NO: 3580265 - DNA, 16 bp, Homo sapiens
atgaaatcttcccagt

SEQ ID NO: 3580266 - DNA, 22 bp, Homo sapiens
atgaaatgccctcctaaatgtc

SEQ ID NO: 3580267 - DNA, 13 bp, Homo sapiens
atgaaatttgata

SEQ ID NO: 3580268 - DNA, 19 bp, Homo sapiens
atgaacagaaactacattt

SEQ ID NO: 3580269 - DNA, 23 bp, Homo sapiens
atgaactttcagcagtctaaatt

SEQ ID NO: 3580270 - DNA, 13 bp, Homo sapiens
atgaagcaagaat

SEQ ID NO: 3580271 - DNA, 15 bp, Homo sapiens
atgaagcagaacctt

SEQ ID NO: 3580272 - DNA, 17 bp, Homo sapiens
atgaagcagaaccttct

SEQ ID NO: 3580273 - DNA, 14 bp, Homo sapiens
atgaagctgtataa

SEQ ID NO: 3580274 - DNA, 14 bp, Homo sapiens
atgaagtagaagtt

SEQ ID NO: 3580275 - DNA, 15 bp, Homo sapiens
atgaagtgcacagga

SEQ ID NO: 3580276 - DNA, 16 bp, Homo sapiens
atgaataaaacactca

SEQ ID NO: 3580277 - DNA, 17 bp, Homo sapiens
atgaataaagacaccta

SEQ ID NO: 3580278 - DNA, 12 bp, Homo sapiens
atgaatactttg

SEQ ID NO: 3580279 - DNA, 17 bp, Homo sapiens
atgaatgaaacattttg

SEQ ID NO: 3580280 - DNA, 13 bp, Homo sapiens
atgaatgcccagt

SEQ ID NO: 3580281 - DNA, 21 bp, Homo sapiens
atgaatgcccagtgagactgt

SEQ ID NO: 3580282 - DNA, 21 bp, Homo sapiens
atgaatgctattttttccctt

SEQ ID NO: 3580283 - DNA, 16 bp, Homo sapiens
atgaatgggcatttct

SEQ ID NO: 3580284 - DNA, 12 bp, Homo sapiens
atgaatgtcagt

SEQ ID NO: 3580285 - DNA, 23 bp, Homo sapiens
atgaatgtcagttgttatttatt

SEQ ID NO: 3580286 - DNA, 12 bp, Homo sapiens
atgacaaaagat

SEQ ID NO: 3580287 - DNA, 16 bp, Homo sapiens
atgacaaaattctttc

SEQ ID NO: 3580288 - DNA, 14 bp, Homo sapiens
atgacaacacttaa

SEQ ID NO: 3580289 - DNA, 21 bp, Homo sapiens
atgacaccacacttgttttct

SEQ ID NO: 3580290 - DNA, 13 bp, Homo sapiens
atgacaccctggc

SEQ ID NO: 3580291 - DNA, 14 bp, Homo sapiens
atgacaccctggcc

SEQ ID NO: 3580292 - DNA, 16 bp, Homo sapiens
atgacagaggtttgaa

SEQ ID NO: 3580293 - DNA, 19 bp, Homo sapiens
atgacatatcacatgtcag

SEQ ID NO: 3580294 - DNA, 19 bp, Homo sapiens
atgacatcacttgtacaaa

SEQ ID NO: 3580295 - DNA, 20 bp, Homo sapiens
atgacatcacttgtacaaaa

SEQ ID NO: 3580296 - DNA, 14 bp, Homo sapiens
atgacattccctgc

SEQ ID NO: 3580297 - DNA, 18 bp, Homo sapiens
atgaccagggatgctggg

SEQ ID NO: 3580298 - DNA, 19 bp, Homo sapiens
atgaccagggatgctgggc

SEQ ID NO: 3580299 - DNA, 23 bp, Homo sapiens
atgaccagggatgctgggctggg

SEQ ID NO: 3580300 - DNA, 15 bp, Homo sapiens
atgaccgagccctgg

SEQ ID NO: 3580301 - DNA, 19 bp, Homo sapiens
atgaccgagccctggagag

SEQ ID NO: 3580302 - DNA, 20 bp, Homo sapiens
atgaccgagccctggagagc

SEQ ID NO: 3580303 - DNA, 14 bp, Homo sapiens
atgacctccagaag

SEQ ID NO: 3580304 - DNA, 15 bp, Homo sapiens
atgacctccagaagt

SEQ ID NO: 3580305 - DNA, 14 bp, Homo sapiens
atgaccttcccagg

SEQ ID NO: 3580306 - DNA, 21 bp, Homo sapiens
atgacggtgttaattttgcta

SEQ ID NO: 3580307 - DNA, 23 bp, Homo sapiens
atgacggtgttaattttgctaac

SEQ ID NO: 3580308 - DNA, 22 bp, Homo sapiens
atgactatgcgtggctggaacc

SEQ ID NO: 3580309 - DNA, 15 bp, Homo sapiens
atgactatgtaaact

SEQ ID NO: 3580310 - DNA, 16 bp, Homo sapiens
atgactatgtaaacta

SEQ ID NO: 3580311 - DNA, 14 bp, Homo sapiens
atgactcaaagtct

SEQ ID NO: 3580312 - DNA, 19 bp, Homo sapiens
atgactcaggacatccccc

SEQ ID NO: 3580313 - DNA, 14 bp, Homo sapiens
atgactctcatttt

SEQ ID NO: 3580314 - DNA, 16 bp, Homo sapiens
atgactctcattttat

SEQ ID NO: 3580315 - DNA, 20 bp, Homo sapiens
atgacttatttctgctctgg

SEQ ID NO: 3580316 - DNA, 15 bp, Homo sapiens
atgactttccttagg

SEQ ID NO: 3580317 - DNA, 16 bp, Homo sapiens
atgagaaacagctcag

SEQ ID NO: 3580318 - DNA, 17 bp, Homo sapiens
atgagagaatgtggaaa

SEQ ID NO: 3580319 - DNA, 18 bp, Homo sapiens
atgagagaatgtggaaat

SEQ ID NO: 3580320 - DNA, 16 bp, Homo sapiens
atgagagcataattta

SEQ ID NO: 3580321 - DNA, 21 bp, Homo sapiens
atgagatattaaattctcaaa

SEQ ID NO: 3580322 - DNA, 18 bp, Homo sapiens
atgagccaccgcgcccag

SEQ ID NO: 3580323 - DNA, 21 bp, Homo sapiens
atgagccaccgcgcccagcct

SEQ ID NO: 3580324 - DNA, 15 bp, Homo sapiens
atgagctggcaacca

SEQ ID NO: 3580325 - DNA, 23 bp, Homo sapiens
atgaggatccagggcagcaggcc

SEQ ID NO: 3580326 - DNA, 16 bp, Homo sapiens
atgaggccatctcagg

SEQ ID NO: 3580327 - DNA, 17 bp, Homo sapiens
atgaggccatctcagga

SEQ ID NO: 3580328 - DNA, 18 bp, Homo sapiens
atgaggctcagagaggta

SEQ ID NO: 3580329 - DNA, 14 bp, Homo sapiens
atgaggtctgttta

SEQ ID NO: 3580330 - DNA, 15 bp, Homo sapiens
atgaggtctgtttaa

SEQ ID NO: 3580331 - DNA, 21 bp, Homo sapiens
atgagtaaaaaaaaaaacaat

SEQ ID NO: 3580332 - DNA, 15 bp, Homo sapiens
atgagtgcacctgcc

SEQ ID NO: 3580333 - DNA, 19 bp, Homo sapiens
atgagtgtctggagcgctt

SEQ ID NO: 3580334 - DNA, 23 bp, Homo sapiens
atgagtgtgatccagtttttcat

SEQ ID NO: 3580335 - DNA, 18 bp, Homo sapiens
atgagttggctgggaata

SEQ ID NO: 3580336 - DNA, 14 bp, Homo sapiens
atgatatgcatgta

SEQ ID NO: 3580337 - DNA, 22 bp, Homo sapiens
atgatcagaagaacatgatttt

SEQ ID NO: 3580338 - DNA, 18 bp, Homo sapiens
atgatcttctttataatt

SEQ ID NO: 3580339 - DNA, 21 bp, Homo sapiens
atgatgcacagtatctgctgt

SEQ ID NO: 3580340 - DNA, 16 bp, Homo sapiens
atgatggatggcagac

SEQ ID NO: 3580341 - DNA, 18 bp, Homo sapiens
atgatggatggcagactc

SEQ ID NO: 3580342 - DNA, 16 bp, Homo sapiens
atgatgggtcagttgt

SEQ ID NO: 3580343 - DNA, 14 bp, Homo sapiens
atgattactggcct

SEQ ID NO: 3580344 - DNA, 17 bp, Homo sapiens
atgattcaaatgtttta

SEQ ID NO: 3580345 - DNA, 12 bp, Homo sapiens
atgattgtttct

SEQ ID NO: 3580346 - DNA, 13 bp, Homo sapiens
atgatttcacagt

SEQ ID NO: 3580347 - DNA, 15 bp, Homo sapiens
atgatttcacagtgt

SEQ ID NO: 3580348 - DNA, 20 bp, Homo sapiens
atgatttcatgctatctctg

SEQ ID NO: 3580349 - DNA, 17 bp, Homo sapiens
atgatttgtagtggaaa

SEQ ID NO: 3580350 - DNA, 13 bp, Homo sapiens
atgattttccttt

SEQ ID NO: 3580351 - DNA, 11 bp, Homo sapiens
atgcaaaatgg

SEQ ID NO: 3580352 - DNA, 13 bp, Homo sapiens
atgcaaaatggaa

SEQ ID NO: 3580353 - DNA, 12 bp, Homo sapiens
atgcaaagcact

SEQ ID NO: 3580354 - DNA, 15 bp, Homo sapiens
atgcaaagcactgac

SEQ ID NO: 3580355 - DNA, 10 bp, Homo sapiens
atgcaaatac

SEQ ID NO: 3580356 - DNA, 16 bp, Homo sapiens
atgcaaatacaatcag

SEQ ID NO: 3580357 - DNA, 22 bp, Homo sapiens
atgcaaatagattcagagaaat

SEQ ID NO: 3580358 - DNA, 15 bp, Homo sapiens
atgcaagcagctttt

SEQ ID NO: 3580359 - DNA, 18 bp, Homo sapiens
atgcaaggattacagaaa

SEQ ID NO: 3580360 - DNA, 18 bp, Homo sapiens
atgcaagtggagctgtct

SEQ ID NO: 3580361 - DNA, 22 bp, Homo sapiens
atgcaagtggagctgtctgtct

SEQ ID NO: 3580362 - DNA, 16 bp, Homo sapiens
atgcacaacagagtaa

SEQ ID NO: 3580363 - DNA, 11 bp, Homo sapiens
atgcacacata

SEQ ID NO: 3580364 - DNA, 18 bp, Homo sapiens
atgcacagtatctgctgt

SEQ ID NO: 3580365 - DNA, 23 bp, Homo sapiens
atgcacagtatctgctgttcttc

SEQ ID NO: 3580366 - DNA, 14 bp, Homo sapiens
atgcacatccctgg

SEQ ID NO: 3580367 - DNA, 14 bp, Homo sapiens
atgcacccctgagc

SEQ ID NO: 3580368 - DNA, 22 bp, Homo sapiens
atgcacccctgagccagcaggg

SEQ ID NO: 3580369 - DNA, 18 bp, Homo sapiens
atgcactcacccctagcc

SEQ ID NO: 3580370 - DNA, 21 bp, Homo sapiens
atgcactcacccctagccctg

SEQ ID NO: 3580371 - DNA, 16 bp, Homo sapiens
atgcagaaagcatccc

SEQ ID NO: 3580372 - DNA, 23 bp, Homo sapiens
atgcagcaggaaggaacaaagac

SEQ ID NO: 3580373 - DNA, 20 bp, Homo sapiens
atgcagcagggatgccctgg

SEQ ID NO: 3580374 - DNA, 16 bp, Homo sapiens
atgcagcggcgtgagg

SEQ ID NO: 3580375 - DNA, 14 bp, Homo sapiens
atgcagtactaaaa

SEQ ID NO: 3580376 - DNA, 17 bp, Homo sapiens
atgcagtactaaaatta

SEQ ID NO: 3580377 - DNA, 21 bp, Homo sapiens
atgcagtgtttccctctgtgt

SEQ ID NO: 3580378 - DNA, 14 bp, Homo sapiens
atgcataaaaatta

SEQ ID NO: 3580379 - DNA, 16 bp, Homo sapiens
atgcataggattccaa

SEQ ID NO: 3580380 - DNA, 22 bp, Homo sapiens
atgcatatgtcactagaatgga

SEQ ID NO: 3580381 - DNA, 21 bp, Homo sapiens
atgcatatttgcaaagtgtat

SEQ ID NO: 3580382 - DNA, 14 bp, Homo sapiens
atgttagtaaagga

SEQ ID NO: 3580383 - DNA, 16 bp, Homo sapiens
atgttagtaaaggaac

SEQ ID NO: 3580384 - DNA, 17 bp, Homo sapiens
atgttagtattttaatc

SEQ ID NO: 3580385 - DNA, 19 bp, Homo sapiens
atgttagtattttaatcct

SEQ ID NO: 3580386 - DNA, 15 bp, Homo sapiens
atgttagttttcctt

SEQ ID NO: 3580387 - DNA, 18 bp, Homo sapiens
atgttatgactatgtaaa

SEQ ID NO: 3580388 - DNA, 18 bp, Homo sapiens
atgttatgcagtgaacta

SEQ ID NO: 3580389 - DNA, 16 bp, Homo sapiens
atgttattttccttct

SEQ ID NO: 3580390 - DNA, 17 bp, Homo sapiens
atgttattttccttctg

SEQ ID NO: 3580391 - DNA, 19 bp, Homo sapiens
atgttccctcttgtccctt

SEQ ID NO: 3580392 - DNA, 16 bp, Homo sapiens
atgttcctagtgaaag

SEQ ID NO: 3580393 - DNA, 18 bp, Homo sapiens
atgttctaaatatccctt

SEQ ID NO: 3580394 - DNA, 22 bp, Homo sapiens
atgttctaacagatcagaacat

SEQ ID NO: 3580395 - DNA, 20 bp, Homo sapiens
atgttctccagtcattatgt

SEQ ID NO: 3580396 - DNA, 20 bp, Homo sapiens
atgttctcctgatgtagctt

SEQ ID NO: 3580397 - DNA, 12 bp, Homo sapiens
atgttctctgaa

SEQ ID NO: 3580398 - DNA, 13 bp, Homo sapiens
atgttctgctttc

SEQ ID NO: 3580399 - DNA, 18 bp, Homo sapiens
atgttcttagcaataaat

SEQ ID NO: 3580400 - DNA, 15 bp, Homo sapiens
atgttgctggactgt

SEQ ID NO: 3580401 - DNA, 15 bp, Homo sapiens
atgttgtacaatgta

SEQ ID NO: 3580402 - DNA, 22 bp, Homo sapiens
atgttgtattgatttttaagaa

SEQ ID NO: 3580403 - DNA, 20 bp, Homo sapiens
atgttgtgtttggttcaatt

SEQ ID NO: 3580404 - DNA, 18 bp, Homo sapiens
atgttgtttataataaaa

SEQ ID NO: 3580405 - DNA, 20 bp, Homo sapiens
atgttgtttataataaaaat

SEQ ID NO: 3580406 - DNA, 12 bp, Homo sapiens
atgtttacattt

SEQ ID NO: 3580407 - DNA, 18 bp, Homo sapiens
atgttttatactgctcta

SEQ ID NO: 3580408 - DNA, 23 bp, Homo sapiens
atgttttgggaaacactgaaatg

SEQ ID NO: 3580409 - DNA, 14 bp, Homo sapiens
atgtttttatttca

SEQ ID NO: 3580410 - DNA, 17 bp, Homo sapiens
atgtttttatttcaatt

SEQ ID NO: 3580411 - DNA, 19 bp, Homo sapiens
atgtttttcatccattcct

SEQ ID NO: 3580412 - DNA, 18 bp, Homo sapiens
atgtttttggttattggt

SEQ ID NO: 3580413 - DNA, 13 bp, Homo sapiens
attaaaaaagaga

SEQ ID NO: 3580414 - DNA, 19 bp, Homo sapiens
attaaaaactgtgattttt

SEQ ID NO: 3580415 - DNA, 21 bp, Homo sapiens
attaaaaagttgttctttgtt

SEQ ID NO: 3580416 - DNA, 12 bp, Homo sapiens
attaaaatattt

SEQ ID NO: 3580417 - DNA, 13 bp, Homo sapiens
attaaaatatttc

SEQ ID NO: 3580418 - DNA, 17 bp, Homo sapiens
attaaaatatttcaggt

SEQ ID NO: 3580419 - DNA, 21 bp, Homo sapiens
attaaacggattattttttca

SEQ ID NO: 3580420 - DNA, 15 bp, Homo sapiens
attaaacttcagcaa

SEQ ID NO: 3580421 - DNA, 22 bp, Homo sapiens
attaaagacaggagacaaaaga

SEQ ID NO: 3580422 - DNA, 13 bp, Homo sapiens
attaaatggattt

SEQ ID NO: 3580423 - DNA, 10 bp, Homo sapiens
attaaatgtg

SEQ ID NO: 3580424 - DNA, 11 bp, Homo sapiens
attaaattatg

SEQ ID NO: 3580425 - DNA, 15 bp, Homo sapiens
attaaattctcaaag

SEQ ID NO: 3580426 - DNA, 22 bp, Homo sapiens
attaaattctcaaagttttatt

SEQ ID NO: 3580427 - DNA, 12 bp, Homo sapiens
attaaatttaat

SEQ ID NO: 3580428 - DNA, 18 bp, Homo sapiens
attaacatattatttcat

SEQ ID NO: 3580429 - DNA, 19 bp, Homo sapiens
attaacatattatttcatt

SEQ ID NO: 3580430 - DNA, 15 bp, Homo sapiens
attaacggtgctaaa

SEQ ID NO: 3580431 - DNA, 11 bp, Homo sapiens
attaagaaacc

SEQ ID NO: 3580432 - DNA, 14 bp, Homo sapiens
attaagatacttag

SEQ ID NO: 3580433 - DNA, 19 bp, Homo sapiens
attaagtaacttatttatg

SEQ ID NO: 3580434 - DNA, 19 bp, Homo sapiens
attaatatccctacatgta

SEQ ID NO: 3580435 - DNA, 13 bp, Homo sapiens
attaatattatta

SEQ ID NO: 3580436 - DNA, 16 bp, Homo sapiens
attaatcaagagaaac

SEQ ID NO: 3580437 - DNA, 21 bp, Homo sapiens
attaatcaagagaaacttcaa

SEQ ID NO: 3580438 - DNA, 16 bp, Homo sapiens
attaatcatacaaact

SEQ ID NO: 3580439 - DNA, 22 bp, Homo sapiens
attaatcttagtgtatgattac

SEQ ID NO: 3580440 - DNA, 16 bp, Homo sapiens
attaatcttattgttt

SEQ ID NO: 3580441 - DNA, 17 bp, Homo sapiens
attaatcttattgttta

SEQ ID NO: 3580442 - DNA, 13 bp, Homo sapiens
attaattaaacat

SEQ ID NO: 3580443 - DNA, 16 bp, Homo sapiens
attaattaaagaaaat

SEQ ID NO: 3580444 - DNA, 13 bp, Homo sapiens
attaattatgtgt

SEQ ID NO: 3580445 - DNA, 22 bp, Homo sapiens
attaatttgaaaccaggacatt

SEQ ID NO: 3580446 - DNA, 14 bp, Homo sapiens
attacaaacaataa

SEQ ID NO: 3580447 - DNA, 20 bp, Homo sapiens
attacaaacaataagaacaa

SEQ ID NO: 3580448 - DNA, 16 bp, Homo sapiens
attacaaatcagaagt

SEQ ID NO: 3580449 - DNA, 19 bp, Homo sapiens
attacaaatcagaagtcat

SEQ ID NO: 3580450 - DNA, 20 bp, Homo sapiens
attacaacagtagagaggga

SEQ ID NO: 3580451 - DNA, 18 bp, Homo sapiens
attacaccacagcattgt

SEQ ID NO: 3580452 - DNA, 16 bp, Homo sapiens
attacagaaactgatg

SEQ ID NO: 3580453 - DNA, 17 bp, Homo sapiens
attacagaaactgatgc

SEQ ID NO: 3580454 - DNA, 18 bp, Homo sapiens
attacagaaactgatgcc

SEQ ID NO: 3580455 - DNA, 15 bp, Homo sapiens
attacagataaaatg

SEQ ID NO: 3580456 - DNA, 16 bp, Homo sapiens
attacagatctgcacc

SEQ ID NO: 3580457 - DNA, 12 bp, Homo sapiens
attacagtgttg

SEQ ID NO: 3580458 - DNA, 22 bp, Homo sapiens
attaccagggactatctttgct

SEQ ID NO: 3580459 - DNA, 20 bp, Homo sapiens
attaccgtcacactcttcag

SEQ ID NO: 3580460 - DNA, 19 bp, Homo sapiens
attactggaattcttctgc

SEQ ID NO: 3580461 - DNA, 17 bp, Homo sapiens
attacttgcctatctga

SEQ ID NO: 3580462 - DNA, 21 bp, Homo sapiens
attacttgcctatctgacttc

SEQ ID NO: 3580463 - DNA, 15 bp, Homo sapiens
attactttaaattat

SEQ ID NO: 3580464 - DNA, 22 bp, Homo sapiens
attactttaaattatatgatat

SEQ ID NO: 3580465 - DNA, 21 bp, Homo sapiens
attagagggaggagaatgagc

SEQ ID NO: 3580466 - DNA, 18 bp, Homo sapiens
attagcaaggcagagcct

SEQ ID NO: 3580467 - DNA, 19 bp, Homo sapiens
attagcaaggcagagcctt

SEQ ID NO: 3580468 - DNA, 14 bp, Homo sapiens
attaggctgtaact

SEQ ID NO: 3580469 - DNA, 17 bp, Homo sapiens
attaggctgtaactact

SEQ ID NO: 3580470 - DNA, 12 bp, Homo sapiens
attaggctgttg

SEQ ID NO: 3580471 - DNA, 20 bp, Homo sapiens
attaggtcgttttccaaaga

SEQ ID NO: 3580472 - DNA, 15 bp, Homo sapiens
attagtctgaaactg

SEQ ID NO: 3580473 - DNA, 19 bp, Homo sapiens
attagtgccacttaatgta

SEQ ID NO: 3580474 - DNA, 20 bp, Homo sapiens
attagtgccacttaatgtat

SEQ ID NO: 3580475 - DNA, 22 bp, Homo sapiens
attagtgccacttaatgtatgt

SEQ ID NO: 3580476 - DNA, 18 bp, Homo sapiens
attagtgtcaacttttaa

SEQ ID NO: 3580477 - DNA, 16 bp, Homo sapiens
attagttgacagtatt

SEQ ID NO: 3580478 - DNA, 17 bp, Homo sapiens
attagttgacagtatta

SEQ ID NO: 3580479 - DNA, 16 bp, Homo sapiens
attagttgcctgactt

SEQ ID NO: 3580480 - DNA, 20 bp, Homo sapiens
attagttggctttcataaat

SEQ ID NO: 3580481 - DNA, 11 bp, Homo sapiens
attagttttaa

SEQ ID NO: 3580482 - DNA, 18 bp, Homo sapiens
attataaaattaatcaca

SEQ ID NO: 3580483 - DNA, 20 bp, Homo sapiens
attataaattctactaagtt

SEQ ID NO: 3580484 - DNA, 14 bp, Homo sapiens
attataaattgtgt

SEQ ID NO: 3580485 - DNA, 13 bp, Homo sapiens
attataactatta

SEQ ID NO: 3580486 - DNA, 17 bp, Homo sapiens
attataactattacagt

SEQ ID NO: 3580487 - DNA, 14 bp, Homo sapiens
attataagttctat

SEQ ID NO: 3580488 - DNA, 17 bp, Homo sapiens
attataagttctatttt

SEQ ID NO: 3580489 - DNA, 13 bp, Homo sapiens
attataagttgac

SEQ ID NO: 3580490 - DNA, 14 bp, Homo sapiens
attataagttgacc

SEQ ID NO: 3580491 - DNA, 16 bp, Homo sapiens
attataagttgacctt

SEQ ID NO: 3580492 - DNA, 17 bp, Homo sapiens
attataagttgaccttt

SEQ ID NO: 3580493 - DNA, 18 bp, Homo sapiens
attatacttctttattca

SEQ ID NO: 3580494 - DNA, 12 bp, Homo sapiens
attatatgaagt

SEQ ID NO: 3580495 - DNA, 23 bp, Homo sapiens
attatatgaagtttaaattctag

SEQ ID NO: 3580496 - DNA, 15 bp, Homo sapiens
attatatgatatgca

SEQ ID NO: 3580497 - DNA, 19 bp, Homo sapiens
attatctaaaatctgctag

SEQ ID NO: 3580498 - DNA, 22 bp, Homo sapiens
attatctatagctaagtacaca

SEQ ID NO: 3580499 - DNA, 15 bp, Homo sapiens
attatctcaagtaaa

SEQ ID NO: 3580500 - DNA, 19 bp, Homo sapiens
attatctcaagtaaaacaa

SEQ ID NO: 3580501 - DNA, 14 bp, Homo sapiens
attatcttatcatt

SEQ ID NO: 3580502 - DNA, 19 bp, Homo sapiens
attatggtagaatcatttt

SEQ ID NO: 3580503 - DNA, 15 bp, Homo sapiens
attatgtgcaaaggt

SEQ ID NO: 3580504 - DNA, 19 bp, Homo sapiens
attatgtgtagttataaac

SEQ ID NO: 3580505 - DNA, 13 bp, Homo sapiens
attatgttaatat

SEQ ID NO: 3580506 - DNA, 18 bp, Homo sapiens
attattaagtaacttatt

SEQ ID NO: 3580507 - DNA, 14 bp, Homo sapiens
attattatctttaa

SEQ ID NO: 3580508 - DNA, 14 bp, Homo sapiens
attattggcaaagt

SEQ ID NO: 3580509 - DNA, 20 bp, Homo sapiens
attattgtctgttttccttc

SEQ ID NO: 3580510 - DNA, 15 bp, Homo sapiens
attatttaattgtcc

SEQ ID NO: 3580511 - DNA, 21 bp, Homo sapiens
attatttgattatttaagact

SEQ ID NO: 3580512 - DNA, 18 bp, Homo sapiens
attatttgggggaactgg

SEQ ID NO: 3580513 - DNA, 12 bp, Homo sapiens
attatttgtctt

SEQ ID NO: 3580514 - DNA, 14 bp, Homo sapiens
attattttaaaaat

SEQ ID NO: 3580515 - DNA, 14 bp, Homo sapiens
attttgctaactgg

SEQ ID NO: 3580516 - DNA, 15 bp, Homo sapiens
attttgctaactggg

SEQ ID NO: 3580517 - DNA, 20 bp, Homo sapiens
attttgctaactgggttaaa

SEQ ID NO: 3580518 - DNA, 16 bp, Homo sapiens
attttgctaactggtt

SEQ ID NO: 3580519 - DNA, 21 bp, Homo sapiens
attttggagagtttcctgaaa

SEQ ID NO: 3580520 - DNA, 22 bp, Homo sapiens
attttggagagtttcctgaaac

SEQ ID NO: 3580521 - DNA, 10 bp, Homo sapiens
attttgtaaa

SEQ ID NO: 3580522 - DNA, 17 bp, Homo sapiens
attttgtaaactcaaaa

SEQ ID NO: 3580523 - DNA, 19 bp, Homo sapiens
attttgtaaactcaaaata

SEQ ID NO: 3580524 - DNA, 11 bp, Homo sapiens
attttgtaata

SEQ ID NO: 3580525 - DNA, 12 bp, Homo sapiens
attttgtaataa

SEQ ID NO: 3580526 - DNA, 15 bp, Homo sapiens
attttgtaataaact

SEQ ID NO: 3580527 - DNA, 19 bp, Homo sapiens
attttgtaataataaagaa

SEQ ID NO: 3580528 - DNA, 23 bp, Homo sapiens
attttgtaatgtatcaaatacat

SEQ ID NO: 3580529 - DNA, 23 bp, Homo sapiens
attttgtcatataagattcatat

SEQ ID NO: 3580530 - DNA, 19 bp, Homo sapiens
attttgtgaaacagacttg

SEQ ID NO: 3580531 - DNA, 22 bp, Homo sapiens
attttgtgaaacagacttgtat

SEQ ID NO: 3580532 - DNA, 20 bp, Homo sapiens
attttgtgtaagaaatacag

SEQ ID NO: 3580533 - DNA, 21 bp, Homo sapiens
attttgttggcatagctctgg

SEQ ID NO: 3580534 - DNA, 16 bp, Homo sapiens
attttgttttgttgga

SEQ ID NO: 3580535 - DNA, 18 bp, Homo sapiens
atttttaaagaatgttag

SEQ ID NO: 3580536 - DNA, 12 bp, Homo sapiens
atttttaaattg

SEQ ID NO: 3580537 - DNA, 14 bp, Homo sapiens
atttttaaattgtt

SEQ ID NO: 3580538 - DNA, 15 bp, Homo sapiens
atttttaagaaagta

SEQ ID NO: 3580539 - DNA, 19 bp, Homo sapiens
atttttaagaaagtaattt

SEQ ID NO: 3580540 - DNA, 18 bp, Homo sapiens
atttttaaggtctaatca

SEQ ID NO: 3580541 - DNA, 17 bp, Homo sapiens
atttttacagcaaaaga

SEQ ID NO: 3580542 - DNA, 17 bp, Homo sapiens
atttttaggcaaagata

SEQ ID NO: 3580543 - DNA, 15 bp, Homo sapiens
atttttatacactgt

SEQ ID NO: 3580544 - DNA, 23 bp, Homo sapiens
atttttatgttttgaaagacaga

SEQ ID NO: 3580545 - DNA, 16 bp, Homo sapiens
atttttatttctgact

SEQ ID NO: 3580546 - DNA, 15 bp, Homo sapiens
atttttatttgtaaa

SEQ ID NO: 3580547 - DNA, 15 bp, Homo sapiens
atttttctcccaaga

SEQ ID NO: 3580548 - DNA, 20 bp, Homo sapiens
atttttctcccaagaaacct

SEQ ID NO: 3580549 - DNA, 17 bp, Homo sapiens
atttttgaaaaaagtac

SEQ ID NO: 3580550 - DNA, 21 bp, Homo sapiens
atttttgcttttgataagaaa

SEQ ID NO: 3580551 - DNA, 12 bp, Homo sapiens
atttttgtattt

SEQ ID NO: 3580552 - DNA, 16 bp, Homo sapiens
atttttgtctgcagct

SEQ ID NO: 3580553 - DNA, 17 bp, Homo sapiens
atttttgttagcaaaga

SEQ ID NO: 3580554 - DNA, 21 bp, Homo sapiens
atttttgttttcattatctca

SEQ ID NO: 3580555 - DNA, 21 bp, Homo sapiens
attttttaagtgaaaatatag

SEQ ID NO: 3580556 - DNA, 17 bp, Homo sapiens
attttttaggtgcttta

SEQ ID NO: 3580557 - DNA, 16 bp, Homo sapiens
attttttcagaccgaa

SEQ ID NO: 3580558 - DNA, 13 bp, Homo sapiens
attttttcccttc

SEQ ID NO: 3580559 - DNA, 17 bp, Homo sapiens
attttttcccttctctt

SEQ ID NO: 3580560 - DNA, 18 bp, Homo sapiens
attttttcttctgaagat

SEQ ID NO: 3580561 - DNA, 22 bp, Homo sapiens
attttttgggcagcaatttaaa

SEQ ID NO: 3580562 - DNA, 19 bp, Homo sapiens
attttttggtggtgaaatt

SEQ ID NO: 3580563 - DNA, 14 bp, Homo sapiens
attttttgtataat

SEQ ID NO: 3580564 - DNA, 18 bp, Homo sapiens
atttttttactaatgata

SEQ ID NO: 3580565 - DNA, 12 bp, Homo sapiens
atttttttcctg

SEQ ID NO: 3580566 - DNA, 21 bp, Homo sapiens
attttttttctttgaataaat

SEQ ID NO: 3580567 - DNA, 14 bp, Homo sapiens
caaaaaaaaaatga

SEQ ID NO: 3580568 - DNA, 20 bp, Homo sapiens
caaaaaaaagaaaatgtctt

SEQ ID NO: 3580569 - DNA, 19 bp, Homo sapiens
caaaaaactatcaactaca

SEQ ID NO: 3580570 - DNA, 20 bp, Homo sapiens
caaaaaactatcaactacaa

SEQ ID NO: 3580571 - DNA, 13 bp, Homo sapiens
caaaaacacagca

SEQ ID NO: 3580572 - DNA, 14 bp, Homo sapiens
caaaaacacagcaa

SEQ ID NO: 3580573 - DNA, 22 bp, Homo sapiens
caaaaagaaaaaaaaaaagaaa

SEQ ID NO: 3580574 - DNA, 19 bp, Homo sapiens
caaaaatctcccagtgaca

SEQ ID NO: 3580575 - DNA, 20 bp, Homo sapiens
caaaaatctcccagtgacaa

SEQ ID NO: 3580576 - DNA, 15 bp, Homo sapiens
caaaaattacaaaga

SEQ ID NO: 3580577 - DNA, 15 bp, Homo sapiens
caaaaattagccggg

SEQ ID NO: 3580578 - DNA, 13 bp, Homo sapiens
caaaacaaaacaa

SEQ ID NO: 3580579 - DNA, 14 bp, Homo sapiens
caaaacaaaacaaa

SEQ ID NO: 3580580 - DNA, 14 bp, Homo sapiens
caaaacaaacaaac

SEQ ID NO: 3580581 - DNA, 21 bp, Homo sapiens
caaaacaaagcaattctttca

SEQ ID NO: 3580582 - DNA, 22 bp, Homo sapiens
caaaacaaagcaattctttcaa

SEQ ID NO: 3580583 - DNA, 21 bp, Homo sapiens
caaaacaaagcagctttaaaa

SEQ ID NO: 3580584 - DNA, 15 bp, Homo sapiens
caaaacaaaggccta

SEQ ID NO: 3580585 - DNA, 15 bp, Homo sapiens
caaaacaagccaaag

SEQ ID NO: 3580586 - DNA, 22 bp, Homo sapiens
caaaacagctttgtctccaaag

SEQ ID NO: 3580587 - DNA, 12 bp, Homo sapiens
caaaacatttct

SEQ ID NO: 3580588 - DNA, 21 bp, Homo sapiens
caaaacatttctggacagtac

SEQ ID NO: 3580589 - DNA, 16 bp, Homo sapiens
caaaacccatgcattt

SEQ ID NO: 3580590 - DNA, 20 bp, Homo sapiens
caaaacctatttttccttta

SEQ ID NO: 3580591 - DNA, 17 bp, Homo sapiens
caaaacgggtcagtatt

SEQ ID NO: 3580592 - DNA, 14 bp, Homo sapiens
caaaactgcactgt

SEQ ID NO: 3580593 - DNA, 21 bp, Homo sapiens
caaaagaaaaaagcaagtaca

SEQ ID NO: 3580594 - DNA, 22 bp, Homo sapiens
caaaagaaaaaagcaagtacaa

SEQ ID NO: 3580595 - DNA, 13 bp, Homo sapiens
caaaagaagcccc

SEQ ID NO: 3580596 - DNA, 16 bp, Homo sapiens
caaaagaagcccccag

SEQ ID NO: 3580597 - DNA, 18 bp, Homo sapiens
caaaagaagcccccagct

SEQ ID NO: 3580598 - DNA, 19 bp, Homo sapiens
caaaagaagcccccagcta

SEQ ID NO: 3580599 - DNA, 14 bp, Homo sapiens
caaaagacattaga

SEQ ID NO: 3580600 - DNA, 19 bp, Homo sapiens
caaaagctttttaaaattt

SEQ ID NO: 3580601 - DNA, 15 bp, Homo sapiens
caaaaggaggtgaaa

SEQ ID NO: 3580602 - DNA, 20 bp, Homo sapiens
caaaaggatctttgtggcca

SEQ ID NO: 3580603 - DNA, 24 bp, Homo sapiens
caaaaggatctttgtggccaagga

SEQ ID NO: 3580604 - DNA, 18 bp, Homo sapiens
caaaagtttgtttgctta

SEQ ID NO: 3580605 - DNA, 23 bp, Homo sapiens
caaaataaaccgtgtatttatta

SEQ ID NO: 3580606 - DNA, 20 bp, Homo sapiens
caaaataaagcaatgtgttt

SEQ ID NO: 3580607 - DNA, 22 bp, Homo sapiens
caaaatccaaaaagctctgaaa

SEQ ID NO: 3580608 - DNA, 14 bp, Homo sapiens
caaaatccaaaact

SEQ ID NO: 3580609 - DNA, 20 bp, Homo sapiens
caaaatcctgaactttctcc

SEQ ID NO: 3580610 - DNA, 16 bp, Homo sapiens
caaaatccttgcttat

SEQ ID NO: 3580611 - DNA, 20 bp, Homo sapiens
caaaatccttgcttatgaca

SEQ ID NO: 3580612 - DNA, 21 bp, Homo sapiens
caaaatcgtttttaatttaaa

SEQ ID NO: 3580613 - DNA, 16 bp, Homo sapiens
caaaatctgttctaac

SEQ ID NO: 3580614 - DNA, 14 bp, Homo sapiens
caaaatggaacgct

SEQ ID NO: 3580615 - DNA, 16 bp, Homo sapiens
caaaattgcttctaaa

SEQ ID NO: 3580616 - DNA, 19 bp, Homo sapiens
caaaattgcttctaaaaca

SEQ ID NO: 3580617 - DNA, 15 bp, Homo sapiens
caaacaaacaaacaa

SEQ ID NO: 3580618 - DNA, 19 bp, Homo sapiens
caaacaatcccaatctttc

SEQ ID NO: 3580619 - DNA, 20 bp, Homo sapiens
caaacaatcccaatctttct

SEQ ID NO: 3580620 - DNA, 21 bp, Homo sapiens
caaacaatcccaatctttcta

SEQ ID NO: 3580621 - DNA, 14 bp, Homo sapiens
caaacacctcccag

SEQ ID NO: 3580622 - DNA, 15 bp, Homo sapiens
caaacagaattttcc

SEQ ID NO: 3580623 - DNA, 22 bp, Homo sapiens
caaacagaattttccatttatt

SEQ ID NO: 3580624 - DNA, 15 bp, Homo sapiens
caaacagtaacgtgt

SEQ ID NO: 3580625 - DNA, 15 bp, Homo sapiens
caaacagtctcagga

SEQ ID NO: 3580626 - DNA, 17 bp, Homo sapiens
caaacagtctcaggaaa

SEQ ID NO: 3580627 - DNA, 17 bp, Homo sapiens
caaacatcaaataaatt

SEQ ID NO: 3580628 - DNA, 19 bp, Homo sapiens
caaacatcaaataaatttc

SEQ ID NO: 3580629 - DNA, 20 bp, Homo sapiens
caaacatcaaataaatttct

SEQ ID NO: 3580630 - DNA, 14 bp, Homo sapiens
caaacattttgtat

SEQ ID NO: 3580631 - DNA, 14 bp, Homo sapiens
caaacccaagttag

SEQ ID NO: 3580632 - DNA, 18 bp, Homo sapiens
caaaccccagccccaact

SEQ ID NO: 3580633 - DNA, 22 bp, Homo sapiens
caaacccccaaaatccaaaact

SEQ ID NO: 3580634 - DNA, 13 bp, Homo sapiens
caaaccccctgca

SEQ ID NO: 3580635 - DNA, 18 bp, Homo sapiens
caaaccccgaccacctgc

SEQ ID NO: 3580636 - DNA, 17 bp, Homo sapiens
caaacccttaactgaca

SEQ ID NO: 3580637 - DNA, 16 bp, Homo sapiens
caaacccttgctttcc

SEQ ID NO: 3580638 - DNA, 16 bp, Homo sapiens
caaacctgggaaggcc

SEQ ID NO: 3580639 - DNA, 17 bp, Homo sapiens
caaacctgggaaggcca

SEQ ID NO: 3580640 - DNA, 20 bp, Homo sapiens
caaacggcaacgtagcctgg

SEQ ID NO: 3580641 - DNA, 21 bp, Homo sapiens
caaacggcaacgtagcctggg

SEQ ID NO: 3580642 - DNA, 13 bp, Homo sapiens
caaacgtttctca

SEQ ID NO: 3580643 - DNA, 21 bp, Homo sapiens
caaacgtttctcaaatctgct

SEQ ID NO: 3580644 - DNA, 18 bp, Homo sapiens
caaactcagatccttggt

SEQ ID NO: 3580645 - DNA, 14 bp, Homo sapiens
caaactcaggccca

SEQ ID NO: 3580646 - DNA, 12 bp, Homo sapiens
caaactccaggc

SEQ ID NO: 3580647 - DNA, 15 bp, Homo sapiens
caagtattaagcagt

SEQ ID NO: 3580648 - DNA, 23 bp, Homo sapiens
caagtcagtccaggatgctaaca

SEQ ID NO: 3580649 - DNA, 20 bp, Homo sapiens
caagtcataggttaatattt

SEQ ID NO: 3580650 - DNA, 18 bp, Homo sapiens
caagtccaataagacact

SEQ ID NO: 3580651 - DNA, 20 bp, Homo sapiens
caagtgaaataacaaaatgg

SEQ ID NO: 3580652 - DNA, 22 bp, Homo sapiens
caagtgaaataacaaaatggac

SEQ ID NO: 3580653 - DNA, 17 bp, Homo sapiens
caagtgatcctcacgcc

SEQ ID NO: 3580654 - DNA, 21 bp, Homo sapiens
caagtgatcctcacgccttgg

SEQ ID NO: 3580655 - DNA, 18 bp, Homo sapiens
caagtgatgctaaaacct

SEQ ID NO: 3580656 - DNA, 20 bp, Homo sapiens
caagtgattctcctgcctca

SEQ ID NO: 3580657 - DNA, 18 bp, Homo sapiens
caagtggagctgtctgtc

SEQ ID NO: 3580658 - DNA, 21 bp, Homo sapiens
caagtggagctgtctgtctct

SEQ ID NO: 3580659 - DNA, 16 bp, Homo sapiens
caagtggtgagcaagc

SEQ ID NO: 3580660 - DNA, 20 bp, Homo sapiens
caagtggtggtaaccctggt

SEQ ID NO: 3580661 - DNA, 16 bp, Homo sapiens
caagttagttcaatct

SEQ ID NO: 3580662 - DNA, 21 bp, Homo sapiens
caagttccttggccatgcaga

SEQ ID NO: 3580663 - DNA, 15 bp, Homo sapiens
caataaacagctccc

SEQ ID NO: 3580664 - DNA, 14 bp, Homo sapiens
caataaactggtat

SEQ ID NO: 3580665 - DNA, 22 bp, Homo sapiens
caataaactggtatgaataatt

SEQ ID NO: 3580666 - DNA, 23 bp, Homo sapiens
caataaagcagttaatttatata

SEQ ID NO: 3580667 - DNA, 13 bp, Homo sapiens
caataaagctttt

SEQ ID NO: 3580668 - DNA, 14 bp, Homo sapiens
caataaagcttttg

SEQ ID NO: 3580669 - DNA, 17 bp, Homo sapiens
caataaagcttttggaa

SEQ ID NO: 3580670 - DNA, 18 bp, Homo sapiens
caataaagcttttggaag

SEQ ID NO: 3580671 - DNA, 15 bp, Homo sapiens
caataaattctaaat

SEQ ID NO: 3580672 - DNA, 22 bp, Homo sapiens
caataaattctaaattacaaag

SEQ ID NO: 3580673 - DNA, 18 bp, Homo sapiens
caataaattttttttggt

SEQ ID NO: 3580674 - DNA, 18 bp, Homo sapiens
caataagaacaaatacaa

SEQ ID NO: 3580675 - DNA, 14 bp, Homo sapiens
caataatccacccc

SEQ ID NO: 3580676 - DNA, 19 bp, Homo sapiens
caatacgtgatctctgtta

SEQ ID NO: 3580677 - DNA, 17 bp, Homo sapiens
caataggtagctgggga

SEQ ID NO: 3580678 - DNA, 18 bp, Homo sapiens
caataggtagctggggag

SEQ ID NO: 3580679 - DNA, 20 bp, Homo sapiens
caatagttgccaatctaaaa

SEQ ID NO: 3580680 - DNA, 12 bp, Homo sapiens
caatatagcaag

SEQ ID NO: 3580681 - DNA, 20 bp, Homo sapiens
caatatcctttgcctcaagg

SEQ ID NO: 3580682 - DNA, 17 bp, Homo sapiens
caatatgtgtttacttt

SEQ ID NO: 3580683 - DNA, 13 bp, Homo sapiens
caatattccttag

SEQ ID NO: 3580684 - DNA, 21 bp, Homo sapiens
caatatttattacacaaagaa

SEQ ID NO: 3580685 - DNA, 13 bp, Homo sapiens
caatcaaatatat

SEQ ID NO: 3580686 - DNA, 22 bp, Homo sapiens
caatcacagggaatggccacaa

SEQ ID NO: 3580687 - DNA, 22 bp, Homo sapiens
caatcccaccaaccctcagagc

SEQ ID NO: 3580688 - DNA, 12 bp, Homo sapiens
caatcccagcta

SEQ ID NO: 3580689 - DNA, 17 bp, Homo sapiens
caatcccagctacctca

SEQ ID NO: 3580690 - DNA, 24 bp, Homo sapiens
caatcctcctacctcagcctcctg

SEQ ID NO: 3580691 - DNA, 12 bp, Homo sapiens
caatctaatttt

SEQ ID NO: 3580692 - DNA, 19 bp, Homo sapiens
caatctcacaccttagcta

SEQ ID NO: 3580693 - DNA, 20 bp, Homo sapiens
caatctcacaccttagctat

SEQ ID NO: 3580694 - DNA, 20 bp, Homo sapiens
caatcttaaacataataaat

SEQ ID NO: 3580695 - DNA, 13 bp, Homo sapiens
caatctttctata

SEQ ID NO: 3580696 - DNA, 20 bp, Homo sapiens
caatgacacccatgccagag

SEQ ID NO: 3580697 - DNA, 14 bp, Homo sapiens
caatgactgagcag

SEQ ID NO: 3580698 - DNA, 13 bp, Homo sapiens
caatgagagcata

SEQ ID NO: 3580699 - DNA, 20 bp, Homo sapiens
caatgatcaccgactgaaaa

SEQ ID NO: 3580700 - DNA, 23 bp, Homo sapiens
caatgatgaccccggcctgtctc

SEQ ID NO: 3580701 - DNA, 16 bp, Homo sapiens
caatgatggcaatttt

SEQ ID NO: 3580702 - DNA, 24 bp, Homo sapiens
caatgatggcaattttgtaacgaa

SEQ ID NO: 3580703 - DNA, 16 bp, Homo sapiens
caatgcacatggtgca

SEQ ID NO: 3580704 - DNA, 19 bp, Homo sapiens
caatgcccagtaaaatttc

SEQ ID NO: 3580705 - DNA, 23 bp, Homo sapiens
caatgcccagtaaaatttcagga

SEQ ID NO: 3580706 - DNA, 22 bp, Homo sapiens
caatgcttgcatggagaatggg

SEQ ID NO: 3580707 - DNA, 18 bp, Homo sapiens
caatggaagaagaaagga

SEQ ID NO: 3580708 - DNA, 20 bp, Homo sapiens
caatgggtcttagctctttc

SEQ ID NO: 3580709 - DNA, 22 bp, Homo sapiens
caatgggtcttagctctttctc

SEQ ID NO: 3580710 - DNA, 17 bp, Homo sapiens
caatgtacttgtttgaa

SEQ ID NO: 3580711 - DNA, 19 bp, Homo sapiens
caatgtccaaacccactca

SEQ ID NO: 3580712 - DNA, 17 bp, Homo sapiens
caatgtccagcagtctg

SEQ ID NO: 3580713 - DNA, 21 bp, Homo sapiens
caatgtgaagttcatcttgca

SEQ ID NO: 3580714 - DNA, 22 bp, Homo sapiens
caatgtgaagttcatcttgcag

SEQ ID NO: 3580715 - DNA, 23 bp, Homo sapiens
caatgtgttttttcggacatgct

SEQ ID NO: 3580716 - DNA, 18 bp, Homo sapiens
caatgttctttgtctcaa

SEQ ID NO: 3580717 - DNA, 15 bp, Homo sapiens
caatgttggagcagc

SEQ ID NO: 3580718 - DNA, 12 bp, Homo sapiens
caattaaacgga

SEQ ID NO: 3580719 - DNA, 15 bp, Homo sapiens
caattaaacggatta

SEQ ID NO: 3580720 - DNA, 16 bp, Homo sapiens
caattaaacggattat

SEQ ID NO: 3580721 - DNA, 15 bp, Homo sapiens
caattagtctgaaac

SEQ ID NO: 3580722 - DNA, 16 bp, Homo sapiens
caattatatctccccc

SEQ ID NO: 3580723 - DNA, 14 bp, Homo sapiens
caattatgtgcaaa

SEQ ID NO: 3580724 - DNA, 23 bp, Homo sapiens
caattatttgcatattttgagaa

SEQ ID NO: 3580725 - DNA, 12 bp, Homo sapiens
caattgaagcat

SEQ ID NO: 3580726 - DNA, 21 bp, Homo sapiens
caattgagggcattagtactt

SEQ ID NO: 3580727 - DNA, 22 bp, Homo sapiens
caattgagggcattagtacttt

SEQ ID NO: 3580728 - DNA, 14 bp, Homo sapiens
caatttcagactcc

SEQ ID NO: 3580729 - DNA, 23 bp, Homo sapiens
caatttctagtacctgtgactct

SEQ ID NO: 3580730 - DNA, 22 bp, Homo sapiens
caattttaccctgaggtcactg

SEQ ID NO: 3580731 - DNA, 20 bp, Homo sapiens
caattttacctattctgaaa

SEQ ID NO: 3580732 - DNA, 21 bp, Homo sapiens
caattttatccctcacctgta

SEQ ID NO: 3580733 - DNA, 20 bp, Homo sapiens
caattttttaagtgaaaata

SEQ ID NO: 3580734 - DNA, 21 bp, Homo sapiens
caattttttaagtgaaaatat

SEQ ID NO: 3580735 - DNA, 17 bp, Homo sapiens
cacaaaaatagagaaaa

SEQ ID NO: 3580736 - DNA, 13 bp, Homo sapiens
cacaaaacaaagc

SEQ ID NO: 3580737 - DNA, 18 bp, Homo sapiens
cacaaaacttcagtgtgg

SEQ ID NO: 3580738 - DNA, 13 bp, Homo sapiens
cacaaaagacagc

SEQ ID NO: 3580739 - DNA, 21 bp, Homo sapiens
cacaaacagaattttccattt

SEQ ID NO: 3580740 - DNA, 13 bp, Homo sapiens
cacaaacctgccc

SEQ ID NO: 3580741 - DNA, 14 bp, Homo sapiens
cacaaacctgcccg

SEQ ID NO: 3580742 - DNA, 13 bp, Homo sapiens
cacaaactccagg

SEQ ID NO: 3580743 - DNA, 22 bp, Homo sapiens
cacaaactgcttcctttcttga

SEQ ID NO: 3580744 - DNA, 14 bp, Homo sapiens
cacaaagcccaagg

SEQ ID NO: 3580745 - DNA, 13 bp, Homo sapiens
cacaaataacaag

SEQ ID NO: 3580746 - DNA, 16 bp, Homo sapiens
cacaaatacattcctt

SEQ ID NO: 3580747 - DNA, 21 bp, Homo sapiens
cacaaatatttattttctttc

SEQ ID NO: 3580748 - DNA, 11 bp, Homo sapiens
cacaacagatt

SEQ ID NO: 3580749 - DNA, 12 bp, Homo sapiens
cacaacagcagt

SEQ ID NO: 3580750 - DNA, 17 bp, Homo sapiens
cacaacagccctgcctg

SEQ ID NO: 3580751 - DNA, 20 bp, Homo sapiens
cacaacagccctgcctgaga

SEQ ID NO: 3580752 - DNA, 20 bp, Homo sapiens
cacaacccttctctgttggt

SEQ ID NO: 3580753 - DNA, 22 bp, Homo sapiens
cacaactactagtgtgactcct

SEQ ID NO: 3580754 - DNA, 16 bp, Homo sapiens
cacaagactggcccag

SEQ ID NO: 3580755 - DNA, 16 bp, Homo sapiens
cacaagctgtccctgc

SEQ ID NO: 3580756 - DNA, 17 bp, Homo sapiens
cacaagctgtccctgca

SEQ ID NO: 3580757 - DNA, 16 bp, Homo sapiens
cacaaggaaccctcag

SEQ ID NO: 3580758 - DNA, 18 bp, Homo sapiens
cacaaggaaccctcaggc

SEQ ID NO: 3580759 - DNA, 12 bp, Homo sapiens
cacaaggacttc

SEQ ID NO: 3580760 - DNA, 13 bp, Homo sapiens
cacaagtggtggt

SEQ ID NO: 3580761 - DNA, 13 bp, Homo sapiens
cacaataagcaaa

SEQ ID NO: 3580762 - DNA, 18 bp, Homo sapiens
cacaataggtctttctct

SEQ ID NO: 3580763 - DNA, 15 bp, Homo sapiens
cacaatgttggagca

SEQ ID NO: 3580764 - DNA, 20 bp, Homo sapiens
cacaatgttggagcagcagg

SEQ ID NO: 3580765 - DNA, 17 bp, Homo sapiens
cacaattattggcaaag

SEQ ID NO: 3580766 - DNA, 19 bp, Homo sapiens
cacacaaggatagatgctg

SEQ ID NO: 3580767 - DNA, 15 bp, Homo sapiens
cacacacagctgggc

SEQ ID NO: 3580768 - DNA, 18 bp, Homo sapiens
cacacactgtgccccaca

SEQ ID NO: 3580769 - DNA, 15 bp, Homo sapiens
cacacagctgagcac

SEQ ID NO: 3580770 - DNA, 16 bp, Homo sapiens
cacacagctgagcact

SEQ ID NO: 3580771 - DNA, 17 bp, Homo sapiens
cacacagctgagcactt

SEQ ID NO: 3580772 - DNA, 18 bp, Homo sapiens
cacacagctgggctgtgg

SEQ ID NO: 3580773 - DNA, 11 bp, Homo sapiens
cacacatatat

SEQ ID NO: 3580774 - DNA, 22 bp, Homo sapiens
cacaccacgtccttattggaat

SEQ ID NO: 3580775 - DNA, 13 bp, Homo sapiens
cacacccaggaag

SEQ ID NO: 3580776 - DNA, 18 bp, Homo sapiens
cacacccctgtcccaccc

SEQ ID NO: 3580777 - DNA, 16 bp, Homo sapiens
cacacctcctcccact

SEQ ID NO: 3580778 - DNA, 15 bp, Homo sapiens
cacacctggccttaa

SEQ ID NO: 3580779 - DNA, 15 bp, Homo sapiens
cactccccagcccca

SEQ ID NO: 3580780 - DNA, 16 bp, Homo sapiens
cactccccagccccag

SEQ ID NO: 3580781 - DNA, 13 bp, Homo sapiens
cactccccaggga

SEQ ID NO: 3580782 - DNA, 19 bp, Homo sapiens
cactccccagggagctctg

SEQ ID NO: 3580783 - DNA, 23 bp, Homo sapiens
cactccccagggagctctgggga

SEQ ID NO: 3580784 - DNA, 12 bp, Homo sapiens
cactcctgggac

SEQ ID NO: 3580785 - DNA, 20 bp, Homo sapiens
cactccttcatgtttggaaa

SEQ ID NO: 3580786 - DNA, 15 bp, Homo sapiens
cactcgaatcattga

SEQ ID NO: 3580787 - DNA, 14 bp, Homo sapiens
cactctacttagca

SEQ ID NO: 3580788 - DNA, 12 bp, Homo sapiens
cactctcagagt

SEQ ID NO: 3580789 - DNA, 15 bp, Homo sapiens
cactctccccgctca

SEQ ID NO: 3580790 - DNA, 20 bp, Homo sapiens
cactctccccgctcaggggc

SEQ ID NO: 3580791 - DNA, 23 bp, Homo sapiens
cactctgggcaaagcccctcaca

SEQ ID NO: 3580792 - DNA, 16 bp, Homo sapiens
cactctgggctccaga

SEQ ID NO: 3580793 - DNA, 22 bp, Homo sapiens
cactcttcagtgactcctgctg

SEQ ID NO: 3580794 - DNA, 15 bp, Homo sapiens
cactcttgatctctc

SEQ ID NO: 3580795 - DNA, 16 bp, Homo sapiens
cactcttgatctctct

SEQ ID NO: 3580796 - DNA, 14 bp, Homo sapiens
cactgaactccacc

SEQ ID NO: 3580797 - DNA, 18 bp, Homo sapiens
cactgaagtttttgaaat

SEQ ID NO: 3580798 - DNA, 20 bp, Homo sapiens
cactgaagtttttgaaatac

SEQ ID NO: 3580799 - DNA, 22 bp, Homo sapiens
cactgaagtttttgaaatacct

SEQ ID NO: 3580800 - DNA, 20 bp, Homo sapiens
cactgactgaactgtaatgt

SEQ ID NO: 3580801 - DNA, 12 bp, Homo sapiens
cactgagaaaga

SEQ ID NO: 3580802 - DNA, 13 bp, Homo sapiens
cactgagaaagag

SEQ ID NO: 3580803 - DNA, 20 bp, Homo sapiens
cactgatatatcatgagtga

SEQ ID NO: 3580804 - DNA, 17 bp, Homo sapiens
cactgatgctgcccctc

SEQ ID NO: 3580805 - DNA, 19 bp, Homo sapiens
cactgatgctgcccctcat

SEQ ID NO: 3580806 - DNA, 15 bp, Homo sapiens
cactgattttgtaaa

SEQ ID NO: 3580807 - DNA, 16 bp, Homo sapiens
cactgcaaacacacct

SEQ ID NO: 3580808 - DNA, 21 bp, Homo sapiens
cactgcaaacacaccttggag

SEQ ID NO: 3580809 - DNA, 17 bp, Homo sapiens
cactgcaacttctgcct

SEQ ID NO: 3580810 - DNA, 21 bp, Homo sapiens
cactgcacagtgcatctcagc

SEQ ID NO: 3580811 - DNA, 23 bp, Homo sapiens
cactgcacagtgcatctcagccc

SEQ ID NO: 3580812 - DNA, 23 bp, Homo sapiens
cactgcagcctcaacctcctggg

SEQ ID NO: 3580813 - DNA, 16 bp, Homo sapiens
cactgcattcctgtgc

SEQ ID NO: 3580814 - DNA, 18 bp, Homo sapiens
cactgcattcctgtgccc

SEQ ID NO: 3580815 - DNA, 13 bp, Homo sapiens
cactgcccactgg

SEQ ID NO: 3580816 - DNA, 16 bp, Homo sapiens
cactgcctcttcctcc

SEQ ID NO: 3580817 - DNA, 22 bp, Homo sapiens
cactgctagagacgctgatcca

SEQ ID NO: 3580818 - DNA, 18 bp, Homo sapiens
cactgctctaacagccct

SEQ ID NO: 3580819 - DNA, 14 bp, Homo sapiens
cactgctgagctgg

SEQ ID NO: 3580820 - DNA, 15 bp, Homo sapiens
cactgctgcccagcc

SEQ ID NO: 3580821 - DNA, 14 bp, Homo sapiens
cactgctggctgcc

SEQ ID NO: 3580822 - DNA, 21 bp, Homo sapiens
cactgctggctgccttagaac

SEQ ID NO: 3580823 - DNA, 18 bp, Homo sapiens
cactgctgttatatttca

SEQ ID NO: 3580824 - DNA, 22 bp, Homo sapiens
cactggaacgtttcactgcaaa

SEQ ID NO: 3580825 - DNA, 16 bp, Homo sapiens
cactggaccactgggc

SEQ ID NO: 3580826 - DNA, 21 bp, Homo sapiens
cactggattgactttgctgtc

SEQ ID NO: 3580827 - DNA, 14 bp, Homo sapiens
cactggcaggtgtg

SEQ ID NO: 3580828 - DNA, 15 bp, Homo sapiens
cactggcctgccatg

SEQ ID NO: 3580829 - DNA, 18 bp, Homo sapiens
cactgggaaacagaggct

SEQ ID NO: 3580830 - DNA, 23 bp, Homo sapiens
cactgggaagctcccaccccact

SEQ ID NO: 3580831 - DNA, 17 bp, Homo sapiens
cactgggacagctggct

SEQ ID NO: 3580832 - DNA, 19 bp, Homo sapiens
cactgggacagctggctgg

SEQ ID NO: 3580833 - DNA, 12 bp, Homo sapiens
cactgggagagc

SEQ ID NO: 3580834 - DNA, 22 bp, Homo sapiens
cactgggccataatgttgcttc

SEQ ID NO: 3580835 - DNA, 23 bp, Homo sapiens
cactggtggcccgacagcctggc

SEQ ID NO: 3580836 - DNA, 18 bp, Homo sapiens
cactggtttgttccctgt

SEQ ID NO: 3580837 - DNA, 22 bp, Homo sapiens
cactgtaatacgtagctctctt

SEQ ID NO: 3580838 - DNA, 14 bp, Homo sapiens
cactgtactaacct

SEQ ID NO: 3580839 - DNA, 15 bp, Homo sapiens
cactgtcctgggcct

SEQ ID NO: 3580840 - DNA, 15 bp, Homo sapiens
cactgtgaaggaccc

SEQ ID NO: 3580841 - DNA, 12 bp, Homo sapiens
cactgtgcagac

SEQ ID NO: 3580842 - DNA, 17 bp, Homo sapiens
cactgtgcagacccagt

SEQ ID NO: 3580843 - DNA, 15 bp, Homo sapiens
cactgtgctggggca

SEQ ID NO: 3580844 - DNA, 20 bp, Homo sapiens
cactgtgcttaatttaaata

SEQ ID NO: 3580845 - DNA, 16 bp, Homo sapiens
cactgtggccaggcct

SEQ ID NO: 3580846 - DNA, 17 bp, Homo sapiens
cactgtggccaggcctt

SEQ ID NO: 3580847 - DNA, 14 bp, Homo sapiens
cactgttgataaaa

SEQ ID NO: 3580848 - DNA, 17 bp, Homo sapiens
cacttaaatttgttctt

SEQ ID NO: 3580849 - DNA, 18 bp, Homo sapiens
cacttaacaaacaaattt

SEQ ID NO: 3580850 - DNA, 17 bp, Homo sapiens
cacttacaagaaaggcc

SEQ ID NO: 3580851 - DNA, 20 bp, Homo sapiens
cacttacacttataaaataa

SEQ ID NO: 3580852 - DNA, 18 bp, Homo sapiens
cacttacactttatgcac

SEQ ID NO: 3580853 - DNA, 24 bp, Homo sapiens
cacttagaaattgcatttcctgac

SEQ ID NO: 3580854 - DNA, 21 bp, Homo sapiens
cacttagcaggcaccgccacg

SEQ ID NO: 3580855 - DNA, 17 bp, Homo sapiens
cacttaggagaagtctt

SEQ ID NO: 3580856 - DNA, 21 bp, Homo sapiens
cacttataaaataacttgcat

SEQ ID NO: 3580857 - DNA, 12 bp, Homo sapiens
cacttattatta

SEQ ID NO: 3580858 - DNA, 23 bp, Homo sapiens
cacttattattaataatgaagta

SEQ ID NO: 3580859 - DNA, 15 bp, Homo sapiens
cacttattgaatata

SEQ ID NO: 3580860 - DNA, 17 bp, Homo sapiens
cacttcacgcccttggc

SEQ ID NO: 3580861 - DNA, 19 bp, Homo sapiens
cacttcacgcccttggcca

SEQ ID NO: 3580862 - DNA, 20 bp, Homo sapiens
cacttcacgcccttggccat

SEQ ID NO: 3580863 - DNA, 15 bp, Homo sapiens
cacttcaggctcttc

SEQ ID NO: 3580864 - DNA, 20 bp, Homo sapiens
cacttcaggctcttctcctt

SEQ ID NO: 3580865 - DNA, 20 bp, Homo sapiens
cacttccataatctggactc

SEQ ID NO: 3580866 - DNA, 14 bp, Homo sapiens
cacttccccctctt

SEQ ID NO: 3580867 - DNA, 14 bp, Homo sapiens
cacttcctgaggcc

SEQ ID NO: 3580868 - DNA, 15 bp, Homo sapiens
cacttcctgaggcct

SEQ ID NO: 3580869 - DNA, 16 bp, Homo sapiens
cacttcctgaggcctc

SEQ ID NO: 3580870 - DNA, 13 bp, Homo sapiens
cacttctggccac

SEQ ID NO: 3580871 - DNA, 23 bp, Homo sapiens
cacttgagaaccagtctcctcac

SEQ ID NO: 3580872 - DNA, 19 bp, Homo sapiens
cacttgatgacccccaacc

SEQ ID NO: 3580873 - DNA, 22 bp, Homo sapiens
cacttgcctatgatactgtctc

SEQ ID NO: 3580874 - DNA, 17 bp, Homo sapiens
cacttgtcgggggccca

SEQ ID NO: 3580875 - DNA, 18 bp, Homo sapiens
cacttgtcgggggcccaa

SEQ ID NO: 3580876 - DNA, 14 bp, Homo sapiens
cactttatattttc

SEQ ID NO: 3580877 - DNA, 20 bp, Homo sapiens
cactttattgccaaaaccca

SEQ ID NO: 3580878 - DNA, 19 bp, Homo sapiens
cactttgcactgatatatc

SEQ ID NO: 3580879 - DNA, 22 bp, Homo sapiens
cactttgcactgatatatcatg

SEQ ID NO: 3580880 - DNA, 21 bp, Homo sapiens
cactttgccaaggctctcccc

SEQ ID NO: 3580881 - DNA, 20 bp, Homo sapiens
cactttgccatttgcttgta

SEQ ID NO: 3580882 - DNA, 16 bp, Homo sapiens
cactttttgaggcaaa

SEQ ID NO: 3580883 - DNA, 20 bp, Homo sapiens
cactttttgaggcaaaagaa

SEQ ID NO: 3580884 - DNA, 14 bp, Homo sapiens
cacttttttataaa

SEQ ID NO: 3580885 - DNA, 11 bp, Homo sapiens
cagaaaaccca

SEQ ID NO: 3580886 - DNA, 21 bp, Homo sapiens
cagaaaacccacggtttttct

SEQ ID NO: 3580887 - DNA, 21 bp, Homo sapiens
cagaaaacctctcctgacccc

SEQ ID NO: 3580888 - DNA, 22 bp, Homo sapiens
cagaaaacctctcctgacccct

SEQ ID NO: 3580889 - DNA, 17 bp, Homo sapiens
cagaaaagtgcctgagc

SEQ ID NO: 3580890 - DNA, 19 bp, Homo sapiens
cagaaaagtgcctgagctg

SEQ ID NO: 3580891 - DNA, 17 bp, Homo sapiens
cagaaaattccctgggg

SEQ ID NO: 3580892 - DNA, 18 bp, Homo sapiens
cagaaaattccctggggt

SEQ ID NO: 3580893 - DNA, 19 bp, Homo sapiens
cagaaaccaacaagaacca

SEQ ID NO: 3580894 - DNA, 16 bp, Homo sapiens
cagaaaccttttattt

SEQ ID NO: 3580895 - DNA, 22 bp, Homo sapiens
cagaaagcatccctcacccatc

SEQ ID NO: 3580896 - DNA, 13 bp, Homo sapiens
cagaaagcctcct

SEQ ID NO: 3580897 - DNA, 19 bp, Homo sapiens
cagaaagcctcctgccccc

SEQ ID NO: 3580898 - DNA, 22 bp, Homo sapiens
cagaaagcctcctgccccctgc

SEQ ID NO: 3580899 - DNA, 12 bp, Homo sapiens
cagaaaggggct

SEQ ID NO: 3580900 - DNA, 18 bp, Homo sapiens
cagaaataaatcacagat

SEQ ID NO: 3580901 - DNA, 21 bp, Homo sapiens
cagaaatacaaaaaattagct

SEQ ID NO: 3580902 - DNA, 16 bp, Homo sapiens
cagaacaaaacttcta

SEQ ID NO: 3580903 - DNA, 19 bp, Homo sapiens
cagaacagatgctgagcca

SEQ ID NO: 3580904 - DNA, 17 bp, Homo sapiens
cagaacagtggtggcaa

SEQ ID NO: 3580905 - DNA, 18 bp, Homo sapiens
cagaacattcagctctgg

SEQ ID NO: 3580906 - DNA, 20 bp, Homo sapiens
cagaacattcagctctggag

SEQ ID NO: 3580907 - DNA, 17 bp, Homo sapiens
cagaacgcaccccactg

SEQ ID NO: 3580908 - DNA, 22 bp, Homo sapiens
cagaacgcaccccactgggaga

SEQ ID NO: 3580909 - DNA, 19 bp, Homo sapiens
cagaacgtggctctgctgg

SEQ ID NO: 3580910 - DNA, 12 bp, Homo sapiens
cagctgcctgca

SEQ ID NO: 3580911 - DNA, 12 bp, Homo sapiens
cagctgctccta

SEQ ID NO: 3580912 - DNA, 19 bp, Homo sapiens
cagctgctcctagagggag

SEQ ID NO: 3580913 - DNA, 20 bp, Homo sapiens
cagctgctgaaacaacaaat

SEQ ID NO: 3580914 - DNA, 21 bp, Homo sapiens
cagctgctgaaacaacaaata

SEQ ID NO: 3580915 - DNA, 20 bp, Homo sapiens
cagctgctttgagctacagg

SEQ ID NO: 3580916 - DNA, 19 bp, Homo sapiens
cagctggaaagttgggccc

SEQ ID NO: 3580917 - DNA, 21 bp, Homo sapiens
cagctggaaagttgggcccct

SEQ ID NO: 3580918 - DNA, 21 bp, Homo sapiens
cagctggacatactgctggag

SEQ ID NO: 3580919 - DNA, 22 bp, Homo sapiens
cagctggacatactgctggagt

SEQ ID NO: 3580920 - DNA, 16 bp, Homo sapiens
cagctggagaagaccc

SEQ ID NO: 3580921 - DNA, 19 bp, Homo sapiens
cagctggcggaggctgctc

SEQ ID NO: 3580922 - DNA, 13 bp, Homo sapiens
cagctggcgggtg

SEQ ID NO: 3580923 - DNA, 12 bp, Homo sapiens
cagctggctggg

SEQ ID NO: 3580924 - DNA, 19 bp, Homo sapiens
cagctggctgggccttcac

SEQ ID NO: 3580925 - DNA, 16 bp, Homo sapiens
cagctgggaagccctt

SEQ ID NO: 3580926 - DNA, 17 bp, Homo sapiens
cagctgggaagcccttt

SEQ ID NO: 3580927 - DNA, 16 bp, Homo sapiens
cagctgggagcactgg

SEQ ID NO: 3580928 - DNA, 16 bp, Homo sapiens
cagctgggagcctggt

SEQ ID NO: 3580929 - DNA, 21 bp, Homo sapiens
cagctgtgctccacactcaga

SEQ ID NO: 3580930 - DNA, 16 bp, Homo sapiens
cagctgtggcagagtt

SEQ ID NO: 3580931 - DNA, 23 bp, Homo sapiens
cagctgtggcagagttacagttc

SEQ ID NO: 3580932 - DNA, 20 bp, Homo sapiens
cagctgtggggaacacagct

SEQ ID NO: 3580933 - DNA, 14 bp, Homo sapiens
cagcttacaggagc

SEQ ID NO: 3580934 - DNA, 16 bp, Homo sapiens
cagcttacaggagcca

SEQ ID NO: 3580935 - DNA, 21 bp, Homo sapiens
cagcttacaggagccagcctg

SEQ ID NO: 3580936 - DNA, 22 bp, Homo sapiens
cagcttacaggagccagcctgc

SEQ ID NO: 3580937 - DNA, 16 bp, Homo sapiens
cagcttcctcacaccc

SEQ ID NO: 3580938 - DNA, 14 bp, Homo sapiens
cagcttctctctcc

SEQ ID NO: 3580939 - DNA, 12 bp, Homo sapiens
cagcttctctgc

SEQ ID NO: 3580940 - DNA, 14 bp, Homo sapiens
cagcttctctgcag

SEQ ID NO: 3580941 - DNA, 16 bp, Homo sapiens
cagcttctctgcagta

SEQ ID NO: 3580942 - DNA, 18 bp, Homo sapiens
cagcttgagtttttagtg

SEQ ID NO: 3580943 - DNA, 16 bp, Homo sapiens
cagcttgctgggcttt

SEQ ID NO: 3580944 - DNA, 12 bp, Homo sapiens
cagcttggctca

SEQ ID NO: 3580945 - DNA, 20 bp, Homo sapiens
cagcttgggcagatctccca

SEQ ID NO: 3580946 - DNA, 19 bp, Homo sapiens
cagcttgtatgcaatggat

SEQ ID NO: 3580947 - DNA, 23 bp, Homo sapiens
cagcttgtatgcaatggattttc

SEQ ID NO: 3580948 - DNA, 13 bp, Homo sapiens
cagctttccctgc

SEQ ID NO: 3580949 - DNA, 18 bp, Homo sapiens
cagctttttattccctgc

SEQ ID NO: 3580950 - DNA, 22 bp, Homo sapiens
cagctttttattccctgcccaa

SEQ ID NO: 3580951 - DNA, 21 bp, Homo sapiens
caggaaaaacaaaacaaagaa

SEQ ID NO: 3580952 - DNA, 20 bp, Homo sapiens
caggaaaataaaatatttaa

SEQ ID NO: 3580953 - DNA, 18 bp, Homo sapiens
caggaaagagctaggaac

SEQ ID NO: 3580954 - DNA, 13 bp, Homo sapiens
caggaaagccaca

SEQ ID NO: 3580955 - DNA, 16 bp, Homo sapiens
caggaaagccacatct

SEQ ID NO: 3580956 - DNA, 22 bp, Homo sapiens
caggaaagccacatcttgctct

SEQ ID NO: 3580957 - DNA, 18 bp, Homo sapiens
caggaaaggcccagccac

SEQ ID NO: 3580958 - DNA, 21 bp, Homo sapiens
caggaaatcaaatatgcaaag

SEQ ID NO: 3580959 - DNA, 22 bp, Homo sapiens
caggaaatcaaatatgcaaagc

SEQ ID NO: 3580960 - DNA, 12 bp, Homo sapiens
caggaagaaact

SEQ ID NO: 3580961 - DNA, 16 bp, Homo sapiens
caggaagaaacttttt

SEQ ID NO: 3580962 - DNA, 17 bp, Homo sapiens
caggaaggaaaactatg

SEQ ID NO: 3580963 - DNA, 19 bp, Homo sapiens
caggaaggaaaactatgta

SEQ ID NO: 3580964 - DNA, 16 bp, Homo sapiens
caggaaggaccccaca

SEQ ID NO: 3580965 - DNA, 19 bp, Homo sapiens
caggaaggaccccacatcc

SEQ ID NO: 3580966 - DNA, 22 bp, Homo sapiens
caggaagggaaagcgggcagcc

SEQ ID NO: 3580967 - DNA, 12 bp, Homo sapiens
caggaattcagt

SEQ ID NO: 3580968 - DNA, 15 bp, Homo sapiens
caggaattcagtgcc

SEQ ID NO: 3580969 - DNA, 17 bp, Homo sapiens
caggaattcagtgcctt

SEQ ID NO: 3580970 - DNA, 19 bp, Homo sapiens
caggaattcagtgccttca

SEQ ID NO: 3580971 - DNA, 19 bp, Homo sapiens
caggaatttcccaggaccc

SEQ ID NO: 3580972 - DNA, 13 bp, Homo sapiens
caggacagatgcc

SEQ ID NO: 3580973 - DNA, 14 bp, Homo sapiens
caggacagatgcca

SEQ ID NO: 3580974 - DNA, 21 bp, Homo sapiens
caggacaggagatgctgtgcc

SEQ ID NO: 3580975 - DNA, 12 bp, Homo sapiens
caggaccagctc

SEQ ID NO: 3580976 - DNA, 13 bp, Homo sapiens
caggaccagctca

SEQ ID NO: 3580977 - DNA, 19 bp, Homo sapiens
caggaccagggttggcacc

SEQ ID NO: 3580978 - DNA, 23 bp, Homo sapiens
caggaccagggttggcaccttcc

SEQ ID NO: 3580979 - DNA, 20 bp, Homo sapiens
caggacccatccctgcctgg

SEQ ID NO: 3580980 - DNA, 24 bp, Homo sapiens
caggacccatccctgcctggaggc

SEQ ID NO: 3580981 - DNA, 13 bp, Homo sapiens
caggaccccagct

SEQ ID NO: 3580982 - DNA, 14 bp, Homo sapiens
caggaccccagctc

SEQ ID NO: 3580983 - DNA, 13 bp, Homo sapiens
caggaccctcagg

SEQ ID NO: 3580984 - DNA, 13 bp, Homo sapiens
caggaccctgaag

SEQ ID NO: 3580985 - DNA, 14 bp, Homo sapiens
caggaccctgaagg

SEQ ID NO: 3580986 - DNA, 19 bp, Homo sapiens
caggaccctgtcctgcagt

SEQ ID NO: 3580987 - DNA, 22 bp, Homo sapiens
caggaccctgtcctgcagtccc

SEQ ID NO: 3580988 - DNA, 24 bp, Homo sapiens
caggaccctgtcctgcagtcccac

SEQ ID NO: 3580989 - DNA, 16 bp, Homo sapiens
caggactcccagaacc

SEQ ID NO: 3580990 - DNA, 22 bp, Homo sapiens
caggactcccagaacctctaag

SEQ ID NO: 3580991 - DNA, 13 bp, Homo sapiens
caggactcctggc

SEQ ID NO: 3580992 - DNA, 15 bp, Homo sapiens
caggactcctggcag

SEQ ID NO: 3580993 - DNA, 19 bp, Homo sapiens
caggactcctggcagggcc

SEQ ID NO: 3580994 - DNA, 19 bp, Homo sapiens
caggactctctccaggagg

SEQ ID NO: 3580995 - DNA, 23 bp, Homo sapiens
caggactctctccaggagggctc

SEQ ID NO: 3580996 - DNA, 16 bp, Homo sapiens
caggactctgcctcct

SEQ ID NO: 3580997 - DNA, 17 bp, Homo sapiens
caggactgtttcaaaca

SEQ ID NO: 3580998 - DNA, 23 bp, Homo sapiens
caggagaatcgcttgaacctggg

SEQ ID NO: 3580999 - DNA, 13 bp, Homo sapiens
caggagacaaaag

SEQ ID NO: 3581000 - DNA, 22 bp, Homo sapiens
caggagacagaccacttgccac

SEQ ID NO: 3581001 - DNA, 14 bp, Homo sapiens
caggagagagccag

SEQ ID NO: 3581002 - DNA, 16 bp, Homo sapiens
caggagagagccagga

SEQ ID NO: 3581003 - DNA, 14 bp, Homo sapiens
caggagaggcagca

SEQ ID NO: 3581004 - DNA, 18 bp, Homo sapiens
caggagatggagggcttg

SEQ ID NO: 3581005 - DNA, 20 bp, Homo sapiens
caggagatggagggcttggc

SEQ ID NO: 3581006 - DNA, 14 bp, Homo sapiens
caggagccagcctg

SEQ ID NO: 3581007 - DNA, 16 bp, Homo sapiens
caggagccagcctgct

SEQ ID NO: 3581008 - DNA, 14 bp, Homo sapiens
caggagccccgcca

SEQ ID NO: 3581009 - DNA, 15 bp, Homo sapiens
caggagccccgccac

SEQ ID NO: 3581010 - DNA, 20 bp, Homo sapiens
caggagccccgccaggtgcc

SEQ ID NO: 3581011 - DNA, 12 bp, Homo sapiens
caggagcctagc

SEQ ID NO: 3581012 - DNA, 18 bp, Homo sapiens
caggagcctagcggagcc

SEQ ID NO: 3581013 - DNA, 12 bp, Homo sapiens
caggagcctggc

SEQ ID NO: 3581014 - DNA, 13 bp, Homo sapiens
caggagcctggcc

SEQ ID NO: 3581015 - DNA, 15 bp, Homo sapiens
caggagcctggccag

SEQ ID NO: 3581016 - DNA, 17 bp, Homo sapiens
caggagcctggccaggc

SEQ ID NO: 3581017 - DNA, 21 bp, Homo sapiens
caggagcctggccaggcaggg

SEQ ID NO: 3581018 - DNA, 16 bp, Homo sapiens
caggagcctgtgcctc

SEQ ID NO: 3581019 - DNA, 14 bp, Homo sapiens
caggaggcctgggc

SEQ ID NO: 3581020 - DNA, 21 bp, Homo sapiens
caggagggaggcaggggaggg

SEQ ID NO: 3581021 - DNA, 13 bp, Homo sapiens
caggagggccagc

SEQ ID NO: 3581022 - DNA, 22 bp, Homo sapiens
caggagggccagcgctgtggac

SEQ ID NO: 3581023 - DNA, 22 bp, Homo sapiens
caggagggctcggggtgtgtca

SEQ ID NO: 3581024 - DNA, 20 bp, Homo sapiens
caggagtctctgccagttac

SEQ ID NO: 3581025 - DNA, 19 bp, Homo sapiens
caggagtgtcctgcccatg

SEQ ID NO: 3581026 - DNA, 21 bp, Homo sapiens
caggagttcgagaccagcctg

SEQ ID NO: 3581027 - DNA, 23 bp, Homo sapiens
caggagttcgagaccagcctggc

SEQ ID NO: 3581028 - DNA, 13 bp, Homo sapiens
caggagtttgtgg

SEQ ID NO: 3581029 - DNA, 16 bp, Homo sapiens
caggataggactccat

SEQ ID NO: 3581030 - DNA, 16 bp, Homo sapiens
caggatatattttatt

SEQ ID NO: 3581031 - DNA, 15 bp, Homo sapiens
caggatcagttaact

SEQ ID NO: 3581032 - DNA, 15 bp, Homo sapiens
caggatccagtgaca

SEQ ID NO: 3581033 - DNA, 23 bp, Homo sapiens
caggatgctaacatctaaaaata

SEQ ID NO: 3581034 - DNA, 19 bp, Homo sapiens
caggattaactaaagaaga

SEQ ID NO: 3581035 - DNA, 21 bp, Homo sapiens
caggattaactaaagaagagg

SEQ ID NO: 3581036 - DNA, 14 bp, Homo sapiens
caggattctctgca

SEQ ID NO: 3581037 - DNA, 16 bp, Homo sapiens
caggattttaatcttt

SEQ ID NO: 3581038 - DNA, 18 bp, Homo sapiens
caggcaaaatccttgctt

SEQ ID NO: 3581039 - DNA, 22 bp, Homo sapiens
caggcaacgcacaaaacagaaa

SEQ ID NO: 3581040 - DNA, 16 bp, Homo sapiens
caggcacaccttgcag

SEQ ID NO: 3581041 - DNA, 17 bp, Homo sapiens
caggcacagcagctgca

SEQ ID NO: 3581042 - DNA, 15 bp, Homo sapiens
cagtgcctattgata

SEQ ID NO: 3581043 - DNA, 13 bp, Homo sapiens
cagtgcctccaca

SEQ ID NO: 3581044 - DNA, 23 bp, Homo sapiens
cagtgcctccacatgctgcctgg

SEQ ID NO: 3581045 - DNA, 13 bp, Homo sapiens
cagtgccttcaac

SEQ ID NO: 3581046 - DNA, 13 bp, Homo sapiens
cagtggatcttca

SEQ ID NO: 3581047 - DNA, 15 bp, Homo sapiens
cagtggatcttcaga

SEQ ID NO: 3581048 - DNA, 18 bp, Homo sapiens
cagtggatcttcagaact

SEQ ID NO: 3581049 - DNA, 14 bp, Homo sapiens
cagtggcaggggag

SEQ ID NO: 3581050 - DNA, 16 bp, Homo sapiens
cagtggcaggggagca

SEQ ID NO: 3581051 - DNA, 14 bp, Homo sapiens
cagtggcctcttga

SEQ ID NO: 3581052 - DNA, 16 bp, Homo sapiens
cagtggggcagcctct

SEQ ID NO: 3581053 - DNA, 15 bp, Homo sapiens
cagtggggctgcagg

SEQ ID NO: 3581054 - DNA, 19 bp, Homo sapiens
cagtggggctgcaggcagg

SEQ ID NO: 3581055 - DNA, 16 bp, Homo sapiens
cagtggtgaccccctt

SEQ ID NO: 3581056 - DNA, 17 bp, Homo sapiens
cagtggtgggtaattgt

SEQ ID NO: 3581057 - DNA, 21 bp, Homo sapiens
cagtggtgggtaattgtacaa

SEQ ID NO: 3581058 - DNA, 14 bp, Homo sapiens
cagtggttgcctgg

SEQ ID NO: 3581059 - DNA, 16 bp, Homo sapiens
cagtggttgcctgggg

SEQ ID NO: 3581060 - DNA, 13 bp, Homo sapiens
cagtgtctaggca

SEQ ID NO: 3581061 - DNA, 19 bp, Homo sapiens
cagtgtgagatactgtgta

SEQ ID NO: 3581062 - DNA, 20 bp, Homo sapiens
cagtgtgccagtttaaaaag

SEQ ID NO: 3581063 - DNA, 16 bp, Homo sapiens
cagtgtgtcagttttt

SEQ ID NO: 3581064 - DNA, 20 bp, Homo sapiens
cagtgtgtcagtttttcctc

SEQ ID NO: 3581065 - DNA, 21 bp, Homo sapiens
cagtgttcctgaagctgctgt

SEQ ID NO: 3581066 - DNA, 20 bp, Homo sapiens
cagtgttccttgtgcccgtg

SEQ ID NO: 3581067 - DNA, 17 bp, Homo sapiens
cagtgttgcgtttttcc

SEQ ID NO: 3581068 - DNA, 19 bp, Homo sapiens
cagtgttttcattttagac

SEQ ID NO: 3581069 - DNA, 22 bp, Homo sapiens
cagttaccacagcaactgacct

SEQ ID NO: 3581070 - DNA, 21 bp, Homo sapiens
cagttactccctacactgatg

SEQ ID NO: 3581071 - DNA, 23 bp, Homo sapiens
cagttactccctacactgatgca

SEQ ID NO: 3581072 - DNA, 15 bp, Homo sapiens
cagttacttgggctt

SEQ ID NO: 3581073 - DNA, 15 bp, Homo sapiens
cagttatatattttg

SEQ ID NO: 3581074 - DNA, 13 bp, Homo sapiens
cagttatggctat

SEQ ID NO: 3581075 - DNA, 20 bp, Homo sapiens
cagttatggctataggtgct

SEQ ID NO: 3581076 - DNA, 23 bp, Homo sapiens
cagttcagaatggcagtcctgga

SEQ ID NO: 3581077 - DNA, 18 bp, Homo sapiens
cagttcctgtcccacatg

SEQ ID NO: 3581078 - DNA, 15 bp, Homo sapiens
cagttctaggccttt

SEQ ID NO: 3581079 - DNA, 20 bp, Homo sapiens
cagttctaggcctttcctct

SEQ ID NO: 3581080 - DNA, 21 bp, Homo sapiens
cagttctaggcctttcctctg

SEQ ID NO: 3581081 - DNA, 15 bp, Homo sapiens
cagttctatttaaaa

SEQ ID NO: 3581082 - DNA, 20 bp, Homo sapiens
cagttctgaataacttgaag

SEQ ID NO: 3581083 - DNA, 20 bp, Homo sapiens
cagttctgtggtttcatgtt

SEQ ID NO: 3581084 - DNA, 18 bp, Homo sapiens
cagttcttacacattcca

SEQ ID NO: 3581085 - DNA, 18 bp, Homo sapiens
cagttctttgggccagac

SEQ ID NO: 3581086 - DNA, 23 bp, Homo sapiens
cagttgaaaagactccaaagaaa

SEQ ID NO: 3581087 - DNA, 14 bp, Homo sapiens
cagttgatggagcc

SEQ ID NO: 3581088 - DNA, 15 bp, Homo sapiens
cagttgatggagccc

SEQ ID NO: 3581089 - DNA, 17 bp, Homo sapiens
cagttgatggagcccca

SEQ ID NO: 3581090 - DNA, 18 bp, Homo sapiens
cagttgcatgctagcatg

SEQ ID NO: 3581091 - DNA, 14 bp, Homo sapiens
cagttggtaacttt

SEQ ID NO: 3581092 - DNA, 16 bp, Homo sapiens
cagttggtaacttttg

SEQ ID NO: 3581093 - DNA, 21 bp, Homo sapiens
cagttgttatattcattcttt

SEQ ID NO: 3581094 - DNA, 17 bp, Homo sapiens
cagttgttatttattga

SEQ ID NO: 3581095 - DNA, 17 bp, Homo sapiens
cagtttaaaaagatgaa

SEQ ID NO: 3581096 - DNA, 16 bp, Homo sapiens
cagtttaagccgcaga

SEQ ID NO: 3581097 - DNA, 17 bp, Homo sapiens
cagtttattgatattca

SEQ ID NO: 3581098 - DNA, 18 bp, Homo sapiens
cagtttattgatattcaa

SEQ ID NO: 3581099 - DNA, 20 bp, Homo sapiens
cagtttccagagagtggaga

SEQ ID NO: 3581100 - DNA, 14 bp, Homo sapiens
cagtttcctcagtg

SEQ ID NO: 3581101 - DNA, 22 bp, Homo sapiens
cagtttcctcagtgatggaata

SEQ ID NO: 3581102 - DNA, 21 bp, Homo sapiens
cagtttcttgcttggaagcca

SEQ ID NO: 3581103 - DNA, 21 bp, Homo sapiens
cagtttgaggaagtggctgtc

SEQ ID NO: 3581104 - DNA, 13 bp, Homo sapiens
cagtttttcctcc

SEQ ID NO: 3581105 - DNA, 19 bp, Homo sapiens
cataaaaaggacatcagca

SEQ ID NO: 3581106 - DNA, 22 bp, Homo sapiens
cataaaaaggacatcagcaaac

SEQ ID NO: 3581107 - DNA, 13 bp, Homo sapiens
cataaaacagaat

SEQ ID NO: 3581108 - DNA, 16 bp, Homo sapiens
cataaaagaaataaac

SEQ ID NO: 3581109 - DNA, 17 bp, Homo sapiens
cataaaagccccagctt

SEQ ID NO: 3581110 - DNA, 14 bp, Homo sapiens
cataaaataaataa

SEQ ID NO: 3581111 - DNA, 22 bp, Homo sapiens
cataaaatcaaaacaagtgaaa

SEQ ID NO: 3581112 - DNA, 15 bp, Homo sapiens
cataaacaaagacat

SEQ ID NO: 3581113 - DNA, 16 bp, Homo sapiens
cataaacaaagacatt

SEQ ID NO: 3581114 - DNA, 18 bp, Homo sapiens
cataaatcatgttgttgt

SEQ ID NO: 3581115 - DNA, 17 bp, Homo sapiens
cataaattatttgatta

SEQ ID NO: 3581116 - DNA, 20 bp, Homo sapiens
cataaatttactttacacaa

SEQ ID NO: 3581117 - DNA, 15 bp, Homo sapiens
cataacaacttcata

SEQ ID NO: 3581118 - DNA, 18 bp, Homo sapiens
cataaccctgtcacccac

SEQ ID NO: 3581119 - DNA, 16 bp, Homo sapiens
cataactcctgtccct

SEQ ID NO: 3581120 - DNA, 22 bp, Homo sapiens
cataactcctgtcccttttccc

SEQ ID NO: 3581121 - DNA, 14 bp, Homo sapiens
cataagagaaacct

SEQ ID NO: 3581122 - DNA, 22 bp, Homo sapiens
cataagctatcacctagcagcc

SEQ ID NO: 3581123 - DNA, 22 bp, Homo sapiens
cataagcttggtgacaaaattc

SEQ ID NO: 3581124 - DNA, 20 bp, Homo sapiens
cataatctggactcctctgt

SEQ ID NO: 3581125 - DNA, 22 bp, Homo sapiens
cataatggggtcctggccatcc

SEQ ID NO: 3581126 - DNA, 18 bp, Homo sapiens
cataattcagcacttaac

SEQ ID NO: 3581127 - DNA, 14 bp, Homo sapiens
cataatttaaaaat

SEQ ID NO: 3581128 - DNA, 13 bp, Homo sapiens
catacaaatttat

SEQ ID NO: 3581129 - DNA, 14 bp, Homo sapiens
catacacctcgtca

SEQ ID NO: 3581130 - DNA, 15 bp, Homo sapiens
catacagagtgggcc

SEQ ID NO: 3581131 - DNA, 20 bp, Homo sapiens
catacataaaagaaataaac

SEQ ID NO: 3581132 - DNA, 17 bp, Homo sapiens
cataccaacacgagcag

SEQ ID NO: 3581133 - DNA, 15 bp, Homo sapiens
catacctgcccctgc

SEQ ID NO: 3581134 - DNA, 17 bp, Homo sapiens
catacctgcccctgcct

SEQ ID NO: 3581135 - DNA, 14 bp, Homo sapiens
cataccttttctct

SEQ ID NO: 3581136 - DNA, 18 bp, Homo sapiens
cataccttttctcttttc

SEQ ID NO: 3581137 - DNA, 19 bp, Homo sapiens
catacgctctcgtctctcg

SEQ ID NO: 3581138 - DNA, 18 bp, Homo sapiens
catacttgaagggccaga

SEQ ID NO: 3581139 - DNA, 21 bp, Homo sapiens
catacttgaagggccagagcc

SEQ ID NO: 3581140 - DNA, 14 bp, Homo sapiens
catacttttcaaag

SEQ ID NO: 3581141 - DNA, 23 bp, Homo sapiens
catagaaatgtaacttttgtaag

SEQ ID NO: 3581142 - DNA, 18 bp, Homo sapiens
catagattccctgagcag

SEQ ID NO: 3581143 - DNA, 19 bp, Homo sapiens
catagcaagcttttgctca

SEQ ID NO: 3581144 - DNA, 19 bp, Homo sapiens
cataggaagttaaaagcac

SEQ ID NO: 3581145 - DNA, 23 bp, Homo sapiens
cataggtctaaataggatcctgg

SEQ ID NO: 3581146 - DNA, 19 bp, Homo sapiens
catagtgatagagtgcagt

SEQ ID NO: 3581147 - DNA, 18 bp, Homo sapiens
catagtgatggttcccct

SEQ ID NO: 3581148 - DNA, 22 bp, Homo sapiens
catagtgatggttcccctgttc

SEQ ID NO: 3581149 - DNA, 11 bp, Homo sapiens
catataaatgt

SEQ ID NO: 3581150 - DNA, 15 bp, Homo sapiens
catataaatgtttat

SEQ ID NO: 3581151 - DNA, 17 bp, Homo sapiens
catataaatgtttatat

SEQ ID NO: 3581152 - DNA, 18 bp, Homo sapiens
catataagacaaatattc

SEQ ID NO: 3581153 - DNA, 23 bp, Homo sapiens
catataagattcatatttacttc

SEQ ID NO: 3581154 - DNA, 15 bp, Homo sapiens
catatagaccaattg

SEQ ID NO: 3581155 - DNA, 22 bp, Homo sapiens
catatagaccaattgaagcatg

SEQ ID NO: 3581156 - DNA, 14 bp, Homo sapiens
catatagagatgaa

SEQ ID NO: 3581157 - DNA, 20 bp, Homo sapiens
catatagagatgaagtttgt

SEQ ID NO: 3581158 - DNA, 16 bp, Homo sapiens
catatataaattatta

SEQ ID NO: 3581159 - DNA, 19 bp, Homo sapiens
catatataaattattactt

SEQ ID NO: 3581160 - DNA, 22 bp, Homo sapiens
catatatttttaaaaaatgaaa

SEQ ID NO: 3581161 - DNA, 16 bp, Homo sapiens
catatcacatgtcagc

SEQ ID NO: 3581162 - DNA, 22 bp, Homo sapiens
catatcacatgtcagccactgt

SEQ ID NO: 3581163 - DNA, 12 bp, Homo sapiens
catatcccacca

SEQ ID NO: 3581164 - DNA, 21 bp, Homo sapiens
catatgaacagctgttcagtt

SEQ ID NO: 3581165 - DNA, 13 bp, Homo sapiens
catatgatctgtt

SEQ ID NO: 3581166 - DNA, 22 bp, Homo sapiens
catatgggatattcccaagccg

SEQ ID NO: 3581167 - DNA, 17 bp, Homo sapiens
catatggtaggaccctc

SEQ ID NO: 3581168 - DNA, 13 bp, Homo sapiens
catatgtaaacat

SEQ ID NO: 3581169 - DNA, 15 bp, Homo sapiens
catatgtaaacataa

SEQ ID NO: 3581170 - DNA, 16 bp, Homo sapiens
catatgtcactagaat

SEQ ID NO: 3581171 - DNA, 15 bp, Homo sapiens
catattacctggatt

SEQ ID NO: 3581172 - DNA, 14 bp, Homo sapiens
catattatgcctga

SEQ ID NO: 3581173 - DNA, 15 bp, Homo sapiens
catattatgcctgaa

SEQ ID NO: 3581174 - DNA, 17 bp, Homo sapiens
ccaacctcaggctccta

SEQ ID NO: 3581175 - DNA, 20 bp, Homo sapiens
ccaacctccagactcagcag

SEQ ID NO: 3581176 - DNA, 18 bp, Homo sapiens
ccaacctccagtgtcagg

SEQ ID NO: 3581177 - DNA, 23 bp, Homo sapiens
ccaacctccagtgtcagggtcca

SEQ ID NO: 3581178 - DNA, 24 bp, Homo sapiens
ccaacctctgtggtcacccatgca

SEQ ID NO: 3581179 - DNA, 17 bp, Homo sapiens
ccaacctgcaaagatct

SEQ ID NO: 3581180 - DNA, 19 bp, Homo sapiens
ccaacctgcaaagatctgt

SEQ ID NO: 3581181 - DNA, 12 bp, Homo sapiens
ccaacgcccctg

SEQ ID NO: 3581182 - DNA, 17 bp, Homo sapiens
ccaacgcccctgtggcc

SEQ ID NO: 3581183 - DNA, 18 bp, Homo sapiens
ccaacgcccctgtggcca

SEQ ID NO: 3581184 - DNA, 15 bp, Homo sapiens
ccaacggcaacagca

SEQ ID NO: 3581185 - DNA, 14 bp, Homo sapiens
ccaactactaatag

SEQ ID NO: 3581186 - DNA, 22 bp, Homo sapiens
ccaactactaatagaataaagg

SEQ ID NO: 3581187 - DNA, 14 bp, Homo sapiens
ccaactccaggggc

SEQ ID NO: 3581188 - DNA, 15 bp, Homo sapiens
ccaactccaggggca

SEQ ID NO: 3581189 - DNA, 14 bp, Homo sapiens
ccaactctagctgg

SEQ ID NO: 3581190 - DNA, 21 bp, Homo sapiens
ccaactctagctgggggtggg

SEQ ID NO: 3581191 - DNA, 14 bp, Homo sapiens
ccaactgtttccct

SEQ ID NO: 3581192 - DNA, 19 bp, Homo sapiens
ccaactgtttccctgctga

SEQ ID NO: 3581193 - DNA, 20 bp, Homo sapiens
ccaactgtttccctgctgaa

SEQ ID NO: 3581194 - DNA, 11 bp, Homo sapiens
ccaacttgtaa

SEQ ID NO: 3581195 - DNA, 20 bp, Homo sapiens
ccaagaatagatgctgactg

SEQ ID NO: 3581196 - DNA, 20 bp, Homo sapiens
ccaagagatctgtgtggctc

SEQ ID NO: 3581197 - DNA, 21 bp, Homo sapiens
ccaagagctactcccacagca

SEQ ID NO: 3581198 - DNA, 16 bp, Homo sapiens
ccaagatgtggccttt

SEQ ID NO: 3581199 - DNA, 17 bp, Homo sapiens
ccaagatgttctcctga

SEQ ID NO: 3581200 - DNA, 14 bp, Homo sapiens
ccaagccagattct

SEQ ID NO: 3581201 - DNA, 23 bp, Homo sapiens
ccaagccgaccttccctccgcct

SEQ ID NO: 3581202 - DNA, 16 bp, Homo sapiens
ccaagccgtggcttcc

SEQ ID NO: 3581203 - DNA, 17 bp, Homo sapiens
ccaagccgtggcttccc

SEQ ID NO: 3581204 - DNA, 13 bp, Homo sapiens
ccaagcttcccaa

SEQ ID NO: 3581205 - DNA, 18 bp, Homo sapiens
ccaaggaatttaaaactg

SEQ ID NO: 3581206 - DNA, 21 bp, Homo sapiens
ccaaggagcatccttggcagt

SEQ ID NO: 3581207 - DNA, 12 bp, Homo sapiens
ccaaggagctgc

SEQ ID NO: 3581208 - DNA, 14 bp, Homo sapiens
ccaaggagctgcta

SEQ ID NO: 3581209 - DNA, 18 bp, Homo sapiens
ccaaggcagcgaccccag

SEQ ID NO: 3581210 - DNA, 19 bp, Homo sapiens
ccaaggcagcgaccccagg

SEQ ID NO: 3581211 - DNA, 16 bp, Homo sapiens
ccaaggctctgagcaa

SEQ ID NO: 3581212 - DNA, 18 bp, Homo sapiens
ccaagggagactgaccat

SEQ ID NO: 3581213 - DNA, 13 bp, Homo sapiens
ccaagggcccaaa

SEQ ID NO: 3581214 - DNA, 17 bp, Homo sapiens
ccaagggggctgctgct

SEQ ID NO: 3581215 - DNA, 15 bp, Homo sapiens
ccaagggtttcgact

SEQ ID NO: 3581216 - DNA, 20 bp, Homo sapiens
ccaagggtttcgactggtcc

SEQ ID NO: 3581217 - DNA, 22 bp, Homo sapiens
ccaagggtttcgactggtccag

SEQ ID NO: 3581218 - DNA, 19 bp, Homo sapiens
ccaagtgccccaccactcc

SEQ ID NO: 3581219 - DNA, 13 bp, Homo sapiens
ccaagtggctccc

SEQ ID NO: 3581220 - DNA, 18 bp, Homo sapiens
ccaagtggtgagcaagca

SEQ ID NO: 3581221 - DNA, 16 bp, Homo sapiens
ccaataaacagctccc

SEQ ID NO: 3581222 - DNA, 12 bp, Homo sapiens
ccaataaagctt

SEQ ID NO: 3581223 - DNA, 11 bp, Homo sapiens
ccaataaattc

SEQ ID NO: 3581224 - DNA, 16 bp, Homo sapiens
ccaataaattctaaat

SEQ ID NO: 3581225 - DNA, 23 bp, Homo sapiens
ccaatcactgtgcttaatttaaa

SEQ ID NO: 3581226 - DNA, 23 bp, Homo sapiens
ccaatgacacccatgccagagag

SEQ ID NO: 3581227 - DNA, 14 bp, Homo sapiens
ccaatgactgagca

SEQ ID NO: 3581228 - DNA, 12 bp, Homo sapiens
ccaatgctgctt

SEQ ID NO: 3581229 - DNA, 14 bp, Homo sapiens
ccaattctcccctc

SEQ ID NO: 3581230 - DNA, 17 bp, Homo sapiens
ccaattctggacagaca

SEQ ID NO: 3581231 - DNA, 18 bp, Homo sapiens
ccaattctggacagacag

SEQ ID NO: 3581232 - DNA, 19 bp, Homo sapiens
ccaattctttagtgctgat

SEQ ID NO: 3581233 - DNA, 11 bp, Homo sapiens
ccaatttaagg

SEQ ID NO: 3581234 - DNA, 23 bp, Homo sapiens
ccaattttttaagtgaaaatata

SEQ ID NO: 3581235 - DNA, 14 bp, Homo sapiens
ccacaaactccagg

SEQ ID NO: 3581236 - DNA, 23 bp, Homo sapiens
ccacaaactccaggctggaagta

SEQ ID NO: 3581237 - DNA, 16 bp, Homo sapiens
ccacaaatgcaggtgt

SEQ ID NO: 3581238 - DNA, 23 bp, Homo sapiens
ccacaactactagtgtgactcct

SEQ ID NO: 3581239 - DNA, 19 bp, Homo sapiens
ccacaagctgtccctgcag

SEQ ID NO: 3581240 - DNA, 20 bp, Homo sapiens
ccacaagctgtccctgcagg

SEQ ID NO: 3581241 - DNA, 19 bp, Homo sapiens
ccacaaggaaccctcaggc

SEQ ID NO: 3581242 - DNA, 17 bp, Homo sapiens
ccacaaggacttcctgt

SEQ ID NO: 3581243 - DNA, 17 bp, Homo sapiens
ccacaagtccagctggg

SEQ ID NO: 3581244 - DNA, 21 bp, Homo sapiens
ccacaagtggtggtaaccctg

SEQ ID NO: 3581245 - DNA, 22 bp, Homo sapiens
ccacaagtggtggtaaccctgg

SEQ ID NO: 3581246 - DNA, 15 bp, Homo sapiens
ccacaagttaaataa

SEQ ID NO: 3581247 - DNA, 20 bp, Homo sapiens
ccacaattgaacttccagga

SEQ ID NO: 3581248 - DNA, 20 bp, Homo sapiens
ccacacacagctgggctgtg

SEQ ID NO: 3581249 - DNA, 14 bp, Homo sapiens
ccacacagctgccc

SEQ ID NO: 3581250 - DNA, 17 bp, Homo sapiens
ccacacagctgccctag

SEQ ID NO: 3581251 - DNA, 15 bp, Homo sapiens
ccacacccaccccct

SEQ ID NO: 3581252 - DNA, 14 bp, Homo sapiens
ccacacccaggaag

SEQ ID NO: 3581253 - DNA, 17 bp, Homo sapiens
ccacacccaggaaggga

SEQ ID NO: 3581254 - DNA, 22 bp, Homo sapiens
ccacaccgtggcagcttgctgg

SEQ ID NO: 3581255 - DNA, 14 bp, Homo sapiens
ccacacctggcctt

SEQ ID NO: 3581256 - DNA, 16 bp, Homo sapiens
ccacacctggccttaa

SEQ ID NO: 3581257 - DNA, 13 bp, Homo sapiens
ccacactcagaaa

SEQ ID NO: 3581258 - DNA, 22 bp, Homo sapiens
ccacactcagaaaattccctgg

SEQ ID NO: 3581259 - DNA, 21 bp, Homo sapiens
ccacacttcaggctcttctcc

SEQ ID NO: 3581260 - DNA, 22 bp, Homo sapiens
ccacacttcaggctcttctcct

SEQ ID NO: 3581261 - DNA, 23 bp, Homo sapiens
ccacagaaccttcaacccagtgg

SEQ ID NO: 3581262 - DNA, 17 bp, Homo sapiens
ccacagacccctgggag

SEQ ID NO: 3581263 - DNA, 12 bp, Homo sapiens
ccacagcagttg

SEQ ID NO: 3581264 - DNA, 18 bp, Homo sapiens
ccacagcagttgaaaaga

SEQ ID NO: 3581265 - DNA, 23 bp, Homo sapiens
ccacagcagttgaaaagactcca

SEQ ID NO: 3581266 - DNA, 19 bp, Homo sapiens
ccacagccttcggacagac

SEQ ID NO: 3581267 - DNA, 21 bp, Homo sapiens
ccacagctatttagaagcatc

SEQ ID NO: 3581268 - DNA, 13 bp, Homo sapiens
ccacagctggaaa

SEQ ID NO: 3581269 - DNA, 18 bp, Homo sapiens
ccacaggagggccagcgc

SEQ ID NO: 3581270 - DNA, 15 bp, Homo sapiens
ccacaggcataagct

SEQ ID NO: 3581271 - DNA, 19 bp, Homo sapiens
ccacagtggggctgcaggc

SEQ ID NO: 3581272 - DNA, 22 bp, Homo sapiens
ccacagtggggctgcaggcagg

SEQ ID NO: 3581273 - DNA, 22 bp, Homo sapiens
ccacagttctgacgctgacaat

SEQ ID NO: 3581274 - DNA, 17 bp, Homo sapiens
ccacataaaagccccag

SEQ ID NO: 3581275 - DNA, 19 bp, Homo sapiens
ccacataaaagccccagct

SEQ ID NO: 3581276 - DNA, 24 bp, Homo sapiens
ccacataaaagccccagcttggct

SEQ ID NO: 3581277 - DNA, 21 bp, Homo sapiens
ccacataaccctgtcacccac

SEQ ID NO: 3581278 - DNA, 14 bp, Homo sapiens
ccacatcagcccca

SEQ ID NO: 3581279 - DNA, 17 bp, Homo sapiens
ccacatgaggccatctc

SEQ ID NO: 3581280 - DNA, 15 bp, Homo sapiens
ccacatggagccccc

SEQ ID NO: 3581281 - DNA, 13 bp, Homo sapiens
ccacatggccatc

SEQ ID NO: 3581282 - DNA, 14 bp, Homo sapiens
ccacattgctggct

SEQ ID NO: 3581283 - DNA, 16 bp, Homo sapiens
ccacatttagtcctgt

SEQ ID NO: 3581284 - DNA, 20 bp, Homo sapiens
ccaccaataaatcagaccat

SEQ ID NO: 3581285 - DNA, 21 bp, Homo sapiens
ccaccaccctgccccccctaa

SEQ ID NO: 3581286 - DNA, 15 bp, Homo sapiens
ccaccactcaggcca

SEQ ID NO: 3581287 - DNA, 16 bp, Homo sapiens
ccaccactcaggccac

SEQ ID NO: 3581288 - DNA, 23 bp, Homo sapiens
ccaccagcgaactctcagaaata

SEQ ID NO: 3581289 - DNA, 14 bp, Homo sapiens
ccaccatgcccagc

SEQ ID NO: 3581290 - DNA, 19 bp, Homo sapiens
ccaccatgcttgcctgaag

SEQ ID NO: 3581291 - DNA, 22 bp, Homo sapiens
ccaccatgcttgcctgaagctt

SEQ ID NO: 3581292 - DNA, 19 bp, Homo sapiens
ccacccacaaactccaggc

SEQ ID NO: 3581293 - DNA, 15 bp, Homo sapiens
ccacccacacagctg

SEQ ID NO: 3581294 - DNA, 16 bp, Homo sapiens
ccacccacacagctgc

SEQ ID NO: 3581295 - DNA, 19 bp, Homo sapiens
ccacccacacagctgccct

SEQ ID NO: 3581296 - DNA, 20 bp, Homo sapiens
ccacccacacagctgcccta

SEQ ID NO: 3581297 - DNA, 12 bp, Homo sapiens
ccacccagcagg

SEQ ID NO: 3581298 - DNA, 18 bp, Homo sapiens
ccaccccatccagttcat

SEQ ID NO: 3581299 - DNA, 14 bp, Homo sapiens
ccacccccaggtgc

SEQ ID NO: 3581300 - DNA, 16 bp, Homo sapiens
ccaccccccactcagt

SEQ ID NO: 3581301 - DNA, 19 bp, Homo sapiens
ccacccccttccctgggag

SEQ ID NO: 3581302 - DNA, 23 bp, Homo sapiens
ccaccccgagggctgagcctggt

SEQ ID NO: 3581303 - DNA, 11 bp, Homo sapiens
ccacccctcac

SEQ ID NO: 3581304 - DNA, 14 bp, Homo sapiens
ccacccctcactcc

SEQ ID NO: 3581305 - DNA, 23 bp, Homo sapiens
ccacccctcactccccagggagc

SEQ ID NO: 3581306 - DNA, 22 bp, Homo sapiens
cccccatgttgtaatgctgcac

SEQ ID NO: 3581307 - DNA, 12 bp, Homo sapiens
ccccccacccct

SEQ ID NO: 3581308 - DNA, 13 bp, Homo sapiens
ccccccacccctg

SEQ ID NO: 3581309 - DNA, 13 bp, Homo sapiens
ccccccactccca

SEQ ID NO: 3581310 - DNA, 14 bp, Homo sapiens
ccccccatgcactg

SEQ ID NO: 3581311 - DNA, 13 bp, Homo sapiens
ccccctaagagac

SEQ ID NO: 3581312 - DNA, 19 bp, Homo sapiens
ccccctcagccttgggacc

SEQ ID NO: 3581313 - DNA, 23 bp, Homo sapiens
ccccctctgccggtcgggcagcc

SEQ ID NO: 3581314 - DNA, 13 bp, Homo sapiens
ccccctctgctgc

SEQ ID NO: 3581315 - DNA, 13 bp, Homo sapiens
ccccctctggaga

SEQ ID NO: 3581316 - DNA, 18 bp, Homo sapiens
ccccctgggctggggcct

SEQ ID NO: 3581317 - DNA, 11 bp, Homo sapiens
cccccttcagg

SEQ ID NO: 3581318 - DNA, 15 bp, Homo sapiens
cccccttcaggagcc

SEQ ID NO: 3581319 - DNA, 22 bp, Homo sapiens
cccccttcaggagcctggccag

SEQ ID NO: 3581320 - DNA, 17 bp, Homo sapiens
cccccttcccctaccca

SEQ ID NO: 3581321 - DNA, 14 bp, Homo sapiens
cccccttccctggg

SEQ ID NO: 3581322 - DNA, 12 bp, Homo sapiens
ccccgacacacg

SEQ ID NO: 3581323 - DNA, 18 bp, Homo sapiens
ccccgacgtttgcggcag

SEQ ID NO: 3581324 - DNA, 16 bp, Homo sapiens
ccccgagaaccctgag

SEQ ID NO: 3581325 - DNA, 16 bp, Homo sapiens
ccccgagaagtgctct

SEQ ID NO: 3581326 - DNA, 22 bp, Homo sapiens
ccccgcagacggtctgtgtgct

SEQ ID NO: 3581327 - DNA, 21 bp, Homo sapiens
ccccgccatgcatgcagcgcc

SEQ ID NO: 3581328 - DNA, 16 bp, Homo sapiens
ccccgcccctcccacg

SEQ ID NO: 3581329 - DNA, 18 bp, Homo sapiens
ccccgcgctcgcccagca

SEQ ID NO: 3581330 - DNA, 22 bp, Homo sapiens
ccccgcgctcgcccagcaggag

SEQ ID NO: 3581331 - DNA, 20 bp, Homo sapiens
ccccgctcaggggcctggag

SEQ ID NO: 3581332 - DNA, 15 bp, Homo sapiens
ccccgggctggagaa

SEQ ID NO: 3581333 - DNA, 18 bp, Homo sapiens
ccccgggctggagaaaga

SEQ ID NO: 3581334 - DNA, 17 bp, Homo sapiens
ccccgtcggactgcccc

SEQ ID NO: 3581335 - DNA, 15 bp, Homo sapiens
ccccgtctctgccct

SEQ ID NO: 3581336 - DNA, 22 bp, Homo sapiens
ccccgtctctgccctgggctcc

SEQ ID NO: 3581337 - DNA, 22 bp, Homo sapiens
cccctaaaccccaagcttccca

SEQ ID NO: 3581338 - DNA, 18 bp, Homo sapiens
cccctaaagagcatcctg

SEQ ID NO: 3581339 - DNA, 21 bp, Homo sapiens
cccctaaagagcatcctgata

SEQ ID NO: 3581340 - DNA, 13 bp, Homo sapiens
cccctaaagccag

SEQ ID NO: 3581341 - DNA, 19 bp, Homo sapiens
cccctaaagcctcaaaaca

SEQ ID NO: 3581342 - DNA, 21 bp, Homo sapiens
cccctaagctggctgtacctg

SEQ ID NO: 3581343 - DNA, 13 bp, Homo sapiens
cccctagccctgg

SEQ ID NO: 3581344 - DNA, 18 bp, Homo sapiens
cccctaggtgcccagggc

SEQ ID NO: 3581345 - DNA, 19 bp, Homo sapiens
cccctaggtgcccagggcc

SEQ ID NO: 3581346 - DNA, 16 bp, Homo sapiens
cccctcactccccagg

SEQ ID NO: 3581347 - DNA, 18 bp, Homo sapiens
cccctcactccccaggga

SEQ ID NO: 3581348 - DNA, 21 bp, Homo sapiens
cccctcactccccagggagct

SEQ ID NO: 3581349 - DNA, 16 bp, Homo sapiens
cccctcagccttggga

SEQ ID NO: 3581350 - DNA, 17 bp, Homo sapiens
cccctccaaacctccag

SEQ ID NO: 3581351 - DNA, 13 bp, Homo sapiens
cccctccaggaga

SEQ ID NO: 3581352 - DNA, 13 bp, Homo sapiens
cccctcccacctc

SEQ ID NO: 3581353 - DNA, 18 bp, Homo sapiens
cccctcccacgcctcacc

SEQ ID NO: 3581354 - DNA, 20 bp, Homo sapiens
cccctcccacgcctcaccag

SEQ ID NO: 3581355 - DNA, 12 bp, Homo sapiens
cccctcccagac

SEQ ID NO: 3581356 - DNA, 15 bp, Homo sapiens
cccctcccagacagg

SEQ ID NO: 3581357 - DNA, 21 bp, Homo sapiens
cccctcccagacaggccctcc

SEQ ID NO: 3581358 - DNA, 22 bp, Homo sapiens
cccctcccagacaggccctccc

SEQ ID NO: 3581359 - DNA, 13 bp, Homo sapiens
cccctccccagcc

SEQ ID NO: 3581360 - DNA, 16 bp, Homo sapiens
cccctccccagccagc

SEQ ID NO: 3581361 - DNA, 18 bp, Homo sapiens
cccctccccagccagccc

SEQ ID NO: 3581362 - DNA, 18 bp, Homo sapiens
cccctcccccatgggctg

SEQ ID NO: 3581363 - DNA, 16 bp, Homo sapiens
cccctcccctggggac

SEQ ID NO: 3581364 - DNA, 15 bp, Homo sapiens
cccctccctgcctgc

SEQ ID NO: 3581365 - DNA, 13 bp, Homo sapiens
cccctcctgcaca

SEQ ID NO: 3581366 - DNA, 12 bp, Homo sapiens
cccctctccagg

SEQ ID NO: 3581367 - DNA, 19 bp, Homo sapiens
cccctctccttcctgtgtg

SEQ ID NO: 3581368 - DNA, 18 bp, Homo sapiens
cccctctcgccccatccc

SEQ ID NO: 3581369 - DNA, 17 bp, Homo sapiens
cccctctgcacccagaa

SEQ ID NO: 3581370 - DNA, 22 bp, Homo sapiens
cccctctgccggtcgggcagcc

SEQ ID NO: 3581371 - DNA, 23 bp, Homo sapiens
cccctctgctgccggctctgggc

SEQ ID NO: 3581372 - DNA, 20 bp, Homo sapiens
cccctctggagaaggcctgg

SEQ ID NO: 3581373 - DNA, 12 bp, Homo sapiens
cccctctggtgt

SEQ ID NO: 3581374 - DNA, 13 bp, Homo sapiens
cccctgcagccca

SEQ ID NO: 3581375 - DNA, 14 bp, Homo sapiens
cccctgcctgacag

SEQ ID NO: 3581376 - DNA, 22 bp, Homo sapiens
cccctgcctgttggcaggccca

SEQ ID NO: 3581377 - DNA, 15 bp, Homo sapiens
cccctgctccaccag

SEQ ID NO: 3581378 - DNA, 20 bp, Homo sapiens
cccctgctccaccagcagca

SEQ ID NO: 3581379 - DNA, 18 bp, Homo sapiens
cccctgctgtgctgctca

SEQ ID NO: 3581380 - DNA, 19 bp, Homo sapiens
cccctgctgtgctgctcaa

SEQ ID NO: 3581381 - DNA, 20 bp, Homo sapiens
cccctggcttttcactgctg

SEQ ID NO: 3581382 - DNA, 11 bp, Homo sapiens
cccctgggctg

SEQ ID NO: 3581383 - DNA, 14 bp, Homo sapiens
cccctgtctagaga

SEQ ID NO: 3581384 - DNA, 13 bp, Homo sapiens
cccctgtggccaa

SEQ ID NO: 3581385 - DNA, 19 bp, Homo sapiens
cccctgtggccaactgcaa

SEQ ID NO: 3581386 - DNA, 17 bp, Homo sapiens
cccctgtggccctggcc

SEQ ID NO: 3581387 - DNA, 20 bp, Homo sapiens
cccctgtgtattcaccacca

SEQ ID NO: 3581388 - DNA, 23 bp, Homo sapiens
ccccttaaacacaggctgtcctt

SEQ ID NO: 3581389 - DNA, 13 bp, Homo sapiens
ccccttcaggagc

SEQ ID NO: 3581390 - DNA, 20 bp, Homo sapiens
ccccttcaggagcctggcca

SEQ ID NO: 3581391 - DNA, 12 bp, Homo sapiens
ccccttccccct

SEQ ID NO: 3581392 - DNA, 13 bp, Homo sapiens
ccccttccctgtc

SEQ ID NO: 3581393 - DNA, 12 bp, Homo sapiens
ccccttcctgtt

SEQ ID NO: 3581394 - DNA, 18 bp, Homo sapiens
ccccttctctgcctcacc

SEQ ID NO: 3581395 - DNA, 21 bp, Homo sapiens
ccccttggaggagagagaccc

SEQ ID NO: 3581396 - DNA, 19 bp, Homo sapiens
cccctttactcgtgcatta

SEQ ID NO: 3581397 - DNA, 17 bp, Homo sapiens
cccctttcacactggat

SEQ ID NO: 3581398 - DNA, 18 bp, Homo sapiens
cccgacagcctggcacag

SEQ ID NO: 3581399 - DNA, 20 bp, Homo sapiens
cccgacaggtgggcctggga

SEQ ID NO: 3581400 - DNA, 17 bp, Homo sapiens
cccgacagtgccatccc

SEQ ID NO: 3581401 - DNA, 15 bp, Homo sapiens
cccgagaaccctgag

SEQ ID NO: 3581402 - DNA, 18 bp, Homo sapiens
cccgagaaccctgagcag

SEQ ID NO: 3581403 - DNA, 14 bp, Homo sapiens
cccgagaagtgctc

SEQ ID NO: 3581404 - DNA, 17 bp, Homo sapiens
cccgagcccaggcagct

SEQ ID NO: 3581405 - DNA, 13 bp, Homo sapiens
cccgcatgtgtgc

SEQ ID NO: 3581406 - DNA, 17 bp, Homo sapiens
cccgccccagagctccg

SEQ ID NO: 3581407 - DNA, 18 bp, Homo sapiens
cccgcccctcccacgcct

SEQ ID NO: 3581408 - DNA, 13 bp, Homo sapiens
cccgccctcaggc

SEQ ID NO: 3581409 - DNA, 15 bp, Homo sapiens
cccgcctccctctca

SEQ ID NO: 3581410 - DNA, 24 bp, Homo sapiens
cccgcctccctctcagaggcctgc

SEQ ID NO: 3581411 - DNA, 13 bp, Homo sapiens
cccgcgatgccct

SEQ ID NO: 3581412 - DNA, 13 bp, Homo sapiens
cccgcgccaggcc

SEQ ID NO: 3581413 - DNA, 21 bp, Homo sapiens
cccgcgggagacagcttctct

SEQ ID NO: 3581414 - DNA, 15 bp, Homo sapiens
cccgctcagccctcc

SEQ ID NO: 3581415 - DNA, 14 bp, Homo sapiens
cccgctcaggggcc

SEQ ID NO: 3581416 - DNA, 21 bp, Homo sapiens
cccggagaggtggccgccatg

SEQ ID NO: 3581417 - DNA, 18 bp, Homo sapiens
cccggaggggcctggcag

SEQ ID NO: 3581418 - DNA, 13 bp, Homo sapiens
cccggcagtgcac

SEQ ID NO: 3581419 - DNA, 11 bp, Homo sapiens
cccggccagct

SEQ ID NO: 3581420 - DNA, 16 bp, Homo sapiens
cccggccagctctgga

SEQ ID NO: 3581421 - DNA, 22 bp, Homo sapiens
cccggcctcctcggagagcagc

SEQ ID NO: 3581422 - DNA, 23 bp, Homo sapiens
cccggcctcctcggagagcagca

SEQ ID NO: 3581423 - DNA, 21 bp, Homo sapiens
cccgggctggagaaagagctg

SEQ ID NO: 3581424 - DNA, 22 bp, Homo sapiens
cccggggaaaggcaaggtccgg

SEQ ID NO: 3581425 - DNA, 20 bp, Homo sapiens
cccgtaaggctgtacatagt

SEQ ID NO: 3581426 - DNA, 15 bp, Homo sapiens
cccgtgtcctgcctg

SEQ ID NO: 3581427 - DNA, 14 bp, Homo sapiens
ccctaaaagcacac

SEQ ID NO: 3581428 - DNA, 20 bp, Homo sapiens
ccctaaaatggcgaacatgt

SEQ ID NO: 3581429 - DNA, 15 bp, Homo sapiens
ccctaaactgcagcc

SEQ ID NO: 3581430 - DNA, 19 bp, Homo sapiens
ccctaaagccaggctcagg

SEQ ID NO: 3581431 - DNA, 22 bp, Homo sapiens
ccctaaagccaggctcaggaga

SEQ ID NO: 3581432 - DNA, 13 bp, Homo sapiens
ccctaaagcctca

SEQ ID NO: 3581433 - DNA, 13 bp, Homo sapiens
ccctaactcctat

SEQ ID NO: 3581434 - DNA, 17 bp, Homo sapiens
ccctaagcccccagggc

SEQ ID NO: 3581435 - DNA, 23 bp, Homo sapiens
ccctaagcccccagggcctccag

SEQ ID NO: 3581436 - DNA, 20 bp, Homo sapiens
ccctaagctggctgtacctg

SEQ ID NO: 3581437 - DNA, 17 bp, Homo sapiens
ccctaagtggctgcctt

SEQ ID NO: 3581438 - DNA, 19 bp, Homo sapiens
ccctacagtatataagctt

SEQ ID NO: 3581439 - DNA, 13 bp, Homo sapiens
cctctatttatta

SEQ ID NO: 3581440 - DNA, 14 bp, Homo sapiens
cctctattttaatt

SEQ ID NO: 3581441 - DNA, 19 bp, Homo sapiens
cctctcagaggcctgctgc

SEQ ID NO: 3581442 - DNA, 13 bp, Homo sapiens
cctctccaggcct

SEQ ID NO: 3581443 - DNA, 16 bp, Homo sapiens
cctctccaggcctgtc

SEQ ID NO: 3581444 - DNA, 17 bp, Homo sapiens
cctctccccagcccaga

SEQ ID NO: 3581445 - DNA, 16 bp, Homo sapiens
cctctccgactctgca

SEQ ID NO: 3581446 - DNA, 23 bp, Homo sapiens
cctctccgtttattataaactgt

SEQ ID NO: 3581447 - DNA, 16 bp, Homo sapiens
cctctcctgccctgtg

SEQ ID NO: 3581448 - DNA, 22 bp, Homo sapiens
cctctcgccccatccctgcttg

SEQ ID NO: 3581449 - DNA, 12 bp, Homo sapiens
cctctcggctgc

SEQ ID NO: 3581450 - DNA, 21 bp, Homo sapiens
cctctctgagtcaaatccagt

SEQ ID NO: 3581451 - DNA, 13 bp, Homo sapiens
cctctctgcttca

SEQ ID NO: 3581452 - DNA, 12 bp, Homo sapiens
cctctctggctg

SEQ ID NO: 3581453 - DNA, 22 bp, Homo sapiens
cctctgacttaagctgcctcaa

SEQ ID NO: 3581454 - DNA, 16 bp, Homo sapiens
cctctgcagtctcatt

SEQ ID NO: 3581455 - DNA, 17 bp, Homo sapiens
cctctgcagtctcattt

SEQ ID NO: 3581456 - DNA, 12 bp, Homo sapiens
cctctgcagttt

SEQ ID NO: 3581457 - DNA, 14 bp, Homo sapiens
cctctgccctggat

SEQ ID NO: 3581458 - DNA, 19 bp, Homo sapiens
cctctgccggtcgggcagc

SEQ ID NO: 3581459 - DNA, 23 bp, Homo sapiens
cctctgccggtcgggcagccagc

SEQ ID NO: 3581460 - DNA, 15 bp, Homo sapiens
cctctgcctgtctcc

SEQ ID NO: 3581461 - DNA, 11 bp, Homo sapiens
cctctgctgcc

SEQ ID NO: 3581462 - DNA, 15 bp, Homo sapiens
cctctgctgccggct

SEQ ID NO: 3581463 - DNA, 16 bp, Homo sapiens
cctctgctgccggctc

SEQ ID NO: 3581464 - DNA, 13 bp, Homo sapiens
cctctggagtggc

SEQ ID NO: 3581465 - DNA, 21 bp, Homo sapiens
cctctggagtggccactaagc

SEQ ID NO: 3581466 - DNA, 18 bp, Homo sapiens
cctctggctccccaaggc

SEQ ID NO: 3581467 - DNA, 12 bp, Homo sapiens
cctctgggactg

SEQ ID NO: 3581468 - DNA, 16 bp, Homo sapiens
cctctgggggtcctct

SEQ ID NO: 3581469 - DNA, 21 bp, Homo sapiens
cctctggtaaacattcctcca

SEQ ID NO: 3581470 - DNA, 23 bp, Homo sapiens
cctctggtaaacattcctccagc

SEQ ID NO: 3581471 - DNA, 20 bp, Homo sapiens
cctctggtgtgtggtgaggg

SEQ ID NO: 3581472 - DNA, 17 bp, Homo sapiens
cctctgtggtcacccat

SEQ ID NO: 3581473 - DNA, 11 bp, Homo sapiens
cctctgttctt

SEQ ID NO: 3581474 - DNA, 20 bp, Homo sapiens
cctcttaaagaaaacccacc

SEQ ID NO: 3581475 - DNA, 15 bp, Homo sapiens
cctcttcctccctca

SEQ ID NO: 3581476 - DNA, 16 bp, Homo sapiens
cctcttcctccctcat

SEQ ID NO: 3581477 - DNA, 16 bp, Homo sapiens
cctcttctgctctttt

SEQ ID NO: 3581478 - DNA, 21 bp, Homo sapiens
cctcttctggagatggaagct

SEQ ID NO: 3581479 - DNA, 13 bp, Homo sapiens
cctcttcttctga

SEQ ID NO: 3581480 - DNA, 12 bp, Homo sapiens
cctcttctttgt

SEQ ID NO: 3581481 - DNA, 19 bp, Homo sapiens
cctcttctttgtgcctttg

SEQ ID NO: 3581482 - DNA, 21 bp, Homo sapiens
cctcttctttgtgcctttggc

SEQ ID NO: 3581483 - DNA, 17 bp, Homo sapiens
cctcttgagttcctctg

SEQ ID NO: 3581484 - DNA, 14 bp, Homo sapiens
cctcttgccactgc

SEQ ID NO: 3581485 - DNA, 15 bp, Homo sapiens
cctcttggctgcctt

SEQ ID NO: 3581486 - DNA, 15 bp, Homo sapiens
cctctttccctgcga

SEQ ID NO: 3581487 - DNA, 16 bp, Homo sapiens
cctctttccctgcgag

SEQ ID NO: 3581488 - DNA, 14 bp, Homo sapiens
cctctttgacattt

SEQ ID NO: 3581489 - DNA, 20 bp, Homo sapiens
cctctttgacatttttgcca

SEQ ID NO: 3581490 - DNA, 11 bp, Homo sapiens
cctctttgctt

SEQ ID NO: 3581491 - DNA, 14 bp, Homo sapiens
cctctttgctttgc

SEQ ID NO: 3581492 - DNA, 23 bp, Homo sapiens
cctctttgtgataattctcagta

SEQ ID NO: 3581493 - DNA, 20 bp, Homo sapiens
cctctttgttcttcctgtct

SEQ ID NO: 3581494 - DNA, 16 bp, Homo sapiens
cctcttttcctggcag

SEQ ID NO: 3581495 - DNA, 18 bp, Homo sapiens
cctcttttcctggcagct

SEQ ID NO: 3581496 - DNA, 20 bp, Homo sapiens
cctcttttcctggcagctgc

SEQ ID NO: 3581497 - DNA, 21 bp, Homo sapiens
cctcttttcctggcagctgct

SEQ ID NO: 3581498 - DNA, 21 bp, Homo sapiens
cctctttttaaagttcaaact

SEQ ID NO: 3581499 - DNA, 16 bp, Homo sapiens
cctgaaagagaggact

SEQ ID NO: 3581500 - DNA, 15 bp, Homo sapiens
cctgaacaagaattg

SEQ ID NO: 3581501 - DNA, 17 bp, Homo sapiens
cctgaacaagaattgga

SEQ ID NO: 3581502 - DNA, 18 bp, Homo sapiens
cctgaactttctccctca

SEQ ID NO: 3581503 - DNA, 16 bp, Homo sapiens
cctgaagaaccagtcc

SEQ ID NO: 3581504 - DNA, 15 bp, Homo sapiens
cctgaagctgctgtg

SEQ ID NO: 3581505 - DNA, 16 bp, Homo sapiens
cctgaagctgctgtgt

SEQ ID NO: 3581506 - DNA, 19 bp, Homo sapiens
cctgaagctgctgtgtcct

SEQ ID NO: 3581507 - DNA, 20 bp, Homo sapiens
cctgaaggggccatgatggc

SEQ ID NO: 3581508 - DNA, 16 bp, Homo sapiens
cctgaaggggttttct

SEQ ID NO: 3581509 - DNA, 19 bp, Homo sapiens
cctgaatccgtacttgggt

SEQ ID NO: 3581510 - DNA, 18 bp, Homo sapiens
cctgaatctgtgcaaaca

SEQ ID NO: 3581511 - DNA, 14 bp, Homo sapiens
cctgaatttcttct

SEQ ID NO: 3581512 - DNA, 12 bp, Homo sapiens
cctgacaccccc

SEQ ID NO: 3581513 - DNA, 15 bp, Homo sapiens
cctgacaccccctcc

SEQ ID NO: 3581514 - DNA, 16 bp, Homo sapiens
cctgacagaaggactc

SEQ ID NO: 3581515 - DNA, 13 bp, Homo sapiens
cctgacagccttc

SEQ ID NO: 3581516 - DNA, 20 bp, Homo sapiens
cctgacctaccccagccagg

SEQ ID NO: 3581517 - DNA, 23 bp, Homo sapiens
cctgacctaccccagccaggctc

SEQ ID NO: 3581518 - DNA, 22 bp, Homo sapiens
cctgactagaactcctgtcttc

SEQ ID NO: 3581519 - DNA, 15 bp, Homo sapiens
cctgactcagtgacc

SEQ ID NO: 3581520 - DNA, 18 bp, Homo sapiens
cctgactcagtgaccagt

SEQ ID NO: 3581521 - DNA, 14 bp, Homo sapiens
cctgactctcagca

SEQ ID NO: 3581522 - DNA, 16 bp, Homo sapiens
cctgactgggggcaga

SEQ ID NO: 3581523 - DNA, 17 bp, Homo sapiens
cctgactgggggcagac

SEQ ID NO: 3581524 - DNA, 15 bp, Homo sapiens
cctgagccagcaggg

SEQ ID NO: 3581525 - DNA, 21 bp, Homo sapiens
cctgagcggcaccctggtctg

SEQ ID NO: 3581526 - DNA, 13 bp, Homo sapiens
cctgagctggcct

SEQ ID NO: 3581527 - DNA, 16 bp, Homo sapiens
cctgagctggggaagc

SEQ ID NO: 3581528 - DNA, 19 bp, Homo sapiens
cctgaggaagagggactgt

SEQ ID NO: 3581529 - DNA, 21 bp, Homo sapiens
cctgagggccggttctaaggc

SEQ ID NO: 3581530 - DNA, 20 bp, Homo sapiens
cctgagggtccacctggaga

SEQ ID NO: 3581531 - DNA, 16 bp, Homo sapiens
cctgaggtcactgcta

SEQ ID NO: 3581532 - DNA, 17 bp, Homo sapiens
cctgaggtcactgctag

SEQ ID NO: 3581533 - DNA, 23 bp, Homo sapiens
cctgagtcaccctacctgtgcct

SEQ ID NO: 3581534 - DNA, 22 bp, Homo sapiens
cctgagtgccccacttctggcc

SEQ ID NO: 3581535 - DNA, 19 bp, Homo sapiens
cctgatcctggaggcccag

SEQ ID NO: 3581536 - DNA, 19 bp, Homo sapiens
cctgatgcttttgtctaat

SEQ ID NO: 3581537 - DNA, 16 bp, Homo sapiens
cctgattcatatttaa

SEQ ID NO: 3581538 - DNA, 19 bp, Homo sapiens
cctgattcggggctgacct

SEQ ID NO: 3581539 - DNA, 20 bp, Homo sapiens
cctgattcggggctgacctt

SEQ ID NO: 3581540 - DNA, 23 bp, Homo sapiens
cctgattcggggctgacctttca

SEQ ID NO: 3581541 - DNA, 15 bp, Homo sapiens
cctgattgtattttt

SEQ ID NO: 3581542 - DNA, 22 bp, Homo sapiens
cctgatttaggagaagccagga

SEQ ID NO: 3581543 - DNA, 17 bp, Homo sapiens
cctgcaagaccacggag

SEQ ID NO: 3581544 - DNA, 22 bp, Homo sapiens
cctgcaatgtggtgacacctcc

SEQ ID NO: 3581545 - DNA, 23 bp, Homo sapiens
cctgcaatgtggtgacacctccc

SEQ ID NO: 3581546 - DNA, 11 bp, Homo sapiens
cctgcacacag

SEQ ID NO: 3581547 - DNA, 16 bp, Homo sapiens
cctgcagaatttgggt

SEQ ID NO: 3581548 - DNA, 14 bp, Homo sapiens
cctgcagcaggcag

SEQ ID NO: 3581549 - DNA, 20 bp, Homo sapiens
cctgcagcaggcagcttcta

SEQ ID NO: 3581550 - DNA, 16 bp, Homo sapiens
cctgcagcccaggcca

SEQ ID NO: 3581551 - DNA, 18 bp, Homo sapiens
cctgcagcccgtgtccag

SEQ ID NO: 3581552 - DNA, 18 bp, Homo sapiens
cctgcaggccaggccagc

SEQ ID NO: 3581553 - DNA, 15 bp, Homo sapiens
cctgcagggcttctc

SEQ ID NO: 3581554 - DNA, 18 bp, Homo sapiens
cctgcagtactttacctc

SEQ ID NO: 3581555 - DNA, 14 bp, Homo sapiens
cctgcagtcccaca

SEQ ID NO: 3581556 - DNA, 19 bp, Homo sapiens
cctgcagtcccacactgtg

SEQ ID NO: 3581557 - DNA, 16 bp, Homo sapiens
cctgcagtctggctga

SEQ ID NO: 3581558 - DNA, 15 bp, Homo sapiens
cctgcatctctgtga

SEQ ID NO: 3581559 - DNA, 15 bp, Homo sapiens
cctgcatgagctggc

SEQ ID NO: 3581560 - DNA, 17 bp, Homo sapiens
cctgcatgagctggcaa

SEQ ID NO: 3581561 - DNA, 22 bp, Homo sapiens
cctgcatgagctggcaaccagc

SEQ ID NO: 3581562 - DNA, 14 bp, Homo sapiens
cctgccaaggagca

SEQ ID NO: 3581563 - DNA, 16 bp, Homo sapiens
cctgccacatggagcc

SEQ ID NO: 3581564 - DNA, 17 bp, Homo sapiens
cctgccacatggagccc

SEQ ID NO: 3581565 - DNA, 14 bp, Homo sapiens
cctgccacccagcc

SEQ ID NO: 3581566 - DNA, 22 bp, Homo sapiens
cctgccacccccttccctggga

SEQ ID NO: 3581567 - DNA, 16 bp, Homo sapiens
cctgccagctgcactg

SEQ ID NO: 3581568 - DNA, 23 bp, Homo sapiens
cctgccagctgcactgatgctgc

SEQ ID NO: 3581569 - DNA, 17 bp, Homo sapiens
cctgcccaaacccttaa

SEQ ID NO: 3581570 - DNA, 18 bp, Homo sapiens
cctgcccaacctctgtgg

SEQ ID NO: 3581571 - DNA, 16 bp, Homo sapiens
cctgcccatgggagct

SEQ ID NO: 3581572 - DNA, 15 bp, Homo sapiens
cggcggtcccagctc

SEQ ID NO: 3581573 - DNA, 19 bp, Homo sapiens
cggcggtcccagctccctg

SEQ ID NO: 3581574 - DNA, 24 bp, Homo sapiens
cggctcctcctcacccacctctgg

SEQ ID NO: 3581575 - DNA, 11 bp, Homo sapiens
cggctcctgca

SEQ ID NO: 3581576 - DNA, 23 bp, Homo sapiens
cggctctctatagcaccagggct

SEQ ID NO: 3581577 - DNA, 13 bp, Homo sapiens
cggctctgcatgt

SEQ ID NO: 3581578 - DNA, 21 bp, Homo sapiens
cggctctgcatgttttccagg

SEQ ID NO: 3581579 - DNA, 17 bp, Homo sapiens
cggctctgggcctgagg

SEQ ID NO: 3581580 - DNA, 16 bp, Homo sapiens
cggctgagtggcagca

SEQ ID NO: 3581581 - DNA, 13 bp, Homo sapiens
cggctgcacaaca

SEQ ID NO: 3581582 - DNA, 15 bp, Homo sapiens
cggctgccaggggct

SEQ ID NO: 3581583 - DNA, 20 bp, Homo sapiens
cggctgccaggggctctgtg

SEQ ID NO: 3581584 - DNA, 14 bp, Homo sapiens
cgggaccagctcac

SEQ ID NO: 3581585 - DNA, 19 bp, Homo sapiens
cgggatcctccacagagag

SEQ ID NO: 3581586 - DNA, 23 bp, Homo sapiens
cgggatcctccacagagaggagg

SEQ ID NO: 3581587 - DNA, 15 bp, Homo sapiens
cgggatgacctccag

SEQ ID NO: 3581588 - DNA, 16 bp, Homo sapiens
cgggatgacctccaga

SEQ ID NO: 3581589 - DNA, 17 bp, Homo sapiens
cgggatgacctccagaa

SEQ ID NO: 3581590 - DNA, 17 bp, Homo sapiens
cgggcaccaggggccaa

SEQ ID NO: 3581591 - DNA, 21 bp, Homo sapiens
cgggcagggtgtggggccatg

SEQ ID NO: 3581592 - DNA, 18 bp, Homo sapiens
cgggccacacgtggctgg

SEQ ID NO: 3581593 - DNA, 19 bp, Homo sapiens
cgggcccctccatccaccc

SEQ ID NO: 3581594 - DNA, 16 bp, Homo sapiens
cgggccgtaggggctc

SEQ ID NO: 3581595 - DNA, 12 bp, Homo sapiens
cgggctggagaa

SEQ ID NO: 3581596 - DNA, 13 bp, Homo sapiens
cgggctggagaaa

SEQ ID NO: 3581597 - DNA, 14 bp, Homo sapiens
cgggctggagaaag

SEQ ID NO: 3581598 - DNA, 18 bp, Homo sapiens
cgggctggagaaagagct

SEQ ID NO: 3581599 - DNA, 22 bp, Homo sapiens
cgggctggagaaagagctgcct

SEQ ID NO: 3581600 - DNA, 20 bp, Homo sapiens
cgggctgggagctctgcaga

SEQ ID NO: 3581601 - DNA, 12 bp, Homo sapiens
cgggctgtgccc

SEQ ID NO: 3581602 - DNA, 17 bp, Homo sapiens
cggggagaaacccagag

SEQ ID NO: 3581603 - DNA, 22 bp, Homo sapiens
cggggagggtgacagtggccgc

SEQ ID NO: 3581604 - DNA, 20 bp, Homo sapiens
cggggagtttccgcggcggc

SEQ ID NO: 3581605 - DNA, 21 bp, Homo sapiens
cggggctctgggtgctgccct

SEQ ID NO: 3581606 - DNA, 20 bp, Homo sapiens
cgggggcccaagtggggtgc

SEQ ID NO: 3581607 - DNA, 19 bp, Homo sapiens
cggggtgtaacttcctgct

SEQ ID NO: 3581608 - DNA, 19 bp, Homo sapiens
cgggtgggcggcacagcct

SEQ ID NO: 3581609 - DNA, 16 bp, Homo sapiens
cgggttgtgtgtctgt

SEQ ID NO: 3581610 - DNA, 21 bp, Homo sapiens
cgggttttattgtttaaaatc

SEQ ID NO: 3581611 - DNA, 13 bp, Homo sapiens
cggtaactgtcct

SEQ ID NO: 3581612 - DNA, 15 bp, Homo sapiens
cggtaactgtcctgt

SEQ ID NO: 3581613 - DNA, 21 bp, Homo sapiens
cggtatctggcttccctggaa

SEQ ID NO: 3581614 - DNA, 22 bp, Homo sapiens
cggtatctggcttccctggaag

SEQ ID NO: 3581615 - DNA, 23 bp, Homo sapiens
cggtatctggcttccctggaagc

SEQ ID NO: 3581616 - DNA, 22 bp, Homo sapiens
cggtcagaggagcgcaggcagc

SEQ ID NO: 3581617 - DNA, 12 bp, Homo sapiens
cggtcccagctc

SEQ ID NO: 3581618 - DNA, 20 bp, Homo sapiens
cggtccccactttattgcca

SEQ ID NO: 3581619 - DNA, 15 bp, Homo sapiens
cggtcgggcagccag

SEQ ID NO: 3581620 - DNA, 13 bp, Homo sapiens
cggtgctgcagga

SEQ ID NO: 3581621 - DNA, 15 bp, Homo sapiens
cggtgctgcaggagt

SEQ ID NO: 3581622 - DNA, 21 bp, Homo sapiens
cggtggctagtcaagctcctc

SEQ ID NO: 3581623 - DNA, 22 bp, Homo sapiens
cggtgtatcctggccctggggg

SEQ ID NO: 3581624 - DNA, 15 bp, Homo sapiens
cggtgtccccaccat

SEQ ID NO: 3581625 - DNA, 18 bp, Homo sapiens
cggtgttaattttgctaa

SEQ ID NO: 3581626 - DNA, 22 bp, Homo sapiens
cggtgttaattttgctaactgg

SEQ ID NO: 3581627 - DNA, 14 bp, Homo sapiens
cggttcctcatctg

SEQ ID NO: 3581628 - DNA, 14 bp, Homo sapiens
cggttcctggtgac

SEQ ID NO: 3581629 - DNA, 18 bp, Homo sapiens
cggttcctggtgactcct

SEQ ID NO: 3581630 - DNA, 15 bp, Homo sapiens
cggttctaaggctca

SEQ ID NO: 3581631 - DNA, 20 bp, Homo sapiens
cggtttttttctttggctgc

SEQ ID NO: 3581632 - DNA, 12 bp, Homo sapiens
cgtaaaatggtg

SEQ ID NO: 3581633 - DNA, 16 bp, Homo sapiens
cgtaaggctgtacata

SEQ ID NO: 3581634 - DNA, 17 bp, Homo sapiens
cgtaatgcattgcctgt

SEQ ID NO: 3581635 - DNA, 18 bp, Homo sapiens
cgtagatcaccagaataa

SEQ ID NO: 3581636 - DNA, 19 bp, Homo sapiens
cgtagatcaccagaataaa

SEQ ID NO: 3581637 - DNA, 18 bp, Homo sapiens
cgtaggacgcatgaaggt

SEQ ID NO: 3581638 - DNA, 17 bp, Homo sapiens
cgtcaagagcatgcaca

SEQ ID NO: 3581639 - DNA, 16 bp, Homo sapiens
cgtcagccacctggga

SEQ ID NO: 3581640 - DNA, 17 bp, Homo sapiens
cgtccagctcagccctg

SEQ ID NO: 3581641 - DNA, 13 bp, Homo sapiens
cgtccaggcccca

SEQ ID NO: 3581642 - DNA, 21 bp, Homo sapiens
cgtccaggggagatggggagg

SEQ ID NO: 3581643 - DNA, 18 bp, Homo sapiens
cgtcccagcatccctgga

SEQ ID NO: 3581644 - DNA, 19 bp, Homo sapiens
cgtcccagcatccctggag

SEQ ID NO: 3581645 - DNA, 17 bp, Homo sapiens
cgtcccttggtgagaaa

SEQ ID NO: 3581646 - DNA, 21 bp, Homo sapiens
cgtcctccctgatcccacccc

SEQ ID NO: 3581647 - DNA, 13 bp, Homo sapiens
cgtcctctcggct

SEQ ID NO: 3581648 - DNA, 15 bp, Homo sapiens
cgtcgccctcccagg

SEQ ID NO: 3581649 - DNA, 21 bp, Homo sapiens
cgtctccccttctctgcctca

SEQ ID NO: 3581650 - DNA, 15 bp, Homo sapiens
cgtctctgccctggg

SEQ ID NO: 3581651 - DNA, 18 bp, Homo sapiens
cgtctctgccctgggctc

SEQ ID NO: 3581652 - DNA, 15 bp, Homo sapiens
cgtctgaggcctgcc

SEQ ID NO: 3581653 - DNA, 22 bp, Homo sapiens
cgtctgaggcctgccccctggg

SEQ ID NO: 3581654 - DNA, 23 bp, Homo sapiens
cgtctgaggcctgccccctgggc

SEQ ID NO: 3581655 - DNA, 13 bp, Homo sapiens
cgtctgcctgggc

SEQ ID NO: 3581656 - DNA, 14 bp, Homo sapiens
cgtctgcctgggcc

SEQ ID NO: 3581657 - DNA, 21 bp, Homo sapiens
cgtctgtggctttcagcctct

SEQ ID NO: 3581658 - DNA, 22 bp, Homo sapiens
cgtcttgaacgagcagcccagg

SEQ ID NO: 3581659 - DNA, 19 bp, Homo sapiens
cgtgaagaaataaatgaaa

SEQ ID NO: 3581660 - DNA, 22 bp, Homo sapiens
cgtgaagaaataaatgaaactt

SEQ ID NO: 3581661 - DNA, 21 bp, Homo sapiens
cgtgacaggctcgtcagccac

SEQ ID NO: 3581662 - DNA, 22 bp, Homo sapiens
cgtgagagaaagagagaagcca

SEQ ID NO: 3581663 - DNA, 22 bp, Homo sapiens
cgtgagctggggactcagggac

SEQ ID NO: 3581664 - DNA, 12 bp, Homo sapiens
cgtgaggggcaa

SEQ ID NO: 3581665 - DNA, 15 bp, Homo sapiens
cgtgccaccccgagg

SEQ ID NO: 3581666 - DNA, 18 bp, Homo sapiens
cgtgccttcagctctaca

SEQ ID NO: 3581667 - DNA, 17 bp, Homo sapiens
cgtgctgacagctgctc

SEQ ID NO: 3581668 - DNA, 21 bp, Homo sapiens
cgtgctggcggacgcagctgg

SEQ ID NO: 3581669 - DNA, 16 bp, Homo sapiens
cgtgctgtgctctggc

SEQ ID NO: 3581670 - DNA, 14 bp, Homo sapiens
cgtgctttgtgttc

SEQ ID NO: 3581671 - DNA, 14 bp, Homo sapiens
cgtggactgtgctg

SEQ ID NO: 3581672 - DNA, 15 bp, Homo sapiens
cgtggattgtattta

SEQ ID NO: 3581673 - DNA, 22 bp, Homo sapiens
cgtggattgtatttaagacata

SEQ ID NO: 3581674 - DNA, 23 bp, Homo sapiens
cgtggattgtatttaagacataa

SEQ ID NO: 3581675 - DNA, 13 bp, Homo sapiens
cgtggatttgtac

SEQ ID NO: 3581676 - DNA, 14 bp, Homo sapiens
cgtggatttgtact

SEQ ID NO: 3581677 - DNA, 15 bp, Homo sapiens
cgtggatttgtactt

SEQ ID NO: 3581678 - DNA, 20 bp, Homo sapiens
cgtggcacagctgggagcct

SEQ ID NO: 3581679 - DNA, 22 bp, Homo sapiens
cgtggcacagctgggagcctgg

SEQ ID NO: 3581680 - DNA, 16 bp, Homo sapiens
cgtggcagcttgctgg

SEQ ID NO: 3581681 - DNA, 20 bp, Homo sapiens
cgtggcagcttgctgggctt

SEQ ID NO: 3581682 - DNA, 17 bp, Homo sapiens
cgtggccccgccctcag

SEQ ID NO: 3581683 - DNA, 18 bp, Homo sapiens
cgtggccccgccctcagg

SEQ ID NO: 3581684 - DNA, 19 bp, Homo sapiens
cgtggcccgcatgtgcatt

SEQ ID NO: 3581685 - DNA, 22 bp, Homo sapiens
cgtggcctccccatgggcacag

SEQ ID NO: 3581686 - DNA, 21 bp, Homo sapiens
cgtggcctcgtgaggggcaag

SEQ ID NO: 3581687 - DNA, 13 bp, Homo sapiens
cgtggctctgctg

SEQ ID NO: 3581688 - DNA, 14 bp, Homo sapiens
cgtggctctgctgg

SEQ ID NO: 3581689 - DNA, 15 bp, Homo sapiens
cgtggctctgctggc

SEQ ID NO: 3581690 - DNA, 19 bp, Homo sapiens
cgtggcttcccgctcagcc

SEQ ID NO: 3581691 - DNA, 21 bp, Homo sapiens
cgtggcttggggattgtacac

SEQ ID NO: 3581692 - DNA, 20 bp, Homo sapiens
cgtgggaaaggggagtaggt

SEQ ID NO: 3581693 - DNA, 18 bp, Homo sapiens
cgtgggtcccagagacct

SEQ ID NO: 3581694 - DNA, 19 bp, Homo sapiens
cgtggtggcggtggctgcc

SEQ ID NO: 3581695 - DNA, 21 bp, Homo sapiens
cgtggtggcggtggctgcccc

SEQ ID NO: 3581696 - DNA, 15 bp, Homo sapiens
cgtggtgtgtccctg

SEQ ID NO: 3581697 - DNA, 18 bp, Homo sapiens
cgtggtgtgtccctggac

SEQ ID NO: 3581698 - DNA, 19 bp, Homo sapiens
cgtggtgtgtccctggaca

SEQ ID NO: 3581699 - DNA, 23 bp, Homo sapiens
cgtggtgtgtccctggacacagc

SEQ ID NO: 3581700 - DNA, 21 bp, Homo sapiens
cgtggtttgcctgaggctgta

SEQ ID NO: 3581701 - DNA, 16 bp, Homo sapiens
cgtgtatttattacat

SEQ ID NO: 3581702 - DNA, 15 bp, Homo sapiens
cgtgtctcagcctct

SEQ ID NO: 3581703 - DNA, 20 bp, Homo sapiens
ctactcagtggggctggcat

SEQ ID NO: 3581704 - DNA, 15 bp, Homo sapiens
ctactctcttcctcc

SEQ ID NO: 3581705 - DNA, 14 bp, Homo sapiens
ctactgacagggag

SEQ ID NO: 3581706 - DNA, 15 bp, Homo sapiens
ctactgacagggagc

SEQ ID NO: 3581707 - DNA, 16 bp, Homo sapiens
ctactgcaagagccaa

SEQ ID NO: 3581708 - DNA, 18 bp, Homo sapiens
ctactgcaagagccaagt

SEQ ID NO: 3581709 - DNA, 15 bp, Homo sapiens
ctactgcgcctcgtg

SEQ ID NO: 3581710 - DNA, 23 bp, Homo sapiens
ctactgctgctgctgctgccgcc

SEQ ID NO: 3581711 - DNA, 17 bp, Homo sapiens
ctactggtcttgtggaa

SEQ ID NO: 3581712 - DNA, 18 bp, Homo sapiens
ctactgtaatgctgcctc

SEQ ID NO: 3581713 - DNA, 13 bp, Homo sapiens
ctactgtgggcaa

SEQ ID NO: 3581714 - DNA, 16 bp, Homo sapiens
ctactgtgggcaaagt

SEQ ID NO: 3581715 - DNA, 23 bp, Homo sapiens
ctactgtgggcaaagtcctcctt

SEQ ID NO: 3581716 - DNA, 22 bp, Homo sapiens
ctacttagcatgtccctaccga

SEQ ID NO: 3581717 - DNA, 20 bp, Homo sapiens
ctacttcctgtgacttcagc

SEQ ID NO: 3581718 - DNA, 13 bp, Homo sapiens
ctacttttactca

SEQ ID NO: 3581719 - DNA, 23 bp, Homo sapiens
ctagaaaacattttttttttaaa

SEQ ID NO: 3581720 - DNA, 23 bp, Homo sapiens
ctagaaaatgagaaaattgtctg

SEQ ID NO: 3581721 - DNA, 16 bp, Homo sapiens
ctagaactcctgtctt

SEQ ID NO: 3581722 - DNA, 18 bp, Homo sapiens
ctagaactcctgtcttct

SEQ ID NO: 3581723 - DNA, 21 bp, Homo sapiens
ctagaactcctgtcttctttc

SEQ ID NO: 3581724 - DNA, 13 bp, Homo sapiens
ctagactgctcct

SEQ ID NO: 3581725 - DNA, 18 bp, Homo sapiens
ctagactgctcctgggca

SEQ ID NO: 3581726 - DNA, 17 bp, Homo sapiens
ctagactggtgctaatg

SEQ ID NO: 3581727 - DNA, 20 bp, Homo sapiens
ctagacttgaaagttttcca

SEQ ID NO: 3581728 - DNA, 22 bp, Homo sapiens
ctagacttgaaagttttccagt

SEQ ID NO: 3581729 - DNA, 23 bp, Homo sapiens
ctagacttgaaagttttccagta

SEQ ID NO: 3581730 - DNA, 15 bp, Homo sapiens
ctagagacaaatctt

SEQ ID NO: 3581731 - DNA, 14 bp, Homo sapiens
ctagagagaaccaa

SEQ ID NO: 3581732 - DNA, 13 bp, Homo sapiens
ctagagagggagg

SEQ ID NO: 3581733 - DNA, 18 bp, Homo sapiens
ctagaggagggggcaggc

SEQ ID NO: 3581734 - DNA, 20 bp, Homo sapiens
ctagaggagggggcaggctg

SEQ ID NO: 3581735 - DNA, 17 bp, Homo sapiens
ctagagggacctctccc

SEQ ID NO: 3581736 - DNA, 15 bp, Homo sapiens
ctagagggaggggcc

SEQ ID NO: 3581737 - DNA, 17 bp, Homo sapiens
ctagagggcgagggatg

SEQ ID NO: 3581738 - DNA, 22 bp, Homo sapiens
ctagagtgtagcctaaagggca

SEQ ID NO: 3581739 - DNA, 23 bp, Homo sapiens
ctagatccagcccaaacctggga

SEQ ID NO: 3581740 - DNA, 15 bp, Homo sapiens
ctagatggctcctct

SEQ ID NO: 3581741 - DNA, 16 bp, Homo sapiens
ctagatggctcctctc

SEQ ID NO: 3581742 - DNA, 22 bp, Homo sapiens
ctagatgtagtattttttgtat

SEQ ID NO: 3581743 - DNA, 24 bp, Homo sapiens
ctagattgagagaagagacaaaca

SEQ ID NO: 3581744 - DNA, 13 bp, Homo sapiens
ctagccagagaat

SEQ ID NO: 3581745 - DNA, 18 bp, Homo sapiens
ctagccctctcacattta

SEQ ID NO: 3581746 - DNA, 18 bp, Homo sapiens
ctagccctgctccaactc

SEQ ID NO: 3581747 - DNA, 13 bp, Homo sapiens
ctagcctctggac

SEQ ID NO: 3581748 - DNA, 20 bp, Homo sapiens
ctagcctctggactggaaag

SEQ ID NO: 3581749 - DNA, 15 bp, Homo sapiens
ctagcggagcccagc

SEQ ID NO: 3581750 - DNA, 16 bp, Homo sapiens
ctagctaattatttaa

SEQ ID NO: 3581751 - DNA, 19 bp, Homo sapiens
ctagctaggagcaggcttg

SEQ ID NO: 3581752 - DNA, 21 bp, Homo sapiens
ctagctcctgccacatggagc

SEQ ID NO: 3581753 - DNA, 19 bp, Homo sapiens
ctagctgggggtgggccag

SEQ ID NO: 3581754 - DNA, 20 bp, Homo sapiens
ctagctgggggtgggccagg

SEQ ID NO: 3581755 - DNA, 20 bp, Homo sapiens
ctaggaaccagccaaccatc

SEQ ID NO: 3581756 - DNA, 16 bp, Homo sapiens
ctaggaatgaaatcct

SEQ ID NO: 3581757 - DNA, 14 bp, Homo sapiens
ctaggagcaggctt

SEQ ID NO: 3581758 - DNA, 17 bp, Homo sapiens
ctaggatgttctgggct

SEQ ID NO: 3581759 - DNA, 18 bp, Homo sapiens
ctaggcactgagcaggga

SEQ ID NO: 3581760 - DNA, 17 bp, Homo sapiens
ctaggcatacttttcaa

SEQ ID NO: 3581761 - DNA, 15 bp, Homo sapiens
ctaggccccagaggc

SEQ ID NO: 3581762 - DNA, 22 bp, Homo sapiens
ctaggccccagaggccctggag

SEQ ID NO: 3581763 - DNA, 17 bp, Homo sapiens
ctaggccctgtgagcac

SEQ ID NO: 3581764 - DNA, 17 bp, Homo sapiens
ctaggcctcagccagag

SEQ ID NO: 3581765 - DNA, 22 bp, Homo sapiens
ctaggcctccgttgtctggttg

SEQ ID NO: 3581766 - DNA, 17 bp, Homo sapiens
ctagggtccctgaacgc

SEQ ID NO: 3581767 - DNA, 17 bp, Homo sapiens
ctaggtgcccagggcca

SEQ ID NO: 3581768 - DNA, 19 bp, Homo sapiens
ctaggtgcccagggccagt

SEQ ID NO: 3581769 - DNA, 19 bp, Homo sapiens
ctagtacattactaaatat

SEQ ID NO: 3581770 - DNA, 17 bp, Homo sapiens
ctagtacctgtgactct

SEQ ID NO: 3581771 - DNA, 20 bp, Homo sapiens
ctagtagaagaagctttgcc

SEQ ID NO: 3581772 - DNA, 15 bp, Homo sapiens
ctagtagtgtggcct

SEQ ID NO: 3581773 - DNA, 16 bp, Homo sapiens
ctagtcaagctcctcc

SEQ ID NO: 3581774 - DNA, 23 bp, Homo sapiens
ctagtcaagctcctcctccctgc

SEQ ID NO: 3581775 - DNA, 22 bp, Homo sapiens
ctagtcatttgttaatatttct

SEQ ID NO: 3581776 - DNA, 19 bp, Homo sapiens
ctagtgaaagaggcagctt

SEQ ID NO: 3581777 - DNA, 17 bp, Homo sapiens
ctagtgccttctaaagg

SEQ ID NO: 3581778 - DNA, 17 bp, Homo sapiens
ctagtggagttttataa

SEQ ID NO: 3581779 - DNA, 22 bp, Homo sapiens
ctagtggagttttataaattaa

SEQ ID NO: 3581780 - DNA, 13 bp, Homo sapiens
ctagttctttcct

SEQ ID NO: 3581781 - DNA, 21 bp, Homo sapiens
ctagttctttcctccccctgc

SEQ ID NO: 3581782 - DNA, 21 bp, Homo sapiens
ctagttgatgtatggtatctt

SEQ ID NO: 3581783 - DNA, 16 bp, Homo sapiens
ctagttgtcaataaat

SEQ ID NO: 3581784 - DNA, 17 bp, Homo sapiens
ctagttgtcaataaatg

SEQ ID NO: 3581785 - DNA, 22 bp, Homo sapiens
ctagttgtttgggctttaacat

SEQ ID NO: 3581786 - DNA, 19 bp, Homo sapiens
ctagttttctcctcccagg

SEQ ID NO: 3581787 - DNA, 23 bp, Homo sapiens
ctagttttttcttccttttcact

SEQ ID NO: 3581788 - DNA, 15 bp, Homo sapiens
ctataaattcctctt

SEQ ID NO: 3581789 - DNA, 15 bp, Homo sapiens
ctataaattttttga

SEQ ID NO: 3581790 - DNA, 17 bp, Homo sapiens
ctataaccaaatgaaat

SEQ ID NO: 3581791 - DNA, 19 bp, Homo sapiens
ctataaccaaatgaaatat

SEQ ID NO: 3581792 - DNA, 11 bp, Homo sapiens
ctatacagtag

SEQ ID NO: 3581793 - DNA, 16 bp, Homo sapiens
ctatacccacccagaa

SEQ ID NO: 3581794 - DNA, 19 bp, Homo sapiens
ctatactgtggcctgcagg

SEQ ID NO: 3581795 - DNA, 20 bp, Homo sapiens
ctatactgtggcctgcagga

SEQ ID NO: 3581796 - DNA, 22 bp, Homo sapiens
ctatactgtggcctgcaggagg

SEQ ID NO: 3581797 - DNA, 14 bp, Homo sapiens
ctatagctacatgt

SEQ ID NO: 3581798 - DNA, 13 bp, Homo sapiens
ctatagtaaatgt

SEQ ID NO: 3581799 - DNA, 15 bp, Homo sapiens
ctatagtaaatgtgt

SEQ ID NO: 3581800 - DNA, 18 bp, Homo sapiens
ctatagtgacatgcagtt

SEQ ID NO: 3581801 - DNA, 17 bp, Homo sapiens
ctatataaaatgtattc

SEQ ID NO: 3581802 - DNA, 19 bp, Homo sapiens
ctatataaaatgtattcaa

SEQ ID NO: 3581803 - DNA, 17 bp, Homo sapiens
ctatatagaatgctgca

SEQ ID NO: 3581804 - DNA, 19 bp, Homo sapiens
ctatcacctcgagaagtaa

SEQ ID NO: 3581805 - DNA, 12 bp, Homo sapiens
ctatcagcaatg

SEQ ID NO: 3581806 - DNA, 19 bp, Homo sapiens
ctatcagcagctagaaaac

SEQ ID NO: 3581807 - DNA, 12 bp, Homo sapiens
ctatcatttatt

SEQ ID NO: 3581808 - DNA, 23 bp, Homo sapiens
ctatcatttattggatgggtggg

SEQ ID NO: 3581809 - DNA, 22 bp, Homo sapiens
ctatccttggctttcagagcca

SEQ ID NO: 3581810 - DNA, 18 bp, Homo sapiens
ctatctccgttccatctg

SEQ ID NO: 3581811 - DNA, 23 bp, Homo sapiens
ctatctccgttccatctgggctt

SEQ ID NO: 3581812 - DNA, 17 bp, Homo sapiens
ctatctctgtgtgcaca

SEQ ID NO: 3581813 - DNA, 21 bp, Homo sapiens
ctatctctgtgtgcacaaata

SEQ ID NO: 3581814 - DNA, 16 bp, Homo sapiens
ctatctgacttcatac

SEQ ID NO: 3581815 - DNA, 14 bp, Homo sapiens
ctatctgcctggag

SEQ ID NO: 3581816 - DNA, 15 bp, Homo sapiens
ctatctgcctggagg

SEQ ID NO: 3581817 - DNA, 17 bp, Homo sapiens
ctatctgcctggaggca

SEQ ID NO: 3581818 - DNA, 11 bp, Homo sapiens
ctatgaacaga

SEQ ID NO: 3581819 - DNA, 16 bp, Homo sapiens
ctatgacagatatatt

SEQ ID NO: 3581820 - DNA, 21 bp, Homo sapiens
ctatgcacaacagagtaacta

SEQ ID NO: 3581821 - DNA, 19 bp, Homo sapiens
ctatgcatggtgccccagg

SEQ ID NO: 3581822 - DNA, 22 bp, Homo sapiens
ctatgctgttcactggacactt

SEQ ID NO: 3581823 - DNA, 19 bp, Homo sapiens
ctatggggatagatgtgtg

SEQ ID NO: 3581824 - DNA, 21 bp, Homo sapiens
ctatggggatagatgtgtgga

SEQ ID NO: 3581825 - DNA, 18 bp, Homo sapiens
ctatgtatatcttctaca

SEQ ID NO: 3581826 - DNA, 13 bp, Homo sapiens
ctatgttaatatt

SEQ ID NO: 3581827 - DNA, 21 bp, Homo sapiens
ctatgttaatattttaggtgt

SEQ ID NO: 3581828 - DNA, 21 bp, Homo sapiens
ctatgttaatattttatgtgt

SEQ ID NO: 3581829 - DNA, 22 bp, Homo sapiens
ctatgttaatattttatgtgta

SEQ ID NO: 3581830 - DNA, 15 bp, Homo sapiens
ctattaatcaagaga

SEQ ID NO: 3581831 - DNA, 18 bp, Homo sapiens
ctattaatcaagagaaac

SEQ ID NO: 3581832 - DNA, 14 bp, Homo sapiens
ctattacagtgttg

SEQ ID NO: 3581833 - DNA, 13 bp, Homo sapiens
ctattatccagag

SEQ ID NO: 3581834 - DNA, 20 bp, Homo sapiens
ctccgtagctctgctgctga

SEQ ID NO: 3581835 - DNA, 19 bp, Homo sapiens
ctccgtccaggagcctggc

SEQ ID NO: 3581836 - DNA, 22 bp, Homo sapiens
ctccgtccaggagcctgtgcct

SEQ ID NO: 3581837 - DNA, 21 bp, Homo sapiens
ctccgtccatccgactgcccc

SEQ ID NO: 3581838 - DNA, 22 bp, Homo sapiens
ctccgtccatccgactgcccct

SEQ ID NO: 3581839 - DNA, 16 bp, Homo sapiens
ctccgtggccccgccc

SEQ ID NO: 3581840 - DNA, 22 bp, Homo sapiens
ctccgtggccccgccctcaggc

SEQ ID NO: 3581841 - DNA, 22 bp, Homo sapiens
ctccgtttattataaactgtat

SEQ ID NO: 3581842 - DNA, 17 bp, Homo sapiens
ctcctaaaactgggatt

SEQ ID NO: 3581843 - DNA, 18 bp, Homo sapiens
ctcctaaataaattattt

SEQ ID NO: 3581844 - DNA, 21 bp, Homo sapiens
ctcctaaataaattatttgtt

SEQ ID NO: 3581845 - DNA, 17 bp, Homo sapiens
ctcctaccctcccacca

SEQ ID NO: 3581846 - DNA, 21 bp, Homo sapiens
ctcctacctcagcctcctggg

SEQ ID NO: 3581847 - DNA, 22 bp, Homo sapiens
ctcctataaagggcccacacct

SEQ ID NO: 3581848 - DNA, 23 bp, Homo sapiens
ctcctataaagggcccacacctg

SEQ ID NO: 3581849 - DNA, 15 bp, Homo sapiens
ctcctatctccctgg

SEQ ID NO: 3581850 - DNA, 16 bp, Homo sapiens
ctcctatctccctggc

SEQ ID NO: 3581851 - DNA, 19 bp, Homo sapiens
ctcctatctccctggctca

SEQ ID NO: 3581852 - DNA, 20 bp, Homo sapiens
ctcctatttgaccagaactt

SEQ ID NO: 3581853 - DNA, 19 bp, Homo sapiens
ctcctcacccacctctggg

SEQ ID NO: 3581854 - DNA, 17 bp, Homo sapiens
ctcctcactctgtccct

SEQ ID NO: 3581855 - DNA, 23 bp, Homo sapiens
ctcctcactctgtccctgtcctt

SEQ ID NO: 3581856 - DNA, 12 bp, Homo sapiens
ctcctcagctcc

SEQ ID NO: 3581857 - DNA, 13 bp, Homo sapiens
ctcctcaggacca

SEQ ID NO: 3581858 - DNA, 18 bp, Homo sapiens
ctcctcatagcatgatat

SEQ ID NO: 3581859 - DNA, 23 bp, Homo sapiens
ctcctccaggtcggagtgcctgg

SEQ ID NO: 3581860 - DNA, 15 bp, Homo sapiens
ctcctcccactgccc

SEQ ID NO: 3581861 - DNA, 23 bp, Homo sapiens
ctcctcccaggcgccccttcccc

SEQ ID NO: 3581862 - DNA, 11 bp, Homo sapiens
ctcctccccca

SEQ ID NO: 3581863 - DNA, 20 bp, Homo sapiens
ctcctcccgcccttccatgt

SEQ ID NO: 3581864 - DNA, 21 bp, Homo sapiens
ctcctcccgcccttccatgtg

SEQ ID NO: 3581865 - DNA, 15 bp, Homo sapiens
ctcctccctgcatct

SEQ ID NO: 3581866 - DNA, 23 bp, Homo sapiens
ctcctccctgcatctgaccagca

SEQ ID NO: 3581867 - DNA, 14 bp, Homo sapiens
ctcctcctcaccca

SEQ ID NO: 3581868 - DNA, 14 bp, Homo sapiens
ctcctcctccctgc

SEQ ID NO: 3581869 - DNA, 16 bp, Homo sapiens
ctcctctaggccctgt

SEQ ID NO: 3581870 - DNA, 19 bp, Homo sapiens
ctcctctaggccctgtgag

SEQ ID NO: 3581871 - DNA, 13 bp, Homo sapiens
ctcctctcagtac

SEQ ID NO: 3581872 - DNA, 21 bp, Homo sapiens
ctcctctcccattgtccctct

SEQ ID NO: 3581873 - DNA, 15 bp, Homo sapiens
ctcctctccccagcc

SEQ ID NO: 3581874 - DNA, 17 bp, Homo sapiens
ctcctctccccagccca

SEQ ID NO: 3581875 - DNA, 20 bp, Homo sapiens
ctcctctccccagcccagag

SEQ ID NO: 3581876 - DNA, 12 bp, Homo sapiens
ctcctctctgct

SEQ ID NO: 3581877 - DNA, 14 bp, Homo sapiens
ctcctctgctggga

SEQ ID NO: 3581878 - DNA, 15 bp, Homo sapiens
ctcctctgtccaggc

SEQ ID NO: 3581879 - DNA, 15 bp, Homo sapiens
ctcctcttagctcag

SEQ ID NO: 3581880 - DNA, 18 bp, Homo sapiens
ctcctcttgccactgcct

SEQ ID NO: 3581881 - DNA, 14 bp, Homo sapiens
ctcctcttgttcct

SEQ ID NO: 3581882 - DNA, 20 bp, Homo sapiens
ctcctcttgttcctgaaatg

SEQ ID NO: 3581883 - DNA, 16 bp, Homo sapiens
ctcctgacccctgcct

SEQ ID NO: 3581884 - DNA, 18 bp, Homo sapiens
ctcctgacctcaagtgat

SEQ ID NO: 3581885 - DNA, 22 bp, Homo sapiens
ctcctgagcttgatctttttct

SEQ ID NO: 3581886 - DNA, 21 bp, Homo sapiens
ctcctgagtagctggattaca

SEQ ID NO: 3581887 - DNA, 22 bp, Homo sapiens
ctcctgagtgccccacttctgg

SEQ ID NO: 3581888 - DNA, 23 bp, Homo sapiens
ctcctgagtgccccacttctggc

SEQ ID NO: 3581889 - DNA, 15 bp, Homo sapiens
ctcctgcacacaggg

SEQ ID NO: 3581890 - DNA, 15 bp, Homo sapiens
ctcctgccaccagca

SEQ ID NO: 3581891 - DNA, 18 bp, Homo sapiens
ctcctgccccctgccagt

SEQ ID NO: 3581892 - DNA, 13 bp, Homo sapiens
ctcctgccctgtg

SEQ ID NO: 3581893 - DNA, 14 bp, Homo sapiens
ctcctgccctgtga

SEQ ID NO: 3581894 - DNA, 21 bp, Homo sapiens
ctcctgcctcagcctcctgag

SEQ ID NO: 3581895 - DNA, 18 bp, Homo sapiens
ctcctgcgccctgtgccc

SEQ ID NO: 3581896 - DNA, 14 bp, Homo sapiens
ctcctgctggtacc

SEQ ID NO: 3581897 - DNA, 23 bp, Homo sapiens
ctcctgcttttctgtcctgggca

SEQ ID NO: 3581898 - DNA, 11 bp, Homo sapiens
ctcctggcagg

SEQ ID NO: 3581899 - DNA, 20 bp, Homo sapiens
ctcctggctcaagccctgaa

SEQ ID NO: 3581900 - DNA, 22 bp, Homo sapiens
ctcctgggaacacatctggctg

SEQ ID NO: 3581901 - DNA, 19 bp, Homo sapiens
ctcctgggcattagcaagg

SEQ ID NO: 3581902 - DNA, 11 bp, Homo sapiens
ctcctgggccg

SEQ ID NO: 3581903 - DNA, 17 bp, Homo sapiens
ctcctgtacctcagtgg

SEQ ID NO: 3581904 - DNA, 21 bp, Homo sapiens
ctcctgtacctcagtggatct

SEQ ID NO: 3581905 - DNA, 22 bp, Homo sapiens
ctcctgtccaaagtagggatgc

SEQ ID NO: 3581906 - DNA, 15 bp, Homo sapiens
ctcctgtcccttttc

SEQ ID NO: 3581907 - DNA, 16 bp, Homo sapiens
ctccttcagcacggcg

SEQ ID NO: 3581908 - DNA, 15 bp, Homo sapiens
ctccttcctgtgtgt

SEQ ID NO: 3581909 - DNA, 15 bp, Homo sapiens
ctccttctccttccc

SEQ ID NO: 3581910 - DNA, 15 bp, Homo sapiens
ctccttgaatatctt

SEQ ID NO: 3581911 - DNA, 20 bp, Homo sapiens
ctccttgaatatctttcgat

SEQ ID NO: 3581912 - DNA, 13 bp, Homo sapiens
ctccttggcaccc

SEQ ID NO: 3581913 - DNA, 21 bp, Homo sapiens
ctccttggctttatgcaaata

SEQ ID NO: 3581914 - DNA, 13 bp, Homo sapiens
ctccttgtggcct

SEQ ID NO: 3581915 - DNA, 15 bp, Homo sapiens
ctccttgtggcctat

SEQ ID NO: 3581916 - DNA, 17 bp, Homo sapiens
ctccttgtggcctatga

SEQ ID NO: 3581917 - DNA, 16 bp, Homo sapiens
ctcctttatctgtaat

SEQ ID NO: 3581918 - DNA, 13 bp, Homo sapiens
ctcctttcacaac

SEQ ID NO: 3581919 - DNA, 17 bp, Homo sapiens
ctcctttcacaaccttc

SEQ ID NO: 3581920 - DNA, 22 bp, Homo sapiens
ctcctttcattaccctacagac

SEQ ID NO: 3581921 - DNA, 20 bp, Homo sapiens
ctccttttcttcaccctccc

SEQ ID NO: 3581922 - DNA, 13 bp, Homo sapiens
ctcgaactcctga

SEQ ID NO: 3581923 - DNA, 17 bp, Homo sapiens
ctcgaactcctgacctc

SEQ ID NO: 3581924 - DNA, 19 bp, Homo sapiens
ctcgacagggcctggagcc

SEQ ID NO: 3581925 - DNA, 22 bp, Homo sapiens
ctcgacctccccacccgctccc

SEQ ID NO: 3581926 - DNA, 12 bp, Homo sapiens
ctcgcccagcag

SEQ ID NO: 3581927 - DNA, 17 bp, Homo sapiens
ctcgccccatccctgct

SEQ ID NO: 3581928 - DNA, 17 bp, Homo sapiens
ctcgccggatctgaggg

SEQ ID NO: 3581929 - DNA, 18 bp, Homo sapiens
ctcgccggatctgaggga

SEQ ID NO: 3581930 - DNA, 18 bp, Homo sapiens
ctcgccgtgtctcagcct

SEQ ID NO: 3581931 - DNA, 20 bp, Homo sapiens
ctcgccgtgtctcagcctct

SEQ ID NO: 3581932 - DNA, 21 bp, Homo sapiens
ctcgccgtgtctcagcctctg

SEQ ID NO: 3581933 - DNA, 20 bp, Homo sapiens
ctcggaatctattttctcat

SEQ ID NO: 3581934 - DNA, 20 bp, Homo sapiens
ctcggagaagagctgttcac

SEQ ID NO: 3581935 - DNA, 21 bp, Homo sapiens
ctcggagggatggagaaagaa

SEQ ID NO: 3581936 - DNA, 17 bp, Homo sapiens
ctcggagggtgccgtgc

SEQ ID NO: 3581937 - DNA, 15 bp, Homo sapiens
ctcggatccccttcc

SEQ ID NO: 3581938 - DNA, 23 bp, Homo sapiens
ctcggatccccttcctaccaccc

SEQ ID NO: 3581939 - DNA, 19 bp, Homo sapiens
ctcggatgacaccctggcc

SEQ ID NO: 3581940 - DNA, 21 bp, Homo sapiens
ctcggatgacaccctggcctg

SEQ ID NO: 3581941 - DNA, 18 bp, Homo sapiens
ctcggccgcccggcagtg

SEQ ID NO: 3581942 - DNA, 13 bp, Homo sapiens
ctcggctgccagg

SEQ ID NO: 3581943 - DNA, 21 bp, Homo sapiens
ctcggctgccaggggctctgt

SEQ ID NO: 3581944 - DNA, 12 bp, Homo sapiens
ctcgggagccct

SEQ ID NO: 3581945 - DNA, 14 bp, Homo sapiens
ctcgggccgtaggg

SEQ ID NO: 3581946 - DNA, 19 bp, Homo sapiens
ctcggggtgtgtcatttct

SEQ ID NO: 3581947 - DNA, 16 bp, Homo sapiens
ctcgggtcaccctgct

SEQ ID NO: 3581948 - DNA, 14 bp, Homo sapiens
ctcggtatctggct

SEQ ID NO: 3581949 - DNA, 17 bp, Homo sapiens
ctcggtatctggcttcc

SEQ ID NO: 3581950 - DNA, 24 bp, Homo sapiens
ctcgtcaagagcatgcacatgctg

SEQ ID NO: 3581951 - DNA, 16 bp, Homo sapiens
ctcgtcagccacctgg

SEQ ID NO: 3581952 - DNA, 15 bp, Homo sapiens
ctcgtgaggggcaag

SEQ ID NO: 3581953 - DNA, 20 bp, Homo sapiens
ctcgtgagtcatttaaatgt

SEQ ID NO: 3581954 - DNA, 20 bp, Homo sapiens
ctcgtgcattaaaatttctt

SEQ ID NO: 3581955 - DNA, 21 bp, Homo sapiens
ctcgtgcattaaaatttctta

SEQ ID NO: 3581956 - DNA, 15 bp, Homo sapiens
ctcgtggactgtgct

SEQ ID NO: 3581957 - DNA, 19 bp, Homo sapiens
ctctaaagccaagcacttt

SEQ ID NO: 3581958 - DNA, 15 bp, Homo sapiens
ctctaagtgctgctg

SEQ ID NO: 3581959 - DNA, 19 bp, Homo sapiens
ctctaagtgctgctgtgga

SEQ ID NO: 3581960 - DNA, 16 bp, Homo sapiens
ctctaatgtctgcagc

SEQ ID NO: 3581961 - DNA, 18 bp, Homo sapiens
ctctaatgtctgcagctc

SEQ ID NO: 3581962 - DNA, 20 bp, Homo sapiens
ctctaatgtctgcagctcaa

SEQ ID NO: 3581963 - DNA, 19 bp, Homo sapiens
ctctacttagcatgtccct

SEQ ID NO: 3581964 - DNA, 21 bp, Homo sapiens
ctctagacactgccacacagg

SEQ ID NO: 3581965 - DNA, 14 bp, Homo sapiens
ctgcaccccttcct

SEQ ID NO: 3581966 - DNA, 16 bp, Homo sapiens
ctgcaccccttcctgg

SEQ ID NO: 3581967 - DNA, 17 bp, Homo sapiens
ctgcaccccttcctggg

SEQ ID NO: 3581968 - DNA, 19 bp, Homo sapiens
ctgcaccccttcctgggca

SEQ ID NO: 3581969 - DNA, 13 bp, Homo sapiens
ctgcacccgcctc

SEQ ID NO: 3581970 - DNA, 16 bp, Homo sapiens
ctgcaccctgcgcctc

SEQ ID NO: 3581971 - DNA, 19 bp, Homo sapiens
ctgcacgctcaatgcccag

SEQ ID NO: 3581972 - DNA, 18 bp, Homo sapiens
ctgcactcccacctgaca

SEQ ID NO: 3581973 - DNA, 18 bp, Homo sapiens
ctgcactcctttatctgt

SEQ ID NO: 3581974 - DNA, 14 bp, Homo sapiens
ctgcactgaggatt

SEQ ID NO: 3581975 - DNA, 20 bp, Homo sapiens
ctgcactggggcgtttccta

SEQ ID NO: 3581976 - DNA, 12 bp, Homo sapiens
ctgcactgtcaa

SEQ ID NO: 3581977 - DNA, 20 bp, Homo sapiens
ctgcagattagttctttttg

SEQ ID NO: 3581978 - DNA, 20 bp, Homo sapiens
ctgcagcagtcgcccaagca

SEQ ID NO: 3581979 - DNA, 15 bp, Homo sapiens
ctgcagcccaggcca

SEQ ID NO: 3581980 - DNA, 15 bp, Homo sapiens
ctgcagcccattccc

SEQ ID NO: 3581981 - DNA, 20 bp, Homo sapiens
ctgcagcccgtgtccaggag

SEQ ID NO: 3581982 - DNA, 14 bp, Homo sapiens
ctgcagcctcaacc

SEQ ID NO: 3581983 - DNA, 21 bp, Homo sapiens
ctgcagcctcaacctcctggg

SEQ ID NO: 3581984 - DNA, 23 bp, Homo sapiens
ctgcagcctcaacctcctgggtt

SEQ ID NO: 3581985 - DNA, 18 bp, Homo sapiens
ctgcagcctctctggctg

SEQ ID NO: 3581986 - DNA, 20 bp, Homo sapiens
ctgcagcctctctggctggt

SEQ ID NO: 3581987 - DNA, 19 bp, Homo sapiens
ctgcagcctgcaggacctc

SEQ ID NO: 3581988 - DNA, 23 bp, Homo sapiens
ctgcagccttcatcagaactctt

SEQ ID NO: 3581989 - DNA, 20 bp, Homo sapiens
ctgcagctcaagggctggca

SEQ ID NO: 3581990 - DNA, 15 bp, Homo sapiens
ctgcaggaagaaact

SEQ ID NO: 3581991 - DNA, 12 bp, Homo sapiens
ctgcaggcaggc

SEQ ID NO: 3581992 - DNA, 23 bp, Homo sapiens
ctgcaggcctaggtgcagctcct

SEQ ID NO: 3581993 - DNA, 14 bp, Homo sapiens
ctgcagggccatct

SEQ ID NO: 3581994 - DNA, 22 bp, Homo sapiens
ctgcagggccatctgactgcca

SEQ ID NO: 3581995 - DNA, 16 bp, Homo sapiens
ctgcagggcttctcct

SEQ ID NO: 3581996 - DNA, 18 bp, Homo sapiens
ctgcaggtgttctgctga

SEQ ID NO: 3581997 - DNA, 17 bp, Homo sapiens
ctgcagtaaaacacatt

SEQ ID NO: 3581998 - DNA, 16 bp, Homo sapiens
ctgcagtcccacactg

SEQ ID NO: 3581999 - DNA, 21 bp, Homo sapiens
ctgcagtcccacactgtgcag

SEQ ID NO: 3582000 - DNA, 16 bp, Homo sapiens
ctgcagtctcatttct

SEQ ID NO: 3582001 - DNA, 19 bp, Homo sapiens
ctgcagtctcatttctcat

SEQ ID NO: 3582002 - DNA, 19 bp, Homo sapiens
ctgcagttaccacagcaac

SEQ ID NO: 3582003 - DNA, 21 bp, Homo sapiens
ctgcatgagctggcaaccagc

SEQ ID NO: 3582004 - DNA, 13 bp, Homo sapiens
ctgcatgttttcc

SEQ ID NO: 3582005 - DNA, 17 bp, Homo sapiens
ctgcattattctctttt

SEQ ID NO: 3582006 - DNA, 16 bp, Homo sapiens
ctgcattcctgtgccc

SEQ ID NO: 3582007 - DNA, 23 bp, Homo sapiens
ctgcattgccgctgtataaagca

SEQ ID NO: 3582008 - DNA, 13 bp, Homo sapiens
ctgcatttgtgaa

SEQ ID NO: 3582009 - DNA, 14 bp, Homo sapiens
ctgcatttgtgaaa

SEQ ID NO: 3582010 - DNA, 15 bp, Homo sapiens
ctgcatttgtgaaat

SEQ ID NO: 3582011 - DNA, 22 bp, Homo sapiens
ctgccaaaatgctctagtgcct

SEQ ID NO: 3582012 - DNA, 14 bp, Homo sapiens
ctgccaaaggatgt

SEQ ID NO: 3582013 - DNA, 16 bp, Homo sapiens
ctgccaaaggatgtga

SEQ ID NO: 3582014 - DNA, 18 bp, Homo sapiens
ctgccaaaggatgtgata

SEQ ID NO: 3582015 - DNA, 14 bp, Homo sapiens
ctgccaaggagcat

SEQ ID NO: 3582016 - DNA, 17 bp, Homo sapiens
ctgccacccacctccct

SEQ ID NO: 3582017 - DNA, 20 bp, Homo sapiens
ctgccacccacctccctgcc

SEQ ID NO: 3582018 - DNA, 23 bp, Homo sapiens
ctgccacccacctccctgcctcc

SEQ ID NO: 3582019 - DNA, 23 bp, Homo sapiens
ctgccacccagccccagccaggg

SEQ ID NO: 3582020 - DNA, 19 bp, Homo sapiens
ctgccacccccttccctgg

SEQ ID NO: 3582021 - DNA, 22 bp, Homo sapiens
ctgccacccccttccctgggag

SEQ ID NO: 3582022 - DNA, 15 bp, Homo sapiens
ctgccagcaacgcag

SEQ ID NO: 3582023 - DNA, 12 bp, Homo sapiens
ctgccagcacag

SEQ ID NO: 3582024 - DNA, 19 bp, Homo sapiens
ctgccagctctcaggaccg

SEQ ID NO: 3582025 - DNA, 13 bp, Homo sapiens
ctgccagctgcac

SEQ ID NO: 3582026 - DNA, 16 bp, Homo sapiens
ctgccagctgcactga

SEQ ID NO: 3582027 - DNA, 19 bp, Homo sapiens
ctgccaggctgcctcctgc

SEQ ID NO: 3582028 - DNA, 15 bp, Homo sapiens
ctgccaggctgtttc

SEQ ID NO: 3582029 - DNA, 15 bp, Homo sapiens
ctgccaggggctctg

SEQ ID NO: 3582030 - DNA, 18 bp, Homo sapiens
ctgccaggggctctgtgg

SEQ ID NO: 3582031 - DNA, 21 bp, Homo sapiens
ctgccagtgaagtccttcagt

SEQ ID NO: 3582032 - DNA, 16 bp, Homo sapiens
ctgccagtgcagccac

SEQ ID NO: 3582033 - DNA, 17 bp, Homo sapiens
ctgccagttacttgggc

SEQ ID NO: 3582034 - DNA, 20 bp, Homo sapiens
ctgccagttacttgggcttc

SEQ ID NO: 3582035 - DNA, 17 bp, Homo sapiens
ctgccatgatgtatatc

SEQ ID NO: 3582036 - DNA, 20 bp, Homo sapiens
ctgccatggaattccctcct

SEQ ID NO: 3582037 - DNA, 22 bp, Homo sapiens
ctgccatggaattccctcctga

SEQ ID NO: 3582038 - DNA, 23 bp, Homo sapiens
ctgccatggaattccctcctgag

SEQ ID NO: 3582039 - DNA, 18 bp, Homo sapiens
ctgcccaaacccttaact

SEQ ID NO: 3582040 - DNA, 19 bp, Homo sapiens
ctgcccaacctgctctcct

SEQ ID NO: 3582041 - DNA, 14 bp, Homo sapiens
ctgcccacctggct

SEQ ID NO: 3582042 - DNA, 19 bp, Homo sapiens
ctgcccaggagacagacca

SEQ ID NO: 3582043 - DNA, 16 bp, Homo sapiens
ctgcccatgcaccttc

SEQ ID NO: 3582044 - DNA, 18 bp, Homo sapiens
ctgccccaccccatccag

SEQ ID NO: 3582045 - DNA, 23 bp, Homo sapiens
ctgccccaccccatccagccaga

SEQ ID NO: 3582046 - DNA, 19 bp, Homo sapiens
ctgccccagcctgtccttg

SEQ ID NO: 3582047 - DNA, 16 bp, Homo sapiens
ctgccccatcctccag

SEQ ID NO: 3582048 - DNA, 20 bp, Homo sapiens
ctgcccccagaaagcctcct

SEQ ID NO: 3582049 - DNA, 21 bp, Homo sapiens
ctgcccccagaaagcctcctg

SEQ ID NO: 3582050 - DNA, 15 bp, Homo sapiens
ctgccccccctaaga

SEQ ID NO: 3582051 - DNA, 20 bp, Homo sapiens
ctgccccccctaagagacac

SEQ ID NO: 3582052 - DNA, 13 bp, Homo sapiens
ctgccccctgcca

SEQ ID NO: 3582053 - DNA, 18 bp, Homo sapiens
ctgccccctgccagtgaa

SEQ ID NO: 3582054 - DNA, 13 bp, Homo sapiens
ctgccccctgggc

SEQ ID NO: 3582055 - DNA, 20 bp, Homo sapiens
ctgccccctgggctggggcc

SEQ ID NO: 3582056 - DNA, 13 bp, Homo sapiens
ctgcccctgcctg

SEQ ID NO: 3582057 - DNA, 14 bp, Homo sapiens
ctgcccctgcctga

SEQ ID NO: 3582058 - DNA, 14 bp, Homo sapiens
ctgcccctgctgtg

SEQ ID NO: 3582059 - DNA, 12 bp, Homo sapiens
ctgcccctgtct

SEQ ID NO: 3582060 - DNA, 14 bp, Homo sapiens
ctgcccctgtctgg

SEQ ID NO: 3582061 - DNA, 19 bp, Homo sapiens
ctgcccgcctaagaccctg

SEQ ID NO: 3582062 - DNA, 22 bp, Homo sapiens
ctgccctaagcccccagggcct

SEQ ID NO: 3582063 - DNA, 13 bp, Homo sapiens
ctgccctagctga

SEQ ID NO: 3582064 - DNA, 15 bp, Homo sapiens
ctgccctctatttat

SEQ ID NO: 3582065 - DNA, 13 bp, Homo sapiens
ctgccctgggctc

SEQ ID NO: 3582066 - DNA, 12 bp, Homo sapiens
ctgccctggtgc

SEQ ID NO: 3582067 - DNA, 14 bp, Homo sapiens
ctgccctggtgctg

SEQ ID NO: 3582068 - DNA, 17 bp, Homo sapiens
ctgccctggtgctgcca

SEQ ID NO: 3582069 - DNA, 20 bp, Homo sapiens
ctgccctggtgctgccacac

SEQ ID NO: 3582070 - DNA, 21 bp, Homo sapiens
ctgccctggtgctgccacact

SEQ ID NO: 3582071 - DNA, 13 bp, Homo sapiens
ctgccctgtaccc

SEQ ID NO: 3582072 - DNA, 21 bp, Homo sapiens
ctgccctgtaccccagcactt

SEQ ID NO: 3582073 - DNA, 18 bp, Homo sapiens
ctgccctttcaaagcact

SEQ ID NO: 3582074 - DNA, 13 bp, Homo sapiens
ctgccggctctgg

SEQ ID NO: 3582075 - DNA, 23 bp, Homo sapiens
ctgccggtcgggcagccagcaga

SEQ ID NO: 3582076 - DNA, 14 bp, Homo sapiens
ctgcctagagtgta

SEQ ID NO: 3582077 - DNA, 20 bp, Homo sapiens
ctgcctagagtgtagcctaa

SEQ ID NO: 3582078 - DNA, 22 bp, Homo sapiens
ctgcctagagtgtagcctaaag

SEQ ID NO: 3582079 - DNA, 23 bp, Homo sapiens
ctgcctagagtgtagcctaaagg

SEQ ID NO: 3582080 - DNA, 16 bp, Homo sapiens
ctgcctcacctggtcg

SEQ ID NO: 3582081 - DNA, 22 bp, Homo sapiens
ctgcctcaggacccatccctgc

SEQ ID NO: 3582082 - DNA, 15 bp, Homo sapiens
ctgcctccaccagca

SEQ ID NO: 3582083 - DNA, 13 bp, Homo sapiens
ctgcctcctcttc

SEQ ID NO: 3582084 - DNA, 24 bp, Homo sapiens
ctgcctcctcttcaactgaccagc

SEQ ID NO: 3582085 - DNA, 15 bp, Homo sapiens
ctgcctcctgccctt

SEQ ID NO: 3582086 - DNA, 15 bp, Homo sapiens
ctgcctctccctggg

SEQ ID NO: 3582087 - DNA, 18 bp, Homo sapiens
ctgcctctccctgggtct

SEQ ID NO: 3582088 - DNA, 16 bp, Homo sapiens
ctgcctgacagccttc

SEQ ID NO: 3582089 - DNA, 14 bp, Homo sapiens
ctgcctgcagcagg

SEQ ID NO: 3582090 - DNA, 15 bp, Homo sapiens
ctgcctgcagcaggc

SEQ ID NO: 3582091 - DNA, 18 bp, Homo sapiens
ctgcctgcagcaggcagc

SEQ ID NO: 3582092 - DNA, 21 bp, Homo sapiens
ctgcctgcagtactttacctc

SEQ ID NO: 3582093 - DNA, 20 bp, Homo sapiens
ctgcctgcatgagctggcaa

SEQ ID NO: 3582094 - DNA, 16 bp, Homo sapiens
ctgcctgctccttggc

SEQ ID NO: 3582095 - DNA, 18 bp, Homo sapiens
ctgcctgctgtgctggga

SEQ ID NO: 3582096 - DNA, 22 bp, Homo sapiens
ctgcctggagacaaggtgctaa

SEQ ID NO: 3582097 - DNA, 19 bp, Homo sapiens
ctggttccctgctgcgctg

SEQ ID NO: 3582098 - DNA, 22 bp, Homo sapiens
ctggttccctgctgcgctgctt

SEQ ID NO: 3582099 - DNA, 14 bp, Homo sapiens
ctggttctgaggcc

SEQ ID NO: 3582100 - DNA, 19 bp, Homo sapiens
ctggttgctccatttgaga

SEQ ID NO: 3582101 - DNA, 19 bp, Homo sapiens
ctggtttaattcagcagag

SEQ ID NO: 3582102 - DNA, 15 bp, Homo sapiens
ctgtaaaaatgttac

SEQ ID NO: 3582103 - DNA, 18 bp, Homo sapiens
ctgtaaatcctagacttg

SEQ ID NO: 3582104 - DNA, 18 bp, Homo sapiens
ctgtaacaggtattttgt

SEQ ID NO: 3582105 - DNA, 17 bp, Homo sapiens
ctgtaactactttataa

SEQ ID NO: 3582106 - DNA, 20 bp, Homo sapiens
ctgtaacttccaaataaata

SEQ ID NO: 3582107 - DNA, 15 bp, Homo sapiens
ctgtaagctttgttc

SEQ ID NO: 3582108 - DNA, 18 bp, Homo sapiens
ctgtaagctttgttctgg

SEQ ID NO: 3582109 - DNA, 12 bp, Homo sapiens
ctgtaagggcag

SEQ ID NO: 3582110 - DNA, 14 bp, Homo sapiens
ctgtaagggcagtg

SEQ ID NO: 3582111 - DNA, 17 bp, Homo sapiens
ctgtaagggcagtgccc

SEQ ID NO: 3582112 - DNA, 21 bp, Homo sapiens
ctgtaagttacatgaaggcag

SEQ ID NO: 3582113 - DNA, 20 bp, Homo sapiens
ctgtaatacgtagctctctt

SEQ ID NO: 3582114 - DNA, 21 bp, Homo sapiens
ctgtaatacgtagctctctta

SEQ ID NO: 3582115 - DNA, 18 bp, Homo sapiens
ctgtaatgctgcctcagg

SEQ ID NO: 3582116 - DNA, 20 bp, Homo sapiens
ctgtaatgctgcctcaggac

SEQ ID NO: 3582117 - DNA, 23 bp, Homo sapiens
ctgtaatgctgcctcaggaccca

SEQ ID NO: 3582118 - DNA, 16 bp, Homo sapiens
ctgtaccaaatctgac

SEQ ID NO: 3582119 - DNA, 17 bp, Homo sapiens
ctgtaccaaatctgaca

SEQ ID NO: 3582120 - DNA, 12 bp, Homo sapiens
ctgtaccagtta

SEQ ID NO: 3582121 - DNA, 16 bp, Homo sapiens
ctgtaccagttaattt

SEQ ID NO: 3582122 - DNA, 15 bp, Homo sapiens
ctgtacctgttcctc

SEQ ID NO: 3582123 - DNA, 22 bp, Homo sapiens
ctgtactagcttttgaaatcca

SEQ ID NO: 3582124 - DNA, 18 bp, Homo sapiens
ctgtactatttaaaatgc

SEQ ID NO: 3582125 - DNA, 15 bp, Homo sapiens
ctgtactcctcccag

SEQ ID NO: 3582126 - DNA, 19 bp, Homo sapiens
ctgtactcctcccaggcgc

SEQ ID NO: 3582127 - DNA, 19 bp, Homo sapiens
ctgtactgagcactgaacc

SEQ ID NO: 3582128 - DNA, 17 bp, Homo sapiens
ctgtagattcatgcaag

SEQ ID NO: 3582129 - DNA, 18 bp, Homo sapiens
ctgtagattcatgcaagt

SEQ ID NO: 3582130 - DNA, 19 bp, Homo sapiens
ctgtagattcatgcaagtg

SEQ ID NO: 3582131 - DNA, 13 bp, Homo sapiens
ctgtaggcctcag

SEQ ID NO: 3582132 - DNA, 20 bp, Homo sapiens
ctgtaggtatgatctcttct

SEQ ID NO: 3582133 - DNA, 14 bp, Homo sapiens
ctgtagtaattgtt

SEQ ID NO: 3582134 - DNA, 17 bp, Homo sapiens
ctgtagtaattgttaca

SEQ ID NO: 3582135 - DNA, 19 bp, Homo sapiens
ctgtagtttccgctttgct

SEQ ID NO: 3582136 - DNA, 20 bp, Homo sapiens
ctgtagtttccgctttgctt

SEQ ID NO: 3582137 - DNA, 14 bp, Homo sapiens
ctgtataaagcatg

SEQ ID NO: 3582138 - DNA, 20 bp, Homo sapiens
ctgtataattaattgtcatt

SEQ ID NO: 3582139 - DNA, 17 bp, Homo sapiens
ctgtatataagttgctg

SEQ ID NO: 3582140 - DNA, 22 bp, Homo sapiens
ctgtatatatttatggccgggc

SEQ ID NO: 3582141 - DNA, 15 bp, Homo sapiens
ctgtatggaaacact

SEQ ID NO: 3582142 - DNA, 15 bp, Homo sapiens
ctgtattttctttca

SEQ ID NO: 3582143 - DNA, 22 bp, Homo sapiens
ctgtcaaaactactgacaggga

SEQ ID NO: 3582144 - DNA, 13 bp, Homo sapiens
ctgtcaaggctca

SEQ ID NO: 3582145 - DNA, 14 bp, Homo sapiens
ctgtcaaggctcag

SEQ ID NO: 3582146 - DNA, 16 bp, Homo sapiens
ctgtcaatgagagcat

SEQ ID NO: 3582147 - DNA, 22 bp, Homo sapiens
ctgtcaatgagagcataattta

SEQ ID NO: 3582148 - DNA, 22 bp, Homo sapiens
ctgtcacaggttttcagagaat

SEQ ID NO: 3582149 - DNA, 24 bp, Homo sapiens
ctgtcacaggttttcagagaatta

SEQ ID NO: 3582150 - DNA, 13 bp, Homo sapiens
ctgtcacccacag

SEQ ID NO: 3582151 - DNA, 15 bp, Homo sapiens
ctgtcacccacagac

SEQ ID NO: 3582152 - DNA, 15 bp, Homo sapiens
ctgtcagtggggcag

SEQ ID NO: 3582153 - DNA, 14 bp, Homo sapiens
ctgtcatagaaatt

SEQ ID NO: 3582154 - DNA, 15 bp, Homo sapiens
ctgtcataggactct

SEQ ID NO: 3582155 - DNA, 21 bp, Homo sapiens
ctgtcatcctcaaagaaagtg

SEQ ID NO: 3582156 - DNA, 17 bp, Homo sapiens
ctgtcatttgaacctgg

SEQ ID NO: 3582157 - DNA, 15 bp, Homo sapiens
ctgtccacctcggcc

SEQ ID NO: 3582158 - DNA, 14 bp, Homo sapiens
ctgtccagctccaa

SEQ ID NO: 3582159 - DNA, 17 bp, Homo sapiens
ctgtccagctccaacct

SEQ ID NO: 3582160 - DNA, 21 bp, Homo sapiens
ctgtccagctccaacctgcaa

SEQ ID NO: 3582161 - DNA, 17 bp, Homo sapiens
ctgtccaggcactgctg

SEQ ID NO: 3582162 - DNA, 19 bp, Homo sapiens
ctgtccaggcactgctgcc

SEQ ID NO: 3582163 - DNA, 16 bp, Homo sapiens
ctgtcccacccacaca

SEQ ID NO: 3582164 - DNA, 22 bp, Homo sapiens
ctgtcccacccacacagctgcc

SEQ ID NO: 3582165 - DNA, 18 bp, Homo sapiens
ctgtcccactacatctgg

SEQ ID NO: 3582166 - DNA, 19 bp, Homo sapiens
ctgtccctagtaaaaatac

SEQ ID NO: 3582167 - DNA, 13 bp, Homo sapiens
ctgtccctgcagg

SEQ ID NO: 3582168 - DNA, 14 bp, Homo sapiens
ctgtccctgtcctt

SEQ ID NO: 3582169 - DNA, 18 bp, Homo sapiens
ctgtccctgtccttccct

SEQ ID NO: 3582170 - DNA, 12 bp, Homo sapiens
ctgtccctgtgg

SEQ ID NO: 3582171 - DNA, 16 bp, Homo sapiens
ctgtcccttgcctctg

SEQ ID NO: 3582172 - DNA, 17 bp, Homo sapiens
ctgtcccttgcctctgc

SEQ ID NO: 3582173 - DNA, 20 bp, Homo sapiens
ctgtccgtgccccttccctg

SEQ ID NO: 3582174 - DNA, 22 bp, Homo sapiens
ctgtccgtgccccttccctggg

SEQ ID NO: 3582175 - DNA, 18 bp, Homo sapiens
ctgtcctagttgtccaga

SEQ ID NO: 3582176 - DNA, 21 bp, Homo sapiens
ctgtcctattatattcattct

SEQ ID NO: 3582177 - DNA, 13 bp, Homo sapiens
ctgtcctcagcct

SEQ ID NO: 3582178 - DNA, 14 bp, Homo sapiens
ctgtcctcagcctt

SEQ ID NO: 3582179 - DNA, 22 bp, Homo sapiens
ctgtcctcagccttgccagaga

SEQ ID NO: 3582180 - DNA, 17 bp, Homo sapiens
ctgtcctccaagccagc

SEQ ID NO: 3582181 - DNA, 12 bp, Homo sapiens
ctgtcctgcagt

SEQ ID NO: 3582182 - DNA, 17 bp, Homo sapiens
ctgtcctgccacccagc

SEQ ID NO: 3582183 - DNA, 23 bp, Homo sapiens
ctgtcctgccacccagccccagc

SEQ ID NO: 3582184 - DNA, 12 bp, Homo sapiens
ctgtcctgggca

SEQ ID NO: 3582185 - DNA, 18 bp, Homo sapiens
ctgtcctgggctggtggc

SEQ ID NO: 3582186 - DNA, 19 bp, Homo sapiens
ctgtccttaacccacctct

SEQ ID NO: 3582187 - DNA, 14 bp, Homo sapiens
ctgtccttccctgt

SEQ ID NO: 3582188 - DNA, 21 bp, Homo sapiens
ctgtccttccctgttctccct

SEQ ID NO: 3582189 - DNA, 22 bp, Homo sapiens
ctgtccttccctgttctccctt

SEQ ID NO: 3582190 - DNA, 17 bp, Homo sapiens
ctgtcgaaggggaggca

SEQ ID NO: 3582191 - DNA, 14 bp, Homo sapiens
ctgtctagagaggg

SEQ ID NO: 3582192 - DNA, 18 bp, Homo sapiens
ctgtctagagagggaggc

SEQ ID NO: 3582193 - DNA, 20 bp, Homo sapiens
ctgtctcaagagggcactgg

SEQ ID NO: 3582194 - DNA, 23 bp, Homo sapiens
ctgtctcaagagggcactggtgg

SEQ ID NO: 3582195 - DNA, 17 bp, Homo sapiens
ctgtctcacctggactt

SEQ ID NO: 3582196 - DNA, 16 bp, Homo sapiens
ctgtctcatcttctga

SEQ ID NO: 3582197 - DNA, 15 bp, Homo sapiens
ctgtctccagctgcc

SEQ ID NO: 3582198 - DNA, 19 bp, Homo sapiens
ctgtctccagctgcctggg

SEQ ID NO: 3582199 - DNA, 20 bp, Homo sapiens
ctgtctccagctgcctgggc

SEQ ID NO: 3582200 - DNA, 20 bp, Homo sapiens
ctgtctccagggcccccacc

SEQ ID NO: 3582201 - DNA, 18 bp, Homo sapiens
ctgtctccatgtttgatg

SEQ ID NO: 3582202 - DNA, 11 bp, Homo sapiens
ctgtctccttt

SEQ ID NO: 3582203 - DNA, 18 bp, Homo sapiens
ctgtctcggctctgcatg

SEQ ID NO: 3582204 - DNA, 15 bp, Homo sapiens
ctgtctctccagtga

SEQ ID NO: 3582205 - DNA, 17 bp, Homo sapiens
ctgtctctccagtgaaa

SEQ ID NO: 3582206 - DNA, 17 bp, Homo sapiens
ctgtctgagacaggtgc

SEQ ID NO: 3582207 - DNA, 13 bp, Homo sapiens
ctgtctgctgcca

SEQ ID NO: 3582208 - DNA, 17 bp, Homo sapiens
ctgtctgctgccagcac

SEQ ID NO: 3582209 - DNA, 12 bp, Homo sapiens
ctgtctggaaga

SEQ ID NO: 3582210 - DNA, 20 bp, Homo sapiens
ctgtctggaagacgtggctc

SEQ ID NO: 3582211 - DNA, 21 bp, Homo sapiens
ctgtctggaagacgtggctct

SEQ ID NO: 3582212 - DNA, 16 bp, Homo sapiens
ctgtctgggctcagac

SEQ ID NO: 3582213 - DNA, 20 bp, Homo sapiens
ctgtctgggctcagacatcc

SEQ ID NO: 3582214 - DNA, 13 bp, Homo sapiens
ctgtcttctttct

SEQ ID NO: 3582215 - DNA, 22 bp, Homo sapiens
ctgtcttctttctccatggagc

SEQ ID NO: 3582216 - DNA, 19 bp, Homo sapiens
ctgtcttgaattagtattt

SEQ ID NO: 3582217 - DNA, 21 bp, Homo sapiens
ctgtcttgaattagtatttca

SEQ ID NO: 3582218 - DNA, 22 bp, Homo sapiens
ctgtcttgaattagtatttcag

SEQ ID NO: 3582219 - DNA, 14 bp, Homo sapiens
ctgtctttcttgct

SEQ ID NO: 3582220 - DNA, 19 bp, Homo sapiens
ctgtctttgatcgcctctt

SEQ ID NO: 3582221 - DNA, 17 bp, Homo sapiens
ctgtcttttctttgcca

SEQ ID NO: 3582222 - DNA, 20 bp, Homo sapiens
ctgtgaagccaccctgggct

SEQ ID NO: 3582223 - DNA, 23 bp, Homo sapiens
ctgtgaccagtctgacccttaca

SEQ ID NO: 3582224 - DNA, 12 bp, Homo sapiens
ctgtgagcacaa

SEQ ID NO: 3582225 - DNA, 16 bp, Homo sapiens
ctgtgagcacaaagaa

SEQ ID NO: 3582226 - DNA, 21 bp, Homo sapiens
ctgtgagcacaaagaagaaag

SEQ ID NO: 3582227 - DNA, 18 bp, Homo sapiens
ctgtgagcatggggccag

SEQ ID NO: 3582228 - DNA, 19 bp, Homo sapiens
ctgtgagcatggggccagg

SEQ ID NO: 3582229 - DNA, 17 bp, Homo sapiens
cttccaggcctgaagtc

SEQ ID NO: 3582230 - DNA, 22 bp, Homo sapiens
cttccagggcagcggctccact

SEQ ID NO: 3582231 - DNA, 21 bp, Homo sapiens
cttccataatctggactcctc

SEQ ID NO: 3582232 - DNA, 19 bp, Homo sapiens
cttccatgtcgcctctgca

SEQ ID NO: 3582233 - DNA, 20 bp, Homo sapiens
cttccatgtcgcctctgcat

SEQ ID NO: 3582234 - DNA, 13 bp, Homo sapiens
cttccatgtgcct

SEQ ID NO: 3582235 - DNA, 18 bp, Homo sapiens
cttccatgtgcctttctt

SEQ ID NO: 3582236 - DNA, 23 bp, Homo sapiens
cttccatgtgcctttctttgcct

SEQ ID NO: 3582237 - DNA, 24 bp, Homo sapiens
cttcccacaactactagtgtgact

SEQ ID NO: 3582238 - DNA, 14 bp, Homo sapiens
cttcccactccagc

SEQ ID NO: 3582239 - DNA, 15 bp, Homo sapiens
cttcccactccagct

SEQ ID NO: 3582240 - DNA, 13 bp, Homo sapiens
cttcccagcaatt

SEQ ID NO: 3582241 - DNA, 16 bp, Homo sapiens
cttcccagcgctgctg

SEQ ID NO: 3582242 - DNA, 14 bp, Homo sapiens
cttcccatggccat

SEQ ID NO: 3582243 - DNA, 13 bp, Homo sapiens
cttcccatttctt

SEQ ID NO: 3582244 - DNA, 13 bp, Homo sapiens
cttcccctccctg

SEQ ID NO: 3582245 - DNA, 17 bp, Homo sapiens
cttccccttagaaacac

SEQ ID NO: 3582246 - DNA, 14 bp, Homo sapiens
cttccccttcctgt

SEQ ID NO: 3582247 - DNA, 20 bp, Homo sapiens
cttcccgccgcccagcccac

SEQ ID NO: 3582248 - DNA, 23 bp, Homo sapiens
cttcccgccgcccagcccacccc

SEQ ID NO: 3582249 - DNA, 19 bp, Homo sapiens
cttcccgcctccctctcag

SEQ ID NO: 3582250 - DNA, 15 bp, Homo sapiens
cttcccgctcagccc

SEQ ID NO: 3582251 - DNA, 16 bp, Homo sapiens
cttcccgctcagccct

SEQ ID NO: 3582252 - DNA, 18 bp, Homo sapiens
cttcccgctcagccctcc

SEQ ID NO: 3582253 - DNA, 16 bp, Homo sapiens
cttccctaaactgcag

SEQ ID NO: 3582254 - DNA, 18 bp, Homo sapiens
cttccctaaactgcagcc

SEQ ID NO: 3582255 - DNA, 12 bp, Homo sapiens
cttccctcaggc

SEQ ID NO: 3582256 - DNA, 15 bp, Homo sapiens
cttccctgctttgca

SEQ ID NO: 3582257 - DNA, 16 bp, Homo sapiens
cttccctgctttgcat

SEQ ID NO: 3582258 - DNA, 18 bp, Homo sapiens
cttccctgctttgcatct

SEQ ID NO: 3582259 - DNA, 23 bp, Homo sapiens
cttccctggaaaccttccaccca

SEQ ID NO: 3582260 - DNA, 13 bp, Homo sapiens
cttccctgggagg

SEQ ID NO: 3582261 - DNA, 12 bp, Homo sapiens
cttccctgggtt

SEQ ID NO: 3582262 - DNA, 19 bp, Homo sapiens
cttccctgggtttgggagc

SEQ ID NO: 3582263 - DNA, 16 bp, Homo sapiens
cttccctttctaagca

SEQ ID NO: 3582264 - DNA, 16 bp, Homo sapiens
cttccgctgaggggtc

SEQ ID NO: 3582265 - DNA, 20 bp, Homo sapiens
cttccgctttgaaagaagca

SEQ ID NO: 3582266 - DNA, 19 bp, Homo sapiens
cttccgggttcaagtgact

SEQ ID NO: 3582267 - DNA, 17 bp, Homo sapiens
cttcctactcctcatag

SEQ ID NO: 3582268 - DNA, 15 bp, Homo sapiens
cttcctagttttctc

SEQ ID NO: 3582269 - DNA, 17 bp, Homo sapiens
cttcctagttttctcct

SEQ ID NO: 3582270 - DNA, 18 bp, Homo sapiens
cttcctcacacccctgtc

SEQ ID NO: 3582271 - DNA, 20 bp, Homo sapiens
cttcctcacacccctgtccc

SEQ ID NO: 3582272 - DNA, 22 bp, Homo sapiens
cttcctcacacccctgtcccac

SEQ ID NO: 3582273 - DNA, 16 bp, Homo sapiens
cttcctccacttcatt

SEQ ID NO: 3582274 - DNA, 15 bp, Homo sapiens
cttcctcctcccaag

SEQ ID NO: 3582275 - DNA, 20 bp, Homo sapiens
cttcctcgtgggtcccagag

SEQ ID NO: 3582276 - DNA, 22 bp, Homo sapiens
cttcctcgtgggtcccagagac

SEQ ID NO: 3582277 - DNA, 23 bp, Homo sapiens
cttcctcgtgggtcccagagacc

SEQ ID NO: 3582278 - DNA, 13 bp, Homo sapiens
cttcctctccact

SEQ ID NO: 3582279 - DNA, 15 bp, Homo sapiens
cttcctctccactgc

SEQ ID NO: 3582280 - DNA, 21 bp, Homo sapiens
cttcctctccactgccttcga

SEQ ID NO: 3582281 - DNA, 23 bp, Homo sapiens
cttcctctggctccccaaggctg

SEQ ID NO: 3582282 - DNA, 19 bp, Homo sapiens
cttcctgccggttccgccc

SEQ ID NO: 3582283 - DNA, 17 bp, Homo sapiens
cttcctgctgctgctac

SEQ ID NO: 3582284 - DNA, 18 bp, Homo sapiens
cttcctggaaacagcatg

SEQ ID NO: 3582285 - DNA, 19 bp, Homo sapiens
cttcctggaaacagcatga

SEQ ID NO: 3582286 - DNA, 12 bp, Homo sapiens
cttcctggcaca

SEQ ID NO: 3582287 - DNA, 18 bp, Homo sapiens
cttcctgggcacacgctg

SEQ ID NO: 3582288 - DNA, 22 bp, Homo sapiens
cttcctgtgaagtttaattgtc

SEQ ID NO: 3582289 - DNA, 16 bp, Homo sapiens
cttcctgtgacttcag

SEQ ID NO: 3582290 - DNA, 18 bp, Homo sapiens
cttcctgtgcctttccta

SEQ ID NO: 3582291 - DNA, 14 bp, Homo sapiens
cttccttttaactg

SEQ ID NO: 3582292 - DNA, 12 bp, Homo sapiens
cttccttttcac

SEQ ID NO: 3582293 - DNA, 13 bp, Homo sapiens
cttccttttcact

SEQ ID NO: 3582294 - DNA, 14 bp, Homo sapiens
cttccttttcactg

SEQ ID NO: 3582295 - DNA, 12 bp, Homo sapiens
cttcgctggact

SEQ ID NO: 3582296 - DNA, 17 bp, Homo sapiens
cttcgctggactattgt

SEQ ID NO: 3582297 - DNA, 17 bp, Homo sapiens
cttcggacagacatatg

SEQ ID NO: 3582298 - DNA, 14 bp, Homo sapiens
cttcgggctgtgcc

SEQ ID NO: 3582299 - DNA, 19 bp, Homo sapiens
cttcggtacccaccacaca

SEQ ID NO: 3582300 - DNA, 22 bp, Homo sapiens
cttctaaaggtgttgtcccttc

SEQ ID NO: 3582301 - DNA, 16 bp, Homo sapiens
cttctaaattcccaaa

SEQ ID NO: 3582302 - DNA, 19 bp, Homo sapiens
cttctacatgatgctaaag

SEQ ID NO: 3582303 - DNA, 13 bp, Homo sapiens
cttctactcccct

SEQ ID NO: 3582304 - DNA, 23 bp, Homo sapiens
cttctagttgcccccattcccag

SEQ ID NO: 3582305 - DNA, 17 bp, Homo sapiens
cttctatacccacccag

SEQ ID NO: 3582306 - DNA, 16 bp, Homo sapiens
cttctatttatttatt

SEQ ID NO: 3582307 - DNA, 14 bp, Homo sapiens
cttctattttgtaa

SEQ ID NO: 3582308 - DNA, 17 bp, Homo sapiens
cttctattttgtaaact

SEQ ID NO: 3582309 - DNA, 15 bp, Homo sapiens
cttctcaaagagaat

SEQ ID NO: 3582310 - DNA, 14 bp, Homo sapiens
cttctcaccagcag

SEQ ID NO: 3582311 - DNA, 14 bp, Homo sapiens
cttctcacggcctg

SEQ ID NO: 3582312 - DNA, 13 bp, Homo sapiens
cttctcacggcga

SEQ ID NO: 3582313 - DNA, 13 bp, Homo sapiens
cttctcactgcca

SEQ ID NO: 3582314 - DNA, 22 bp, Homo sapiens
cttctcagatttctgaggaaat

SEQ ID NO: 3582315 - DNA, 17 bp, Homo sapiens
cttctccactggatgga

SEQ ID NO: 3582316 - DNA, 22 bp, Homo sapiens
cttctcccagtgtgagacccca

SEQ ID NO: 3582317 - DNA, 16 bp, Homo sapiens
cttctctccagctgac

SEQ ID NO: 3582318 - DNA, 12 bp, Homo sapiens
cttctctctcca

SEQ ID NO: 3582319 - DNA, 13 bp, Homo sapiens
cttctctgcctca

SEQ ID NO: 3582320 - DNA, 21 bp, Homo sapiens
cttctctgggtctgattttct

SEQ ID NO: 3582321 - DNA, 19 bp, Homo sapiens
cttctctgttggtctgcct

SEQ ID NO: 3582322 - DNA, 20 bp, Homo sapiens
cttctcttgaaaagttcagg

SEQ ID NO: 3582323 - DNA, 21 bp, Homo sapiens
cttctcttgaaaagttcaggg

SEQ ID NO: 3582324 - DNA, 12 bp, Homo sapiens
cttctgaagatt

SEQ ID NO: 3582325 - DNA, 18 bp, Homo sapiens
cttctgaataaagcaatt

SEQ ID NO: 3582326 - DNA, 22 bp, Homo sapiens
cttctgaataaagcaattagca

SEQ ID NO: 3582327 - DNA, 18 bp, Homo sapiens
cttctgaatattttatct

SEQ ID NO: 3582328 - DNA, 20 bp, Homo sapiens
cttctgctactggcaaaagg

SEQ ID NO: 3582329 - DNA, 16 bp, Homo sapiens
cttctgctcttttcct

SEQ ID NO: 3582330 - DNA, 17 bp, Homo sapiens
cttctggccacatcagc

SEQ ID NO: 3582331 - DNA, 19 bp, Homo sapiens
cttctggccacatcagccc

SEQ ID NO: 3582332 - DNA, 17 bp, Homo sapiens
cttctgggtccagggag

SEQ ID NO: 3582333 - DNA, 15 bp, Homo sapiens
cttctggtgttgact

SEQ ID NO: 3582334 - DNA, 13 bp, Homo sapiens
cttcttatacatt

SEQ ID NO: 3582335 - DNA, 13 bp, Homo sapiens
cttcttcctgtga

SEQ ID NO: 3582336 - DNA, 17 bp, Homo sapiens
cttcttctctccacatg

SEQ ID NO: 3582337 - DNA, 19 bp, Homo sapiens
cttctttagaccctcgggc

SEQ ID NO: 3582338 - DNA, 21 bp, Homo sapiens
cttctttagaccctcgggccc

SEQ ID NO: 3582339 - DNA, 14 bp, Homo sapiens
cttctttccagtat

SEQ ID NO: 3582340 - DNA, 13 bp, Homo sapiens
cttctttcctctt

SEQ ID NO: 3582341 - DNA, 18 bp, Homo sapiens
cttctttcctttactcct

SEQ ID NO: 3582342 - DNA, 22 bp, Homo sapiens
cttctttcctttactcctggct

SEQ ID NO: 3582343 - DNA, 16 bp, Homo sapiens
cttctttctagaaaga

SEQ ID NO: 3582344 - DNA, 19 bp, Homo sapiens
cttctttctttcttttgca

SEQ ID NO: 3582345 - DNA, 16 bp, Homo sapiens
cttctttggttccatg

SEQ ID NO: 3582346 - DNA, 15 bp, Homo sapiens
cttctttgtgccttt

SEQ ID NO: 3582347 - DNA, 18 bp, Homo sapiens
cttctttgtgcctttggc

SEQ ID NO: 3582348 - DNA, 22 bp, Homo sapiens
cttctttgtgcctttggcctgg

SEQ ID NO: 3582349 - DNA, 14 bp, Homo sapiens
cttcttttttatct

SEQ ID NO: 3582350 - DNA, 17 bp, Homo sapiens
cttgaacgagcagccca

SEQ ID NO: 3582351 - DNA, 19 bp, Homo sapiens
cttgaacgagcagcccagg

SEQ ID NO: 3582352 - DNA, 13 bp, Homo sapiens
cttgaagggccag

SEQ ID NO: 3582353 - DNA, 14 bp, Homo sapiens
cttgaagggccaga

SEQ ID NO: 3582354 - DNA, 15 bp, Homo sapiens
cttgaagggccagag

SEQ ID NO: 3582355 - DNA, 16 bp, Homo sapiens
cttgaagggccagagc

SEQ ID NO: 3582356 - DNA, 17 bp, Homo sapiens
cttgaagggccagagcc

SEQ ID NO: 3582357 - DNA, 21 bp, Homo sapiens
cttgaagggccagagccaggg

SEQ ID NO: 3582358 - DNA, 18 bp, Homo sapiens
cttgaattagtatttcag

SEQ ID NO: 3582359 - DNA, 13 bp, Homo sapiens
cttgacacctgct

SEQ ID NO: 3582360 - DNA, 22 bp, Homo sapiens
cttgacacctgctgagaaaaca

SEQ ID NO: 3582361 - DNA, 16 bp, Homo sapiens
cttgaccaacagaaac

SEQ ID NO: 3582362 - DNA, 18 bp, Homo sapiens
gaaagagaaacagttggt

SEQ ID NO: 3582363 - DNA, 18 bp, Homo sapiens
gaaagagagaagccagcc

SEQ ID NO: 3582364 - DNA, 13 bp, Homo sapiens
gaaagagaggact

SEQ ID NO: 3582365 - DNA, 14 bp, Homo sapiens
gaaagagctgcctg

SEQ ID NO: 3582366 - DNA, 22 bp, Homo sapiens
gaaagaggcagggacctaaagg

SEQ ID NO: 3582367 - DNA, 20 bp, Homo sapiens
gaaagatgcagtcctcagga

SEQ ID NO: 3582368 - DNA, 18 bp, Homo sapiens
gaaagcaaaggtgcactc

SEQ ID NO: 3582369 - DNA, 22 bp, Homo sapiens
gaaagcaaaggtgcactccaga

SEQ ID NO: 3582370 - DNA, 17 bp, Homo sapiens
gaaagcacaagactggc

SEQ ID NO: 3582371 - DNA, 14 bp, Homo sapiens
gaaagccacatctt

SEQ ID NO: 3582372 - DNA, 14 bp, Homo sapiens
gaaagcgggcagcc

SEQ ID NO: 3582373 - DNA, 15 bp, Homo sapiens
gaaagcgggcagccc

SEQ ID NO: 3582374 - DNA, 16 bp, Homo sapiens
gaaagcgggcagcccc

SEQ ID NO: 3582375 - DNA, 17 bp, Homo sapiens
gaaagcttcaaactgca

SEQ ID NO: 3582376 - DNA, 20 bp, Homo sapiens
gaaagctttgttgaaagaaa

SEQ ID NO: 3582377 - DNA, 14 bp, Homo sapiens
gaaaggattttacc

SEQ ID NO: 3582378 - DNA, 20 bp, Homo sapiens
gaaaggcagggcaagaacag

SEQ ID NO: 3582379 - DNA, 17 bp, Homo sapiens
gaaaggccctgcacagg

SEQ ID NO: 3582380 - DNA, 15 bp, Homo sapiens
gaaaggggagcccac

SEQ ID NO: 3582381 - DNA, 16 bp, Homo sapiens
gaaaggggagcccact

SEQ ID NO: 3582382 - DNA, 12 bp, Homo sapiens
gaaagggtctcc

SEQ ID NO: 3582383 - DNA, 19 bp, Homo sapiens
gaaagggttaatcatattt

SEQ ID NO: 3582384 - DNA, 16 bp, Homo sapiens
gaaaggtgtgaggaga

SEQ ID NO: 3582385 - DNA, 15 bp, Homo sapiens
gaaagtgtatttgga

SEQ ID NO: 3582386 - DNA, 12 bp, Homo sapiens
gaaagtgtgaag

SEQ ID NO: 3582387 - DNA, 21 bp, Homo sapiens
gaaagttgggcccctgaggag

SEQ ID NO: 3582388 - DNA, 14 bp, Homo sapiens
gaaagttttccagt

SEQ ID NO: 3582389 - DNA, 15 bp, Homo sapiens
gaaatacctttgtag

SEQ ID NO: 3582390 - DNA, 21 bp, Homo sapiens
gaaatacctttgtagttactc

SEQ ID NO: 3582391 - DNA, 21 bp, Homo sapiens
gaaatatattttctctttttg

SEQ ID NO: 3582392 - DNA, 23 bp, Homo sapiens
gaaatatccacccagcaggcaga

SEQ ID NO: 3582393 - DNA, 16 bp, Homo sapiens
gaaatcaaatgtaaag

SEQ ID NO: 3582394 - DNA, 14 bp, Homo sapiens
gaaatccattcaca

SEQ ID NO: 3582395 - DNA, 13 bp, Homo sapiens
gaaatcttcccag

SEQ ID NO: 3582396 - DNA, 22 bp, Homo sapiens
gaaatgacggtgttaattttgc

SEQ ID NO: 3582397 - DNA, 17 bp, Homo sapiens
gaaatgaggtctgttta

SEQ ID NO: 3582398 - DNA, 22 bp, Homo sapiens
gaaatgccactgggacagctgg

SEQ ID NO: 3582399 - DNA, 24 bp, Homo sapiens
gaaatggaggatctctaaagagca

SEQ ID NO: 3582400 - DNA, 20 bp, Homo sapiens
gaaatggtttcacttgctct

SEQ ID NO: 3582401 - DNA, 22 bp, Homo sapiens
gaaatgtaagggaaactgccag

SEQ ID NO: 3582402 - DNA, 22 bp, Homo sapiens
gaaatgtgtttccttttcagga

SEQ ID NO: 3582403 - DNA, 17 bp, Homo sapiens
gaaattacacccaaaga

SEQ ID NO: 3582404 - DNA, 22 bp, Homo sapiens
gaaattactgcccacttgtcaa

SEQ ID NO: 3582405 - DNA, 15 bp, Homo sapiens
gaaattataactatt

SEQ ID NO: 3582406 - DNA, 16 bp, Homo sapiens
gaaattataactatta

SEQ ID NO: 3582407 - DNA, 19 bp, Homo sapiens
gaaattataactattacag

SEQ ID NO: 3582408 - DNA, 22 bp, Homo sapiens
gaaattataactattacagtgt

SEQ ID NO: 3582409 - DNA, 22 bp, Homo sapiens
gaaattatgtgacattttacat

SEQ ID NO: 3582410 - DNA, 15 bp, Homo sapiens
gaaatttaattacaa

SEQ ID NO: 3582411 - DNA, 19 bp, Homo sapiens
gaaatttaattacaaacaa

SEQ ID NO: 3582412 - DNA, 20 bp, Homo sapiens
gaaatttaattacaaacaat

SEQ ID NO: 3582413 - DNA, 22 bp, Homo sapiens
gaaatttaattacaaacaataa

SEQ ID NO: 3582414 - DNA, 11 bp, Homo sapiens
gaaatttcaga

SEQ ID NO: 3582415 - DNA, 23 bp, Homo sapiens
gaaatttcagattcccagagcaa

SEQ ID NO: 3582416 - DNA, 19 bp, Homo sapiens
gaaatttttattaaattat

SEQ ID NO: 3582417 - DNA, 19 bp, Homo sapiens
gaacaaaaattacaaagaa

SEQ ID NO: 3582418 - DNA, 18 bp, Homo sapiens
gaacaaacaaaacttaaa

SEQ ID NO: 3582419 - DNA, 20 bp, Homo sapiens
gaacaaacaaaacttaaaag

SEQ ID NO: 3582420 - DNA, 14 bp, Homo sapiens
gaacaaagacaggc

SEQ ID NO: 3582421 - DNA, 13 bp, Homo sapiens
gaacaagcttcag

SEQ ID NO: 3582422 - DNA, 18 bp, Homo sapiens
gaacaagcttcagtaagt

SEQ ID NO: 3582423 - DNA, 21 bp, Homo sapiens
gaacaagttttggcagccatg

SEQ ID NO: 3582424 - DNA, 22 bp, Homo sapiens
gaacaagttttggcagccatga

SEQ ID NO: 3582425 - DNA, 19 bp, Homo sapiens
gaacaatattgactttgtc

SEQ ID NO: 3582426 - DNA, 23 bp, Homo sapiens
gaacaatggaagaagaaaggact

SEQ ID NO: 3582427 - DNA, 15 bp, Homo sapiens
gaacacagttctggg

SEQ ID NO: 3582428 - DNA, 15 bp, Homo sapiens
gaacactgagaaaga

SEQ ID NO: 3582429 - DNA, 19 bp, Homo sapiens
gaacagatgctgagccata

SEQ ID NO: 3582430 - DNA, 14 bp, Homo sapiens
gaacagccttagag

SEQ ID NO: 3582431 - DNA, 18 bp, Homo sapiens
gaacagccttagagctct

SEQ ID NO: 3582432 - DNA, 17 bp, Homo sapiens
gaacaggaaagagctag

SEQ ID NO: 3582433 - DNA, 16 bp, Homo sapiens
gaacataaaaaggaca

SEQ ID NO: 3582434 - DNA, 18 bp, Homo sapiens
gaacataaaaaggacatc

SEQ ID NO: 3582435 - DNA, 15 bp, Homo sapiens
gaacataaaatacaa

SEQ ID NO: 3582436 - DNA, 15 bp, Homo sapiens
gaacatgattttaca

SEQ ID NO: 3582437 - DNA, 22 bp, Homo sapiens
gaacatgtgtgtggtggtgact

SEQ ID NO: 3582438 - DNA, 21 bp, Homo sapiens
gaacatgtgttttcatcattt

SEQ ID NO: 3582439 - DNA, 13 bp, Homo sapiens
gaacattataatt

SEQ ID NO: 3582440 - DNA, 16 bp, Homo sapiens
gaacattcagctctgg

SEQ ID NO: 3582441 - DNA, 20 bp, Homo sapiens
gaacattcagctctggagaa

SEQ ID NO: 3582442 - DNA, 17 bp, Homo sapiens
gaacattccatttgctt

SEQ ID NO: 3582443 - DNA, 21 bp, Homo sapiens
gaaccaaattgcactgaagtt

SEQ ID NO: 3582444 - DNA, 23 bp, Homo sapiens
gaaccaatcaaggtagaacaaag

SEQ ID NO: 3582445 - DNA, 19 bp, Homo sapiens
gaaccagtccccccaccct

SEQ ID NO: 3582446 - DNA, 20 bp, Homo sapiens
gaaccagtctcctcactctg

SEQ ID NO: 3582447 - DNA, 21 bp, Homo sapiens
gaaccatgcaggaaggaaaac

SEQ ID NO: 3582448 - DNA, 16 bp, Homo sapiens
gaacccaagtccaagc

SEQ ID NO: 3582449 - DNA, 23 bp, Homo sapiens
gaacccacataaaagccccagct

SEQ ID NO: 3582450 - DNA, 21 bp, Homo sapiens
gaacccccctcccacccaccg

SEQ ID NO: 3582451 - DNA, 21 bp, Homo sapiens
gaacccctacatgaaacagaa

SEQ ID NO: 3582452 - DNA, 22 bp, Homo sapiens
gaaccctcaggccaccctccac

SEQ ID NO: 3582453 - DNA, 18 bp, Homo sapiens
gaaccctccaaaggaact

SEQ ID NO: 3582454 - DNA, 20 bp, Homo sapiens
gaaccgcagaagcctcccca

SEQ ID NO: 3582455 - DNA, 19 bp, Homo sapiens
gaacctacagactccatct

SEQ ID NO: 3582456 - DNA, 18 bp, Homo sapiens
gaacctcagattcttcat

SEQ ID NO: 3582457 - DNA, 13 bp, Homo sapiens
gaacctcagcctg

SEQ ID NO: 3582458 - DNA, 17 bp, Homo sapiens
gaacctcagcctggcca

SEQ ID NO: 3582459 - DNA, 18 bp, Homo sapiens
gaacctcagcctggccag

SEQ ID NO: 3582460 - DNA, 19 bp, Homo sapiens
gaacctcagcctggccaga

SEQ ID NO: 3582461 - DNA, 19 bp, Homo sapiens
gaacctctaagtgctgctg

SEQ ID NO: 3582462 - DNA, 22 bp, Homo sapiens
gaacctctaagtgctgctgtgg

SEQ ID NO: 3582463 - DNA, 21 bp, Homo sapiens
gaacctgctctcggaggatgc

SEQ ID NO: 3582464 - DNA, 11 bp, Homo sapiens
gaacctggatc

SEQ ID NO: 3582465 - DNA, 17 bp, Homo sapiens
gaacctggatccagcac

SEQ ID NO: 3582466 - DNA, 17 bp, Homo sapiens
gaacctgggaggcagag

SEQ ID NO: 3582467 - DNA, 20 bp, Homo sapiens
gaaccttaatgacaacactt

SEQ ID NO: 3582468 - DNA, 21 bp, Homo sapiens
gaaccttaatgacaacactta

SEQ ID NO: 3582469 - DNA, 18 bp, Homo sapiens
gaaccttctggcctccca

SEQ ID NO: 3582470 - DNA, 21 bp, Homo sapiens
gaaccttctggcctcccacag

SEQ ID NO: 3582471 - DNA, 15 bp, Homo sapiens
gaacgagcagcccag

SEQ ID NO: 3582472 - DNA, 18 bp, Homo sapiens
gaacgagcagcccagggc

SEQ ID NO: 3582473 - DNA, 13 bp, Homo sapiens
gaacgcaccccac

SEQ ID NO: 3582474 - DNA, 17 bp, Homo sapiens
gaacgtggattgtattt

SEQ ID NO: 3582475 - DNA, 13 bp, Homo sapiens
gaacgtggtttgc

SEQ ID NO: 3582476 - DNA, 17 bp, Homo sapiens
gaacgtttcactgcaaa

SEQ ID NO: 3582477 - DNA, 16 bp, Homo sapiens
gaactaaaatgttcta

SEQ ID NO: 3582478 - DNA, 20 bp, Homo sapiens
gaactattgtgctcagagac

SEQ ID NO: 3582479 - DNA, 21 bp, Homo sapiens
gaactcaccctgggagccagt

SEQ ID NO: 3582480 - DNA, 22 bp, Homo sapiens
gaactccaccgaccaactgccc

SEQ ID NO: 3582481 - DNA, 15 bp, Homo sapiens
gaactcttctttgct

SEQ ID NO: 3582482 - DNA, 18 bp, Homo sapiens
gaactgaaatccttgaga

SEQ ID NO: 3582483 - DNA, 17 bp, Homo sapiens
gaactgagctgggcagg

SEQ ID NO: 3582484 - DNA, 22 bp, Homo sapiens
gaactgaggagatgaccaggga

SEQ ID NO: 3582485 - DNA, 15 bp, Homo sapiens
gaactgagtatgtgt

SEQ ID NO: 3582486 - DNA, 18 bp, Homo sapiens
gaactgcccttgctgccc

SEQ ID NO: 3582487 - DNA, 20 bp, Homo sapiens
gaactgcccttgctgcccgc

SEQ ID NO: 3582488 - DNA, 15 bp, Homo sapiens
gaactggacacaata

SEQ ID NO: 3582489 - DNA, 18 bp, Homo sapiens
gaacttaaggcatttgtt

SEQ ID NO: 3582490 - DNA, 20 bp, Homo sapiens
gaacttccaggaaagtgtga

SEQ ID NO: 3582491 - DNA, 14 bp, Homo sapiens
gaacttgctgctgc

SEQ ID NO: 3582492 - DNA, 17 bp, Homo sapiens
gaacttgctgctgcctt

SEQ ID NO: 3582493 - DNA, 18 bp, Homo sapiens
gactcctcagcacccctc

SEQ ID NO: 3582494 - DNA, 12 bp, Homo sapiens
gactcctggcag

SEQ ID NO: 3582495 - DNA, 21 bp, Homo sapiens
gactcctggcagggccacctg

SEQ ID NO: 3582496 - DNA, 18 bp, Homo sapiens
gactcctgttgccatgga

SEQ ID NO: 3582497 - DNA, 20 bp, Homo sapiens
gactccttatctctttccac

SEQ ID NO: 3582498 - DNA, 22 bp, Homo sapiens
gactccttatctctttccacca

SEQ ID NO: 3582499 - DNA, 15 bp, Homo sapiens
gactctaaagtctgt

SEQ ID NO: 3582500 - DNA, 14 bp, Homo sapiens
gactctctccagga

SEQ ID NO: 3582501 - DNA, 21 bp, Homo sapiens
gactctctccaggagggctcg

SEQ ID NO: 3582502 - DNA, 15 bp, Homo sapiens
gactctgcacccgcc

SEQ ID NO: 3582503 - DNA, 20 bp, Homo sapiens
gactctggaggtcatctggc

SEQ ID NO: 3582504 - DNA, 16 bp, Homo sapiens
gactgacccccatctg

SEQ ID NO: 3582505 - DNA, 20 bp, Homo sapiens
gactgacccccatctgagct

SEQ ID NO: 3582506 - DNA, 19 bp, Homo sapiens
gactgagcagccgccagct

SEQ ID NO: 3582507 - DNA, 20 bp, Homo sapiens
gactgagcagccgccagctg

SEQ ID NO: 3582508 - DNA, 14 bp, Homo sapiens
gactgcattgccgc

SEQ ID NO: 3582509 - DNA, 20 bp, Homo sapiens
gactgccaagccagattctc

SEQ ID NO: 3582510 - DNA, 17 bp, Homo sapiens
gactgccctctcgactg

SEQ ID NO: 3582511 - DNA, 22 bp, Homo sapiens
gactggcacagttttctgagaa

SEQ ID NO: 3582512 - DNA, 18 bp, Homo sapiens
gactggcccagtgccagc

SEQ ID NO: 3582513 - DNA, 23 bp, Homo sapiens
gactgggggcagacatggtgggg

SEQ ID NO: 3582514 - DNA, 13 bp, Homo sapiens
gactggtccagct

SEQ ID NO: 3582515 - DNA, 15 bp, Homo sapiens
gactggtccagctct

SEQ ID NO: 3582516 - DNA, 18 bp, Homo sapiens
gactggtccagctctgac

SEQ ID NO: 3582517 - DNA, 19 bp, Homo sapiens
gactggttctgaggccaga

SEQ ID NO: 3582518 - DNA, 23 bp, Homo sapiens
gactggttctgaggccagaaagg

SEQ ID NO: 3582519 - DNA, 23 bp, Homo sapiens
gactgtactcctcccaggcgccc

SEQ ID NO: 3582520 - DNA, 13 bp, Homo sapiens
gactgtcagttct

SEQ ID NO: 3582521 - DNA, 17 bp, Homo sapiens
gactgtctccacggcct

SEQ ID NO: 3582522 - DNA, 14 bp, Homo sapiens
gactgtgccagagg

SEQ ID NO: 3582523 - DNA, 16 bp, Homo sapiens
gactgtgccagaggcc

SEQ ID NO: 3582524 - DNA, 17 bp, Homo sapiens
gactgtgccagaggcca

SEQ ID NO: 3582525 - DNA, 23 bp, Homo sapiens
gacttaaactgctgaattcacct

SEQ ID NO: 3582526 - DNA, 13 bp, Homo sapiens
gacttagaaactg

SEQ ID NO: 3582527 - DNA, 18 bp, Homo sapiens
gacttatttctgctctgg

SEQ ID NO: 3582528 - DNA, 14 bp, Homo sapiens
gacttcagctctgt

SEQ ID NO: 3582529 - DNA, 17 bp, Homo sapiens
gacttcaggtcaggtgg

SEQ ID NO: 3582530 - DNA, 18 bp, Homo sapiens
gacttcctgtccagctcc

SEQ ID NO: 3582531 - DNA, 24 bp, Homo sapiens
gacttctaagtaaaaccacagcag

SEQ ID NO: 3582532 - DNA, 17 bp, Homo sapiens
gacttctcaaagagaat

SEQ ID NO: 3582533 - DNA, 20 bp, Homo sapiens
gacttctgtcttcacaacag

SEQ ID NO: 3582534 - DNA, 23 bp, Homo sapiens
gacttctgtcttcacaacagatt

SEQ ID NO: 3582535 - DNA, 20 bp, Homo sapiens
gacttgatatttaagcagct

SEQ ID NO: 3582536 - DNA, 17 bp, Homo sapiens
gacttgtgattggctgc

SEQ ID NO: 3582537 - DNA, 13 bp, Homo sapiens
gacttgtgtctct

SEQ ID NO: 3582538 - DNA, 13 bp, Homo sapiens
gactttatttatt

SEQ ID NO: 3582539 - DNA, 14 bp, Homo sapiens
gactttatttattt

SEQ ID NO: 3582540 - DNA, 16 bp, Homo sapiens
gactttatttatttct

SEQ ID NO: 3582541 - DNA, 14 bp, Homo sapiens
gactttccagaatg

SEQ ID NO: 3582542 - DNA, 17 bp, Homo sapiens
gacttttggtagagaag

SEQ ID NO: 3582543 - DNA, 16 bp, Homo sapiens
gagaaaaaaaaagcaa

SEQ ID NO: 3582544 - DNA, 12 bp, Homo sapiens
gagaaaacctta

SEQ ID NO: 3582545 - DNA, 15 bp, Homo sapiens
gagaaacagctcagc

SEQ ID NO: 3582546 - DNA, 16 bp, Homo sapiens
gagaaacagctcagcc

SEQ ID NO: 3582547 - DNA, 19 bp, Homo sapiens
gagaaacagctcagccagt

SEQ ID NO: 3582548 - DNA, 17 bp, Homo sapiens
gagaaacagttggtaac

SEQ ID NO: 3582549 - DNA, 13 bp, Homo sapiens
gagaaacccagag

SEQ ID NO: 3582550 - DNA, 14 bp, Homo sapiens
gagaaacccagaga

SEQ ID NO: 3582551 - DNA, 15 bp, Homo sapiens
gagaaactgctgcag

SEQ ID NO: 3582552 - DNA, 18 bp, Homo sapiens
gagaaactgctgcagatt

SEQ ID NO: 3582553 - DNA, 18 bp, Homo sapiens
gagaaagactattcaaac

SEQ ID NO: 3582554 - DNA, 17 bp, Homo sapiens
gagaaagagagaagcca

SEQ ID NO: 3582555 - DNA, 18 bp, Homo sapiens
gagaaagagagaagccag

SEQ ID NO: 3582556 - DNA, 14 bp, Homo sapiens
gagaaagagctgcc

SEQ ID NO: 3582557 - DNA, 15 bp, Homo sapiens
gagaaatgccccagt

SEQ ID NO: 3582558 - DNA, 17 bp, Homo sapiens
gagaaatgccccagtgt

SEQ ID NO: 3582559 - DNA, 21 bp, Homo sapiens
gagaaccaaccagggaagctg

SEQ ID NO: 3582560 - DNA, 15 bp, Homo sapiens
gagaaccctgagcag

SEQ ID NO: 3582561 - DNA, 17 bp, Homo sapiens
gagaaccctgagcaggg

SEQ ID NO: 3582562 - DNA, 21 bp, Homo sapiens
gagaactcgttcacctccaag

SEQ ID NO: 3582563 - DNA, 16 bp, Homo sapiens
gagaacttgctgcctc

SEQ ID NO: 3582564 - DNA, 22 bp, Homo sapiens
gagaagagctgttcacagccag

SEQ ID NO: 3582565 - DNA, 18 bp, Homo sapiens
gagaagagggcccagccc

SEQ ID NO: 3582566 - DNA, 21 bp, Homo sapiens
gagaagagggcccagcccaga

SEQ ID NO: 3582567 - DNA, 15 bp, Homo sapiens
gagaagatgaaattt

SEQ ID NO: 3582568 - DNA, 20 bp, Homo sapiens
gagaagatgcctgttaattt

SEQ ID NO: 3582569 - DNA, 12 bp, Homo sapiens
gagaaggcctgg

SEQ ID NO: 3582570 - DNA, 12 bp, Homo sapiens
gagaaggggcag

SEQ ID NO: 3582571 - DNA, 20 bp, Homo sapiens
gagaaggggctttgtgacca

SEQ ID NO: 3582572 - DNA, 16 bp, Homo sapiens
gagaaggtctgtggtg

SEQ ID NO: 3582573 - DNA, 22 bp, Homo sapiens
gagaaggtctgtggtgcagtgt

SEQ ID NO: 3582574 - DNA, 16 bp, Homo sapiens
gagaatggcctggagc

SEQ ID NO: 3582575 - DNA, 17 bp, Homo sapiens
gagaatggcctggagca

SEQ ID NO: 3582576 - DNA, 17 bp, Homo sapiens
gagaattatctcaagta

SEQ ID NO: 3582577 - DNA, 18 bp, Homo sapiens
gagaattatctcaagtaa

SEQ ID NO: 3582578 - DNA, 19 bp, Homo sapiens
gagacaaacacctcccagg

SEQ ID NO: 3582579 - DNA, 11 bp, Homo sapiens
gagacaaagct

SEQ ID NO: 3582580 - DNA, 18 bp, Homo sapiens
gagacaaatctttaagaa

SEQ ID NO: 3582581 - DNA, 17 bp, Homo sapiens
gagacacgctggcgaca

SEQ ID NO: 3582582 - DNA, 21 bp, Homo sapiens
gagacagaccacttgccacgc

SEQ ID NO: 3582583 - DNA, 15 bp, Homo sapiens
gagacagactagaag

SEQ ID NO: 3582584 - DNA, 17 bp, Homo sapiens
gagacagatcactcctg

SEQ ID NO: 3582585 - DNA, 14 bp, Homo sapiens
gagacagcttctct

SEQ ID NO: 3582586 - DNA, 15 bp, Homo sapiens
gagacagcttctctg

SEQ ID NO: 3582587 - DNA, 17 bp, Homo sapiens
gagacagcttctctgca

SEQ ID NO: 3582588 - DNA, 21 bp, Homo sapiens
gagacaggtgcctaacctggg

SEQ ID NO: 3582589 - DNA, 16 bp, Homo sapiens
gagacagttcaagaaa

SEQ ID NO: 3582590 - DNA, 21 bp, Homo sapiens
gagacatacttgaagggccag

SEQ ID NO: 3582591 - DNA, 13 bp, Homo sapiens
gagacatgtgaca

SEQ ID NO: 3582592 - DNA, 13 bp, Homo sapiens
gagaccagcctgg

SEQ ID NO: 3582593 - DNA, 14 bp, Homo sapiens
gagaccagcctggc

SEQ ID NO: 3582594 - DNA, 15 bp, Homo sapiens
gagacccaaaccccc

SEQ ID NO: 3582595 - DNA, 22 bp, Homo sapiens
gagacccaaagcggtccctgtc

SEQ ID NO: 3582596 - DNA, 18 bp, Homo sapiens
gagacctcatcagccttg

SEQ ID NO: 3582597 - DNA, 13 bp, Homo sapiens
gagacctccagct

SEQ ID NO: 3582598 - DNA, 16 bp, Homo sapiens
gagactcctcagcacc

SEQ ID NO: 3582599 - DNA, 23 bp, Homo sapiens
gagactgtctcaagagggcactg

SEQ ID NO: 3582600 - DNA, 14 bp, Homo sapiens
gagacttgatattt

SEQ ID NO: 3582601 - DNA, 13 bp, Homo sapiens
gagacttgtatga

SEQ ID NO: 3582602 - DNA, 21 bp, Homo sapiens
gagactttgatactaccaggg

SEQ ID NO: 3582603 - DNA, 15 bp, Homo sapiens
gagagaaagagagaa

SEQ ID NO: 3582604 - DNA, 19 bp, Homo sapiens
gagagaaagagagaagcca

SEQ ID NO: 3582605 - DNA, 12 bp, Homo sapiens
gagagaagccag

SEQ ID NO: 3582606 - DNA, 17 bp, Homo sapiens
gagagaagccagccaca

SEQ ID NO: 3582607 - DNA, 19 bp, Homo sapiens
gagagaagccagccacaga

SEQ ID NO: 3582608 - DNA, 22 bp, Homo sapiens
gagagaatgtgtgtgtgtggca

SEQ ID NO: 3582609 - DNA, 21 bp, Homo sapiens
gagagaccccgcacccggctc

SEQ ID NO: 3582610 - DNA, 13 bp, Homo sapiens
gagagaccctggc

SEQ ID NO: 3582611 - DNA, 14 bp, Homo sapiens
gagagaggaggaaa

SEQ ID NO: 3582612 - DNA, 15 bp, Homo sapiens
gagagcaacatttta

SEQ ID NO: 3582613 - DNA, 14 bp, Homo sapiens
gagagcagcagcac

SEQ ID NO: 3582614 - DNA, 16 bp, Homo sapiens
gagagcataatttaaa

SEQ ID NO: 3582615 - DNA, 14 bp, Homo sapiens
gagagccaggatgc

SEQ ID NO: 3582616 - DNA, 16 bp, Homo sapiens
gagagccaggatgccc

SEQ ID NO: 3582617 - DNA, 19 bp, Homo sapiens
gagaggactggttctgagg

SEQ ID NO: 3582618 - DNA, 23 bp, Homo sapiens
gagaggactggttctgaggccag

SEQ ID NO: 3582619 - DNA, 17 bp, Homo sapiens
gagaggcgtttggagaa

SEQ ID NO: 3582620 - DNA, 17 bp, Homo sapiens
gagaggctctccgtgca

SEQ ID NO: 3582621 - DNA, 21 bp, Homo sapiens
gagaggctgtggtttggggga

SEQ ID NO: 3582622 - DNA, 21 bp, Homo sapiens
gagagggaaaaggcaggtgct

SEQ ID NO: 3582623 - DNA, 17 bp, Homo sapiens
gagagggaaaatcttca

SEQ ID NO: 3582624 - DNA, 23 bp, Homo sapiens
gagagggaagatgacctgcccca

SEQ ID NO: 3582625 - DNA, 19 bp, Homo sapiens
gagagggaggcaagccctg

SEQ ID NO: 3582626 - DNA, 18 bp, Homo sapiens
gatgaccagggatgctgg

SEQ ID NO: 3582627 - DNA, 22 bp, Homo sapiens
gatgaccagggatgctgggctg

SEQ ID NO: 3582628 - DNA, 14 bp, Homo sapiens
gatgacctccagaa

SEQ ID NO: 3582629 - DNA, 15 bp, Homo sapiens
gatgacctccagaag

SEQ ID NO: 3582630 - DNA, 17 bp, Homo sapiens
gatgacctccagaagtc

SEQ ID NO: 3582631 - DNA, 14 bp, Homo sapiens
gatgacctgcccca

SEQ ID NO: 3582632 - DNA, 12 bp, Homo sapiens
gatgactaaaat

SEQ ID NO: 3582633 - DNA, 22 bp, Homo sapiens
gatgactctgtctcattgacct

SEQ ID NO: 3582634 - DNA, 13 bp, Homo sapiens
gatgagaaacagc

SEQ ID NO: 3582635 - DNA, 18 bp, Homo sapiens
gatgagaaacagctcagc

SEQ ID NO: 3582636 - DNA, 19 bp, Homo sapiens
gatgagaaacagctcagcc

SEQ ID NO: 3582637 - DNA, 11 bp, Homo sapiens
gatgagagaat

SEQ ID NO: 3582638 - DNA, 12 bp, Homo sapiens
gatgagagaatg

SEQ ID NO: 3582639 - DNA, 18 bp, Homo sapiens
gatgagagaatgtggaaa

SEQ ID NO: 3582640 - DNA, 23 bp, Homo sapiens
gatgaggctcagagaggtagcac

SEQ ID NO: 3582641 - DNA, 20 bp, Homo sapiens
gatgaggtcaccaggggagg

SEQ ID NO: 3582642 - DNA, 13 bp, Homo sapiens
gatgataaaggaa

SEQ ID NO: 3582643 - DNA, 13 bp, Homo sapiens
gatgatgagggaa

SEQ ID NO: 3582644 - DNA, 14 bp, Homo sapiens
gatgatgatgaaaa

SEQ ID NO: 3582645 - DNA, 16 bp, Homo sapiens
gatgatggcagagcca

SEQ ID NO: 3582646 - DNA, 21 bp, Homo sapiens
gatgcaaatagattcagagaa

SEQ ID NO: 3582647 - DNA, 22 bp, Homo sapiens
gatgcaaatagattcagagaaa

SEQ ID NO: 3582648 - DNA, 23 bp, Homo sapiens
gatgcaaatagattcagagaaat

SEQ ID NO: 3582649 - DNA, 20 bp, Homo sapiens
gatgcaaggattacagaaac

SEQ ID NO: 3582650 - DNA, 21 bp, Homo sapiens
gatgcaaggattacagaaact

SEQ ID NO: 3582651 - DNA, 23 bp, Homo sapiens
gatgcaaggattacagaaactga

SEQ ID NO: 3582652 - DNA, 15 bp, Homo sapiens
gatgcacatccctgg

SEQ ID NO: 3582653 - DNA, 16 bp, Homo sapiens
gatgcagtcctcagga

SEQ ID NO: 3582654 - DNA, 18 bp, Homo sapiens
gatgcatatagacacaca

SEQ ID NO: 3582655 - DNA, 15 bp, Homo sapiens
gatgccacacaagga

SEQ ID NO: 3582656 - DNA, 19 bp, Homo sapiens
gatgccccctccaggagag

SEQ ID NO: 3582657 - DNA, 20 bp, Homo sapiens
gatgccccctccaggagaga

SEQ ID NO: 3582658 - DNA, 24 bp, Homo sapiens
gatgccccctccaggagagagcca

SEQ ID NO: 3582659 - DNA, 15 bp, Homo sapiens
gatgccctggaggtg

SEQ ID NO: 3582660 - DNA, 14 bp, Homo sapiens
gatgcctgttaatt

SEQ ID NO: 3582661 - DNA, 15 bp, Homo sapiens
gatgcggatcctgct

SEQ ID NO: 3582662 - DNA, 20 bp, Homo sapiens
gatgcggatcctgctggggc

SEQ ID NO: 3582663 - DNA, 13 bp, Homo sapiens
gatgctaaaacct

SEQ ID NO: 3582664 - DNA, 23 bp, Homo sapiens
gatgctaagagaaaaaaaagact

SEQ ID NO: 3582665 - DNA, 19 bp, Homo sapiens
gatgctactactgcagtct

SEQ ID NO: 3582666 - DNA, 22 bp, Homo sapiens
gatgctactactgcagtcttta

SEQ ID NO: 3582667 - DNA, 13 bp, Homo sapiens
gatgctgaggccc

SEQ ID NO: 3582668 - DNA, 13 bp, Homo sapiens
gatgctggcccag

SEQ ID NO: 3582669 - DNA, 16 bp, Homo sapiens
gatgctggcccagggc

SEQ ID NO: 3582670 - DNA, 17 bp, Homo sapiens
gatgctggcccagggcc

SEQ ID NO: 3582671 - DNA, 15 bp, Homo sapiens
gatgctgggctgggc

SEQ ID NO: 3582672 - DNA, 20 bp, Homo sapiens
gatgctgggctgggccctct

SEQ ID NO: 3582673 - DNA, 16 bp, Homo sapiens
gatggaaaataaacat

SEQ ID NO: 3582674 - DNA, 17 bp, Homo sapiens
gatggaaaattcatttt

SEQ ID NO: 3582675 - DNA, 20 bp, Homo sapiens
gatggacttgtgattggctg

SEQ ID NO: 3582676 - DNA, 18 bp, Homo sapiens
gatggagaaagaagtgga

SEQ ID NO: 3582677 - DNA, 19 bp, Homo sapiens
gatggagacaccctctggg

SEQ ID NO: 3582678 - DNA, 13 bp, Homo sapiens
gatggagagaata

SEQ ID NO: 3582679 - DNA, 18 bp, Homo sapiens
gatggagggcttggccca

SEQ ID NO: 3582680 - DNA, 16 bp, Homo sapiens
gatggagtgttttagt

SEQ ID NO: 3582681 - DNA, 15 bp, Homo sapiens
gatggatggcagact

SEQ ID NO: 3582682 - DNA, 16 bp, Homo sapiens
gatggcaacagatctg

SEQ ID NO: 3582683 - DNA, 13 bp, Homo sapiens
gatggcagagcca

SEQ ID NO: 3582684 - DNA, 22 bp, Homo sapiens
gatggccatgctcaacccccct

SEQ ID NO: 3582685 - DNA, 20 bp, Homo sapiens
gatggctaacttacaaagat

SEQ ID NO: 3582686 - DNA, 14 bp, Homo sapiens
gatggctcctctca

SEQ ID NO: 3582687 - DNA, 17 bp, Homo sapiens
gatggctgtgcctctgc

SEQ ID NO: 3582688 - DNA, 18 bp, Homo sapiens
gatggctgtgcctctgcc

SEQ ID NO: 3582689 - DNA, 18 bp, Homo sapiens
gatgggcaaagcttgtca

SEQ ID NO: 3582690 - DNA, 22 bp, Homo sapiens
gatggggcaagacagaaaagtg

SEQ ID NO: 3582691 - DNA, 16 bp, Homo sapiens
gatgggggaactcaga

SEQ ID NO: 3582692 - DNA, 20 bp, Homo sapiens
gatgggggaactcagatcca

SEQ ID NO: 3582693 - DNA, 22 bp, Homo sapiens
gatgggggaactcagatccagg

SEQ ID NO: 3582694 - DNA, 15 bp, Homo sapiens
gatgggtcagttgta

SEQ ID NO: 3582695 - DNA, 21 bp, Homo sapiens
gatgggtcagttgtatcagca

SEQ ID NO: 3582696 - DNA, 23 bp, Homo sapiens
gatggtatctatagtcaagacga

SEQ ID NO: 3582697 - DNA, 13 bp, Homo sapiens
gatggttcccctg

SEQ ID NO: 3582698 - DNA, 18 bp, Homo sapiens
gatggttcccctgttcac

SEQ ID NO: 3582699 - DNA, 19 bp, Homo sapiens
gatgtaattttgtgtaaga

SEQ ID NO: 3582700 - DNA, 16 bp, Homo sapiens
gatgtacatttaataa

SEQ ID NO: 3582701 - DNA, 21 bp, Homo sapiens
gatgtaccaattgtcaaatta

SEQ ID NO: 3582702 - DNA, 18 bp, Homo sapiens
gatgtactctaaatactg

SEQ ID NO: 3582703 - DNA, 14 bp, Homo sapiens
gatgtagcttgaga

SEQ ID NO: 3582704 - DNA, 13 bp, Homo sapiens
gatgtagtatttt

SEQ ID NO: 3582705 - DNA, 14 bp, Homo sapiens
gatgtataaatttt

SEQ ID NO: 3582706 - DNA, 15 bp, Homo sapiens
gatgtataatgtaat

SEQ ID NO: 3582707 - DNA, 23 bp, Homo sapiens
gatgtctttttattaaaatattt

SEQ ID NO: 3582708 - DNA, 11 bp, Homo sapiens
gatgtgatata

SEQ ID NO: 3582709 - DNA, 20 bp, Homo sapiens
gattaaagatgagctttgtc

SEQ ID NO: 3582710 - DNA, 20 bp, Homo sapiens
gattaaatgtgtcattggaa

SEQ ID NO: 3582711 - DNA, 22 bp, Homo sapiens
gattaaccttttcaaattaatg

SEQ ID NO: 3582712 - DNA, 11 bp, Homo sapiens
gattaagaaac

SEQ ID NO: 3582713 - DNA, 13 bp, Homo sapiens
gattaagaaacct

SEQ ID NO: 3582714 - DNA, 21 bp, Homo sapiens
gattacaaatcagaagtcatc

SEQ ID NO: 3582715 - DNA, 15 bp, Homo sapiens
gattacagaaactga

SEQ ID NO: 3582716 - DNA, 18 bp, Homo sapiens
gattacagaaactgatgc

SEQ ID NO: 3582717 - DNA, 12 bp, Homo sapiens
gattagaaacta

SEQ ID NO: 3582718 - DNA, 13 bp, Homo sapiens
gattagagaccag

SEQ ID NO: 3582719 - DNA, 17 bp, Homo sapiens
gattagttgacagtatt

SEQ ID NO: 3582720 - DNA, 18 bp, Homo sapiens
gattagttgacagtatta

SEQ ID NO: 3582721 - DNA, 21 bp, Homo sapiens
gattattttttcagaccgaaa

SEQ ID NO: 3582722 - DNA, 14 bp, Homo sapiens
gattcaaatgtttt

SEQ ID NO: 3582723 - DNA, 13 bp, Homo sapiens
gattcaggccagc

SEQ ID NO: 3582724 - DNA, 20 bp, Homo sapiens
gattcaggccagcccagcca

SEQ ID NO: 3582725 - DNA, 21 bp, Homo sapiens
gattcaggccagcccagccag

SEQ ID NO: 3582726 - DNA, 22 bp, Homo sapiens
gattcaggccagcccagccagg

SEQ ID NO: 3582727 - DNA, 21 bp, Homo sapiens
gattccaaggctttaaagctg

SEQ ID NO: 3582728 - DNA, 19 bp, Homo sapiens
gattccagagagtggctcc

SEQ ID NO: 3582729 - DNA, 20 bp, Homo sapiens
gattccagagagtggctcct

SEQ ID NO: 3582730 - DNA, 13 bp, Homo sapiens
gattcccagagca

SEQ ID NO: 3582731 - DNA, 19 bp, Homo sapiens
gattcccagagcaaaataa

SEQ ID NO: 3582732 - DNA, 17 bp, Homo sapiens
gattcctgagctggcct

SEQ ID NO: 3582733 - DNA, 18 bp, Homo sapiens
gattcctgagctggcctg

SEQ ID NO: 3582734 - DNA, 17 bp, Homo sapiens
gattctatgttaatatt

SEQ ID NO: 3582735 - DNA, 20 bp, Homo sapiens
gattctatgttaatatttta

SEQ ID NO: 3582736 - DNA, 22 bp, Homo sapiens
gattctcagggctggagcctgg

SEQ ID NO: 3582737 - DNA, 12 bp, Homo sapiens
gattctctgcag

SEQ ID NO: 3582738 - DNA, 16 bp, Homo sapiens
gattctgattgctatc

SEQ ID NO: 3582739 - DNA, 17 bp, Homo sapiens
gattcttcttaaaagtt

SEQ ID NO: 3582740 - DNA, 14 bp, Homo sapiens
gattgaatctactt

SEQ ID NO: 3582741 - DNA, 16 bp, Homo sapiens
gattgacagctttgct

SEQ ID NO: 3582742 - DNA, 17 bp, Homo sapiens
gattgaggggccctggc

SEQ ID NO: 3582743 - DNA, 20 bp, Homo sapiens
gattgaggggccctggccag

SEQ ID NO: 3582744 - DNA, 17 bp, Homo sapiens
gattgcgcctaatgtgt

SEQ ID NO: 3582745 - DNA, 14 bp, Homo sapiens
gattggctgcagga

SEQ ID NO: 3582746 - DNA, 16 bp, Homo sapiens
gattggctgcaggaag

SEQ ID NO: 3582747 - DNA, 23 bp, Homo sapiens
gattggctgcttaaactggaaag

SEQ ID NO: 3582748 - DNA, 18 bp, Homo sapiens
gattgtgtacttttcctt

SEQ ID NO: 3582749 - DNA, 20 bp, Homo sapiens
gattgtgtacttttcctttg

SEQ ID NO: 3582750 - DNA, 17 bp, Homo sapiens
gatttaagccttacaaa

SEQ ID NO: 3582751 - DNA, 20 bp, Homo sapiens
gatttaagccttacaaaggg

SEQ ID NO: 3582752 - DNA, 14 bp, Homo sapiens
gatttaatatggat

SEQ ID NO: 3582753 - DNA, 20 bp, Homo sapiens
gatttaggagaagccaggaa

SEQ ID NO: 3582754 - DNA, 15 bp, Homo sapiens
gatttaggtagcctt

SEQ ID NO: 3582755 - DNA, 18 bp, Homo sapiens
gatttagtgtaataagac

SEQ ID NO: 3582756 - DNA, 20 bp, Homo sapiens
gatttcacagtgtgtggtca

SEQ ID NO: 3582757 - DNA, 18 bp, Homo sapiens
gatttcatgctatctctg

SEQ ID NO: 3582758 - DNA, 14 bp, Homo sapiens
gccagcaggggggc

SEQ ID NO: 3582759 - DNA, 9 bp, Homo sapiens
gccagccac

SEQ ID NO: 3582760 - DNA, 10 bp, Homo sapiens
gccagccaca

SEQ ID NO: 3582761 - DNA, 11 bp, Homo sapiens
gccagccacag

SEQ ID NO: 3582762 - DNA, 15 bp, Homo sapiens
gccagccacagaccc

SEQ ID NO: 3582763 - DNA, 16 bp, Homo sapiens
gccagccacagacccc

SEQ ID NO: 3582764 - DNA, 21 bp, Homo sapiens
gccagccacagacccctggga

SEQ ID NO: 3582765 - DNA, 11 bp, Homo sapiens
gccagcccagc

SEQ ID NO: 3582766 - DNA, 13 bp, Homo sapiens
gccagcctcagaa

SEQ ID NO: 3582767 - DNA, 14 bp, Homo sapiens
gccagcctgcttcc

SEQ ID NO: 3582768 - DNA, 16 bp, Homo sapiens
gccagcctgcttccca

SEQ ID NO: 3582769 - DNA, 18 bp, Homo sapiens
gccagcctgcttcccaca

SEQ ID NO: 3582770 - DNA, 21 bp, Homo sapiens
gccagcctgcttcccacaact

SEQ ID NO: 3582771 - DNA, 12 bp, Homo sapiens
gccagcctggct

SEQ ID NO: 3582772 - DNA, 22 bp, Homo sapiens
gccagcctggctctgccccctc

SEQ ID NO: 3582773 - DNA, 19 bp, Homo sapiens
gccagcgggaatggcagct

SEQ ID NO: 3582774 - DNA, 13 bp, Homo sapiens
gccagctctggag

SEQ ID NO: 3582775 - DNA, 20 bp, Homo sapiens
gccagctgcactgatgctgc

SEQ ID NO: 3582776 - DNA, 13 bp, Homo sapiens
gccagctgcctcc

SEQ ID NO: 3582777 - DNA, 13 bp, Homo sapiens
gccagctggagaa

SEQ ID NO: 3582778 - DNA, 13 bp, Homo sapiens
gccagcttctctc

SEQ ID NO: 3582779 - DNA, 15 bp, Homo sapiens
gccagcttctctctc

SEQ ID NO: 3582780 - DNA, 16 bp, Homo sapiens
gccagcttctctctcc

SEQ ID NO: 3582781 - DNA, 18 bp, Homo sapiens
gccagcttctctctccag

SEQ ID NO: 3582782 - DNA, 21 bp, Homo sapiens
gccaggaatttcccaggaccc

SEQ ID NO: 3582783 - DNA, 13 bp, Homo sapiens
gccaggactccca

SEQ ID NO: 3582784 - DNA, 17 bp, Homo sapiens
gccaggactcccagaac

SEQ ID NO: 3582785 - DNA, 14 bp, Homo sapiens
gccaggatggaatg

SEQ ID NO: 3582786 - DNA, 19 bp, Homo sapiens
gccaggcaccacagcctcc

SEQ ID NO: 3582787 - DNA, 13 bp, Homo sapiens
gccaggccctcag

SEQ ID NO: 3582788 - DNA, 20 bp, Homo sapiens
gccaggccgcgcccagcaga

SEQ ID NO: 3582789 - DNA, 20 bp, Homo sapiens
gccaggcctgggtgatctgc

SEQ ID NO: 3582790 - DNA, 22 bp, Homo sapiens
gccaggccttacatctggctgg

SEQ ID NO: 3582791 - DNA, 15 bp, Homo sapiens
gccagggagaagctc

SEQ ID NO: 3582792 - DNA, 11 bp, Homo sapiens
gccagggctgg

SEQ ID NO: 3582793 - DNA, 21 bp, Homo sapiens
gccagggctggggacagaggg

SEQ ID NO: 3582794 - DNA, 12 bp, Homo sapiens
gccagggcttcc

SEQ ID NO: 3582795 - DNA, 16 bp, Homo sapiens
gccagggcttcctctt

SEQ ID NO: 3582796 - DNA, 15 bp, Homo sapiens
gccaggggctctgtg

SEQ ID NO: 3582797 - DNA, 16 bp, Homo sapiens
gccaggggctctgtgg

SEQ ID NO: 3582798 - DNA, 17 bp, Homo sapiens
gccaggggctctgtggc

SEQ ID NO: 3582799 - DNA, 22 bp, Homo sapiens
gccaggtacaggagaggcagca

SEQ ID NO: 3582800 - DNA, 21 bp, Homo sapiens
gccaggtactgcattctctcc

SEQ ID NO: 3582801 - DNA, 16 bp, Homo sapiens
gccaggtccttgccct

SEQ ID NO: 3582802 - DNA, 16 bp, Homo sapiens
gccaggtctgactcca

SEQ ID NO: 3582803 - DNA, 20 bp, Homo sapiens
gccaggtgcccgcgccaggc

SEQ ID NO: 3582804 - DNA, 18 bp, Homo sapiens
gccaggtggccactccag

SEQ ID NO: 3582805 - DNA, 21 bp, Homo sapiens
gccagtgaagtccttcagtga

SEQ ID NO: 3582806 - DNA, 13 bp, Homo sapiens
gccagtgcagcca

SEQ ID NO: 3582807 - DNA, 16 bp, Homo sapiens
gccagtgcagccactg

SEQ ID NO: 3582808 - DNA, 23 bp, Homo sapiens
gccagtggctggatctgtgaggg

SEQ ID NO: 3582809 - DNA, 21 bp, Homo sapiens
gccagtggggatgaggtcacc

SEQ ID NO: 3582810 - DNA, 18 bp, Homo sapiens
gccagttacttgggcttc

SEQ ID NO: 3582811 - DNA, 17 bp, Homo sapiens
gccataaacggttcctg

SEQ ID NO: 3582812 - DNA, 19 bp, Homo sapiens
gccataaacggttcctggt

SEQ ID NO: 3582813 - DNA, 21 bp, Homo sapiens
gccataaacggttcctggtga

SEQ ID NO: 3582814 - DNA, 19 bp, Homo sapiens
gccatagtttgggtatttt

SEQ ID NO: 3582815 - DNA, 21 bp, Homo sapiens
gccatatggaggactgtgaca

SEQ ID NO: 3582816 - DNA, 18 bp, Homo sapiens
gccatccctttttttaca

SEQ ID NO: 3582817 - DNA, 23 bp, Homo sapiens
gccatccctttttttacatttca

SEQ ID NO: 3582818 - DNA, 17 bp, Homo sapiens
gccatccttctgtgtac

SEQ ID NO: 3582819 - DNA, 23 bp, Homo sapiens
gccatcgccgggactccagaacc

SEQ ID NO: 3582820 - DNA, 17 bp, Homo sapiens
gccatctcaggagatgg

SEQ ID NO: 3582821 - DNA, 13 bp, Homo sapiens
gccatctctgctc

SEQ ID NO: 3582822 - DNA, 23 bp, Homo sapiens
gccatctgactgccaagccagat

SEQ ID NO: 3582823 - DNA, 13 bp, Homo sapiens
gccatctggagag

SEQ ID NO: 3582824 - DNA, 15 bp, Homo sapiens
gccatcttctttctt

SEQ ID NO: 3582825 - DNA, 23 bp, Homo sapiens
gccatgatggcaacagatctgga

SEQ ID NO: 3582826 - DNA, 16 bp, Homo sapiens
gccatgatgtccttgg

SEQ ID NO: 3582827 - DNA, 17 bp, Homo sapiens
gccatgatgtccttgga

SEQ ID NO: 3582828 - DNA, 19 bp, Homo sapiens
gccatgctcaacccccctc

SEQ ID NO: 3582829 - DNA, 17 bp, Homo sapiens
gccatgctgggccactg

SEQ ID NO: 3582830 - DNA, 21 bp, Homo sapiens
gccatggaattccctcctgag

SEQ ID NO: 3582831 - DNA, 19 bp, Homo sapiens
gccatgtataaatgtgata

SEQ ID NO: 3582832 - DNA, 22 bp, Homo sapiens
gccatttaaagcttattaaaac

SEQ ID NO: 3582833 - DNA, 16 bp, Homo sapiens
gcccaaacctgggaag

SEQ ID NO: 3582834 - DNA, 16 bp, Homo sapiens
gcccaacccttccctc

SEQ ID NO: 3582835 - DNA, 14 bp, Homo sapiens
gcccaacctgctct

SEQ ID NO: 3582836 - DNA, 20 bp, Homo sapiens
gcccaagcagacagccctgg

SEQ ID NO: 3582837 - DNA, 15 bp, Homo sapiens
gcccaagggatctgg

SEQ ID NO: 3582838 - DNA, 18 bp, Homo sapiens
gcccaagggatctggtcc

SEQ ID NO: 3582839 - DNA, 20 bp, Homo sapiens
gcccaagtggggtgctctgg

SEQ ID NO: 3582840 - DNA, 14 bp, Homo sapiens
gcccaatgctgctt

SEQ ID NO: 3582841 - DNA, 20 bp, Homo sapiens
gcccacatagtgatggttcc

SEQ ID NO: 3582842 - DNA, 13 bp, Homo sapiens
gcccacccctcac

SEQ ID NO: 3582843 - DNA, 16 bp, Homo sapiens
gcccacccctcactcc

SEQ ID NO: 3582844 - DNA, 18 bp, Homo sapiens
gcccacccctcactcccc

SEQ ID NO: 3582845 - DNA, 19 bp, Homo sapiens
gcccacccctcactcccca

SEQ ID NO: 3582846 - DNA, 13 bp, Homo sapiens
gcccacctggctg

SEQ ID NO: 3582847 - DNA, 14 bp, Homo sapiens
gcccacctggctgc

SEQ ID NO: 3582848 - DNA, 16 bp, Homo sapiens
gcccacctggctgcca

SEQ ID NO: 3582849 - DNA, 15 bp, Homo sapiens
gcccactccccagcc

SEQ ID NO: 3582850 - DNA, 20 bp, Homo sapiens
gcccactccccagccccagc

SEQ ID NO: 3582851 - DNA, 13 bp, Homo sapiens
gcccactcctggg

SEQ ID NO: 3582852 - DNA, 22 bp, Homo sapiens
gcccactgctcgtggactgtgc

SEQ ID NO: 3582853 - DNA, 11 bp, Homo sapiens
gcccactggcc

SEQ ID NO: 3582854 - DNA, 15 bp, Homo sapiens
gcccagagagggaag

SEQ ID NO: 3582855 - DNA, 13 bp, Homo sapiens
gcccagagcccag

SEQ ID NO: 3582856 - DNA, 16 bp, Homo sapiens
gcccagagcccagctc

SEQ ID NO: 3582857 - DNA, 18 bp, Homo sapiens
gcccagatgaactgactg

SEQ ID NO: 3582858 - DNA, 14 bp, Homo sapiens
gcccagcacccctt

SEQ ID NO: 3582859 - DNA, 23 bp, Homo sapiens
gcccagcaggagagactgagcag

SEQ ID NO: 3582860 - DNA, 17 bp, Homo sapiens
gcccagccaggccaaca

SEQ ID NO: 3582861 - DNA, 11 bp, Homo sapiens
gcccagcccag

SEQ ID NO: 3582862 - DNA, 14 bp, Homo sapiens
gcccagcctgggag

SEQ ID NO: 3582863 - DNA, 12 bp, Homo sapiens
gcccagctccaa

SEQ ID NO: 3582864 - DNA, 17 bp, Homo sapiens
gcccaggagaatgctgc

SEQ ID NO: 3582865 - DNA, 18 bp, Homo sapiens
gcccaggagacagaccac

SEQ ID NO: 3582866 - DNA, 18 bp, Homo sapiens
gcccaggatatattttat

SEQ ID NO: 3582867 - DNA, 17 bp, Homo sapiens
gcccaggcctgcctgtt

SEQ ID NO: 3582868 - DNA, 18 bp, Homo sapiens
gcccagggccagtgggac

SEQ ID NO: 3582869 - DNA, 15 bp, Homo sapiens
gcccagggcccagag

SEQ ID NO: 3582870 - DNA, 19 bp, Homo sapiens
gcccagggcccagagccca

SEQ ID NO: 3582871 - DNA, 20 bp, Homo sapiens
gcccagggcccagagcccag

SEQ ID NO: 3582872 - DNA, 21 bp, Homo sapiens
gcccagggcccagagcccagc

SEQ ID NO: 3582873 - DNA, 15 bp, Homo sapiens
gcccaggggagccct

SEQ ID NO: 3582874 - DNA, 18 bp, Homo sapiens
gcccagtaaaatttcagg

SEQ ID NO: 3582875 - DNA, 21 bp, Homo sapiens
gcccagtcgaccccaaaggaa

SEQ ID NO: 3582876 - DNA, 14 bp, Homo sapiens
gcccagtgccagca

SEQ ID NO: 3582877 - DNA, 19 bp, Homo sapiens
gcccagttcaccctgattt

SEQ ID NO: 3582878 - DNA, 18 bp, Homo sapiens
gcccatccccaggcacct

SEQ ID NO: 3582879 - DNA, 22 bp, Homo sapiens
gcccatgccctccactccactg

SEQ ID NO: 3582880 - DNA, 13 bp, Homo sapiens
gcccatttctggg

SEQ ID NO: 3582881 - DNA, 15 bp, Homo sapiens
gcccatttgggcaga

SEQ ID NO: 3582882 - DNA, 18 bp, Homo sapiens
gcccatttgggcagagag

SEQ ID NO: 3582883 - DNA, 19 bp, Homo sapiens
gccccaactccaggggcac

SEQ ID NO: 3582884 - DNA, 21 bp, Homo sapiens
gccccacaaaacttcagtgtg

SEQ ID NO: 3582885 - DNA, 22 bp, Homo sapiens
gccccacaaaacttcagtgtgg

SEQ ID NO: 3582886 - DNA, 22 bp, Homo sapiens
gccccaccactccccaacccct

SEQ ID NO: 3582887 - DNA, 16 bp, Homo sapiens
gccccaccccacctca

SEQ ID NO: 3582888 - DNA, 17 bp, Homo sapiens
gccccaccccaggtcct

SEQ ID NO: 3582889 - DNA, 20 bp, Homo sapiens
gccccaccccatccagccag

SEQ ID NO: 3582890 - DNA, 14 bp, Homo sapiens
gccccaccggccag

SEQ ID NO: 3582891 - DNA, 21 bp, Homo sapiens
gctcctgcttttctgtcctgg

SEQ ID NO: 3582892 - DNA, 21 bp, Homo sapiens
gctcctgggcattagcaaggc

SEQ ID NO: 3582893 - DNA, 23 bp, Homo sapiens
gctcctgggggttctttcttcct

SEQ ID NO: 3582894 - DNA, 16 bp, Homo sapiens
gctcgccgtgtctcag

SEQ ID NO: 3582895 - DNA, 18 bp, Homo sapiens
gctcgccgtgtctcagcc

SEQ ID NO: 3582896 - DNA, 17 bp, Homo sapiens
gctcgtcagccacctgg

SEQ ID NO: 3582897 - DNA, 15 bp, Homo sapiens
gctctaacagccctc

SEQ ID NO: 3582898 - DNA, 15 bp, Homo sapiens
gctctaattcacagt

SEQ ID NO: 3582899 - DNA, 16 bp, Homo sapiens
gctctaattcacagtg

SEQ ID NO: 3582900 - DNA, 20 bp, Homo sapiens
gctctacagctaatcagcat

SEQ ID NO: 3582901 - DNA, 15 bp, Homo sapiens
gctctagcctctgga

SEQ ID NO: 3582902 - DNA, 22 bp, Homo sapiens
gctctagggactgccaggctgt

SEQ ID NO: 3582903 - DNA, 22 bp, Homo sapiens
gctctcccctctcgccccatcc

SEQ ID NO: 3582904 - DNA, 15 bp, Homo sapiens
gctctccgagctctg

SEQ ID NO: 3582905 - DNA, 20 bp, Homo sapiens
gctctccgagctctggtgct

SEQ ID NO: 3582906 - DNA, 13 bp, Homo sapiens
gctctccgtgcag

SEQ ID NO: 3582907 - DNA, 15 bp, Homo sapiens
gctctcctcccgccc

SEQ ID NO: 3582908 - DNA, 14 bp, Homo sapiens
gctctcctgacttt

SEQ ID NO: 3582909 - DNA, 19 bp, Homo sapiens
gctctcgggttgtgtgtct

SEQ ID NO: 3582910 - DNA, 18 bp, Homo sapiens
gctctctccgaggggtgg

SEQ ID NO: 3582911 - DNA, 13 bp, Homo sapiens
gctctctctgagg

SEQ ID NO: 3582912 - DNA, 15 bp, Homo sapiens
gctctctgtgaccct

SEQ ID NO: 3582913 - DNA, 11 bp, Homo sapiens
gctctgaaaac

SEQ ID NO: 3582914 - DNA, 15 bp, Homo sapiens
gctctgacatccctt

SEQ ID NO: 3582915 - DNA, 16 bp, Homo sapiens
gctctgacatcccttc

SEQ ID NO: 3582916 - DNA, 22 bp, Homo sapiens
gctctgacatcccttcctggaa

SEQ ID NO: 3582917 - DNA, 22 bp, Homo sapiens
gctctgccccagcttgggcaga

SEQ ID NO: 3582918 - DNA, 18 bp, Homo sapiens
gctctgccccctccccca

SEQ ID NO: 3582919 - DNA, 22 bp, Homo sapiens
gctctgctcccctaaagcctca

SEQ ID NO: 3582920 - DNA, 14 bp, Homo sapiens
gctctgctgctgat

SEQ ID NO: 3582921 - DNA, 22 bp, Homo sapiens
gctctggaagaggccttcccat

SEQ ID NO: 3582922 - DNA, 20 bp, Homo sapiens
gctctggaataaagttgcag

SEQ ID NO: 3582923 - DNA, 19 bp, Homo sapiens
gctctggacagccccaccc

SEQ ID NO: 3582924 - DNA, 13 bp, Homo sapiens
gctctggagaaca

SEQ ID NO: 3582925 - DNA, 18 bp, Homo sapiens
gctctggcaccatcagcc

SEQ ID NO: 3582926 - DNA, 14 bp, Homo sapiens
gctctggctgcttt

SEQ ID NO: 3582927 - DNA, 21 bp, Homo sapiens
gctctggggacagcttcctca

SEQ ID NO: 3582928 - DNA, 17 bp, Homo sapiens
gctcttatgtgtgcctt

SEQ ID NO: 3582929 - DNA, 19 bp, Homo sapiens
gctcttatgtgtgcctttg

SEQ ID NO: 3582930 - DNA, 12 bp, Homo sapiens
gctcttcacagt

SEQ ID NO: 3582931 - DNA, 16 bp, Homo sapiens
gctcttcccactccag

SEQ ID NO: 3582932 - DNA, 23 bp, Homo sapiens
gctcttctcctttcacaaccttc

SEQ ID NO: 3582933 - DNA, 13 bp, Homo sapiens
gctcttggctgac

SEQ ID NO: 3582934 - DNA, 17 bp, Homo sapiens
gctcttggctgacccct

SEQ ID NO: 3582935 - DNA, 19 bp, Homo sapiens
gctcttgtgttcagaagaa

SEQ ID NO: 3582936 - DNA, 21 bp, Homo sapiens
gctctttgactgtcagcaaga

SEQ ID NO: 3582937 - DNA, 13 bp, Homo sapiens
gctctttggtaga

SEQ ID NO: 3582938 - DNA, 13 bp, Homo sapiens
gctcttttcctgg

SEQ ID NO: 3582939 - DNA, 19 bp, Homo sapiens
gctcttttcctggtgctct

SEQ ID NO: 3582940 - DNA, 12 bp, Homo sapiens
gctctttttgtg

SEQ ID NO: 3582941 - DNA, 16 bp, Homo sapiens
gctgaaacaacaaata

SEQ ID NO: 3582942 - DNA, 19 bp, Homo sapiens
gctgaaatatccacccagc

SEQ ID NO: 3582943 - DNA, 20 bp, Homo sapiens
gctgaacaggaaagagctag

SEQ ID NO: 3582944 - DNA, 21 bp, Homo sapiens
gctgaacaggaaagagctagg

SEQ ID NO: 3582945 - DNA, 14 bp, Homo sapiens
gctgaagagaggga

SEQ ID NO: 3582946 - DNA, 18 bp, Homo sapiens
gctgaagagagggacagg

SEQ ID NO: 3582947 - DNA, 11 bp, Homo sapiens
gctgaattcct

SEQ ID NO: 3582948 - DNA, 13 bp, Homo sapiens
gctgaattccttt

SEQ ID NO: 3582949 - DNA, 17 bp, Homo sapiens
gctgaatttccctctct

SEQ ID NO: 3582950 - DNA, 16 bp, Homo sapiens
gctgacaataaaggaa

SEQ ID NO: 3582951 - DNA, 19 bp, Homo sapiens
gctgacacgctcagttgaa

SEQ ID NO: 3582952 - DNA, 21 bp, Homo sapiens
gctgacagccacaccgtggca

SEQ ID NO: 3582953 - DNA, 22 bp, Homo sapiens
gctgacccagcatctcccagca

SEQ ID NO: 3582954 - DNA, 19 bp, Homo sapiens
gctgaccccgagaagtgct

SEQ ID NO: 3582955 - DNA, 18 bp, Homo sapiens
gctgacccctctggtgtg

SEQ ID NO: 3582956 - DNA, 15 bp, Homo sapiens
gctgacggccaggga

SEQ ID NO: 3582957 - DNA, 15 bp, Homo sapiens
gctgagcatggagac

SEQ ID NO: 3582958 - DNA, 18 bp, Homo sapiens
gctgagcatggagacagc

SEQ ID NO: 3582959 - DNA, 22 bp, Homo sapiens
gctgagcccctgtctagagagg

SEQ ID NO: 3582960 - DNA, 19 bp, Homo sapiens
gctgagccctcctgagggc

SEQ ID NO: 3582961 - DNA, 12 bp, Homo sapiens
gctgaggagcag

SEQ ID NO: 3582962 - DNA, 13 bp, Homo sapiens
gctgaggcagaag

SEQ ID NO: 3582963 - DNA, 21 bp, Homo sapiens
gctgaggggtctcggatgaca

SEQ ID NO: 3582964 - DNA, 11 bp, Homo sapiens
gctgagggtcg

SEQ ID NO: 3582965 - DNA, 13 bp, Homo sapiens
gctgagtggcagc

SEQ ID NO: 3582966 - DNA, 15 bp, Homo sapiens
gctgagtggcagcag

SEQ ID NO: 3582967 - DNA, 16 bp, Homo sapiens
gctgataaatttaatc

SEQ ID NO: 3582968 - DNA, 14 bp, Homo sapiens
gctgattgtattta

SEQ ID NO: 3582969 - DNA, 21 bp, Homo sapiens
gctgcaaagcaaaacagactg

SEQ ID NO: 3582970 - DNA, 18 bp, Homo sapiens
gctgcaagcacagccctt

SEQ ID NO: 3582971 - DNA, 12 bp, Homo sapiens
gctgcaaggtac

SEQ ID NO: 3582972 - DNA, 17 bp, Homo sapiens
gctgcacaacagccctg

SEQ ID NO: 3582973 - DNA, 18 bp, Homo sapiens
gctgcacaacagccctgc

SEQ ID NO: 3582974 - DNA, 14 bp, Homo sapiens
gctgcaccccttcc

SEQ ID NO: 3582975 - DNA, 19 bp, Homo sapiens
gctgcaccccttcctgggc

SEQ ID NO: 3582976 - DNA, 21 bp, Homo sapiens
gctgcaccctgcgcctccaga

SEQ ID NO: 3582977 - DNA, 19 bp, Homo sapiens
gctgcacctcctaccctcc

SEQ ID NO: 3582978 - DNA, 22 bp, Homo sapiens
gctgcagccttcatcagaactc

SEQ ID NO: 3582979 - DNA, 12 bp, Homo sapiens
gctgcaggagtg

SEQ ID NO: 3582980 - DNA, 14 bp, Homo sapiens
gctgcaggggcctc

SEQ ID NO: 3582981 - DNA, 18 bp, Homo sapiens
gctgcagttaccacagca

SEQ ID NO: 3582982 - DNA, 20 bp, Homo sapiens
gctgcagttaccacagcaac

SEQ ID NO: 3582983 - DNA, 22 bp, Homo sapiens
gctgcagttaccacagcaactg

SEQ ID NO: 3582984 - DNA, 18 bp, Homo sapiens
gctgcatatttgaccttt

SEQ ID NO: 3582985 - DNA, 21 bp, Homo sapiens
gctgccacacttcaggctctt

SEQ ID NO: 3582986 - DNA, 22 bp, Homo sapiens
gctgccacacttcaggctcttc

SEQ ID NO: 3582987 - DNA, 22 bp, Homo sapiens
gctgccacccacctccctgcct

SEQ ID NO: 3582988 - DNA, 23 bp, Homo sapiens
gctgccacccacctccctgcctc

SEQ ID NO: 3582989 - DNA, 10 bp, Homo sapiens
gctgccagca

SEQ ID NO: 3582990 - DNA, 14 bp, Homo sapiens
gctgccagcacagt

SEQ ID NO: 3582991 - DNA, 19 bp, Homo sapiens
gctgccagctctcaggacc

SEQ ID NO: 3582992 - DNA, 13 bp, Homo sapiens
gctgccagggctt

SEQ ID NO: 3582993 - DNA, 17 bp, Homo sapiens
gctgccaggggctctgt

SEQ ID NO: 3582994 - DNA, 19 bp, Homo sapiens
gctgccaggggctctgtgg

SEQ ID NO: 3582995 - DNA, 20 bp, Homo sapiens
gctgccaggggctctgtggc

SEQ ID NO: 3582996 - DNA, 16 bp, Homo sapiens
gctgccagtgcagcca

SEQ ID NO: 3582997 - DNA, 17 bp, Homo sapiens
gctgccagtgcagccac

SEQ ID NO: 3582998 - DNA, 12 bp, Homo sapiens
gctgcccaggag

SEQ ID NO: 3582999 - DNA, 16 bp, Homo sapiens
gctgcccaggagacag

SEQ ID NO: 3583000 - DNA, 15 bp, Homo sapiens
gctgcccctgtctgg

SEQ ID NO: 3583001 - DNA, 18 bp, Homo sapiens
gctgcccctgtctggaag

SEQ ID NO: 3583002 - DNA, 23 bp, Homo sapiens
gctgcccgcgggagacagcttct

SEQ ID NO: 3583003 - DNA, 20 bp, Homo sapiens
gctgccctagctgaccccga

SEQ ID NO: 3583004 - DNA, 15 bp, Homo sapiens
gctgccctgcgccct

SEQ ID NO: 3583005 - DNA, 12 bp, Homo sapiens
gctgccctggtg

SEQ ID NO: 3583006 - DNA, 14 bp, Homo sapiens
gctgccctggtgct

SEQ ID NO: 3583007 - DNA, 18 bp, Homo sapiens
gctgccctggtgctgcca

SEQ ID NO: 3583008 - DNA, 19 bp, Homo sapiens
gctgccctggtgctgccac

SEQ ID NO: 3583009 - DNA, 18 bp, Homo sapiens
gctgccctgtaccccagc

SEQ ID NO: 3583010 - DNA, 15 bp, Homo sapiens
gctgccgagccacca

SEQ ID NO: 3583011 - DNA, 19 bp, Homo sapiens
gctgccggctctgggcctg

SEQ ID NO: 3583012 - DNA, 21 bp, Homo sapiens
gctgccggctctgggcctgag

SEQ ID NO: 3583013 - DNA, 22 bp, Homo sapiens
gctgcctaggatgttctgggct

SEQ ID NO: 3583014 - DNA, 21 bp, Homo sapiens
gctgcctcaggacccatccct

SEQ ID NO: 3583015 - DNA, 13 bp, Homo sapiens
gctgcctcctgcg

SEQ ID NO: 3583016 - DNA, 22 bp, Homo sapiens
gctgcctcggatccccttccta

SEQ ID NO: 3583017 - DNA, 15 bp, Homo sapiens
gctgccttagaacct

SEQ ID NO: 3583018 - DNA, 20 bp, Homo sapiens
gctgccttagaacctttctt

SEQ ID NO: 3583019 - DNA, 12 bp, Homo sapiens
gctgccttcagg

SEQ ID NO: 3583020 - DNA, 21 bp, Homo sapiens
gctgcgaatctagaggagggg

SEQ ID NO: 3583021 - DNA, 21 bp, Homo sapiens
gctgctaagtcattggcaaag

SEQ ID NO: 3583022 - DNA, 22 bp, Homo sapiens
gctgctaagtcattggcaaagt

SEQ ID NO: 3583023 - DNA, 22 bp, Homo sapiens
gcttctcagatttctgaggaaa

SEQ ID NO: 3583024 - DNA, 17 bp, Homo sapiens
gcttctctctccagggt

SEQ ID NO: 3583025 - DNA, 14 bp, Homo sapiens
gcttcttccttctt

SEQ ID NO: 3583026 - DNA, 16 bp, Homo sapiens
gcttcttccttcttgt

SEQ ID NO: 3583027 - DNA, 15 bp, Homo sapiens
gcttctttctagaaa

SEQ ID NO: 3583028 - DNA, 16 bp, Homo sapiens
gcttgactttccagaa

SEQ ID NO: 3583029 - DNA, 19 bp, Homo sapiens
gcttgcaatctaatctgaa

SEQ ID NO: 3583030 - DNA, 20 bp, Homo sapiens
gcttgcaatctaatctgaac

SEQ ID NO: 3583031 - DNA, 15 bp, Homo sapiens
gcttgcatggagaat

SEQ ID NO: 3583032 - DNA, 17 bp, Homo sapiens
gcttgcatggagaatgg

SEQ ID NO: 3583033 - DNA, 18 bp, Homo sapiens
gcttgcccgctcccacag

SEQ ID NO: 3583034 - DNA, 19 bp, Homo sapiens
gcttgcccgctcccacagc

SEQ ID NO: 3583035 - DNA, 14 bp, Homo sapiens
gcttggaggacaaa

SEQ ID NO: 3583036 - DNA, 20 bp, Homo sapiens
gcttggaggacaaataagaa

SEQ ID NO: 3583037 - DNA, 23 bp, Homo sapiens
gcttggggctgcacctcctaccc

SEQ ID NO: 3583038 - DNA, 24 bp, Homo sapiens
gcttggtagttaacacatcaaata

SEQ ID NO: 3583039 - DNA, 14 bp, Homo sapiens
gcttggtgtgaccc

SEQ ID NO: 3583040 - DNA, 15 bp, Homo sapiens
gcttggttctgtgaa

SEQ ID NO: 3583041 - DNA, 17 bp, Homo sapiens
gcttgtaactaaaataa

SEQ ID NO: 3583042 - DNA, 22 bp, Homo sapiens
gcttgtaactaaaataattttg

SEQ ID NO: 3583043 - DNA, 16 bp, Homo sapiens
gcttgtactgggacat

SEQ ID NO: 3583044 - DNA, 20 bp, Homo sapiens
gcttgtgatttccatttctg

SEQ ID NO: 3583045 - DNA, 12 bp, Homo sapiens
gcttgtgttctg

SEQ ID NO: 3583046 - DNA, 19 bp, Homo sapiens
gctttaaaacaaagggaaa

SEQ ID NO: 3583047 - DNA, 19 bp, Homo sapiens
gctttaatgagtgcacctg

SEQ ID NO: 3583048 - DNA, 20 bp, Homo sapiens
gctttaatgagtgcacctgc

SEQ ID NO: 3583049 - DNA, 21 bp, Homo sapiens
gctttaatgagtgcacctgcc

SEQ ID NO: 3583050 - DNA, 19 bp, Homo sapiens
gctttagttaggtcatttt

SEQ ID NO: 3583051 - DNA, 15 bp, Homo sapiens
gctttatgcaaatac

SEQ ID NO: 3583052 - DNA, 18 bp, Homo sapiens
gctttattaaagaaataa

SEQ ID NO: 3583053 - DNA, 15 bp, Homo sapiens
gctttcacatttaaa

SEQ ID NO: 3583054 - DNA, 15 bp, Homo sapiens
gctttcagcctctgg

SEQ ID NO: 3583055 - DNA, 20 bp, Homo sapiens
gctttcccagtcccattcct

SEQ ID NO: 3583056 - DNA, 13 bp, Homo sapiens
gctttcccccagg

SEQ ID NO: 3583057 - DNA, 22 bp, Homo sapiens
gctttcctgcagcagtcgccca

SEQ ID NO: 3583058 - DNA, 12 bp, Homo sapiens
gctttcctgggc

SEQ ID NO: 3583059 - DNA, 19 bp, Homo sapiens
gctttcctgggcctttgca

SEQ ID NO: 3583060 - DNA, 17 bp, Homo sapiens
gctttctgccttagcct

SEQ ID NO: 3583061 - DNA, 15 bp, Homo sapiens
gctttcttacctact

SEQ ID NO: 3583062 - DNA, 21 bp, Homo sapiens
gctttctttccgtcaccctgg

SEQ ID NO: 3583063 - DNA, 22 bp, Homo sapiens
gctttgcaatatttattacaca

SEQ ID NO: 3583064 - DNA, 15 bp, Homo sapiens
gctttgcccacccct

SEQ ID NO: 3583065 - DNA, 17 bp, Homo sapiens
gctttgcccacccctca

SEQ ID NO: 3583066 - DNA, 11 bp, Homo sapiens
gctttgcctct

SEQ ID NO: 3583067 - DNA, 12 bp, Homo sapiens
gctttgcctctt

SEQ ID NO: 3583068 - DNA, 22 bp, Homo sapiens
gctttgcctcttctttgtgcct

SEQ ID NO: 3583069 - DNA, 12 bp, Homo sapiens
gctttgctgctg

SEQ ID NO: 3583070 - DNA, 19 bp, Homo sapiens
gctttgctttctgctcagc

SEQ ID NO: 3583071 - DNA, 18 bp, Homo sapiens
gctttggaacaatcacag

SEQ ID NO: 3583072 - DNA, 21 bp, Homo sapiens
gctttggatagtctcctacgc

SEQ ID NO: 3583073 - DNA, 16 bp, Homo sapiens
gctttggctctggctg

SEQ ID NO: 3583074 - DNA, 13 bp, Homo sapiens
gctttggcttctt

SEQ ID NO: 3583075 - DNA, 19 bp, Homo sapiens
gctttgggaagtttgctgt

SEQ ID NO: 3583076 - DNA, 19 bp, Homo sapiens
gctttgggctgccctggtg

SEQ ID NO: 3583077 - DNA, 15 bp, Homo sapiens
gctttggttccttct

SEQ ID NO: 3583078 - DNA, 20 bp, Homo sapiens
gctttggttccttctctggg

SEQ ID NO: 3583079 - DNA, 18 bp, Homo sapiens
gctttgtctacttcaaaa

SEQ ID NO: 3583080 - DNA, 20 bp, Homo sapiens
gctttgtctccaaagaagat

SEQ ID NO: 3583081 - DNA, 18 bp, Homo sapiens
gctttgtgtcgtcttgaa

SEQ ID NO: 3583082 - DNA, 15 bp, Homo sapiens
gctttgttgtgagaa

SEQ ID NO: 3583083 - DNA, 19 bp, Homo sapiens
gctttgttgtgagaatggc

SEQ ID NO: 3583084 - DNA, 23 bp, Homo sapiens
gctttgttgtgagaatggcctgg

SEQ ID NO: 3583085 - DNA, 17 bp, Homo sapiens
gcttttaaaaaaaaata

SEQ ID NO: 3583086 - DNA, 22 bp, Homo sapiens
gcttttcctcaaagggagagag

SEQ ID NO: 3583087 - DNA, 20 bp, Homo sapiens
gcttttcctggacagctaga

SEQ ID NO: 3583088 - DNA, 18 bp, Homo sapiens
gcttttgccactccttgt

SEQ ID NO: 3583089 - DNA, 14 bp, Homo sapiens
gcttttggcagaga

SEQ ID NO: 3583090 - DNA, 21 bp, Homo sapiens
gcttttgtctaattaaaacac

SEQ ID NO: 3583091 - DNA, 14 bp, Homo sapiens
gctttttaaaattt

SEQ ID NO: 3583092 - DNA, 19 bp, Homo sapiens
gctttttattccctgccca

SEQ ID NO: 3583093 - DNA, 20 bp, Homo sapiens
gctttttattccctgcccaa

SEQ ID NO: 3583094 - DNA, 15 bp, Homo sapiens
gcttttttattttaa

SEQ ID NO: 3583095 - DNA, 20 bp, Homo sapiens
gcttttttattttaatacaa

SEQ ID NO: 3583096 - DNA, 18 bp, Homo sapiens
gcttttttctcaataaaa

SEQ ID NO: 3583097 - DNA, 19 bp, Homo sapiens
ggaaaaaccacccccaaat

SEQ ID NO: 3583098 - DNA, 17 bp, Homo sapiens
ggaaaaatggttgatgg

SEQ ID NO: 3583099 - DNA, 12 bp, Homo sapiens
ggaaaaccagac

SEQ ID NO: 3583100 - DNA, 22 bp, Homo sapiens
ggaaaaccagactacttgggag

SEQ ID NO: 3583101 - DNA, 14 bp, Homo sapiens
ggaaaagcagctct

SEQ ID NO: 3583102 - DNA, 17 bp, Homo sapiens
ggaaaaggcaggtgctt

SEQ ID NO: 3583103 - DNA, 15 bp, Homo sapiens
ggaaaaggcccctgc

SEQ ID NO: 3583104 - DNA, 22 bp, Homo sapiens
ggaaaatgacctcaaggaagct

SEQ ID NO: 3583105 - DNA, 20 bp, Homo sapiens
ggaaaatgcagcagggatgc

SEQ ID NO: 3583106 - DNA, 18 bp, Homo sapiens
ggaaacaacgttgctatt

SEQ ID NO: 3583107 - DNA, 13 bp, Homo sapiens
ggaaacagaggct

SEQ ID NO: 3583108 - DNA, 13 bp, Homo sapiens
ggaaacagcatga

SEQ ID NO: 3583109 - DNA, 16 bp, Homo sapiens
ggaaacagcatgaata

SEQ ID NO: 3583110 - DNA, 21 bp, Homo sapiens
ggaaagaagggggccctgcta

SEQ ID NO: 3583111 - DNA, 19 bp, Homo sapiens
ggaaagaggtgaaaatgaa

SEQ ID NO: 3583112 - DNA, 22 bp, Homo sapiens
ggaaagcacaagactggcccag

SEQ ID NO: 3583113 - DNA, 14 bp, Homo sapiens
ggaaagccacatct

SEQ ID NO: 3583114 - DNA, 12 bp, Homo sapiens
ggaaagcctctg

SEQ ID NO: 3583115 - DNA, 13 bp, Homo sapiens
ggaaagcctctgg

SEQ ID NO: 3583116 - DNA, 15 bp, Homo sapiens
ggaaaggatctgtga

SEQ ID NO: 3583117 - DNA, 19 bp, Homo sapiens
ggaaaggatctgtgattgg

SEQ ID NO: 3583118 - DNA, 21 bp, Homo sapiens
ggaaagtgtgagctcttccct

SEQ ID NO: 3583119 - DNA, 16 bp, Homo sapiens
ggaaatcaaatatgca

SEQ ID NO: 3583120 - DNA, 20 bp, Homo sapiens
ggaaatgatttactggaatt

SEQ ID NO: 3583121 - DNA, 17 bp, Homo sapiens
ggaaattggaagagcac

SEQ ID NO: 3583122 - DNA, 23 bp, Homo sapiens
ggaaattttacaagggcataaag

SEQ ID NO: 3583123 - DNA, 19 bp, Homo sapiens
ggaacaatcacagggaatg

SEQ ID NO: 3583124 - DNA, 12 bp, Homo sapiens
ggaacacagcta

SEQ ID NO: 3583125 - DNA, 16 bp, Homo sapiens
ggaacacatctggctg

SEQ ID NO: 3583126 - DNA, 15 bp, Homo sapiens
ggaacactgagaaag

SEQ ID NO: 3583127 - DNA, 20 bp, Homo sapiens
ggaacagtgtaaatcccaga

SEQ ID NO: 3583128 - DNA, 23 bp, Homo sapiens
ggaacatcctaagacagaggaac

SEQ ID NO: 3583129 - DNA, 13 bp, Homo sapiens
ggaaccactccca

SEQ ID NO: 3583130 - DNA, 21 bp, Homo sapiens
ggaacccccctcccacccacc

SEQ ID NO: 3583131 - DNA, 13 bp, Homo sapiens
ggaaccctggagg

SEQ ID NO: 3583132 - DNA, 20 bp, Homo sapiens
ggaacctcagcctggccaga

SEQ ID NO: 3583133 - DNA, 22 bp, Homo sapiens
ggaacctcagcctggccagaca

SEQ ID NO: 3583134 - DNA, 23 bp, Homo sapiens
ggaacctcagcctggccagacac

SEQ ID NO: 3583135 - DNA, 15 bp, Homo sapiens
ggaacggaggaggac

SEQ ID NO: 3583136 - DNA, 23 bp, Homo sapiens
ggaactaggctcttatgtgtgcc

SEQ ID NO: 3583137 - DNA, 17 bp, Homo sapiens
ggaactcagatccaggg

SEQ ID NO: 3583138 - DNA, 16 bp, Homo sapiens
ggaactcctggccttt

SEQ ID NO: 3583139 - DNA, 19 bp, Homo sapiens
ggaactgaaatccttgaga

SEQ ID NO: 3583140 - DNA, 14 bp, Homo sapiens
ggaactgctgggct

SEQ ID NO: 3583141 - DNA, 18 bp, Homo sapiens
ggaagaagaaaggactga

SEQ ID NO: 3583142 - DNA, 17 bp, Homo sapiens
ggaagaatccagtatta

SEQ ID NO: 3583143 - DNA, 15 bp, Homo sapiens
ggaagacagtggccc

SEQ ID NO: 3583144 - DNA, 23 bp, Homo sapiens
ggaagagaagagggcccagccca

SEQ ID NO: 3583145 - DNA, 21 bp, Homo sapiens
ggaagcaataggtagctgggg

SEQ ID NO: 3583146 - DNA, 11 bp, Homo sapiens
ggaagccaggt

SEQ ID NO: 3583147 - DNA, 12 bp, Homo sapiens
ggaagccgcgcg

SEQ ID NO: 3583148 - DNA, 22 bp, Homo sapiens
ggaagctcccaccccactcagg

SEQ ID NO: 3583149 - DNA, 23 bp, Homo sapiens
ggaagctctccgagctctggtgc

SEQ ID NO: 3583150 - DNA, 17 bp, Homo sapiens
ggaagctgccctgccca

SEQ ID NO: 3583151 - DNA, 16 bp, Homo sapiens
ggaagctgtcctggag

SEQ ID NO: 3583152 - DNA, 18 bp, Homo sapiens
ggaagctgtgttgaaaca

SEQ ID NO: 3583153 - DNA, 15 bp, Homo sapiens
ggaaggaaaactatg

SEQ ID NO: 3583154 - DNA, 20 bp, Homo sapiens
ggaaggaatgtcagggccag

SEQ ID NO: 3583155 - DNA, 19 bp, Homo sapiens
ggccttacatctggctgga

SEQ ID NO: 3583156 - DNA, 15 bp, Homo sapiens
ggccttatctgaaag

SEQ ID NO: 3583157 - DNA, 13 bp, Homo sapiens
ggccttcaccaag

SEQ ID NO: 3583158 - DNA, 14 bp, Homo sapiens
ggccttcaccaagc

SEQ ID NO: 3583159 - DNA, 12 bp, Homo sapiens
ggccttgccagt

SEQ ID NO: 3583160 - DNA, 22 bp, Homo sapiens
ggcctttatgttctttcaccca

SEQ ID NO: 3583161 - DNA, 15 bp, Homo sapiens
ggcctttcctctgca

SEQ ID NO: 3583162 - DNA, 19 bp, Homo sapiens
ggcgaccccgtcacagcct

SEQ ID NO: 3583163 - DNA, 20 bp, Homo sapiens
ggcgaccccgtcacagcctc

SEQ ID NO: 3583164 - DNA, 14 bp, Homo sapiens
ggcgaggccgccca

SEQ ID NO: 3583165 - DNA, 11 bp, Homo sapiens
ggcgcaggagg

SEQ ID NO: 3583166 - DNA, 17 bp, Homo sapiens
ggcggcacgtccttggg

SEQ ID NO: 3583167 - DNA, 18 bp, Homo sapiens
ggcggcacgtccttgggc

SEQ ID NO: 3583168 - DNA, 21 bp, Homo sapiens
ggcggcacgtccttgggcgtc

SEQ ID NO: 3583169 - DNA, 23 bp, Homo sapiens
ggcggcccggccggagggcagga

SEQ ID NO: 3583170 - DNA, 12 bp, Homo sapiens
ggcggcctccat

SEQ ID NO: 3583171 - DNA, 20 bp, Homo sapiens
ggcggcttcgcgctggaatc

SEQ ID NO: 3583172 - DNA, 20 bp, Homo sapiens
ggcgggcacacctcctccca

SEQ ID NO: 3583173 - DNA, 14 bp, Homo sapiens
ggcgtccagctcag

SEQ ID NO: 3583174 - DNA, 19 bp, Homo sapiens
ggcgtgagccactgttccc

SEQ ID NO: 3583175 - DNA, 14 bp, Homo sapiens
ggcgtgctcagacc

SEQ ID NO: 3583176 - DNA, 14 bp, Homo sapiens
ggcgtgtgaagaac

SEQ ID NO: 3583177 - DNA, 17 bp, Homo sapiens
ggcgttctcccaaagat

SEQ ID NO: 3583178 - DNA, 20 bp, Homo sapiens
ggcgtttggagaaggtctgt

SEQ ID NO: 3583179 - DNA, 19 bp, Homo sapiens
ggctaattttttatccttt

SEQ ID NO: 3583180 - DNA, 15 bp, Homo sapiens
ggctagctaagccaa

SEQ ID NO: 3583181 - DNA, 12 bp, Homo sapiens
ggctaggcctcc

SEQ ID NO: 3583182 - DNA, 13 bp, Homo sapiens
ggctaggtacaca

SEQ ID NO: 3583183 - DNA, 19 bp, Homo sapiens
ggctagtcaagctcctcct

SEQ ID NO: 3583184 - DNA, 17 bp, Homo sapiens
ggctatggagggtcctc

SEQ ID NO: 3583185 - DNA, 21 bp, Homo sapiens
ggctatggggatagatgtgtg

SEQ ID NO: 3583186 - DNA, 17 bp, Homo sapiens
ggctatttttgaagcaa

SEQ ID NO: 3583187 - DNA, 22 bp, Homo sapiens
ggctatttttgaagcaaagaag

SEQ ID NO: 3583188 - DNA, 15 bp, Homo sapiens
ggctcacaaggccca

SEQ ID NO: 3583189 - DNA, 17 bp, Homo sapiens
ggctcacaaggcccagg

SEQ ID NO: 3583190 - DNA, 12 bp, Homo sapiens
ggctcactggca

SEQ ID NO: 3583191 - DNA, 17 bp, Homo sapiens
ggctcaggagaagccag

SEQ ID NO: 3583192 - DNA, 18 bp, Homo sapiens
ggctcaggagaagccagt

SEQ ID NO: 3583193 - DNA, 15 bp, Homo sapiens
ggctcatgcacccct

SEQ ID NO: 3583194 - DNA, 22 bp, Homo sapiens
ggctccactcttgatctctctt

SEQ ID NO: 3583195 - DNA, 17 bp, Homo sapiens
ggctccatatcatttga

SEQ ID NO: 3583196 - DNA, 20 bp, Homo sapiens
ggctccccaaggctgcaaag

SEQ ID NO: 3583197 - DNA, 16 bp, Homo sapiens
ggctcccgggggcccc

SEQ ID NO: 3583198 - DNA, 20 bp, Homo sapiens
ggctcctacctgtctgctgc

SEQ ID NO: 3583199 - DNA, 15 bp, Homo sapiens
ggctcctcctcaccc

SEQ ID NO: 3583200 - DNA, 23 bp, Homo sapiens
ggctcctcctcacccacctctgg

SEQ ID NO: 3583201 - DNA, 21 bp, Homo sapiens
ggctcctgaccccgccatgca

SEQ ID NO: 3583202 - DNA, 17 bp, Homo sapiens
ggctcgccgtgtctcag

SEQ ID NO: 3583203 - DNA, 17 bp, Homo sapiens
ggctcgtcagccacctg

SEQ ID NO: 3583204 - DNA, 18 bp, Homo sapiens
ggctcgtcagccacctgg

SEQ ID NO: 3583205 - DNA, 22 bp, Homo sapiens
ggctcgtcagccacctgggaac

SEQ ID NO: 3583206 - DNA, 19 bp, Homo sapiens
ggctctgcacagacaagca

SEQ ID NO: 3583207 - DNA, 15 bp, Homo sapiens
ggctctgggcctgag

SEQ ID NO: 3583208 - DNA, 14 bp, Homo sapiens
ggctctgtggcaaa

SEQ ID NO: 3583209 - DNA, 22 bp, Homo sapiens
ggctcttaagcagcatggaaaa

SEQ ID NO: 3583210 - DNA, 12 bp, Homo sapiens
ggctcttctcct

SEQ ID NO: 3583211 - DNA, 16 bp, Homo sapiens
ggctcttctcctttca

SEQ ID NO: 3583212 - DNA, 18 bp, Homo sapiens
ggctgaactttgtggtcg

SEQ ID NO: 3583213 - DNA, 17 bp, Homo sapiens
ggctgacatgctcacac

SEQ ID NO: 3583214 - DNA, 20 bp, Homo sapiens
ggctgacccagcatctccca

SEQ ID NO: 3583215 - DNA, 21 bp, Homo sapiens
ggctgacccagcatctcccag

SEQ ID NO: 3583216 - DNA, 15 bp, Homo sapiens
ggctgacctttcaaa

SEQ ID NO: 3583217 - DNA, 21 bp, Homo sapiens
ggctgagcaaatattaaaatt

SEQ ID NO: 3583218 - DNA, 22 bp, Homo sapiens
ggctgagcaaatattaaaattg

SEQ ID NO: 3583219 - DNA, 16 bp, Homo sapiens
ggctgagcccctgggg

SEQ ID NO: 3583220 - DNA, 12 bp, Homo sapiens
ggctgaggcagg

SEQ ID NO: 3583221 - DNA, 13 bp, Homo sapiens
ggctgagtggcag

SEQ ID NO: 3583222 - DNA, 15 bp, Homo sapiens
ggctgagtggcagca

SEQ ID NO: 3583223 - DNA, 19 bp, Homo sapiens
ggctgcacaacagccctgc

SEQ ID NO: 3583224 - DNA, 15 bp, Homo sapiens
ggctgcacaggctga

SEQ ID NO: 3583225 - DNA, 20 bp, Homo sapiens
ggctgcacctcctaccctcc

SEQ ID NO: 3583226 - DNA, 13 bp, Homo sapiens
ggctgcaggaaga

SEQ ID NO: 3583227 - DNA, 15 bp, Homo sapiens
ggctgcaggcaggcg

SEQ ID NO: 3583228 - DNA, 13 bp, Homo sapiens
ggctgcaggtgtt

SEQ ID NO: 3583229 - DNA, 20 bp, Homo sapiens
ggctgcaggtgttctgctga

SEQ ID NO: 3583230 - DNA, 21 bp, Homo sapiens
ggctgcatttgcctgtcatgc

SEQ ID NO: 3583231 - DNA, 14 bp, Homo sapiens
ggctgccaggggct

SEQ ID NO: 3583232 - DNA, 16 bp, Homo sapiens
ggctgccaggggctct

SEQ ID NO: 3583233 - DNA, 17 bp, Homo sapiens
ggctgccaggggctctg

SEQ ID NO: 3583234 - DNA, 17 bp, Homo sapiens
ggctgcccacctggctg

SEQ ID NO: 3583235 - DNA, 14 bp, Homo sapiens
ggctgcccaggaga

SEQ ID NO: 3583236 - DNA, 17 bp, Homo sapiens
ggctgccccggcctcct

SEQ ID NO: 3583237 - DNA, 15 bp, Homo sapiens
ggctgccctggtgct

SEQ ID NO: 3583238 - DNA, 18 bp, Homo sapiens
ggctgcctcctgccctta

SEQ ID NO: 3583239 - DNA, 18 bp, Homo sapiens
ggctgccttctttccatc

SEQ ID NO: 3583240 - DNA, 12 bp, Homo sapiens
ggctgctgctcc

SEQ ID NO: 3583241 - DNA, 19 bp, Homo sapiens
ggctggagaaagagctgcc

SEQ ID NO: 3583242 - DNA, 21 bp, Homo sapiens
ggctggagaaagagctgcctg

SEQ ID NO: 3583243 - DNA, 14 bp, Homo sapiens
ggctggagtgagga

SEQ ID NO: 3583244 - DNA, 16 bp, Homo sapiens
ggctggagttggggca

SEQ ID NO: 3583245 - DNA, 20 bp, Homo sapiens
ggctggcatcaagggagaca

SEQ ID NO: 3583246 - DNA, 15 bp, Homo sapiens
ggctgggagctctgc

SEQ ID NO: 3583247 - DNA, 18 bp, Homo sapiens
ggctgggccctctttccc

SEQ ID NO: 3583248 - DNA, 20 bp, Homo sapiens
ggctgggggaggtccaagca

SEQ ID NO: 3583249 - DNA, 16 bp, Homo sapiens
ggctggtagcagcagg

SEQ ID NO: 3583250 - DNA, 21 bp, Homo sapiens
ggctggtggctcccggagggc

SEQ ID NO: 3583251 - DNA, 17 bp, Homo sapiens
ggctgtacatagtcctt

SEQ ID NO: 3583252 - DNA, 16 bp, Homo sapiens
ggctgtgcctctgcct

SEQ ID NO: 3583253 - DNA, 24 bp, Homo sapiens
ggctgtggtagggggtgtctcagg

SEQ ID NO: 3583254 - DNA, 19 bp, Homo sapiens
ggctgtgtcctaaggccca

SEQ ID NO: 3583255 - DNA, 20 bp, Homo sapiens
ggctgtgttatgaaaatata

SEQ ID NO: 3583256 - DNA, 20 bp, Homo sapiens
ggctgtttcttgtctgttat

SEQ ID NO: 3583257 - DNA, 20 bp, Homo sapiens
ggcttagggtcctgtcgaag

SEQ ID NO: 3583258 - DNA, 18 bp, Homo sapiens
ggcttcaaaaagccacag

SEQ ID NO: 3583259 - DNA, 22 bp, Homo sapiens
ggcttcaaaaagccacagcaga

SEQ ID NO: 3583260 - DNA, 18 bp, Homo sapiens
ggcttcccgctcagccct

SEQ ID NO: 3583261 - DNA, 19 bp, Homo sapiens
ggcttcccgctcagccctc

SEQ ID NO: 3583262 - DNA, 21 bp, Homo sapiens
ggcttcccgctcagccctccc

SEQ ID NO: 3583263 - DNA, 17 bp, Homo sapiens
ggcttccctaaactgca

SEQ ID NO: 3583264 - DNA, 13 bp, Homo sapiens
ggcttccctggaa

SEQ ID NO: 3583265 - DNA, 14 bp, Homo sapiens
ggcttccctggaag

SEQ ID NO: 3583266 - DNA, 19 bp, Homo sapiens
ggcttccctggaagctctc

SEQ ID NO: 3583267 - DNA, 20 bp, Homo sapiens
ggcttctctgtgaattgcct

SEQ ID NO: 3583268 - DNA, 13 bp, Homo sapiens
ggcttggcccagc

SEQ ID NO: 3583269 - DNA, 22 bp, Homo sapiens
ggcttggggattgtacacggga

SEQ ID NO: 3583270 - DNA, 15 bp, Homo sapiens
ggctttaaagctgag

SEQ ID NO: 3583271 - DNA, 20 bp, Homo sapiens
ggctttagaaccgtaggttt

SEQ ID NO: 3583272 - DNA, 18 bp, Homo sapiens
ggctttcacatttaaatg

SEQ ID NO: 3583273 - DNA, 21 bp, Homo sapiens
ggctttcagagccagcctggc

SEQ ID NO: 3583274 - DNA, 16 bp, Homo sapiens
ggctttctcttcccct

SEQ ID NO: 3583275 - DNA, 22 bp, Homo sapiens
ggctttctcttccccttcctgt

SEQ ID NO: 3583276 - DNA, 19 bp, Homo sapiens
ggctttgcctcttctttgt

SEQ ID NO: 3583277 - DNA, 12 bp, Homo sapiens
ggctttgggaag

SEQ ID NO: 3583278 - DNA, 22 bp, Homo sapiens
ggctttgggaagtttgctgtgc

SEQ ID NO: 3583279 - DNA, 18 bp, Homo sapiens
ggctttggttccttctct

SEQ ID NO: 3583280 - DNA, 19 bp, Homo sapiens
ggctttgttgtgagaatgg

SEQ ID NO: 3583281 - DNA, 18 bp, Homo sapiens
ggcttttactgaagcctt

SEQ ID NO: 3583282 - DNA, 17 bp, Homo sapiens
gggaaaggatggagtgt

SEQ ID NO: 3583283 - DNA, 17 bp, Homo sapiens
gggaacacagctacaac

SEQ ID NO: 3583284 - DNA, 16 bp, Homo sapiens
gggaacacagttctgg

SEQ ID NO: 3583285 - DNA, 20 bp, Homo sapiens
gggaacccaagtccaagcat

SEQ ID NO: 3583286 - DNA, 16 bp, Homo sapiens
gggaactcagatccag

SEQ ID NO: 3583287 - DNA, 22 bp, Homo sapiens
ggtggtcctcctatctccctgg

SEQ ID NO: 3583288 - DNA, 19 bp, Homo sapiens
ggtggtggcagctgggcag

SEQ ID NO: 3583289 - DNA, 15 bp, Homo sapiens
ggtgtaacttcctgc

SEQ ID NO: 3583290 - DNA, 17 bp, Homo sapiens
ggtgtaacttcctgctg

SEQ ID NO: 3583291 - DNA, 14 bp, Homo sapiens
ggtgtataaatgta

SEQ ID NO: 3583292 - DNA, 21 bp, Homo sapiens
ggtgtatgccacacctggcct

SEQ ID NO: 3583293 - DNA, 18 bp, Homo sapiens
ggtgtgaacctacctgcc

SEQ ID NO: 3583294 - DNA, 20 bp, Homo sapiens
ggtgtgaactcaccctggga

SEQ ID NO: 3583295 - DNA, 17 bp, Homo sapiens
ggtgtgaatttgccaga

SEQ ID NO: 3583296 - DNA, 21 bp, Homo sapiens
ggtgtgaatttgccagaggac

SEQ ID NO: 3583297 - DNA, 13 bp, Homo sapiens
ggtgtgaggagag

SEQ ID NO: 3583298 - DNA, 20 bp, Homo sapiens
ggtgtgagtaattgaggaaa

SEQ ID NO: 3583299 - DNA, 21 bp, Homo sapiens
ggtgtgtccctggacacagct

SEQ ID NO: 3583300 - DNA, 22 bp, Homo sapiens
ggtgtgtccctggacacagctc

SEQ ID NO: 3583301 - DNA, 23 bp, Homo sapiens
ggtgtgtccctggacacagctct

SEQ ID NO: 3583302 - DNA, 21 bp, Homo sapiens
ggtgtttgtcatggtgaaatt

SEQ ID NO: 3583303 - DNA, 13 bp, Homo sapiens
ggttatgattgaa

SEQ ID NO: 3583304 - DNA, 15 bp, Homo sapiens
ggttcaaatctagaa

SEQ ID NO: 3583305 - DNA, 17 bp, Homo sapiens
ggttcaagtattaagca

SEQ ID NO: 3583306 - DNA, 18 bp, Homo sapiens
ggttcaagtattaagcag

SEQ ID NO: 3583307 - DNA, 16 bp, Homo sapiens
ggttcagacacagctc

SEQ ID NO: 3583308 - DNA, 14 bp, Homo sapiens
ggttccccaagggc

SEQ ID NO: 3583309 - DNA, 17 bp, Homo sapiens
ggttcctggtgactcct

SEQ ID NO: 3583310 - DNA, 18 bp, Homo sapiens
ggttctgaggccagaaag

SEQ ID NO: 3583311 - DNA, 20 bp, Homo sapiens
ggttctgaggccagaaaggt

SEQ ID NO: 3583312 - DNA, 20 bp, Homo sapiens
ggttctgcctgccagctgca

SEQ ID NO: 3583313 - DNA, 20 bp, Homo sapiens
ggttcttctatagtgatgat

SEQ ID NO: 3583314 - DNA, 14 bp, Homo sapiens
ggttctttcttcct

SEQ ID NO: 3583315 - DNA, 18 bp, Homo sapiens
ggttctttcttcctctgc

SEQ ID NO: 3583316 - DNA, 19 bp, Homo sapiens
ggttgatggaaaataaaca

SEQ ID NO: 3583317 - DNA, 13 bp, Homo sapiens
ggttgcctggggg

SEQ ID NO: 3583318 - DNA, 15 bp, Homo sapiens
ggttgcgtctgaggc

SEQ ID NO: 3583319 - DNA, 16 bp, Homo sapiens
ggttgctggtcctgca

SEQ ID NO: 3583320 - DNA, 19 bp, Homo sapiens
ggttgctgttttcctccct

SEQ ID NO: 3583321 - DNA, 21 bp, Homo sapiens
ggttgctgttttcctcccttc

SEQ ID NO: 3583322 - DNA, 20 bp, Homo sapiens
ggttggagtgctcttcccac

SEQ ID NO: 3583323 - DNA, 18 bp, Homo sapiens
ggtttaaagaaagtgtat

SEQ ID NO: 3583324 - DNA, 14 bp, Homo sapiens
ggtttaaagtttga

SEQ ID NO: 3583325 - DNA, 22 bp, Homo sapiens
ggtttacatgaagcagaacctt

SEQ ID NO: 3583326 - DNA, 20 bp, Homo sapiens
ggtttaggctggtggcccag

SEQ ID NO: 3583327 - DNA, 15 bp, Homo sapiens
ggtttataataaact

SEQ ID NO: 3583328 - DNA, 15 bp, Homo sapiens
ggtttcgactggtcc

SEQ ID NO: 3583329 - DNA, 18 bp, Homo sapiens
ggtttcgactggtccagc

SEQ ID NO: 3583330 - DNA, 21 bp, Homo sapiens
ggtttcgactggtccagctct

SEQ ID NO: 3583331 - DNA, 23 bp, Homo sapiens
ggtttcgactggtccagctctga

SEQ ID NO: 3583332 - DNA, 12 bp, Homo sapiens
ggtttctgggtg

SEQ ID NO: 3583333 - DNA, 15 bp, Homo sapiens
ggtttctttcagatt

SEQ ID NO: 3583334 - DNA, 18 bp, Homo sapiens
ggtttgaaggagaatggc

SEQ ID NO: 3583335 - DNA, 14 bp, Homo sapiens
ggtttgggagccag

SEQ ID NO: 3583336 - DNA, 21 bp, Homo sapiens
ggtttgtgtttgattggcttt

SEQ ID NO: 3583337 - DNA, 17 bp, Homo sapiens
ggttttatttatttctt

SEQ ID NO: 3583338 - DNA, 22 bp, Homo sapiens
ggttttccgcattctttgtaca

SEQ ID NO: 3583339 - DNA, 12 bp, Homo sapiens
ggtttttcaatt

SEQ ID NO: 3583340 - DNA, 17 bp, Homo sapiens
ggttttttaaaaggaaa

SEQ ID NO: 3583341 - DNA, 19 bp, Homo sapiens
gtaaaaatgagtcatttgt

SEQ ID NO: 3583342 - DNA, 13 bp, Homo sapiens
gtaaaacaaatga

SEQ ID NO: 3583343 - DNA, 14 bp, Homo sapiens
gtaaaacaaatgaa

SEQ ID NO: 3583344 - DNA, 16 bp, Homo sapiens
gtaaaacaaatgaaat

SEQ ID NO: 3583345 - DNA, 17 bp, Homo sapiens
gtaaaacaaatgaaatt

SEQ ID NO: 3583346 - DNA, 18 bp, Homo sapiens
gtaaaaccacagcagttg

SEQ ID NO: 3583347 - DNA, 11 bp, Homo sapiens
gtaaaacttct

SEQ ID NO: 3583348 - DNA, 12 bp, Homo sapiens
gtaaaacttctg

SEQ ID NO: 3583349 - DNA, 16 bp, Homo sapiens
gtaaaagcattttgta

SEQ ID NO: 3583350 - DNA, 17 bp, Homo sapiens
gtaaaaggtattaaatt

SEQ ID NO: 3583351 - DNA, 19 bp, Homo sapiens
gtaaaagtctacctgtgtt

SEQ ID NO: 3583352 - DNA, 17 bp, Homo sapiens
gtaaaataaggttatga

SEQ ID NO: 3583353 - DNA, 21 bp, Homo sapiens
gtaaacaaagactttgatcca

SEQ ID NO: 3583354 - DNA, 13 bp, Homo sapiens
gtaaagaaatgtc

SEQ ID NO: 3583355 - DNA, 16 bp, Homo sapiens
gtaaagaaatgtctta

SEQ ID NO: 3583356 - DNA, 20 bp, Homo sapiens
gtaaagcaaccaaaaagaaa

SEQ ID NO: 3583357 - DNA, 17 bp, Homo sapiens
gtaaagcacatggttca

SEQ ID NO: 3583358 - DNA, 21 bp, Homo sapiens
gtaaagtatgtttttaaattt

SEQ ID NO: 3583359 - DNA, 16 bp, Homo sapiens
gtaaatacatgcatat

SEQ ID NO: 3583360 - DNA, 14 bp, Homo sapiens
gtaaataggaattg

SEQ ID NO: 3583361 - DNA, 20 bp, Homo sapiens
gtaaatcctagacttgaaag

SEQ ID NO: 3583362 - DNA, 21 bp, Homo sapiens
gtaaatcctagacttgaaagt

SEQ ID NO: 3583363 - DNA, 22 bp, Homo sapiens
gtaaatcctagacttgaaagtt

SEQ ID NO: 3583364 - DNA, 21 bp, Homo sapiens
gtaaatggttaaattttacat

SEQ ID NO: 3583365 - DNA, 22 bp, Homo sapiens
gtaaatgtccacttaaaataca

SEQ ID NO: 3583366 - DNA, 16 bp, Homo sapiens
gtaaatttatgtgatg

SEQ ID NO: 3583367 - DNA, 19 bp, Homo sapiens
gtaaatttttaggcaaaga

SEQ ID NO: 3583368 - DNA, 23 bp, Homo sapiens
gtaaattttttacgtagctattt

SEQ ID NO: 3583369 - DNA, 20 bp, Homo sapiens
gtaacaaattgatctgtttt

SEQ ID NO: 3583370 - DNA, 15 bp, Homo sapiens
gtaacatcaagccat

SEQ ID NO: 3583371 - DNA, 19 bp, Homo sapiens
gtaacatcgcacagtttac

SEQ ID NO: 3583372 - DNA, 13 bp, Homo sapiens
gtaactaaaataa

SEQ ID NO: 3583373 - DNA, 12 bp, Homo sapiens
gtaacttcctgc

SEQ ID NO: 3583374 - DNA, 17 bp, Homo sapiens
gtaacttcctgctgcac

SEQ ID NO: 3583375 - DNA, 18 bp, Homo sapiens
gtaacttgagattcaaga

SEQ ID NO: 3583376 - DNA, 17 bp, Homo sapiens
gtaacttttgtaagaca

SEQ ID NO: 3583377 - DNA, 16 bp, Homo sapiens
gtaagaaatacagact

SEQ ID NO: 3583378 - DNA, 16 bp, Homo sapiens
gtaagaccaaatgtag

SEQ ID NO: 3583379 - DNA, 19 bp, Homo sapiens
gtaagatcgttctctgcct

SEQ ID NO: 3583380 - DNA, 20 bp, Homo sapiens
gtaagcaggagagaaatttc

SEQ ID NO: 3583381 - DNA, 15 bp, Homo sapiens
gtaagctttgttctg

SEQ ID NO: 3583382 - DNA, 17 bp, Homo sapiens
gtaaggctgtacatagt

SEQ ID NO: 3583383 - DNA, 21 bp, Homo sapiens
gtaaggctgtacatagtcctt

SEQ ID NO: 3583384 - DNA, 17 bp, Homo sapiens
gtaagggaaactgccag

SEQ ID NO: 3583385 - DNA, 13 bp, Homo sapiens
gtaagttttttga

SEQ ID NO: 3583386 - DNA, 13 bp, Homo sapiens
gtaataaactctc

SEQ ID NO: 3583387 - DNA, 14 bp, Homo sapiens
gtaataaactctct

SEQ ID NO: 3583388 - DNA, 16 bp, Homo sapiens
gtaataaagagaaata

SEQ ID NO: 3583389 - DNA, 21 bp, Homo sapiens
gtaataaagatacaaaatgtt

SEQ ID NO: 3583390 - DNA, 13 bp, Homo sapiens
gtaataaatactg

SEQ ID NO: 3583391 - DNA, 17 bp, Homo sapiens
gtaatacccgtcctctc

SEQ ID NO: 3583392 - DNA, 14 bp, Homo sapiens
gtaataggaaaatg

SEQ ID NO: 3583393 - DNA, 22 bp, Homo sapiens
gtaatatattctgaagcaacat

SEQ ID NO: 3583394 - DNA, 16 bp, Homo sapiens
gtaatattgacttgta

SEQ ID NO: 3583395 - DNA, 15 bp, Homo sapiens
gtaatccacctgcct

SEQ ID NO: 3583396 - DNA, 20 bp, Homo sapiens
gtaatctagttgtcaataaa

SEQ ID NO: 3583397 - DNA, 22 bp, Homo sapiens
gtaatctagttgtcaataaatg

SEQ ID NO: 3583398 - DNA, 18 bp, Homo sapiens
gtaatgacttagaaactg

SEQ ID NO: 3583399 - DNA, 14 bp, Homo sapiens
gtaatgctgcactt

SEQ ID NO: 3583400 - DNA, 12 bp, Homo sapiens
gtaatgctgcct

SEQ ID NO: 3583401 - DNA, 17 bp, Homo sapiens
gtaatgtttttatttca

SEQ ID NO: 3583402 - DNA, 20 bp, Homo sapiens
gtaatgtttttatttcaatt

SEQ ID NO: 3583403 - DNA, 20 bp, Homo sapiens
gtaattagtgccacttaatg

SEQ ID NO: 3583404 - DNA, 13 bp, Homo sapiens
gtaattatcagtt

SEQ ID NO: 3583405 - DNA, 22 bp, Homo sapiens
gtaattcaagcctctaaacaga

SEQ ID NO: 3583406 - DNA, 16 bp, Homo sapiens
gtaattccaaaatcca

SEQ ID NO: 3583407 - DNA, 16 bp, Homo sapiens
gtaattgtaattccaa

SEQ ID NO: 3583408 - DNA, 18 bp, Homo sapiens
gtaattgtacaataaatt

SEQ ID NO: 3583409 - DNA, 17 bp, Homo sapiens
gtaattgttacaatttt

SEQ ID NO: 3583410 - DNA, 17 bp, Homo sapiens
gtaatttaatttgtaaa

SEQ ID NO: 3583411 - DNA, 14 bp, Homo sapiens
gtaattttgtgtaa

SEQ ID NO: 3583412 - DNA, 20 bp, Homo sapiens
gtaattttgtgtaagaaata

SEQ ID NO: 3583413 - DNA, 15 bp, Homo sapiens
gtaatttttttcacc

SEQ ID NO: 3583414 - DNA, 17 bp, Homo sapiens
gtacaaccccctccacc

SEQ ID NO: 3583415 - DNA, 14 bp, Homo sapiens
gtacaatgtgagat

SEQ ID NO: 3583416 - DNA, 20 bp, Homo sapiens
gtacacagctctagacactg

SEQ ID NO: 3583417 - DNA, 17 bp, Homo sapiens
gtacacccatgaaagaa

SEQ ID NO: 3583418 - DNA, 13 bp, Homo sapiens
gtacaccctttcc

SEQ ID NO: 3583419 - DNA, 15 bp, Homo sapiens
gtgagatactgtgta

SEQ ID NO: 3583420 - DNA, 18 bp, Homo sapiens
gtgagcacaaagaagaaa

SEQ ID NO: 3583421 - DNA, 14 bp, Homo sapiens
gtgagcacacccgt

SEQ ID NO: 3583422 - DNA, 21 bp, Homo sapiens
gtgagcagtcgcctgcctgca

SEQ ID NO: 3583423 - DNA, 17 bp, Homo sapiens
gtgagcccctccccagc

SEQ ID NO: 3583424 - DNA, 12 bp, Homo sapiens
gtgagctgggga

SEQ ID NO: 3583425 - DNA, 14 bp, Homo sapiens
gtgagctggggact

SEQ ID NO: 3583426 - DNA, 16 bp, Homo sapiens
gtgaggataggacaga

SEQ ID NO: 3583427 - DNA, 15 bp, Homo sapiens
gtgagggccacctcc

SEQ ID NO: 3583428 - DNA, 17 bp, Homo sapiens
gtgaggggcaagctagg

SEQ ID NO: 3583429 - DNA, 23 bp, Homo sapiens
gtgagggtcctgcagcctgcagg

SEQ ID NO: 3583430 - DNA, 20 bp, Homo sapiens
gtgaggtgaactccaggcat

SEQ ID NO: 3583431 - DNA, 14 bp, Homo sapiens
gtgagtcaccactt

SEQ ID NO: 3583432 - DNA, 16 bp, Homo sapiens
gtgagtcacctgctcc

SEQ ID NO: 3583433 - DNA, 20 bp, Homo sapiens
gtgagtcacctgctccagaa

SEQ ID NO: 3583434 - DNA, 21 bp, Homo sapiens
gtgagtcacctgctccagaag

SEQ ID NO: 3583435 - DNA, 14 bp, Homo sapiens
gtgagtcatttaaa

SEQ ID NO: 3583436 - DNA, 14 bp, Homo sapiens
gtgagtctgggata

SEQ ID NO: 3583437 - DNA, 20 bp, Homo sapiens
gtgagtctgggatattcttt

SEQ ID NO: 3583438 - DNA, 13 bp, Homo sapiens
gtgatcaaagcca

SEQ ID NO: 3583439 - DNA, 13 bp, Homo sapiens
gtgatcctgttct

SEQ ID NO: 3583440 - DNA, 15 bp, Homo sapiens
gtgatctgctgctga

SEQ ID NO: 3583441 - DNA, 17 bp, Homo sapiens
gtgatgggaaagcattg

SEQ ID NO: 3583442 - DNA, 17 bp, Homo sapiens
gtgatgggctaggcctc

SEQ ID NO: 3583443 - DNA, 18 bp, Homo sapiens
gtgatgggctaggcctcc

SEQ ID NO: 3583444 - DNA, 14 bp, Homo sapiens
gtgatggttcccct

SEQ ID NO: 3583445 - DNA, 16 bp, Homo sapiens
gtgatggttcccctgt

SEQ ID NO: 3583446 - DNA, 23 bp, Homo sapiens
gtgatggttcccctgttcactct

SEQ ID NO: 3583447 - DNA, 12 bp, Homo sapiens
gtgatgtatttt

SEQ ID NO: 3583448 - DNA, 22 bp, Homo sapiens
gtgattagagggaggagaatga

SEQ ID NO: 3583449 - DNA, 13 bp, Homo sapiens
gtgattctcctgc

SEQ ID NO: 3583450 - DNA, 23 bp, Homo sapiens
gtgattgacagctttgctgctga

SEQ ID NO: 3583451 - DNA, 14 bp, Homo sapiens
gtgattggctgcag

SEQ ID NO: 3583452 - DNA, 17 bp, Homo sapiens
gtgatttccatttctga

SEQ ID NO: 3583453 - DNA, 16 bp, Homo sapiens
gtgatttgaattctgt

SEQ ID NO: 3583454 - DNA, 15 bp, Homo sapiens
gtgatttttatcaca

SEQ ID NO: 3583455 - DNA, 23 bp, Homo sapiens
gtgcaataaatctgacccagtgc

SEQ ID NO: 3583456 - DNA, 20 bp, Homo sapiens
gtgcacaaatatttattttc

SEQ ID NO: 3583457 - DNA, 20 bp, Homo sapiens
gtgcacacacacgcactctc

SEQ ID NO: 3583458 - DNA, 15 bp, Homo sapiens
gtgcacaggagccaa

SEQ ID NO: 3583459 - DNA, 16 bp, Homo sapiens
gtgcacctgcctccac

SEQ ID NO: 3583460 - DNA, 14 bp, Homo sapiens
gtgcactccagact

SEQ ID NO: 3583461 - DNA, 15 bp, Homo sapiens
gtgcactccagactc

SEQ ID NO: 3583462 - DNA, 23 bp, Homo sapiens
gtgcactgcctgcatgagctggc

SEQ ID NO: 3583463 - DNA, 21 bp, Homo sapiens
gtgcagtcagcagatgctgtt

SEQ ID NO: 3583464 - DNA, 16 bp, Homo sapiens
gtgcagtccatttcct

SEQ ID NO: 3583465 - DNA, 17 bp, Homo sapiens
gtgcagtgtgtgaaaat

SEQ ID NO: 3583466 - DNA, 19 bp, Homo sapiens
gtgcagtttcttttcacat

SEQ ID NO: 3583467 - DNA, 12 bp, Homo sapiens
gtgcatcattac

SEQ ID NO: 3583468 - DNA, 17 bp, Homo sapiens
gtgcatcattactgttc

SEQ ID NO: 3583469 - DNA, 13 bp, Homo sapiens
gtgcatctcagcc

SEQ ID NO: 3583470 - DNA, 15 bp, Homo sapiens
gtgcatctcagccca

SEQ ID NO: 3583471 - DNA, 14 bp, Homo sapiens
gtgcatctcctccc

SEQ ID NO: 3583472 - DNA, 15 bp, Homo sapiens
gtgccaccaccctgc

SEQ ID NO: 3583473 - DNA, 18 bp, Homo sapiens
gtgccaccccgagggctg

SEQ ID NO: 3583474 - DNA, 20 bp, Homo sapiens
gtgccagcaccacagccggt

SEQ ID NO: 3583475 - DNA, 14 bp, Homo sapiens
gtgccatgctgggc

SEQ ID NO: 3583476 - DNA, 23 bp, Homo sapiens
gtgccatgctgggccactgggga

SEQ ID NO: 3583477 - DNA, 20 bp, Homo sapiens
gtgcccaagaatagatgctg

SEQ ID NO: 3583478 - DNA, 17 bp, Homo sapiens
gtgcccacgagggtctc

SEQ ID NO: 3583479 - DNA, 16 bp, Homo sapiens
gtgcccagggccagtg

SEQ ID NO: 3583480 - DNA, 17 bp, Homo sapiens
gtgccccaccactcccc

SEQ ID NO: 3583481 - DNA, 18 bp, Homo sapiens
gtgccccaccactcccca

SEQ ID NO: 3583482 - DNA, 20 bp, Homo sapiens
gtgccccaccactccccaac

SEQ ID NO: 3583483 - DNA, 19 bp, Homo sapiens
gtgccccacttctggccac

SEQ ID NO: 3583484 - DNA, 21 bp, Homo sapiens
gtgccccacttctggccacat

SEQ ID NO: 3583485 - DNA, 15 bp, Homo sapiens
gtgccccaggaccag

SEQ ID NO: 3583486 - DNA, 13 bp, Homo sapiens
gtgcccccactga

SEQ ID NO: 3583487 - DNA, 19 bp, Homo sapiens
gtgcccccactgaccagaa

SEQ ID NO: 3583488 - DNA, 17 bp, Homo sapiens
gtgcccgcgccaggccc

SEQ ID NO: 3583489 - DNA, 21 bp, Homo sapiens
gtgcccgcgccaggccctcag

SEQ ID NO: 3583490 - DNA, 19 bp, Homo sapiens
gtgccctggatgcccagga

SEQ ID NO: 3583491 - DNA, 15 bp, Homo sapiens
gtgcctaatgtgttt

SEQ ID NO: 3583492 - DNA, 14 bp, Homo sapiens
gtgcctctgggact

SEQ ID NO: 3583493 - DNA, 16 bp, Homo sapiens
gtgcctgagctgggga

SEQ ID NO: 3583494 - DNA, 22 bp, Homo sapiens
gtgcctggccgcagggcggggc

SEQ ID NO: 3583495 - DNA, 16 bp, Homo sapiens
gtgcctttctttgcct

SEQ ID NO: 3583496 - DNA, 13 bp, Homo sapiens
gtgcctttggcct

SEQ ID NO: 3583497 - DNA, 19 bp, Homo sapiens
gtgcggcggtcccagctcc

SEQ ID NO: 3583498 - DNA, 16 bp, Homo sapiens
gtgctagatccagccc

SEQ ID NO: 3583499 - DNA, 17 bp, Homo sapiens
gtgctccgtagctctgc

SEQ ID NO: 3583500 - DNA, 20 bp, Homo sapiens
gtgctctggcaccatcagcc

SEQ ID NO: 3583501 - DNA, 14 bp, Homo sapiens
gtgctctgtaacat

SEQ ID NO: 3583502 - DNA, 22 bp, Homo sapiens
gtgctctgtaacatcgcacagt

SEQ ID NO: 3583503 - DNA, 22 bp, Homo sapiens
gtgctcttcccactccagctga

SEQ ID NO: 3583504 - DNA, 20 bp, Homo sapiens
gtgctcttggctgacccctc

SEQ ID NO: 3583505 - DNA, 17 bp, Homo sapiens
gtgctgacagctgctcc

SEQ ID NO: 3583506 - DNA, 16 bp, Homo sapiens
gtgctgacggccaggg

SEQ ID NO: 3583507 - DNA, 21 bp, Homo sapiens
gtgctgacggccagggagaag

SEQ ID NO: 3583508 - DNA, 23 bp, Homo sapiens
gtgctgacggccagggagaagct

SEQ ID NO: 3583509 - DNA, 15 bp, Homo sapiens
gtgctgcagatttga

SEQ ID NO: 3583510 - DNA, 13 bp, Homo sapiens
gtgctgcaggagt

SEQ ID NO: 3583511 - DNA, 21 bp, Homo sapiens
gtgctgccacacttcaggctc

SEQ ID NO: 3583512 - DNA, 23 bp, Homo sapiens
gtgctgctctctccgaggggtgg

SEQ ID NO: 3583513 - DNA, 16 bp, Homo sapiens
gtgctggcggacgcag

SEQ ID NO: 3583514 - DNA, 12 bp, Homo sapiens
gtgctgggcaga

SEQ ID NO: 3583515 - DNA, 15 bp, Homo sapiens
gtgctggggcacggc

SEQ ID NO: 3583516 - DNA, 14 bp, Homo sapiens
gtgctggtgcatca

SEQ ID NO: 3583517 - DNA, 15 bp, Homo sapiens
gtgctgtgctctggc

SEQ ID NO: 3583518 - DNA, 17 bp, Homo sapiens
gtgctgtgctctggcac

SEQ ID NO: 3583519 - DNA, 17 bp, Homo sapiens
gtgctgtgtgagtgagc

SEQ ID NO: 3583520 - DNA, 15 bp, Homo sapiens
gtgctgtttgaaaat

SEQ ID NO: 3583521 - DNA, 23 bp, Homo sapiens
gtgctgttttctacccttggaaa

SEQ ID NO: 3583522 - DNA, 17 bp, Homo sapiens
gtgcttaatttaaatag

SEQ ID NO: 3583523 - DNA, 21 bp, Homo sapiens
gtgctttggaacaatcacagg

SEQ ID NO: 3583524 - DNA, 24 bp, Homo sapiens
gtggaaagtcaggctagctgtgct

SEQ ID NO: 3583525 - DNA, 21 bp, Homo sapiens
gtggaacataaaaaggacatc

SEQ ID NO: 3583526 - DNA, 15 bp, Homo sapiens
gtggaagtgtgggtc

SEQ ID NO: 3583527 - DNA, 20 bp, Homo sapiens
gtggaagtgtgggtctgtgt

SEQ ID NO: 3583528 - DNA, 21 bp, Homo sapiens
gtggaagtgtgggtctgtgtg

SEQ ID NO: 3583529 - DNA, 20 bp, Homo sapiens
gtggaatagtatcctccagg

SEQ ID NO: 3583530 - DNA, 17 bp, Homo sapiens
gtggacatgcataaaaa

SEQ ID NO: 3583531 - DNA, 18 bp, Homo sapiens
gtggactgtgctggtgca

SEQ ID NO: 3583532 - DNA, 17 bp, Homo sapiens
gtggagctgtctgtctc

SEQ ID NO: 3583533 - DNA, 17 bp, Homo sapiens
gtggatacctggttgag

SEQ ID NO: 3583534 - DNA, 15 bp, Homo sapiens
gtggatgcaaataga

SEQ ID NO: 3583535 - DNA, 20 bp, Homo sapiens
gtggattgtatttaagacat

SEQ ID NO: 3583536 - DNA, 18 bp, Homo sapiens
gtggcaaaaagagtcaga

SEQ ID NO: 3583537 - DNA, 14 bp, Homo sapiens
gtggcacagctggg

SEQ ID NO: 3583538 - DNA, 17 bp, Homo sapiens
gtggcacctgtttcccg

SEQ ID NO: 3583539 - DNA, 15 bp, Homo sapiens
gtggcagagttacag

SEQ ID NO: 3583540 - DNA, 12 bp, Homo sapiens
gtggcagcagcc

SEQ ID NO: 3583541 - DNA, 15 bp, Homo sapiens
gtggcagcttgctgg

SEQ ID NO: 3583542 - DNA, 18 bp, Homo sapiens
gtggcagcttgctgggct

SEQ ID NO: 3583543 - DNA, 23 bp, Homo sapiens
gtggcagcttgctgggctttggg

SEQ ID NO: 3583544 - DNA, 22 bp, Homo sapiens
gtggcagggggccccgccaggg

SEQ ID NO: 3583545 - DNA, 17 bp, Homo sapiens
gtggccaaggagctgct

SEQ ID NO: 3583546 - DNA, 13 bp, Homo sapiens
gtggccaggcctt

SEQ ID NO: 3583547 - DNA, 19 bp, Homo sapiens
gtggcccgacagcctggca

SEQ ID NO: 3583548 - DNA, 20 bp, Homo sapiens
gtggcctatgaaactggttt

SEQ ID NO: 3583549 - DNA, 14 bp, Homo sapiens
gtggcctccctgct

SEQ ID NO: 3583550 - DNA, 19 bp, Homo sapiens
gtggcctcgtgctccgcag

SEQ ID NO: 3583551 - DNA, 22 bp, Homo sapiens
taaaagtgttgctgattgtcaa

SEQ ID NO: 3583552 - DNA, 14 bp, Homo sapiens
taaaagtttctaat

SEQ ID NO: 3583553 - DNA, 11 bp, Homo sapiens
taaaataaacc

SEQ ID NO: 3583554 - DNA, 15 bp, Homo sapiens
taaaataaaccaaat

SEQ ID NO: 3583555 - DNA, 18 bp, Homo sapiens
taaaataaaccaaatatg

SEQ ID NO: 3583556 - DNA, 23 bp, Homo sapiens
taaaataaaccaaatatgttaaa

SEQ ID NO: 3583557 - DNA, 14 bp, Homo sapiens
taaaataaataatc

SEQ ID NO: 3583558 - DNA, 17 bp, Homo sapiens
taaaataacttgcatct

SEQ ID NO: 3583559 - DNA, 15 bp, Homo sapiens
taaaataatgggatt

SEQ ID NO: 3583560 - DNA, 14 bp, Homo sapiens
taaaataattttgt

SEQ ID NO: 3583561 - DNA, 15 bp, Homo sapiens
taaaataattttgta

SEQ ID NO: 3583562 - DNA, 14 bp, Homo sapiens
taaaatacatgaat

SEQ ID NO: 3583563 - DNA, 16 bp, Homo sapiens
taaaatagtatgaaaa

SEQ ID NO: 3583564 - DNA, 21 bp, Homo sapiens
taaaatcagtgtgcttgcctt

SEQ ID NO: 3583565 - DNA, 10 bp, Homo sapiens
taaaatcatt

SEQ ID NO: 3583566 - DNA, 12 bp, Homo sapiens
taaaatctaaaa

SEQ ID NO: 3583567 - DNA, 21 bp, Homo sapiens
taaaatctaaaatttcataat

SEQ ID NO: 3583568 - DNA, 16 bp, Homo sapiens
taaaatcttgaaaatg

SEQ ID NO: 3583569 - DNA, 19 bp, Homo sapiens
taaaatgaacctgctactt

SEQ ID NO: 3583570 - DNA, 23 bp, Homo sapiens
taaaatgatattgttatatacat

SEQ ID NO: 3583571 - DNA, 17 bp, Homo sapiens
taaaatgatttgtagtg

SEQ ID NO: 3583572 - DNA, 23 bp, Homo sapiens
taaaatgatttgtagtggaaaca

SEQ ID NO: 3583573 - DNA, 19 bp, Homo sapiens
taaaatgctcaatttcagc

SEQ ID NO: 3583574 - DNA, 22 bp, Homo sapiens
taaaatgctggtgaaatgctgt

SEQ ID NO: 3583575 - DNA, 13 bp, Homo sapiens
taaaatggaattg

SEQ ID NO: 3583576 - DNA, 21 bp, Homo sapiens
taaaatggtgaagaactagca

SEQ ID NO: 3583577 - DNA, 12 bp, Homo sapiens
taaaatgtatat

SEQ ID NO: 3583578 - DNA, 20 bp, Homo sapiens
taaaatgtatatttttaaag

SEQ ID NO: 3583579 - DNA, 17 bp, Homo sapiens
taaaatgtattcaagca

SEQ ID NO: 3583580 - DNA, 19 bp, Homo sapiens
taaaatgttaaaacataaa

SEQ ID NO: 3583581 - DNA, 21 bp, Homo sapiens
taaaatgttaaaacataaaca

SEQ ID NO: 3583582 - DNA, 21 bp, Homo sapiens
taaaattatatagctgctcct

SEQ ID NO: 3583583 - DNA, 15 bp, Homo sapiens
taaaatttaatttca

SEQ ID NO: 3583584 - DNA, 12 bp, Homo sapiens
taaacaaagaca

SEQ ID NO: 3583585 - DNA, 14 bp, Homo sapiens
taaacaaagacatt

SEQ ID NO: 3583586 - DNA, 21 bp, Homo sapiens
taaacaaagacattgacagca

SEQ ID NO: 3583587 - DNA, 21 bp, Homo sapiens
taaacagacaggaatttagaa

SEQ ID NO: 3583588 - DNA, 16 bp, Homo sapiens
taaacataataaatca

SEQ ID NO: 3583589 - DNA, 15 bp, Homo sapiens
taaacataatgaaaa

SEQ ID NO: 3583590 - DNA, 15 bp, Homo sapiens
taaacatcagtttct

SEQ ID NO: 3583591 - DNA, 23 bp, Homo sapiens
taaacattattaagtaacttatt

SEQ ID NO: 3583592 - DNA, 21 bp, Homo sapiens
taaacattcaattccagagaa

SEQ ID NO: 3583593 - DNA, 15 bp, Homo sapiens
taaaccgtgtattta

SEQ ID NO: 3583594 - DNA, 21 bp, Homo sapiens
taaacggattattttttcaga

SEQ ID NO: 3583595 - DNA, 17 bp, Homo sapiens
taaacggttcctggtga

SEQ ID NO: 3583596 - DNA, 21 bp, Homo sapiens
taaactatcttggtgaatttt

SEQ ID NO: 3583597 - DNA, 17 bp, Homo sapiens
taaactccatgatattt

SEQ ID NO: 3583598 - DNA, 15 bp, Homo sapiens
taaactctgttgcaa

SEQ ID NO: 3583599 - DNA, 10 bp, Homo sapiens
taaactgcag

SEQ ID NO: 3583600 - DNA, 12 bp, Homo sapiens
taaactgcagcc

SEQ ID NO: 3583601 - DNA, 20 bp, Homo sapiens
taaactgcagcctctctggc

SEQ ID NO: 3583602 - DNA, 19 bp, Homo sapiens
taaactgctgaattcacct

SEQ ID NO: 3583603 - DNA, 22 bp, Homo sapiens
taaactgtgttttagtgtaaaa

SEQ ID NO: 3583604 - DNA, 18 bp, Homo sapiens
taaactgtttctttaaaa

SEQ ID NO: 3583605 - DNA, 14 bp, Homo sapiens
taaacttcagcaac

SEQ ID NO: 3583606 - DNA, 19 bp, Homo sapiens
taaactttgaagcaactgt

SEQ ID NO: 3583607 - DNA, 23 bp, Homo sapiens
taaagaaagtgtatttggaaata

SEQ ID NO: 3583608 - DNA, 24 bp, Homo sapiens
taaagaaagtgtatttggaaataa

SEQ ID NO: 3583609 - DNA, 13 bp, Homo sapiens
taaagaacaaagt

SEQ ID NO: 3583610 - DNA, 16 bp, Homo sapiens
taaagaagaggagaaa

SEQ ID NO: 3583611 - DNA, 16 bp, Homo sapiens
taaagaaggatgatgt

SEQ ID NO: 3583612 - DNA, 13 bp, Homo sapiens
taaagaatgttag

SEQ ID NO: 3583613 - DNA, 17 bp, Homo sapiens
taaagaattaatgactt

SEQ ID NO: 3583614 - DNA, 20 bp, Homo sapiens
taaagacaatcactgccaac

SEQ ID NO: 3583615 - DNA, 23 bp, Homo sapiens
taaagacaggagacaaaagagca

SEQ ID NO: 3583616 - DNA, 22 bp, Homo sapiens
taaagaccgtacaaactcagat

SEQ ID NO: 3583617 - DNA, 11 bp, Homo sapiens
taaagagcatc

SEQ ID NO: 3583618 - DNA, 20 bp, Homo sapiens
taaagagcatctgattcttg

SEQ ID NO: 3583619 - DNA, 13 bp, Homo sapiens
taaagatggaaaa

SEQ ID NO: 3583620 - DNA, 22 bp, Homo sapiens
taaagccaggctcaggagaagc

SEQ ID NO: 3583621 - DNA, 11 bp, Homo sapiens
taaagcctcaa

SEQ ID NO: 3583622 - DNA, 23 bp, Homo sapiens
taaagcctgtgggtttggtcctt

SEQ ID NO: 3583623 - DNA, 19 bp, Homo sapiens
taaaggaaaggccctgcac

SEQ ID NO: 3583624 - DNA, 14 bp, Homo sapiens
taaaggcagttttc

SEQ ID NO: 3583625 - DNA, 17 bp, Homo sapiens
taaaggcagttttctaa

SEQ ID NO: 3583626 - DNA, 20 bp, Homo sapiens
taaagggactacctctgtgc

SEQ ID NO: 3583627 - DNA, 21 bp, Homo sapiens
taaagggcagggcccacgtgt

SEQ ID NO: 3583628 - DNA, 14 bp, Homo sapiens
taaaggtctgcact

SEQ ID NO: 3583629 - DNA, 13 bp, Homo sapiens
taaaggttaaaaa

SEQ ID NO: 3583630 - DNA, 13 bp, Homo sapiens
taaaggttgagta

SEQ ID NO: 3583631 - DNA, 14 bp, Homo sapiens
taaagtataacatg

SEQ ID NO: 3583632 - DNA, 13 bp, Homo sapiens
taaagtcagatgg

SEQ ID NO: 3583633 - DNA, 17 bp, Homo sapiens
taaagtcagatggaaaa

SEQ ID NO: 3583634 - DNA, 21 bp, Homo sapiens
taaagtctgttgattaaagat

SEQ ID NO: 3583635 - DNA, 22 bp, Homo sapiens
taaagtctgttgattaaagatg

SEQ ID NO: 3583636 - DNA, 12 bp, Homo sapiens
taaagtgcttga

SEQ ID NO: 3583637 - DNA, 14 bp, Homo sapiens
taaagttcaaactc

SEQ ID NO: 3583638 - DNA, 16 bp, Homo sapiens
taaagtttaatgccta

SEQ ID NO: 3583639 - DNA, 16 bp, Homo sapiens
taaataaaaatttata

SEQ ID NO: 3583640 - DNA, 11 bp, Homo sapiens
taaataaagag

SEQ ID NO: 3583641 - DNA, 13 bp, Homo sapiens
taaataaagagga

SEQ ID NO: 3583642 - DNA, 17 bp, Homo sapiens
taaataacacagatatt

SEQ ID NO: 3583643 - DNA, 16 bp, Homo sapiens
taaataaccaatagtt

SEQ ID NO: 3583644 - DNA, 15 bp, Homo sapiens
taaatacgtgtcaaa

SEQ ID NO: 3583645 - DNA, 16 bp, Homo sapiens
taaatactttccatgt

SEQ ID NO: 3583646 - DNA, 16 bp, Homo sapiens
taaatagcattatctt

SEQ ID NO: 3583647 - DNA, 17 bp, Homo sapiens
taaataggatcctggag

SEQ ID NO: 3583648 - DNA, 14 bp, Homo sapiens
taaatagtattcca

SEQ ID NO: 3583649 - DNA, 12 bp, Homo sapiens
taaatataaaaa

SEQ ID NO: 3583650 - DNA, 15 bp, Homo sapiens
taaatataaaaatgg

SEQ ID NO: 3583651 - DNA, 13 bp, Homo sapiens
taaatataacact

SEQ ID NO: 3583652 - DNA, 20 bp, Homo sapiens
taaatatatatatatttctc

SEQ ID NO: 3583653 - DNA, 20 bp, Homo sapiens
taaatatcccttggacattt

SEQ ID NO: 3583654 - DNA, 13 bp, Homo sapiens
taaatattttccg

SEQ ID NO: 3583655 - DNA, 14 bp, Homo sapiens
taaatattttgcta

SEQ ID NO: 3583656 - DNA, 18 bp, Homo sapiens
taaatattttgctaactg

SEQ ID NO: 3583657 - DNA, 16 bp, Homo sapiens
taaatcacacattcag

SEQ ID NO: 3583658 - DNA, 22 bp, Homo sapiens
taaatcatgttgttgtgtgtat

SEQ ID NO: 3583659 - DNA, 20 bp, Homo sapiens
taaatccaccaccaaaatta

SEQ ID NO: 3583660 - DNA, 14 bp, Homo sapiens
taaatcctgaagag

SEQ ID NO: 3583661 - DNA, 15 bp, Homo sapiens
taaatctgacccagt

SEQ ID NO: 3583662 - DNA, 13 bp, Homo sapiens
taaatctttcaaa

SEQ ID NO: 3583663 - DNA, 22 bp, Homo sapiens
taaatgaaacttaagaattgaa

SEQ ID NO: 3583664 - DNA, 14 bp, Homo sapiens
taaatgcattatag

SEQ ID NO: 3583665 - DNA, 17 bp, Homo sapiens
taaatggggctcacaaa

SEQ ID NO: 3583666 - DNA, 21 bp, Homo sapiens
taaatgtaaaaatgaaggaat

SEQ ID NO: 3583667 - DNA, 20 bp, Homo sapiens
taaatgtatactatagtacc

SEQ ID NO: 3583668 - DNA, 22 bp, Homo sapiens
taaatgtcactttttgaggcaa

SEQ ID NO: 3583669 - DNA, 23 bp, Homo sapiens
taaatgtccacttaaaatacatg

SEQ ID NO: 3583670 - DNA, 20 bp, Homo sapiens
taaatgttatgactatgtaa

SEQ ID NO: 3583671 - DNA, 21 bp, Homo sapiens
taaatgttatgactatgtaaa

SEQ ID NO: 3583672 - DNA, 15 bp, Homo sapiens
taaattaatggttta

SEQ ID NO: 3583673 - DNA, 13 bp, Homo sapiens
taaattacaaagg

SEQ ID NO: 3583674 - DNA, 17 bp, Homo sapiens
taaattattactttaaa

SEQ ID NO: 3583675 - DNA, 23 bp, Homo sapiens
taaattattactttaaattatat

SEQ ID NO: 3583676 - DNA, 11 bp, Homo sapiens
taaattatttt

SEQ ID NO: 3583677 - DNA, 15 bp, Homo sapiens
taaattccactgaaa

SEQ ID NO: 3583678 - DNA, 20 bp, Homo sapiens
taaattccactgaaaattta

SEQ ID NO: 3583679 - DNA, 22 bp, Homo sapiens
taaattccactgaaaatttaac

SEQ ID NO: 3583680 - DNA, 18 bp, Homo sapiens
taaattcccaaatcctag

SEQ ID NO: 3583681 - DNA, 12 bp, Homo sapiens
taaattcctctt

SEQ ID NO: 3583682 - DNA, 13 bp, Homo sapiens
taaattctaaatt

SEQ ID NO: 3583683 - DNA, 20 bp, Homo sapiens
taaattctagtgtccataaa

SEQ ID NO: 3583684 - DNA, 24 bp, Homo sapiens
tactaacccagtctttcttcactc

SEQ ID NO: 3583685 - DNA, 19 bp, Homo sapiens
tactaagttattttatgac

SEQ ID NO: 3583686 - DNA, 16 bp, Homo sapiens
tactaatgtctcttct

SEQ ID NO: 3583687 - DNA, 13 bp, Homo sapiens
tactacccagctc

SEQ ID NO: 3583688 - DNA, 16 bp, Homo sapiens
tactacccagctctgt

SEQ ID NO: 3583689 - DNA, 13 bp, Homo sapiens
tactactgcagtc

SEQ ID NO: 3583690 - DNA, 21 bp, Homo sapiens
tactagtcaccagagacttta

SEQ ID NO: 3583691 - DNA, 14 bp, Homo sapiens
tactagtgtgactc

SEQ ID NO: 3583692 - DNA, 16 bp, Homo sapiens
tactagtgtgactcct

SEQ ID NO: 3583693 - DNA, 12 bp, Homo sapiens
tactatagtacc

SEQ ID NO: 3583694 - DNA, 21 bp, Homo sapiens
tactatgatcagaagaacatg

SEQ ID NO: 3583695 - DNA, 23 bp, Homo sapiens
tactatgatcagaagaacatgat

SEQ ID NO: 3583696 - DNA, 12 bp, Homo sapiens
tactatgcacaa

SEQ ID NO: 3583697 - DNA, 18 bp, Homo sapiens
tactatgcacaacagagt

SEQ ID NO: 3583698 - DNA, 23 bp, Homo sapiens
tactattgttgctgaaacttgct

SEQ ID NO: 3583699 - DNA, 21 bp, Homo sapiens
tactcagtttatgttgtacaa

SEQ ID NO: 3583700 - DNA, 15 bp, Homo sapiens
tactcataagtaaaa

SEQ ID NO: 3583701 - DNA, 16 bp, Homo sapiens
tactcccaaactgaca

SEQ ID NO: 3583702 - DNA, 18 bp, Homo sapiens
tactcccaaactgacaat

SEQ ID NO: 3583703 - DNA, 15 bp, Homo sapiens
tactcccccaccact

SEQ ID NO: 3583704 - DNA, 19 bp, Homo sapiens
tactcccccaccactcagg

SEQ ID NO: 3583705 - DNA, 18 bp, Homo sapiens
tactccctacactgatgc

SEQ ID NO: 3583706 - DNA, 20 bp, Homo sapiens
tactcctggctcaagccctg

SEQ ID NO: 3583707 - DNA, 20 bp, Homo sapiens
tactctataaccaaatgaaa

SEQ ID NO: 3583708 - DNA, 14 bp, Homo sapiens
tactctcttcctcc

SEQ ID NO: 3583709 - DNA, 17 bp, Homo sapiens
tactctcttcctccact

SEQ ID NO: 3583710 - DNA, 15 bp, Homo sapiens
tactctgtgaaagaa

SEQ ID NO: 3583711 - DNA, 22 bp, Homo sapiens
tactgaaatttgttatacttca

SEQ ID NO: 3583712 - DNA, 23 bp, Homo sapiens
tactgaaatttgttatacttcaa

SEQ ID NO: 3583713 - DNA, 14 bp, Homo sapiens
tactgacagggagc

SEQ ID NO: 3583714 - DNA, 18 bp, Homo sapiens
tactgacagggagcagcc

SEQ ID NO: 3583715 - DNA, 23 bp, Homo sapiens
tactgacagggagcagcccccgg

SEQ ID NO: 3583716 - DNA, 20 bp, Homo sapiens
tactgagaaaagcctctcca

SEQ ID NO: 3583717 - DNA, 15 bp, Homo sapiens
tactgagcactgaac

SEQ ID NO: 3583718 - DNA, 16 bp, Homo sapiens
tactgagcactgaacc

SEQ ID NO: 3583719 - DNA, 17 bp, Homo sapiens
tactgatgagagaatgt

SEQ ID NO: 3583720 - DNA, 21 bp, Homo sapiens
tactgatgagagaatgtggaa

SEQ ID NO: 3583721 - DNA, 19 bp, Homo sapiens
tactgcccaggcctgcctg

SEQ ID NO: 3583722 - DNA, 20 bp, Homo sapiens
tactgcccaggcctgcctgt

SEQ ID NO: 3583723 - DNA, 21 bp, Homo sapiens
tactgcccaggcctgcctgtt

SEQ ID NO: 3583724 - DNA, 22 bp, Homo sapiens
tactgcccaggcctgcctgttc

SEQ ID NO: 3583725 - DNA, 21 bp, Homo sapiens
tactgccctttcaaagcactt

SEQ ID NO: 3583726 - DNA, 12 bp, Homo sapiens
tactgctggagt

SEQ ID NO: 3583727 - DNA, 13 bp, Homo sapiens
tactgctggagtc

SEQ ID NO: 3583728 - DNA, 17 bp, Homo sapiens
tactggaattcttctgc

SEQ ID NO: 3583729 - DNA, 18 bp, Homo sapiens
tactggaattcttctgca

SEQ ID NO: 3583730 - DNA, 18 bp, Homo sapiens
tactggcaaaaggatctt

SEQ ID NO: 3583731 - DNA, 17 bp, Homo sapiens
tactggttacctggaga

SEQ ID NO: 3583732 - DNA, 20 bp, Homo sapiens
tactggttacctggagaagt

SEQ ID NO: 3583733 - DNA, 21 bp, Homo sapiens
tactgtaatgctgcctcagga

SEQ ID NO: 3583734 - DNA, 22 bp, Homo sapiens
tactgtatggaaacactgattt

SEQ ID NO: 3583735 - DNA, 14 bp, Homo sapiens
tactgtgtaattag

SEQ ID NO: 3583736 - DNA, 14 bp, Homo sapiens
tactgttacttgat

SEQ ID NO: 3583737 - DNA, 15 bp, Homo sapiens
tactgttacttgata

SEQ ID NO: 3583738 - DNA, 17 bp, Homo sapiens
tactgttcttcatttta

SEQ ID NO: 3583739 - DNA, 15 bp, Homo sapiens
tacttaagagtggca

SEQ ID NO: 3583740 - DNA, 20 bp, Homo sapiens
tacttagagtttctgtttga

SEQ ID NO: 3583741 - DNA, 18 bp, Homo sapiens
tacttatgtagaaactga

SEQ ID NO: 3583742 - DNA, 14 bp, Homo sapiens
tacttatttctcag

SEQ ID NO: 3583743 - DNA, 23 bp, Homo sapiens
tacttatttctcagctgtgcctt

SEQ ID NO: 3583744 - DNA, 21 bp, Homo sapiens
tacttattttcagtgcatcat

SEQ ID NO: 3583745 - DNA, 17 bp, Homo sapiens
tacttatttttgacagt

SEQ ID NO: 3583746 - DNA, 17 bp, Homo sapiens
tacttcaaaagtttgtt

SEQ ID NO: 3583747 - DNA, 19 bp, Homo sapiens
tacttcaaagtgcctgggc

SEQ ID NO: 3583748 - DNA, 20 bp, Homo sapiens
tacttcaaagtgcctgggct

SEQ ID NO: 3583749 - DNA, 12 bp, Homo sapiens
tacttgaagggc

SEQ ID NO: 3583750 - DNA, 20 bp, Homo sapiens
tacttgggtcacatgactct

SEQ ID NO: 3583751 - DNA, 13 bp, Homo sapiens
tacttgtttgaat

SEQ ID NO: 3583752 - DNA, 17 bp, Homo sapiens
tactttaaacttgtctt

SEQ ID NO: 3583753 - DNA, 22 bp, Homo sapiens
tactttaaattatatgatatgc

SEQ ID NO: 3583754 - DNA, 22 bp, Homo sapiens
tactttaattactggaattctt

SEQ ID NO: 3583755 - DNA, 20 bp, Homo sapiens
tactttctatctcatctgtc

SEQ ID NO: 3583756 - DNA, 17 bp, Homo sapiens
tactttctatgtgacat

SEQ ID NO: 3583757 - DNA, 23 bp, Homo sapiens
tactttgatattttcaacgcagc

SEQ ID NO: 3583758 - DNA, 21 bp, Homo sapiens
tacttttaaacagtgagcctg

SEQ ID NO: 3583759 - DNA, 13 bp, Homo sapiens
tacttttctaaaa

SEQ ID NO: 3583760 - DNA, 20 bp, Homo sapiens
tagaaaaagtcaatgtactt

SEQ ID NO: 3583761 - DNA, 21 bp, Homo sapiens
tagaaaaagtcaatgtacttg

SEQ ID NO: 3583762 - DNA, 21 bp, Homo sapiens
tagaaaatagagcttttaaaa

SEQ ID NO: 3583763 - DNA, 21 bp, Homo sapiens
tagaaaatgacttatttctgc

SEQ ID NO: 3583764 - DNA, 19 bp, Homo sapiens
tagaaatgtaacttttgta

SEQ ID NO: 3583765 - DNA, 12 bp, Homo sapiens
tagaaatgtgaa

SEQ ID NO: 3583766 - DNA, 12 bp, Homo sapiens
tagaactcctgt

SEQ ID NO: 3583767 - DNA, 15 bp, Homo sapiens
tagaactcctgtctt

SEQ ID NO: 3583768 - DNA, 22 bp, Homo sapiens
tagaactcctgtcttctttctc

SEQ ID NO: 3583769 - DNA, 18 bp, Homo sapiens
tagaagattctatgttaa

SEQ ID NO: 3583770 - DNA, 21 bp, Homo sapiens
tagaagcctactggtagaaaa

SEQ ID NO: 3583771 - DNA, 21 bp, Homo sapiens
tagaagtaaggattataaaca

SEQ ID NO: 3583772 - DNA, 16 bp, Homo sapiens
tagaatgatttcatgc

SEQ ID NO: 3583773 - DNA, 21 bp, Homo sapiens
tagaatgatttcatgctatct

SEQ ID NO: 3583774 - DNA, 22 bp, Homo sapiens
tagaatggataaaataatgctg

SEQ ID NO: 3583775 - DNA, 21 bp, Homo sapiens
tagaatgtcaataaatttgct

SEQ ID NO: 3583776 - DNA, 12 bp, Homo sapiens
tagaatgttgaa

SEQ ID NO: 3583777 - DNA, 20 bp, Homo sapiens
tagacaaagccttaagcaaa

SEQ ID NO: 3583778 - DNA, 21 bp, Homo sapiens
tagacaaagccttaagcaaat

SEQ ID NO: 3583779 - DNA, 18 bp, Homo sapiens
tagacaatataagagctt

SEQ ID NO: 3583780 - DNA, 14 bp, Homo sapiens
tagacattcagact

SEQ ID NO: 3583781 - DNA, 22 bp, Homo sapiens
tagacattcagactaaaaatac

SEQ ID NO: 3583782 - DNA, 13 bp, Homo sapiens
tagaccaaaataa

SEQ ID NO: 3583783 - DNA, 14 bp, Homo sapiens
tagaccaaaataaa

SEQ ID NO: 3583784 - DNA, 19 bp, Homo sapiens
tagaccaattgaagcatga

SEQ ID NO: 3583785 - DNA, 17 bp, Homo sapiens
tagactgctcctgggca

SEQ ID NO: 3583786 - DNA, 17 bp, Homo sapiens
tagactgtgccagaggc

SEQ ID NO: 3583787 - DNA, 18 bp, Homo sapiens
tagactgtgccagaggcc

SEQ ID NO: 3583788 - DNA, 19 bp, Homo sapiens
tagactgttgggacagcca

SEQ ID NO: 3583789 - DNA, 21 bp, Homo sapiens
tagactgttgggacagccatt

SEQ ID NO: 3583790 - DNA, 15 bp, Homo sapiens
tagagaaaaccttaa

SEQ ID NO: 3583791 - DNA, 22 bp, Homo sapiens
tagagaaggacccggaggggcc

SEQ ID NO: 3583792 - DNA, 17 bp, Homo sapiens
tagagataggaaactga

SEQ ID NO: 3583793 - DNA, 13 bp, Homo sapiens
tagagcatatttg

SEQ ID NO: 3583794 - DNA, 16 bp, Homo sapiens
tagagctaaaaaggcc

SEQ ID NO: 3583795 - DNA, 16 bp, Homo sapiens
tagaggcaacaggatt

SEQ ID NO: 3583796 - DNA, 15 bp, Homo sapiens
tagagggacctctcc

SEQ ID NO: 3583797 - DNA, 22 bp, Homo sapiens
tagagggcgagggatgatgagg

SEQ ID NO: 3583798 - DNA, 15 bp, Homo sapiens
tagaggtactagaat

SEQ ID NO: 3583799 - DNA, 18 bp, Homo sapiens
tagaggtactagaatgct

SEQ ID NO: 3583800 - DNA, 12 bp, Homo sapiens
tagagtaatgaa

SEQ ID NO: 3583801 - DNA, 13 bp, Homo sapiens
tagagtgtagcct

SEQ ID NO: 3583802 - DNA, 21 bp, Homo sapiens
tagagtgtagcctaaagggca

SEQ ID NO: 3583803 - DNA, 22 bp, Homo sapiens
tagagtgtagcctaaagggcag

SEQ ID NO: 3583804 - DNA, 20 bp, Homo sapiens
tagagtgtagctgtaagggc

SEQ ID NO: 3583805 - DNA, 13 bp, Homo sapiens
tagagtttctgtt

SEQ ID NO: 3583806 - DNA, 23 bp, Homo sapiens
tagagtttctgtttgattctttt

SEQ ID NO: 3583807 - DNA, 13 bp, Homo sapiens
tagatataaatat

SEQ ID NO: 3583808 - DNA, 15 bp, Homo sapiens
tagatcagtatttca

SEQ ID NO: 3583809 - DNA, 14 bp, Homo sapiens
tagatccagcccaa

SEQ ID NO: 3583810 - DNA, 18 bp, Homo sapiens
tagatccagcccaaacct

SEQ ID NO: 3583811 - DNA, 19 bp, Homo sapiens
tagatccagcccaaacctg

SEQ ID NO: 3583812 - DNA, 15 bp, Homo sapiens
tagatgactttgcag

SEQ ID NO: 3583813 - DNA, 20 bp, Homo sapiens
tagatgactttgcagatgga

SEQ ID NO: 3583814 - DNA, 14 bp, Homo sapiens
tagatgaggctcag

SEQ ID NO: 3583815 - DNA, 16 bp, Homo sapiens
tattatttgtcttaaa

SEQ ID NO: 3583816 - DNA, 23 bp, Homo sapiens
tattcaaaaattatctatagcta

SEQ ID NO: 3583817 - DNA, 15 bp, Homo sapiens
tattcaaacagtctc

SEQ ID NO: 3583818 - DNA, 18 bp, Homo sapiens
tattcaagcaaacatcaa

SEQ ID NO: 3583819 - DNA, 16 bp, Homo sapiens
tattcaatatcctttg

SEQ ID NO: 3583820 - DNA, 15 bp, Homo sapiens
tattcacaaaatatc

SEQ ID NO: 3583821 - DNA, 16 bp, Homo sapiens
tattcagttcttacac

SEQ ID NO: 3583822 - DNA, 13 bp, Homo sapiens
tattccaatcact

SEQ ID NO: 3583823 - DNA, 15 bp, Homo sapiens
tattccactatttgc

SEQ ID NO: 3583824 - DNA, 16 bp, Homo sapiens
tattccccagtgactc

SEQ ID NO: 3583825 - DNA, 20 bp, Homo sapiens
tattccccagtgactccagg

SEQ ID NO: 3583826 - DNA, 22 bp, Homo sapiens
tattccctgcccaaacccttaa

SEQ ID NO: 3583827 - DNA, 19 bp, Homo sapiens
tattcctgcatttgtgaaa

SEQ ID NO: 3583828 - DNA, 21 bp, Homo sapiens
tattcctgcatttgtgaaatg

SEQ ID NO: 3583829 - DNA, 15 bp, Homo sapiens
tattcctttattttg

SEQ ID NO: 3583830 - DNA, 12 bp, Homo sapiens
tattctatttta

SEQ ID NO: 3583831 - DNA, 13 bp, Homo sapiens
tattctccagaca

SEQ ID NO: 3583832 - DNA, 16 bp, Homo sapiens
tattctccagacatgg

SEQ ID NO: 3583833 - DNA, 15 bp, Homo sapiens
tattcttataaaaat

SEQ ID NO: 3583834 - DNA, 14 bp, Homo sapiens
tattgaaaacttca

SEQ ID NO: 3583835 - DNA, 16 bp, Homo sapiens
tattgaaaacttcaaa

SEQ ID NO: 3583836 - DNA, 17 bp, Homo sapiens
tattgaaaacttcaaag

SEQ ID NO: 3583837 - DNA, 18 bp, Homo sapiens
tattgaaaacttcaaagc

SEQ ID NO: 3583838 - DNA, 22 bp, Homo sapiens
tattgaaaacttcaaagctgaa

SEQ ID NO: 3583839 - DNA, 18 bp, Homo sapiens
tattgaattcatttcact

SEQ ID NO: 3583840 - DNA, 14 bp, Homo sapiens
tattgacttgtata

SEQ ID NO: 3583841 - DNA, 21 bp, Homo sapiens
tattgatacaatattgtgcat

SEQ ID NO: 3583842 - DNA, 14 bp, Homo sapiens
tattgatgttttca

SEQ ID NO: 3583843 - DNA, 16 bp, Homo sapiens
tattgatttttaagaa

SEQ ID NO: 3583844 - DNA, 13 bp, Homo sapiens
tattgcacattgt

SEQ ID NO: 3583845 - DNA, 17 bp, Homo sapiens
tattgccctaattaaaa

SEQ ID NO: 3583846 - DNA, 20 bp, Homo sapiens
tattgcctaagaataaacat

SEQ ID NO: 3583847 - DNA, 11 bp, Homo sapiens
tattgctgcta

SEQ ID NO: 3583848 - DNA, 17 bp, Homo sapiens
tattggaatagcagcct

SEQ ID NO: 3583849 - DNA, 16 bp, Homo sapiens
tattggtgttgcagcc

SEQ ID NO: 3583850 - DNA, 15 bp, Homo sapiens
tattgtttaaaatca

SEQ ID NO: 3583851 - DNA, 16 bp, Homo sapiens
tattgtttaaaatcat

SEQ ID NO: 3583852 - DNA, 17 bp, Homo sapiens
tattgtttaaaatcatt

SEQ ID NO: 3583853 - DNA, 12 bp, Homo sapiens
tattgtttattt

SEQ ID NO: 3583854 - DNA, 17 bp, Homo sapiens
tattgtttgatgttttt

SEQ ID NO: 3583855 - DNA, 18 bp, Homo sapiens
tattgtttgatgttttta

SEQ ID NO: 3583856 - DNA, 14 bp, Homo sapiens
tattgttttacaat

SEQ ID NO: 3583857 - DNA, 15 bp, Homo sapiens
tattgttttacaata

SEQ ID NO: 3583858 - DNA, 22 bp, Homo sapiens
tatttaaaaaatgaatagtaca

SEQ ID NO: 3583859 - DNA, 12 bp, Homo sapiens
tatttaaaatgg

SEQ ID NO: 3583860 - DNA, 19 bp, Homo sapiens
tatttaaagaaatatgtat

SEQ ID NO: 3583861 - DNA, 21 bp, Homo sapiens
tatttaaatcctgaagagcat

SEQ ID NO: 3583862 - DNA, 15 bp, Homo sapiens
tatttaacaagatct

SEQ ID NO: 3583863 - DNA, 20 bp, Homo sapiens
tatttaactaattaaaaaat

SEQ ID NO: 3583864 - DNA, 13 bp, Homo sapiens
tatttaacttctg

SEQ ID NO: 3583865 - DNA, 12 bp, Homo sapiens
tatttaagacat

SEQ ID NO: 3583866 - DNA, 14 bp, Homo sapiens
tatttaagacataa

SEQ ID NO: 3583867 - DNA, 17 bp, Homo sapiens
tatttaagatgtacatt

SEQ ID NO: 3583868 - DNA, 19 bp, Homo sapiens
tatttaagatgtacattta

SEQ ID NO: 3583869 - DNA, 21 bp, Homo sapiens
tatttaagatgtacatttaat

SEQ ID NO: 3583870 - DNA, 18 bp, Homo sapiens
tatttaagcaacatcttt

SEQ ID NO: 3583871 - DNA, 20 bp, Homo sapiens
tatttaagcaacatcttttt

SEQ ID NO: 3583872 - DNA, 21 bp, Homo sapiens
tatttaagcaacatcttttta

SEQ ID NO: 3583873 - DNA, 12 bp, Homo sapiens
tatttaagcctt

SEQ ID NO: 3583874 - DNA, 13 bp, Homo sapiens
tatttaatttgaa

SEQ ID NO: 3583875 - DNA, 16 bp, Homo sapiens
tatttaatttgaaggt

SEQ ID NO: 3583876 - DNA, 23 bp, Homo sapiens
tatttaatttgaaggtagaatgt

SEQ ID NO: 3583877 - DNA, 20 bp, Homo sapiens
tatttacactattatttcct

SEQ ID NO: 3583878 - DNA, 18 bp, Homo sapiens
tatttacagctgtgctcc

SEQ ID NO: 3583879 - DNA, 14 bp, Homo sapiens
tatttaccaaagta

SEQ ID NO: 3583880 - DNA, 18 bp, Homo sapiens
tatttacttcttatacat

SEQ ID NO: 3583881 - DNA, 14 bp, Homo sapiens
tatttagattcact

SEQ ID NO: 3583882 - DNA, 14 bp, Homo sapiens
tatttagttggaat

SEQ ID NO: 3583883 - DNA, 12 bp, Homo sapiens
tatttatcttta

SEQ ID NO: 3583884 - DNA, 13 bp, Homo sapiens
tatttatgaaagt

SEQ ID NO: 3583885 - DNA, 21 bp, Homo sapiens
tatttatgccttgatgattta

SEQ ID NO: 3583886 - DNA, 21 bp, Homo sapiens
tatttattccccagtgactcc

SEQ ID NO: 3583887 - DNA, 20 bp, Homo sapiens
tatttattgaaatgatttca

SEQ ID NO: 3583888 - DNA, 14 bp, Homo sapiens
tatttattgatgtt

SEQ ID NO: 3583889 - DNA, 10 bp, Homo sapiens
tatttattgt

SEQ ID NO: 3583890 - DNA, 11 bp, Homo sapiens
tatttattgtt

SEQ ID NO: 3583891 - DNA, 15 bp, Homo sapiens
tatttattgttagaa

SEQ ID NO: 3583892 - DNA, 18 bp, Homo sapiens
tatttattgtttatttta

SEQ ID NO: 3583893 - DNA, 13 bp, Homo sapiens
tatttatttaaat

SEQ ID NO: 3583894 - DNA, 14 bp, Homo sapiens
tatttatttctagt

SEQ ID NO: 3583895 - DNA, 15 bp, Homo sapiens
tatttatttctttct

SEQ ID NO: 3583896 - DNA, 16 bp, Homo sapiens
tatttatttgtttgtt

SEQ ID NO: 3583897 - DNA, 21 bp, Homo sapiens
tatttattttcttttgaattg

SEQ ID NO: 3583898 - DNA, 22 bp, Homo sapiens
tatttcaaacattttgtatcaa

SEQ ID NO: 3583899 - DNA, 21 bp, Homo sapiens
tatttcaataaatctttcaaa

SEQ ID NO: 3583900 - DNA, 12 bp, Homo sapiens
tatttcatttct

SEQ ID NO: 3583901 - DNA, 15 bp, Homo sapiens
tatttcccccttcat

SEQ ID NO: 3583902 - DNA, 22 bp, Homo sapiens
tatttcccccttcatccatcct

SEQ ID NO: 3583903 - DNA, 20 bp, Homo sapiens
tatttctaatccttttcctt

SEQ ID NO: 3583904 - DNA, 14 bp, Homo sapiens
tatttctcagctgt

SEQ ID NO: 3583905 - DNA, 16 bp, Homo sapiens
tatttgaggtcagtgt

SEQ ID NO: 3583906 - DNA, 13 bp, Homo sapiens
tatttgattattt

SEQ ID NO: 3583907 - DNA, 15 bp, Homo sapiens
tatttgcattgagga

SEQ ID NO: 3583908 - DNA, 23 bp, Homo sapiens
tatttgccaataaagcttttgga

SEQ ID NO: 3583909 - DNA, 19 bp, Homo sapiens
tatttgccttctactcccc

SEQ ID NO: 3583910 - DNA, 16 bp, Homo sapiens
tatttggaaataaagt

SEQ ID NO: 3583911 - DNA, 19 bp, Homo sapiens
tatttggaaataaagtcag

SEQ ID NO: 3583912 - DNA, 10 bp, Homo sapiens
tatttgtaaa

SEQ ID NO: 3583913 - DNA, 15 bp, Homo sapiens
tatttgtaaagtgat

SEQ ID NO: 3583914 - DNA, 18 bp, Homo sapiens
tatttgtcttaaaaaatg

SEQ ID NO: 3583915 - DNA, 23 bp, Homo sapiens
tatttgtcttaaaaaatgtgaaa

SEQ ID NO: 3583916 - DNA, 15 bp, Homo sapiens
tatttgtgagactgt

SEQ ID NO: 3583917 - DNA, 21 bp, Homo sapiens
tatttgtttttattgtaaaac

SEQ ID NO: 3583918 - DNA, 14 bp, Homo sapiens
tattttaatcctgt

SEQ ID NO: 3583919 - DNA, 21 bp, Homo sapiens
tattttcaacgcagccctgct

SEQ ID NO: 3583920 - DNA, 16 bp, Homo sapiens
tattttcaagaaactg

SEQ ID NO: 3583921 - DNA, 21 bp, Homo sapiens
tattttccaagtaaaatatta

SEQ ID NO: 3583922 - DNA, 16 bp, Homo sapiens
tattttccttctgaag

SEQ ID NO: 3583923 - DNA, 19 bp, Homo sapiens
tattttcttttgaattgtt

SEQ ID NO: 3583924 - DNA, 16 bp, Homo sapiens
tattttgagaaactgc

SEQ ID NO: 3583925 - DNA, 17 bp, Homo sapiens
tattttgatgtaaagat

SEQ ID NO: 3583926 - DNA, 16 bp, Homo sapiens
tattttgctaactggt

SEQ ID NO: 3583927 - DNA, 13 bp, Homo sapiens
tattttgtaaact

SEQ ID NO: 3583928 - DNA, 17 bp, Homo sapiens
tattttgtaactgtaaa

SEQ ID NO: 3583929 - DNA, 13 bp, Homo sapiens
tattttgtaataa

SEQ ID NO: 3583930 - DNA, 15 bp, Homo sapiens
tattttgtactttgt

SEQ ID NO: 3583931 - DNA, 20 bp, Homo sapiens
tattttgtactttgtggaga

SEQ ID NO: 3583932 - DNA, 12 bp, Homo sapiens
tatttttaaggt

SEQ ID NO: 3583933 - DNA, 16 bp, Homo sapiens
tatttttatacactgt

SEQ ID NO: 3583934 - DNA, 12 bp, Homo sapiens
tatttttatttg

SEQ ID NO: 3583935 - DNA, 12 bp, Homo sapiens
tatttttccttt

SEQ ID NO: 3583936 - DNA, 13 bp, Homo sapiens
tatttttgtattt

SEQ ID NO: 3583937 - DNA, 16 bp, Homo sapiens
tattttttaaatcttg

SEQ ID NO: 3583938 - DNA, 14 bp, Homo sapiens
tattttttcagacc

SEQ ID NO: 3583939 - DNA, 13 bp, Homo sapiens
tattttttgaaaa

SEQ ID NO: 3583940 - DNA, 14 bp, Homo sapiens
tattttttgtataa

SEQ ID NO: 3583941 - DNA, 16 bp, Homo sapiens
tattttttgtataatt

SEQ ID NO: 3583942 - DNA, 16 bp, Homo sapiens
tatttttttcccatga

SEQ ID NO: 3583943 - DNA, 17 bp, Homo sapiens
tattttttttaagtatt

SEQ ID NO: 3583944 - DNA, 18 bp, Homo sapiens
tcaaaaaaaagaaaatgt

SEQ ID NO: 3583945 - DNA, 15 bp, Homo sapiens
tcaaaaacattctta

SEQ ID NO: 3583946 - DNA, 15 bp, Homo sapiens
tcaaaaagccacagc

SEQ ID NO: 3583947 - DNA, 22 bp, Homo sapiens
tcaaaaagccacagcagagcat

SEQ ID NO: 3583948 - DNA, 23 bp, Homo sapiens
tcaaaaagccacagcagagcatt

SEQ ID NO: 3583949 - DNA, 23 bp, Homo sapiens
tcattttaaattccactgaaaat

SEQ ID NO: 3583950 - DNA, 23 bp, Homo sapiens
tcattttatttacagctgtgctc

SEQ ID NO: 3583951 - DNA, 12 bp, Homo sapiens
tcattttttccc

SEQ ID NO: 3583952 - DNA, 14 bp, Homo sapiens
tccaaaacatttct

SEQ ID NO: 3583953 - DNA, 13 bp, Homo sapiens
tccaaaactgcct

SEQ ID NO: 3583954 - DNA, 15 bp, Homo sapiens
tccaaaacttctctt

SEQ ID NO: 3583955 - DNA, 15 bp, Homo sapiens
tccaaacctccagcc

SEQ ID NO: 3583956 - DNA, 12 bp, Homo sapiens
tccaaacctgtc

SEQ ID NO: 3583957 - DNA, 20 bp, Homo sapiens
tccaaacctgtcttggggcc

SEQ ID NO: 3583958 - DNA, 14 bp, Homo sapiens
tccaaagaaatgta

SEQ ID NO: 3583959 - DNA, 17 bp, Homo sapiens
tccaaagaaatgtaagg

SEQ ID NO: 3583960 - DNA, 11 bp, Homo sapiens
tccaaagaaga

SEQ ID NO: 3583961 - DNA, 21 bp, Homo sapiens
tccaaagctttattaccagtg

SEQ ID NO: 3583962 - DNA, 23 bp, Homo sapiens
tccaaccaaggaatttaaaactg

SEQ ID NO: 3583963 - DNA, 14 bp, Homo sapiens
tccaacgcccctgt

SEQ ID NO: 3583964 - DNA, 15 bp, Homo sapiens
tccaacgcccctgtg

SEQ ID NO: 3583965 - DNA, 19 bp, Homo sapiens
tccaacgcccctgtggcca

SEQ ID NO: 3583966 - DNA, 16 bp, Homo sapiens
tccaagagggaatggt

SEQ ID NO: 3583967 - DNA, 16 bp, Homo sapiens
tccaagcagagtgttt

SEQ ID NO: 3583968 - DNA, 23 bp, Homo sapiens
tccaagcataccaacacgagcag

SEQ ID NO: 3583969 - DNA, 12 bp, Homo sapiens
tccaagcatttc

SEQ ID NO: 3583970 - DNA, 15 bp, Homo sapiens
tccaagcatttcatg

SEQ ID NO: 3583971 - DNA, 14 bp, Homo sapiens
tccaaggctttaaa

SEQ ID NO: 3583972 - DNA, 21 bp, Homo sapiens
tccaaggctttaaagctgaga

SEQ ID NO: 3583973 - DNA, 19 bp, Homo sapiens
tccaagggtttcgactggt

SEQ ID NO: 3583974 - DNA, 24 bp, Homo sapiens
tccaagggtttcgactggtccagc

SEQ ID NO: 3583975 - DNA, 18 bp, Homo sapiens
tccaatcccaccaaccct

SEQ ID NO: 3583976 - DNA, 14 bp, Homo sapiens
tccaatgcacagtt

SEQ ID NO: 3583977 - DNA, 12 bp, Homo sapiens
tccaatttaagg

SEQ ID NO: 3583978 - DNA, 18 bp, Homo sapiens
tccaatttacatactctg

SEQ ID NO: 3583979 - DNA, 21 bp, Homo sapiens
tccacacacagctgggctgtg

SEQ ID NO: 3583980 - DNA, 22 bp, Homo sapiens
tccacacccaccccctctggag

SEQ ID NO: 3583981 - DNA, 15 bp, Homo sapiens
tccacagaggacaca

SEQ ID NO: 3583982 - DNA, 14 bp, Homo sapiens
tccacagccttgca

SEQ ID NO: 3583983 - DNA, 20 bp, Homo sapiens
tccacagccttgcagcggct

SEQ ID NO: 3583984 - DNA, 18 bp, Homo sapiens
tccacaggggccaccacc

SEQ ID NO: 3583985 - DNA, 16 bp, Homo sapiens
tccacatgctgcctgg

SEQ ID NO: 3583986 - DNA, 17 bp, Homo sapiens
tccacatgctgcctggc

SEQ ID NO: 3583987 - DNA, 11 bp, Homo sapiens
tccacccacaa

SEQ ID NO: 3583988 - DNA, 19 bp, Homo sapiens
tccacccacaaactccagg

SEQ ID NO: 3583989 - DNA, 21 bp, Homo sapiens
tccacccacaaactccaggct

SEQ ID NO: 3583990 - DNA, 17 bp, Homo sapiens
tccacccagcaggcaga

SEQ ID NO: 3583991 - DNA, 18 bp, Homo sapiens
tccacccatttgttttcg

SEQ ID NO: 3583992 - DNA, 15 bp, Homo sapiens
tccaccccccactca

SEQ ID NO: 3583993 - DNA, 19 bp, Homo sapiens
tccaccccccactcagtgc

SEQ ID NO: 3583994 - DNA, 20 bp, Homo sapiens
tccacccgggggagcccagt

SEQ ID NO: 3583995 - DNA, 23 bp, Homo sapiens
tccacggcctgcccagtcgaccc

SEQ ID NO: 3583996 - DNA, 18 bp, Homo sapiens
tccactccaagtgcccca

SEQ ID NO: 3583997 - DNA, 14 bp, Homo sapiens
tccactccactgcc

SEQ ID NO: 3583998 - DNA, 18 bp, Homo sapiens
tccactcgtgtgtttcta

SEQ ID NO: 3583999 - DNA, 19 bp, Homo sapiens
tccactgaaaatttaacag

SEQ ID NO: 3584000 - DNA, 23 bp, Homo sapiens
tccactgaggtgggagcatctcc

SEQ ID NO: 3584001 - DNA, 14 bp, Homo sapiens
tccacttacatcca

SEQ ID NO: 3584002 - DNA, 14 bp, Homo sapiens
tccacttcaatgca

SEQ ID NO: 3584003 - DNA, 20 bp, Homo sapiens
tccagaagatgccagcttct

SEQ ID NO: 3584004 - DNA, 13 bp, Homo sapiens
tccagaaggaagc

SEQ ID NO: 3584005 - DNA, 20 bp, Homo sapiens
tccagaagttttaacttcca

SEQ ID NO: 3584006 - DNA, 18 bp, Homo sapiens
tccagaatgaccttgagt

SEQ ID NO: 3584007 - DNA, 15 bp, Homo sapiens
tccagacccctggct

SEQ ID NO: 3584008 - DNA, 16 bp, Homo sapiens
tccagacccctggctt

SEQ ID NO: 3584009 - DNA, 11 bp, Homo sapiens
tccagacctga

SEQ ID NO: 3584010 - DNA, 13 bp, Homo sapiens
tccagacctgatc

SEQ ID NO: 3584011 - DNA, 22 bp, Homo sapiens
tccagacctgatcctggaggcc

SEQ ID NO: 3584012 - DNA, 21 bp, Homo sapiens
tccagacctggctccactctt

SEQ ID NO: 3584013 - DNA, 17 bp, Homo sapiens
tccagagagtggctcct

SEQ ID NO: 3584014 - DNA, 22 bp, Homo sapiens
tccagagagtggctcctcccgg

SEQ ID NO: 3584015 - DNA, 14 bp, Homo sapiens
tccagcccaaacct

SEQ ID NO: 3584016 - DNA, 20 bp, Homo sapiens
tccagcccaaacctgggaag

SEQ ID NO: 3584017 - DNA, 15 bp, Homo sapiens
tccagcctcccctcc

SEQ ID NO: 3584018 - DNA, 16 bp, Homo sapiens
tccagcctcccctccc

SEQ ID NO: 3584019 - DNA, 13 bp, Homo sapiens
tccagcctccctg

SEQ ID NO: 3584020 - DNA, 17 bp, Homo sapiens
tccagcctccctgtctc

SEQ ID NO: 3584021 - DNA, 20 bp, Homo sapiens
tccagcctccctgtctccag

SEQ ID NO: 3584022 - DNA, 19 bp, Homo sapiens
tccagcctggggctgaggc

SEQ ID NO: 3584023 - DNA, 23 bp, Homo sapiens
tccagctaaacaccaacccctga

SEQ ID NO: 3584024 - DNA, 16 bp, Homo sapiens
tccagctccaacctgc

SEQ ID NO: 3584025 - DNA, 20 bp, Homo sapiens
tccagctccgtgtttctcta

SEQ ID NO: 3584026 - DNA, 15 bp, Homo sapiens
tccagctctgacatc

SEQ ID NO: 3584027 - DNA, 16 bp, Homo sapiens
tccagctctgacatcc

SEQ ID NO: 3584028 - DNA, 17 bp, Homo sapiens
tccagctgacagccaca

SEQ ID NO: 3584029 - DNA, 15 bp, Homo sapiens
tccagctgcctgggc

SEQ ID NO: 3584030 - DNA, 17 bp, Homo sapiens
tccagctgggaagccct

SEQ ID NO: 3584031 - DNA, 13 bp, Homo sapiens
tccaggaaagtgt

SEQ ID NO: 3584032 - DNA, 16 bp, Homo sapiens
tccaggaaagtgtgaa

SEQ ID NO: 3584033 - DNA, 18 bp, Homo sapiens
tccaggaaagtgtgaaga

SEQ ID NO: 3584034 - DNA, 23 bp, Homo sapiens
tccaggactatatttgggcctgc

SEQ ID NO: 3584035 - DNA, 20 bp, Homo sapiens
tccaggactgtttcaaacat

SEQ ID NO: 3584036 - DNA, 15 bp, Homo sapiens
tccaggagagcctgg

SEQ ID NO: 3584037 - DNA, 23 bp, Homo sapiens
tccaggagcctggctccgtccag

SEQ ID NO: 3584038 - DNA, 15 bp, Homo sapiens
tccaggagggctcgg

SEQ ID NO: 3584039 - DNA, 14 bp, Homo sapiens
tccaggcagatcca

SEQ ID NO: 3584040 - DNA, 15 bp, Homo sapiens
tccagggacagaggc

SEQ ID NO: 3584041 - DNA, 15 bp, Homo sapiens
tccagggaggggtcc

SEQ ID NO: 3584042 - DNA, 14 bp, Homo sapiens
tccagggcagcagg

SEQ ID NO: 3584043 - DNA, 23 bp, Homo sapiens
tccagggcagcaggccagagaaa

SEQ ID NO: 3584044 - DNA, 16 bp, Homo sapiens
tccagggcccaggttc

SEQ ID NO: 3584045 - DNA, 13 bp, Homo sapiens
tccagggccccca

SEQ ID NO: 3584046 - DNA, 15 bp, Homo sapiens
tccagggcccccacc

SEQ ID NO: 3584047 - DNA, 16 bp, Homo sapiens
tccagggcctgacacc

SEQ ID NO: 3584048 - DNA, 20 bp, Homo sapiens
tccagggcctgacaccccct

SEQ ID NO: 3584049 - DNA, 18 bp, Homo sapiens
tccaggggcctgcagaag

SEQ ID NO: 3584050 - DNA, 21 bp, Homo sapiens
tccaggggcctgcagaaggaa

SEQ ID NO: 3584051 - DNA, 17 bp, Homo sapiens
tccaggtcagcctggaa

SEQ ID NO: 3584052 - DNA, 19 bp, Homo sapiens
tccaggtcggagtgcctgg

SEQ ID NO: 3584053 - DNA, 21 bp, Homo sapiens
tccaggtcggagtgcctggag

SEQ ID NO: 3584054 - DNA, 22 bp, Homo sapiens
tccaggtcggagtgcctggagt

SEQ ID NO: 3584055 - DNA, 24 bp, Homo sapiens
tccaggtcggagtgcctggagtca

SEQ ID NO: 3584056 - DNA, 18 bp, Homo sapiens
tccaggttggttttgctg

SEQ ID NO: 3584057 - DNA, 15 bp, Homo sapiens
tccaggtttttcaat

SEQ ID NO: 3584058 - DNA, 13 bp, Homo sapiens
tccagtaaggatt

SEQ ID NO: 3584059 - DNA, 18 bp, Homo sapiens
tccagtattgaaaacttc

SEQ ID NO: 3584060 - DNA, 15 bp, Homo sapiens
tccagtcattatgtt

SEQ ID NO: 3584061 - DNA, 13 bp, Homo sapiens
tccagtgacatga

SEQ ID NO: 3584062 - DNA, 19 bp, Homo sapiens
tccagtgacatgattctga

SEQ ID NO: 3584063 - DNA, 11 bp, Homo sapiens
tccagtgcagt

SEQ ID NO: 3584064 - DNA, 12 bp, Homo sapiens
tccagtgcagtc

SEQ ID NO: 3584065 - DNA, 14 bp, Homo sapiens
tccagtggtgggta

SEQ ID NO: 3584066 - DNA, 17 bp, Homo sapiens
tccagtggtgggtaatt

SEQ ID NO: 3584067 - DNA, 19 bp, Homo sapiens
tccagtggtgggtaattgt

SEQ ID NO: 3584068 - DNA, 22 bp, Homo sapiens
tccagtggtgggtaattgtaca

SEQ ID NO: 3584069 - DNA, 15 bp, Homo sapiens
tccagtgtctgtctg

SEQ ID NO: 3584070 - DNA, 16 bp, Homo sapiens
tccagttcatgagaat

SEQ ID NO: 3584071 - DNA, 19 bp, Homo sapiens
tccagttcatgagaatcta

SEQ ID NO: 3584072 - DNA, 22 bp, Homo sapiens
tccataaagacaatcactgcca

SEQ ID NO: 3584073 - DNA, 21 bp, Homo sapiens
tccataatctggactcctctg

SEQ ID NO: 3584074 - DNA, 18 bp, Homo sapiens
tccatacacacgctgcct

SEQ ID NO: 3584075 - DNA, 13 bp, Homo sapiens
tccataccttttc

SEQ ID NO: 3584076 - DNA, 20 bp, Homo sapiens
tccataccttttctcttttc

SEQ ID NO: 3584077 - DNA, 14 bp, Homo sapiens
tccatcatttctgt

SEQ ID NO: 3584078 - DNA, 13 bp, Homo sapiens
tccatcctgagcc

SEQ ID NO: 3584079 - DNA, 19 bp, Homo sapiens
tccatctcaaaacaaaaca

SEQ ID NO: 3584080 - DNA, 15 bp, Homo sapiens
tccatgatgcacagt

SEQ ID NO: 3584081 - DNA, 18 bp, Homo sapiens
tccatgatgcacagtatc

SEQ ID NO: 3584082 - DNA, 20 bp, Homo sapiens
tccttggaaatcaaatgtaa

SEQ ID NO: 3584083 - DNA, 23 bp, Homo sapiens
tccttggaaatcaaatgtaaagt

SEQ ID NO: 3584084 - DNA, 22 bp, Homo sapiens
tccttggatcctgaatctgtgc

SEQ ID NO: 3584085 - DNA, 23 bp, Homo sapiens
tccttggctttatgcaaatacaa

SEQ ID NO: 3584086 - DNA, 22 bp, Homo sapiens
tccttgtagcatttggaaatga

SEQ ID NO: 3584087 - DNA, 17 bp, Homo sapiens
tccttgtggcctatgaa

SEQ ID NO: 3584088 - DNA, 22 bp, Homo sapiens
tccttgtgttgcactgaacagg

SEQ ID NO: 3584089 - DNA, 16 bp, Homo sapiens
tcctttaaatttcagc

SEQ ID NO: 3584090 - DNA, 17 bp, Homo sapiens
tcctttaaatttcagct

SEQ ID NO: 3584091 - DNA, 20 bp, Homo sapiens
tcctttacaactaaataaca

SEQ ID NO: 3584092 - DNA, 21 bp, Homo sapiens
tcctttacaactaaataacac

SEQ ID NO: 3584093 - DNA, 17 bp, Homo sapiens
tcctttacctttcagtg

SEQ ID NO: 3584094 - DNA, 15 bp, Homo sapiens
tcctttatctgtaat

SEQ ID NO: 3584095 - DNA, 20 bp, Homo sapiens
tcctttcacaaccttctgtg

SEQ ID NO: 3584096 - DNA, 13 bp, Homo sapiens
tcctttctctggg

SEQ ID NO: 3584097 - DNA, 15 bp, Homo sapiens
tcctttctctgggct

SEQ ID NO: 3584098 - DNA, 12 bp, Homo sapiens
tcctttgtaaaa

SEQ ID NO: 3584099 - DNA, 13 bp, Homo sapiens
tcctttgtctttc

SEQ ID NO: 3584100 - DNA, 11 bp, Homo sapiens
tccttttcctt

SEQ ID NO: 3584101 - DNA, 19 bp, Homo sapiens
tccttttccttatttgcct

SEQ ID NO: 3584102 - DNA, 16 bp, Homo sapiens
tccttttgacactgct

SEQ ID NO: 3584103 - DNA, 20 bp, Homo sapiens
tccttttgacactgctctaa

SEQ ID NO: 3584104 - DNA, 14 bp, Homo sapiens
tccttttgaggctt

SEQ ID NO: 3584105 - DNA, 18 bp, Homo sapiens
tccttttttcaatatgca

SEQ ID NO: 3584106 - DNA, 19 bp, Homo sapiens
tccttttttcaatatgcaa

SEQ ID NO: 3584107 - DNA, 17 bp, Homo sapiens
tcgaatcttaatttatt

SEQ ID NO: 3584108 - DNA, 14 bp, Homo sapiens
tcgacccagaatgg

SEQ ID NO: 3584109 - DNA, 12 bp, Homo sapiens
tcgacctcccca

SEQ ID NO: 3584110 - DNA, 20 bp, Homo sapiens
tcgactggtccagctctgac

SEQ ID NO: 3584111 - DNA, 12 bp, Homo sapiens
tcgagagcctta

SEQ ID NO: 3584112 - DNA, 17 bp, Homo sapiens
tcgagagccttacttca

SEQ ID NO: 3584113 - DNA, 18 bp, Homo sapiens
tcgagatagttttttctt

SEQ ID NO: 3584114 - DNA, 24 bp, Homo sapiens
tcgagcatcaggctaagaccctgt

SEQ ID NO: 3584115 - DNA, 14 bp, Homo sapiens
tcgaggagctagaa

SEQ ID NO: 3584116 - DNA, 19 bp, Homo sapiens
tcgaggccacattgctggc

SEQ ID NO: 3584117 - DNA, 14 bp, Homo sapiens
tcgagtgagacaga

SEQ ID NO: 3584118 - DNA, 23 bp, Homo sapiens
tcgatacctggagcagaggaggg

SEQ ID NO: 3584119 - DNA, 18 bp, Homo sapiens
tcgatatttattgatgtt

SEQ ID NO: 3584120 - DNA, 20 bp, Homo sapiens
tcgattgtgtacttttcctt

SEQ ID NO: 3584121 - DNA, 12 bp, Homo sapiens
tcgcacagttta

SEQ ID NO: 3584122 - DNA, 19 bp, Homo sapiens
tcgcactctggcagcaccg

SEQ ID NO: 3584123 - DNA, 12 bp, Homo sapiens
tcgccccatccc

SEQ ID NO: 3584124 - DNA, 13 bp, Homo sapiens
tcgccccatccct

SEQ ID NO: 3584125 - DNA, 13 bp, Homo sapiens
tcgcccccacctc

SEQ ID NO: 3584126 - DNA, 17 bp, Homo sapiens
tcgccggatctgaggga

SEQ ID NO: 3584127 - DNA, 20 bp, Homo sapiens
tcggagggatggagaaagaa

SEQ ID NO: 3584128 - DNA, 15 bp, Homo sapiens
tcggagtgcctggag

SEQ ID NO: 3584129 - DNA, 17 bp, Homo sapiens
tcggagtgcctggagtc

SEQ ID NO: 3584130 - DNA, 16 bp, Homo sapiens
tcggatgacaccctgg

SEQ ID NO: 3584131 - DNA, 19 bp, Homo sapiens
tcggatgacaccctggcct

SEQ ID NO: 3584132 - DNA, 21 bp, Homo sapiens
tcggatgacaccctggcctga

SEQ ID NO: 3584133 - DNA, 11 bp, Homo sapiens
tcggcacacac

SEQ ID NO: 3584134 - DNA, 22 bp, Homo sapiens
tcggcacacactgtgccccaca

SEQ ID NO: 3584135 - DNA, 16 bp, Homo sapiens
tcggcagatactgtct

SEQ ID NO: 3584136 - DNA, 13 bp, Homo sapiens
tcggcagccttaa

SEQ ID NO: 3584137 - DNA, 15 bp, Homo sapiens
tcggccgcccggcag

SEQ ID NO: 3584138 - DNA, 22 bp, Homo sapiens
tcggctctgcatgttttccagg

SEQ ID NO: 3584139 - DNA, 16 bp, Homo sapiens
tcggctgccaggggct

SEQ ID NO: 3584140 - DNA, 19 bp, Homo sapiens
tcggctgccaggggctctg

SEQ ID NO: 3584141 - DNA, 17 bp, Homo sapiens
tcgggagcacccagagc

SEQ ID NO: 3584142 - DNA, 18 bp, Homo sapiens
tcgggagcacccagagca

SEQ ID NO: 3584143 - DNA, 20 bp, Homo sapiens
tcgggagcacccagagcacc

SEQ ID NO: 3584144 - DNA, 21 bp, Homo sapiens
tcgggccgtaggggctcctga

SEQ ID NO: 3584145 - DNA, 12 bp, Homo sapiens
tcgggctgtgcc

SEQ ID NO: 3584146 - DNA, 13 bp, Homo sapiens
tcgggctgtgccc

SEQ ID NO: 3584147 - DNA, 22 bp, Homo sapiens
tcgggttttattgtttaaaatc

SEQ ID NO: 3584148 - DNA, 13 bp, Homo sapiens
tcggtatctggct

SEQ ID NO: 3584149 - DNA, 21 bp, Homo sapiens
tcggtatctggcttccctgga

SEQ ID NO: 3584150 - DNA, 20 bp, Homo sapiens
tcgtcagccacctgggaaca

SEQ ID NO: 3584151 - DNA, 14 bp, Homo sapiens
tcgtctactgcaag

SEQ ID NO: 3584152 - DNA, 15 bp, Homo sapiens
tcgtctctcgttttg

SEQ ID NO: 3584153 - DNA, 17 bp, Homo sapiens
tcgtcttgaacgagcag

SEQ ID NO: 3584154 - DNA, 23 bp, Homo sapiens
tcgtcttgaacgagcagcccagg

SEQ ID NO: 3584155 - DNA, 14 bp, Homo sapiens
tcgtgagctgggga

SEQ ID NO: 3584156 - DNA, 15 bp, Homo sapiens
tcgtgagctggggac

SEQ ID NO: 3584157 - DNA, 21 bp, Homo sapiens
tcgtgatgctatgatgttagt

SEQ ID NO: 3584158 - DNA, 22 bp, Homo sapiens
tcgtgccaccccgagggctgag

SEQ ID NO: 3584159 - DNA, 21 bp, Homo sapiens
tcgtgctggcggacgcagctg

SEQ ID NO: 3584160 - DNA, 15 bp, Homo sapiens
tcgtgctgtgctctg

SEQ ID NO: 3584161 - DNA, 16 bp, Homo sapiens
tcgtgttggtattttc

SEQ ID NO: 3584162 - DNA, 14 bp, Homo sapiens
tcgttgttattatt

SEQ ID NO: 3584163 - DNA, 17 bp, Homo sapiens
tcgtttacactgcacat

SEQ ID NO: 3584164 - DNA, 14 bp, Homo sapiens
tctaaaacaataaa

SEQ ID NO: 3584165 - DNA, 22 bp, Homo sapiens
tctaacagccctcctctgcact

SEQ ID NO: 3584166 - DNA, 17 bp, Homo sapiens
tctaacatgaaatatat

SEQ ID NO: 3584167 - DNA, 14 bp, Homo sapiens
tctaaccaaaaagt

SEQ ID NO: 3584168 - DNA, 15 bp, Homo sapiens
tctaactcaaagact

SEQ ID NO: 3584169 - DNA, 22 bp, Homo sapiens
tctaactcaaagacttcctctg

SEQ ID NO: 3584170 - DNA, 14 bp, Homo sapiens
tctaagcaaccaca

SEQ ID NO: 3584171 - DNA, 14 bp, Homo sapiens
tctaagcctgaagg

SEQ ID NO: 3584172 - DNA, 19 bp, Homo sapiens
tctaaggaattatttcaca

SEQ ID NO: 3584173 - DNA, 19 bp, Homo sapiens
tctaagtaaaaccacagca

SEQ ID NO: 3584174 - DNA, 14 bp, Homo sapiens
tctaagtatttaaa

SEQ ID NO: 3584175 - DNA, 15 bp, Homo sapiens
tctaagtgctgctgt

SEQ ID NO: 3584176 - DNA, 20 bp, Homo sapiens
tctaatatcccagaaaaagt

SEQ ID NO: 3584177 - DNA, 14 bp, Homo sapiens
tctaatcagtgatt

SEQ ID NO: 3584178 - DNA, 15 bp, Homo sapiens
tctaatccttttcct

SEQ ID NO: 3584179 - DNA, 17 bp, Homo sapiens
tctaatccttttcctta

SEQ ID NO: 3584180 - DNA, 17 bp, Homo sapiens
tctaatgcttgatttag

SEQ ID NO: 3584181 - DNA, 13 bp, Homo sapiens
tctaatgtctgca

SEQ ID NO: 3584182 - DNA, 14 bp, Homo sapiens
tctaatgtctgcag

SEQ ID NO: 3584183 - DNA, 20 bp, Homo sapiens
tctaatgtgagtgtgaagct

SEQ ID NO: 3584184 - DNA, 19 bp, Homo sapiens
tctaatgttattttccttc

SEQ ID NO: 3584185 - DNA, 16 bp, Homo sapiens
tctaattcacagtgct

SEQ ID NO: 3584186 - DNA, 18 bp, Homo sapiens
tctaattcttcctttgta

SEQ ID NO: 3584187 - DNA, 21 bp, Homo sapiens
tctaattggctttactatttt

SEQ ID NO: 3584188 - DNA, 13 bp, Homo sapiens
tctacaaaacatt

SEQ ID NO: 3584189 - DNA, 18 bp, Homo sapiens
tctacaaaacattaaact

SEQ ID NO: 3584190 - DNA, 14 bp, Homo sapiens
tctacaactggagt

SEQ ID NO: 3584191 - DNA, 16 bp, Homo sapiens
tctacattcagattat

SEQ ID NO: 3584192 - DNA, 13 bp, Homo sapiens
tctaccaagctgt

SEQ ID NO: 3584193 - DNA, 23 bp, Homo sapiens
tctaccccagactagatgtagta

SEQ ID NO: 3584194 - DNA, 15 bp, Homo sapiens
tctacctgtgttttt

SEQ ID NO: 3584195 - DNA, 22 bp, Homo sapiens
tctacctgtgtttttttctaaa

SEQ ID NO: 3584196 - DNA, 23 bp, Homo sapiens
tctacctgtgtttttttctaaaa

SEQ ID NO: 3584197 - DNA, 13 bp, Homo sapiens
tctaccttttctg

SEQ ID NO: 3584198 - DNA, 14 bp, Homo sapiens
tctaccttttctgg

SEQ ID NO: 3584199 - DNA, 12 bp, Homo sapiens
tctactcctgcc

SEQ ID NO: 3584200 - DNA, 14 bp, Homo sapiens
tctactcctgcctc

SEQ ID NO: 3584201 - DNA, 15 bp, Homo sapiens
tctactcctgcctca

SEQ ID NO: 3584202 - DNA, 16 bp, Homo sapiens
tctacttgcacactct

SEQ ID NO: 3584203 - DNA, 11 bp, Homo sapiens
tctagaaagaa

SEQ ID NO: 3584204 - DNA, 13 bp, Homo sapiens
tctagaacacagg

SEQ ID NO: 3584205 - DNA, 17 bp, Homo sapiens
tctagaacacaggcaaa

SEQ ID NO: 3584206 - DNA, 14 bp, Homo sapiens
tctagacactgcca

SEQ ID NO: 3584207 - DNA, 13 bp, Homo sapiens
tctagagagggag

SEQ ID NO: 3584208 - DNA, 22 bp, Homo sapiens
tctagaggagggggcaggctga

SEQ ID NO: 3584209 - DNA, 23 bp, Homo sapiens
tctagaggagggggcaggctgag

SEQ ID NO: 3584210 - DNA, 19 bp, Homo sapiens
tctagatggctcctctcag

SEQ ID NO: 3584211 - DNA, 15 bp, Homo sapiens
tctagattgagagaa

SEQ ID NO: 3584212 - DNA, 14 bp, Homo sapiens
tctagcatgttggg

SEQ ID NO: 3584213 - DNA, 21 bp, Homo sapiens
tctagcccaacctacattcca

SEQ ID NO: 3584214 - DNA, 14 bp, Homo sapiens
tctagcctctggac

SEQ ID NO: 3584215 - DNA, 20 bp, Homo sapiens
tcttcagtcctttgtctttc

SEQ ID NO: 3584216 - DNA, 20 bp, Homo sapiens
tcttcagtgactcctgctgg

SEQ ID NO: 3584217 - DNA, 15 bp, Homo sapiens
tcttcattccattga

SEQ ID NO: 3584218 - DNA, 20 bp, Homo sapiens
tcttcattctttactgcact

SEQ ID NO: 3584219 - DNA, 23 bp, Homo sapiens
tcttccacccacaaactccaggc

SEQ ID NO: 3584220 - DNA, 18 bp, Homo sapiens
tcttccagggcagcggct

SEQ ID NO: 3584221 - DNA, 17 bp, Homo sapiens
tcttccattccttcatg

SEQ ID NO: 3584222 - DNA, 14 bp, Homo sapiens
tcttcccactccag

SEQ ID NO: 3584223 - DNA, 21 bp, Homo sapiens
tcttcccactttcatctacct

SEQ ID NO: 3584224 - DNA, 15 bp, Homo sapiens
tcttccccttccctt

SEQ ID NO: 3584225 - DNA, 15 bp, Homo sapiens
tcttccccttcctgt

SEQ ID NO: 3584226 - DNA, 13 bp, Homo sapiens
tcttccctgcttt

SEQ ID NO: 3584227 - DNA, 23 bp, Homo sapiens
tcttcctagttttctcctcccag

SEQ ID NO: 3584228 - DNA, 13 bp, Homo sapiens
tcttcctctccat

SEQ ID NO: 3584229 - DNA, 17 bp, Homo sapiens
tcttcctctccatacct

SEQ ID NO: 3584230 - DNA, 16 bp, Homo sapiens
tcttcctttgtaaaaa

SEQ ID NO: 3584231 - DNA, 19 bp, Homo sapiens
tcttcgctggactattgtg

SEQ ID NO: 3584232 - DNA, 10 bp, Homo sapiens
tcttctatta

SEQ ID NO: 3584233 - DNA, 20 bp, Homo sapiens
tcttctattaatcaagagaa

SEQ ID NO: 3584234 - DNA, 13 bp, Homo sapiens
tcttctattttgt

SEQ ID NO: 3584235 - DNA, 13 bp, Homo sapiens
tcttctccactgg

SEQ ID NO: 3584236 - DNA, 16 bp, Homo sapiens
tcttctccactggatg

SEQ ID NO: 3584237 - DNA, 20 bp, Homo sapiens
tcttctctctcaattttatc

SEQ ID NO: 3584238 - DNA, 23 bp, Homo sapiens
tcttctgaagaggaaaagtcaaa

SEQ ID NO: 3584239 - DNA, 16 bp, Homo sapiens
tcttctgaagattctt

SEQ ID NO: 3584240 - DNA, 16 bp, Homo sapiens
tcttctgaatatttta

SEQ ID NO: 3584241 - DNA, 19 bp, Homo sapiens
tcttctggtgttgactgga

SEQ ID NO: 3584242 - DNA, 13 bp, Homo sapiens
tcttctttctcca

SEQ ID NO: 3584243 - DNA, 21 bp, Homo sapiens
tcttctttctccatggagcct

SEQ ID NO: 3584244 - DNA, 15 bp, Homo sapiens
tcttctttcttccac

SEQ ID NO: 3584245 - DNA, 21 bp, Homo sapiens
tcttctttctttcttttgcag

SEQ ID NO: 3584246 - DNA, 15 bp, Homo sapiens
tcttctttgtgcctt

SEQ ID NO: 3584247 - DNA, 17 bp, Homo sapiens
tcttctttgtgcctttg

SEQ ID NO: 3584248 - DNA, 20 bp, Homo sapiens
tcttctttgtgcctttggcc

SEQ ID NO: 3584249 - DNA, 16 bp, Homo sapiens
tcttctttttttgtga

SEQ ID NO: 3584250 - DNA, 15 bp, Homo sapiens
tcttgaaaagttcag

SEQ ID NO: 3584251 - DNA, 18 bp, Homo sapiens
tcttgaagaataaattct

SEQ ID NO: 3584252 - DNA, 19 bp, Homo sapiens
tcttgaagaataaattcta

SEQ ID NO: 3584253 - DNA, 13 bp, Homo sapiens
tcttgaccaacag

SEQ ID NO: 3584254 - DNA, 21 bp, Homo sapiens
tcttgagtataagaaatgcat

SEQ ID NO: 3584255 - DNA, 18 bp, Homo sapiens
tcttgagttcctctgcag

SEQ ID NO: 3584256 - DNA, 19 bp, Homo sapiens
tcttgagttcctctgcagt

SEQ ID NO: 3584257 - DNA, 23 bp, Homo sapiens
tcttgattcgtagatttaataac

SEQ ID NO: 3584258 - DNA, 18 bp, Homo sapiens
tcttgcagcatttactat

SEQ ID NO: 3584259 - DNA, 16 bp, Homo sapiens
tcttgccactgcctct

SEQ ID NO: 3584260 - DNA, 21 bp, Homo sapiens
tcttgcccttcctactcctca

SEQ ID NO: 3584261 - DNA, 13 bp, Homo sapiens
tcttgctaccagt

SEQ ID NO: 3584262 - DNA, 17 bp, Homo sapiens
tcttgcttctttctaga

SEQ ID NO: 3584263 - DNA, 16 bp, Homo sapiens
tcttgcttggaagcca

SEQ ID NO: 3584264 - DNA, 17 bp, Homo sapiens
tcttggcttggtgagga

SEQ ID NO: 3584265 - DNA, 23 bp, Homo sapiens
tcttgggatagtgttctgctcct

SEQ ID NO: 3584266 - DNA, 13 bp, Homo sapiens
tcttgggggaggc

SEQ ID NO: 3584267 - DNA, 19 bp, Homo sapiens
tcttgggggaggccacccc

SEQ ID NO: 3584268 - DNA, 15 bp, Homo sapiens
tcttggtaaaacatt

SEQ ID NO: 3584269 - DNA, 22 bp, Homo sapiens
tcttggtaaaacattacttatt

SEQ ID NO: 3584270 - DNA, 17 bp, Homo sapiens
tcttggtcagatttgaa

SEQ ID NO: 3584271 - DNA, 19 bp, Homo sapiens
tcttggttcgatacctgga

SEQ ID NO: 3584272 - DNA, 20 bp, Homo sapiens
tcttgtattatctcctttga

SEQ ID NO: 3584273 - DNA, 21 bp, Homo sapiens
tcttgtcatacaaatttataa

SEQ ID NO: 3584274 - DNA, 13 bp, Homo sapiens
tcttgtcattttt

SEQ ID NO: 3584275 - DNA, 23 bp, Homo sapiens
tcttgtgctatgaaacaatcttc

SEQ ID NO: 3584276 - DNA, 22 bp, Homo sapiens
tcttgtgtttccacagcctgca

SEQ ID NO: 3584277 - DNA, 18 bp, Homo sapiens
tcttgttgctgtacaaaa

SEQ ID NO: 3584278 - DNA, 17 bp, Homo sapiens
tctttaaaatacacact

SEQ ID NO: 3584279 - DNA, 21 bp, Homo sapiens
tctttaaagggatggcaagat

SEQ ID NO: 3584280 - DNA, 17 bp, Homo sapiens
tctttaaccaaacaata

SEQ ID NO: 3584281 - DNA, 14 bp, Homo sapiens
tctttactgcactc

SEQ ID NO: 3584282 - DNA, 13 bp, Homo sapiens
tctttagatattt

SEQ ID NO: 3584283 - DNA, 16 bp, Homo sapiens
tctttagatatttgcc

SEQ ID NO: 3584284 - DNA, 19 bp, Homo sapiens
tctttagcagtttcctcag

SEQ ID NO: 3584285 - DNA, 15 bp, Homo sapiens
tctttcaaaagcctt

SEQ ID NO: 3584286 - DNA, 12 bp, Homo sapiens
tctttcaccttt

SEQ ID NO: 3584287 - DNA, 15 bp, Homo sapiens
tctttcagcaagata

SEQ ID NO: 3584288 - DNA, 14 bp, Homo sapiens
tctttcccctttct

SEQ ID NO: 3584289 - DNA, 18 bp, Homo sapiens
tctttctaatacaagcat

SEQ ID NO: 3584290 - DNA, 19 bp, Homo sapiens
tctttctaatgtgtgaatc

SEQ ID NO: 3584291 - DNA, 15 bp, Homo sapiens
tctttctacagagat

SEQ ID NO: 3584292 - DNA, 10 bp, Homo sapiens
tctttctata

SEQ ID NO: 3584293 - DNA, 12 bp, Homo sapiens
tctttctgctct

SEQ ID NO: 3584294 - DNA, 21 bp, Homo sapiens
tctttctggttgtttttaaac

SEQ ID NO: 3584295 - DNA, 19 bp, Homo sapiens
tctttcttattttgtaata

SEQ ID NO: 3584296 - DNA, 22 bp, Homo sapiens
tctttcttccattccttcatgt

SEQ ID NO: 3584297 - DNA, 20 bp, Homo sapiens
tctttcttgctccctgactg

SEQ ID NO: 3584298 - DNA, 12 bp, Homo sapiens
tctttcttggga

SEQ ID NO: 3584299 - DNA, 18 bp, Homo sapiens
tctttctttccaaaacat

SEQ ID NO: 3584300 - DNA, 19 bp, Homo sapiens
tctttctttgcaccaaaga

SEQ ID NO: 3584301 - DNA, 16 bp, Homo sapiens
tctttctttgtcattc

SEQ ID NO: 3584302 - DNA, 19 bp, Homo sapiens
tctttctttgtcattcagt

SEQ ID NO: 3584303 - DNA, 22 bp, Homo sapiens
tctttctttgtcattcagttct

SEQ ID NO: 3584304 - DNA, 15 bp, Homo sapiens
tctttgacatttttg

SEQ ID NO: 3584305 - DNA, 16 bp, Homo sapiens
tctttgacatttttgc

SEQ ID NO: 3584306 - DNA, 17 bp, Homo sapiens
tctttgactgtcagcaa

SEQ ID NO: 3584307 - DNA, 12 bp, Homo sapiens
tctttgcaaata

SEQ ID NO: 3584308 - DNA, 16 bp, Homo sapiens
tctttgccatctctgc

SEQ ID NO: 3584309 - DNA, 19 bp, Homo sapiens
tctttgccatctctgctcc

SEQ ID NO: 3584310 - DNA, 20 bp, Homo sapiens
tctttgccatctctgctcca

SEQ ID NO: 3584311 - DNA, 12 bp, Homo sapiens
tctttgcctctg

SEQ ID NO: 3584312 - DNA, 15 bp, Homo sapiens
tctttgcctctgcag

SEQ ID NO: 3584313 - DNA, 21 bp, Homo sapiens
tctttgctgcccctgtctgga

SEQ ID NO: 3584314 - DNA, 11 bp, Homo sapiens
tctttgctttg

SEQ ID NO: 3584315 - DNA, 13 bp, Homo sapiens
tctttgctttgct

SEQ ID NO: 3584316 - DNA, 18 bp, Homo sapiens
tctttggcatgatttaaa

SEQ ID NO: 3584317 - DNA, 13 bp, Homo sapiens
tctttggctgcag

SEQ ID NO: 3584318 - DNA, 18 bp, Homo sapiens
tctttgtaccttttgtag

SEQ ID NO: 3584319 - DNA, 20 bp, Homo sapiens
tctttgtaccttttgtagtt

SEQ ID NO: 3584320 - DNA, 18 bp, Homo sapiens
tctttgtcattcagttct

SEQ ID NO: 3584321 - DNA, 23 bp, Homo sapiens
tctttgtcattcagttctaggcc

SEQ ID NO: 3584322 - DNA, 16 bp, Homo sapiens
tctttgtgcctttggc

SEQ ID NO: 3584323 - DNA, 15 bp, Homo sapiens
tctttgtttctttgt

SEQ ID NO: 3584324 - DNA, 22 bp, Homo sapiens
tcttttaatccatttcaggact

SEQ ID NO: 3584325 - DNA, 15 bp, Homo sapiens
tcttttagagagggg

SEQ ID NO: 3584326 - DNA, 15 bp, Homo sapiens
tcttttatctgttta

SEQ ID NO: 3584327 - DNA, 18 bp, Homo sapiens
tcttttcatatctcttgc

SEQ ID NO: 3584328 - DNA, 14 bp, Homo sapiens
tcttttgattttgt

SEQ ID NO: 3584329 - DNA, 14 bp, Homo sapiens
tcttttgcaggagt

SEQ ID NO: 3584330 - DNA, 20 bp, Homo sapiens
tcttttgctgaacaggaaag

SEQ ID NO: 3584331 - DNA, 20 bp, Homo sapiens
tcttttggttatgaatactt

SEQ ID NO: 3584332 - DNA, 17 bp, Homo sapiens
tcttttttaataaacta

SEQ ID NO: 3584333 - DNA, 19 bp, Homo sapiens
tcttttttaataaactact

SEQ ID NO: 3584334 - DNA, 23 bp, Homo sapiens
tctttttttttttttaaagacag

SEQ ID NO: 3584335 - DNA, 15 bp, Homo sapiens
tgaaaaaaacttcat

SEQ ID NO: 3584336 - DNA, 20 bp, Homo sapiens
tgaaaaagaataaaaacttt

SEQ ID NO: 3584337 - DNA, 12 bp, Homo sapiens
tgaaaaagacat

SEQ ID NO: 3584338 - DNA, 14 bp, Homo sapiens
tgaaaaagacataa

SEQ ID NO: 3584339 - DNA, 21 bp, Homo sapiens
tgaaaaagacataaaacagaa

SEQ ID NO: 3584340 - DNA, 16 bp, Homo sapiens
tgaaaaagctgcttct

SEQ ID NO: 3584341 - DNA, 22 bp, Homo sapiens
tgaaaaccatattttattgtat

SEQ ID NO: 3584342 - DNA, 13 bp, Homo sapiens
tgaaaacccagac

SEQ ID NO: 3584343 - DNA, 13 bp, Homo sapiens
tgaaaacttcaaa

SEQ ID NO: 3584344 - DNA, 16 bp, Homo sapiens
tgaaaacttcaaagct

SEQ ID NO: 3584345 - DNA, 19 bp, Homo sapiens
tgaaaacttcaaagctgaa

SEQ ID NO: 3584346 - DNA, 22 bp, Homo sapiens
tgaaaacttcaaagctgaatat

SEQ ID NO: 3584347 - DNA, 13 bp, Homo sapiens
tgaaaactttgta

SEQ ID NO: 3584348 - DNA, 17 bp, Homo sapiens
tgatcctggaggcccag

SEQ ID NO: 3584349 - DNA, 18 bp, Homo sapiens
tgatcctggaggcccagt

SEQ ID NO: 3584350 - DNA, 18 bp, Homo sapiens
tgatcctgttctgcgctg

SEQ ID NO: 3584351 - DNA, 17 bp, Homo sapiens
tgatctctcttgtcctc

SEQ ID NO: 3584352 - DNA, 18 bp, Homo sapiens
tgatctctcttgtcctct

SEQ ID NO: 3584353 - DNA, 24 bp, Homo sapiens
tgatctctcttgtcctcttctgct

SEQ ID NO: 3584354 - DNA, 15 bp, Homo sapiens
tgatctggaacccag

SEQ ID NO: 3584355 - DNA, 19 bp, Homo sapiens
tgatctggaacccagactc

SEQ ID NO: 3584356 - DNA, 17 bp, Homo sapiens
tgatctgggtctctaat

SEQ ID NO: 3584357 - DNA, 15 bp, Homo sapiens
tgatctgttttggat

SEQ ID NO: 3584358 - DNA, 23 bp, Homo sapiens
tgatctgttttggatgttgctat

SEQ ID NO: 3584359 - DNA, 21 bp, Homo sapiens
tgatgacttagtacaaagttt

SEQ ID NO: 3584360 - DNA, 16 bp, Homo sapiens
tgatgagagaatgtgg

SEQ ID NO: 3584361 - DNA, 20 bp, Homo sapiens
tgatgagatattaaattctc

SEQ ID NO: 3584362 - DNA, 12 bp, Homo sapiens
tgatgagggaag

SEQ ID NO: 3584363 - DNA, 13 bp, Homo sapiens
tgatgatgatgaa

SEQ ID NO: 3584364 - DNA, 16 bp, Homo sapiens
tgatgatgatgatgaa

SEQ ID NO: 3584365 - DNA, 16 bp, Homo sapiens
tgatgattttcctttt

SEQ ID NO: 3584366 - DNA, 21 bp, Homo sapiens
tgatgcaaggattacagaaac

SEQ ID NO: 3584367 - DNA, 19 bp, Homo sapiens
tgatgctatcagttttata

SEQ ID NO: 3584368 - DNA, 15 bp, Homo sapiens
tgatggaacacagaa

SEQ ID NO: 3584369 - DNA, 15 bp, Homo sapiens
tgatggagccccagg

SEQ ID NO: 3584370 - DNA, 18 bp, Homo sapiens
tgatggcaacagatctgg

SEQ ID NO: 3584371 - DNA, 19 bp, Homo sapiens
tgatggcaacagatctgga

SEQ ID NO: 3584372 - DNA, 23 bp, Homo sapiens
tgatggcaacagatctggaacct

SEQ ID NO: 3584373 - DNA, 15 bp, Homo sapiens
tgatggcagagccag

SEQ ID NO: 3584374 - DNA, 20 bp, Homo sapiens
tgatgtacataactcctgtc

SEQ ID NO: 3584375 - DNA, 15 bp, Homo sapiens
tgatgtataatgtaa

SEQ ID NO: 3584376 - DNA, 19 bp, Homo sapiens
tgatgtatggtatctttag

SEQ ID NO: 3584377 - DNA, 18 bp, Homo sapiens
tgatgtcaataacagtat

SEQ ID NO: 3584378 - DNA, 18 bp, Homo sapiens
tgatgtccttggactcca

SEQ ID NO: 3584379 - DNA, 14 bp, Homo sapiens
tgatgttttgccgt

SEQ ID NO: 3584380 - DNA, 15 bp, Homo sapiens
tgatgtttttaaagg

SEQ ID NO: 3584381 - DNA, 22 bp, Homo sapiens
tgattaaccttttcaaattaat

SEQ ID NO: 3584382 - DNA, 17 bp, Homo sapiens
tgattaacttatactgt

SEQ ID NO: 3584383 - DNA, 21 bp, Homo sapiens
tgattactggcctttttcatt

SEQ ID NO: 3584384 - DNA, 18 bp, Homo sapiens
tgattatggagccttaga

SEQ ID NO: 3584385 - DNA, 23 bp, Homo sapiens
tgattcaacacttaagtctcaga

SEQ ID NO: 3584386 - DNA, 15 bp, Homo sapiens
tgattcagcaaaaat

SEQ ID NO: 3584387 - DNA, 16 bp, Homo sapiens
tgattcatatttaatt

SEQ ID NO: 3584388 - DNA, 13 bp, Homo sapiens
tgattcattctga

SEQ ID NO: 3584389 - DNA, 12 bp, Homo sapiens
tgattctcaggg

SEQ ID NO: 3584390 - DNA, 16 bp, Homo sapiens
tgattctcagggctgg

SEQ ID NO: 3584391 - DNA, 19 bp, Homo sapiens
tgattctgatgtactctaa

SEQ ID NO: 3584392 - DNA, 15 bp, Homo sapiens
tgattgaatctactt

SEQ ID NO: 3584393 - DNA, 13 bp, Homo sapiens
tgattgacagctt

SEQ ID NO: 3584394 - DNA, 17 bp, Homo sapiens
tgattgacagctttgct

SEQ ID NO: 3584395 - DNA, 14 bp, Homo sapiens
tgattggctgcagg

SEQ ID NO: 3584396 - DNA, 13 bp, Homo sapiens
tgattggctggtt

SEQ ID NO: 3584397 - DNA, 19 bp, Homo sapiens
tgattgtttctcaaatctt

SEQ ID NO: 3584398 - DNA, 15 bp, Homo sapiens
tgatttaatttgaaa

SEQ ID NO: 3584399 - DNA, 16 bp, Homo sapiens
tgatttaggagaagcc

SEQ ID NO: 3584400 - DNA, 20 bp, Homo sapiens
tgatttaggagaagccagga

SEQ ID NO: 3584401 - DNA, 21 bp, Homo sapiens
tgatttaggagaagccaggaa

SEQ ID NO: 3584402 - DNA, 16 bp, Homo sapiens
tgatttcacagtgtgt

SEQ ID NO: 3584403 - DNA, 15 bp, Homo sapiens
tgatttcattcctcg

SEQ ID NO: 3584404 - DNA, 15 bp, Homo sapiens
tgatttccatttctg

SEQ ID NO: 3584405 - DNA, 17 bp, Homo sapiens
tgatttccatttctgat

SEQ ID NO: 3584406 - DNA, 22 bp, Homo sapiens
tgatttccgtgaactctggtgc

SEQ ID NO: 3584407 - DNA, 14 bp, Homo sapiens
tgatttgagatttt

SEQ ID NO: 3584408 - DNA, 20 bp, Homo sapiens
tgattttcaaagctttttcc

SEQ ID NO: 3584409 - DNA, 15 bp, Homo sapiens
tgattttcctttttc

SEQ ID NO: 3584410 - DNA, 12 bp, Homo sapiens
tgattttctcac

SEQ ID NO: 3584411 - DNA, 16 bp, Homo sapiens
tgattttgtaaagttg

SEQ ID NO: 3584412 - DNA, 20 bp, Homo sapiens
tgattttgtttactgaaatt

SEQ ID NO: 3584413 - DNA, 23 bp, Homo sapiens
tgatttttaagaaagtaatttaa

SEQ ID NO: 3584414 - DNA, 16 bp, Homo sapiens
tgatttttatcacaag

SEQ ID NO: 3584415 - DNA, 16 bp, Homo sapiens
tgcaaaaaaagcctcc

SEQ ID NO: 3584416 - DNA, 19 bp, Homo sapiens
tgcaaaactccaggcagga

SEQ ID NO: 3584417 - DNA, 15 bp, Homo sapiens
tgcaaacacaccttg

SEQ ID NO: 3584418 - DNA, 13 bp, Homo sapiens
tgcaaacagtaac

SEQ ID NO: 3584419 - DNA, 15 bp, Homo sapiens
tgcaaagccaaggca

SEQ ID NO: 3584420 - DNA, 16 bp, Homo sapiens
tgcaaagccaaggcag

SEQ ID NO: 3584421 - DNA, 23 bp, Homo sapiens
tgcaaagttccctacttcctgtg

SEQ ID NO: 3584422 - DNA, 17 bp, Homo sapiens
tgcaacccaaggtgagg

SEQ ID NO: 3584423 - DNA, 13 bp, Homo sapiens
tgcaacttctgcc

SEQ ID NO: 3584424 - DNA, 23 bp, Homo sapiens
tgcaagcagctttttattccctg

SEQ ID NO: 3584425 - DNA, 22 bp, Homo sapiens
tgcaaggattacagaaactgat

SEQ ID NO: 3584426 - DNA, 18 bp, Homo sapiens
tgcaaggtactctggtga

SEQ ID NO: 3584427 - DNA, 17 bp, Homo sapiens
tgcaagtggagctgtct

SEQ ID NO: 3584428 - DNA, 18 bp, Homo sapiens
tgcaagtggagctgtctg

SEQ ID NO: 3584429 - DNA, 21 bp, Homo sapiens
tgcaagtggagctgtctgtct

SEQ ID NO: 3584430 - DNA, 20 bp, Homo sapiens
tgcaataaatctgacccagt

SEQ ID NO: 3584431 - DNA, 23 bp, Homo sapiens
tgcaataaatctgacccagtgcc

SEQ ID NO: 3584432 - DNA, 16 bp, Homo sapiens
tgcaataatccacccc

SEQ ID NO: 3584433 - DNA, 20 bp, Homo sapiens
tgcaataatccacccccagg

SEQ ID NO: 3584434 - DNA, 23 bp, Homo sapiens
tgcaatatttattacacaaagaa

SEQ ID NO: 3584435 - DNA, 17 bp, Homo sapiens
tgcaatctaatctgaac

SEQ ID NO: 3584436 - DNA, 13 bp, Homo sapiens
tgcaatggatttt

SEQ ID NO: 3584437 - DNA, 20 bp, Homo sapiens
tgcaatgtccagcagtctga

SEQ ID NO: 3584438 - DNA, 23 bp, Homo sapiens
tgcaatgtggtgacacctccccc

SEQ ID NO: 3584439 - DNA, 15 bp, Homo sapiens
tgcacaaagcccttc

SEQ ID NO: 3584440 - DNA, 19 bp, Homo sapiens
tgcacaacagccctgcctg

SEQ ID NO: 3584441 - DNA, 20 bp, Homo sapiens
tgcacaacagccctgcctga

SEQ ID NO: 3584442 - DNA, 13 bp, Homo sapiens
tgcacacatatat

SEQ ID NO: 3584443 - DNA, 14 bp, Homo sapiens
tgcacacatatata

SEQ ID NO: 3584444 - DNA, 23 bp, Homo sapiens
tgcacaccattttgtaaatgaaa

SEQ ID NO: 3584445 - DNA, 13 bp, Homo sapiens
tgcacagacaagc

SEQ ID NO: 3584446 - DNA, 15 bp, Homo sapiens
tgcacagacaagcag

SEQ ID NO: 3584447 - DNA, 19 bp, Homo sapiens
tgcacaggtggctgtttct

SEQ ID NO: 3584448 - DNA, 13 bp, Homo sapiens
tgcacagtatctg

SEQ ID NO: 3584449 - DNA, 15 bp, Homo sapiens
tgcacagtatctgct

SEQ ID NO: 3584450 - DNA, 15 bp, Homo sapiens
tgcacagtgcatctc

SEQ ID NO: 3584451 - DNA, 18 bp, Homo sapiens
tgcacagtgcatctcagc

SEQ ID NO: 3584452 - DNA, 20 bp, Homo sapiens
tgcacagtgcatctcagccc

SEQ ID NO: 3584453 - DNA, 13 bp, Homo sapiens
tgcacatctgttt

SEQ ID NO: 3584454 - DNA, 17 bp, Homo sapiens
tgcacatctgttttgta

SEQ ID NO: 3584455 - DNA, 15 bp, Homo sapiens
tgcacatgagtggaa

SEQ ID NO: 3584456 - DNA, 17 bp, Homo sapiens
tgcacatgagtggaaat

SEQ ID NO: 3584457 - DNA, 16 bp, Homo sapiens
tgcaccaccatgccca

SEQ ID NO: 3584458 - DNA, 21 bp, Homo sapiens
tgcacccctgagccagcaggg

SEQ ID NO: 3584459 - DNA, 15 bp, Homo sapiens
tgcaccccttcctgg

SEQ ID NO: 3584460 - DNA, 18 bp, Homo sapiens
tgcaccctgcgcctccag

SEQ ID NO: 3584461 - DNA, 19 bp, Homo sapiens
tgcaccctgcgcctccaga

SEQ ID NO: 3584462 - DNA, 20 bp, Homo sapiens
tgcaccctgcgcctccagag

SEQ ID NO: 3584463 - DNA, 21 bp, Homo sapiens
tgcaccctgcgcctccagagg

SEQ ID NO: 3584464 - DNA, 14 bp, Homo sapiens
tgcacctgcctcca

SEQ ID NO: 3584465 - DNA, 20 bp, Homo sapiens
tgcactaaaatgaggatcca

SEQ ID NO: 3584466 - DNA, 20 bp, Homo sapiens
tgcactcacccctagccctg

SEQ ID NO: 3584467 - DNA, 14 bp, Homo sapiens
tgcactcagctctt

SEQ ID NO: 3584468 - DNA, 19 bp, Homo sapiens
tgcactccagcctgggcga

SEQ ID NO: 3584469 - DNA, 19 bp, Homo sapiens
tgcactcctttatctgtaa

SEQ ID NO: 3584470 - DNA, 16 bp, Homo sapiens
tgcactctagcctggc

SEQ ID NO: 3584471 - DNA, 19 bp, Homo sapiens
tgcactgaagtttttgaaa

SEQ ID NO: 3584472 - DNA, 17 bp, Homo sapiens
tgcactgaggatttctt

SEQ ID NO: 3584473 - DNA, 14 bp, Homo sapiens
tgcactgatgctgc

SEQ ID NO: 3584474 - DNA, 16 bp, Homo sapiens
tgcactgatgctgccc

SEQ ID NO: 3584475 - DNA, 22 bp, Homo sapiens
tgcactgatgctgcccctcatc

SEQ ID NO: 3584476 - DNA, 18 bp, Homo sapiens
tgcactgtgaaggaccct

SEQ ID NO: 3584477 - DNA, 17 bp, Homo sapiens
tgcacttgcctatgata

SEQ ID NO: 3584478 - DNA, 13 bp, Homo sapiens
tgcagaaggcaag

SEQ ID NO: 3584479 - DNA, 20 bp, Homo sapiens
tgcagaaggcaaggccctgc

SEQ ID NO: 3584480 - DNA, 13 bp, Homo sapiens
tgctgggctctgc

SEQ ID NO: 3584481 - DNA, 13 bp, Homo sapiens
tgctgggctttgg

SEQ ID NO: 3584482 - DNA, 22 bp, Homo sapiens
tgctggggaagacagtggcccc

SEQ ID NO: 3584483 - DNA, 18 bp, Homo sapiens
tgctggtagatgctgagg

SEQ ID NO: 3584484 - DNA, 15 bp, Homo sapiens
tgctggtcctgcaca

SEQ ID NO: 3584485 - DNA, 20 bp, Homo sapiens
tgctggtcctgcacatgagt

SEQ ID NO: 3584486 - DNA, 23 bp, Homo sapiens
tgctggtcctgcacatgagtgga

SEQ ID NO: 3584487 - DNA, 17 bp, Homo sapiens
tgctgtctggccctggg

SEQ ID NO: 3584488 - DNA, 21 bp, Homo sapiens
tgctgtctttcttgctccctg

SEQ ID NO: 3584489 - DNA, 14 bp, Homo sapiens
tgctgtcttttctt

SEQ ID NO: 3584490 - DNA, 20 bp, Homo sapiens
tgctgtgccatgctgggcca

SEQ ID NO: 3584491 - DNA, 19 bp, Homo sapiens
tgctgtgctctggcaccat

SEQ ID NO: 3584492 - DNA, 15 bp, Homo sapiens
tgctgtgctgggagg

SEQ ID NO: 3584493 - DNA, 14 bp, Homo sapiens
tgctgtgctttgga

SEQ ID NO: 3584494 - DNA, 13 bp, Homo sapiens
tgctgtggctcca

SEQ ID NO: 3584495 - DNA, 19 bp, Homo sapiens
tgctgtgtgagtgagcaca

SEQ ID NO: 3584496 - DNA, 13 bp, Homo sapiens
tgctgttaatatt

SEQ ID NO: 3584497 - DNA, 14 bp, Homo sapiens
tgctgttaatctga

SEQ ID NO: 3584498 - DNA, 15 bp, Homo sapiens
tgctgttaatctgat

SEQ ID NO: 3584499 - DNA, 23 bp, Homo sapiens
tgctgttaatctgatgtataatg

SEQ ID NO: 3584500 - DNA, 13 bp, Homo sapiens
tgctgttcttcag

SEQ ID NO: 3584501 - DNA, 16 bp, Homo sapiens
tgctgttcttcagtcc

SEQ ID NO: 3584502 - DNA, 14 bp, Homo sapiens
tgctgtttattaat

SEQ ID NO: 3584503 - DNA, 23 bp, Homo sapiens
tgctgtttattaatcttagtgta

SEQ ID NO: 3584504 - DNA, 21 bp, Homo sapiens
tgctgttttcctcccttctgc

SEQ ID NO: 3584505 - DNA, 22 bp, Homo sapiens
tgctgttttcctcccttctgct

SEQ ID NO: 3584506 - DNA, 23 bp, Homo sapiens
tgcttaggagacagatcactcct

SEQ ID NO: 3584507 - DNA, 16 bp, Homo sapiens
tgcttagttggctttg

SEQ ID NO: 3584508 - DNA, 21 bp, Homo sapiens
tgcttccactaccaaaagaca

SEQ ID NO: 3584509 - DNA, 19 bp, Homo sapiens
tgcttctaggagaactttt

SEQ ID NO: 3584510 - DNA, 22 bp, Homo sapiens
tgcttctcagatttctgaggaa

SEQ ID NO: 3584511 - DNA, 21 bp, Homo sapiens
tgcttgactttccagaatgac

SEQ ID NO: 3584512 - DNA, 19 bp, Homo sapiens
tgcttgctttcttttttaa

SEQ ID NO: 3584513 - DNA, 15 bp, Homo sapiens
tgcttggcccttcaa

SEQ ID NO: 3584514 - DNA, 21 bp, Homo sapiens
tgcttgggctgacccagcatc

SEQ ID NO: 3584515 - DNA, 16 bp, Homo sapiens
tgcttgtactgggaca

SEQ ID NO: 3584516 - DNA, 15 bp, Homo sapiens
tgcttgtataggttt

SEQ ID NO: 3584517 - DNA, 20 bp, Homo sapiens
tgctttagagataattgctt

SEQ ID NO: 3584518 - DNA, 16 bp, Homo sapiens
tgctttcctgggcctt

SEQ ID NO: 3584519 - DNA, 21 bp, Homo sapiens
tgctttcggagctcctgtcca

SEQ ID NO: 3584520 - DNA, 19 bp, Homo sapiens
tgctttctatgctgtttgt

SEQ ID NO: 3584521 - DNA, 21 bp, Homo sapiens
tgctttctatgctgtttgtag

SEQ ID NO: 3584522 - DNA, 12 bp, Homo sapiens
tgctttctgctc

SEQ ID NO: 3584523 - DNA, 15 bp, Homo sapiens
tgctttctgctcagc

SEQ ID NO: 3584524 - DNA, 20 bp, Homo sapiens
tgctttcttttttaaaatca

SEQ ID NO: 3584525 - DNA, 19 bp, Homo sapiens
tgctttgagactcctcagc

SEQ ID NO: 3584526 - DNA, 14 bp, Homo sapiens
tgctttgctttctg

SEQ ID NO: 3584527 - DNA, 14 bp, Homo sapiens
tgctttggcaatgc

SEQ ID NO: 3584528 - DNA, 14 bp, Homo sapiens
tgctttgggctgcc

SEQ ID NO: 3584529 - DNA, 17 bp, Homo sapiens
tgctttgggctgccctg

SEQ ID NO: 3584530 - DNA, 19 bp, Homo sapiens
tgctttgggctgccctggt

SEQ ID NO: 3584531 - DNA, 12 bp, Homo sapiens
tgctttgtattg

SEQ ID NO: 3584532 - DNA, 17 bp, Homo sapiens
tgcttttaaaaaaaaat

SEQ ID NO: 3584533 - DNA, 16 bp, Homo sapiens
tgcttttctgtcctgg

SEQ ID NO: 3584534 - DNA, 17 bp, Homo sapiens
tgcttttctgtcctggg

SEQ ID NO: 3584535 - DNA, 19 bp, Homo sapiens
tgcttttgctaataccaaa

SEQ ID NO: 3584536 - DNA, 13 bp, Homo sapiens
tgctttttgtcat

SEQ ID NO: 3584537 - DNA, 23 bp, Homo sapiens
tgctttttgtcatgttatgcagt

SEQ ID NO: 3584538 - DNA, 19 bp, Homo sapiens
tggaaaaatggttgatgga

SEQ ID NO: 3584539 - DNA, 21 bp, Homo sapiens
tggaaaacagcgaacagcctt

SEQ ID NO: 3584540 - DNA, 15 bp, Homo sapiens
tggaaaacgaagctc

SEQ ID NO: 3584541 - DNA, 23 bp, Homo sapiens
tggaaaatgacctcaaggaagct

SEQ ID NO: 3584542 - DNA, 15 bp, Homo sapiens
tggaaaattcatttt

SEQ ID NO: 3584543 - DNA, 13 bp, Homo sapiens
tggaaacagcatg

SEQ ID NO: 3584544 - DNA, 19 bp, Homo sapiens
tggaaaccttccacccagt

SEQ ID NO: 3584545 - DNA, 12 bp, Homo sapiens
tggaaagacttc

SEQ ID NO: 3584546 - DNA, 18 bp, Homo sapiens
tggaaagacttctcaaag

SEQ ID NO: 3584547 - DNA, 19 bp, Homo sapiens
tggaaagaggtgaaaatga

SEQ ID NO: 3584548 - DNA, 18 bp, Homo sapiens
tggaaagataactaggaa

SEQ ID NO: 3584549 - DNA, 23 bp, Homo sapiens
tggaaagataactaggaaatcca

SEQ ID NO: 3584550 - DNA, 22 bp, Homo sapiens
tggaaaggatctgtgattggct

SEQ ID NO: 3584551 - DNA, 20 bp, Homo sapiens
tggaaagttgggcccctgag

SEQ ID NO: 3584552 - DNA, 12 bp, Homo sapiens
tggaaataaagt

SEQ ID NO: 3584553 - DNA, 15 bp, Homo sapiens
tggaaatacacagtg

SEQ ID NO: 3584554 - DNA, 17 bp, Homo sapiens
tggaaatcaaatgtaaa

SEQ ID NO: 3584555 - DNA, 21 bp, Homo sapiens
tggaaatttgttataatgaat

SEQ ID NO: 3584556 - DNA, 23 bp, Homo sapiens
tggaaatttgttataatgaatga

SEQ ID NO: 3584557 - DNA, 13 bp, Homo sapiens
tggaacaccctgg

SEQ ID NO: 3584558 - DNA, 14 bp, Homo sapiens
tggaacaccctgga

SEQ ID NO: 3584559 - DNA, 18 bp, Homo sapiens
tggaacataaaaaggaca

SEQ ID NO: 3584560 - DNA, 21 bp, Homo sapiens
tggaacataaaatacaatgtt

SEQ ID NO: 3584561 - DNA, 17 bp, Homo sapiens
tggaaccacattgaaga

SEQ ID NO: 3584562 - DNA, 19 bp, Homo sapiens
tggaaccacattgaagaat

SEQ ID NO: 3584563 - DNA, 16 bp, Homo sapiens
tggaacccagactcag

SEQ ID NO: 3584564 - DNA, 15 bp, Homo sapiens
tggaacctcagcctg

SEQ ID NO: 3584565 - DNA, 16 bp, Homo sapiens
tggaacctcagcctgg

SEQ ID NO: 3584566 - DNA, 22 bp, Homo sapiens
tggaactaaggactccaatgtc

SEQ ID NO: 3584567 - DNA, 17 bp, Homo sapiens
tggaactcctggccttt

SEQ ID NO: 3584568 - DNA, 12 bp, Homo sapiens
tggaagacgtgg

SEQ ID NO: 3584569 - DNA, 17 bp, Homo sapiens
tggaagagctgagacct

SEQ ID NO: 3584570 - DNA, 22 bp, Homo sapiens
tggaagccaggtacaggagagg

SEQ ID NO: 3584571 - DNA, 17 bp, Homo sapiens
tggaagctgccctgccc

SEQ ID NO: 3584572 - DNA, 14 bp, Homo sapiens
tggaagcttgttga

SEQ ID NO: 3584573 - DNA, 14 bp, Homo sapiens
tggaaggagagggg

SEQ ID NO: 3584574 - DNA, 23 bp, Homo sapiens
tggaagtgtgggtctgtgtgtgt

SEQ ID NO: 3584575 - DNA, 23 bp, Homo sapiens
tggaagttgttgctatacatgtt

SEQ ID NO: 3584576 - DNA, 18 bp, Homo sapiens
tggaatacacatgcagga

SEQ ID NO: 3584577 - DNA, 17 bp, Homo sapiens
tggaatagtatcctcca

SEQ ID NO: 3584578 - DNA, 18 bp, Homo sapiens
tggaatagtatcctccag

SEQ ID NO: 3584579 - DNA, 20 bp, Homo sapiens
tggaatgatgggtcagttgt

SEQ ID NO: 3584580 - DNA, 18 bp, Homo sapiens
tggaatgccgctgtctct

SEQ ID NO: 3584581 - DNA, 15 bp, Homo sapiens
tggaattccctcctg

SEQ ID NO: 3584582 - DNA, 13 bp, Homo sapiens
tggaattctaaca

SEQ ID NO: 3584583 - DNA, 19 bp, Homo sapiens
tggacacaacagcagtctc

SEQ ID NO: 3584584 - DNA, 21 bp, Homo sapiens
tggacacaacagcagtctcct

SEQ ID NO: 3584585 - DNA, 13 bp, Homo sapiens
tggacacagctct

SEQ ID NO: 3584586 - DNA, 14 bp, Homo sapiens
tggacacagctctt

SEQ ID NO: 3584587 - DNA, 24 bp, Homo sapiens
tggacagacagatgttgggaggat

SEQ ID NO: 3584588 - DNA, 14 bp, Homo sapiens
tggacagccccacc

SEQ ID NO: 3584589 - DNA, 18 bp, Homo sapiens
tggacagctgataaattt

SEQ ID NO: 3584590 - DNA, 17 bp, Homo sapiens
tggacagcttgacttgt

SEQ ID NO: 3584591 - DNA, 15 bp, Homo sapiens
tggacagtggcctct

SEQ ID NO: 3584592 - DNA, 15 bp, Homo sapiens
tggacatactgctgg

SEQ ID NO: 3584593 - DNA, 19 bp, Homo sapiens
tggacatactgctggagtc

SEQ ID NO: 3584594 - DNA, 14 bp, Homo sapiens
tggacatgcataaa

SEQ ID NO: 3584595 - DNA, 20 bp, Homo sapiens
tggacatgcataaaaattaa

SEQ ID NO: 3584596 - DNA, 22 bp, Homo sapiens
tggacatgcataaaaattaaat

SEQ ID NO: 3584597 - DNA, 23 bp, Homo sapiens
tggaccaccgttcagtcattttg

SEQ ID NO: 3584598 - DNA, 16 bp, Homo sapiens
tggacctggggagtgg

SEQ ID NO: 3584599 - DNA, 22 bp, Homo sapiens
tggacctttcctgaggaagagg

SEQ ID NO: 3584600 - DNA, 17 bp, Homo sapiens
tggacgttaggccaggc

SEQ ID NO: 3584601 - DNA, 21 bp, Homo sapiens
tggactagagggacctctccc

SEQ ID NO: 3584602 - DNA, 20 bp, Homo sapiens
tggactcaggatccagtgac

SEQ ID NO: 3584603 - DNA, 21 bp, Homo sapiens
tggactcaggatccagtgaca

SEQ ID NO: 3584604 - DNA, 15 bp, Homo sapiens
tggactcctctgtcc

SEQ ID NO: 3584605 - DNA, 17 bp, Homo sapiens
tggactgagctggggga

SEQ ID NO: 3584606 - DNA, 15 bp, Homo sapiens
tggactgtcatagaa

SEQ ID NO: 3584607 - DNA, 22 bp, Homo sapiens
tggactgttctgtagattcatg

SEQ ID NO: 3584608 - DNA, 22 bp, Homo sapiens
tggacttgtgattggctgcagg

SEQ ID NO: 3584609 - DNA, 11 bp, Homo sapiens
tggagaaagaa

SEQ ID NO: 3584610 - DNA, 16 bp, Homo sapiens
tggagaaagagctgcc

SEQ ID NO: 3584611 - DNA, 20 bp, Homo sapiens
tggagaaagatgcagtcctc

SEQ ID NO: 3584612 - DNA, 15 bp, Homo sapiens
tgggatccaggcccc

SEQ ID NO: 3584613 - DNA, 22 bp, Homo sapiens
tgggatctggggagagcggctg

SEQ ID NO: 3584614 - DNA, 23 bp, Homo sapiens
tgggattaagaaaccttgctctc

SEQ ID NO: 3584615 - DNA, 20 bp, Homo sapiens
tgggattacaggcgtgagcc

SEQ ID NO: 3584616 - DNA, 14 bp, Homo sapiens
tgggattttgcaaa

SEQ ID NO: 3584617 - DNA, 21 bp, Homo sapiens
tgggattttttttttttggtc

SEQ ID NO: 3584618 - DNA, 13 bp, Homo sapiens
tgggcaaagcttg

SEQ ID NO: 3584619 - DNA, 14 bp, Homo sapiens
tgggcaaagcttgt

SEQ ID NO: 3584620 - DNA, 23 bp, Homo sapiens
tgggcaaagcttgtcaaagatgc

SEQ ID NO: 3584621 - DNA, 16 bp, Homo sapiens
tgggcaaagggaagta

SEQ ID NO: 3584622 - DNA, 12 bp, Homo sapiens
tgggcaagcaga

SEQ ID NO: 3584623 - DNA, 22 bp, Homo sapiens
tgggcaccacctctgtgggcac

SEQ ID NO: 3584624 - DNA, 19 bp, Homo sapiens
tgggcagcaatttaaatgt

SEQ ID NO: 3584625 - DNA, 20 bp, Homo sapiens
tgggcatgggtccagggcct

SEQ ID NO: 3584626 - DNA, 13 bp, Homo sapiens
tgggcatttcaat

SEQ ID NO: 3584627 - DNA, 17 bp, Homo sapiens
tgggcatttggtgagag

SEQ ID NO: 3584628 - DNA, 23 bp, Homo sapiens
tgggcatttggtgagagtcaaag

SEQ ID NO: 3584629 - DNA, 19 bp, Homo sapiens
tgggccacacccaggaagg

SEQ ID NO: 3584630 - DNA, 20 bp, Homo sapiens
tgggccacacccaggaaggg

SEQ ID NO: 3584631 - DNA, 22 bp, Homo sapiens
tgggccacacccaggaagggaa

SEQ ID NO: 3584632 - DNA, 18 bp, Homo sapiens
tgggccccgggctggaga

SEQ ID NO: 3584633 - DNA, 23 bp, Homo sapiens
tgggccccgggctggagaaagag

SEQ ID NO: 3584634 - DNA, 14 bp, Homo sapiens
tgggcccctgagga

SEQ ID NO: 3584635 - DNA, 17 bp, Homo sapiens
tgggccgtggcacagct

SEQ ID NO: 3584636 - DNA, 17 bp, Homo sapiens
tgggcctcaggctctgc

SEQ ID NO: 3584637 - DNA, 22 bp, Homo sapiens
tgggcctgagggtccacctgga

SEQ ID NO: 3584638 - DNA, 14 bp, Homo sapiens
tgggcctgctccag

SEQ ID NO: 3584639 - DNA, 19 bp, Homo sapiens
tgggcgttgggagcctagc

SEQ ID NO: 3584640 - DNA, 14 bp, Homo sapiens
tgggctaggcctcc

SEQ ID NO: 3584641 - DNA, 14 bp, Homo sapiens
tgggctcagcctgg

SEQ ID NO: 3584642 - DNA, 12 bp, Homo sapiens
tgggctcctctt

SEQ ID NO: 3584643 - DNA, 15 bp, Homo sapiens
tgggctcctcttagc

SEQ ID NO: 3584644 - DNA, 15 bp, Homo sapiens
tgggctgacccagca

SEQ ID NO: 3584645 - DNA, 19 bp, Homo sapiens
tgggctgcccacctggctg

SEQ ID NO: 3584646 - DNA, 21 bp, Homo sapiens
tgggctgcccacctggctgcc

SEQ ID NO: 3584647 - DNA, 13 bp, Homo sapiens
tgggctgccctgg

SEQ ID NO: 3584648 - DNA, 16 bp, Homo sapiens
tgggctgccctggtgc

SEQ ID NO: 3584649 - DNA, 21 bp, Homo sapiens
tgggctgccctggtgctgcca

SEQ ID NO: 3584650 - DNA, 16 bp, Homo sapiens
tgggctgggccctctt

SEQ ID NO: 3584651 - DNA, 22 bp, Homo sapiens
tgggctgtgtcctaaggcccat

SEQ ID NO: 3584652 - DNA, 17 bp, Homo sapiens
tgggctttgttgtgaga

SEQ ID NO: 3584653 - DNA, 13 bp, Homo sapiens
tggggaagacagt

SEQ ID NO: 3584654 - DNA, 18 bp, Homo sapiens
tggggaagacagtggccc

SEQ ID NO: 3584655 - DNA, 22 bp, Homo sapiens
tggggaagcttccatgatgcac

SEQ ID NO: 3584656 - DNA, 22 bp, Homo sapiens
tggggacccaaaccccctgcag

SEQ ID NO: 3584657 - DNA, 17 bp, Homo sapiens
tggggacgccaaggagg

SEQ ID NO: 3584658 - DNA, 21 bp, Homo sapiens
tggggacgccaaggaggtggg

SEQ ID NO: 3584659 - DNA, 19 bp, Homo sapiens
tggggacgtgaacgtttta

SEQ ID NO: 3584660 - DNA, 14 bp, Homo sapiens
tggggactcaggga

SEQ ID NO: 3584661 - DNA, 21 bp, Homo sapiens
tggggactttatttatttcta

SEQ ID NO: 3584662 - DNA, 19 bp, Homo sapiens
tggggagagcggctggaga

SEQ ID NO: 3584663 - DNA, 20 bp, Homo sapiens
tggggagccctattgctgct

SEQ ID NO: 3584664 - DNA, 12 bp, Homo sapiens
tggggaggacaa

SEQ ID NO: 3584665 - DNA, 19 bp, Homo sapiens
tggggagtggttaggcagc

SEQ ID NO: 3584666 - DNA, 20 bp, Homo sapiens
tggggagttaagacctggca

SEQ ID NO: 3584667 - DNA, 22 bp, Homo sapiens
tggggatagtccttcctggcat

SEQ ID NO: 3584668 - DNA, 20 bp, Homo sapiens
tggggatccctcccccccat

SEQ ID NO: 3584669 - DNA, 20 bp, Homo sapiens
tggggcaagacagaaaagtg

SEQ ID NO: 3584670 - DNA, 10 bp, Homo sapiens
tggggcagca

SEQ ID NO: 3584671 - DNA, 13 bp, Homo sapiens
tggggcagcactc

SEQ ID NO: 3584672 - DNA, 21 bp, Homo sapiens
tggggcaggattctctgcagc

SEQ ID NO: 3584673 - DNA, 15 bp, Homo sapiens
tggggccagatccag

SEQ ID NO: 3584674 - DNA, 12 bp, Homo sapiens
tggggccaggaa

SEQ ID NO: 3584675 - DNA, 23 bp, Homo sapiens
tggggccataaacggttcctggt

SEQ ID NO: 3584676 - DNA, 19 bp, Homo sapiens
tggggccatgcctcctcag

SEQ ID NO: 3584677 - DNA, 13 bp, Homo sapiens
tggggccgggagc

SEQ ID NO: 3584678 - DNA, 13 bp, Homo sapiens
tggggcctcagac

SEQ ID NO: 3584679 - DNA, 14 bp, Homo sapiens
tggggcctcagacc

SEQ ID NO: 3584680 - DNA, 21 bp, Homo sapiens
tggggcctcaggctccgggca

SEQ ID NO: 3584681 - DNA, 24 bp, Homo sapiens
tggggctgagccctcctgagggcc

SEQ ID NO: 3584682 - DNA, 14 bp, Homo sapiens
tggggctgcaggca

SEQ ID NO: 3584683 - DNA, 16 bp, Homo sapiens
tggggctgcaggcagg

SEQ ID NO: 3584684 - DNA, 21 bp, Homo sapiens
tggggctgcaggcaggcggct

SEQ ID NO: 3584685 - DNA, 11 bp, Homo sapiens
tggggctggca

SEQ ID NO: 3584686 - DNA, 18 bp, Homo sapiens
tgggggaacactgagaaa

SEQ ID NO: 3584687 - DNA, 19 bp, Homo sapiens
tgggggaacactgagaaag

SEQ ID NO: 3584688 - DNA, 18 bp, Homo sapiens
tgggggaactcagatcca

SEQ ID NO: 3584689 - DNA, 15 bp, Homo sapiens
tgggggagggaaagg

SEQ ID NO: 3584690 - DNA, 20 bp, Homo sapiens
tgggggagggaaagggaggg

SEQ ID NO: 3584691 - DNA, 21 bp, Homo sapiens
tgggggattcctgagctggcc

SEQ ID NO: 3584692 - DNA, 15 bp, Homo sapiens
tggggggtgggcttt

SEQ ID NO: 3584693 - DNA, 15 bp, Homo sapiens
tgggggtcctctctg

SEQ ID NO: 3584694 - DNA, 21 bp, Homo sapiens
tgggggtcctctctgagtcaa

SEQ ID NO: 3584695 - DNA, 15 bp, Homo sapiens
tgggggtctgtgtgt

SEQ ID NO: 3584696 - DNA, 20 bp, Homo sapiens
tgggggttctttcttcctct

SEQ ID NO: 3584697 - DNA, 18 bp, Homo sapiens
tggggtcatgccctcctc

SEQ ID NO: 3584698 - DNA, 20 bp, Homo sapiens
tggggtcatgccctcctctc

SEQ ID NO: 3584699 - DNA, 15 bp, Homo sapiens
tggggtccctccacc

SEQ ID NO: 3584700 - DNA, 17 bp, Homo sapiens
tggggtccctccacccc

SEQ ID NO: 3584701 - DNA, 22 bp, Homo sapiens
tggggtccttttttatacagga

SEQ ID NO: 3584702 - DNA, 15 bp, Homo sapiens
tgggtaattgtacaa

SEQ ID NO: 3584703 - DNA, 18 bp, Homo sapiens
tgggtaattgtacaataa

SEQ ID NO: 3584704 - DNA, 19 bp, Homo sapiens
tgggtaattgtacaataaa

SEQ ID NO: 3584705 - DNA, 16 bp, Homo sapiens
tgggtacttcttgaag

SEQ ID NO: 3584706 - DNA, 21 bp, Homo sapiens
tgggtagaaagagatacagag

SEQ ID NO: 3584707 - DNA, 22 bp, Homo sapiens
tgggtatttttataacaatata

SEQ ID NO: 3584708 - DNA, 18 bp, Homo sapiens
tgggtcccagagacctca

SEQ ID NO: 3584709 - DNA, 23 bp, Homo sapiens
tgggtccccccgagtctccggga

SEQ ID NO: 3584710 - DNA, 24 bp, Homo sapiens
tgggtctgggatatggctgcccag

SEQ ID NO: 3584711 - DNA, 12 bp, Homo sapiens
tgggtctgtgtg

SEQ ID NO: 3584712 - DNA, 22 bp, Homo sapiens
tgggtcttgttttttttttcca

SEQ ID NO: 3584713 - DNA, 17 bp, Homo sapiens
tgggtgctagatccagc

SEQ ID NO: 3584714 - DNA, 20 bp, Homo sapiens
tgggtgctagatccagccca

SEQ ID NO: 3584715 - DNA, 21 bp, Homo sapiens
tgggtgctagatccagcccaa

SEQ ID NO: 3584716 - DNA, 19 bp, Homo sapiens
tgggtgtttttcatgtttt

SEQ ID NO: 3584717 - DNA, 20 bp, Homo sapiens
tgggtgtttttcatgtttta

SEQ ID NO: 3584718 - DNA, 19 bp, Homo sapiens
tgggttaaatattttgcta

SEQ ID NO: 3584719 - DNA, 19 bp, Homo sapiens
tgggttctgcctgccagct

SEQ ID NO: 3584720 - DNA, 14 bp, Homo sapiens
tgggtttgggagcc

SEQ ID NO: 3584721 - DNA, 19 bp, Homo sapiens
tgggtttgggagccaggac

SEQ ID NO: 3584722 - DNA, 18 bp, Homo sapiens
tgggttttccgcccacag

SEQ ID NO: 3584723 - DNA, 24 bp, Homo sapiens
tggtaaacattcctccagcctccc

SEQ ID NO: 3584724 - DNA, 19 bp, Homo sapiens
tggtaaacgctgtccctag

SEQ ID NO: 3584725 - DNA, 20 bp, Homo sapiens
tggtaacgctctatctggtt

SEQ ID NO: 3584726 - DNA, 14 bp, Homo sapiens
tggtaacttttgtg

SEQ ID NO: 3584727 - DNA, 14 bp, Homo sapiens
tggtaatattgact

SEQ ID NO: 3584728 - DNA, 15 bp, Homo sapiens
tggtacctgccctct

SEQ ID NO: 3584729 - DNA, 13 bp, Homo sapiens
tggtactcccaaa

SEQ ID NO: 3584730 - DNA, 20 bp, Homo sapiens
tggtactcccaaactgacaa

SEQ ID NO: 3584731 - DNA, 18 bp, Homo sapiens
tggtactgtagcagggga

SEQ ID NO: 3584732 - DNA, 14 bp, Homo sapiens
tggtagagaaggag

SEQ ID NO: 3584733 - DNA, 17 bp, Homo sapiens
tggtagcagcaggctca

SEQ ID NO: 3584734 - DNA, 20 bp, Homo sapiens
tggtagcttttcccttcttt

SEQ ID NO: 3584735 - DNA, 21 bp, Homo sapiens
tggtagcttttcccttctttt

SEQ ID NO: 3584736 - DNA, 20 bp, Homo sapiens
tggtaggaactgctgggctt

SEQ ID NO: 3584737 - DNA, 18 bp, Homo sapiens
tggtatgaataattgcat

SEQ ID NO: 3584738 - DNA, 22 bp, Homo sapiens
tggtcaacatttctcatgttga

SEQ ID NO: 3584739 - DNA, 23 bp, Homo sapiens
tggtcaacatttctcatgttgaa

SEQ ID NO: 3584740 - DNA, 13 bp, Homo sapiens
tggtcaacttaag

SEQ ID NO: 3584741 - DNA, 19 bp, Homo sapiens
tggtcacaggactctgcct

SEQ ID NO: 3584742 - DNA, 22 bp, Homo sapiens
tggtcacaggactctgcctcct

SEQ ID NO: 3584743 - DNA, 17 bp, Homo sapiens
tgtggcccctgaacaag

SEQ ID NO: 3584744 - DNA, 15 bp, Homo sapiens
tgtggccctggccac

SEQ ID NO: 3584745 - DNA, 15 bp, Homo sapiens
tgtggctcctgggcc

SEQ ID NO: 3584746 - DNA, 17 bp, Homo sapiens
tgtggctttcagcctct

SEQ ID NO: 3584747 - DNA, 15 bp, Homo sapiens
tgtgggagtgtgtaa

SEQ ID NO: 3584748 - DNA, 21 bp, Homo sapiens
tgtgggcatttcttgcgagcc

SEQ ID NO: 3584749 - DNA, 18 bp, Homo sapiens
tgtggggcctcaggctcc

SEQ ID NO: 3584750 - DNA, 16 bp, Homo sapiens
tgtgggggtctgtgtg

SEQ ID NO: 3584751 - DNA, 14 bp, Homo sapiens
tgtggtaacttgag

SEQ ID NO: 3584752 - DNA, 16 bp, Homo sapiens
tgtggtcaacatttct

SEQ ID NO: 3584753 - DNA, 22 bp, Homo sapiens
tgtggtcaacatttctcatgtt

SEQ ID NO: 3584754 - DNA, 14 bp, Homo sapiens
tgtggtgaggggct

SEQ ID NO: 3584755 - DNA, 19 bp, Homo sapiens
tgtggtgaggggctttctc

SEQ ID NO: 3584756 - DNA, 23 bp, Homo sapiens
tgtgtaaattaatggtttattct

SEQ ID NO: 3584757 - DNA, 21 bp, Homo sapiens
tgtgtaattagtgccacttaa

SEQ ID NO: 3584758 - DNA, 11 bp, Homo sapiens
tgtgtaattta

SEQ ID NO: 3584759 - DNA, 19 bp, Homo sapiens
tgtgtaatttaaaattgtg

SEQ ID NO: 3584760 - DNA, 15 bp, Homo sapiens
tgtgtaatttctgcc

SEQ ID NO: 3584761 - DNA, 14 bp, Homo sapiens
tgtgtacttttcct

SEQ ID NO: 3584762 - DNA, 15 bp, Homo sapiens
tgtgtacttttcctt

SEQ ID NO: 3584763 - DNA, 13 bp, Homo sapiens
tgtgtatatgtat

SEQ ID NO: 3584764 - DNA, 16 bp, Homo sapiens
tgtgtatatgtattta

SEQ ID NO: 3584765 - DNA, 18 bp, Homo sapiens
tgtgtatctgtgcttcta

SEQ ID NO: 3584766 - DNA, 11 bp, Homo sapiens
tgtgtatgtgg

SEQ ID NO: 3584767 - DNA, 13 bp, Homo sapiens
tgtgtatgtgggg

SEQ ID NO: 3584768 - DNA, 15 bp, Homo sapiens
tgtgtattaaatggt

SEQ ID NO: 3584769 - DNA, 16 bp, Homo sapiens
tgtgtattaaatggtt

SEQ ID NO: 3584770 - DNA, 18 bp, Homo sapiens
tgtgtcagtttttcctcc

SEQ ID NO: 3584771 - DNA, 14 bp, Homo sapiens
tgtgtcatttcaaa

SEQ ID NO: 3584772 - DNA, 13 bp, Homo sapiens
tgtgtcatttcta

SEQ ID NO: 3584773 - DNA, 18 bp, Homo sapiens
tgtgtcatttctatattc

SEQ ID NO: 3584774 - DNA, 19 bp, Homo sapiens
tgtgtccacactaccagtt

SEQ ID NO: 3584775 - DNA, 22 bp, Homo sapiens
tgtgtccctggacacagctctt

SEQ ID NO: 3584776 - DNA, 23 bp, Homo sapiens
tgtgtcctccaccatgcactcac

SEQ ID NO: 3584777 - DNA, 18 bp, Homo sapiens
tgtgtcctctgcctgggc

SEQ ID NO: 3584778 - DNA, 13 bp, Homo sapiens
tgtgtctcccaga

SEQ ID NO: 3584779 - DNA, 17 bp, Homo sapiens
tgtgtctcccagaacta

SEQ ID NO: 3584780 - DNA, 18 bp, Homo sapiens
tgtgtctcccagaactat

SEQ ID NO: 3584781 - DNA, 14 bp, Homo sapiens
tgtgtctgctcagt

SEQ ID NO: 3584782 - DNA, 17 bp, Homo sapiens
tgtgtcttttaaactgg

SEQ ID NO: 3584783 - DNA, 23 bp, Homo sapiens
tgtgtgaaaattcaggtgctaga

SEQ ID NO: 3584784 - DNA, 21 bp, Homo sapiens
tgtgtgagtgagcacacccgt

SEQ ID NO: 3584785 - DNA, 21 bp, Homo sapiens
tgtgtgattgacagctttgct

SEQ ID NO: 3584786 - DNA, 15 bp, Homo sapiens
tgtgtggcagggggc

SEQ ID NO: 3584787 - DNA, 15 bp, Homo sapiens
tgtgtggctcctggg

SEQ ID NO: 3584788 - DNA, 14 bp, Homo sapiens
tgtgtggtcaacat

SEQ ID NO: 3584789 - DNA, 18 bp, Homo sapiens
tgtgtggtcaacatttct

SEQ ID NO: 3584790 - DNA, 20 bp, Homo sapiens
tgtgtggtctctgccccagc

SEQ ID NO: 3584791 - DNA, 23 bp, Homo sapiens
tgtgtggtctctgccccagcctg

SEQ ID NO: 3584792 - DNA, 16 bp, Homo sapiens
tgtgtgtccaaaactg

SEQ ID NO: 3584793 - DNA, 19 bp, Homo sapiens
tgtgtgtccaaaactgcct

SEQ ID NO: 3584794 - DNA, 13 bp, Homo sapiens
tgtgtgtggcagg

SEQ ID NO: 3584795 - DNA, 20 bp, Homo sapiens
tgtgtgtgggagtgtgtaat

SEQ ID NO: 3584796 - DNA, 13 bp, Homo sapiens
tgtgtgtgtgtat

SEQ ID NO: 3584797 - DNA, 13 bp, Homo sapiens
tgtgttcagaaga

SEQ ID NO: 3584798 - DNA, 14 bp, Homo sapiens
tgtgttcagttttg

SEQ ID NO: 3584799 - DNA, 14 bp, Homo sapiens
tgtgttcatttcat

SEQ ID NO: 3584800 - DNA, 15 bp, Homo sapiens
tgtgttgatacattc

SEQ ID NO: 3584801 - DNA, 17 bp, Homo sapiens
tgtgttgcactgaacag

SEQ ID NO: 3584802 - DNA, 14 bp, Homo sapiens
tgtgttgtgtgtgg

SEQ ID NO: 3584803 - DNA, 21 bp, Homo sapiens
tgtgtttaactgctgcagggt

SEQ ID NO: 3584804 - DNA, 15 bp, Homo sapiens
tgtgtttatgtgtgt

SEQ ID NO: 3584805 - DNA, 15 bp, Homo sapiens
tgtgtttggttcaat

SEQ ID NO: 3584806 - DNA, 15 bp, Homo sapiens
tgtgtttttaataaa

SEQ ID NO: 3584807 - DNA, 16 bp, Homo sapiens
tgtgtttttgggaaga

SEQ ID NO: 3584808 - DNA, 18 bp, Homo sapiens
tgttaaaacataaacaca

SEQ ID NO: 3584809 - DNA, 21 bp, Homo sapiens
tgttaaaagatgaaaatattt

SEQ ID NO: 3584810 - DNA, 13 bp, Homo sapiens
tgttaaagtttaa

SEQ ID NO: 3584811 - DNA, 17 bp, Homo sapiens
tgttaactatgacagat

SEQ ID NO: 3584812 - DNA, 18 bp, Homo sapiens
tgttaactgttaactatg

SEQ ID NO: 3584813 - DNA, 18 bp, Homo sapiens
tgttaagcagctaaattt

SEQ ID NO: 3584814 - DNA, 15 bp, Homo sapiens
tgttaatatttcttc

SEQ ID NO: 3584815 - DNA, 16 bp, Homo sapiens
tgttaatctgatgtat

SEQ ID NO: 3584816 - DNA, 18 bp, Homo sapiens
tgttaatctgatgtataa

SEQ ID NO: 3584817 - DNA, 22 bp, Homo sapiens
tgttaatctgatgtataatgta

SEQ ID NO: 3584818 - DNA, 23 bp, Homo sapiens
tgttaatctgatgtataatgtaa

SEQ ID NO: 3584819 - DNA, 14 bp, Homo sapiens
tgttaatttataat

SEQ ID NO: 3584820 - DNA, 23 bp, Homo sapiens
tgttaatttataatgtatttgaa

SEQ ID NO: 3584821 - DNA, 16 bp, Homo sapiens
tgttaattttgctaac

SEQ ID NO: 3584822 - DNA, 17 bp, Homo sapiens
tgttaattttgctaact

SEQ ID NO: 3584823 - DNA, 20 bp, Homo sapiens
tgttaattttgctaactggg

SEQ ID NO: 3584824 - DNA, 21 bp, Homo sapiens
tgttaattttgctaactgggt

SEQ ID NO: 3584825 - DNA, 23 bp, Homo sapiens
tgttacaaaagaaaaaagcaagt

SEQ ID NO: 3584826 - DNA, 18 bp, Homo sapiens
tgttacactttttggaag

SEQ ID NO: 3584827 - DNA, 12 bp, Homo sapiens
tgttacatgtat

SEQ ID NO: 3584828 - DNA, 14 bp, Homo sapiens
tgttacttccttat

SEQ ID NO: 3584829 - DNA, 19 bp, Homo sapiens
tgttagcattaaagttcta

SEQ ID NO: 3584830 - DNA, 14 bp, Homo sapiens
tgttagcttcctta

SEQ ID NO: 3584831 - DNA, 20 bp, Homo sapiens
tgttagcttccttaagtata

SEQ ID NO: 3584832 - DNA, 13 bp, Homo sapiens
tgttagtaaagga

SEQ ID NO: 3584833 - DNA, 14 bp, Homo sapiens
tgttagtaaaggaa

SEQ ID NO: 3584834 - DNA, 15 bp, Homo sapiens
tgttagtattttaat

SEQ ID NO: 3584835 - DNA, 23 bp, Homo sapiens
tgttagttaccttatagttactg

SEQ ID NO: 3584836 - DNA, 13 bp, Homo sapiens
tgttataaataaa

SEQ ID NO: 3584837 - DNA, 13 bp, Homo sapiens
tgttatatttcat

SEQ ID NO: 3584838 - DNA, 18 bp, Homo sapiens
tgttatcaaactgctgtc

SEQ ID NO: 3584839 - DNA, 16 bp, Homo sapiens
tgttatgactatgtaa

SEQ ID NO: 3584840 - DNA, 15 bp, Homo sapiens
tgttatgcagtgaac

SEQ ID NO: 3584841 - DNA, 14 bp, Homo sapiens
tgttatttattgaa

SEQ ID NO: 3584842 - DNA, 15 bp, Homo sapiens
tgttatttattgaaa

SEQ ID NO: 3584843 - DNA, 18 bp, Homo sapiens
tgttatttattgaaatga

SEQ ID NO: 3584844 - DNA, 19 bp, Homo sapiens
tgttattttccttctgaag

SEQ ID NO: 3584845 - DNA, 20 bp, Homo sapiens
tgttattttccttctgaagt

SEQ ID NO: 3584846 - DNA, 14 bp, Homo sapiens
tgttatttttacag

SEQ ID NO: 3584847 - DNA, 22 bp, Homo sapiens
tgttatttttacagcaaaagat

SEQ ID NO: 3584848 - DNA, 18 bp, Homo sapiens
tgttcactggacacttca

SEQ ID NO: 3584849 - DNA, 22 bp, Homo sapiens
tgttcagaaggttgctctagat

SEQ ID NO: 3584850 - DNA, 13 bp, Homo sapiens
tgttcatttcatt

SEQ ID NO: 3584851 - DNA, 17 bp, Homo sapiens
tgttcccacctgctgga

SEQ ID NO: 3584852 - DNA, 21 bp, Homo sapiens
tgttccccaaatggccatttt

SEQ ID NO: 3584853 - DNA, 13 bp, Homo sapiens
tgttccccagaga

SEQ ID NO: 3584854 - DNA, 14 bp, Homo sapiens
tgttccccagagaa

SEQ ID NO: 3584855 - DNA, 14 bp, Homo sapiens
tgttcctgaagctg

SEQ ID NO: 3584856 - DNA, 13 bp, Homo sapiens
tgttcctttctct

SEQ ID NO: 3584857 - DNA, 19 bp, Homo sapiens
tgttctaaaggctgttaaa

SEQ ID NO: 3584858 - DNA, 22 bp, Homo sapiens
tgttctaaatatcccttggaca

SEQ ID NO: 3584859 - DNA, 12 bp, Homo sapiens
tgttctctgaat

SEQ ID NO: 3584860 - DNA, 15 bp, Homo sapiens
tgttctgcctctccc

SEQ ID NO: 3584861 - DNA, 19 bp, Homo sapiens
tgttctgcgctgtgtacaa

SEQ ID NO: 3584862 - DNA, 14 bp, Homo sapiens
tgttctgctcctgc

SEQ ID NO: 3584863 - DNA, 16 bp, Homo sapiens
tgttctgctcctgctt

SEQ ID NO: 3584864 - DNA, 24 bp, Homo sapiens
tgttctgctcctgcttttctgtcc

SEQ ID NO: 3584865 - DNA, 22 bp, Homo sapiens
tgttctgggagttgctgttaat

SEQ ID NO: 3584866 - DNA, 22 bp, Homo sapiens
tgttctgtagattcatgcaagt

SEQ ID NO: 3584867 - DNA, 22 bp, Homo sapiens
tgttcttacctgtatgtctcca

SEQ ID NO: 3584868 - DNA, 11 bp, Homo sapiens
tgttcttcagt

SEQ ID NO: 3584869 - DNA, 14 bp, Homo sapiens
tgttcttcagtcct

SEQ ID NO: 3584870 - DNA, 24 bp, Homo sapiens
tgttctttcacccatcctaggaac

SEQ ID NO: 3584871 - DNA, 15 bp, Homo sapiens
tgttctttccggcca

SEQ ID NO: 3584872 - DNA, 11 bp, Homo sapiens
tgttctttctg

SEQ ID NO: 3584873 - DNA, 13 bp, Homo sapiens
tgttctttctgct

SEQ ID NO: 3584874 - DNA, 20 bp, Homo sapiens
tgttctttggaaatacacag

SEQ ID NO: 3584875 - DNA, 17 bp, Homo sapiens
tgttgaaaatgttcaga

SEQ ID NO: 3584876 - DNA, 14 bp, Homo sapiens
ttatttaaatttta

SEQ ID NO: 3584877 - DNA, 14 bp, Homo sapiens
ttatttaagactaa

SEQ ID NO: 3584878 - DNA, 22 bp, Homo sapiens
ttatttcaattgtttatatgga

SEQ ID NO: 3584879 - DNA, 22 bp, Homo sapiens
ttatttctaatccttttcctta

SEQ ID NO: 3584880 - DNA, 16 bp, Homo sapiens
ttatttctcagctgtg

SEQ ID NO: 3584881 - DNA, 16 bp, Homo sapiens
ttatttctccatcccc

SEQ ID NO: 3584882 - DNA, 16 bp, Homo sapiens
ttatttctgctctgga

SEQ ID NO: 3584883 - DNA, 15 bp, Homo sapiens
ttatttgtaaagtga

SEQ ID NO: 3584884 - DNA, 11 bp, Homo sapiens
ttatttgtatt

SEQ ID NO: 3584885 - DNA, 22 bp, Homo sapiens
ttatttgtcttaaaaaatgtga

SEQ ID NO: 3584886 - DNA, 22 bp, Homo sapiens
ttatttgtttgttttagaagat

SEQ ID NO: 3584887 - DNA, 18 bp, Homo sapiens
ttattttcacagcccata

SEQ ID NO: 3584888 - DNA, 12 bp, Homo sapiens
ttattttcactg

SEQ ID NO: 3584889 - DNA, 22 bp, Homo sapiens
ttattttcagtgcatcattact

SEQ ID NO: 3584890 - DNA, 22 bp, Homo sapiens
ttattttcccctatcatttatt

SEQ ID NO: 3584891 - DNA, 20 bp, Homo sapiens
ttattttcttttgaattgtt

SEQ ID NO: 3584892 - DNA, 13 bp, Homo sapiens
ttattttgatgta

SEQ ID NO: 3584893 - DNA, 13 bp, Homo sapiens
ttattttgtaata

SEQ ID NO: 3584894 - DNA, 14 bp, Homo sapiens
ttattttgtaataa

SEQ ID NO: 3584895 - DNA, 23 bp, Homo sapiens
ttatttttgacagtgttgaaaat

SEQ ID NO: 3584896 - DNA, 12 bp, Homo sapiens
ttatttttgctt

SEQ ID NO: 3584897 - DNA, 15 bp, Homo sapiens
ttattttttcagacc

SEQ ID NO: 3584898 - DNA, 20 bp, Homo sapiens
ttattttttcagaccgaaaa

SEQ ID NO: 3584899 - DNA, 23 bp, Homo sapiens
ttattttttggtggtgaaattga

SEQ ID NO: 3584900 - DNA, 13 bp, Homo sapiens
ttatttttttccc

SEQ ID NO: 3584901 - DNA, 16 bp, Homo sapiens
ttcaaaacaaaatgaa

SEQ ID NO: 3584902 - DNA, 15 bp, Homo sapiens
ttcaaaataaaaagt

SEQ ID NO: 3584903 - DNA, 22 bp, Homo sapiens
ttcaaaatcgtttttaatttaa

SEQ ID NO: 3584904 - DNA, 15 bp, Homo sapiens
ttcaaacattttgta

SEQ ID NO: 3584905 - DNA, 22 bp, Homo sapiens
ttcaaacttaaacaaaaaacta

SEQ ID NO: 3584906 - DNA, 14 bp, Homo sapiens
ttcaaagtgcctgg

SEQ ID NO: 3584907 - DNA, 21 bp, Homo sapiens
ttcaacagccaagctggcaca

SEQ ID NO: 3584908 - DNA, 13 bp, Homo sapiens
ttcaacgcagccc

SEQ ID NO: 3584909 - DNA, 14 bp, Homo sapiens
ttcaacgcagccct

SEQ ID NO: 3584910 - DNA, 16 bp, Homo sapiens
ttcaacgcagccctgc

SEQ ID NO: 3584911 - DNA, 12 bp, Homo sapiens
ttcaagaaactg

SEQ ID NO: 3584912 - DNA, 23 bp, Homo sapiens
ttcaagaaactgaggaattttct

SEQ ID NO: 3584913 - DNA, 22 bp, Homo sapiens
ttcaagaaagcttcaaactgca

SEQ ID NO: 3584914 - DNA, 16 bp, Homo sapiens
ttcaagacgaggggca

SEQ ID NO: 3584915 - DNA, 17 bp, Homo sapiens
ttcaagacgaggggcag

SEQ ID NO: 3584916 - DNA, 21 bp, Homo sapiens
ttcaagcaaacatcaaataaa

SEQ ID NO: 3584917 - DNA, 16 bp, Homo sapiens
ttcaaggccatccttc

SEQ ID NO: 3584918 - DNA, 19 bp, Homo sapiens
ttcaagtcagttctgtgat

SEQ ID NO: 3584919 - DNA, 17 bp, Homo sapiens
ttcaagtgactctcctg

SEQ ID NO: 3584920 - DNA, 14 bp, Homo sapiens
ttcaagtttgctgc

SEQ ID NO: 3584921 - DNA, 17 bp, Homo sapiens
ttcaataaagcagttaa

SEQ ID NO: 3584922 - DNA, 16 bp, Homo sapiens
ttcaatatatttgtat

SEQ ID NO: 3584923 - DNA, 12 bp, Homo sapiens
ttcaatatgcaa

SEQ ID NO: 3584924 - DNA, 20 bp, Homo sapiens
ttcaatatgcaagcagcttt

SEQ ID NO: 3584925 - DNA, 23 bp, Homo sapiens
ttcaatctggattcatatttaat

SEQ ID NO: 3584926 - DNA, 16 bp, Homo sapiens
ttcaattaaacggatt

SEQ ID NO: 3584927 - DNA, 18 bp, Homo sapiens
ttcaattaaacggattat

SEQ ID NO: 3584928 - DNA, 15 bp, Homo sapiens
ttcacaaagcccaag

SEQ ID NO: 3584929 - DNA, 18 bp, Homo sapiens
ttcacactggtaaatgtt

SEQ ID NO: 3584930 - DNA, 13 bp, Homo sapiens
ttcacaggcactc

SEQ ID NO: 3584931 - DNA, 18 bp, Homo sapiens
ttcacattaggctgttgg

SEQ ID NO: 3584932 - DNA, 15 bp, Homo sapiens
ttcaccacagacttt

SEQ ID NO: 3584933 - DNA, 18 bp, Homo sapiens
ttcaccagtgttcctgaa

SEQ ID NO: 3584934 - DNA, 20 bp, Homo sapiens
ttcaccagtgttcctgaagc

SEQ ID NO: 3584935 - DNA, 22 bp, Homo sapiens
ttcaccagtgttcctgaagctg

SEQ ID NO: 3584936 - DNA, 20 bp, Homo sapiens
ttcacccatcctaggaacca

SEQ ID NO: 3584937 - DNA, 21 bp, Homo sapiens
ttcacctactaatgtctcttc

SEQ ID NO: 3584938 - DNA, 21 bp, Homo sapiens
ttcacctccaagcatttcatg

SEQ ID NO: 3584939 - DNA, 23 bp, Homo sapiens
ttcacctcggagggatggagaaa

SEQ ID NO: 3584940 - DNA, 16 bp, Homo sapiens
ttcacctgtgactcct

SEQ ID NO: 3584941 - DNA, 15 bp, Homo sapiens
ttcacgagagcccgg

SEQ ID NO: 3584942 - DNA, 19 bp, Homo sapiens
ttcacgcctgaggcaatta

SEQ ID NO: 3584943 - DNA, 21 bp, Homo sapiens
ttcacgtgctttgtgttcagt

SEQ ID NO: 3584944 - DNA, 19 bp, Homo sapiens
ttcactagagacaaatctt

SEQ ID NO: 3584945 - DNA, 18 bp, Homo sapiens
ttcactgcaaacacacct

SEQ ID NO: 3584946 - DNA, 19 bp, Homo sapiens
ttcactgcaaacacacctt

SEQ ID NO: 3584947 - DNA, 20 bp, Homo sapiens
ttcactgcaaacacaccttg

SEQ ID NO: 3584948 - DNA, 19 bp, Homo sapiens
ttcactgctggctgcctta

SEQ ID NO: 3584949 - DNA, 22 bp, Homo sapiens
ttcactgtagaatgatttcatg

SEQ ID NO: 3584950 - DNA, 23 bp, Homo sapiens
ttcactttgtgtattaaatggtt

SEQ ID NO: 3584951 - DNA, 22 bp, Homo sapiens
ttcagaacaactgcaaagaaag

SEQ ID NO: 3584952 - DNA, 19 bp, Homo sapiens
ttcagaactgcccttgctg

SEQ ID NO: 3584953 - DNA, 18 bp, Homo sapiens
ttcagaagaatcttcctg

SEQ ID NO: 3584954 - DNA, 16 bp, Homo sapiens
ttcagaatcttttcaa

SEQ ID NO: 3584955 - DNA, 19 bp, Homo sapiens
ttcagaatggcagtcctgg

SEQ ID NO: 3584956 - DNA, 22 bp, Homo sapiens
ttcagaatggcagtcctggagg

SEQ ID NO: 3584957 - DNA, 18 bp, Homo sapiens
ttcagagaattatctcaa

SEQ ID NO: 3584958 - DNA, 22 bp, Homo sapiens
ttcagagaattatctcaagtaa

SEQ ID NO: 3584959 - DNA, 16 bp, Homo sapiens
ttcagagccagcctgg

SEQ ID NO: 3584960 - DNA, 17 bp, Homo sapiens
ttcagagccagcctggc

SEQ ID NO: 3584961 - DNA, 21 bp, Homo sapiens
ttcagatgaaaagaaaactta

SEQ ID NO: 3584962 - DNA, 19 bp, Homo sapiens
ttcagcaaccctacagtat

SEQ ID NO: 3584963 - DNA, 21 bp, Homo sapiens
ttcagcaaccctacagtatat

SEQ ID NO: 3584964 - DNA, 13 bp, Homo sapiens
ttcagcagactgg

SEQ ID NO: 3584965 - DNA, 14 bp, Homo sapiens
ttcagcagtctaaa

SEQ ID NO: 3584966 - DNA, 16 bp, Homo sapiens
ttcagccaaagtccta

SEQ ID NO: 3584967 - DNA, 17 bp, Homo sapiens
ttcagccttatccaggt

SEQ ID NO: 3584968 - DNA, 17 bp, Homo sapiens
ttcaggattaactaaag

SEQ ID NO: 3584969 - DNA, 22 bp, Homo sapiens
ttcaggattaactaaagaagag

SEQ ID NO: 3584970 - DNA, 13 bp, Homo sapiens
ttcaggcagctga

SEQ ID NO: 3584971 - DNA, 17 bp, Homo sapiens
ttcaggcagctgaaatt

SEQ ID NO: 3584972 - DNA, 16 bp, Homo sapiens
ttcaggccagcccagc

SEQ ID NO: 3584973 - DNA, 18 bp, Homo sapiens
ttcagggaccgtccaggg

SEQ ID NO: 3584974 - DNA, 17 bp, Homo sapiens
ttcaggggaaacttgat

SEQ ID NO: 3584975 - DNA, 17 bp, Homo sapiens
ttcagtaagttctgtgg

SEQ ID NO: 3584976 - DNA, 12 bp, Homo sapiens
ttcagtgaatat

SEQ ID NO: 3584977 - DNA, 18 bp, Homo sapiens
ttcagtgactcctgctgg

SEQ ID NO: 3584978 - DNA, 20 bp, Homo sapiens
ttcagtgagcccctccccag

SEQ ID NO: 3584979 - DNA, 21 bp, Homo sapiens
ttcagtgcagtttcttttcac

SEQ ID NO: 3584980 - DNA, 13 bp, Homo sapiens
ttcagttcagctt

SEQ ID NO: 3584981 - DNA, 22 bp, Homo sapiens
ttcagttctaggcctttcctct

SEQ ID NO: 3584982 - DNA, 13 bp, Homo sapiens
ttcataaatcatg

SEQ ID NO: 3584983 - DNA, 16 bp, Homo sapiens
ttcataattctgaaac

SEQ ID NO: 3584984 - DNA, 17 bp, Homo sapiens
ttcataattctgaaaca

SEQ ID NO: 3584985 - DNA, 21 bp, Homo sapiens
ttcatattttaaacagaggat

SEQ ID NO: 3584986 - DNA, 12 bp, Homo sapiens
ttcatcatttca

SEQ ID NO: 3584987 - DNA, 14 bp, Homo sapiens
ttcatcatttcagc

SEQ ID NO: 3584988 - DNA, 17 bp, Homo sapiens
ttcatcatttcagccaa

SEQ ID NO: 3584989 - DNA, 16 bp, Homo sapiens
ttcatccaatgtgaag

SEQ ID NO: 3584990 - DNA, 17 bp, Homo sapiens
ttcatccaatgtgaagt

SEQ ID NO: 3584991 - DNA, 15 bp, Homo sapiens
ttcatccgcctgtgg

SEQ ID NO: 3584992 - DNA, 20 bp, Homo sapiens
ttcatctccctcctccaggt

SEQ ID NO: 3584993 - DNA, 12 bp, Homo sapiens
ttcatcttgcag

SEQ ID NO: 3584994 - DNA, 15 bp, Homo sapiens
ttcatgcagctgtgg

SEQ ID NO: 3584995 - DNA, 21 bp, Homo sapiens
ttcatgccaattagcaattga

SEQ ID NO: 3584996 - DNA, 22 bp, Homo sapiens
ttcatggttcaagtattaagca

SEQ ID NO: 3584997 - DNA, 14 bp, Homo sapiens
ttcatgtaaaaagt

SEQ ID NO: 3584998 - DNA, 17 bp, Homo sapiens
ttcatgtccagtgagca

SEQ ID NO: 3584999 - DNA, 23 bp, Homo sapiens
ttcatgtccagtgagcagtgttg

SEQ ID NO: 3585000 - DNA, 14 bp, Homo sapiens
ttcatgtttggaaa

SEQ ID NO: 3585001 - DNA, 20 bp, Homo sapiens
ttcatgttttagcatttgta

SEQ ID NO: 3585002 - DNA, 14 bp, Homo sapiens
ttcattatctcaaa

SEQ ID NO: 3585003 - DNA, 13 bp, Homo sapiens
ttcattctaccaa

SEQ ID NO: 3585004 - DNA, 18 bp, Homo sapiens
ttcattggtgaagtaaat

SEQ ID NO: 3585005 - DNA, 19 bp, Homo sapiens
ttcatttagtcatgtgacc

SEQ ID NO: 3585006 - DNA, 11 bp, Homo sapiens
ttcatttcatt

SEQ ID NO: 3585007 - DNA, 16 bp, Homo sapiens
ttccaaagctttatta

SEQ ID NO: 3585008 - DNA, 17 bp, Homo sapiens
ttgcctctgccctggat

SEQ ID NO: 3585009 - DNA, 15 bp, Homo sapiens
ttgcctcttctttgt

SEQ ID NO: 3585010 - DNA, 21 bp, Homo sapiens
ttgcctcttctttgtgccttt

SEQ ID NO: 3585011 - DNA, 15 bp, Homo sapiens
ttgccttctactccc

SEQ ID NO: 3585012 - DNA, 14 bp, Homo sapiens
ttgccttgagttta

SEQ ID NO: 3585013 - DNA, 20 bp, Homo sapiens
ttgcctttatctctgaggct

SEQ ID NO: 3585014 - DNA, 16 bp, Homo sapiens
ttgcgcctaatgtgtt

SEQ ID NO: 3585015 - DNA, 20 bp, Homo sapiens
ttgcgcctaatgtgtttgag

SEQ ID NO: 3585016 - DNA, 14 bp, Homo sapiens
ttgcgtttttcctt

SEQ ID NO: 3585017 - DNA, 15 bp, Homo sapiens
ttgcgtttttccttg

SEQ ID NO: 3585018 - DNA, 13 bp, Homo sapiens
ttgctaactgggt

SEQ ID NO: 3585019 - DNA, 16 bp, Homo sapiens
ttgctaactgggttaa

SEQ ID NO: 3585020 - DNA, 20 bp, Homo sapiens
ttgctaactgggttaaatat

SEQ ID NO: 3585021 - DNA, 15 bp, Homo sapiens
ttgctaactggttaa

SEQ ID NO: 3585022 - DNA, 18 bp, Homo sapiens
ttgctaataccaaaattg

SEQ ID NO: 3585023 - DNA, 20 bp, Homo sapiens
ttgctagccagcattccata

SEQ ID NO: 3585024 - DNA, 15 bp, Homo sapiens
ttgctatagtgacat

SEQ ID NO: 3585025 - DNA, 21 bp, Homo sapiens
ttgctatagtgacatgcagtt

SEQ ID NO: 3585026 - DNA, 12 bp, Homo sapiens
ttgctccttgac

SEQ ID NO: 3585027 - DNA, 14 bp, Homo sapiens
ttgctctaccaaat

SEQ ID NO: 3585028 - DNA, 21 bp, Homo sapiens
ttgctctaccaaatagtgatt

SEQ ID NO: 3585029 - DNA, 21 bp, Homo sapiens
ttgctctcttttattctgtgc

SEQ ID NO: 3585030 - DNA, 12 bp, Homo sapiens
ttgctgaagatg

SEQ ID NO: 3585031 - DNA, 12 bp, Homo sapiens
ttgctgaggcac

SEQ ID NO: 3585032 - DNA, 15 bp, Homo sapiens
ttgctgcatatttga

SEQ ID NO: 3585033 - DNA, 13 bp, Homo sapiens
ttgctgcccctgt

SEQ ID NO: 3585034 - DNA, 13 bp, Homo sapiens
ttgctgctgaagg

SEQ ID NO: 3585035 - DNA, 15 bp, Homo sapiens
ttgctgcttgatgat

SEQ ID NO: 3585036 - DNA, 15 bp, Homo sapiens
ttgctgggctttggg

SEQ ID NO: 3585037 - DNA, 13 bp, Homo sapiens
ttgctgtacaaaa

SEQ ID NO: 3585038 - DNA, 14 bp, Homo sapiens
ttgctgtggctcca

SEQ ID NO: 3585039 - DNA, 22 bp, Homo sapiens
ttgctgttttcctcccttctgc

SEQ ID NO: 3585040 - DNA, 16 bp, Homo sapiens
ttgcttccccttttgc

SEQ ID NO: 3585041 - DNA, 17 bp, Homo sapiens
ttgcttctacatgatgc

SEQ ID NO: 3585042 - DNA, 17 bp, Homo sapiens
ttgcttctttctagaaa

SEQ ID NO: 3585043 - DNA, 20 bp, Homo sapiens
ttgcttctttctagaaagag

SEQ ID NO: 3585044 - DNA, 14 bp, Homo sapiens
ttgctttaaaacaa

SEQ ID NO: 3585045 - DNA, 17 bp, Homo sapiens
ttgctttcctgggcctt

SEQ ID NO: 3585046 - DNA, 20 bp, Homo sapiens
ttgctttctgctcagcttct

SEQ ID NO: 3585047 - DNA, 21 bp, Homo sapiens
ttgctttgagactcctcagca

SEQ ID NO: 3585048 - DNA, 22 bp, Homo sapiens
ttgctttgagactcctcagcac

SEQ ID NO: 3585049 - DNA, 13 bp, Homo sapiens
ttgctttgtatgc

SEQ ID NO: 3585050 - DNA, 16 bp, Homo sapiens
ttgctttgtatgcact

SEQ ID NO: 3585051 - DNA, 21 bp, Homo sapiens
ttggaaataaagtcagatgga

SEQ ID NO: 3585052 - DNA, 13 bp, Homo sapiens
ttggaaatgtgtt

SEQ ID NO: 3585053 - DNA, 16 bp, Homo sapiens
ttggaacaccctggat

SEQ ID NO: 3585054 - DNA, 18 bp, Homo sapiens
ttggaacaccctggatgc

SEQ ID NO: 3585055 - DNA, 20 bp, Homo sapiens
ttggaagtgaaaactttgta

SEQ ID NO: 3585056 - DNA, 15 bp, Homo sapiens
ttggaagttttaatc

SEQ ID NO: 3585057 - DNA, 12 bp, Homo sapiens
ttggacatttta

SEQ ID NO: 3585058 - DNA, 14 bp, Homo sapiens
ttggacattttatg

SEQ ID NO: 3585059 - DNA, 20 bp, Homo sapiens
ttggacattttatgtctttc

SEQ ID NO: 3585060 - DNA, 20 bp, Homo sapiens
ttggacgggatgacctccag

SEQ ID NO: 3585061 - DNA, 21 bp, Homo sapiens
ttggacgggatgacctccaga

SEQ ID NO: 3585062 - DNA, 22 bp, Homo sapiens
ttggagagggcccaggtcccaa

SEQ ID NO: 3585063 - DNA, 16 bp, Homo sapiens
ttggagagtttcctga

SEQ ID NO: 3585064 - DNA, 21 bp, Homo sapiens
ttggagagtttcctgaaacaa

SEQ ID NO: 3585065 - DNA, 13 bp, Homo sapiens
ttggagtgctctt

SEQ ID NO: 3585066 - DNA, 17 bp, Homo sapiens
ttggagtgctcttccca

SEQ ID NO: 3585067 - DNA, 21 bp, Homo sapiens
ttggataagtttctattctgt

SEQ ID NO: 3585068 - DNA, 14 bp, Homo sapiens
ttggatacagctgc

SEQ ID NO: 3585069 - DNA, 14 bp, Homo sapiens
ttggatgttgctat

SEQ ID NO: 3585070 - DNA, 15 bp, Homo sapiens
ttggatgttgctata

SEQ ID NO: 3585071 - DNA, 14 bp, Homo sapiens
ttggattggggtcc

SEQ ID NO: 3585072 - DNA, 12 bp, Homo sapiens
ttggatttccta

SEQ ID NO: 3585073 - DNA, 22 bp, Homo sapiens
ttggcaaagtttaaatgtattt

SEQ ID NO: 3585074 - DNA, 17 bp, Homo sapiens
ttggcaccagacaccca

SEQ ID NO: 3585075 - DNA, 20 bp, Homo sapiens
ttggcacccccatgctgcct

SEQ ID NO: 3585076 - DNA, 19 bp, Homo sapiens
ttggcacctaatccaggca

SEQ ID NO: 3585077 - DNA, 21 bp, Homo sapiens
ttggcacctaatccaggcaga

SEQ ID NO: 3585078 - DNA, 16 bp, Homo sapiens
ttggcaccttccccct

SEQ ID NO: 3585079 - DNA, 16 bp, Homo sapiens
ttggcagctctactct

SEQ ID NO: 3585080 - DNA, 22 bp, Homo sapiens
ttggcaggagtgggctctgagc

SEQ ID NO: 3585081 - DNA, 21 bp, Homo sapiens
ttggcaggcccactccccagc

SEQ ID NO: 3585082 - DNA, 20 bp, Homo sapiens
ttggccatgatgtccttgga

SEQ ID NO: 3585083 - DNA, 19 bp, Homo sapiens
ttggccatgcagaaagcat

SEQ ID NO: 3585084 - DNA, 11 bp, Homo sapiens
ttggcccagcg

SEQ ID NO: 3585085 - DNA, 17 bp, Homo sapiens
ttggcccccttcaggag

SEQ ID NO: 3585086 - DNA, 20 bp, Homo sapiens
ttggcccccttcaggagcct

SEQ ID NO: 3585087 - DNA, 22 bp, Homo sapiens
ttggcccccttcaggagcctgg

SEQ ID NO: 3585088 - DNA, 17 bp, Homo sapiens
ttggccctcctcagctc

SEQ ID NO: 3585089 - DNA, 19 bp, Homo sapiens
ttggccctcctcagctccc

SEQ ID NO: 3585090 - DNA, 21 bp, Homo sapiens
ttggccctcctcagctccctg

SEQ ID NO: 3585091 - DNA, 23 bp, Homo sapiens
ttggcggcccggccggagggcag

SEQ ID NO: 3585092 - DNA, 22 bp, Homo sapiens
ttggctgacccctctggtgtgt

SEQ ID NO: 3585093 - DNA, 14 bp, Homo sapiens
ttggctgcaggaag

SEQ ID NO: 3585094 - DNA, 22 bp, Homo sapiens
ttggctgcaggaagaaactttt

SEQ ID NO: 3585095 - DNA, 17 bp, Homo sapiens
ttggctgcatttgcctg

SEQ ID NO: 3585096 - DNA, 20 bp, Homo sapiens
ttggctgcttaaactggaaa

SEQ ID NO: 3585097 - DNA, 19 bp, Homo sapiens
ttggctggttaatgggaaa

SEQ ID NO: 3585098 - DNA, 18 bp, Homo sapiens
ttggcttaaagggatgga

SEQ ID NO: 3585099 - DNA, 15 bp, Homo sapiens
ttggctttcataaat

SEQ ID NO: 3585100 - DNA, 15 bp, Homo sapiens
ttggctttgcccacc

SEQ ID NO: 3585101 - DNA, 21 bp, Homo sapiens
ttggctttgcccacccctcac

SEQ ID NO: 3585102 - DNA, 15 bp, Homo sapiens
ttgggaactgaaatc

SEQ ID NO: 3585103 - DNA, 10 bp, Homo sapiens
ttgggaagaa

SEQ ID NO: 3585104 - DNA, 18 bp, Homo sapiens
ttgggaagaatccagtat

SEQ ID NO: 3585105 - DNA, 21 bp, Homo sapiens
ttgggagagccatacataaaa

SEQ ID NO: 3585106 - DNA, 19 bp, Homo sapiens
ttgggcagcaatttaaatg

SEQ ID NO: 3585107 - DNA, 14 bp, Homo sapiens
ttgggcccctgagg

SEQ ID NO: 3585108 - DNA, 16 bp, Homo sapiens
ttgggcccctgaggag

SEQ ID NO: 3585109 - DNA, 17 bp, Homo sapiens
ttgggcccctgaggagc

SEQ ID NO: 3585110 - DNA, 19 bp, Homo sapiens
ttgggcctcaggctctgca

SEQ ID NO: 3585111 - DNA, 20 bp, Homo sapiens
ttgggcctcaggctctgcac

SEQ ID NO: 3585112 - DNA, 17 bp, Homo sapiens
ttgggcctgctccagac

SEQ ID NO: 3585113 - DNA, 20 bp, Homo sapiens
ttgggcctgctccagacctg

SEQ ID NO: 3585114 - DNA, 20 bp, Homo sapiens
ttgggcttcaacagccaagc

SEQ ID NO: 3585115 - DNA, 17 bp, Homo sapiens
ttggggagttaagacct

SEQ ID NO: 3585116 - DNA, 20 bp, Homo sapiens
ttggggtccctccaccccac

SEQ ID NO: 3585117 - DNA, 15 bp, Homo sapiens
ttggtagttaacaca

SEQ ID NO: 3585118 - DNA, 18 bp, Homo sapiens
ttggtctgccttctgctg

SEQ ID NO: 3585119 - DNA, 14 bp, Homo sapiens
ttggtgaagtaaat

SEQ ID NO: 3585120 - DNA, 22 bp, Homo sapiens
ttggtgaatcggttgttctttc

SEQ ID NO: 3585121 - DNA, 21 bp, Homo sapiens
ttggtgacaaaattcatttgc

SEQ ID NO: 3585122 - DNA, 22 bp, Homo sapiens
ttggtgacaaaattcatttgct

SEQ ID NO: 3585123 - DNA, 19 bp, Homo sapiens
ttggtggggtggcacctgt

SEQ ID NO: 3585124 - DNA, 21 bp, Homo sapiens
ttggtggggtggcacctgttt

SEQ ID NO: 3585125 - DNA, 13 bp, Homo sapiens
ttggttcaatttt

SEQ ID NO: 3585126 - DNA, 13 bp, Homo sapiens
ttggttcacctgt

SEQ ID NO: 3585127 - DNA, 19 bp, Homo sapiens
ttggtttgccttttatgta

SEQ ID NO: 3585128 - DNA, 19 bp, Homo sapiens
ttgtaaaaatgtctttcat

SEQ ID NO: 3585129 - DNA, 15 bp, Homo sapiens
ttgtaaaacttctgc

SEQ ID NO: 3585130 - DNA, 16 bp, Homo sapiens
ttgtaaaacttctgct

SEQ ID NO: 3585131 - DNA, 17 bp, Homo sapiens
ttgtaaaagcattttgt

SEQ ID NO: 3585132 - DNA, 19 bp, Homo sapiens
ttgtaaaagcattttgtaa

SEQ ID NO: 3585133 - DNA, 16 bp, Homo sapiens
ttgtaaactcaaaata

SEQ ID NO: 3585134 - DNA, 16 bp, Homo sapiens
ttgtaaatgaaactta

SEQ ID NO: 3585135 - DNA, 18 bp, Homo sapiens
ttgtaaatgtgcttttaa

SEQ ID NO: 3585136 - DNA, 19 bp, Homo sapiens
ttgtaaatttatgtgatgg

SEQ ID NO: 3585137 - DNA, 17 bp, Homo sapiens
ttgtaactaaaataatt

SEQ ID NO: 3585138 - DNA, 23 bp, Homo sapiens
ttgtaactaaaataattttgtaa

SEQ ID NO: 3585139 - DNA, 22 bp, Homo sapiens
ttgtaactgtttagatgaatgt

SEQ ID NO: 3585140 - DNA, 11 bp, Homo sapiens
ttttatattta

SEQ ID NO: 3585141 - DNA, 12 bp, Homo sapiens
ttttatctcctt

SEQ ID NO: 3585142 - DNA, 16 bp, Homo sapiens
ttttatctggttctat

SEQ ID NO: 3585143 - DNA, 20 bp, Homo sapiens
ttttatctggttctatatga

SEQ ID NO: 3585144 - DNA, 21 bp, Homo sapiens
ttttatcttaatccattaaaa

SEQ ID NO: 3585145 - DNA, 16 bp, Homo sapiens
ttttatgtctttcttg

SEQ ID NO: 3585146 - DNA, 20 bp, Homo sapiens
ttttatgtctttcttgtaag

SEQ ID NO: 3585147 - DNA, 13 bp, Homo sapiens
ttttatgtgtaaa

SEQ ID NO: 3585148 - DNA, 19 bp, Homo sapiens
ttttattaaaatatttcag

SEQ ID NO: 3585149 - DNA, 12 bp, Homo sapiens
ttttattaaatt

SEQ ID NO: 3585150 - DNA, 16 bp, Homo sapiens
ttttattataaattct

SEQ ID NO: 3585151 - DNA, 14 bp, Homo sapiens
ttttattattttct

SEQ ID NO: 3585152 - DNA, 22 bp, Homo sapiens
ttttatttaggcttttccaaat

SEQ ID NO: 3585153 - DNA, 14 bp, Homo sapiens
ttttatttctaagt

SEQ ID NO: 3585154 - DNA, 19 bp, Homo sapiens
ttttatttctaagtattta

SEQ ID NO: 3585155 - DNA, 20 bp, Homo sapiens
ttttatttctgactcttatt

SEQ ID NO: 3585156 - DNA, 13 bp, Homo sapiens
ttttcaaattaat

SEQ ID NO: 3585157 - DNA, 22 bp, Homo sapiens
ttttcaaattaatgttccagtt

SEQ ID NO: 3585158 - DNA, 17 bp, Homo sapiens
ttttcaatatgcaagca

SEQ ID NO: 3585159 - DNA, 18 bp, Homo sapiens
ttttcaattaaacggatt

SEQ ID NO: 3585160 - DNA, 19 bp, Homo sapiens
ttttcaccagatttgctaa

SEQ ID NO: 3585161 - DNA, 20 bp, Homo sapiens
ttttcactttgtgtattaaa

SEQ ID NO: 3585162 - DNA, 13 bp, Homo sapiens
ttttcagaccgaa

SEQ ID NO: 3585163 - DNA, 23 bp, Homo sapiens
ttttcataaattatttgattatt

SEQ ID NO: 3585164 - DNA, 17 bp, Homo sapiens
ttttcatcatttcagcc

SEQ ID NO: 3585165 - DNA, 13 bp, Homo sapiens
ttttcatcctaaa

SEQ ID NO: 3585166 - DNA, 14 bp, Homo sapiens
ttttcatttgtaaa

SEQ ID NO: 3585167 - DNA, 18 bp, Homo sapiens
ttttcatttgtaaaaatg

SEQ ID NO: 3585168 - DNA, 12 bp, Homo sapiens
ttttccaaagag

SEQ ID NO: 3585169 - DNA, 14 bp, Homo sapiens
ttttccaactacta

SEQ ID NO: 3585170 - DNA, 18 bp, Homo sapiens
ttttccatatttttacaa

SEQ ID NO: 3585171 - DNA, 14 bp, Homo sapiens
ttttccattttata

SEQ ID NO: 3585172 - DNA, 15 bp, Homo sapiens
ttttccattttataa

SEQ ID NO: 3585173 - DNA, 23 bp, Homo sapiens
ttttcccagactactattttctt

SEQ ID NO: 3585174 - DNA, 18 bp, Homo sapiens
ttttcccagctacacctt

SEQ ID NO: 3585175 - DNA, 14 bp, Homo sapiens
ttttccctggaact

SEQ ID NO: 3585176 - DNA, 22 bp, Homo sapiens
ttttccctggaactcctggcct

SEQ ID NO: 3585177 - DNA, 18 bp, Homo sapiens
ttttccgaagtctctgat

SEQ ID NO: 3585178 - DNA, 16 bp, Homo sapiens
ttttccgtcacttaaa

SEQ ID NO: 3585179 - DNA, 18 bp, Homo sapiens
ttttcctcttctattttg

SEQ ID NO: 3585180 - DNA, 20 bp, Homo sapiens
ttttccttatttgccttcta

SEQ ID NO: 3585181 - DNA, 19 bp, Homo sapiens
ttttcctttaaatttcagc

SEQ ID NO: 3585182 - DNA, 10 bp, Homo sapiens
ttttcctttt

SEQ ID NO: 3585183 - DNA, 14 bp, Homo sapiens
ttttctaaagactt

SEQ ID NO: 3585184 - DNA, 20 bp, Homo sapiens
ttttctcccaagaaacctga

SEQ ID NO: 3585185 - DNA, 14 bp, Homo sapiens
ttttctcctcccag

SEQ ID NO: 3585186 - DNA, 14 bp, Homo sapiens
ttttctcttcatat

SEQ ID NO: 3585187 - DNA, 13 bp, Homo sapiens
ttttctgtcctgg

SEQ ID NO: 3585188 - DNA, 13 bp, Homo sapiens
ttttctttcactt

SEQ ID NO: 3585189 - DNA, 12 bp, Homo sapiens
ttttctttgtgt

SEQ ID NO: 3585190 - DNA, 20 bp, Homo sapiens
ttttgacagccttcttgatg

SEQ ID NO: 3585191 - DNA, 19 bp, Homo sapiens
ttttgacagtgttgaaaat

SEQ ID NO: 3585192 - DNA, 13 bp, Homo sapiens
ttttgaggcaaaa

SEQ ID NO: 3585193 - DNA, 18 bp, Homo sapiens
ttttgaggcttctccttc

SEQ ID NO: 3585194 - DNA, 20 bp, Homo sapiens
ttttgatttgtactgaaaaa

SEQ ID NO: 3585195 - DNA, 17 bp, Homo sapiens
ttttgccagttttccct

SEQ ID NO: 3585196 - DNA, 19 bp, Homo sapiens
ttttgccagttttccctgg

SEQ ID NO: 3585197 - DNA, 11 bp, Homo sapiens
ttttgctaact

SEQ ID NO: 3585198 - DNA, 13 bp, Homo sapiens
ttttgctaactgg

SEQ ID NO: 3585199 - DNA, 18 bp, Homo sapiens
ttttgctcagttccatgg

SEQ ID NO: 3585200 - DNA, 15 bp, Homo sapiens
ttttgctgaattcct

SEQ ID NO: 3585201 - DNA, 17 bp, Homo sapiens
ttttgctttaaaacaaa

SEQ ID NO: 3585202 - DNA, 18 bp, Homo sapiens
ttttgctttaaaacaaag

SEQ ID NO: 3585203 - DNA, 16 bp, Homo sapiens
ttttggatgttgctat

SEQ ID NO: 3585204 - DNA, 22 bp, Homo sapiens
ttttggcaatgactcaaagtct

SEQ ID NO: 3585205 - DNA, 20 bp, Homo sapiens
ttttgggggtaaagtttgct

SEQ ID NO: 3585206 - DNA, 19 bp, Homo sapiens
ttttgggggtcatcttgga

SEQ ID NO: 3585207 - DNA, 19 bp, Homo sapiens
ttttgggtgtttttcatgt

SEQ ID NO: 3585208 - DNA, 17 bp, Homo sapiens
ttttggtagagaaggag

SEQ ID NO: 3585209 - DNA, 16 bp, Homo sapiens
ttttggtggtgaaatt

SEQ ID NO: 3585210 - DNA, 19 bp, Homo sapiens
ttttgtaaatgaaacttaa

SEQ ID NO: 3585211 - DNA, 17 bp, Homo sapiens
ttttgtaataataaaga

SEQ ID NO: 3585212 - DNA, 19 bp, Homo sapiens
ttttgtaataataaagaat

SEQ ID NO: 3585213 - DNA, 13 bp, Homo sapiens
ttttgtatacaga

SEQ ID NO: 3585214 - DNA, 16 bp, Homo sapiens
ttttgtattttacatg

SEQ ID NO: 3585215 - DNA, 17 bp, Homo sapiens
ttttgtcatgttatgca

SEQ ID NO: 3585216 - DNA, 21 bp, Homo sapiens
ttttgtcatgttatgcagtga

SEQ ID NO: 3585217 - DNA, 21 bp, Homo sapiens
ttttgtgatgtcccaacttgt

SEQ ID NO: 3585218 - DNA, 15 bp, Homo sapiens
ttttgtggaggggag

SEQ ID NO: 3585219 - DNA, 16 bp, Homo sapiens
ttttgttagcaaagat

SEQ ID NO: 3585220 - DNA, 15 bp, Homo sapiens
ttttgttattaaaca

SEQ ID NO: 3585221 - DNA, 21 bp, Homo sapiens
ttttgttccacaagttaaata

SEQ ID NO: 3585222 - DNA, 13 bp, Homo sapiens
ttttgttggcata

SEQ ID NO: 3585223 - DNA, 17 bp, Homo sapiens
ttttgtttataaaaaac

SEQ ID NO: 3585224 - DNA, 20 bp, Homo sapiens
tttttaaaaaggtaaatggt

SEQ ID NO: 3585225 - DNA, 15 bp, Homo sapiens
tttttaaaatttaga

SEQ ID NO: 3585226 - DNA, 15 bp, Homo sapiens
tttttaaagaatgtt

SEQ ID NO: 3585227 - DNA, 17 bp, Homo sapiens
tttttaaataaaagcac

SEQ ID NO: 3585228 - DNA, 13 bp, Homo sapiens
tttttaagaaagt

SEQ ID NO: 3585229 - DNA, 15 bp, Homo sapiens
tttttaagaaagtaa

SEQ ID NO: 3585230 - DNA, 14 bp, Homo sapiens
tttttaatttaaac

SEQ ID NO: 3585231 - DNA, 13 bp, Homo sapiens
tttttaatttaat

SEQ ID NO: 3585232 - DNA, 20 bp, Homo sapiens
tttttaatttaatttttcct

SEQ ID NO: 3585233 - DNA, 17 bp, Homo sapiens
tttttacagcaaaagat

SEQ ID NO: 3585234 - DNA, 12 bp, Homo sapiens
tttttagaattt

SEQ ID NO: 3585235 - DNA, 14 bp, Homo sapiens
tttttaggcaaaga

SEQ ID NO: 3585236 - DNA, 21 bp, Homo sapiens
tttttagtggaagcttctaaa

SEQ ID NO: 3585237 - DNA, 12 bp, Homo sapiens
tttttatacact

SEQ ID NO: 3585238 - DNA, 17 bp, Homo sapiens
tttttattccctgccca

SEQ ID NO: 3585239 - DNA, 13 bp, Homo sapiens
tttttattgtaaa

SEQ ID NO: 3585240 - DNA, 14 bp, Homo sapiens
tttttatttgtaaa

SEQ ID NO: 3585241 - DNA, 20 bp, Homo sapiens
tttttcactttgtgtattaa

SEQ ID NO: 3585242 - DNA, 14 bp, Homo sapiens
tttttcagaccgaa

SEQ ID NO: 3585243 - DNA, 12 bp, Homo sapiens
tttttcatgttt

SEQ ID NO: 3585244 - DNA, 15 bp, Homo sapiens
tttttcatgttttag

SEQ ID NO: 3585245 - DNA, 12 bp, Homo sapiens
tttttcatttgt

SEQ ID NO: 3585246 - DNA, 21 bp, Homo sapiens
tttttccaactactaatagaa

SEQ ID NO: 3585247 - DNA, 23 bp, Homo sapiens
tttttccaactactaatagaata

SEQ ID NO: 3585248 - DNA, 17 bp, Homo sapiens
tttttccagctccgtgt

SEQ ID NO: 3585249 - DNA, 20 bp, Homo sapiens
tttttcccttctcttctaac

SEQ ID NO: 3585250 - DNA, 15 bp, Homo sapiens
tttttccgtaaatgt

SEQ ID NO: 3585251 - DNA, 16 bp, Homo sapiens
tttttctctaatgctt

SEQ ID NO: 3585252 - DNA, 13 bp, Homo sapiens
tttttctgataaa

SEQ ID NO: 3585253 - DNA, 21 bp, Homo sapiens
tttttcttcaaatgtttaaac

SEQ ID NO: 3585254 - DNA, 23 bp, Homo sapiens
tttttcttctattaatcaagaga

SEQ ID NO: 3585255 - DNA, 21 bp, Homo sapiens
tttttgaaccatccacttaca

SEQ ID NO: 3585256 - DNA, 21 bp, Homo sapiens
tttttgccagttttccctgga

SEQ ID NO: 3585257 - DNA, 15 bp, Homo sapiens
tttttggaagtgaaa

SEQ ID NO: 3585258 - DNA, 23 bp, Homo sapiens
tttttgggcagcaatttaaatgt

SEQ ID NO: 3585259 - DNA, 14 bp, Homo sapiens
tttttgttaggttt

SEQ ID NO: 3585260 - DNA, 16 bp, Homo sapiens
tttttgttattaaaca

SEQ ID NO: 3585261 - DNA, 22 bp, Homo sapiens
tttttgttccacaagttaaata

SEQ ID NO: 3585262 - DNA, 13 bp, Homo sapiens
tttttgtttgcag

SEQ ID NO: 3585263 - DNA, 17 bp, Homo sapiens
ttttttaaaaaatttgc

SEQ ID NO: 3585264 - DNA, 12 bp, Homo sapiens
ttttttacattt

SEQ ID NO: 3585265 - DNA, 13 bp, Homo sapiens
ttttttcatttgt

SEQ ID NO: 3585266 - DNA, 20 bp, Homo sapiens
ttttttccgtaaatgtctgc

SEQ ID NO: 3585267 - DNA, 12 bp, Homo sapiens
ttttttcttcta

SEQ ID NO: 3585268 - DNA, 21 bp, Homo sapiens
ttttttgtatagaccaaagca

SEQ ID NO: 3585269 - DNA, 13 bp, Homo sapiens
tttttttctaaaa

SEQ ID NO: 3585270 - DNA, 11 bp, Homo sapiens
aaaaaaagaaa

SEQ ID NO: 3585271 - DNA, 13 bp, Homo sapiens
aaaaaaagaaact

SEQ ID NO: 3585272 - DNA, 12 bp, Homo sapiens
aaaaaagaaaga

SEQ ID NO: 3585273 - DNA, 12 bp, Homo sapiens
aaaaaagagaca

SEQ ID NO: 3585274 - DNA, 12 bp, Homo sapiens
aaaaaagcctcc

SEQ ID NO: 3585275 - DNA, 13 bp, Homo sapiens
aaaaaagcctcca

SEQ ID NO: 3585276 - DNA, 17 bp, Homo sapiens
aaaaacaatttttgaaa

SEQ ID NO: 3585277 - DNA, 13 bp, Homo sapiens
aaaaacacagcaa

SEQ ID NO: 3585278 - DNA, 18 bp, Homo sapiens
aaaaacacagcaagggtg

SEQ ID NO: 3585279 - DNA, 15 bp, Homo sapiens
aaaaaccaacatcta

SEQ ID NO: 3585280 - DNA, 17 bp, Homo sapiens
aaaaacccacaattgaa

SEQ ID NO: 3585281 - DNA, 16 bp, Homo sapiens
aaaaacctattccact

SEQ ID NO: 3585282 - DNA, 15 bp, Homo sapiens
aaaaactctttattt

SEQ ID NO: 3585283 - DNA, 17 bp, Homo sapiens
aaaaactgttaccagat

SEQ ID NO: 3585284 - DNA, 12 bp, Homo sapiens
aaaaacttttga

SEQ ID NO: 3585285 - DNA, 15 bp, Homo sapiens
aaaaacttttgagga

SEQ ID NO: 3585286 - DNA, 15 bp, Homo sapiens
aaaaagagacatcca

SEQ ID NO: 3585287 - DNA, 16 bp, Homo sapiens
aaaaagattgccaatt

SEQ ID NO: 3585288 - DNA, 18 bp, Homo sapiens
aaaaagcaaatcagaaaa

SEQ ID NO: 3585289 - DNA, 20 bp, Homo sapiens
aaaaagcctccaagggtttc

SEQ ID NO: 3585290 - DNA, 15 bp, Homo sapiens
aaaaagctctgaaaa

SEQ ID NO: 3585291 - DNA, 14 bp, Homo sapiens
aaaaagtataaaat

SEQ ID NO: 3585292 - DNA, 17 bp, Homo sapiens
aaaaataccttctatgt

SEQ ID NO: 3585293 - DNA, 21 bp, Homo sapiens
aaaaatggttgatggaaaata

SEQ ID NO: 3585294 - DNA, 22 bp, Homo sapiens
aaaaatggttgatggaaaataa

SEQ ID NO: 3585295 - DNA, 21 bp, Homo sapiens
aaaaatgttacgtgaagaaat

SEQ ID NO: 3585296 - DNA, 15 bp, Homo sapiens
aaaaattagccgggc

SEQ ID NO: 3585297 - DNA, 11 bp, Homo sapiens
aaaaattgtta

SEQ ID NO: 3585298 - DNA, 22 bp, Homo sapiens
aaaaatttatacaccagcaatt

SEQ ID NO: 3585299 - DNA, 13 bp, Homo sapiens
aaaacaaaacaaa

SEQ ID NO: 3585300 - DNA, 14 bp, Homo sapiens
aaaacaaaacaaaa

SEQ ID NO: 3585301 - DNA, 20 bp, Homo sapiens
aaaacaaagcaattctttca

SEQ ID NO: 3585302 - DNA, 18 bp, Homo sapiens
aaaacaaagggaaaaaag

SEQ ID NO: 3585303 - DNA, 20 bp, Homo sapiens
aaacattcctccagcctccc

SEQ ID NO: 3585304 - DNA, 15 bp, Homo sapiens
aaaccaaaaactgaa

SEQ ID NO: 3585305 - DNA, 16 bp, Homo sapiens
aaaccaagccgtggct

SEQ ID NO: 3585306 - DNA, 21 bp, Homo sapiens
aaaccaatcttaaacataata

SEQ ID NO: 3585307 - DNA, 14 bp, Homo sapiens
aaaccaatgaaatt

SEQ ID NO: 3585308 - DNA, 15 bp, Homo sapiens
aaaccacagcagttg

SEQ ID NO: 3585309 - DNA, 17 bp, Homo sapiens
aaaccaggctttctaga

SEQ ID NO: 3585310 - DNA, 21 bp, Homo sapiens
aaaccataaaataaataatct

SEQ ID NO: 3585311 - DNA, 23 bp, Homo sapiens
aaaccatattttattgtattttg

SEQ ID NO: 3585312 - DNA, 19 bp, Homo sapiens
aaacccacgacctgtcctg

SEQ ID NO: 3585313 - DNA, 22 bp, Homo sapiens
aaacccagagggttgctggtcc

SEQ ID NO: 3585314 - DNA, 23 bp, Homo sapiens
aaacccagctgcaccccttcctg

SEQ ID NO: 3585315 - DNA, 15 bp, Homo sapiens
aaaccccagccccaa

SEQ ID NO: 3585316 - DNA, 15 bp, Homo sapiens
aaaccccctgcagcc

SEQ ID NO: 3585317 - DNA, 18 bp, Homo sapiens
aaacccctgtaggcctca

SEQ ID NO: 3585318 - DNA, 16 bp, Homo sapiens
aaacctatttttcctt

SEQ ID NO: 3585319 - DNA, 12 bp, Homo sapiens
aaacctccagcc

SEQ ID NO: 3585320 - DNA, 18 bp, Homo sapiens
aaacctctcctgacccct

SEQ ID NO: 3585321 - DNA, 16 bp, Homo sapiens
aaacctgacttcagtg

SEQ ID NO: 3585322 - DNA, 11 bp, Homo sapiens
aaacctgccaa

SEQ ID NO: 3585323 - DNA, 14 bp, Homo sapiens
aaacctgcttttca

SEQ ID NO: 3585324 - DNA, 15 bp, Homo sapiens
aaacctgcttttcaa

SEQ ID NO: 3585325 - DNA, 20 bp, Homo sapiens
aaacctgcttttcaatgtgt

SEQ ID NO: 3585326 - DNA, 16 bp, Homo sapiens
aaacctgggaaggcca

SEQ ID NO: 3585327 - DNA, 22 bp, Homo sapiens
aaacctggggtgaatacttatt

SEQ ID NO: 3585328 - DNA, 19 bp, Homo sapiens
aaaccttaaaagtaataaa

SEQ ID NO: 3585329 - DNA, 20 bp, Homo sapiens
aaaccttaaaagtaataaag

SEQ ID NO: 3585330 - DNA, 16 bp, Homo sapiens
aaaccttgctctcctc

SEQ ID NO: 3585331 - DNA, 12 bp, Homo sapiens
aaaccttttatt

SEQ ID NO: 3585332 - DNA, 14 bp, Homo sapiens
aaaccttttatttt

SEQ ID NO: 3585333 - DNA, 18 bp, Homo sapiens
aaaccttttatttttatt

SEQ ID NO: 3585334 - DNA, 23 bp, Homo sapiens
aaacgccacaaaaatagagaaaa

SEQ ID NO: 3585335 - DNA, 14 bp, Homo sapiens
aaacggattatttt

SEQ ID NO: 3585336 - DNA, 16 bp, Homo sapiens
aaacggattatttttt

SEQ ID NO: 3585337 - DNA, 21 bp, Homo sapiens
aaacggattattttttcagac

SEQ ID NO: 3585338 - DNA, 22 bp, Homo sapiens
aaacggattattttttcagacc

SEQ ID NO: 3585339 - DNA, 21 bp, Homo sapiens
aaacggcaacgtagcctgggc

SEQ ID NO: 3585340 - DNA, 23 bp, Homo sapiens
aaacggtttttttctttggctgc

SEQ ID NO: 3585341 - DNA, 14 bp, Homo sapiens
aaacgtttctcaaa

SEQ ID NO: 3585342 - DNA, 20 bp, Homo sapiens
aaactaaccttgaataaggc

SEQ ID NO: 3585343 - DNA, 17 bp, Homo sapiens
aaactaaggatttttca

SEQ ID NO: 3585344 - DNA, 15 bp, Homo sapiens
aaactatatataatg

SEQ ID NO: 3585345 - DNA, 17 bp, Homo sapiens
aaactatatataatgta

SEQ ID NO: 3585346 - DNA, 15 bp, Homo sapiens
aaactatctggccat

SEQ ID NO: 3585347 - DNA, 16 bp, Homo sapiens
aaactatcttggtgaa

SEQ ID NO: 3585348 - DNA, 14 bp, Homo sapiens
aaactcagatcctt

SEQ ID NO: 3585349 - DNA, 19 bp, Homo sapiens
aaactcaggcaaagaaaat

SEQ ID NO: 3585350 - DNA, 22 bp, Homo sapiens
aaactctgggtcttggccatga

SEQ ID NO: 3585351 - DNA, 18 bp, Homo sapiens
aaactctgttacactttt

SEQ ID NO: 3585352 - DNA, 20 bp, Homo sapiens
aaactctgttgcaagtgcaa

SEQ ID NO: 3585353 - DNA, 12 bp, Homo sapiens
aaactgacaatt

SEQ ID NO: 3585354 - DNA, 13 bp, Homo sapiens
aaactgacaattt

SEQ ID NO: 3585355 - DNA, 18 bp, Homo sapiens
aaactgacaattttacct

SEQ ID NO: 3585356 - DNA, 21 bp, Homo sapiens
aaactgagatgtgaacacatc

SEQ ID NO: 3585357 - DNA, 18 bp, Homo sapiens
aaactgaggaattttctt

SEQ ID NO: 3585358 - DNA, 14 bp, Homo sapiens
aaactgcacatcta

SEQ ID NO: 3585359 - DNA, 17 bp, Homo sapiens
aaactgcagcctctctg

SEQ ID NO: 3585360 - DNA, 14 bp, Homo sapiens
aaactgccagcaac

SEQ ID NO: 3585361 - DNA, 16 bp, Homo sapiens
aaactgctgtcgttgt

SEQ ID NO: 3585362 - DNA, 18 bp, Homo sapiens
aaactggatatttcaatc

SEQ ID NO: 3585363 - DNA, 19 bp, Homo sapiens
aaactggcttccccactcc

SEQ ID NO: 3585364 - DNA, 15 bp, Homo sapiens
aaactgggatgtaag

SEQ ID NO: 3585365 - DNA, 20 bp, Homo sapiens
aaactggtatgaataattgc

SEQ ID NO: 3585366 - DNA, 21 bp, Homo sapiens
aaactggtatgaataattgca

SEQ ID NO: 3585367 - DNA, 14 bp, Homo sapiens
aaactggtgcatga

SEQ ID NO: 3585368 - DNA, 15 bp, Homo sapiens
aaactggtttataat

SEQ ID NO: 3585369 - DNA, 16 bp, Homo sapiens
aaactgtttctttaaa

SEQ ID NO: 3585370 - DNA, 21 bp, Homo sapiens
aaacttaaaagtattcataca

SEQ ID NO: 3585371 - DNA, 15 bp, Homo sapiens
aaacttaaacaaaaa

SEQ ID NO: 3585372 - DNA, 12 bp, Homo sapiens
aaacttcaaagc

SEQ ID NO: 3585373 - DNA, 16 bp, Homo sapiens
aaacttcaaagctgaa

SEQ ID NO: 3585374 - DNA, 12 bp, Homo sapiens
aaacttcagcaa

SEQ ID NO: 3585375 - DNA, 16 bp, Homo sapiens
aaacttgctgagctgt

SEQ ID NO: 3585376 - DNA, 12 bp, Homo sapiens
aaactttctcat

SEQ ID NO: 3585377 - DNA, 18 bp, Homo sapiens
aaactttctcataagcac

SEQ ID NO: 3585378 - DNA, 15 bp, Homo sapiens
aaacttttttatttt

SEQ ID NO: 3585379 - DNA, 22 bp, Homo sapiens
aaactttttttctgtaccagtt

SEQ ID NO: 3585380 - DNA, 16 bp, Homo sapiens
aaagaaaagaaaattt

SEQ ID NO: 3585381 - DNA, 17 bp, Homo sapiens
aaagaaaatatttttgt

SEQ ID NO: 3585382 - DNA, 12 bp, Homo sapiens
aaagaaaatttt

SEQ ID NO: 3585383 - DNA, 19 bp, Homo sapiens
aaagaaaatttttgtagta

SEQ ID NO: 3585384 - DNA, 17 bp, Homo sapiens
aaagaaacaccagtgtt

SEQ ID NO: 3585385 - DNA, 16 bp, Homo sapiens
aaagaaacttttctga

SEQ ID NO: 3585386 - DNA, 10 bp, Homo sapiens
aaagaaagtg

SEQ ID NO: 3585387 - DNA, 13 bp, Homo sapiens
aaagaaagtgtat

SEQ ID NO: 3585388 - DNA, 16 bp, Homo sapiens
aaagaaagtgtatttg

SEQ ID NO: 3585389 - DNA, 15 bp, Homo sapiens
aaagaaatgtaaggg

SEQ ID NO: 3585390 - DNA, 18 bp, Homo sapiens
aaagaacaaacaaaactt

SEQ ID NO: 3585391 - DNA, 10 bp, Homo sapiens
aaagaagaaa

SEQ ID NO: 3585392 - DNA, 15 bp, Homo sapiens
aaagaagaggagaaa

SEQ ID NO: 3585393 - DNA, 19 bp, Homo sapiens
aaagaagatagctctctga

SEQ ID NO: 3585394 - DNA, 19 bp, Homo sapiens
aaagaagggggccctgcta

SEQ ID NO: 3585395 - DNA, 15 bp, Homo sapiens
aaagaagtggagaca

SEQ ID NO: 3585396 - DNA, 15 bp, Homo sapiens
aaagaatctgtattc

SEQ ID NO: 3585397 - DNA, 13 bp, Homo sapiens
aaagaatgtaaag

SEQ ID NO: 3585398 - DNA, 22 bp, Homo sapiens
aaagacagcagacaaaatgaaa

SEQ ID NO: 3585399 - DNA, 18 bp, Homo sapiens
aaagacagggtcttgcta

SEQ ID NO: 3585400 - DNA, 17 bp, Homo sapiens
aaagacattagagaaaa

SEQ ID NO: 3585401 - DNA, 15 bp, Homo sapiens
aaagacattgacagc

SEQ ID NO: 3585402 - DNA, 20 bp, Homo sapiens
aaagacattgacagcaattc

SEQ ID NO: 3585403 - DNA, 18 bp, Homo sapiens
aaagactattcaaacagt

SEQ ID NO: 3585404 - DNA, 21 bp, Homo sapiens
aaagactattcaaacagtctc

SEQ ID NO: 3585405 - DNA, 13 bp, Homo sapiens
aaagactccaaag

SEQ ID NO: 3585406 - DNA, 20 bp, Homo sapiens
aaagacttctcaaagagaat

SEQ ID NO: 3585407 - DNA, 19 bp, Homo sapiens
aaagacttgtaatattttt

SEQ ID NO: 3585408 - DNA, 15 bp, Homo sapiens
aaagagaagatgcct

SEQ ID NO: 3585409 - DNA, 20 bp, Homo sapiens
aaagaggaatggccctcatt

SEQ ID NO: 3585410 - DNA, 20 bp, Homo sapiens
aaagaggcagcttgaaactg

SEQ ID NO: 3585411 - DNA, 19 bp, Homo sapiens
aaagaggtgaaaatgaaga

SEQ ID NO: 3585412 - DNA, 20 bp, Homo sapiens
aaagagtccattgtttaaaa

SEQ ID NO: 3585413 - DNA, 19 bp, Homo sapiens
aaagatctgtcctcagcct

SEQ ID NO: 3585414 - DNA, 19 bp, Homo sapiens
aaagatgaaaaagaataaa

SEQ ID NO: 3585415 - DNA, 17 bp, Homo sapiens
aaagatgaaaatatttg

SEQ ID NO: 3585416 - DNA, 22 bp, Homo sapiens
aaagatggctgtgcctctgcct

SEQ ID NO: 3585417 - DNA, 16 bp, Homo sapiens
aaagatgttctggata

SEQ ID NO: 3585418 - DNA, 14 bp, Homo sapiens
aaagattttgtttt

SEQ ID NO: 3585419 - DNA, 12 bp, Homo sapiens
aaagcaaaatac

SEQ ID NO: 3585420 - DNA, 15 bp, Homo sapiens
aaagcaaatcagaaa

SEQ ID NO: 3585421 - DNA, 14 bp, Homo sapiens
aaagcaacactttt

SEQ ID NO: 3585422 - DNA, 23 bp, Homo sapiens
aaagcaatttactgatgagagaa

SEQ ID NO: 3585423 - DNA, 13 bp, Homo sapiens
aaagcacaaagga

SEQ ID NO: 3585424 - DNA, 15 bp, Homo sapiens
aaagcacaagactgg

SEQ ID NO: 3585425 - DNA, 19 bp, Homo sapiens
aaagcacaagactggccca

SEQ ID NO: 3585426 - DNA, 19 bp, Homo sapiens
aaagcagagcctcctggga

SEQ ID NO: 3585427 - DNA, 18 bp, Homo sapiens
aaagcagctctcccctca

SEQ ID NO: 3585428 - DNA, 18 bp, Homo sapiens
aaagcagttcctgtccca

SEQ ID NO: 3585429 - DNA, 21 bp, Homo sapiens
aaagcagttcctgtcccacat

SEQ ID NO: 3585430 - DNA, 12 bp, Homo sapiens
aaagcatccctc

SEQ ID NO: 3585431 - DNA, 15 bp, Homo sapiens
aaagcatccctcacc

SEQ ID NO: 3585432 - DNA, 17 bp, Homo sapiens
aaagccacagcagagca

SEQ ID NO: 3585433 - DNA, 18 bp, Homo sapiens
aaagccacagcagagcat

SEQ ID NO: 3585434 - DNA, 12 bp, Homo sapiens
aaagccacatct

SEQ ID NO: 3585435 - DNA, 17 bp, Homo sapiens
aaagccataacttgaaa

SEQ ID NO: 3585436 - DNA, 15 bp, Homo sapiens
aaagcctccaagggt

SEQ ID NO: 3585437 - DNA, 20 bp, Homo sapiens
aaagcctcctgccccctgcc

SEQ ID NO: 3585438 - DNA, 22 bp, Homo sapiens
aaagcctctggccgtcacacgt

SEQ ID NO: 3585439 - DNA, 17 bp, Homo sapiens
aaagccttaagcaaatt

SEQ ID NO: 3585440 - DNA, 21 bp, Homo sapiens
aaaacaaagggaaaaaagagt

SEQ ID NO: 3585441 - DNA, 12 bp, Homo sapiens
aaaacacagcaa

SEQ ID NO: 3585442 - DNA, 13 bp, Homo sapiens
aaaacacagcaag

SEQ ID NO: 3585443 - DNA, 21 bp, Homo sapiens
aaaacactaaaaataaaaatg

SEQ ID NO: 3585444 - DNA, 22 bp, Homo sapiens
aaaacagctttgtctccaaaga

SEQ ID NO: 3585445 - DNA, 17 bp, Homo sapiens
aaaacattttaaatgaa

SEQ ID NO: 3585446 - DNA, 18 bp, Homo sapiens
aaaacattttaaatgaaa

SEQ ID NO: 3585447 - DNA, 14 bp, Homo sapiens
aaaaccaggctttc

SEQ ID NO: 3585448 - DNA, 12 bp, Homo sapiens
aaaaccatattt

SEQ ID NO: 3585449 - DNA, 22 bp, Homo sapiens
aaaaccatattttattgtattt

SEQ ID NO: 3585450 - DNA, 21 bp, Homo sapiens
aaaacccacggtttttctttt

SEQ ID NO: 3585451 - DNA, 21 bp, Homo sapiens
aaaacctagtacattactaaa

SEQ ID NO: 3585452 - DNA, 19 bp, Homo sapiens
aaaaccttaaaagtaataa

SEQ ID NO: 3585453 - DNA, 17 bp, Homo sapiens
aaaacgcgtctgcctgg

SEQ ID NO: 3585454 - DNA, 12 bp, Homo sapiens
aaaactactttt

SEQ ID NO: 3585455 - DNA, 13 bp, Homo sapiens
aaaactatgtatt

SEQ ID NO: 3585456 - DNA, 13 bp, Homo sapiens
aaaactctgggtc

SEQ ID NO: 3585457 - DNA, 23 bp, Homo sapiens
aaaactgaaagtgaaagtccaga

SEQ ID NO: 3585458 - DNA, 16 bp, Homo sapiens
aaaactgacagatgct

SEQ ID NO: 3585459 - DNA, 22 bp, Homo sapiens
aaaactgggattaagaaacctt

SEQ ID NO: 3585460 - DNA, 21 bp, Homo sapiens
aaaactgtgatttttatcaca

SEQ ID NO: 3585461 - DNA, 16 bp, Homo sapiens
aaaacttaaaagtatt

SEQ ID NO: 3585462 - DNA, 14 bp, Homo sapiens
aaaacttttgagga

SEQ ID NO: 3585463 - DNA, 17 bp, Homo sapiens
aaaagaaaacttaaaga

SEQ ID NO: 3585464 - DNA, 13 bp, Homo sapiens
aaaagaaactttt

SEQ ID NO: 3585465 - DNA, 17 bp, Homo sapiens
aaaagaaacttttctga

SEQ ID NO: 3585466 - DNA, 10 bp, Homo sapiens
aaaagaaaga

SEQ ID NO: 3585467 - DNA, 17 bp, Homo sapiens
aaaagaacaatattgac

SEQ ID NO: 3585468 - DNA, 15 bp, Homo sapiens
aaaagaagagtttta

SEQ ID NO: 3585469 - DNA, 12 bp, Homo sapiens
aaaagaatattt

SEQ ID NO: 3585470 - DNA, 13 bp, Homo sapiens
aaaagacagctgg

SEQ ID NO: 3585471 - DNA, 13 bp, Homo sapiens
aaaagacagggct

SEQ ID NO: 3585472 - DNA, 13 bp, Homo sapiens
aaaagacataaaa

SEQ ID NO: 3585473 - DNA, 19 bp, Homo sapiens
aaaagacataaaacagaat

SEQ ID NO: 3585474 - DNA, 15 bp, Homo sapiens
aaaagacattagaga

SEQ ID NO: 3585475 - DNA, 16 bp, Homo sapiens
aaaagacattagagaa

SEQ ID NO: 3585476 - DNA, 22 bp, Homo sapiens
aaaagatacaaaagctttttaa

SEQ ID NO: 3585477 - DNA, 22 bp, Homo sapiens
aaaagattcttcttaaaagttt

SEQ ID NO: 3585478 - DNA, 9 bp, Homo sapiens
aaaagcaaa

SEQ ID NO: 3585479 - DNA, 14 bp, Homo sapiens
aaaagcaaatcaga

SEQ ID NO: 3585480 - DNA, 21 bp, Homo sapiens
aaaagcaaatcagaaaaccca

SEQ ID NO: 3585481 - DNA, 21 bp, Homo sapiens
aaaagcacactcatcccctca

SEQ ID NO: 3585482 - DNA, 16 bp, Homo sapiens
aaaagcagctctcccc

SEQ ID NO: 3585483 - DNA, 14 bp, Homo sapiens
aaaagctaagagaa

SEQ ID NO: 3585484 - DNA, 14 bp, Homo sapiens
aaaagctctgaaaa

SEQ ID NO: 3585485 - DNA, 18 bp, Homo sapiens
aaaagctttttaaaattt

SEQ ID NO: 3585486 - DNA, 17 bp, Homo sapiens
aaaaggacatcagcaaa

SEQ ID NO: 3585487 - DNA, 19 bp, Homo sapiens
aaaaggagccttttgctct

SEQ ID NO: 3585488 - DNA, 17 bp, Homo sapiens
aaaaggatgtataaatt

SEQ ID NO: 3585489 - DNA, 23 bp, Homo sapiens
aaaaggcaggtgcttttggcaga

SEQ ID NO: 3585490 - DNA, 14 bp, Homo sapiens
aaaaggcccatgta

SEQ ID NO: 3585491 - DNA, 21 bp, Homo sapiens
aaaaggtgataggtaaatttt

SEQ ID NO: 3585492 - DNA, 22 bp, Homo sapiens
aaaagtaatgacttagaaactg

SEQ ID NO: 3585493 - DNA, 21 bp, Homo sapiens
aaaagtacatatttattttct

SEQ ID NO: 3585494 - DNA, 15 bp, Homo sapiens
aaaagtcacttacta

SEQ ID NO: 3585495 - DNA, 15 bp, Homo sapiens
aaaagtctacctgtg

SEQ ID NO: 3585496 - DNA, 21 bp, Homo sapiens
aaaagtgttgctgattgtcaa

SEQ ID NO: 3585497 - DNA, 12 bp, Homo sapiens
aaaagttattta

SEQ ID NO: 3585498 - DNA, 14 bp, Homo sapiens
aaaagttatttatg

SEQ ID NO: 3585499 - DNA, 13 bp, Homo sapiens
aaaagttgttctt

SEQ ID NO: 3585500 - DNA, 22 bp, Homo sapiens
aaaagtttattgtttgatgttt

SEQ ID NO: 3585501 - DNA, 20 bp, Homo sapiens
aaaagtttctaatgttattt

SEQ ID NO: 3585502 - DNA, 12 bp, Homo sapiens
aaaataaacatc

SEQ ID NO: 3585503 - DNA, 17 bp, Homo sapiens
aaaataaatatatctac

SEQ ID NO: 3585504 - DNA, 20 bp, Homo sapiens
aaaataattttaaacaaagg

SEQ ID NO: 3585505 - DNA, 13 bp, Homo sapiens
aaaataattttgt

SEQ ID NO: 3585506 - DNA, 22 bp, Homo sapiens
aaaatacctctaataaacactg

SEQ ID NO: 3585507 - DNA, 24 bp, Homo sapiens
aaaataccttctatgtattagtgt

SEQ ID NO: 3585508 - DNA, 17 bp, Homo sapiens
aaaatagaaaaagtgga

SEQ ID NO: 3585509 - DNA, 16 bp, Homo sapiens
aaaatagagcttttaa

SEQ ID NO: 3585510 - DNA, 15 bp, Homo sapiens
aaaatatattgaata

SEQ ID NO: 3585511 - DNA, 15 bp, Homo sapiens
aaaatattaacatat

SEQ ID NO: 3585512 - DNA, 15 bp, Homo sapiens
aaaatattcctgcat

SEQ ID NO: 3585513 - DNA, 19 bp, Homo sapiens
aaaatattgttttacaata

SEQ ID NO: 3585514 - DNA, 15 bp, Homo sapiens
aaaatatttgtacat

SEQ ID NO: 3585515 - DNA, 16 bp, Homo sapiens
aaaatcaaaacaagtg

SEQ ID NO: 3585516 - DNA, 24 bp, Homo sapiens
aaaatcaagagtgagatgtagaaa

SEQ ID NO: 3585517 - DNA, 15 bp, Homo sapiens
aaaatcaccatcttt

SEQ ID NO: 3585518 - DNA, 14 bp, Homo sapiens
aaaatcagaacaaa

SEQ ID NO: 3585519 - DNA, 16 bp, Homo sapiens
aaaatccaaaacttct

SEQ ID NO: 3585520 - DNA, 13 bp, Homo sapiens
aaaatccttgctt

SEQ ID NO: 3585521 - DNA, 20 bp, Homo sapiens
aaaatccttgcttatgacat

SEQ ID NO: 3585522 - DNA, 15 bp, Homo sapiens
aaaatcttcactttc

SEQ ID NO: 3585523 - DNA, 18 bp, Homo sapiens
aaaatgaaggaattacat

SEQ ID NO: 3585524 - DNA, 18 bp, Homo sapiens
aaaatgaggatccagggc

SEQ ID NO: 3585525 - DNA, 19 bp, Homo sapiens
aaaatgatattgttatata

SEQ ID NO: 3585526 - DNA, 19 bp, Homo sapiens
aaaatgcattgaaagaatt

SEQ ID NO: 3585527 - DNA, 20 bp, Homo sapiens
aaaatgcattgaaagaatta

SEQ ID NO: 3585528 - DNA, 16 bp, Homo sapiens
aaaatgctcaatttca

SEQ ID NO: 3585529 - DNA, 13 bp, Homo sapiens
aaaatggaaattt

SEQ ID NO: 3585530 - DNA, 19 bp, Homo sapiens
aaaatggccatttgctttt

SEQ ID NO: 3585531 - DNA, 17 bp, Homo sapiens
aaaatgtcctgcctttt

SEQ ID NO: 3585532 - DNA, 17 bp, Homo sapiens
aaaatgtctgtaataat

SEQ ID NO: 3585533 - DNA, 18 bp, Homo sapiens
aaaatgtctgtaataata

SEQ ID NO: 3585534 - DNA, 21 bp, Homo sapiens
aaaatgtgaaatgcttttata

SEQ ID NO: 3585535 - DNA, 18 bp, Homo sapiens
aaaatgttaaaacataaa

SEQ ID NO: 3585536 - DNA, 16 bp, Homo sapiens
aaaatgttcagaaggt

SEQ ID NO: 3585537 - DNA, 20 bp, Homo sapiens
aaaattgcttctaaaacaat

SEQ ID NO: 3585538 - DNA, 17 bp, Homo sapiens
aaaattgttaatatgca

SEQ ID NO: 3585539 - DNA, 12 bp, Homo sapiens
aaaatttataag

SEQ ID NO: 3585540 - DNA, 19 bp, Homo sapiens
aaaattttagctcttccca

SEQ ID NO: 3585541 - DNA, 13 bp, Homo sapiens
aaacaaaaacact

SEQ ID NO: 3585542 - DNA, 16 bp, Homo sapiens
aaacaaaatcctcagg

SEQ ID NO: 3585543 - DNA, 12 bp, Homo sapiens
aaacaaaatgaa

SEQ ID NO: 3585544 - DNA, 16 bp, Homo sapiens
aaacaaagcaattctt

SEQ ID NO: 3585545 - DNA, 21 bp, Homo sapiens
aaacaaagcagctttaaaaaa

SEQ ID NO: 3585546 - DNA, 20 bp, Homo sapiens
aaacaaaggcctaattctat

SEQ ID NO: 3585547 - DNA, 17 bp, Homo sapiens
aaacaaagggaaaaaag

SEQ ID NO: 3585548 - DNA, 17 bp, Homo sapiens
aaacaaaggttgagatg

SEQ ID NO: 3585549 - DNA, 15 bp, Homo sapiens
aaacaataagaacaa

SEQ ID NO: 3585550 - DNA, 17 bp, Homo sapiens
aaacaatcccaatcttt

SEQ ID NO: 3585551 - DNA, 15 bp, Homo sapiens
aaacacaaaaaaaat

SEQ ID NO: 3585552 - DNA, 12 bp, Homo sapiens
aaacacagcaag

SEQ ID NO: 3585553 - DNA, 18 bp, Homo sapiens
aaacacaggctgtcctta

SEQ ID NO: 3585554 - DNA, 12 bp, Homo sapiens
aaacaccagtgt

SEQ ID NO: 3585555 - DNA, 22 bp, Homo sapiens
aaacactgcaaattttaactgt

SEQ ID NO: 3585556 - DNA, 20 bp, Homo sapiens
aaacactgttttatagaaaa

SEQ ID NO: 3585557 - DNA, 13 bp, Homo sapiens
aaacagaaacaaa

SEQ ID NO: 3585558 - DNA, 20 bp, Homo sapiens
aaacagaattttccatttat

SEQ ID NO: 3585559 - DNA, 22 bp, Homo sapiens
aaacagagtccaatttaaggaa

SEQ ID NO: 3585560 - DNA, 18 bp, Homo sapiens
aaacagagtggcctccct

SEQ ID NO: 3585561 - DNA, 22 bp, Homo sapiens
aaacagagtggcctccctgctg

SEQ ID NO: 3585562 - DNA, 20 bp, Homo sapiens
aaacagattcaggccagccc

SEQ ID NO: 3585563 - DNA, 21 bp, Homo sapiens
aaacagattcaggccagccca

SEQ ID NO: 3585564 - DNA, 22 bp, Homo sapiens
aaacagattcaggccagcccag

SEQ ID NO: 3585565 - DNA, 17 bp, Homo sapiens
aaacagatttggaaaga

SEQ ID NO: 3585566 - DNA, 14 bp, Homo sapiens
aaacagcatgaata

SEQ ID NO: 3585567 - DNA, 11 bp, Homo sapiens
aaacagctcag

SEQ ID NO: 3585568 - DNA, 13 bp, Homo sapiens
aaacagctcagcc

SEQ ID NO: 3585569 - DNA, 23 bp, Homo sapiens
aaacagctttgtctccaaagaag

SEQ ID NO: 3585570 - DNA, 15 bp, Homo sapiens
aaacagggtctggga

SEQ ID NO: 3585571 - DNA, 15 bp, Homo sapiens
aaacagtctcaggaa

SEQ ID NO: 3585572 - DNA, 16 bp, Homo sapiens
aaacagtctcccttcc

SEQ ID NO: 3585573 - DNA, 15 bp, Homo sapiens
aaacataatgaaaat

SEQ ID NO: 3585574 - DNA, 16 bp, Homo sapiens
aaacatattcaaggag

SEQ ID NO: 3585575 - DNA, 14 bp, Homo sapiens
aaacatcaaataaa

SEQ ID NO: 3585576 - DNA, 16 bp, Homo sapiens
aaacatcaaataaatt

SEQ ID NO: 3585577 - DNA, 17 bp, Homo sapiens
aaacattaatatttacc

SEQ ID NO: 3585578 - DNA, 19 bp, Homo sapiens
aagcctccaagggtttcga

SEQ ID NO: 3585579 - DNA, 14 bp, Homo sapiens
aagcctccccagct

SEQ ID NO: 3585580 - DNA, 14 bp, Homo sapiens
aagcctcctgcccc

SEQ ID NO: 3585581 - DNA, 19 bp, Homo sapiens
aagcctctggccgtcacac

SEQ ID NO: 3585582 - DNA, 21 bp, Homo sapiens
aagcctgaaggggcgtctgtt

SEQ ID NO: 3585583 - DNA, 15 bp, Homo sapiens
aagccttacaaaggg

SEQ ID NO: 3585584 - DNA, 12 bp, Homo sapiens
aagcgggcagcc

SEQ ID NO: 3585585 - DNA, 19 bp, Homo sapiens
aagctaggccccagaggcc

SEQ ID NO: 3585586 - DNA, 20 bp, Homo sapiens
aagctaggccccagaggccc

SEQ ID NO: 3585587 - DNA, 18 bp, Homo sapiens
aagctataaattcctctt

SEQ ID NO: 3585588 - DNA, 21 bp, Homo sapiens
aagctataaattcctctttgc

SEQ ID NO: 3585589 - DNA, 18 bp, Homo sapiens
aagctcaaataaaaataa

SEQ ID NO: 3585590 - DNA, 22 bp, Homo sapiens
aagctcattcccaacgtgcaaa

SEQ ID NO: 3585591 - DNA, 20 bp, Homo sapiens
aagctccatctccactccag

SEQ ID NO: 3585592 - DNA, 16 bp, Homo sapiens
aagctcctcctccctg

SEQ ID NO: 3585593 - DNA, 19 bp, Homo sapiens
aagctcctcctccctgcat

SEQ ID NO: 3585594 - DNA, 21 bp, Homo sapiens
aagctcctcctccctgcatct

SEQ ID NO: 3585595 - DNA, 21 bp, Homo sapiens
aagctcctctccccagcccag

SEQ ID NO: 3585596 - DNA, 16 bp, Homo sapiens
aagctctccgagctct

SEQ ID NO: 3585597 - DNA, 17 bp, Homo sapiens
aagctctccgagctctg

SEQ ID NO: 3585598 - DNA, 15 bp, Homo sapiens
aagctctgaaaacaa

SEQ ID NO: 3585599 - DNA, 14 bp, Homo sapiens
aagctgaatatttt

SEQ ID NO: 3585600 - DNA, 21 bp, Homo sapiens
aagctgccatttcccttctgg

SEQ ID NO: 3585601 - DNA, 16 bp, Homo sapiens
aagctgcctcaaggaa

SEQ ID NO: 3585602 - DNA, 12 bp, Homo sapiens
aagctgtccctg

SEQ ID NO: 3585603 - DNA, 17 bp, Homo sapiens
aagctgtccctgcaggg

SEQ ID NO: 3585604 - DNA, 16 bp, Homo sapiens
aagcttcatccacagc

SEQ ID NO: 3585605 - DNA, 15 bp, Homo sapiens
aagcttccatgatgc

SEQ ID NO: 3585606 - DNA, 16 bp, Homo sapiens
aagcttccatgatgca

SEQ ID NO: 3585607 - DNA, 20 bp, Homo sapiens
aagcttccatgatgcacagt

SEQ ID NO: 3585608 - DNA, 13 bp, Homo sapiens
aagcttccttggc

SEQ ID NO: 3585609 - DNA, 15 bp, Homo sapiens
aagcttctaaatggt

SEQ ID NO: 3585610 - DNA, 17 bp, Homo sapiens
aagcttggttctgtgaa

SEQ ID NO: 3585611 - DNA, 22 bp, Homo sapiens
aagcttgttgaaaacccagact

SEQ ID NO: 3585612 - DNA, 23 bp, Homo sapiens
aagcttttatttaacagtgcaaa

SEQ ID NO: 3585613 - DNA, 14 bp, Homo sapiens
aagctttttaaaat

SEQ ID NO: 3585614 - DNA, 20 bp, Homo sapiens
aagctttttatttaggcttt

SEQ ID NO: 3585615 - DNA, 17 bp, Homo sapiens
aaggaaaatatttcatt

SEQ ID NO: 3585616 - DNA, 13 bp, Homo sapiens
aaggaaagaaggg

SEQ ID NO: 3585617 - DNA, 13 bp, Homo sapiens
aaggaaattttac

SEQ ID NO: 3585618 - DNA, 18 bp, Homo sapiens
aaggaacaaaaattacaa

SEQ ID NO: 3585619 - DNA, 14 bp, Homo sapiens
aaggaacactgaca

SEQ ID NO: 3585620 - DNA, 17 bp, Homo sapiens
aaggaagagctatatcc

SEQ ID NO: 3585621 - DNA, 23 bp, Homo sapiens
aaggaattacattttatatgtga

SEQ ID NO: 3585622 - DNA, 14 bp, Homo sapiens
aaggaatttcttaa

SEQ ID NO: 3585623 - DNA, 13 bp, Homo sapiens
aaggacactagaa

SEQ ID NO: 3585624 - DNA, 15 bp, Homo sapiens
aaggacatcagcaaa

SEQ ID NO: 3585625 - DNA, 20 bp, Homo sapiens
aaggagaatggcatggcagg

SEQ ID NO: 3585626 - DNA, 13 bp, Homo sapiens
aaggagcatcctt

SEQ ID NO: 3585627 - DNA, 20 bp, Homo sapiens
aaggagccttttgctctctg

SEQ ID NO: 3585628 - DNA, 16 bp, Homo sapiens
aaggaggccaaccagc

SEQ ID NO: 3585629 - DNA, 18 bp, Homo sapiens
aaggaggccaaccagccc

SEQ ID NO: 3585630 - DNA, 19 bp, Homo sapiens
aaggaggccaaccagcccg

SEQ ID NO: 3585631 - DNA, 20 bp, Homo sapiens
aaggaggccaaccagcccga

SEQ ID NO: 3585632 - DNA, 15 bp, Homo sapiens
aaggagtgtaaaatg

SEQ ID NO: 3585633 - DNA, 17 bp, Homo sapiens
aaggagtgtaaaatgta

SEQ ID NO: 3585634 - DNA, 22 bp, Homo sapiens
aaggagttacagggaagtggtc

SEQ ID NO: 3585635 - DNA, 19 bp, Homo sapiens
aaggatagatgctggccca

SEQ ID NO: 3585636 - DNA, 14 bp, Homo sapiens
aaggatagtgtgaa

SEQ ID NO: 3585637 - DNA, 16 bp, Homo sapiens
aaggatctttgtggcc

SEQ ID NO: 3585638 - DNA, 18 bp, Homo sapiens
aaggatctttgtggccaa

SEQ ID NO: 3585639 - DNA, 20 bp, Homo sapiens
aaggatctttgtggccaagg

SEQ ID NO: 3585640 - DNA, 18 bp, Homo sapiens
aaggattacagaaactga

SEQ ID NO: 3585641 - DNA, 19 bp, Homo sapiens
aaggattttaccaaagcat

SEQ ID NO: 3585642 - DNA, 18 bp, Homo sapiens
aaggatttttcaagagat

SEQ ID NO: 3585643 - DNA, 16 bp, Homo sapiens
aaggcaaggccctgcc

SEQ ID NO: 3585644 - DNA, 13 bp, Homo sapiens
aaggcaaggctga

SEQ ID NO: 3585645 - DNA, 21 bp, Homo sapiens
aaggcaatggtttcacatggt

SEQ ID NO: 3585646 - DNA, 17 bp, Homo sapiens
aaggcacagtgggagct

SEQ ID NO: 3585647 - DNA, 16 bp, Homo sapiens
aaggcagtggcagggg

SEQ ID NO: 3585648 - DNA, 13 bp, Homo sapiens
aaggccagcagct

SEQ ID NO: 3585649 - DNA, 21 bp, Homo sapiens
aaggcccacgagcttgttctt

SEQ ID NO: 3585650 - DNA, 21 bp, Homo sapiens
aaggcctgcttgactttccag

SEQ ID NO: 3585651 - DNA, 22 bp, Homo sapiens
aaggcctgcttgactttccaga

SEQ ID NO: 3585652 - DNA, 22 bp, Homo sapiens
aaggcgtagcatcatcctgcag

SEQ ID NO: 3585653 - DNA, 14 bp, Homo sapiens
aaggctctcccctc

SEQ ID NO: 3585654 - DNA, 23 bp, Homo sapiens
aaggctgctcacaagttctattt

SEQ ID NO: 3585655 - DNA, 20 bp, Homo sapiens
aaggctggtaagagaagtga

SEQ ID NO: 3585656 - DNA, 21 bp, Homo sapiens
aaggctggtgaggtcctggtg

SEQ ID NO: 3585657 - DNA, 13 bp, Homo sapiens
aagggaaaaaaga

SEQ ID NO: 3585658 - DNA, 14 bp, Homo sapiens
aagggaaaaaagag

SEQ ID NO: 3585659 - DNA, 22 bp, Homo sapiens
aagggaccatctgctgcagtta

SEQ ID NO: 3585660 - DNA, 13 bp, Homo sapiens
aagggagaaaaaa

SEQ ID NO: 3585661 - DNA, 9 bp, Homo sapiens
aagggagcc

SEQ ID NO: 3585662 - DNA, 11 bp, Homo sapiens
aagggagccaa

SEQ ID NO: 3585663 - DNA, 18 bp, Homo sapiens
aagggagccaagggatgg

SEQ ID NO: 3585664 - DNA, 17 bp, Homo sapiens
aagggatggcaagatgt

SEQ ID NO: 3585665 - DNA, 16 bp, Homo sapiens
aagggcaaggggtgag

SEQ ID NO: 3585666 - DNA, 14 bp, Homo sapiens
aagggcagtgccca

SEQ ID NO: 3585667 - DNA, 12 bp, Homo sapiens
aagggccagagc

SEQ ID NO: 3585668 - DNA, 13 bp, Homo sapiens
aagggccagagcc

SEQ ID NO: 3585669 - DNA, 17 bp, Homo sapiens
aagggccagagccaggg

SEQ ID NO: 3585670 - DNA, 17 bp, Homo sapiens
aagggccctggcacccc

SEQ ID NO: 3585671 - DNA, 22 bp, Homo sapiens
aagggctggcacttttttaaat

SEQ ID NO: 3585672 - DNA, 23 bp, Homo sapiens
aagggctttggttccttctctgg

SEQ ID NO: 3585673 - DNA, 17 bp, Homo sapiens
aaggggaggcacacttt

SEQ ID NO: 3585674 - DNA, 20 bp, Homo sapiens
aagggggacttaaactgctg

SEQ ID NO: 3585675 - DNA, 13 bp, Homo sapiens
aagggggccctgc

SEQ ID NO: 3585676 - DNA, 14 bp, Homo sapiens
aagggggctgctgc

SEQ ID NO: 3585677 - DNA, 11 bp, Homo sapiens
aagggtcaggg

SEQ ID NO: 3585678 - DNA, 23 bp, Homo sapiens
aagggtctccgaaatgctgtctt

SEQ ID NO: 3585679 - DNA, 22 bp, Homo sapiens
aagggtctctctccaggtcagc

SEQ ID NO: 3585680 - DNA, 14 bp, Homo sapiens
aagggtttcgactg

SEQ ID NO: 3585681 - DNA, 19 bp, Homo sapiens
aagggtttcgactggtcca

SEQ ID NO: 3585682 - DNA, 22 bp, Homo sapiens
aaggtactttcatattttaaac

SEQ ID NO: 3585683 - DNA, 21 bp, Homo sapiens
aaggtagaacaaagaaaatgt

SEQ ID NO: 3585684 - DNA, 13 bp, Homo sapiens
aaggtagaatgtt

SEQ ID NO: 3585685 - DNA, 18 bp, Homo sapiens
aaggtattaaattgatgt

SEQ ID NO: 3585686 - DNA, 17 bp, Homo sapiens
aaggtcaaaactgaagc

SEQ ID NO: 3585687 - DNA, 23 bp, Homo sapiens
aaggtcacaacccttctctgttg

SEQ ID NO: 3585688 - DNA, 21 bp, Homo sapiens
aaggtctcctaaaactgggat

SEQ ID NO: 3585689 - DNA, 13 bp, Homo sapiens
aaggtgaggtgaa

SEQ ID NO: 3585690 - DNA, 17 bp, Homo sapiens
aaggtgcactccagact

SEQ ID NO: 3585691 - DNA, 13 bp, Homo sapiens
aaggtgctaacat

SEQ ID NO: 3585692 - DNA, 15 bp, Homo sapiens
aaggtggcagcttgt

SEQ ID NO: 3585693 - DNA, 20 bp, Homo sapiens
aaggtggcagcttgtgaaga

SEQ ID NO: 3585694 - DNA, 12 bp, Homo sapiens
aaggtggcttct

SEQ ID NO: 3585695 - DNA, 16 bp, Homo sapiens
aaggtggtgtgatctt

SEQ ID NO: 3585696 - DNA, 15 bp, Homo sapiens
aaggtgtgaggagag

SEQ ID NO: 3585697 - DNA, 16 bp, Homo sapiens
aaggtttaaagtttga

SEQ ID NO: 3585698 - DNA, 20 bp, Homo sapiens
aaggtttaggctggtggccc

SEQ ID NO: 3585699 - DNA, 21 bp, Homo sapiens
aaggtttgcagatattctcta

SEQ ID NO: 3585700 - DNA, 12 bp, Homo sapiens
aagtaaaacaaa

SEQ ID NO: 3585701 - DNA, 17 bp, Homo sapiens
aagtaaaacaaatgaaa

SEQ ID NO: 3585702 - DNA, 16 bp, Homo sapiens
aagtaaaaccacagca

SEQ ID NO: 3585703 - DNA, 16 bp, Homo sapiens
aagtaagcatttccag

SEQ ID NO: 3585704 - DNA, 17 bp, Homo sapiens
aagtaagtttatccaaa

SEQ ID NO: 3585705 - DNA, 18 bp, Homo sapiens
aagtaataaagagaaata

SEQ ID NO: 3585706 - DNA, 15 bp, Homo sapiens
aagtaatattattac

SEQ ID NO: 3585707 - DNA, 18 bp, Homo sapiens
aagtaatgacagaacatg

SEQ ID NO: 3585708 - DNA, 16 bp, Homo sapiens
aagtacacaataagca

SEQ ID NO: 3585709 - DNA, 18 bp, Homo sapiens
aagtacacaataagcaaa

SEQ ID NO: 3585710 - DNA, 17 bp, Homo sapiens
aagtagggatgcggatc

SEQ ID NO: 3585711 - DNA, 20 bp, Homo sapiens
aagtataaaatagtatgaaa

SEQ ID NO: 3585712 - DNA, 15 bp, Homo sapiens
aagtatacataagtt

SEQ ID NO: 3585713 - DNA, 19 bp, Homo sapiens
aagtatatgttctgattat

SEQ ID NO: 3585714 - DNA, 14 bp, Homo sapiens
aagtatgtttttaa

SEQ ID NO: 3585715 - DNA, 17 bp, Homo sapiens
aacatccaagtggcctc

SEQ ID NO: 3585716 - DNA, 18 bp, Homo sapiens
aacatctacaaaacatta

SEQ ID NO: 3585717 - DNA, 23 bp, Homo sapiens
aacatgatccccgtctctgccct

SEQ ID NO: 3585718 - DNA, 24 bp, Homo sapiens
aacatgattttacaagtataacag

SEQ ID NO: 3585719 - DNA, 14 bp, Homo sapiens
aacatgccctgttc

SEQ ID NO: 3585720 - DNA, 23 bp, Homo sapiens
aacatgctgttatttaggtattt

SEQ ID NO: 3585721 - DNA, 22 bp, Homo sapiens
aacatgtgttttcatcatttca

SEQ ID NO: 3585722 - DNA, 18 bp, Homo sapiens
aacatgtttctgttttgt

SEQ ID NO: 3585723 - DNA, 13 bp, Homo sapiens
aacattaaaatat

SEQ ID NO: 3585724 - DNA, 23 bp, Homo sapiens
aacattattaagtaacttattta

SEQ ID NO: 3585725 - DNA, 16 bp, Homo sapiens
aacattcagctctgga

SEQ ID NO: 3585726 - DNA, 19 bp, Homo sapiens
aacattcctccagcctccc

SEQ ID NO: 3585727 - DNA, 22 bp, Homo sapiens
aacattcctccagcctcccctc

SEQ ID NO: 3585728 - DNA, 14 bp, Homo sapiens
aacattgtagcctc

SEQ ID NO: 3585729 - DNA, 17 bp, Homo sapiens
aacatttctcatgttga

SEQ ID NO: 3585730 - DNA, 18 bp, Homo sapiens
aacatttctcatgttgaa

SEQ ID NO: 3585731 - DNA, 23 bp, Homo sapiens
aacattttagctctattgatact

SEQ ID NO: 3585732 - DNA, 23 bp, Homo sapiens
aacattttttcttctgaagattc

SEQ ID NO: 3585733 - DNA, 16 bp, Homo sapiens
aaccaaaggaaaatgt

SEQ ID NO: 3585734 - DNA, 22 bp, Homo sapiens
aaccaaatatgttaaagtttaa

SEQ ID NO: 3585735 - DNA, 20 bp, Homo sapiens
aaccaaattgcactgaagtt

SEQ ID NO: 3585736 - DNA, 17 bp, Homo sapiens
aaccaacaacaatgtgt

SEQ ID NO: 3585737 - DNA, 18 bp, Homo sapiens
aaccaagccgtggcttcc

SEQ ID NO: 3585738 - DNA, 21 bp, Homo sapiens
aaccaatcttaaacataataa

SEQ ID NO: 3585739 - DNA, 12 bp, Homo sapiens
aaccacagcagt

SEQ ID NO: 3585740 - DNA, 20 bp, Homo sapiens
aaccacagttattaattaaa

SEQ ID NO: 3585741 - DNA, 22 bp, Homo sapiens
aaccacagttattaattaaaga

SEQ ID NO: 3585742 - DNA, 16 bp, Homo sapiens
aaccacattgaagaat

SEQ ID NO: 3585743 - DNA, 22 bp, Homo sapiens
aaccacattgaagaatgttaga

SEQ ID NO: 3585744 - DNA, 13 bp, Homo sapiens
aaccacgaatgag

SEQ ID NO: 3585745 - DNA, 15 bp, Homo sapiens
aaccagaaaagcaat

SEQ ID NO: 3585746 - DNA, 19 bp, Homo sapiens
aaccagcccgacagtgcca

SEQ ID NO: 3585747 - DNA, 17 bp, Homo sapiens
aaccaggctttctagaa

SEQ ID NO: 3585748 - DNA, 21 bp, Homo sapiens
aaccaggctttctagaaagaa

SEQ ID NO: 3585749 - DNA, 18 bp, Homo sapiens
aaccagggaagctgtcct

SEQ ID NO: 3585750 - DNA, 22 bp, Homo sapiens
aaccagtccccccaccctcatt

SEQ ID NO: 3585751 - DNA, 15 bp, Homo sapiens
aaccagtctcctcac

SEQ ID NO: 3585752 - DNA, 16 bp, Homo sapiens
aaccataaaataaata

SEQ ID NO: 3585753 - DNA, 17 bp, Homo sapiens
aaccataaaataaataa

SEQ ID NO: 3585754 - DNA, 22 bp, Homo sapiens
aaccatattttattgtattttg

SEQ ID NO: 3585755 - DNA, 19 bp, Homo sapiens
aaccatgcaaatgctatga

SEQ ID NO: 3585756 - DNA, 14 bp, Homo sapiens
aacccaaggtgagg

SEQ ID NO: 3585757 - DNA, 18 bp, Homo sapiens
aacccaagtccaagcata

SEQ ID NO: 3585758 - DNA, 15 bp, Homo sapiens
aacccacctctcctg

SEQ ID NO: 3585759 - DNA, 19 bp, Homo sapiens
aacccacctctcctgccct

SEQ ID NO: 3585760 - DNA, 15 bp, Homo sapiens
aacccagactcagac

SEQ ID NO: 3585761 - DNA, 16 bp, Homo sapiens
aacccagactcagaca

SEQ ID NO: 3585762 - DNA, 18 bp, Homo sapiens
aacccagactcagacatt

SEQ ID NO: 3585763 - DNA, 16 bp, Homo sapiens
aacccagctgcacccc

SEQ ID NO: 3585764 - DNA, 23 bp, Homo sapiens
aacccagctgcaccccttcctgg

SEQ ID NO: 3585765 - DNA, 17 bp, Homo sapiens
aaccccaagcttcccaa

SEQ ID NO: 3585766 - DNA, 16 bp, Homo sapiens
aaccccaagttagttc

SEQ ID NO: 3585767 - DNA, 11 bp, Homo sapiens
aaccccagccc

SEQ ID NO: 3585768 - DNA, 20 bp, Homo sapiens
aacccccaaaatccaaaact

SEQ ID NO: 3585769 - DNA, 12 bp, Homo sapiens
aacccccctccc

SEQ ID NO: 3585770 - DNA, 13 bp, Homo sapiens
aacccccctccca

SEQ ID NO: 3585771 - DNA, 21 bp, Homo sapiens
aacccctacatgaaacagaaa

SEQ ID NO: 3585772 - DNA, 18 bp, Homo sapiens
aacccctctccaggcctg

SEQ ID NO: 3585773 - DNA, 17 bp, Homo sapiens
aacccctgtaggcctca

SEQ ID NO: 3585774 - DNA, 15 bp, Homo sapiens
aaccctacagtatat

SEQ ID NO: 3585775 - DNA, 16 bp, Homo sapiens
aaccctacagtatata

SEQ ID NO: 3585776 - DNA, 20 bp, Homo sapiens
aaccctcaggccaccctcca

SEQ ID NO: 3585777 - DNA, 21 bp, Homo sapiens
aaccctccaaaggaactctag

SEQ ID NO: 3585778 - DNA, 16 bp, Homo sapiens
aaccgcctcaaaatgt

SEQ ID NO: 3585779 - DNA, 23 bp, Homo sapiens
aacctacagagatgctaagagaa

SEQ ID NO: 3585780 - DNA, 21 bp, Homo sapiens
aacctacattccaccctgtta

SEQ ID NO: 3585781 - DNA, 20 bp, Homo sapiens
aacctcagcctggccagaca

SEQ ID NO: 3585782 - DNA, 15 bp, Homo sapiens
aacctcaggctccta

SEQ ID NO: 3585783 - DNA, 13 bp, Homo sapiens
aacctccagactc

SEQ ID NO: 3585784 - DNA, 19 bp, Homo sapiens
aacctccagactcagcaga

SEQ ID NO: 3585785 - DNA, 14 bp, Homo sapiens
aacctccagcctcc

SEQ ID NO: 3585786 - DNA, 23 bp, Homo sapiens
aacctccagcctccctgtctcca

SEQ ID NO: 3585787 - DNA, 21 bp, Homo sapiens
aacctctcctcatgttctgct

SEQ ID NO: 3585788 - DNA, 15 bp, Homo sapiens
aacctctcctgaccc

SEQ ID NO: 3585789 - DNA, 23 bp, Homo sapiens
aacctctgtggtcacccatgcat

SEQ ID NO: 3585790 - DNA, 16 bp, Homo sapiens
aacctgccaaggagca

SEQ ID NO: 3585791 - DNA, 19 bp, Homo sapiens
aacctgccaaggagcatcc

SEQ ID NO: 3585792 - DNA, 15 bp, Homo sapiens
aacctgggaaggcca

SEQ ID NO: 3585793 - DNA, 20 bp, Homo sapiens
aacctgggaaggccagcctt

SEQ ID NO: 3585794 - DNA, 16 bp, Homo sapiens
aacctgggacctgtgg

SEQ ID NO: 3585795 - DNA, 22 bp, Homo sapiens
aacctggggtgaatacttattt

SEQ ID NO: 3585796 - DNA, 19 bp, Homo sapiens
aacctgttcttagagtgta

SEQ ID NO: 3585797 - DNA, 23 bp, Homo sapiens
aacctgttcttagagtgtagctg

SEQ ID NO: 3585798 - DNA, 15 bp, Homo sapiens
aaccttaaaagtaat

SEQ ID NO: 3585799 - DNA, 18 bp, Homo sapiens
aaccttaaaagtaataaa

SEQ ID NO: 3585800 - DNA, 20 bp, Homo sapiens
aaccttaaaagtaataaaga

SEQ ID NO: 3585801 - DNA, 23 bp, Homo sapiens
aaccttaaaagtaataaagagaa

SEQ ID NO: 3585802 - DNA, 17 bp, Homo sapiens
aaccttaatgacaacac

SEQ ID NO: 3585803 - DNA, 15 bp, Homo sapiens
aaccttccacccagt

SEQ ID NO: 3585804 - DNA, 12 bp, Homo sapiens
aaccttctggcc

SEQ ID NO: 3585805 - DNA, 17 bp, Homo sapiens
aacgagcagcccagggc

SEQ ID NO: 3585806 - DNA, 12 bp, Homo sapiens
aacgcagccctg

SEQ ID NO: 3585807 - DNA, 15 bp, Homo sapiens
aacgcccctgtggcc

SEQ ID NO: 3585808 - DNA, 17 bp, Homo sapiens
aacgcccctgtggccaa

SEQ ID NO: 3585809 - DNA, 14 bp, Homo sapiens
aacgccctggtaag

SEQ ID NO: 3585810 - DNA, 16 bp, Homo sapiens
aacgccgagtgcactg

SEQ ID NO: 3585811 - DNA, 15 bp, Homo sapiens
aacgcgtctgcctgg

SEQ ID NO: 3585812 - DNA, 17 bp, Homo sapiens
aacggattattttttca

SEQ ID NO: 3585813 - DNA, 22 bp, Homo sapiens
aacggattattttttcagaccg

SEQ ID NO: 3585814 - DNA, 14 bp, Homo sapiens
aacggcaacagcat

SEQ ID NO: 3585815 - DNA, 22 bp, Homo sapiens
aacggcttgctttcctgcatct

SEQ ID NO: 3585816 - DNA, 19 bp, Homo sapiens
aacggttcctggtgactcc

SEQ ID NO: 3585817 - DNA, 22 bp, Homo sapiens
aacgtgagagaaagagagaagc

SEQ ID NO: 3585818 - DNA, 14 bp, Homo sapiens
aacgtggattgtat

SEQ ID NO: 3585819 - DNA, 20 bp, Homo sapiens
aacgtggattgtatttaaga

SEQ ID NO: 3585820 - DNA, 23 bp, Homo sapiens
aacgtggtttgcctgaggctgta

SEQ ID NO: 3585821 - DNA, 19 bp, Homo sapiens
aactaaaataattttgtaa

SEQ ID NO: 3585822 - DNA, 13 bp, Homo sapiens
aactaaagaagag

SEQ ID NO: 3585823 - DNA, 21 bp, Homo sapiens
aactaaagaagaggagaaaaa

SEQ ID NO: 3585824 - DNA, 15 bp, Homo sapiens
aactacctatcctta

SEQ ID NO: 3585825 - DNA, 17 bp, Homo sapiens
aactactaatagaataa

SEQ ID NO: 3585826 - DNA, 18 bp, Homo sapiens
aactactagtgtgactcc

SEQ ID NO: 3585827 - DNA, 13 bp, Homo sapiens
aactactttataa

SEQ ID NO: 3585828 - DNA, 21 bp, Homo sapiens
aactagtagaagaagctttgc

SEQ ID NO: 3585829 - DNA, 18 bp, Homo sapiens
aactatcttggtgaattt

SEQ ID NO: 3585830 - DNA, 13 bp, Homo sapiens
aactatgacagat

SEQ ID NO: 3585831 - DNA, 18 bp, Homo sapiens
aactatgacagatatatt

SEQ ID NO: 3585832 - DNA, 15 bp, Homo sapiens
aagaagcccccagct

SEQ ID NO: 3585833 - DNA, 16 bp, Homo sapiens
aagaagcccccagcta

SEQ ID NO: 3585834 - DNA, 19 bp, Homo sapiens
aagaagcccccagctaaga

SEQ ID NO: 3585835 - DNA, 13 bp, Homo sapiens
aagaaggcaaggc

SEQ ID NO: 3585836 - DNA, 16 bp, Homo sapiens
aagaagtggagacagt

SEQ ID NO: 3585837 - DNA, 14 bp, Homo sapiens
aagaataaaaactt

SEQ ID NO: 3585838 - DNA, 13 bp, Homo sapiens
aagaataaattct

SEQ ID NO: 3585839 - DNA, 17 bp, Homo sapiens
aagaatagctttaatga

SEQ ID NO: 3585840 - DNA, 16 bp, Homo sapiens
aagaatcttcctggca

SEQ ID NO: 3585841 - DNA, 12 bp, Homo sapiens
aagaatgttagt

SEQ ID NO: 3585842 - DNA, 18 bp, Homo sapiens
aagaatgttagtaaagga

SEQ ID NO: 3585843 - DNA, 15 bp, Homo sapiens
aagaattggaagtta

SEQ ID NO: 3585844 - DNA, 20 bp, Homo sapiens
aagaatttggggcaggaaat

SEQ ID NO: 3585845 - DNA, 13 bp, Homo sapiens
aagacaaatattc

SEQ ID NO: 3585846 - DNA, 22 bp, Homo sapiens
aagacaagagctgttatgctgt

SEQ ID NO: 3585847 - DNA, 11 bp, Homo sapiens
aagacagaaaa

SEQ ID NO: 3585848 - DNA, 20 bp, Homo sapiens
aagacagaaaagtgcctgag

SEQ ID NO: 3585849 - DNA, 21 bp, Homo sapiens
aagacagggctgataagctaa

SEQ ID NO: 3585850 - DNA, 16 bp, Homo sapiens
aagacataaacaaaga

SEQ ID NO: 3585851 - DNA, 18 bp, Homo sapiens
aagacataaacaaagaca

SEQ ID NO: 3585852 - DNA, 16 bp, Homo sapiens
aagacatcagtctcca

SEQ ID NO: 3585853 - DNA, 13 bp, Homo sapiens
aagacattagaga

SEQ ID NO: 3585854 - DNA, 18 bp, Homo sapiens
aagacattagagaaaacc

SEQ ID NO: 3585855 - DNA, 20 bp, Homo sapiens
aagacattagagaaaacctt

SEQ ID NO: 3585856 - DNA, 20 bp, Homo sapiens
aagaccaatcaaatatatta

SEQ ID NO: 3585857 - DNA, 23 bp, Homo sapiens
aagaccagagatagtggggagac

SEQ ID NO: 3585858 - DNA, 14 bp, Homo sapiens
aagacccaaaacag

SEQ ID NO: 3585859 - DNA, 18 bp, Homo sapiens
aagacccaaaacagcttt

SEQ ID NO: 3585860 - DNA, 21 bp, Homo sapiens
aaatgaatagtacatgcagaa

SEQ ID NO: 3585861 - DNA, 16 bp, Homo sapiens
aaatgaccgagccctg

SEQ ID NO: 3585862 - DNA, 18 bp, Homo sapiens
aaatgaccgagccctgga

SEQ ID NO: 3585863 - DNA, 21 bp, Homo sapiens
aaatgaccgagccctggagag

SEQ ID NO: 3585864 - DNA, 22 bp, Homo sapiens
aaatgaccgagccctggagagc

SEQ ID NO: 3585865 - DNA, 16 bp, Homo sapiens
aaatgacttatttctg

SEQ ID NO: 3585866 - DNA, 17 bp, Homo sapiens
aaatgacttatttctgc

SEQ ID NO: 3585867 - DNA, 19 bp, Homo sapiens
aaatgagtcatttgtttaa

SEQ ID NO: 3585868 - DNA, 21 bp, Homo sapiens
aaatgatttgtagtggaaaca

SEQ ID NO: 3585869 - DNA, 18 bp, Homo sapiens
aaatgcttttatattcta

SEQ ID NO: 3585870 - DNA, 17 bp, Homo sapiens
aaatggcaagttttcca

SEQ ID NO: 3585871 - DNA, 15 bp, Homo sapiens
aaatggctatgaaca

SEQ ID NO: 3585872 - DNA, 15 bp, Homo sapiens
aaatggctttctcag

SEQ ID NO: 3585873 - DNA, 19 bp, Homo sapiens
aaatggttaaattttacat

SEQ ID NO: 3585874 - DNA, 20 bp, Homo sapiens
aaatggttaaattttacatg

SEQ ID NO: 3585875 - DNA, 15 bp, Homo sapiens
aaatggttgatggaa

SEQ ID NO: 3585876 - DNA, 14 bp, Homo sapiens
aaatgtaagatcgt

SEQ ID NO: 3585877 - DNA, 22 bp, Homo sapiens
aaatgtaagatcgttctctgcc

SEQ ID NO: 3585878 - DNA, 20 bp, Homo sapiens
aaatgtaatagccaaaccca

SEQ ID NO: 3585879 - DNA, 17 bp, Homo sapiens
aaatgtagttttgtata

SEQ ID NO: 3585880 - DNA, 20 bp, Homo sapiens
aaatgtatcatagaaatgta

SEQ ID NO: 3585881 - DNA, 14 bp, Homo sapiens
aaatgtattttaca

SEQ ID NO: 3585882 - DNA, 15 bp, Homo sapiens
aaatgtattttacat

SEQ ID NO: 3585883 - DNA, 13 bp, Homo sapiens
aaatgtcactttt

SEQ ID NO: 3585884 - DNA, 20 bp, Homo sapiens
aaatgtcactttttgaggca

SEQ ID NO: 3585885 - DNA, 15 bp, Homo sapiens
aaatgtcttaatttt

SEQ ID NO: 3585886 - DNA, 18 bp, Homo sapiens
aaatgtgccttcattttt

SEQ ID NO: 3585887 - DNA, 13 bp, Homo sapiens
aaatgttacgtga

SEQ ID NO: 3585888 - DNA, 22 bp, Homo sapiens
aaatgttatgactatgtaaact

SEQ ID NO: 3585889 - DNA, 19 bp, Homo sapiens
aaatgtttggatggtttgt

SEQ ID NO: 3585890 - DNA, 14 bp, Homo sapiens
aaattaaatggatt

SEQ ID NO: 3585891 - DNA, 18 bp, Homo sapiens
aaattacatgttttttca

SEQ ID NO: 3585892 - DNA, 12 bp, Homo sapiens
aaattaggcagt

SEQ ID NO: 3585893 - DNA, 15 bp, Homo sapiens
aaattagttcccatt

SEQ ID NO: 3585894 - DNA, 15 bp, Homo sapiens
aaattataactatta

SEQ ID NO: 3585895 - DNA, 17 bp, Homo sapiens
aaattataactattaca

SEQ ID NO: 3585896 - DNA, 15 bp, Homo sapiens
aaattatacaatgat

SEQ ID NO: 3585897 - DNA, 20 bp, Homo sapiens
aaattatatgatatgcatgt

SEQ ID NO: 3585898 - DNA, 16 bp, Homo sapiens
aaattatctatagcta

SEQ ID NO: 3585899 - DNA, 16 bp, Homo sapiens
aaattcaccttcccct

SEQ ID NO: 3585900 - DNA, 23 bp, Homo sapiens
aaattcaggtctgtatgtcatgg

SEQ ID NO: 3585901 - DNA, 15 bp, Homo sapiens
aaattccactgaaaa

SEQ ID NO: 3585902 - DNA, 17 bp, Homo sapiens
aaattccactgaaaatt

SEQ ID NO: 3585903 - DNA, 12 bp, Homo sapiens
aaattccctggg

SEQ ID NO: 3585904 - DNA, 20 bp, Homo sapiens
aaattcctctttgctttgct

SEQ ID NO: 3585905 - DNA, 17 bp, Homo sapiens
aaattctaaattacaaa

SEQ ID NO: 3585906 - DNA, 19 bp, Homo sapiens
aaattctactaagttattt

SEQ ID NO: 3585907 - DNA, 22 bp, Homo sapiens
aaattctactaagttattttat

SEQ ID NO: 3585908 - DNA, 18 bp, Homo sapiens
aaattctcaaagttttat

SEQ ID NO: 3585909 - DNA, 17 bp, Homo sapiens
aaattctgtctggggac

SEQ ID NO: 3585910 - DNA, 14 bp, Homo sapiens
aaattcttcacatg

SEQ ID NO: 3585911 - DNA, 18 bp, Homo sapiens
aaattgaccctagccaga

SEQ ID NO: 3585912 - DNA, 14 bp, Homo sapiens
aaattgcactgaag

SEQ ID NO: 3585913 - DNA, 18 bp, Homo sapiens
aaattgcactgaagtttt

SEQ ID NO: 3585914 - DNA, 18 bp, Homo sapiens
aaattgcatttcctgaca

SEQ ID NO: 3585915 - DNA, 22 bp, Homo sapiens
aaattgcatttttacctttcat

SEQ ID NO: 3585916 - DNA, 18 bp, Homo sapiens
aaattgctttgtattgta

SEQ ID NO: 3585917 - DNA, 21 bp, Homo sapiens
aaattgggcttgtgatttcca

SEQ ID NO: 3585918 - DNA, 15 bp, Homo sapiens
aaattggggtttatt

SEQ ID NO: 3585919 - DNA, 14 bp, Homo sapiens
aaattggtaaaaat

SEQ ID NO: 3585920 - DNA, 13 bp, Homo sapiens
aaattgtcagcaa

SEQ ID NO: 3585921 - DNA, 13 bp, Homo sapiens
aaatttaatgctg

SEQ ID NO: 3585922 - DNA, 17 bp, Homo sapiens
aaatttaatgctgcctt

SEQ ID NO: 3585923 - DNA, 20 bp, Homo sapiens
aaatttaattacaaacaata

SEQ ID NO: 3585924 - DNA, 12 bp, Homo sapiens
aaatttcagatt

SEQ ID NO: 3585925 - DNA, 17 bp, Homo sapiens
aaatttcagctttggct

SEQ ID NO: 3585926 - DNA, 19 bp, Homo sapiens
aaatttctgggatatttaa

SEQ ID NO: 3585927 - DNA, 19 bp, Homo sapiens
aaatttgataaactgaatt

SEQ ID NO: 3585928 - DNA, 19 bp, Homo sapiens
aaatttgctttttgagatg

SEQ ID NO: 3585929 - DNA, 15 bp, Homo sapiens
aaatttgtcttaaaa

SEQ ID NO: 3585930 - DNA, 20 bp, Homo sapiens
aaatttgttatacttcaaaa

SEQ ID NO: 3585931 - DNA, 16 bp, Homo sapiens
aaattttaaaaagcag

SEQ ID NO: 3585932 - DNA, 12 bp, Homo sapiens
aaattttaactg

SEQ ID NO: 3585933 - DNA, 21 bp, Homo sapiens
aaattttacaagggcataaag

SEQ ID NO: 3585934 - DNA, 15 bp, Homo sapiens
aaattttctaaataa

SEQ ID NO: 3585935 - DNA, 19 bp, Homo sapiens
aaatttttacctttatctt

SEQ ID NO: 3585936 - DNA, 17 bp, Homo sapiens
aaatttttgtagtagcg

SEQ ID NO: 3585937 - DNA, 19 bp, Homo sapiens
aaatttttttttaaagcag

SEQ ID NO: 3585938 - DNA, 16 bp, Homo sapiens
aacaaaaaaaaaatga

SEQ ID NO: 3585939 - DNA, 14 bp, Homo sapiens
aacaaaacttctat

SEQ ID NO: 3585940 - DNA, 13 bp, Homo sapiens
aacaaacaaaact

SEQ ID NO: 3585941 - DNA, 16 bp, Homo sapiens
aacaaactctctgaac

SEQ ID NO: 3585942 - DNA, 14 bp, Homo sapiens
aacaaagacattga

SEQ ID NO: 3585943 - DNA, 19 bp, Homo sapiens
aacaaagacattgacagca

SEQ ID NO: 3585944 - DNA, 21 bp, Homo sapiens
aacaaagacattgacagcaat

SEQ ID NO: 3585945 - DNA, 22 bp, Homo sapiens
aacaaagacattgacagcaatt

SEQ ID NO: 3585946 - DNA, 16 bp, Homo sapiens
aacaaaggttgagatg

SEQ ID NO: 3585947 - DNA, 14 bp, Homo sapiens
aacaacatgttcta

SEQ ID NO: 3585948 - DNA, 12 bp, Homo sapiens
aacaagaattgg

SEQ ID NO: 3585949 - DNA, 14 bp, Homo sapiens
aacaagcttcagta

SEQ ID NO: 3585950 - DNA, 23 bp, Homo sapiens
aacaagtgaaataacaaaatgga

SEQ ID NO: 3585951 - DNA, 23 bp, Homo sapiens
aacaatcttccaaagaactgtat

SEQ ID NO: 3585952 - DNA, 22 bp, Homo sapiens
aacaatggaagaagaaaggact

SEQ ID NO: 3585953 - DNA, 18 bp, Homo sapiens
aacaatttttgaaaaaga

SEQ ID NO: 3585954 - DNA, 12 bp, Homo sapiens
aacacaaaaaaa

SEQ ID NO: 3585955 - DNA, 23 bp, Homo sapiens
aacacaccttggagaagtggcat

SEQ ID NO: 3585956 - DNA, 22 bp, Homo sapiens
aacacagaggaatttatacctc

SEQ ID NO: 3585957 - DNA, 14 bp, Homo sapiens
aacacagatattgt

SEQ ID NO: 3585958 - DNA, 20 bp, Homo sapiens
aacacagcaagggtgatggg

SEQ ID NO: 3585959 - DNA, 20 bp, Homo sapiens
aacacagcttacaatcgcaa

SEQ ID NO: 3585960 - DNA, 15 bp, Homo sapiens
aacacaggcaaaatc

SEQ ID NO: 3585961 - DNA, 16 bp, Homo sapiens
aacacatcagcttgcc

SEQ ID NO: 3585962 - DNA, 15 bp, Homo sapiens
aacacatctggctgc

SEQ ID NO: 3585963 - DNA, 20 bp, Homo sapiens
aacaccgcttctgccttttc

SEQ ID NO: 3585964 - DNA, 22 bp, Homo sapiens
aacacctcctcccgaaaaatgt

SEQ ID NO: 3585965 - DNA, 20 bp, Homo sapiens
aacactaaattgcagtttac

SEQ ID NO: 3585966 - DNA, 15 bp, Homo sapiens
aacactgagaaagag

SEQ ID NO: 3585967 - DNA, 22 bp, Homo sapiens
aacacttaggactagaagatta

SEQ ID NO: 3585968 - DNA, 19 bp, Homo sapiens
aacagaaaaataagtcaaa

SEQ ID NO: 3585969 - DNA, 18 bp, Homo sapiens
aacagaattttccattta

SEQ ID NO: 3585970 - DNA, 15 bp, Homo sapiens
aacagagtggcctcc

SEQ ID NO: 3585971 - DNA, 17 bp, Homo sapiens
aacagattcaggccagc

SEQ ID NO: 3585972 - DNA, 18 bp, Homo sapiens
aacagattcaggccagcc

SEQ ID NO: 3585973 - DNA, 21 bp, Homo sapiens
aacagattcaggccagcccag

SEQ ID NO: 3585974 - DNA, 12 bp, Homo sapiens
aacagcagtctc

SEQ ID NO: 3585975 - DNA, 22 bp, Homo sapiens
aacagcatgaataaaacactca

SEQ ID NO: 3585976 - DNA, 18 bp, Homo sapiens
aacagccaagctggcaca

SEQ ID NO: 3585977 - DNA, 19 bp, Homo sapiens
aacagccctcctctgcact

SEQ ID NO: 3585978 - DNA, 17 bp, Homo sapiens
aacagctttgtctccaa

SEQ ID NO: 3585979 - DNA, 21 bp, Homo sapiens
aacagctttgtctccaaagaa

SEQ ID NO: 3585980 - DNA, 19 bp, Homo sapiens
aacaggaaagagctaggaa

SEQ ID NO: 3585981 - DNA, 20 bp, Homo sapiens
aacaggatcagttaactatt

SEQ ID NO: 3585982 - DNA, 16 bp, Homo sapiens
aacaggattgatcatt

SEQ ID NO: 3585983 - DNA, 18 bp, Homo sapiens
aacaggtattttgtttct

SEQ ID NO: 3585984 - DNA, 21 bp, Homo sapiens
aacaggtattttgtttctttt

SEQ ID NO: 3585985 - DNA, 13 bp, Homo sapiens
aacagtctcagga

SEQ ID NO: 3585986 - DNA, 13 bp, Homo sapiens
aacagtgagcctg

SEQ ID NO: 3585987 - DNA, 18 bp, Homo sapiens
aacagtggttgcctgggg

SEQ ID NO: 3585988 - DNA, 14 bp, Homo sapiens
aacagttggtaact

SEQ ID NO: 3585989 - DNA, 21 bp, Homo sapiens
aacagttggtaacttttgtga

SEQ ID NO: 3585990 - DNA, 22 bp, Homo sapiens
aacagtttcttgcttggaagcc

SEQ ID NO: 3585991 - DNA, 19 bp, Homo sapiens
aacataaaaaggacatcag

SEQ ID NO: 3585992 - DNA, 15 bp, Homo sapiens
aacataatgaaaata

SEQ ID NO: 3585993 - DNA, 15 bp, Homo sapiens
aacatatactattta

SEQ ID NO: 3585994 - DNA, 15 bp, Homo sapiens
aacatattatttcat

SEQ ID NO: 3585995 - DNA, 12 bp, Homo sapiens
aacatcaaataa

SEQ ID NO: 3585996 - DNA, 22 bp, Homo sapiens
aaagccttaagcaaattttgta

SEQ ID NO: 3585997 - DNA, 15 bp, Homo sapiens
aaagcggtccctgtc

SEQ ID NO: 3585998 - DNA, 21 bp, Homo sapiens
aaagctgatttttgtctttta

SEQ ID NO: 3585999 - DNA, 21 bp, Homo sapiens
aaagctgctcagggaaaagca

SEQ ID NO: 3586000 - DNA, 13 bp, Homo sapiens
aaagcttattaaa

SEQ ID NO: 3586001 - DNA, 21 bp, Homo sapiens
aaagcttcagactcaagtacc

SEQ ID NO: 3586002 - DNA, 22 bp, Homo sapiens
aaaggaacaaaaattacaaaga

SEQ ID NO: 3586003 - DNA, 14 bp, Homo sapiens
aaaggaacactgac

SEQ ID NO: 3586004 - DNA, 12 bp, Homo sapiens
aaaggaactaga

SEQ ID NO: 3586005 - DNA, 14 bp, Homo sapiens
aaaggaactctaga

SEQ ID NO: 3586006 - DNA, 14 bp, Homo sapiens
aaaggacatcagca

SEQ ID NO: 3586007 - DNA, 21 bp, Homo sapiens
aaaggacccttgagtaagtga

SEQ ID NO: 3586008 - DNA, 13 bp, Homo sapiens
aaaggactgtaat

SEQ ID NO: 3586009 - DNA, 21 bp, Homo sapiens
aaaggagccttttgctctctg

SEQ ID NO: 3586010 - DNA, 22 bp, Homo sapiens
aaaggataaagaaggatgatgt

SEQ ID NO: 3586011 - DNA, 14 bp, Homo sapiens
aaaggatgtgatat

SEQ ID NO: 3586012 - DNA, 19 bp, Homo sapiens
aaaggattttaccaaagca

SEQ ID NO: 3586013 - DNA, 20 bp, Homo sapiens
aaaggattttaccaaagcat

SEQ ID NO: 3586014 - DNA, 12 bp, Homo sapiens
aaagggcagggc

SEQ ID NO: 3586015 - DNA, 19 bp, Homo sapiens
aaagggcccacacctggtg

SEQ ID NO: 3586016 - DNA, 20 bp, Homo sapiens
aaagggcccacacctggtgg

SEQ ID NO: 3586017 - DNA, 16 bp, Homo sapiens
aaaggtaaatggttaa

SEQ ID NO: 3586018 - DNA, 21 bp, Homo sapiens
aaaggtaaatggttaaatttt

SEQ ID NO: 3586019 - DNA, 16 bp, Homo sapiens
aaaggtgcactccaga

SEQ ID NO: 3586020 - DNA, 17 bp, Homo sapiens
aaaggtgcactccagac

SEQ ID NO: 3586021 - DNA, 13 bp, Homo sapiens
aaaggtggcagct

SEQ ID NO: 3586022 - DNA, 15 bp, Homo sapiens
aaaggtgtgaggaga

SEQ ID NO: 3586023 - DNA, 14 bp, Homo sapiens
aaaggtgttgtccc

SEQ ID NO: 3586024 - DNA, 18 bp, Homo sapiens
aaaggttgagtatgtgaa

SEQ ID NO: 3586025 - DNA, 14 bp, Homo sapiens
aaaggtttaaagtt

SEQ ID NO: 3586026 - DNA, 14 bp, Homo sapiens
aaaggttttcctct

SEQ ID NO: 3586027 - DNA, 14 bp, Homo sapiens
aaaggtttttgaaa

SEQ ID NO: 3586028 - DNA, 18 bp, Homo sapiens
aaagtaaatacatgcata

SEQ ID NO: 3586029 - DNA, 18 bp, Homo sapiens
aaagtaagcatttccagc

SEQ ID NO: 3586030 - DNA, 13 bp, Homo sapiens
aaagtaataaaga

SEQ ID NO: 3586031 - DNA, 17 bp, Homo sapiens
aaagtaataaagagaaa

SEQ ID NO: 3586032 - DNA, 12 bp, Homo sapiens
aaagtaatttaa

SEQ ID NO: 3586033 - DNA, 15 bp, Homo sapiens
aaagtaggattttga

SEQ ID NO: 3586034 - DNA, 18 bp, Homo sapiens
aaagtagggatgcggatc

SEQ ID NO: 3586035 - DNA, 22 bp, Homo sapiens
aaagtatatgttctgattatgt

SEQ ID NO: 3586036 - DNA, 19 bp, Homo sapiens
aaagtcaatgtacttgttt

SEQ ID NO: 3586037 - DNA, 16 bp, Homo sapiens
aaagtcattaaagaca

SEQ ID NO: 3586038 - DNA, 15 bp, Homo sapiens
aaagtcccagttaag

SEQ ID NO: 3586039 - DNA, 18 bp, Homo sapiens
aaagtcttggttttatct

SEQ ID NO: 3586040 - DNA, 15 bp, Homo sapiens
aaagtggaagtatgt

SEQ ID NO: 3586041 - DNA, 14 bp, Homo sapiens
aaagtgtatttgga

SEQ ID NO: 3586042 - DNA, 23 bp, Homo sapiens
aaagtgtatttggaaataaagtc

SEQ ID NO: 3586043 - DNA, 19 bp, Homo sapiens
aaagtgtgagctcttccct

SEQ ID NO: 3586044 - DNA, 20 bp, Homo sapiens
aaagtgtgagctcttccctt

SEQ ID NO: 3586045 - DNA, 17 bp, Homo sapiens
aaagttaaaattgttat

SEQ ID NO: 3586046 - DNA, 13 bp, Homo sapiens
aaagttatttatg

SEQ ID NO: 3586047 - DNA, 12 bp, Homo sapiens
aaagttcaggga

SEQ ID NO: 3586048 - DNA, 21 bp, Homo sapiens
aaagttccctacttcctgtga

SEQ ID NO: 3586049 - DNA, 13 bp, Homo sapiens
aaagttgcagatg

SEQ ID NO: 3586050 - DNA, 23 bp, Homo sapiens
aaagttgcctttatttgctgtta

SEQ ID NO: 3586051 - DNA, 19 bp, Homo sapiens
aaagttgggcccctgagga

SEQ ID NO: 3586052 - DNA, 20 bp, Homo sapiens
aaagttgggcccctgaggag

SEQ ID NO: 3586053 - DNA, 13 bp, Homo sapiens
aaagttgtaaaat

SEQ ID NO: 3586054 - DNA, 14 bp, Homo sapiens
aaagtttgtttgct

SEQ ID NO: 3586055 - DNA, 18 bp, Homo sapiens
aaagttttccagtattga

SEQ ID NO: 3586056 - DNA, 15 bp, Homo sapiens
aaagttttcccttga

SEQ ID NO: 3586057 - DNA, 16 bp, Homo sapiens
aaataaacatcagttt

SEQ ID NO: 3586058 - DNA, 18 bp, Homo sapiens
aaataaacatcagtttct

SEQ ID NO: 3586059 - DNA, 13 bp, Homo sapiens
aaataaaccaaat

SEQ ID NO: 3586060 - DNA, 14 bp, Homo sapiens
aaataaaccaaata

SEQ ID NO: 3586061 - DNA, 11 bp, Homo sapiens
aaataaataat

SEQ ID NO: 3586062 - DNA, 21 bp, Homo sapiens
aaataaatagggaagatggag

SEQ ID NO: 3586063 - DNA, 13 bp, Homo sapiens
aaataaatcacag

SEQ ID NO: 3586064 - DNA, 15 bp, Homo sapiens
aaataaatgtatcat

SEQ ID NO: 3586065 - DNA, 21 bp, Homo sapiens
aaataaatttaactttaacca

SEQ ID NO: 3586066 - DNA, 15 bp, Homo sapiens
aaataacaaaatgga

SEQ ID NO: 3586067 - DNA, 17 bp, Homo sapiens
aaataactgaaccaaat

SEQ ID NO: 3586068 - DNA, 19 bp, Homo sapiens
aaataaggttatgattgaa

SEQ ID NO: 3586069 - DNA, 13 bp, Homo sapiens
aaataatgctgca

SEQ ID NO: 3586070 - DNA, 12 bp, Homo sapiens
aaataattttaa

SEQ ID NO: 3586071 - DNA, 14 bp, Homo sapiens
aaataattttaaac

SEQ ID NO: 3586072 - DNA, 18 bp, Homo sapiens
aaataattttaaacaaag

SEQ ID NO: 3586073 - DNA, 12 bp, Homo sapiens
aaataattttgt

SEQ ID NO: 3586074 - DNA, 14 bp, Homo sapiens
aaataattttgtaa

SEQ ID NO: 3586075 - DNA, 19 bp, Homo sapiens
aaatacacactcaaatcaa

SEQ ID NO: 3586076 - DNA, 18 bp, Homo sapiens
aaatacctctaataaaca

SEQ ID NO: 3586077 - DNA, 18 bp, Homo sapiens
aaataccttctatgtatt

SEQ ID NO: 3586078 - DNA, 23 bp, Homo sapiens
aaatacctttgtagttactcaag

SEQ ID NO: 3586079 - DNA, 16 bp, Homo sapiens
aaatactggtggcgtc

SEQ ID NO: 3586080 - DNA, 17 bp, Homo sapiens
aaatagacagcatgaga

SEQ ID NO: 3586081 - DNA, 17 bp, Homo sapiens
aaatagggaagatggag

SEQ ID NO: 3586082 - DNA, 18 bp, Homo sapiens
aaataggtttatattatt

SEQ ID NO: 3586083 - DNA, 16 bp, Homo sapiens
aaatagtatgaaaatg

SEQ ID NO: 3586084 - DNA, 19 bp, Homo sapiens
aaatagtatgaaaatggaa

SEQ ID NO: 3586085 - DNA, 13 bp, Homo sapiens
aaatagtattcca

SEQ ID NO: 3586086 - DNA, 23 bp, Homo sapiens
aaatagtgattgtaacaaattga

SEQ ID NO: 3586087 - DNA, 16 bp, Homo sapiens
aaatatatactaaaca

SEQ ID NO: 3586088 - DNA, 13 bp, Homo sapiens
aaatatatatata

SEQ ID NO: 3586089 - DNA, 15 bp, Homo sapiens
aaatatatattttgt

SEQ ID NO: 3586090 - DNA, 15 bp, Homo sapiens
aaatatccacccagc

SEQ ID NO: 3586091 - DNA, 22 bp, Homo sapiens
aaatatcccttggacattttat

SEQ ID NO: 3586092 - DNA, 15 bp, Homo sapiens
aaatatgcaaagcac

SEQ ID NO: 3586093 - DNA, 19 bp, Homo sapiens
aaatatggtcttttggtta

SEQ ID NO: 3586094 - DNA, 15 bp, Homo sapiens
aaatattcctgcatt

SEQ ID NO: 3586095 - DNA, 22 bp, Homo sapiens
aaatatttagatgtaattttgt

SEQ ID NO: 3586096 - DNA, 13 bp, Homo sapiens
aaatatttatttt

SEQ ID NO: 3586097 - DNA, 15 bp, Homo sapiens
aaatatttgtacata

SEQ ID NO: 3586098 - DNA, 11 bp, Homo sapiens
aaatattttgc

SEQ ID NO: 3586099 - DNA, 15 bp, Homo sapiens
aaatattttgctaac

SEQ ID NO: 3586100 - DNA, 17 bp, Homo sapiens
aaatattttgctaactg

SEQ ID NO: 3586101 - DNA, 21 bp, Homo sapiens
aaatcaaaactcacaagtgct

SEQ ID NO: 3586102 - DNA, 15 bp, Homo sapiens
aaatcaaatatgcaa

SEQ ID NO: 3586103 - DNA, 16 bp, Homo sapiens
aaatcaaatatgcaaa

SEQ ID NO: 3586104 - DNA, 18 bp, Homo sapiens
aaatcaaatatgcaaagc

SEQ ID NO: 3586105 - DNA, 19 bp, Homo sapiens
aaatcaaatatgcaaagca

SEQ ID NO: 3586106 - DNA, 16 bp, Homo sapiens
aaatcaaatgtaaagt

SEQ ID NO: 3586107 - DNA, 22 bp, Homo sapiens
aaatcaaatgtaaagtttaatt

SEQ ID NO: 3586108 - DNA, 16 bp, Homo sapiens
aaatcaacttaacatg

SEQ ID NO: 3586109 - DNA, 16 bp, Homo sapiens
aaatcaagtattttgt

SEQ ID NO: 3586110 - DNA, 19 bp, Homo sapiens
aaatcacagatgcatatag

SEQ ID NO: 3586111 - DNA, 19 bp, Homo sapiens
aaatcagaacaaaacttct

SEQ ID NO: 3586112 - DNA, 21 bp, Homo sapiens
aaatcagaagtcatcttgcta

SEQ ID NO: 3586113 - DNA, 19 bp, Homo sapiens
aaatcatatagaccaattg

SEQ ID NO: 3586114 - DNA, 21 bp, Homo sapiens
aaatcatatagaccaattgaa

SEQ ID NO: 3586115 - DNA, 19 bp, Homo sapiens
aaatcattcttactaaaaa

SEQ ID NO: 3586116 - DNA, 19 bp, Homo sapiens
aaatcatttctgcatcagc

SEQ ID NO: 3586117 - DNA, 22 bp, Homo sapiens
aaatccaaaaagctctgaaaac

SEQ ID NO: 3586118 - DNA, 13 bp, Homo sapiens
aaatccagtggtg

SEQ ID NO: 3586119 - DNA, 14 bp, Homo sapiens
aaatccatttaccc

SEQ ID NO: 3586120 - DNA, 21 bp, Homo sapiens
aaatcccagactgacagactt

SEQ ID NO: 3586121 - DNA, 17 bp, Homo sapiens
aaatcctagacttgaaa

SEQ ID NO: 3586122 - DNA, 18 bp, Homo sapiens
aaatcctgaactttctcc

SEQ ID NO: 3586123 - DNA, 18 bp, Homo sapiens
aaatctaaaatttcataa

SEQ ID NO: 3586124 - DNA, 15 bp, Homo sapiens
aaatctagaagatgc

SEQ ID NO: 3586125 - DNA, 13 bp, Homo sapiens
aaatctgacatat

SEQ ID NO: 3586126 - DNA, 15 bp, Homo sapiens
aaatctgacatatta

SEQ ID NO: 3586127 - DNA, 18 bp, Homo sapiens
aaatctgtaacaggtatt

SEQ ID NO: 3586128 - DNA, 15 bp, Homo sapiens
aaatcttagtgttca

SEQ ID NO: 3586129 - DNA, 16 bp, Homo sapiens
aaatcttggcaatatt

SEQ ID NO: 3586130 - DNA, 11 bp, Homo sapiens
aaatgaaaatt

SEQ ID NO: 3586131 - DNA, 15 bp, Homo sapiens
aaatgaaagaaaatg

SEQ ID NO: 3586132 - DNA, 14 bp, Homo sapiens
aaatgaaatcttcc

SEQ ID NO: 3586133 - DNA, 14 bp, Homo sapiens
aaatgaagaaggaa

SEQ ID NO: 3586134 - DNA, 23 bp, Homo sapiens
atggtggggtctcctcaggacca

SEQ ID NO: 3586135 - DNA, 16 bp, Homo sapiens
atggttcaagtattaa

SEQ ID NO: 3586136 - DNA, 19 bp, Homo sapiens
atggttcccctgttcactc

SEQ ID NO: 3586137 - DNA, 16 bp, Homo sapiens
atggttgagttacatt

SEQ ID NO: 3586138 - DNA, 16 bp, Homo sapiens
atggttgatggaaaat

SEQ ID NO: 3586139 - DNA, 18 bp, Homo sapiens
atggttgatggaaaataa

SEQ ID NO: 3586140 - DNA, 21 bp, Homo sapiens
atggtttacatccttcactgc

SEQ ID NO: 3586141 - DNA, 20 bp, Homo sapiens
atgtaaaaatgaaggaatta

SEQ ID NO: 3586142 - DNA, 19 bp, Homo sapiens
atgtaaactgtttctttaa

SEQ ID NO: 3586143 - DNA, 21 bp, Homo sapiens
atgtaaagcaaccaaaaagaa

SEQ ID NO: 3586144 - DNA, 17 bp, Homo sapiens
atgtaaatactttccat

SEQ ID NO: 3586145 - DNA, 13 bp, Homo sapiens
atgtaaatttttt

SEQ ID NO: 3586146 - DNA, 16 bp, Homo sapiens
atgtaacttcctgtgg

SEQ ID NO: 3586147 - DNA, 14 bp, Homo sapiens
atgtaagaaataag

SEQ ID NO: 3586148 - DNA, 14 bp, Homo sapiens
atgtaagggaaact

SEQ ID NO: 3586149 - DNA, 18 bp, Homo sapiens
atgtaagtttgtgtaaat

SEQ ID NO: 3586150 - DNA, 19 bp, Homo sapiens
atgtaatgtttttatttca

SEQ ID NO: 3586151 - DNA, 12 bp, Homo sapiens
atgtaattttgt

SEQ ID NO: 3586152 - DNA, 15 bp, Homo sapiens
atgtaattttgtgta

SEQ ID NO: 3586153 - DNA, 17 bp, Homo sapiens
atgtaattttgtgtaag

SEQ ID NO: 3586154 - DNA, 22 bp, Homo sapiens
atgtaattttgtgtaagaaata

SEQ ID NO: 3586155 - DNA, 14 bp, Homo sapiens
atgtacagtttatt

SEQ ID NO: 3586156 - DNA, 19 bp, Homo sapiens
atgtacagtttattgatat

SEQ ID NO: 3586157 - DNA, 15 bp, Homo sapiens
atgtacatacgctct

SEQ ID NO: 3586158 - DNA, 15 bp, Homo sapiens
atgtacatgaagcaa

SEQ ID NO: 3586159 - DNA, 17 bp, Homo sapiens
atgtacttgtttgaata

SEQ ID NO: 3586160 - DNA, 20 bp, Homo sapiens
atgtacttgtttgaatattt

SEQ ID NO: 3586161 - DNA, 20 bp, Homo sapiens
atgtagaaagttgtaaaata

SEQ ID NO: 3586162 - DNA, 15 bp, Homo sapiens
atgtagaataggcag

SEQ ID NO: 3586163 - DNA, 17 bp, Homo sapiens
atgtagactgtgccaga

SEQ ID NO: 3586164 - DNA, 22 bp, Homo sapiens
atgtagactgtgccagaggcca

SEQ ID NO: 3586165 - DNA, 21 bp, Homo sapiens
atgtagctgtcgtacattgag

SEQ ID NO: 3586166 - DNA, 19 bp, Homo sapiens
atgtagtatctatatgact

SEQ ID NO: 3586167 - DNA, 21 bp, Homo sapiens
atgtagtattttttgtataat

SEQ ID NO: 3586168 - DNA, 14 bp, Homo sapiens
atgtataatgtaat

SEQ ID NO: 3586169 - DNA, 15 bp, Homo sapiens
atgtataatgtaatg

SEQ ID NO: 3586170 - DNA, 19 bp, Homo sapiens
atgtatataaactgggatg

SEQ ID NO: 3586171 - DNA, 17 bp, Homo sapiens
atgtatattaaaaaaga

SEQ ID NO: 3586172 - DNA, 22 bp, Homo sapiens
atgtatattaaaaaagagacat

SEQ ID NO: 3586173 - DNA, 17 bp, Homo sapiens
atgtatcaaatacattt

SEQ ID NO: 3586174 - DNA, 17 bp, Homo sapiens
atgtatcagtgtccttt

SEQ ID NO: 3586175 - DNA, 18 bp, Homo sapiens
atgtatcagtgtcctttc

SEQ ID NO: 3586176 - DNA, 18 bp, Homo sapiens
atgtatggtatctttaga

SEQ ID NO: 3586177 - DNA, 11 bp, Homo sapiens
atgtatgtgtg

SEQ ID NO: 3586178 - DNA, 13 bp, Homo sapiens
atgtatgttacca

SEQ ID NO: 3586179 - DNA, 13 bp, Homo sapiens
atgtattagtgtc

SEQ ID NO: 3586180 - DNA, 18 bp, Homo sapiens
atgtattcaagcaaacat

SEQ ID NO: 3586181 - DNA, 14 bp, Homo sapiens
atgtattcctatga

SEQ ID NO: 3586182 - DNA, 15 bp, Homo sapiens
atgtattcctatgac

SEQ ID NO: 3586183 - DNA, 18 bp, Homo sapiens
atgtattctgtaaaagaa

SEQ ID NO: 3586184 - DNA, 17 bp, Homo sapiens
atgtattgcacattgta

SEQ ID NO: 3586185 - DNA, 18 bp, Homo sapiens
atgtatttgaaaattaca

SEQ ID NO: 3586186 - DNA, 22 bp, Homo sapiens
atgtatttgaaaattacatgtt

SEQ ID NO: 3586187 - DNA, 12 bp, Homo sapiens
atgtattttaca

SEQ ID NO: 3586188 - DNA, 20 bp, Homo sapiens
atgtattttattattttctt

SEQ ID NO: 3586189 - DNA, 16 bp, Homo sapiens
atgtcaataacagtat

SEQ ID NO: 3586190 - DNA, 22 bp, Homo sapiens
atgtcactagaatggataaaat

SEQ ID NO: 3586191 - DNA, 20 bp, Homo sapiens
atgtcagggccaggtgcaga

SEQ ID NO: 3586192 - DNA, 23 bp, Homo sapiens
atgtcaggggcggggagggtgac

SEQ ID NO: 3586193 - DNA, 14 bp, Homo sapiens
atgtcagtatgtgg

SEQ ID NO: 3586194 - DNA, 15 bp, Homo sapiens
atgtcagttgttatt

SEQ ID NO: 3586195 - DNA, 16 bp, Homo sapiens
atgtcagttgttattt

SEQ ID NO: 3586196 - DNA, 22 bp, Homo sapiens
atgtcatcactctaggttttac

SEQ ID NO: 3586197 - DNA, 13 bp, Homo sapiens
atgtcattaaatg

SEQ ID NO: 3586198 - DNA, 16 bp, Homo sapiens
atgtccaaacccactc

SEQ ID NO: 3586199 - DNA, 22 bp, Homo sapiens
atgtccaaacccactcatgact

SEQ ID NO: 3586200 - DNA, 18 bp, Homo sapiens
atgtccacttaaaataca

SEQ ID NO: 3586201 - DNA, 12 bp, Homo sapiens
atgtccagtgag

SEQ ID NO: 3586202 - DNA, 20 bp, Homo sapiens
atgtccagtgagcagtgttg

SEQ ID NO: 3586203 - DNA, 19 bp, Homo sapiens
atgtccatttatatcattt

SEQ ID NO: 3586204 - DNA, 18 bp, Homo sapiens
atgtcgccaaaaatacag

SEQ ID NO: 3586205 - DNA, 13 bp, Homo sapiens
atgtcgcctctgc

SEQ ID NO: 3586206 - DNA, 14 bp, Homo sapiens
atgtcgcctctgca

SEQ ID NO: 3586207 - DNA, 17 bp, Homo sapiens
atgtctcaggtccctgc

SEQ ID NO: 3586208 - DNA, 22 bp, Homo sapiens
atgtctcaggtccctgcagggc

SEQ ID NO: 3586209 - DNA, 20 bp, Homo sapiens
atgtctgaaaagggactgtg

SEQ ID NO: 3586210 - DNA, 21 bp, Homo sapiens
attacagaaactgatgccaag

SEQ ID NO: 3586211 - DNA, 22 bp, Homo sapiens
attacagataaaatgtaaactg

SEQ ID NO: 3586212 - DNA, 18 bp, Homo sapiens
attacatgttttttcatt

SEQ ID NO: 3586213 - DNA, 19 bp, Homo sapiens
attaccagcttaaaacact

SEQ ID NO: 3586214 - DNA, 23 bp, Homo sapiens
attaccagggactatctttgctg

SEQ ID NO: 3586215 - DNA, 17 bp, Homo sapiens
attaccctacagacagc

SEQ ID NO: 3586216 - DNA, 15 bp, Homo sapiens
attaccgtgtaccac

SEQ ID NO: 3586217 - DNA, 13 bp, Homo sapiens
attactaaatata

SEQ ID NO: 3586218 - DNA, 15 bp, Homo sapiens
attactcctccatta

SEQ ID NO: 3586219 - DNA, 17 bp, Homo sapiens
attactggaattcttct

SEQ ID NO: 3586220 - DNA, 21 bp, Homo sapiens
attactggcctttttcattta

SEQ ID NO: 3586221 - DNA, 15 bp, Homo sapiens
attactgttccagat

SEQ ID NO: 3586222 - DNA, 21 bp, Homo sapiens
attacttatttaactgattaa

SEQ ID NO: 3586223 - DNA, 17 bp, Homo sapiens
attacttatttttgaca

SEQ ID NO: 3586224 - DNA, 19 bp, Homo sapiens
attactttaaattatatga

SEQ ID NO: 3586225 - DNA, 19 bp, Homo sapiens
attagagggaggagaatga

SEQ ID NO: 3586226 - DNA, 15 bp, Homo sapiens
attaggaagtgttta

SEQ ID NO: 3586227 - DNA, 16 bp, Homo sapiens
attaggatttcatgat

SEQ ID NO: 3586228 - DNA, 15 bp, Homo sapiens
attaggctgtaacta

SEQ ID NO: 3586229 - DNA, 21 bp, Homo sapiens
attaggctgtaactactttat

SEQ ID NO: 3586230 - DNA, 22 bp, Homo sapiens
attaggctgtaactactttata

SEQ ID NO: 3586231 - DNA, 23 bp, Homo sapiens
attaggctgtaactactttataa

SEQ ID NO: 3586232 - DNA, 16 bp, Homo sapiens
attagggagagaagat

SEQ ID NO: 3586233 - DNA, 22 bp, Homo sapiens
attagtcgttatatttgacttg

SEQ ID NO: 3586234 - DNA, 13 bp, Homo sapiens
attagtctgaaac

SEQ ID NO: 3586235 - DNA, 22 bp, Homo sapiens
attagtgattccatcaaagaga

SEQ ID NO: 3586236 - DNA, 18 bp, Homo sapiens
attagtgccacttaatgt

SEQ ID NO: 3586237 - DNA, 17 bp, Homo sapiens
attagttctttttgcca

SEQ ID NO: 3586238 - DNA, 14 bp, Homo sapiens
attagttgacagta

SEQ ID NO: 3586239 - DNA, 17 bp, Homo sapiens
attagttggctttcata

SEQ ID NO: 3586240 - DNA, 21 bp, Homo sapiens
attagttttgaagattctatg

SEQ ID NO: 3586241 - DNA, 19 bp, Homo sapiens
attataactattacagtgt

SEQ ID NO: 3586242 - DNA, 12 bp, Homo sapiens
attataatattt

SEQ ID NO: 3586243 - DNA, 16 bp, Homo sapiens
attataattggaagtg

SEQ ID NO: 3586244 - DNA, 14 bp, Homo sapiens
attatacaatgata

SEQ ID NO: 3586245 - DNA, 23 bp, Homo sapiens
attatatctcccccactccacta

SEQ ID NO: 3586246 - DNA, 16 bp, Homo sapiens
attatatgatatgcat

SEQ ID NO: 3586247 - DNA, 18 bp, Homo sapiens
attatatgatatgcatgt

SEQ ID NO: 3586248 - DNA, 21 bp, Homo sapiens
attatattttgttgctttctt

SEQ ID NO: 3586249 - DNA, 23 bp, Homo sapiens
attatcgctttatgtttttggtt

SEQ ID NO: 3586250 - DNA, 19 bp, Homo sapiens
attatctatagctaagtac

SEQ ID NO: 3586251 - DNA, 18 bp, Homo sapiens
attatctcaagtaaaaca

SEQ ID NO: 3586252 - DNA, 15 bp, Homo sapiens
attatgcagtgtttc

SEQ ID NO: 3586253 - DNA, 19 bp, Homo sapiens
attatgtgacattttacat

SEQ ID NO: 3586254 - DNA, 17 bp, Homo sapiens
attatgttaatatttct

SEQ ID NO: 3586255 - DNA, 23 bp, Homo sapiens
attatgttcttagcaataaatgc

SEQ ID NO: 3586256 - DNA, 14 bp, Homo sapiens
attatgttttactg

SEQ ID NO: 3586257 - DNA, 21 bp, Homo sapiens
attattaagtaacttatttat

SEQ ID NO: 3586258 - DNA, 13 bp, Homo sapiens
attattactttaa

SEQ ID NO: 3586259 - DNA, 17 bp, Homo sapiens
attattgatgttttcat

SEQ ID NO: 3586260 - DNA, 22 bp, Homo sapiens
attatttcattggtcttctttt

SEQ ID NO: 3586261 - DNA, 16 bp, Homo sapiens
attatttctccatccc

SEQ ID NO: 3586262 - DNA, 16 bp, Homo sapiens
attatttgattattta

SEQ ID NO: 3586263 - DNA, 18 bp, Homo sapiens
attatttgattatttaag

SEQ ID NO: 3586264 - DNA, 22 bp, Homo sapiens
attcaaaaagacagcagacaaa

SEQ ID NO: 3586265 - DNA, 23 bp, Homo sapiens
attcaaaaattatctatagctaa

SEQ ID NO: 3586266 - DNA, 19 bp, Homo sapiens
attcaaaatataacaggtg

SEQ ID NO: 3586267 - DNA, 15 bp, Homo sapiens
attcaaacagtctca

SEQ ID NO: 3586268 - DNA, 16 bp, Homo sapiens
attcaaacagtctcag

SEQ ID NO: 3586269 - DNA, 16 bp, Homo sapiens
attcaagcctctaaac

SEQ ID NO: 3586270 - DNA, 19 bp, Homo sapiens
attcaagcctctaaacaga

SEQ ID NO: 3586271 - DNA, 17 bp, Homo sapiens
attcaaggaatttctta

SEQ ID NO: 3586272 - DNA, 22 bp, Homo sapiens
attcaaggaatttcttaacttc

SEQ ID NO: 3586273 - DNA, 23 bp, Homo sapiens
attcaattaagttattaacattt

SEQ ID NO: 3586274 - DNA, 22 bp, Homo sapiens
attcacaagcctcctgtacctc

SEQ ID NO: 3586275 - DNA, 19 bp, Homo sapiens
attcacagtgctcttttct

SEQ ID NO: 3586276 - DNA, 19 bp, Homo sapiens
attcacccccctctgctgc

SEQ ID NO: 3586277 - DNA, 12 bp, Homo sapiens
attcagaaaaaa

SEQ ID NO: 3586278 - DNA, 12 bp, Homo sapiens
attcagatgtat

SEQ ID NO: 3586279 - DNA, 14 bp, Homo sapiens
attcagctctggag

SEQ ID NO: 3586280 - DNA, 16 bp, Homo sapiens
attcagctctggagaa

SEQ ID NO: 3586281 - DNA, 19 bp, Homo sapiens
attcagtaagttctgtggt

SEQ ID NO: 3586282 - DNA, 16 bp, Homo sapiens
attcagtgccttcaac

SEQ ID NO: 3586283 - DNA, 18 bp, Homo sapiens
attcagttctaggccttt

SEQ ID NO: 3586284 - DNA, 18 bp, Homo sapiens
attcatatttaatttgaa

SEQ ID NO: 3586285 - DNA, 17 bp, Homo sapiens
attcatggcctggggga

SEQ ID NO: 3586286 - DNA, 23 bp, Homo sapiens
attcatggttcaagtattaagca

SEQ ID NO: 3586287 - DNA, 15 bp, Homo sapiens
attccaaagctttat

SEQ ID NO: 3586288 - DNA, 22 bp, Homo sapiens
attccaaggctttaaagctgag

SEQ ID NO: 3586289 - DNA, 16 bp, Homo sapiens
attccaccctgttact

SEQ ID NO: 3586290 - DNA, 21 bp, Homo sapiens
attccagagagtggctcctcc

SEQ ID NO: 3586291 - DNA, 16 bp, Homo sapiens
attcccaaatcctaga

SEQ ID NO: 3586292 - DNA, 17 bp, Homo sapiens
attcccaaatcctagac

SEQ ID NO: 3586293 - DNA, 16 bp, Homo sapiens
attcccaagggagact

SEQ ID NO: 3586294 - DNA, 14 bp, Homo sapiens
attcccagcctgac

SEQ ID NO: 3586295 - DNA, 22 bp, Homo sapiens
attcccagcctgactagaactc

SEQ ID NO: 3586296 - DNA, 14 bp, Homo sapiens
attccccagtgact

SEQ ID NO: 3586297 - DNA, 18 bp, Homo sapiens
attccccagtgactccag

SEQ ID NO: 3586298 - DNA, 19 bp, Homo sapiens
attccccagtgactccagg

SEQ ID NO: 3586299 - DNA, 13 bp, Homo sapiens
attccccatcaac

SEQ ID NO: 3586300 - DNA, 22 bp, Homo sapiens
attcccctcccacctctccttt

SEQ ID NO: 3586301 - DNA, 16 bp, Homo sapiens
attccctccccctcct

SEQ ID NO: 3586302 - DNA, 12 bp, Homo sapiens
attccctgccca

SEQ ID NO: 3586303 - DNA, 19 bp, Homo sapiens
attcctccagcctcccctc

SEQ ID NO: 3586304 - DNA, 12 bp, Homo sapiens
attcctccagct

SEQ ID NO: 3586305 - DNA, 18 bp, Homo sapiens
attcctgcatttgtgaaa

SEQ ID NO: 3586306 - DNA, 22 bp, Homo sapiens
attcctttgttacttctctaat

SEQ ID NO: 3586307 - DNA, 14 bp, Homo sapiens
attctatgttaata

SEQ ID NO: 3586308 - DNA, 20 bp, Homo sapiens
attctatgttaatattttat

SEQ ID NO: 3586309 - DNA, 14 bp, Homo sapiens
attctattctccag

SEQ ID NO: 3586310 - DNA, 16 bp, Homo sapiens
attctattttagaata

SEQ ID NO: 3586311 - DNA, 15 bp, Homo sapiens
attctcaaagtttta

SEQ ID NO: 3586312 - DNA, 12 bp, Homo sapiens
attctcagggct

SEQ ID NO: 3586313 - DNA, 13 bp, Homo sapiens
attctccagacat

SEQ ID NO: 3586314 - DNA, 15 bp, Homo sapiens
attctcccagctcta

SEQ ID NO: 3586315 - DNA, 22 bp, Homo sapiens
attctctagtcatttgttaata

SEQ ID NO: 3586316 - DNA, 17 bp, Homo sapiens
attctctcccatcctgg

SEQ ID NO: 3586317 - DNA, 11 bp, Homo sapiens
attctctgcag

SEQ ID NO: 3586318 - DNA, 13 bp, Homo sapiens
attctctgcagcc

SEQ ID NO: 3586319 - DNA, 21 bp, Homo sapiens
attctctgcagcccattccca

SEQ ID NO: 3586320 - DNA, 19 bp, Homo sapiens
attctcttttatctgttta

SEQ ID NO: 3586321 - DNA, 14 bp, Homo sapiens
attctgaaaaagac

SEQ ID NO: 3586322 - DNA, 16 bp, Homo sapiens
attctgaaaaagacat

SEQ ID NO: 3586323 - DNA, 21 bp, Homo sapiens
attctgaaccctccaaaggaa

SEQ ID NO: 3586324 - DNA, 14 bp, Homo sapiens
attctgaccttaaa

SEQ ID NO: 3586325 - DNA, 18 bp, Homo sapiens
attctgaccttaaatgca

SEQ ID NO: 3586326 - DNA, 19 bp, Homo sapiens
attctgattgctatcagca

SEQ ID NO: 3586327 - DNA, 16 bp, Homo sapiens
attctggacagacaga

SEQ ID NO: 3586328 - DNA, 15 bp, Homo sapiens
attctggagatactg

SEQ ID NO: 3586329 - DNA, 18 bp, Homo sapiens
attctggttccctgctgc

SEQ ID NO: 3586330 - DNA, 19 bp, Homo sapiens
attctggttccctgctgcg

SEQ ID NO: 3586331 - DNA, 15 bp, Homo sapiens
attctgtttgccttt

SEQ ID NO: 3586332 - DNA, 14 bp, Homo sapiens
attcttaaaaattg

SEQ ID NO: 3586333 - DNA, 17 bp, Homo sapiens
attcttaaaaattgaat

SEQ ID NO: 3586334 - DNA, 22 bp, Homo sapiens
attcttactaaaaagtataaaa

SEQ ID NO: 3586335 - DNA, 18 bp, Homo sapiens
attctttagcttacctgg

SEQ ID NO: 3586336 - DNA, 21 bp, Homo sapiens
attctttagcttacctgggca

SEQ ID NO: 3586337 - DNA, 16 bp, Homo sapiens
attctttttgaaatgt

SEQ ID NO: 3586338 - DNA, 13 bp, Homo sapiens
attgaaaacttca

SEQ ID NO: 3586339 - DNA, 15 bp, Homo sapiens
attgaaaacttcaaa

SEQ ID NO: 3586340 - DNA, 13 bp, Homo sapiens
attgaaagaatgt

SEQ ID NO: 3586341 - DNA, 14 bp, Homo sapiens
attgaaagaatgta

SEQ ID NO: 3586342 - DNA, 12 bp, Homo sapiens
atgccagagagg

SEQ ID NO: 3586343 - DNA, 17 bp, Homo sapiens
atgccagcttctctctc

SEQ ID NO: 3586344 - DNA, 17 bp, Homo sapiens
atgccatttaaagctta

SEQ ID NO: 3586345 - DNA, 20 bp, Homo sapiens
atgcccagtaaaatttcagg

SEQ ID NO: 3586346 - DNA, 15 bp, Homo sapiens
atgcccagtgagact

SEQ ID NO: 3586347 - DNA, 16 bp, Homo sapiens
atgcccagtgagactg

SEQ ID NO: 3586348 - DNA, 17 bp, Homo sapiens
atgccccctccaggaga

SEQ ID NO: 3586349 - DNA, 17 bp, Homo sapiens
atgccccgagcccaggc

SEQ ID NO: 3586350 - DNA, 23 bp, Homo sapiens
atgccctactctcttatgcatta

SEQ ID NO: 3586351 - DNA, 16 bp, Homo sapiens
atgccctcaagtaaaa

SEQ ID NO: 3586352 - DNA, 19 bp, Homo sapiens
atgccctcaagtaaaagaa

SEQ ID NO: 3586353 - DNA, 15 bp, Homo sapiens
atgccctcctctccc

SEQ ID NO: 3586354 - DNA, 21 bp, Homo sapiens
atgccctctctcgggagccct

SEQ ID NO: 3586355 - DNA, 24 bp, Homo sapiens
atgccctctctcgggagccctagc

SEQ ID NO: 3586356 - DNA, 16 bp, Homo sapiens
atgccctggaggtggc

SEQ ID NO: 3586357 - DNA, 18 bp, Homo sapiens
atgcctagcagagaactg

SEQ ID NO: 3586358 - DNA, 18 bp, Homo sapiens
atgcctctgccaaaggat

SEQ ID NO: 3586359 - DNA, 13 bp, Homo sapiens
atgcctgttaatt

SEQ ID NO: 3586360 - DNA, 15 bp, Homo sapiens
atgcctgttaattta

SEQ ID NO: 3586361 - DNA, 21 bp, Homo sapiens
atgcctgttaatttataatgt

SEQ ID NO: 3586362 - DNA, 23 bp, Homo sapiens
atgcctgttaatttataatgtat

SEQ ID NO: 3586363 - DNA, 16 bp, Homo sapiens
atgccttcccctgggc

SEQ ID NO: 3586364 - DNA, 19 bp, Homo sapiens
atgccttgaggtgaaatgg

SEQ ID NO: 3586365 - DNA, 15 bp, Homo sapiens
atgccttttgaatac

SEQ ID NO: 3586366 - DNA, 14 bp, Homo sapiens
atgcggatcctgct

SEQ ID NO: 3586367 - DNA, 22 bp, Homo sapiens
atgcgtgtgtttggtttcccat

SEQ ID NO: 3586368 - DNA, 22 bp, Homo sapiens
atgctataaattttttgaaaca

SEQ ID NO: 3586369 - DNA, 13 bp, Homo sapiens
atgctatctctgt

SEQ ID NO: 3586370 - DNA, 19 bp, Homo sapiens
atgctcaacccccctccca

SEQ ID NO: 3586371 - DNA, 12 bp, Homo sapiens
atgctcagacca

SEQ ID NO: 3586372 - DNA, 16 bp, Homo sapiens
atgctctagtgccttc

SEQ ID NO: 3586373 - DNA, 17 bp, Homo sapiens
atgctctagtgccttct

SEQ ID NO: 3586374 - DNA, 18 bp, Homo sapiens
atgctctctcaaattgtc

SEQ ID NO: 3586375 - DNA, 19 bp, Homo sapiens
atgctctctcaaattgtca

SEQ ID NO: 3586376 - DNA, 21 bp, Homo sapiens
atgctctctttcttttctctg

SEQ ID NO: 3586377 - DNA, 19 bp, Homo sapiens
atgctgactgtactcctcc

SEQ ID NO: 3586378 - DNA, 20 bp, Homo sapiens
atgctgactgtactcctccc

SEQ ID NO: 3586379 - DNA, 14 bp, Homo sapiens
atgctgaggcccct

SEQ ID NO: 3586380 - DNA, 22 bp, Homo sapiens
atgctgcctcaggacccatccc

SEQ ID NO: 3586381 - DNA, 12 bp, Homo sapiens
atgctgcctcca

SEQ ID NO: 3586382 - DNA, 15 bp, Homo sapiens
atgctgcctccagaa

SEQ ID NO: 3586383 - DNA, 23 bp, Homo sapiens
atgctgcctggcacagaccaggc

SEQ ID NO: 3586384 - DNA, 23 bp, Homo sapiens
atgctgctcccctaaagccaggc

SEQ ID NO: 3586385 - DNA, 16 bp, Homo sapiens
atgctgctggggaaga

SEQ ID NO: 3586386 - DNA, 17 bp, Homo sapiens
atgctgctggggaagac

SEQ ID NO: 3586387 - DNA, 21 bp, Homo sapiens
atgctgctggggaagacagtg

SEQ ID NO: 3586388 - DNA, 18 bp, Homo sapiens
atgctggcccagggccca

SEQ ID NO: 3586389 - DNA, 19 bp, Homo sapiens
atgctggcccagggcccag

SEQ ID NO: 3586390 - DNA, 22 bp, Homo sapiens
atgctggcccagggcccagagc

SEQ ID NO: 3586391 - DNA, 14 bp, Homo sapiens
atgctgggccactg

SEQ ID NO: 3586392 - DNA, 21 bp, Homo sapiens
atgctggtagatgctgaggcc

SEQ ID NO: 3586393 - DNA, 21 bp, Homo sapiens
atgctgtctttcttgctccct

SEQ ID NO: 3586394 - DNA, 14 bp, Homo sapiens
atgctgtgcccctg

SEQ ID NO: 3586395 - DNA, 16 bp, Homo sapiens
atgctgttgtgaagct

SEQ ID NO: 3586396 - DNA, 17 bp, Homo sapiens
atgctgtttcctagcta

SEQ ID NO: 3586397 - DNA, 16 bp, Homo sapiens
atgcttgcatggagaa

SEQ ID NO: 3586398 - DNA, 12 bp, Homo sapiens
atggaaaataaa

SEQ ID NO: 3586399 - DNA, 14 bp, Homo sapiens
atggaaaataaaca

SEQ ID NO: 3586400 - DNA, 15 bp, Homo sapiens
atggaaaataaacat

SEQ ID NO: 3586401 - DNA, 15 bp, Homo sapiens
atggaaggaagaaaa

SEQ ID NO: 3586402 - DNA, 18 bp, Homo sapiens
atggaatatcatgaatgt

SEQ ID NO: 3586403 - DNA, 16 bp, Homo sapiens
atggaattccctcctg

SEQ ID NO: 3586404 - DNA, 19 bp, Homo sapiens
atggacatgatcttcttta

SEQ ID NO: 3586405 - DNA, 14 bp, Homo sapiens
atggacatggtggc

SEQ ID NO: 3586406 - DNA, 21 bp, Homo sapiens
atggactcaggatccagtgac

SEQ ID NO: 3586407 - DNA, 21 bp, Homo sapiens
atggagaaagaagtggagaca

SEQ ID NO: 3586408 - DNA, 19 bp, Homo sapiens
atggagacaccctctgggg

SEQ ID NO: 3586409 - DNA, 11 bp, Homo sapiens
atggagacagc

SEQ ID NO: 3586410 - DNA, 18 bp, Homo sapiens
atggagactgtctcaaga

SEQ ID NO: 3586411 - DNA, 17 bp, Homo sapiens
atggagccccctctgcc

SEQ ID NO: 3586412 - DNA, 22 bp, Homo sapiens
atggaggaaaaccaagccgtgg

SEQ ID NO: 3586413 - DNA, 21 bp, Homo sapiens
atggagtagaggtactagaat

SEQ ID NO: 3586414 - DNA, 18 bp, Homo sapiens
atggagtgagtcacctgc

SEQ ID NO: 3586415 - DNA, 19 bp, Homo sapiens
atggagtgagtcacctgct

SEQ ID NO: 3586416 - DNA, 18 bp, Homo sapiens
atggataatctgagcagg

SEQ ID NO: 3586417 - DNA, 21 bp, Homo sapiens
atggataatctgagcaggtac

SEQ ID NO: 3586418 - DNA, 22 bp, Homo sapiens
atggataatctgagcaggtaca

SEQ ID NO: 3586419 - DNA, 23 bp, Homo sapiens
atggattcacccccctctgctgc

SEQ ID NO: 3586420 - DNA, 14 bp, Homo sapiens
atggcaacagatct

SEQ ID NO: 3586421 - DNA, 16 bp, Homo sapiens
atggcaacagatctgg

SEQ ID NO: 3586422 - DNA, 23 bp, Homo sapiens
atggcaagttttccatattttta

SEQ ID NO: 3586423 - DNA, 16 bp, Homo sapiens
atggcagagaagatga

SEQ ID NO: 3586424 - DNA, 15 bp, Homo sapiens
atggcagagccaggc

SEQ ID NO: 3586425 - DNA, 15 bp, Homo sapiens
atggcagctagtgcc

SEQ ID NO: 3586426 - DNA, 12 bp, Homo sapiens
atggcagctcct

SEQ ID NO: 3586427 - DNA, 12 bp, Homo sapiens
atggcaggactc

SEQ ID NO: 3586428 - DNA, 14 bp, Homo sapiens
atggcaggactcct

SEQ ID NO: 3586429 - DNA, 16 bp, Homo sapiens
atggcaggactcctgg

SEQ ID NO: 3586430 - DNA, 19 bp, Homo sapiens
atggcaggagtctctgcca

SEQ ID NO: 3586431 - DNA, 22 bp, Homo sapiens
atggcagtgactccccagccca

SEQ ID NO: 3586432 - DNA, 22 bp, Homo sapiens
atggcatccctttttcataaat

SEQ ID NO: 3586433 - DNA, 16 bp, Homo sapiens
atggcatggcaggagt

SEQ ID NO: 3586434 - DNA, 13 bp, Homo sapiens
atggccacaaacc

SEQ ID NO: 3586435 - DNA, 22 bp, Homo sapiens
atggccaggtggccactccaga

SEQ ID NO: 3586436 - DNA, 14 bp, Homo sapiens
atggccctcattca

SEQ ID NO: 3586437 - DNA, 14 bp, Homo sapiens
atggccgggcaggg

SEQ ID NO: 3586438 - DNA, 12 bp, Homo sapiens
atggcctggagc

SEQ ID NO: 3586439 - DNA, 13 bp, Homo sapiens
atggcctggagca

SEQ ID NO: 3586440 - DNA, 15 bp, Homo sapiens
atggcctggagcagg

SEQ ID NO: 3586441 - DNA, 18 bp, Homo sapiens
atggctaatgtactgcat

SEQ ID NO: 3586442 - DNA, 19 bp, Homo sapiens
atggctataggtgctacaa

SEQ ID NO: 3586443 - DNA, 17 bp, Homo sapiens
atggctatttttgaagc

SEQ ID NO: 3586444 - DNA, 12 bp, Homo sapiens
atggctcctctc

SEQ ID NO: 3586445 - DNA, 13 bp, Homo sapiens
atggctcctctca

SEQ ID NO: 3586446 - DNA, 13 bp, Homo sapiens
atggctgcccagg

SEQ ID NO: 3586447 - DNA, 15 bp, Homo sapiens
atggctgcccaggag

SEQ ID NO: 3586448 - DNA, 15 bp, Homo sapiens
atggctgtgcctctg

SEQ ID NO: 3586449 - DNA, 17 bp, Homo sapiens
atggctgtgcctctgcc

SEQ ID NO: 3586450 - DNA, 20 bp, Homo sapiens
atggctgtgcctctgcctgt

SEQ ID NO: 3586451 - DNA, 14 bp, Homo sapiens
atgggaaagcattg

SEQ ID NO: 3586452 - DNA, 18 bp, Homo sapiens
atgggagacccttgacac

SEQ ID NO: 3586453 - DNA, 22 bp, Homo sapiens
atgggatggtcggatctcacag

SEQ ID NO: 3586454 - DNA, 20 bp, Homo sapiens
atgggcaaagcttgtcaaag

SEQ ID NO: 3586455 - DNA, 23 bp, Homo sapiens
atgggcggaagtacttccctcag

SEQ ID NO: 3586456 - DNA, 23 bp, Homo sapiens
atgggctcgccgtgtctcagcct

SEQ ID NO: 3586457 - DNA, 23 bp, Homo sapiens
atgggctgtgtcctaaggcccat

SEQ ID NO: 3586458 - DNA, 13 bp, Homo sapiens
atggggaggacaa

SEQ ID NO: 3586459 - DNA, 15 bp, Homo sapiens
atggggcaagacaga

SEQ ID NO: 3586460 - DNA, 19 bp, Homo sapiens
atggggccagatccagcct

SEQ ID NO: 3586461 - DNA, 16 bp, Homo sapiens
atggggtcctggccat

SEQ ID NO: 3586462 - DNA, 12 bp, Homo sapiens
atgggtccaggg

SEQ ID NO: 3586463 - DNA, 14 bp, Homo sapiens
atgggtccagggcc

SEQ ID NO: 3586464 - DNA, 15 bp, Homo sapiens
atgggtccagggcct

SEQ ID NO: 3586465 - DNA, 10 bp, Homo sapiens
atgggtctta

SEQ ID NO: 3586466 - DNA, 14 bp, Homo sapiens
atggtaggaccctc

SEQ ID NO: 3586467 - DNA, 22 bp, Homo sapiens
atggtaggaccctcgagagcct

SEQ ID NO: 3586468 - DNA, 20 bp, Homo sapiens
atggtcacgtttggtgcttc

SEQ ID NO: 3586469 - DNA, 24 bp, Homo sapiens
atggtcacgtttggtgcttctcag

SEQ ID NO: 3586470 - DNA, 15 bp, Homo sapiens
atggtccatagcact

SEQ ID NO: 3586471 - DNA, 17 bp, Homo sapiens
atggtcggatctcacag

SEQ ID NO: 3586472 - DNA, 20 bp, Homo sapiens
atggtgaaattataactatt

SEQ ID NO: 3586473 - DNA, 14 bp, Homo sapiens
atggtgccccagga

SEQ ID NO: 3586474 - DNA, 20 bp, Homo sapiens
atggtgccccaggaccagct

SEQ ID NO: 3586475 - DNA, 21 bp, Homo sapiens
atggtgctgcagatttgatat

SEQ ID NO: 3586476 - DNA, 18 bp, Homo sapiens
atggtggcacacgcctgt

SEQ ID NO: 3586477 - DNA, 17 bp, Homo sapiens
atggtggccacagactg

SEQ ID NO: 3586478 - DNA, 22 bp, Homo sapiens
atctttttatcccatttagtgt

SEQ ID NO: 3586479 - DNA, 19 bp, Homo sapiens
atcttttttttaaaaaaac

SEQ ID NO: 3586480 - DNA, 12 bp, Homo sapiens
atgaaaaagaat

SEQ ID NO: 3586481 - DNA, 17 bp, Homo sapiens
atgaaaactaaggattt

SEQ ID NO: 3586482 - DNA, 18 bp, Homo sapiens
atgaaaataactgaacca

SEQ ID NO: 3586483 - DNA, 21 bp, Homo sapiens
atgaaaataactgaaccaaat

SEQ ID NO: 3586484 - DNA, 18 bp, Homo sapiens
atgaaaatattttttaca

SEQ ID NO: 3586485 - DNA, 20 bp, Homo sapiens
atgaaacaaaaaaaaaatga

SEQ ID NO: 3586486 - DNA, 12 bp, Homo sapiens
atgaaacaatct

SEQ ID NO: 3586487 - DNA, 23 bp, Homo sapiens
atgaaacatcctatgaaatactt

SEQ ID NO: 3586488 - DNA, 18 bp, Homo sapiens
atgaaagaaaacttttat

SEQ ID NO: 3586489 - DNA, 19 bp, Homo sapiens
atgaaagatggctgtgcct

SEQ ID NO: 3586490 - DNA, 20 bp, Homo sapiens
atgaaagatggctgtgcctc

SEQ ID NO: 3586491 - DNA, 18 bp, Homo sapiens
atgaaatatatttaaaat

SEQ ID NO: 3586492 - DNA, 22 bp, Homo sapiens
atgaaatatattttctcttttt

SEQ ID NO: 3586493 - DNA, 21 bp, Homo sapiens
atgaaatgccctcctaaatgt

SEQ ID NO: 3586494 - DNA, 21 bp, Homo sapiens
atgaaatgtgcactttatcct

SEQ ID NO: 3586495 - DNA, 17 bp, Homo sapiens
atgaaatttaattacaa

SEQ ID NO: 3586496 - DNA, 20 bp, Homo sapiens
atgaaatttaattacaaaca

SEQ ID NO: 3586497 - DNA, 14 bp, Homo sapiens
atgaaccttctggc

SEQ ID NO: 3586498 - DNA, 17 bp, Homo sapiens
atgaaccttctggcctc

SEQ ID NO: 3586499 - DNA, 14 bp, Homo sapiens
atgaagaaggaagc

SEQ ID NO: 3586500 - DNA, 20 bp, Homo sapiens
atgaagacagaggcagagat

SEQ ID NO: 3586501 - DNA, 23 bp, Homo sapiens
atgaagcaattagtctgaaactg

SEQ ID NO: 3586502 - DNA, 22 bp, Homo sapiens
atgaagcagaaccttctttggt

SEQ ID NO: 3586503 - DNA, 22 bp, Homo sapiens
atgaagctgtataattaattgt

SEQ ID NO: 3586504 - DNA, 20 bp, Homo sapiens
atgaagtcataggttacaga

SEQ ID NO: 3586505 - DNA, 19 bp, Homo sapiens
atgaagtgcacaggagcca

SEQ ID NO: 3586506 - DNA, 22 bp, Homo sapiens
atgaagtttgtagttgttttaa

SEQ ID NO: 3586507 - DNA, 15 bp, Homo sapiens
atgaataaaacactc

SEQ ID NO: 3586508 - DNA, 23 bp, Homo sapiens
atgaatatatttaagcaacatct

SEQ ID NO: 3586509 - DNA, 19 bp, Homo sapiens
atgaatgggcatttctaaa

SEQ ID NO: 3586510 - DNA, 23 bp, Homo sapiens
atgacaaaagatacaaaagcttt

SEQ ID NO: 3586511 - DNA, 22 bp, Homo sapiens
atgacaaacatcattgtttaga

SEQ ID NO: 3586512 - DNA, 16 bp, Homo sapiens
atgacacccatgccag

SEQ ID NO: 3586513 - DNA, 15 bp, Homo sapiens
atgacaccctggcct

SEQ ID NO: 3586514 - DNA, 20 bp, Homo sapiens
atgacagaggtttgaaggag

SEQ ID NO: 3586515 - DNA, 21 bp, Homo sapiens
atgacagaggtttgaaggaga

SEQ ID NO: 3586516 - DNA, 23 bp, Homo sapiens
atgacagaggtttgaaggagaat

SEQ ID NO: 3586517 - DNA, 15 bp, Homo sapiens
atgacagccttgcaa

SEQ ID NO: 3586518 - DNA, 15 bp, Homo sapiens
atgacaggcctgtcc

SEQ ID NO: 3586519 - DNA, 17 bp, Homo sapiens
atgacatatcacatgtc

SEQ ID NO: 3586520 - DNA, 14 bp, Homo sapiens
atgacatcacttgt

SEQ ID NO: 3586521 - DNA, 18 bp, Homo sapiens
atgacatcacttgtacaa

SEQ ID NO: 3586522 - DNA, 17 bp, Homo sapiens
atgaccagggatgctgg

SEQ ID NO: 3586523 - DNA, 20 bp, Homo sapiens
atgaccagggatgctgggct

SEQ ID NO: 3586524 - DNA, 21 bp, Homo sapiens
atgaccagggatgctgggctg

SEQ ID NO: 3586525 - DNA, 22 bp, Homo sapiens
atgaccagggatgctgggctgg

SEQ ID NO: 3586526 - DNA, 20 bp, Homo sapiens
atgaccattgagtccctgct

SEQ ID NO: 3586527 - DNA, 14 bp, Homo sapiens
atgacctcaaggaa

SEQ ID NO: 3586528 - DNA, 18 bp, Homo sapiens
atgacctcaaggaagcta

SEQ ID NO: 3586529 - DNA, 13 bp, Homo sapiens
atgacctccagaa

SEQ ID NO: 3586530 - DNA, 22 bp, Homo sapiens
atgacctccagaagtcccttca

SEQ ID NO: 3586531 - DNA, 11 bp, Homo sapiens
atgacctgccc

SEQ ID NO: 3586532 - DNA, 15 bp, Homo sapiens
atgacttagaaactg

SEQ ID NO: 3586533 - DNA, 19 bp, Homo sapiens
atgacttatttctgctctg

SEQ ID NO: 3586534 - DNA, 21 bp, Homo sapiens
atgacttatttctgctctgga

SEQ ID NO: 3586535 - DNA, 19 bp, Homo sapiens
atgactttgcagatggaaa

SEQ ID NO: 3586536 - DNA, 15 bp, Homo sapiens
atgagaaacagctca

SEQ ID NO: 3586537 - DNA, 20 bp, Homo sapiens
atgagaaacagctcagccag

SEQ ID NO: 3586538 - DNA, 17 bp, Homo sapiens
atgagatctgaatgtgg

SEQ ID NO: 3586539 - DNA, 17 bp, Homo sapiens
atgagatggccatgctc

SEQ ID NO: 3586540 - DNA, 11 bp, Homo sapiens
atgagctggca

SEQ ID NO: 3586541 - DNA, 20 bp, Homo sapiens
atgagctggcaaccagccag

SEQ ID NO: 3586542 - DNA, 23 bp, Homo sapiens
atgagctggcaaccagccagcgt

SEQ ID NO: 3586543 - DNA, 20 bp, Homo sapiens
atgaggccatctcaggagat

SEQ ID NO: 3586544 - DNA, 11 bp, Homo sapiens
atgagggccac

SEQ ID NO: 3586545 - DNA, 18 bp, Homo sapiens
atgaggtcaccaggggag

SEQ ID NO: 3586546 - DNA, 22 bp, Homo sapiens
atgaggtcaccaggggaggagc

SEQ ID NO: 3586547 - DNA, 13 bp, Homo sapiens
atgaggtctgttt

SEQ ID NO: 3586548 - DNA, 22 bp, Homo sapiens
atgagtcatttgtttaaacaat

SEQ ID NO: 3586549 - DNA, 13 bp, Homo sapiens
atgagtttttccc

SEQ ID NO: 3586550 - DNA, 14 bp, Homo sapiens
atgataaaggaaat

SEQ ID NO: 3586551 - DNA, 15 bp, Homo sapiens
atgataaaggaaata

SEQ ID NO: 3586552 - DNA, 15 bp, Homo sapiens
atgataacactattt

SEQ ID NO: 3586553 - DNA, 14 bp, Homo sapiens
atgatactgtctct

SEQ ID NO: 3586554 - DNA, 22 bp, Homo sapiens
atgatactgtctctccagtgaa

SEQ ID NO: 3586555 - DNA, 22 bp, Homo sapiens
atgatacttacaagtttctagc

SEQ ID NO: 3586556 - DNA, 12 bp, Homo sapiens
atgatatgcatg

SEQ ID NO: 3586557 - DNA, 18 bp, Homo sapiens
atgatatgcatgtagcat

SEQ ID NO: 3586558 - DNA, 17 bp, Homo sapiens
atgatatgcttgtaact

SEQ ID NO: 3586559 - DNA, 22 bp, Homo sapiens
atgatccccgtctctgccctgg

SEQ ID NO: 3586560 - DNA, 12 bp, Homo sapiens
atgatctcttct

SEQ ID NO: 3586561 - DNA, 17 bp, Homo sapiens
atgatctcttctggtgt

SEQ ID NO: 3586562 - DNA, 16 bp, Homo sapiens
atgatctttaaaatac

SEQ ID NO: 3586563 - DNA, 18 bp, Homo sapiens
atgatgatctttaaaata

SEQ ID NO: 3586564 - DNA, 17 bp, Homo sapiens
atgatggatggcagact

SEQ ID NO: 3586565 - DNA, 19 bp, Homo sapiens
atgatggcaattttgtaac

SEQ ID NO: 3586566 - DNA, 16 bp, Homo sapiens
atgatgtatatccata

SEQ ID NO: 3586567 - DNA, 14 bp, Homo sapiens
atgatgtccttgga

SEQ ID NO: 3586568 - DNA, 19 bp, Homo sapiens
atgatgtctttttattaaa

SEQ ID NO: 3586569 - DNA, 16 bp, Homo sapiens
atcccctccctgcctg

SEQ ID NO: 3586570 - DNA, 17 bp, Homo sapiens
atcccctccctgcctgc

SEQ ID NO: 3586571 - DNA, 18 bp, Homo sapiens
atcccctccctgcctgct

SEQ ID NO: 3586572 - DNA, 24 bp, Homo sapiens
atcccgcttctgaagctgctgcag

SEQ ID NO: 3586573 - DNA, 12 bp, Homo sapiens
atccctacatgt

SEQ ID NO: 3586574 - DNA, 12 bp, Homo sapiens
atccctcaccca

SEQ ID NO: 3586575 - DNA, 12 bp, Homo sapiens
atccctctcttc

SEQ ID NO: 3586576 - DNA, 14 bp, Homo sapiens
atccctctcttccc

SEQ ID NO: 3586577 - DNA, 20 bp, Homo sapiens
atccctctcttccccttccc

SEQ ID NO: 3586578 - DNA, 20 bp, Homo sapiens
atccctgcctggaggctcct

SEQ ID NO: 3586579 - DNA, 23 bp, Homo sapiens
atccctgcctggaggctcctcta

SEQ ID NO: 3586580 - DNA, 18 bp, Homo sapiens
atccctgcttgcccgctc

SEQ ID NO: 3586581 - DNA, 14 bp, Homo sapiens
atccctggagcagg

SEQ ID NO: 3586582 - DNA, 17 bp, Homo sapiens
atccctggagcaggagc

SEQ ID NO: 3586583 - DNA, 22 bp, Homo sapiens
atccctggagcaggagccccgc

SEQ ID NO: 3586584 - DNA, 19 bp, Homo sapiens
atcccttcctggaaacagc

SEQ ID NO: 3586585 - DNA, 19 bp, Homo sapiens
atcccttggacattttatg

SEQ ID NO: 3586586 - DNA, 15 bp, Homo sapiens
atccgactgcccctg

SEQ ID NO: 3586587 - DNA, 14 bp, Homo sapiens
atcctagactgctc

SEQ ID NO: 3586588 - DNA, 21 bp, Homo sapiens
atcctagactgctcctgggca

SEQ ID NO: 3586589 - DNA, 13 bp, Homo sapiens
atcctagacttga

SEQ ID NO: 3586590 - DNA, 20 bp, Homo sapiens
atcctatatagaatgctgca

SEQ ID NO: 3586591 - DNA, 15 bp, Homo sapiens
atcctcaaagaaagt

SEQ ID NO: 3586592 - DNA, 20 bp, Homo sapiens
atcctcaaagaaagtgtatt

SEQ ID NO: 3586593 - DNA, 16 bp, Homo sapiens
atcctcatccctgact

SEQ ID NO: 3586594 - DNA, 14 bp, Homo sapiens
atcctccacagaga

SEQ ID NO: 3586595 - DNA, 11 bp, Homo sapiens
atcctccagca

SEQ ID NO: 3586596 - DNA, 19 bp, Homo sapiens
agttagttccactgagacc

SEQ ID NO: 3586597 - DNA, 15 bp, Homo sapiens
atagatcagtatttc

SEQ ID NO: 3586598 - DNA, 16 bp, Homo sapiens
atagatgactttgcag

SEQ ID NO: 3586599 - DNA, 17 bp, Homo sapiens
atagatgactttgcaga

SEQ ID NO: 3586600 - DNA, 15 bp, Homo sapiens
atagatgctggccca

SEQ ID NO: 3586601 - DNA, 23 bp, Homo sapiens
atagatgctggcccagggcccag

SEQ ID NO: 3586602 - DNA, 12 bp, Homo sapiens
atagatgtgtgg

SEQ ID NO: 3586603 - DNA, 15 bp, Homo sapiens
atagattcagagaaa

SEQ ID NO: 3586604 - DNA, 21 bp, Homo sapiens
atagcagaaaaaccaacatct

SEQ ID NO: 3586605 - DNA, 24 bp, Homo sapiens
atagcagcctcacactggcgtctg

SEQ ID NO: 3586606 - DNA, 13 bp, Homo sapiens
atagcatgaaata

SEQ ID NO: 3586607 - DNA, 15 bp, Homo sapiens
atagcatgaaataaa

SEQ ID NO: 3586608 - DNA, 23 bp, Homo sapiens
aggggtgtttgggagctgctggg

SEQ ID NO: 3586609 - DNA, 21 bp, Homo sapiens
aggggttttcttgataatttt

SEQ ID NO: 3586610 - DNA, 15 bp, Homo sapiens
agggtagtggctggg

SEQ ID NO: 3586611 - DNA, 13 bp, Homo sapiens
agggtccacagct

SEQ ID NO: 3586612 - DNA, 16 bp, Homo sapiens
agggtccacagctgga

SEQ ID NO: 3586613 - DNA, 19 bp, Homo sapiens
agggtccaggagagcctgg

SEQ ID NO: 3586614 - DNA, 22 bp, Homo sapiens
agggtcccggtgtatcctggcc

SEQ ID NO: 3586615 - DNA, 12 bp, Homo sapiens
agggtccctggg

SEQ ID NO: 3586616 - DNA, 16 bp, Homo sapiens
agggtcctgcagcctg

SEQ ID NO: 3586617 - DNA, 21 bp, Homo sapiens
agggtcctgcagcctgcagga

SEQ ID NO: 3586618 - DNA, 22 bp, Homo sapiens
agggtcctgtcgaaggggaggc

SEQ ID NO: 3586619 - DNA, 15 bp, Homo sapiens
agggtcgtgggaaag

SEQ ID NO: 3586620 - DNA, 17 bp, Homo sapiens
agggtcgtgggaaaggg

SEQ ID NO: 3586621 - DNA, 20 bp, Homo sapiens
agggtcgtgggaaaggggag

SEQ ID NO: 3586622 - DNA, 21 bp, Homo sapiens
agggtcgtgggaaaggggagt

SEQ ID NO: 3586623 - DNA, 16 bp, Homo sapiens
agggtctcccctcctg

SEQ ID NO: 3586624 - DNA, 19 bp, Homo sapiens
agggtctcccctcctgcac

SEQ ID NO: 3586625 - DNA, 20 bp, Homo sapiens
agggtctcccctcctgcaca

SEQ ID NO: 3586626 - DNA, 19 bp, Homo sapiens
agggtctctctccaggtca

SEQ ID NO: 3586627 - DNA, 20 bp, Homo sapiens
agggtctctctccaggtcag

SEQ ID NO: 3586628 - DNA, 23 bp, Homo sapiens
agggtctctctccaggtcagcct

SEQ ID NO: 3586629 - DNA, 19 bp, Homo sapiens
agggtcttggctgcctgtg

SEQ ID NO: 3586630 - DNA, 14 bp, Homo sapiens
agggtctttgcaga

SEQ ID NO: 3586631 - DNA, 16 bp, Homo sapiens
agggtctttgcagatg

SEQ ID NO: 3586632 - DNA, 18 bp, Homo sapiens
agtacctgattgtatttt

SEQ ID NO: 3586633 - DNA, 14 bp, Homo sapiens
agtacctgtgactc

SEQ ID NO: 3586634 - DNA, 13 bp, Homo sapiens
agtactaaaatta

SEQ ID NO: 3586635 - DNA, 19 bp, Homo sapiens
agtacttggcccccttcag

SEQ ID NO: 3586636 - DNA, 21 bp, Homo sapiens
agtacttggcccccttcagga

SEQ ID NO: 3586637 - DNA, 23 bp, Homo sapiens
agtacttggcccccttcaggagc

SEQ ID NO: 3586638 - DNA, 22 bp, Homo sapiens
agtactttggaggcccctatgt

SEQ ID NO: 3586639 - DNA, 17 bp, Homo sapiens
agtactttgtgctcata

SEQ ID NO: 3586640 - DNA, 18 bp, Homo sapiens
agtagaataaagaaaaac

SEQ ID NO: 3586641 - DNA, 22 bp, Homo sapiens
agtagagagggaacatcctaag

SEQ ID NO: 3586642 - DNA, 18 bp, Homo sapiens
agtagaggtactagaatg

SEQ ID NO: 3586643 - DNA, 19 bp, Homo sapiens
agtagcgttttttaaatgt

SEQ ID NO: 3586644 - DNA, 20 bp, Homo sapiens
agtagcgttttttaaatgta

SEQ ID NO: 3586645 - DNA, 14 bp, Homo sapiens
agtagctgcagcct

SEQ ID NO: 3586646 - DNA, 12 bp, Homo sapiens
agtagcttgaaa

SEQ ID NO: 3586647 - DNA, 19 bp, Homo sapiens
agtagggatgcggatcctg

SEQ ID NO: 3586648 - DNA, 18 bp, Homo sapiens
agtaggtcccggccagct

SEQ ID NO: 3586649 - DNA, 23 bp, Homo sapiens
agtaggtcccggccagctctgga

SEQ ID NO: 3586650 - DNA, 17 bp, Homo sapiens
agtaggtgggggaacac

SEQ ID NO: 3586651 - DNA, 21 bp, Homo sapiens
agtagtatatttaattttgac

SEQ ID NO: 3586652 - DNA, 13 bp, Homo sapiens
agtagtgtggcct

SEQ ID NO: 3586653 - DNA, 14 bp, Homo sapiens
agtagtgtggcctg

SEQ ID NO: 3586654 - DNA, 20 bp, Homo sapiens
agtagtgtggcctgtgccag

SEQ ID NO: 3586655 - DNA, 14 bp, Homo sapiens
agtagtgttacatg

SEQ ID NO: 3586656 - DNA, 17 bp, Homo sapiens
agtagtgttacatgtat

SEQ ID NO: 3586657 - DNA, 22 bp, Homo sapiens
agtataaaatagtatgaaaatg

SEQ ID NO: 3586658 - DNA, 23 bp, Homo sapiens
agtatatttaattttgacataag

SEQ ID NO: 3586659 - DNA, 14 bp, Homo sapiens
agtatccactttgc

SEQ ID NO: 3586660 - DNA, 13 bp, Homo sapiens
agtatcctccagg

SEQ ID NO: 3586661 - DNA, 15 bp, Homo sapiens
agtatcctccaggtt

SEQ ID NO: 3586662 - DNA, 13 bp, Homo sapiens
agtatctgctgtt

SEQ ID NO: 3586663 - DNA, 16 bp, Homo sapiens
agtatctgctgttctt

SEQ ID NO: 3586664 - DNA, 23 bp, Homo sapiens
agtatctgctgttcttcagtcct

SEQ ID NO: 3586665 - DNA, 21 bp, Homo sapiens
agtatctgtatataagttgct

SEQ ID NO: 3586666 - DNA, 22 bp, Homo sapiens
agtatgtatattaaaaaagaga

SEQ ID NO: 3586667 - DNA, 21 bp, Homo sapiens
agtatgtcagtccaataaatt

SEQ ID NO: 3586668 - DNA, 13 bp, Homo sapiens
agtatgtgaagat

SEQ ID NO: 3586669 - DNA, 14 bp, Homo sapiens
agtattaagcagtt

SEQ ID NO: 3586670 - DNA, 17 bp, Homo sapiens
agtattaagcagttcat

SEQ ID NO: 3586671 - DNA, 14 bp, Homo sapiens
agtattatagatat

SEQ ID NO: 3586672 - DNA, 16 bp, Homo sapiens
agtatttctacattac

SEQ ID NO: 3586673 - DNA, 14 bp, Homo sapiens
agtattttaatcct

SEQ ID NO: 3586674 - DNA, 22 bp, Homo sapiens
agtattttttgtataattggat

SEQ ID NO: 3586675 - DNA, 12 bp, Homo sapiens
agtcaaaacaaa

SEQ ID NO: 3586676 - DNA, 15 bp, Homo sapiens
agtcaaatccagtgg

SEQ ID NO: 3586677 - DNA, 19 bp, Homo sapiens
agtcaagacgaacatgtag

SEQ ID NO: 3586678 - DNA, 14 bp, Homo sapiens
agtcaagctcctcc

SEQ ID NO: 3586679 - DNA, 16 bp, Homo sapiens
agtcaagctcctcctc

SEQ ID NO: 3586680 - DNA, 18 bp, Homo sapiens
agtcaagctcctcctccc

SEQ ID NO: 3586681 - DNA, 22 bp, Homo sapiens
agtcaagctcctcctccctgca

SEQ ID NO: 3586682 - DNA, 14 bp, Homo sapiens
agtcaataggccta

SEQ ID NO: 3586683 - DNA, 20 bp, Homo sapiens
agtcaatggaagaaatggct

SEQ ID NO: 3586684 - DNA, 12 bp, Homo sapiens
agtcacaatgag

SEQ ID NO: 3586685 - DNA, 16 bp, Homo sapiens
agtcacactgctagca

SEQ ID NO: 3586686 - DNA, 19 bp, Homo sapiens
agtcacactgctagcaaat

SEQ ID NO: 3586687 - DNA, 20 bp, Homo sapiens
agtcacccctttctgtccca

SEQ ID NO: 3586688 - DNA, 17 bp, Homo sapiens
agtcacctgctccagaa

SEQ ID NO: 3586689 - DNA, 18 bp, Homo sapiens
agtcacctgctccagaag

SEQ ID NO: 3586690 - DNA, 13 bp, Homo sapiens
agtcactgcacag

SEQ ID NO: 3586691 - DNA, 19 bp, Homo sapiens
agtcacttactattgttgc

SEQ ID NO: 3586692 - DNA, 19 bp, Homo sapiens
agtcagacatttctttgga

SEQ ID NO: 3586693 - DNA, 16 bp, Homo sapiens
agtcagtgccaggtcc

SEQ ID NO: 3586694 - DNA, 18 bp, Homo sapiens
agtcattatgttaatatt

SEQ ID NO: 3586695 - DNA, 13 bp, Homo sapiens
agtcattggcaaa

SEQ ID NO: 3586696 - DNA, 13 bp, Homo sapiens
agtcatttaataa

SEQ ID NO: 3586697 - DNA, 12 bp, Homo sapiens
agtcattttggg

SEQ ID NO: 3586698 - DNA, 17 bp, Homo sapiens
agtccaaggagaagaag

SEQ ID NO: 3586699 - DNA, 13 bp, Homo sapiens
agtccacaggggc

SEQ ID NO: 3586700 - DNA, 14 bp, Homo sapiens
agtccacaggggcc

SEQ ID NO: 3586701 - DNA, 20 bp, Homo sapiens
agtccagaaactgttcccac

SEQ ID NO: 3586702 - DNA, 13 bp, Homo sapiens
agtcccacactgt

SEQ ID NO: 3586703 - DNA, 17 bp, Homo sapiens
agtcccacactgtgcag

SEQ ID NO: 3586704 - DNA, 22 bp, Homo sapiens
agtcccagttaagtgaagccta

SEQ ID NO: 3586705 - DNA, 23 bp, Homo sapiens
agtccctgtcatttgaacctgga

SEQ ID NO: 3586706 - DNA, 12 bp, Homo sapiens
agtcccttcaat

SEQ ID NO: 3586707 - DNA, 17 bp, Homo sapiens
agtcccttcagactggc

SEQ ID NO: 3586708 - DNA, 20 bp, Homo sapiens
agtccgcagttgtagcagaa

SEQ ID NO: 3586709 - DNA, 20 bp, Homo sapiens
agtccgtgctgacagctgct

SEQ ID NO: 3586710 - DNA, 23 bp, Homo sapiens
agtcctggactcctgccaccagc

SEQ ID NO: 3586711 - DNA, 14 bp, Homo sapiens
agtccttaggctac

SEQ ID NO: 3586712 - DNA, 16 bp, Homo sapiens
agtccttaggctactg

SEQ ID NO: 3586713 - DNA, 22 bp, Homo sapiens
agtccttcagtgagcccctccc

SEQ ID NO: 3586714 - DNA, 14 bp, Homo sapiens
agtccttccacctg

SEQ ID NO: 3586715 - DNA, 16 bp, Homo sapiens
agtccttccacctgcc

SEQ ID NO: 3586716 - DNA, 14 bp, Homo sapiens
agtccttcctggca

SEQ ID NO: 3586717 - DNA, 20 bp, Homo sapiens
agtcctttcccaccattcct

SEQ ID NO: 3586718 - DNA, 19 bp, Homo sapiens
agtcctttgtctttctttg

SEQ ID NO: 3586719 - DNA, 18 bp, Homo sapiens
agtccttttatctccttg

SEQ ID NO: 3586720 - DNA, 18 bp, Homo sapiens
agtcgctgtgccacaggc

SEQ ID NO: 3586721 - DNA, 15 bp, Homo sapiens
agtcggccccatctc

SEQ ID NO: 3586722 - DNA, 14 bp, Homo sapiens
agtcgtggggaacg

SEQ ID NO: 3586723 - DNA, 17 bp, Homo sapiens
agtctagatggctcctc

SEQ ID NO: 3586724 - DNA, 15 bp, Homo sapiens
agtctcccttcctat

SEQ ID NO: 3586725 - DNA, 14 bp, Homo sapiens
agtctcctcactct

SEQ ID NO: 3586726 - DNA, 21 bp, Homo sapiens
agtctcctcactctgtccctg

SEQ ID NO: 3586727 - DNA, 23 bp, Homo sapiens
agtctcctcactctgtccctgtc

SEQ ID NO: 3586728 - DNA, 21 bp, Homo sapiens
agtctcctcccctactctgcc

SEQ ID NO: 3586729 - DNA, 15 bp, Homo sapiens
agtctctcttctctc

SEQ ID NO: 3586730 - DNA, 18 bp, Homo sapiens
agtctctcttctctccag

SEQ ID NO: 3586731 - DNA, 13 bp, Homo sapiens
agtctcttctcca

SEQ ID NO: 3586732 - DNA, 16 bp, Homo sapiens
agtctcttctccactg

SEQ ID NO: 3586733 - DNA, 17 bp, Homo sapiens
agtctcttctccactgg

SEQ ID NO: 3586734 - DNA, 21 bp, Homo sapiens
agtctcttctccactggatgg

SEQ ID NO: 3586735 - DNA, 14 bp, Homo sapiens
agtctgaaactggc

SEQ ID NO: 3586736 - DNA, 19 bp, Homo sapiens
agtctgagatgccccgagc

SEQ ID NO: 3586737 - DNA, 14 bp, Homo sapiens
agtctgagcccatt

SEQ ID NO: 3586738 - DNA, 20 bp, Homo sapiens
agtctgagcccatttctggg

SEQ ID NO: 3586739 - DNA, 20 bp, Homo sapiens
agtctgataaactgacgatt

SEQ ID NO: 3586740 - DNA, 13 bp, Homo sapiens
agtctgctcctct

SEQ ID NO: 3586741 - DNA, 23 bp, Homo sapiens
agtctgctcctcttgttcctgaa

SEQ ID NO: 3586742 - DNA, 22 bp, Homo sapiens
agtctggcagactttcttctct

SEQ ID NO: 3586743 - DNA, 13 bp, Homo sapiens
agtctgggccagg

SEQ ID NO: 3586744 - DNA, 17 bp, Homo sapiens
agtcttcccagcaatta

SEQ ID NO: 3586745 - DNA, 14 bp, Homo sapiens
agtcttctcctcca

SEQ ID NO: 3586746 - DNA, 16 bp, Homo sapiens
agtcttggtaaaacat

SEQ ID NO: 3586747 - DNA, 15 bp, Homo sapiens
agtcttggttttatc

SEQ ID NO: 3586748 - DNA, 20 bp, Homo sapiens
agtctttatttttttcccat

SEQ ID NO: 3586749 - DNA, 20 bp, Homo sapiens
agtgaaataacaaaatggac

SEQ ID NO: 3586750 - DNA, 14 bp, Homo sapiens
agtgaaataataga

SEQ ID NO: 3586751 - DNA, 17 bp, Homo sapiens
agtgaagcctaccagaa

SEQ ID NO: 3586752 - DNA, 15 bp, Homo sapiens
agattcaggccagcc

SEQ ID NO: 3586753 - DNA, 16 bp, Homo sapiens
agattcaggccagccc

SEQ ID NO: 3586754 - DNA, 17 bp, Homo sapiens
agattcaggccagccca

SEQ ID NO: 3586755 - DNA, 21 bp, Homo sapiens
agattcaggccagcccagcca

SEQ ID NO: 3586756 - DNA, 23 bp, Homo sapiens
agattcaggccagcccagccagg

SEQ ID NO: 3586757 - DNA, 16 bp, Homo sapiens
agattctatgttaata

SEQ ID NO: 3586758 - DNA, 13 bp, Homo sapiens
agattctcttgaa

SEQ ID NO: 3586759 - DNA, 16 bp, Homo sapiens
agattctcttgaataa

SEQ ID NO: 3586760 - DNA, 19 bp, Homo sapiens
agattcttcttaaaagttt

SEQ ID NO: 3586761 - DNA, 20 bp, Homo sapiens
agattgaacctgaatattgc

SEQ ID NO: 3586762 - DNA, 22 bp, Homo sapiens
agattggcacccctttctagtt

SEQ ID NO: 3586763 - DNA, 16 bp, Homo sapiens
agattggcttgtctca

SEQ ID NO: 3586764 - DNA, 23 bp, Homo sapiens
agatttaagtgaatacattaacg

SEQ ID NO: 3586765 - DNA, 18 bp, Homo sapiens
agatttaatattacagat

SEQ ID NO: 3586766 - DNA, 15 bp, Homo sapiens
agatttctgaggaaa

SEQ ID NO: 3586767 - DNA, 14 bp, Homo sapiens
agatttttttcctg

SEQ ID NO: 3586768 - DNA, 13 bp, Homo sapiens
agcaaacatcaaa

SEQ ID NO: 3586769 - DNA, 16 bp, Homo sapiens
agcaaacatcaaataa

SEQ ID NO: 3586770 - DNA, 21 bp, Homo sapiens
agcaaacatcaaataaatttc

SEQ ID NO: 3586771 - DNA, 19 bp, Homo sapiens
agcaaaggtgcactccaga

SEQ ID NO: 3586772 - DNA, 15 bp, Homo sapiens
agcaaataaatacgt

SEQ ID NO: 3586773 - DNA, 14 bp, Homo sapiens
agcaaatcagaaaa

SEQ ID NO: 3586774 - DNA, 15 bp, Homo sapiens
agcaaatcagaaaac

SEQ ID NO: 3586775 - DNA, 23 bp, Homo sapiens
agcaacattggcacatgccacct

SEQ ID NO: 3586776 - DNA, 14 bp, Homo sapiens
agcaaccaaaaaga

SEQ ID NO: 3586777 - DNA, 15 bp, Homo sapiens
agcaaccacactgct

SEQ ID NO: 3586778 - DNA, 14 bp, Homo sapiens
agcaactgacctga

SEQ ID NO: 3586779 - DNA, 16 bp, Homo sapiens
agcaactgacctgagc

SEQ ID NO: 3586780 - DNA, 22 bp, Homo sapiens
agcaagacacgtggcctcgtga

SEQ ID NO: 3586781 - DNA, 19 bp, Homo sapiens
agcaagacctcatctgtgg

SEQ ID NO: 3586782 - DNA, 15 bp, Homo sapiens
agcaagataaacatt

SEQ ID NO: 3586783 - DNA, 22 bp, Homo sapiens
agcaagcaccaacctccagact

SEQ ID NO: 3586784 - DNA, 13 bp, Homo sapiens
agcaaggcagagc

SEQ ID NO: 3586785 - DNA, 17 bp, Homo sapiens
agcaaggggaccccgag

SEQ ID NO: 3586786 - DNA, 16 bp, Homo sapiens
agcaagggtgatggga

SEQ ID NO: 3586787 - DNA, 22 bp, Homo sapiens
agcaagtcccttcagactggcc

SEQ ID NO: 3586788 - DNA, 20 bp, Homo sapiens
agcaagtccttaggctactg

SEQ ID NO: 3586789 - DNA, 16 bp, Homo sapiens
agcaataatttctgta

SEQ ID NO: 3586790 - DNA, 19 bp, Homo sapiens
agcaataggtagctgggga

SEQ ID NO: 3586791 - DNA, 13 bp, Homo sapiens
agcaatcctccta

SEQ ID NO: 3586792 - DNA, 21 bp, Homo sapiens
agcaatcctcctacctcagcc

SEQ ID NO: 3586793 - DNA, 17 bp, Homo sapiens
agcaatgccccaaactt

SEQ ID NO: 3586794 - DNA, 16 bp, Homo sapiens
agcaatgggtcttagc

SEQ ID NO: 3586795 - DNA, 20 bp, Homo sapiens
agcaattcatggttcaagta

SEQ ID NO: 3586796 - DNA, 22 bp, Homo sapiens
agcaatttaactagacacagat

SEQ ID NO: 3586797 - DNA, 18 bp, Homo sapiens
agcaatttactgatgaga

SEQ ID NO: 3586798 - DNA, 21 bp, Homo sapiens
agcaatttactgatgagagaa

SEQ ID NO: 3586799 - DNA, 22 bp, Homo sapiens
agcaatttactgatgagagaat

SEQ ID NO: 3586800 - DNA, 23 bp, Homo sapiens
agcaatttactgatgagagaatg

SEQ ID NO: 3586801 - DNA, 16 bp, Homo sapiens
agcaatttagacaaag

SEQ ID NO: 3586802 - DNA, 21 bp, Homo sapiens
agcacaagactggcccagtgc

SEQ ID NO: 3586803 - DNA, 23 bp, Homo sapiens
agcacagtaggtcccggccagct

SEQ ID NO: 3586804 - DNA, 17 bp, Homo sapiens
agcaccaacctccagac

SEQ ID NO: 3586805 - DNA, 22 bp, Homo sapiens
agcacccctccagttttgcctg

SEQ ID NO: 3586806 - DNA, 16 bp, Homo sapiens
agcaccgcctcttccc

SEQ ID NO: 3586807 - DNA, 17 bp, Homo sapiens
agcacctagcctcgctc

SEQ ID NO: 3586808 - DNA, 14 bp, Homo sapiens
agcacctccccgct

SEQ ID NO: 3586809 - DNA, 23 bp, Homo sapiens
agcactccccagagctgtgccag

SEQ ID NO: 3586810 - DNA, 12 bp, Homo sapiens
agcactctcaga

SEQ ID NO: 3586811 - DNA, 16 bp, Homo sapiens
agcactgacttctaag

SEQ ID NO: 3586812 - DNA, 14 bp, Homo sapiens
agcacttaagtgtt

SEQ ID NO: 3586813 - DNA, 15 bp, Homo sapiens
agcacttaagtgtta

SEQ ID NO: 3586814 - DNA, 22 bp, Homo sapiens
agcacttgagaaccagtctcct

SEQ ID NO: 3586815 - DNA, 18 bp, Homo sapiens
agcagaaagaagagaagt

SEQ ID NO: 3586816 - DNA, 15 bp, Homo sapiens
agcagacagccctgg

SEQ ID NO: 3586817 - DNA, 21 bp, Homo sapiens
agcagagaattctcttatcca

SEQ ID NO: 3586818 - DNA, 14 bp, Homo sapiens
agcagagcattgtc

SEQ ID NO: 3586819 - DNA, 22 bp, Homo sapiens
agcagagcctcctgggaacaca

SEQ ID NO: 3586820 - DNA, 15 bp, Homo sapiens
agcagaggaggggcc

SEQ ID NO: 3586821 - DNA, 14 bp, Homo sapiens
agcagagggggagt

SEQ ID NO: 3586822 - DNA, 18 bp, Homo sapiens
agcagagggggagtagcc

SEQ ID NO: 3586823 - DNA, 15 bp, Homo sapiens
agcagatgacagagg

SEQ ID NO: 3586824 - DNA, 12 bp, Homo sapiens
agcagcaggcct

SEQ ID NO: 3586825 - DNA, 14 bp, Homo sapiens
agcagcaggcctct

SEQ ID NO: 3586826 - DNA, 18 bp, Homo sapiens
agcagcaggcctctggga

SEQ ID NO: 3586827 - DNA, 19 bp, Homo sapiens
agcagcatggaaaaatggt

SEQ ID NO: 3586828 - DNA, 22 bp, Homo sapiens
agcagcatggaaaaatggttga

SEQ ID NO: 3586829 - DNA, 11 bp, Homo sapiens
agcagcccagg

SEQ ID NO: 3586830 - DNA, 22 bp, Homo sapiens
agcagcccccgggccgctggct

SEQ ID NO: 3586831 - DNA, 13 bp, Homo sapiens
agcagcccttgct

SEQ ID NO: 3586832 - DNA, 22 bp, Homo sapiens
agcagcctcaaaacgggtcagt

SEQ ID NO: 3586833 - DNA, 19 bp, Homo sapiens
agaggatccgtgctgtctc

SEQ ID NO: 3586834 - DNA, 14 bp, Homo sapiens
agaggattttgcgt

SEQ ID NO: 3586835 - DNA, 22 bp, Homo sapiens
agaggattttgcgtcagagaaa

SEQ ID NO: 3586836 - DNA, 18 bp, Homo sapiens
agaggccctctggagtgg

SEQ ID NO: 3586837 - DNA, 24 bp, Homo sapiens
agaggccctctggagtggccacta

SEQ ID NO: 3586838 - DNA, 16 bp, Homo sapiens
agaggccctggaggtc

SEQ ID NO: 3586839 - DNA, 23 bp, Homo sapiens
agaggccctggaggtctccaggg

SEQ ID NO: 3586840 - DNA, 23 bp, Homo sapiens
agaggcctgctgccagtgcagcc

SEQ ID NO: 3586841 - DNA, 18 bp, Homo sapiens
agaggcgtactacccagc

SEQ ID NO: 3586842 - DNA, 19 bp, Homo sapiens
agaggcgtactacccagct

SEQ ID NO: 3586843 - DNA, 19 bp, Homo sapiens
agaggctattattttcact

SEQ ID NO: 3586844 - DNA, 10 bp, Homo sapiens
agaggctcag

SEQ ID NO: 3586845 - DNA, 18 bp, Homo sapiens
agaggctcagattgtaat

SEQ ID NO: 3586846 - DNA, 16 bp, Homo sapiens
agagggaagccatgtg

SEQ ID NO: 3586847 - DNA, 16 bp, Homo sapiens
agagggaatctagccc

SEQ ID NO: 3586848 - DNA, 15 bp, Homo sapiens
agagggacaggcact

SEQ ID NO: 3586849 - DNA, 17 bp, Homo sapiens
agagggacaggcactcc

SEQ ID NO: 3586850 - DNA, 15 bp, Homo sapiens
agagggacaggctga

SEQ ID NO: 3586851 - DNA, 18 bp, Homo sapiens
agagggacaggctgaaga

SEQ ID NO: 3586852 - DNA, 18 bp, Homo sapiens
agagggaggggcctaggc

SEQ ID NO: 3586853 - DNA, 20 bp, Homo sapiens
agagggaggggcctaggcct

SEQ ID NO: 3586854 - DNA, 18 bp, Homo sapiens
agagggcagactgtgaac

SEQ ID NO: 3586855 - DNA, 14 bp, Homo sapiens
agagggcccagccc

SEQ ID NO: 3586856 - DNA, 15 bp, Homo sapiens
agagggcccagccca

SEQ ID NO: 3586857 - DNA, 16 bp, Homo sapiens
agagggcccaggtccc

SEQ ID NO: 3586858 - DNA, 22 bp, Homo sapiens
agaggggcgttctcccaaagat

SEQ ID NO: 3586859 - DNA, 14 bp, Homo sapiens
agagggttgctggt

SEQ ID NO: 3586860 - DNA, 17 bp, Homo sapiens
agagggttgctggtcct

SEQ ID NO: 3586861 - DNA, 13 bp, Homo sapiens
agaggtagcactc

SEQ ID NO: 3586862 - DNA, 18 bp, Homo sapiens
agaggtagcactctcaga

SEQ ID NO: 3586863 - DNA, 15 bp, Homo sapiens
agaggtctgattggc

SEQ ID NO: 3586864 - DNA, 19 bp, Homo sapiens
agaggtctgattggctgct

SEQ ID NO: 3586865 - DNA, 16 bp, Homo sapiens
agaggtgaaaatgaag

SEQ ID NO: 3586866 - DNA, 21 bp, Homo sapiens
agaggtgaaaatgaagaagga

SEQ ID NO: 3586867 - DNA, 16 bp, Homo sapiens
agaggtgaaagcataa

SEQ ID NO: 3586868 - DNA, 14 bp, Homo sapiens
agaggtgtgtgacg

SEQ ID NO: 3586869 - DNA, 18 bp, Homo sapiens
agaggtttgaaggagaat

SEQ ID NO: 3586870 - DNA, 21 bp, Homo sapiens
agaggtttgaaggagaatggc

SEQ ID NO: 3586871 - DNA, 12 bp, Homo sapiens
agagtaactatc

SEQ ID NO: 3586872 - DNA, 16 bp, Homo sapiens
agagtagctgcagcct

SEQ ID NO: 3586873 - DNA, 22 bp, Homo sapiens
agagtagctgcagccttcatca

SEQ ID NO: 3586874 - DNA, 13 bp, Homo sapiens
agagtcaaagctg

SEQ ID NO: 3586875 - DNA, 18 bp, Homo sapiens
agagtccccccactccca

SEQ ID NO: 3586876 - DNA, 15 bp, Homo sapiens
agagtcgctgtgcca

SEQ ID NO: 3586877 - DNA, 19 bp, Homo sapiens
agagtcgctgtgccacagg

SEQ ID NO: 3586878 - DNA, 21 bp, Homo sapiens
agagtcttccacttcaatgca

SEQ ID NO: 3586879 - DNA, 13 bp, Homo sapiens
agagtgcaatggt

SEQ ID NO: 3586880 - DNA, 16 bp, Homo sapiens
agagtgcaatggtgca

SEQ ID NO: 3586881 - DNA, 12 bp, Homo sapiens
agagtgctggga

SEQ ID NO: 3586882 - DNA, 21 bp, Homo sapiens
agagtggagagagcagggcta

SEQ ID NO: 3586883 - DNA, 15 bp, Homo sapiens
agagtggcctccctg

SEQ ID NO: 3586884 - DNA, 18 bp, Homo sapiens
agagtggcctccctgctg

SEQ ID NO: 3586885 - DNA, 21 bp, Homo sapiens
agagtggcctccctgctgtgc

SEQ ID NO: 3586886 - DNA, 22 bp, Homo sapiens
agagtggcctccctgctgtgcc

SEQ ID NO: 3586887 - DNA, 18 bp, Homo sapiens
agagtgggccccgggctg

SEQ ID NO: 3586888 - DNA, 19 bp, Homo sapiens
agagtggggtaggttggga

SEQ ID NO: 3586889 - DNA, 13 bp, Homo sapiens
agagtgtagccta

SEQ ID NO: 3586890 - DNA, 19 bp, Homo sapiens
agagtgtagctgtaagggc

SEQ ID NO: 3586891 - DNA, 20 bp, Homo sapiens
agagtgtagctgtaagggca

SEQ ID NO: 3586892 - DNA, 22 bp, Homo sapiens
agagtgtagctgtaagggcagt

SEQ ID NO: 3586893 - DNA, 20 bp, Homo sapiens
agagtgttttgaccagttta

SEQ ID NO: 3586894 - DNA, 16 bp, Homo sapiens
agagttacagttctgt

SEQ ID NO: 3586895 - DNA, 22 bp, Homo sapiens
agagttctttgctgcccctgtc

SEQ ID NO: 3586896 - DNA, 14 bp, Homo sapiens
agagtttaaacaaa

SEQ ID NO: 3586897 - DNA, 13 bp, Homo sapiens
agagtttcctgaa

SEQ ID NO: 3586898 - DNA, 23 bp, Homo sapiens
agataaaaaaactgttaccagat

SEQ ID NO: 3586899 - DNA, 14 bp, Homo sapiens
agataaacattatt

SEQ ID NO: 3586900 - DNA, 13 bp, Homo sapiens
agataactaggaa

SEQ ID NO: 3586901 - DNA, 20 bp, Homo sapiens
agataatagggttttcagat

SEQ ID NO: 3586902 - DNA, 24 bp, Homo sapiens
agataatagggttttcagatgaaa

SEQ ID NO: 3586903 - DNA, 13 bp, Homo sapiens
agataatccctgt

SEQ ID NO: 3586904 - DNA, 13 bp, Homo sapiens
agatactggtgga

SEQ ID NO: 3586905 - DNA, 17 bp, Homo sapiens
agatacttatttttctg

SEQ ID NO: 3586906 - DNA, 15 bp, Homo sapiens
agataggaaactgaa

SEQ ID NO: 3586907 - DNA, 17 bp, Homo sapiens
agatatatttaagcctt

SEQ ID NO: 3586908 - DNA, 22 bp, Homo sapiens
agatatggagtgagtcacctgc

SEQ ID NO: 3586909 - DNA, 14 bp, Homo sapiens
agatattaaattct

SEQ ID NO: 3586910 - DNA, 21 bp, Homo sapiens
agatattaaattctcaaagtt

SEQ ID NO: 3586911 - DNA, 19 bp, Homo sapiens
agatattatttgtcttaaa

SEQ ID NO: 3586912 - DNA, 11 bp, Homo sapiens
agatattttat

SEQ ID NO: 3586913 - DNA, 13 bp, Homo sapiens
agatcaatgtgac

SEQ ID NO: 3586914 - DNA, 14 bp, Homo sapiens
agatcactcctgga

SEQ ID NO: 3586915 - DNA, 17 bp, Homo sapiens
agatcagaacattcagc

SEQ ID NO: 3586916 - DNA, 22 bp, Homo sapiens
agatcagaacattcagctctgg

SEQ ID NO: 3586917 - DNA, 21 bp, Homo sapiens
agatccagcccaaacctggga

SEQ ID NO: 3586918 - DNA, 13 bp, Homo sapiens
agatccagcctgg

SEQ ID NO: 3586919 - DNA, 16 bp, Homo sapiens
agatcgttctctgcct

SEQ ID NO: 3586920 - DNA, 21 bp, Homo sapiens
agatctgcagggggtgtgtct

SEQ ID NO: 3586921 - DNA, 20 bp, Homo sapiens
agatctggaacctcagcctg

SEQ ID NO: 3586922 - DNA, 19 bp, Homo sapiens
agatctgtcctcagccttg

SEQ ID NO: 3586923 - DNA, 17 bp, Homo sapiens
agatctgtgtggctcct

SEQ ID NO: 3586924 - DNA, 13 bp, Homo sapiens
agaccagcctggc

SEQ ID NO: 3586925 - DNA, 16 bp, Homo sapiens
agaccataagagaaac

SEQ ID NO: 3586926 - DNA, 22 bp, Homo sapiens
agaccataagagaaacctgcca

SEQ ID NO: 3586927 - DNA, 23 bp, Homo sapiens
agaccataagagaaacctgccaa

SEQ ID NO: 3586928 - DNA, 13 bp, Homo sapiens
agaccccctcagc

SEQ ID NO: 3586929 - DNA, 14 bp, Homo sapiens
agacccctggcttt

SEQ ID NO: 3586930 - DNA, 13 bp, Homo sapiens
agaccctcgggcc

SEQ ID NO: 3586931 - DNA, 19 bp, Homo sapiens
agaccctcgggccccatcc

SEQ ID NO: 3586932 - DNA, 20 bp, Homo sapiens
agaccctgtgtcctccacca

SEQ ID NO: 3586933 - DNA, 15 bp, Homo sapiens
agacctcatcagcct

SEQ ID NO: 3586934 - DNA, 21 bp, Homo sapiens
agacctcatcagccttgggat

SEQ ID NO: 3586935 - DNA, 11 bp, Homo sapiens
agacctgaaag

SEQ ID NO: 3586936 - DNA, 17 bp, Homo sapiens
agacctgaaagagagga

SEQ ID NO: 3586937 - DNA, 14 bp, Homo sapiens
agacctgatcctgg

SEQ ID NO: 3586938 - DNA, 22 bp, Homo sapiens
agacctggagcttcagccaggt

SEQ ID NO: 3586939 - DNA, 16 bp, Homo sapiens
agacctggcagctctg

SEQ ID NO: 3586940 - DNA, 19 bp, Homo sapiens
agaccttgggggaagactt

SEQ ID NO: 3586941 - DNA, 19 bp, Homo sapiens
agacgaggggcagggaagg

SEQ ID NO: 3586942 - DNA, 16 bp, Homo sapiens
agactactattttctt

SEQ ID NO: 3586943 - DNA, 23 bp, Homo sapiens
agactagatgtagtattttttgt

SEQ ID NO: 3586944 - DNA, 16 bp, Homo sapiens
agactattcaaacagt

SEQ ID NO: 3586945 - DNA, 20 bp, Homo sapiens
agactattcaaacagtctca

SEQ ID NO: 3586946 - DNA, 21 bp, Homo sapiens
agactattcaaacagtctcag

SEQ ID NO: 3586947 - DNA, 18 bp, Homo sapiens
agactcaatgtgctctgt

SEQ ID NO: 3586948 - DNA, 14 bp, Homo sapiens
agactcagcagagt

SEQ ID NO: 3586949 - DNA, 17 bp, Homo sapiens
agactcagcagagtgag

SEQ ID NO: 3586950 - DNA, 17 bp, Homo sapiens
agactccatctcttctg

SEQ ID NO: 3586951 - DNA, 18 bp, Homo sapiens
agactccatctcttctgc

SEQ ID NO: 3586952 - DNA, 15 bp, Homo sapiens
agactcctcagcacc

SEQ ID NO: 3586953 - DNA, 13 bp, Homo sapiens
agactcgagaacc

SEQ ID NO: 3586954 - DNA, 17 bp, Homo sapiens
agactctttaataaatt

SEQ ID NO: 3586955 - DNA, 13 bp, Homo sapiens
agactgatagaca

SEQ ID NO: 3586956 - DNA, 15 bp, Homo sapiens
agactgatagacacc

SEQ ID NO: 3586957 - DNA, 19 bp, Homo sapiens
agactgcttccaattttct

SEQ ID NO: 3586958 - DNA, 14 bp, Homo sapiens
agactggcacagtt

SEQ ID NO: 3586959 - DNA, 18 bp, Homo sapiens
agactggcacagttttct

SEQ ID NO: 3586960 - DNA, 11 bp, Homo sapiens
agactggccca

SEQ ID NO: 3586961 - DNA, 20 bp, Homo sapiens
agactggcccagtgccagca

SEQ ID NO: 3586962 - DNA, 18 bp, Homo sapiens
agactgggcactggggcc

SEQ ID NO: 3586963 - DNA, 22 bp, Homo sapiens
agactgtaacttccaaataaat

SEQ ID NO: 3586964 - DNA, 15 bp, Homo sapiens
agactgtgaacttga

SEQ ID NO: 3586965 - DNA, 18 bp, Homo sapiens
agactgtgaacttgactg

SEQ ID NO: 3586966 - DNA, 17 bp, Homo sapiens
agacttcctctggctcc

SEQ ID NO: 3586967 - DNA, 21 bp, Homo sapiens
agacttgtatagcatgaaata

SEQ ID NO: 3586968 - DNA, 19 bp, Homo sapiens
agactttgatccatgtatg

SEQ ID NO: 3586969 - DNA, 18 bp, Homo sapiens
agactttggacagtggcc

SEQ ID NO: 3586970 - DNA, 19 bp, Homo sapiens
agactttggacagtggcct

SEQ ID NO: 3586971 - DNA, 17 bp, Homo sapiens
agacttttggtagagaa

SEQ ID NO: 3586972 - DNA, 18 bp, Homo sapiens
agagaaacctgccaagga

SEQ ID NO: 3586973 - DNA, 16 bp, Homo sapiens
agagaaagagagaagc

SEQ ID NO: 3586974 - DNA, 21 bp, Homo sapiens
agagaaaggggagcccactgt

SEQ ID NO: 3586975 - DNA, 23 bp, Homo sapiens
agagaaaggggagcccactgtcc

SEQ ID NO: 3586976 - DNA, 18 bp, Homo sapiens
agagaaatgccccagtgt

SEQ ID NO: 3586977 - DNA, 17 bp, Homo sapiens
agagaagagggcccagc

SEQ ID NO: 3586978 - DNA, 18 bp, Homo sapiens
agagaagagggcccagcc

SEQ ID NO: 3586979 - DNA, 19 bp, Homo sapiens
agagaagagggcccagccc

SEQ ID NO: 3586980 - DNA, 14 bp, Homo sapiens
agagaagccagcca

SEQ ID NO: 3586981 - DNA, 15 bp, Homo sapiens
agagaagccagccac

SEQ ID NO: 3586982 - DNA, 12 bp, Homo sapiens
agagaagctacc

SEQ ID NO: 3586983 - DNA, 20 bp, Homo sapiens
agagaagtttgtagccaggt

SEQ ID NO: 3586984 - DNA, 13 bp, Homo sapiens
agagaatgtggaa

SEQ ID NO: 3586985 - DNA, 15 bp, Homo sapiens
agagaatgtggaaat

SEQ ID NO: 3586986 - DNA, 20 bp, Homo sapiens
agagacaaacacctcccagg

SEQ ID NO: 3586987 - DNA, 12 bp, Homo sapiens
agagacaaagct

SEQ ID NO: 3586988 - DNA, 22 bp, Homo sapiens
agagacacatacagagtgggcc

SEQ ID NO: 3586989 - DNA, 17 bp, Homo sapiens
agagacatacttgaagg

SEQ ID NO: 3586990 - DNA, 19 bp, Homo sapiens
agagaccccgcacccggct

SEQ ID NO: 3586991 - DNA, 14 bp, Homo sapiens
agagaccctggcct

SEQ ID NO: 3586992 - DNA, 15 bp, Homo sapiens
agagaccctggcctc

SEQ ID NO: 3586993 - DNA, 19 bp, Homo sapiens
agagacctcatcagccttg

SEQ ID NO: 3586994 - DNA, 21 bp, Homo sapiens
agagacctcatcagccttggg

SEQ ID NO: 3586995 - DNA, 16 bp, Homo sapiens
agagactgagcagccg

SEQ ID NO: 3586996 - DNA, 20 bp, Homo sapiens
agagactgagcagccgccag

SEQ ID NO: 3586997 - DNA, 22 bp, Homo sapiens
agagactgagcagccgccagct

SEQ ID NO: 3586998 - DNA, 12 bp, Homo sapiens
agagagaagcca

SEQ ID NO: 3586999 - DNA, 15 bp, Homo sapiens
agagagaagccagcc

SEQ ID NO: 3587000 - DNA, 17 bp, Homo sapiens
agagagaagccagccac

SEQ ID NO: 3587001 - DNA, 18 bp, Homo sapiens
agagagaagccagccaca

SEQ ID NO: 3587002 - DNA, 22 bp, Homo sapiens
agagagaccccgcacccggctc

SEQ ID NO: 3587003 - DNA, 13 bp, Homo sapiens
agagagggaaaag

SEQ ID NO: 3587004 - DNA, 17 bp, Homo sapiens
agagagggaaaaggcag

SEQ ID NO: 3587005 - DNA, 23 bp, Homo sapiens
agagagggaaaaggcaggtgctt

SEQ ID NO: 3587006 - DNA, 16 bp, Homo sapiens
agagagggacaggcac

SEQ ID NO: 3587007 - DNA, 17 bp, Homo sapiens
agagagggaggcaagcc

SEQ ID NO: 3587008 - DNA, 21 bp, Homo sapiens
agagaggtggggatcctgcct

SEQ ID NO: 3587009 - DNA, 21 bp, Homo sapiens
agagagtagctgcagccttca

SEQ ID NO: 3587010 - DNA, 16 bp, Homo sapiens
agagagtggagagagc

SEQ ID NO: 3587011 - DNA, 19 bp, Homo sapiens
agagagtggagagagcagg

SEQ ID NO: 3587012 - DNA, 22 bp, Homo sapiens
agagagtggagagagcagggct

SEQ ID NO: 3587013 - DNA, 14 bp, Homo sapiens
agagagtggctcct

SEQ ID NO: 3587014 - DNA, 16 bp, Homo sapiens
agagataggaaactga

SEQ ID NO: 3587015 - DNA, 16 bp, Homo sapiens
agagatctgtgtggct

SEQ ID NO: 3587016 - DNA, 17 bp, Homo sapiens
agagatctgtgtggctc

SEQ ID NO: 3587017 - DNA, 19 bp, Homo sapiens
agagatctttctttccaaa

SEQ ID NO: 3587018 - DNA, 17 bp, Homo sapiens
agagatgagtgtctgga

SEQ ID NO: 3587019 - DNA, 12 bp, Homo sapiens
agagcagcagca

SEQ ID NO: 3587020 - DNA, 16 bp, Homo sapiens
agagcagcagcaccaa

SEQ ID NO: 3587021 - DNA, 12 bp, Homo sapiens
agagcatatttg

SEQ ID NO: 3587022 - DNA, 22 bp, Homo sapiens
agagcatatttgccaataaagc

SEQ ID NO: 3587023 - DNA, 14 bp, Homo sapiens
agagcatgcacatg

SEQ ID NO: 3587024 - DNA, 15 bp, Homo sapiens
agaacattcagctct

SEQ ID NO: 3587025 - DNA, 17 bp, Homo sapiens
agaacattcagctctgg

SEQ ID NO: 3587026 - DNA, 20 bp, Homo sapiens
agaacattcagctctggaga

SEQ ID NO: 3587027 - DNA, 17 bp, Homo sapiens
agaacattccatttgct

SEQ ID NO: 3587028 - DNA, 22 bp, Homo sapiens
agaaccacgatgaccacagact

SEQ ID NO: 3587029 - DNA, 22 bp, Homo sapiens
agaaccagccgtattttacatg

SEQ ID NO: 3587030 - DNA, 19 bp, Homo sapiens
agaaccagtccccccaccc

SEQ ID NO: 3587031 - DNA, 14 bp, Homo sapiens
agaaccagtctcct

SEQ ID NO: 3587032 - DNA, 20 bp, Homo sapiens
agaacctacagactccatct

SEQ ID NO: 3587033 - DNA, 17 bp, Homo sapiens
agaacctgaggtctcat

SEQ ID NO: 3587034 - DNA, 20 bp, Homo sapiens
agaacctggaacttggggag

SEQ ID NO: 3587035 - DNA, 23 bp, Homo sapiens
agaacctgtcttattaagactgg

SEQ ID NO: 3587036 - DNA, 20 bp, Homo sapiens
agaaccttaatgacaacact

SEQ ID NO: 3587037 - DNA, 13 bp, Homo sapiens
agaacgcacccca

SEQ ID NO: 3587038 - DNA, 15 bp, Homo sapiens
agaacgcaccccact

SEQ ID NO: 3587039 - DNA, 21 bp, Homo sapiens
agaacgcaccccactgggaga

SEQ ID NO: 3587040 - DNA, 16 bp, Homo sapiens
agaacgctgatttaaa

SEQ ID NO: 3587041 - DNA, 14 bp, Homo sapiens
agaacggcttgctt

SEQ ID NO: 3587042 - DNA, 14 bp, Homo sapiens
agaactagtagaag

SEQ ID NO: 3587043 - DNA, 18 bp, Homo sapiens
agaactcggtgtccccac

SEQ ID NO: 3587044 - DNA, 20 bp, Homo sapiens
agaactcggtgtccccacca

SEQ ID NO: 3587045 - DNA, 12 bp, Homo sapiens
agaactcttcct

SEQ ID NO: 3587046 - DNA, 20 bp, Homo sapiens
agaactgcccttgctgcccg

SEQ ID NO: 3587047 - DNA, 14 bp, Homo sapiens
agaacttgctgcct

SEQ ID NO: 3587048 - DNA, 16 bp, Homo sapiens
agaacttgctgctgcc

SEQ ID NO: 3587049 - DNA, 17 bp, Homo sapiens
agaacttgctgctgcct

SEQ ID NO: 3587050 - DNA, 14 bp, Homo sapiens
agaagaaaagattc

SEQ ID NO: 3587051 - DNA, 15 bp, Homo sapiens
agaagaaggccagag

SEQ ID NO: 3587052 - DNA, 16 bp, Homo sapiens
agaagaaggccagaga

SEQ ID NO: 3587053 - DNA, 14 bp, Homo sapiens
agaagaatcttcct

SEQ ID NO: 3587054 - DNA, 20 bp, Homo sapiens
agaagaatcttcctggcaca

SEQ ID NO: 3587055 - DNA, 21 bp, Homo sapiens
agaagagctgttcacagccag

SEQ ID NO: 3587056 - DNA, 22 bp, Homo sapiens
agaagagctgttcacagccaga

SEQ ID NO: 3587057 - DNA, 15 bp, Homo sapiens
agaagaggagaaaaa

SEQ ID NO: 3587058 - DNA, 17 bp, Homo sapiens
agaagaggagaaaaaga

SEQ ID NO: 3587059 - DNA, 16 bp, Homo sapiens
agaagagggcccagcc

SEQ ID NO: 3587060 - DNA, 17 bp, Homo sapiens
agaagagggcccagccc

SEQ ID NO: 3587061 - DNA, 12 bp, Homo sapiens
agaagataaaaa

SEQ ID NO: 3587062 - DNA, 15 bp, Homo sapiens
agaagatgaaatttg

SEQ ID NO: 3587063 - DNA, 23 bp, Homo sapiens
agaagatgccagcttctctctcc

SEQ ID NO: 3587064 - DNA, 17 bp, Homo sapiens
agaagatgcctgttaat

SEQ ID NO: 3587065 - DNA, 16 bp, Homo sapiens
agaagattagaaacta

SEQ ID NO: 3587066 - DNA, 17 bp, Homo sapiens
agaagattctatgttaa

SEQ ID NO: 3587067 - DNA, 18 bp, Homo sapiens
agaagccaactatgatta

SEQ ID NO: 3587068 - DNA, 14 bp, Homo sapiens
agaagccagtgtct

SEQ ID NO: 3587069 - DNA, 22 bp, Homo sapiens
agaagccagtgtctaggcactg

SEQ ID NO: 3587070 - DNA, 14 bp, Homo sapiens
agaagcccccagct

SEQ ID NO: 3587071 - DNA, 24 bp, Homo sapiens
agaagcccccagctaagaacctgg

SEQ ID NO: 3587072 - DNA, 23 bp, Homo sapiens
agaagccccgacacacggggctc

SEQ ID NO: 3587073 - DNA, 15 bp, Homo sapiens
agaagcctccccagc

SEQ ID NO: 3587074 - DNA, 21 bp, Homo sapiens
agaagccttctttttctgaga

SEQ ID NO: 3587075 - DNA, 18 bp, Homo sapiens
agaagctaaggtttagat

SEQ ID NO: 3587076 - DNA, 17 bp, Homo sapiens
agaagctcctctcccca

SEQ ID NO: 3587077 - DNA, 22 bp, Homo sapiens
agaagctgaggctagttccaga

SEQ ID NO: 3587078 - DNA, 13 bp, Homo sapiens
agaaggatgatgt

SEQ ID NO: 3587079 - DNA, 18 bp, Homo sapiens
agaaggccccagagagac

SEQ ID NO: 3587080 - DNA, 19 bp, Homo sapiens
agaaggccccagagagacc

SEQ ID NO: 3587081 - DNA, 15 bp, Homo sapiens
agaaggcctggaaga

SEQ ID NO: 3587082 - DNA, 19 bp, Homo sapiens
agaaggggctttgtgacca

SEQ ID NO: 3587083 - DNA, 14 bp, Homo sapiens
agaagggggccctg

SEQ ID NO: 3587084 - DNA, 17 bp, Homo sapiens
agaagggggccctgcta

SEQ ID NO: 3587085 - DNA, 21 bp, Homo sapiens
agaagggggccctgctacctg

SEQ ID NO: 3587086 - DNA, 23 bp, Homo sapiens
agaagtaagtttatccaaatctt

SEQ ID NO: 3587087 - DNA, 13 bp, Homo sapiens
agaagtatacata

SEQ ID NO: 3587088 - DNA, 15 bp, Homo sapiens
agaagtcatcttgct

SEQ ID NO: 3587089 - DNA, 13 bp, Homo sapiens
agaagtcccttca

SEQ ID NO: 3587090 - DNA, 19 bp, Homo sapiens
agaagtcccttcaatttct

SEQ ID NO: 3587091 - DNA, 22 bp, Homo sapiens
agaagtgagtggtgtgactctt

SEQ ID NO: 3587092 - DNA, 15 bp, Homo sapiens
agaagtggagacagt

SEQ ID NO: 3587093 - DNA, 13 bp, Homo sapiens
agaagtttctgtc

SEQ ID NO: 3587094 - DNA, 15 bp, Homo sapiens
agaataaagaaaaac

SEQ ID NO: 3587095 - DNA, 14 bp, Homo sapiens
agaataaaggcagt

SEQ ID NO: 3587096 - DNA, 21 bp, Homo sapiens
agaatcctaggctccacccca

SEQ ID NO: 3587097 - DNA, 23 bp, Homo sapiens
agaatctttagagaagtatacat

SEQ ID NO: 3587098 - DNA, 15 bp, Homo sapiens
agaatgaccttgagt

SEQ ID NO: 3587099 - DNA, 16 bp, Homo sapiens
agaatgaccttgagtt

SEQ ID NO: 3587100 - DNA, 20 bp, Homo sapiens
agaatgatgataacagaact

SEQ ID NO: 3587101 - DNA, 18 bp, Homo sapiens
agaatgctagcaggctgt

SEQ ID NO: 3587102 - DNA, 17 bp, Homo sapiens
agaatggcctggagcag

SEQ ID NO: 3587103 - DNA, 18 bp, Homo sapiens
agaatggcctggagcagg

SEQ ID NO: 3587104 - DNA, 21 bp, Homo sapiens
agaatggcctggagcaggccc

SEQ ID NO: 3587105 - DNA, 22 bp, Homo sapiens
agaatggcctggagcaggccca

SEQ ID NO: 3587106 - DNA, 18 bp, Homo sapiens
agaatgggacgaggacat

SEQ ID NO: 3587107 - DNA, 19 bp, Homo sapiens
agaatggtgtttgcaagtg

SEQ ID NO: 3587108 - DNA, 21 bp, Homo sapiens
agaatgtcaataaatttgctt

SEQ ID NO: 3587109 - DNA, 19 bp, Homo sapiens
agaatgtcagtatgtggaa

SEQ ID NO: 3587110 - DNA, 15 bp, Homo sapiens
agaatgttagagtaa

SEQ ID NO: 3587111 - DNA, 16 bp, Homo sapiens
agaatgttagagtaat

SEQ ID NO: 3587112 - DNA, 17 bp, Homo sapiens
agaattatctcaagtaa

SEQ ID NO: 3587113 - DNA, 19 bp, Homo sapiens
agaattatctcaagtaaaa

SEQ ID NO: 3587114 - DNA, 19 bp, Homo sapiens
agaatttaccatcatctct

SEQ ID NO: 3587115 - DNA, 12 bp, Homo sapiens
agacaaatattc

SEQ ID NO: 3587116 - DNA, 18 bp, Homo sapiens
agacaaatctttaagaat

SEQ ID NO: 3587117 - DNA, 16 bp, Homo sapiens
agacaagcagcccttg

SEQ ID NO: 3587118 - DNA, 20 bp, Homo sapiens
agacaatcactgccaacccc

SEQ ID NO: 3587119 - DNA, 16 bp, Homo sapiens
agacacacatacataa

SEQ ID NO: 3587120 - DNA, 19 bp, Homo sapiens
agacacacatacataatgg

SEQ ID NO: 3587121 - DNA, 15 bp, Homo sapiens
agacacagataataa

SEQ ID NO: 3587122 - DNA, 13 bp, Homo sapiens
agacacagctctt

SEQ ID NO: 3587123 - DNA, 14 bp, Homo sapiens
agacacagctcttc

SEQ ID NO: 3587124 - DNA, 12 bp, Homo sapiens
agacacaggccc

SEQ ID NO: 3587125 - DNA, 14 bp, Homo sapiens
agacacccaggact

SEQ ID NO: 3587126 - DNA, 15 bp, Homo sapiens
agacacccaggactt

SEQ ID NO: 3587127 - DNA, 16 bp, Homo sapiens
agacacccaggactta

SEQ ID NO: 3587128 - DNA, 15 bp, Homo sapiens
agacaccctctgggg

SEQ ID NO: 3587129 - DNA, 22 bp, Homo sapiens
agacaccctctgggggtcctct

SEQ ID NO: 3587130 - DNA, 19 bp, Homo sapiens
agacaccgttcattcaggc

SEQ ID NO: 3587131 - DNA, 18 bp, Homo sapiens
agacactgaaaaatctaa

SEQ ID NO: 3587132 - DNA, 14 bp, Homo sapiens
agacactgttgata

SEQ ID NO: 3587133 - DNA, 17 bp, Homo sapiens
agacactgttgataaaa

SEQ ID NO: 3587134 - DNA, 18 bp, Homo sapiens
agacactgttgataaaaa

SEQ ID NO: 3587135 - DNA, 11 bp, Homo sapiens
agacagaaaag

SEQ ID NO: 3587136 - DNA, 12 bp, Homo sapiens
agacagaaaagt

SEQ ID NO: 3587137 - DNA, 15 bp, Homo sapiens
agacagaaaagtgcc

SEQ ID NO: 3587138 - DNA, 20 bp, Homo sapiens
agacagaaaagtgcctgagc

SEQ ID NO: 3587139 - DNA, 16 bp, Homo sapiens
agacagaggcagagat

SEQ ID NO: 3587140 - DNA, 16 bp, Homo sapiens
agacagatgttgggag

SEQ ID NO: 3587141 - DNA, 21 bp, Homo sapiens
agacagcagtttccagagagt

SEQ ID NO: 3587142 - DNA, 18 bp, Homo sapiens
agacagcttacaggagcc

SEQ ID NO: 3587143 - DNA, 20 bp, Homo sapiens
agacagcttacaggagccag

SEQ ID NO: 3587144 - DNA, 14 bp, Homo sapiens
agacaggagcctag

SEQ ID NO: 3587145 - DNA, 13 bp, Homo sapiens
agacaggccctcc

SEQ ID NO: 3587146 - DNA, 15 bp, Homo sapiens
agacagtcctttccc

SEQ ID NO: 3587147 - DNA, 12 bp, Homo sapiens
agacataaaaca

SEQ ID NO: 3587148 - DNA, 14 bp, Homo sapiens
agacataaaacaga

SEQ ID NO: 3587149 - DNA, 17 bp, Homo sapiens
agacataaaacagaatt

SEQ ID NO: 3587150 - DNA, 13 bp, Homo sapiens
agacataaacaaa

SEQ ID NO: 3587151 - DNA, 20 bp, Homo sapiens
agacatacttgaagggccag

SEQ ID NO: 3587152 - DNA, 23 bp, Homo sapiens
agacatatgggatattcccaagc

SEQ ID NO: 3587153 - DNA, 23 bp, Homo sapiens
agacatcagtctccaacatgttt

SEQ ID NO: 3587154 - DNA, 18 bp, Homo sapiens
agacatggtggggtctcc

SEQ ID NO: 3587155 - DNA, 14 bp, Homo sapiens
agacatgtgacatt

SEQ ID NO: 3587156 - DNA, 16 bp, Homo sapiens
agacatgtgacattta

SEQ ID NO: 3587157 - DNA, 17 bp, Homo sapiens
agacatgtgacatttat

SEQ ID NO: 3587158 - DNA, 17 bp, Homo sapiens
agacattagagaaaacc

SEQ ID NO: 3587159 - DNA, 18 bp, Homo sapiens
agacattagagaaaacct

SEQ ID NO: 3587160 - DNA, 13 bp, Homo sapiens
agaccaaaataaa

SEQ ID NO: 3587161 - DNA, 20 bp, Homo sapiens
acttctggccacatcagccc

SEQ ID NO: 3587162 - DNA, 21 bp, Homo sapiens
acttctgtcttcacaacagat

SEQ ID NO: 3587163 - DNA, 22 bp, Homo sapiens
acttctgtcttcacaacagatt

SEQ ID NO: 3587164 - DNA, 18 bp, Homo sapiens
acttcttatacatttgat

SEQ ID NO: 3587165 - DNA, 12 bp, Homo sapiens
acttcttgaagg

SEQ ID NO: 3587166 - DNA, 16 bp, Homo sapiens
acttcttgaaggtgct

SEQ ID NO: 3587167 - DNA, 18 bp, Homo sapiens
acttcttgcttctttcta

SEQ ID NO: 3587168 - DNA, 19 bp, Homo sapiens
acttcttgcttctttctag

SEQ ID NO: 3587169 - DNA, 23 bp, Homo sapiens
acttgaaagttttccagtattga

SEQ ID NO: 3587170 - DNA, 15 bp, Homo sapiens
acttgaagggccaga

SEQ ID NO: 3587171 - DNA, 18 bp, Homo sapiens
acttgaagggccagagcc

SEQ ID NO: 3587172 - DNA, 16 bp, Homo sapiens
acttgagattcaagac

SEQ ID NO: 3587173 - DNA, 17 bp, Homo sapiens
acttgagggcctgtatg

SEQ ID NO: 3587174 - DNA, 22 bp, Homo sapiens
acttgatatttaagcagcttga

SEQ ID NO: 3587175 - DNA, 22 bp, Homo sapiens
acttgatgtacataactcctgt

SEQ ID NO: 3587176 - DNA, 20 bp, Homo sapiens
acttgcatctaaccaaaaag

SEQ ID NO: 3587177 - DNA, 22 bp, Homo sapiens
acttgccgcgtcgccctcccag

SEQ ID NO: 3587178 - DNA, 13 bp, Homo sapiens
acttgctgcctcg

SEQ ID NO: 3587179 - DNA, 13 bp, Homo sapiens
acttgctgctgcc

SEQ ID NO: 3587180 - DNA, 18 bp, Homo sapiens
acttggcccccttcagga

SEQ ID NO: 3587181 - DNA, 21 bp, Homo sapiens
acttggggagttaagacctgg

SEQ ID NO: 3587182 - DNA, 19 bp, Homo sapiens
acttgggtcacatgactct

SEQ ID NO: 3587183 - DNA, 17 bp, Homo sapiens
acttgtaatatttttat

SEQ ID NO: 3587184 - DNA, 18 bp, Homo sapiens
acttgtacaaaataaaca

SEQ ID NO: 3587185 - DNA, 20 bp, Homo sapiens
acttgtatattttaagaaat

SEQ ID NO: 3587186 - DNA, 20 bp, Homo sapiens
acttgtcacagatgcagatt

SEQ ID NO: 3587187 - DNA, 16 bp, Homo sapiens
acttgtcgggggccca

SEQ ID NO: 3587188 - DNA, 14 bp, Homo sapiens
acttgtgattggct

SEQ ID NO: 3587189 - DNA, 17 bp, Homo sapiens
acttgtgattggctgca

SEQ ID NO: 3587190 - DNA, 18 bp, Homo sapiens
acttgtgattggctgcag

SEQ ID NO: 3587191 - DNA, 14 bp, Homo sapiens
acttgtgtctctgt

SEQ ID NO: 3587192 - DNA, 20 bp, Homo sapiens
acttgtttgaatatttgttt

SEQ ID NO: 3587193 - DNA, 16 bp, Homo sapiens
actttaacttctgttt

SEQ ID NO: 3587194 - DNA, 14 bp, Homo sapiens
actttaagaggaca

SEQ ID NO: 3587195 - DNA, 17 bp, Homo sapiens
actttaaggatttgaac

SEQ ID NO: 3587196 - DNA, 13 bp, Homo sapiens
actttactttcag

SEQ ID NO: 3587197 - DNA, 22 bp, Homo sapiens
actttatcctcattccataaat

SEQ ID NO: 3587198 - DNA, 17 bp, Homo sapiens
actttatttatttctag

SEQ ID NO: 3587199 - DNA, 18 bp, Homo sapiens
actttatttatttctagt

SEQ ID NO: 3587200 - DNA, 20 bp, Homo sapiens
actttcagagcccccagccc

SEQ ID NO: 3587201 - DNA, 16 bp, Homo sapiens
actttcagtaaacata

SEQ ID NO: 3587202 - DNA, 18 bp, Homo sapiens
actttccagaatgacctt

SEQ ID NO: 3587203 - DNA, 20 bp, Homo sapiens
actttccagaatgaccttga

SEQ ID NO: 3587204 - DNA, 12 bp, Homo sapiens
actttcctcagt

SEQ ID NO: 3587205 - DNA, 22 bp, Homo sapiens
actttctatgtgacatttctct

SEQ ID NO: 3587206 - DNA, 20 bp, Homo sapiens
actttcttctgaatatttta

SEQ ID NO: 3587207 - DNA, 22 bp, Homo sapiens
actttgcagcacagctgagagg

SEQ ID NO: 3587208 - DNA, 16 bp, Homo sapiens
actttggacagtggcc

SEQ ID NO: 3587209 - DNA, 17 bp, Homo sapiens
actttggacagtggcct

SEQ ID NO: 3587210 - DNA, 21 bp, Homo sapiens
actttggagagggaaaatctt

SEQ ID NO: 3587211 - DNA, 16 bp, Homo sapiens
actttgtgctcataaa

SEQ ID NO: 3587212 - DNA, 12 bp, Homo sapiens
acttttaattta

SEQ ID NO: 3587213 - DNA, 13 bp, Homo sapiens
acttttaatttaa

SEQ ID NO: 3587214 - DNA, 17 bp, Homo sapiens
acttttcctccctcagt

SEQ ID NO: 3587215 - DNA, 12 bp, Homo sapiens
acttttctaaaa

SEQ ID NO: 3587216 - DNA, 12 bp, Homo sapiens
acttttctcaat

SEQ ID NO: 3587217 - DNA, 12 bp, Homo sapiens
acttttctcttt

SEQ ID NO: 3587218 - DNA, 12 bp, Homo sapiens
actttttctgat

SEQ ID NO: 3587219 - DNA, 15 bp, Homo sapiens
acttttttaaatata

SEQ ID NO: 3587220 - DNA, 16 bp, Homo sapiens
acttttttaaatataa

SEQ ID NO: 3587221 - DNA, 18 bp, Homo sapiens
actttttttcttctactt

SEQ ID NO: 3587222 - DNA, 17 bp, Homo sapiens
acttttttttctctctt

SEQ ID NO: 3587223 - DNA, 18 bp, Homo sapiens
acttttttttctctcttt

SEQ ID NO: 3587224 - DNA, 18 bp, Homo sapiens
actttttttttattttat

SEQ ID NO: 3587225 - DNA, 17 bp, Homo sapiens
agaaaaaaaaagcaaat

SEQ ID NO: 3587226 - DNA, 21 bp, Homo sapiens
agaaaaaaaaagcaaatcaga

SEQ ID NO: 3587227 - DNA, 22 bp, Homo sapiens
agaaaaaaaaagcaaatcagaa

SEQ ID NO: 3587228 - DNA, 12 bp, Homo sapiens
agaaaaaacaat

SEQ ID NO: 3587229 - DNA, 19 bp, Homo sapiens
agaaaaaacaatttttgaa

SEQ ID NO: 3587230 - DNA, 13 bp, Homo sapiens
agaaaaagaagaa

SEQ ID NO: 3587231 - DNA, 17 bp, Homo sapiens
agaaaaatatatactaa

SEQ ID NO: 3587232 - DNA, 23 bp, Homo sapiens
agaaaacccacggtttttctttt

SEQ ID NO: 3587233 - DNA, 19 bp, Homo sapiens
agaaaagccgaaagggtta

SEQ ID NO: 3587234 - DNA, 17 bp, Homo sapiens
agaaaagctaagagaag

SEQ ID NO: 3587235 - DNA, 21 bp, Homo sapiens
agaaaatgaaatgcatatttg

SEQ ID NO: 3587236 - DNA, 10 bp, Homo sapiens
agaaaatgtc

SEQ ID NO: 3587237 - DNA, 22 bp, Homo sapiens
agaaaatgtctttctcttcctt

SEQ ID NO: 3587238 - DNA, 12 bp, Homo sapiens
agaaaattaatt

SEQ ID NO: 3587239 - DNA, 14 bp, Homo sapiens
agaaaattcaggtc

SEQ ID NO: 3587240 - DNA, 23 bp, Homo sapiens
agaaaattgtctgggttccaaaa

SEQ ID NO: 3587241 - DNA, 22 bp, Homo sapiens
agaaaatttttgtagtagcgtt

SEQ ID NO: 3587242 - DNA, 16 bp, Homo sapiens
agaaacaagctgtgca

SEQ ID NO: 3587243 - DNA, 15 bp, Homo sapiens
agaaacaccagtgtt

SEQ ID NO: 3587244 - DNA, 13 bp, Homo sapiens
agaaacagctcag

SEQ ID NO: 3587245 - DNA, 17 bp, Homo sapiens
agaaacagttggtaact

SEQ ID NO: 3587246 - DNA, 18 bp, Homo sapiens
agaaacagttggtaactt

SEQ ID NO: 3587247 - DNA, 21 bp, Homo sapiens
agaaacagttggtaacttttg

SEQ ID NO: 3587248 - DNA, 13 bp, Homo sapiens
agaaacagtttct

SEQ ID NO: 3587249 - DNA, 23 bp, Homo sapiens
agaaaccaacaagaaccactcct

SEQ ID NO: 3587250 - DNA, 22 bp, Homo sapiens
agaaacccacgacctgtcctgt

SEQ ID NO: 3587251 - DNA, 14 bp, Homo sapiens
agaaacccagagat

SEQ ID NO: 3587252 - DNA, 22 bp, Homo sapiens
agaaacctgactcaattatttg

SEQ ID NO: 3587253 - DNA, 17 bp, Homo sapiens
agaaacctgccaaggag

SEQ ID NO: 3587254 - DNA, 18 bp, Homo sapiens
agaaacctgccaaggagc

SEQ ID NO: 3587255 - DNA, 23 bp, Homo sapiens
agaaacctggggtgaatacttat

SEQ ID NO: 3587256 - DNA, 14 bp, Homo sapiens
agaaaccttgctct

SEQ ID NO: 3587257 - DNA, 18 bp, Homo sapiens
agaaactgaggcccagag

SEQ ID NO: 3587258 - DNA, 13 bp, Homo sapiens
agaaactgctgca

SEQ ID NO: 3587259 - DNA, 22 bp, Homo sapiens
agaaactgttcccacctgctgg

SEQ ID NO: 3587260 - DNA, 16 bp, Homo sapiens
agaaacttttttattt

SEQ ID NO: 3587261 - DNA, 16 bp, Homo sapiens
agaaagactattcaaa

SEQ ID NO: 3587262 - DNA, 18 bp, Homo sapiens
agaaagactattcaaaca

SEQ ID NO: 3587263 - DNA, 23 bp, Homo sapiens
agaaagactattcaaacagtctc

SEQ ID NO: 3587264 - DNA, 21 bp, Homo sapiens
agaaagagagaagccagccac

SEQ ID NO: 3587265 - DNA, 16 bp, Homo sapiens
agaaagagctgcctgg

SEQ ID NO: 3587266 - DNA, 14 bp, Homo sapiens
agaaagcaaaatac

SEQ ID NO: 3587267 - DNA, 17 bp, Homo sapiens
agaaagcatatcccacc

SEQ ID NO: 3587268 - DNA, 17 bp, Homo sapiens
agaaagcatccctcacc

SEQ ID NO: 3587269 - DNA, 21 bp, Homo sapiens
agaaagcctcctgccccctgc

SEQ ID NO: 3587270 - DNA, 19 bp, Homo sapiens
agaaagggattgctgaggc

SEQ ID NO: 3587271 - DNA, 16 bp, Homo sapiens
agaaaggggagaatgt

SEQ ID NO: 3587272 - DNA, 21 bp, Homo sapiens
agaaaggtgtgaggagagagg

SEQ ID NO: 3587273 - DNA, 13 bp, Homo sapiens
agaaagtaattta

SEQ ID NO: 3587274 - DNA, 18 bp, Homo sapiens
agaaagtggaaaatgacc

SEQ ID NO: 3587275 - DNA, 11 bp, Homo sapiens
agaaagtgtat

SEQ ID NO: 3587276 - DNA, 15 bp, Homo sapiens
agaaataaatcacag

SEQ ID NO: 3587277 - DNA, 17 bp, Homo sapiens
agaaataaatgaaactt

SEQ ID NO: 3587278 - DNA, 22 bp, Homo sapiens
actgcccccagaaagcctcctg

SEQ ID NO: 3587279 - DNA, 17 bp, Homo sapiens
actgccctaagccccca

SEQ ID NO: 3587280 - DNA, 22 bp, Homo sapiens
actgccctaagcccccagggcc

SEQ ID NO: 3587281 - DNA, 14 bp, Homo sapiens
actgcctcttcctc

SEQ ID NO: 3587282 - DNA, 19 bp, Homo sapiens
actgcctgcatgagctggc

SEQ ID NO: 3587283 - DNA, 21 bp, Homo sapiens
actgcctgcatgagctggcaa

SEQ ID NO: 3587284 - DNA, 19 bp, Homo sapiens
actgccttgtttaatgtta

SEQ ID NO: 3587285 - DNA, 16 bp, Homo sapiens
actgcgcctcgtgctg

SEQ ID NO: 3587286 - DNA, 13 bp, Homo sapiens
actgctataaata

SEQ ID NO: 3587287 - DNA, 17 bp, Homo sapiens
actgctataaataggtt

SEQ ID NO: 3587288 - DNA, 13 bp, Homo sapiens
actgctcctgggc

SEQ ID NO: 3587289 - DNA, 14 bp, Homo sapiens
actgctcctgggca

SEQ ID NO: 3587290 - DNA, 14 bp, Homo sapiens
actgctgagctggc

SEQ ID NO: 3587291 - DNA, 19 bp, Homo sapiens
actgctgcagattagttct

SEQ ID NO: 3587292 - DNA, 12 bp, Homo sapiens
actgctgcaggg

SEQ ID NO: 3587293 - DNA, 21 bp, Homo sapiens
actgctgcccagcctccaagc

SEQ ID NO: 3587294 - DNA, 23 bp, Homo sapiens
actgctgctgctgctgccgccgc

SEQ ID NO: 3587295 - DNA, 20 bp, Homo sapiens
actgctgttatatttcatca

SEQ ID NO: 3587296 - DNA, 18 bp, Homo sapiens
actggaaaggatctgtga

SEQ ID NO: 3587297 - DNA, 20 bp, Homo sapiens
actggaagctttgtagaaat

SEQ ID NO: 3587298 - DNA, 20 bp, Homo sapiens
actggacacaataggtcttt

SEQ ID NO: 3587299 - DNA, 16 bp, Homo sapiens
actggaccactgggca

SEQ ID NO: 3587300 - DNA, 20 bp, Homo sapiens
actggaccactgggcaatga

SEQ ID NO: 3587301 - DNA, 15 bp, Homo sapiens
actggatatttcaat

SEQ ID NO: 3587302 - DNA, 22 bp, Homo sapiens
actggatatttcaatcttttaa

SEQ ID NO: 3587303 - DNA, 12 bp, Homo sapiens
actggcaaaagg

SEQ ID NO: 3587304 - DNA, 21 bp, Homo sapiens
actggcacagttttctgagaa

SEQ ID NO: 3587305 - DNA, 13 bp, Homo sapiens
actggcaggtgtg

SEQ ID NO: 3587306 - DNA, 17 bp, Homo sapiens
actggccgcgggggcag

SEQ ID NO: 3587307 - DNA, 15 bp, Homo sapiens
actggctttggcttc

SEQ ID NO: 3587308 - DNA, 22 bp, Homo sapiens
actgggattaagaaaccttgct

SEQ ID NO: 3587309 - DNA, 19 bp, Homo sapiens
actgggctcaagtgatcct

SEQ ID NO: 3587310 - DNA, 22 bp, Homo sapiens
actgggctgcccacctggctgc

SEQ ID NO: 3587311 - DNA, 23 bp, Homo sapiens
actgggctgcccacctggctgcc

SEQ ID NO: 3587312 - DNA, 16 bp, Homo sapiens
actggggactttattt

SEQ ID NO: 3587313 - DNA, 23 bp, Homo sapiens
actggggttgcgtctgaggcctg

SEQ ID NO: 3587314 - DNA, 16 bp, Homo sapiens
actgggttaaatattt

SEQ ID NO: 3587315 - DNA, 13 bp, Homo sapiens
actggtaaatgtt

SEQ ID NO: 3587316 - DNA, 16 bp, Homo sapiens
actggtacttagagtt

SEQ ID NO: 3587317 - DNA, 17 bp, Homo sapiens
actggtacttagagttt

SEQ ID NO: 3587318 - DNA, 23 bp, Homo sapiens
actggtacttagagtttctgttt

SEQ ID NO: 3587319 - DNA, 14 bp, Homo sapiens
actggtccagctct

SEQ ID NO: 3587320 - DNA, 15 bp, Homo sapiens
actggtccagctctg

SEQ ID NO: 3587321 - DNA, 17 bp, Homo sapiens
actggtccagctctgac

SEQ ID NO: 3587322 - DNA, 19 bp, Homo sapiens
actggtccagctctgacat

SEQ ID NO: 3587323 - DNA, 23 bp, Homo sapiens
actggtccagctctgacatccct

SEQ ID NO: 3587324 - DNA, 14 bp, Homo sapiens
actggtgcatgaca

SEQ ID NO: 3587325 - DNA, 21 bp, Homo sapiens
actggtggcccgacagcctgg

SEQ ID NO: 3587326 - DNA, 21 bp, Homo sapiens
actggttaaacattaatattt

SEQ ID NO: 3587327 - DNA, 17 bp, Homo sapiens
actggttacctggagaa

SEQ ID NO: 3587328 - DNA, 17 bp, Homo sapiens
actggttctgaggccag

SEQ ID NO: 3587329 - DNA, 21 bp, Homo sapiens
actggttctgaggccagaaag

SEQ ID NO: 3587330 - DNA, 14 bp, Homo sapiens
actggttgtatatt

SEQ ID NO: 3587331 - DNA, 18 bp, Homo sapiens
actgtaaagatgaatgtc

SEQ ID NO: 3587332 - DNA, 19 bp, Homo sapiens
actgtaagctttgttctgg

SEQ ID NO: 3587333 - DNA, 22 bp, Homo sapiens
actgtaatcttatttaggaagt

SEQ ID NO: 3587334 - DNA, 20 bp, Homo sapiens
actgtaatgctgcctcagga

SEQ ID NO: 3587335 - DNA, 19 bp, Homo sapiens
actgtagaatgatttcatg

SEQ ID NO: 3587336 - DNA, 16 bp, Homo sapiens
actgtaggtgttatgt

SEQ ID NO: 3587337 - DNA, 19 bp, Homo sapiens
actgtaggtgttatgtatt

SEQ ID NO: 3587338 - DNA, 15 bp, Homo sapiens
actgtcactgttcct

SEQ ID NO: 3587339 - DNA, 22 bp, Homo sapiens
actgtcatcctcaaagaaagtg

SEQ ID NO: 3587340 - DNA, 18 bp, Homo sapiens
actgtcctattatattca

SEQ ID NO: 3587341 - DNA, 16 bp, Homo sapiens
actgtcctgggcctgc

SEQ ID NO: 3587342 - DNA, 17 bp, Homo sapiens
actgtcctgggcctgca

SEQ ID NO: 3587343 - DNA, 18 bp, Homo sapiens
actgtctctccagtgaaa

SEQ ID NO: 3587344 - DNA, 15 bp, Homo sapiens
actgtgcagacccag

SEQ ID NO: 3587345 - DNA, 17 bp, Homo sapiens
actgtgcagacccagtc

SEQ ID NO: 3587346 - DNA, 17 bp, Homo sapiens
actgtgccagaggccag

SEQ ID NO: 3587347 - DNA, 18 bp, Homo sapiens
actgtgctgtactgagca

SEQ ID NO: 3587348 - DNA, 14 bp, Homo sapiens
actgtgcttggcca

SEQ ID NO: 3587349 - DNA, 14 bp, Homo sapiens
actgtggccaggcc

SEQ ID NO: 3587350 - DNA, 15 bp, Homo sapiens
actgtggcctgcagg

SEQ ID NO: 3587351 - DNA, 16 bp, Homo sapiens
actgtggcctgcagga

SEQ ID NO: 3587352 - DNA, 14 bp, Homo sapiens
actgtgggcaaagt

SEQ ID NO: 3587353 - DNA, 14 bp, Homo sapiens
actgttacttgata

SEQ ID NO: 3587354 - DNA, 16 bp, Homo sapiens
actgttctgtagattc

SEQ ID NO: 3587355 - DNA, 18 bp, Homo sapiens
actgttgggacagccatt

SEQ ID NO: 3587356 - DNA, 14 bp, Homo sapiens
actgtttagatgaa

SEQ ID NO: 3587357 - DNA, 15 bp, Homo sapiens
actgtttccctgctg

SEQ ID NO: 3587358 - DNA, 17 bp, Homo sapiens
actgtttccctgctgaa

SEQ ID NO: 3587359 - DNA, 14 bp, Homo sapiens
acttaaaagtattc

SEQ ID NO: 3587360 - DNA, 14 bp, Homo sapiens
acttaaacaaaaaa

SEQ ID NO: 3587361 - DNA, 13 bp, Homo sapiens
acttaaatttgtt

SEQ ID NO: 3587362 - DNA, 16 bp, Homo sapiens
acttaaatttgttctt

SEQ ID NO: 3587363 - DNA, 11 bp, Homo sapiens
acttaacaaac

SEQ ID NO: 3587364 - DNA, 22 bp, Homo sapiens
acttaactatcatcttattcag

SEQ ID NO: 3587365 - DNA, 20 bp, Homo sapiens
acttaagcatctggctctaa

SEQ ID NO: 3587366 - DNA, 16 bp, Homo sapiens
acttaaggcatttgtt

SEQ ID NO: 3587367 - DNA, 19 bp, Homo sapiens
acttaaggggccaaggcag

SEQ ID NO: 3587368 - DNA, 14 bp, Homo sapiens
acttacacttataa

SEQ ID NO: 3587369 - DNA, 21 bp, Homo sapiens
acttacacttataaaataact

SEQ ID NO: 3587370 - DNA, 14 bp, Homo sapiens
acttacatatctga

SEQ ID NO: 3587371 - DNA, 16 bp, Homo sapiens
acttacatatctgact

SEQ ID NO: 3587372 - DNA, 23 bp, Homo sapiens
acttacctgaaggggttttcttg

SEQ ID NO: 3587373 - DNA, 22 bp, Homo sapiens
acttagaacctgaggtctcatt

SEQ ID NO: 3587374 - DNA, 22 bp, Homo sapiens
acttagaaggattgaacttctt

SEQ ID NO: 3587375 - DNA, 15 bp, Homo sapiens
acttagagtttctgt

SEQ ID NO: 3587376 - DNA, 18 bp, Homo sapiens
acttagagtttctgtttg

SEQ ID NO: 3587377 - DNA, 21 bp, Homo sapiens
acttagagtttctgtttgatt

SEQ ID NO: 3587378 - DNA, 22 bp, Homo sapiens
acttagagtttctgtttgattc

SEQ ID NO: 3587379 - DNA, 18 bp, Homo sapiens
acttaggactagaagatt

SEQ ID NO: 3587380 - DNA, 20 bp, Homo sapiens
acttagtacaaagtttcaat

SEQ ID NO: 3587381 - DNA, 13 bp, Homo sapiens
acttataaaataa

SEQ ID NO: 3587382 - DNA, 11 bp, Homo sapiens
acttatacctg

SEQ ID NO: 3587383 - DNA, 17 bp, Homo sapiens
acttatagtacatgata

SEQ ID NO: 3587384 - DNA, 17 bp, Homo sapiens
acttatggcatgactct

SEQ ID NO: 3587385 - DNA, 21 bp, Homo sapiens
acttatgtagaaactgaggcc

SEQ ID NO: 3587386 - DNA, 15 bp, Homo sapiens
acttattgaatatat

SEQ ID NO: 3587387 - DNA, 18 bp, Homo sapiens
acttattgaatatatgat

SEQ ID NO: 3587388 - DNA, 16 bp, Homo sapiens
acttatttctcagctg

SEQ ID NO: 3587389 - DNA, 12 bp, Homo sapiens
acttatttctgc

SEQ ID NO: 3587390 - DNA, 20 bp, Homo sapiens
acttattttcagtgcatcat

SEQ ID NO: 3587391 - DNA, 12 bp, Homo sapiens
acttatttttct

SEQ ID NO: 3587392 - DNA, 22 bp, Homo sapiens
acttatttttgacagtgttgaa

SEQ ID NO: 3587393 - DNA, 15 bp, Homo sapiens
acttcaaaagccata

SEQ ID NO: 3587394 - DNA, 16 bp, Homo sapiens
acttcaaagctgaata

SEQ ID NO: 3587395 - DNA, 13 bp, Homo sapiens
acttcaaagtgcc

SEQ ID NO: 3587396 - DNA, 14 bp, Homo sapiens
acttcaaagtgcct

SEQ ID NO: 3587397 - DNA, 16 bp, Homo sapiens
acttcaaagtgcctgg

SEQ ID NO: 3587398 - DNA, 18 bp, Homo sapiens
acttcaaagtgcctgggc

SEQ ID NO: 3587399 - DNA, 19 bp, Homo sapiens
acttcaaagtgcctgggct

SEQ ID NO: 3587400 - DNA, 9 bp, Homo sapiens
acttcagca

SEQ ID NO: 3587401 - DNA, 21 bp, Homo sapiens
acttcagcaaccctacagtat

SEQ ID NO: 3587402 - DNA, 16 bp, Homo sapiens
acttcaggctcttctc

SEQ ID NO: 3587403 - DNA, 21 bp, Homo sapiens
acttccaggaaagtgtgaaga

SEQ ID NO: 3587404 - DNA, 20 bp, Homo sapiens
actcacccctagccctggtt

SEQ ID NO: 3587405 - DNA, 22 bp, Homo sapiens
actcaccctgggagccagtcct

SEQ ID NO: 3587406 - DNA, 19 bp, Homo sapiens
actcagaaaattccctggg

SEQ ID NO: 3587407 - DNA, 14 bp, Homo sapiens
actcaggcccagaa

SEQ ID NO: 3587408 - DNA, 17 bp, Homo sapiens
actcagggaccggtgct

SEQ ID NO: 3587409 - DNA, 22 bp, Homo sapiens
actcagggaccggtgctgcagg

SEQ ID NO: 3587410 - DNA, 12 bp, Homo sapiens
actcagggacct

SEQ ID NO: 3587411 - DNA, 13 bp, Homo sapiens
actcagtctttaa

SEQ ID NO: 3587412 - DNA, 19 bp, Homo sapiens
actcagtgaccagtgcctg

SEQ ID NO: 3587413 - DNA, 13 bp, Homo sapiens
actcagtgcctcc

SEQ ID NO: 3587414 - DNA, 21 bp, Homo sapiens
actcatattgccctaattaaa

SEQ ID NO: 3587415 - DNA, 23 bp, Homo sapiens
actcatcttggccctcctcagct

SEQ ID NO: 3587416 - DNA, 17 bp, Homo sapiens
actcatgactgcatgac

SEQ ID NO: 3587417 - DNA, 20 bp, Homo sapiens
actcattttaaaaaatggaa

SEQ ID NO: 3587418 - DNA, 14 bp, Homo sapiens
actccaaacctgtc

SEQ ID NO: 3587419 - DNA, 21 bp, Homo sapiens
actccaaagaaatgtaaggga

SEQ ID NO: 3587420 - DNA, 18 bp, Homo sapiens
actccaccgaccaactgc

SEQ ID NO: 3587421 - DNA, 19 bp, Homo sapiens
actccaccgaccaactgcc

SEQ ID NO: 3587422 - DNA, 20 bp, Homo sapiens
actccaccgaccaactgccc

SEQ ID NO: 3587423 - DNA, 22 bp, Homo sapiens
actccactactctcttcctcca

SEQ ID NO: 3587424 - DNA, 13 bp, Homo sapiens
actccagacccct

SEQ ID NO: 3587425 - DNA, 15 bp, Homo sapiens
actccagacccctgg

SEQ ID NO: 3587426 - DNA, 19 bp, Homo sapiens
actccagacccctggcttt

SEQ ID NO: 3587427 - DNA, 20 bp, Homo sapiens
actccagctgacagccacac

SEQ ID NO: 3587428 - DNA, 16 bp, Homo sapiens
actccaggctggaagt

SEQ ID NO: 3587429 - DNA, 15 bp, Homo sapiens
actccaggggcacct

SEQ ID NO: 3587430 - DNA, 12 bp, Homo sapiens
actccagggtga

SEQ ID NO: 3587431 - DNA, 15 bp, Homo sapiens
actccatactccact

SEQ ID NO: 3587432 - DNA, 18 bp, Homo sapiens
actccatctcaaaacaaa

SEQ ID NO: 3587433 - DNA, 13 bp, Homo sapiens
actccatctcttc

SEQ ID NO: 3587434 - DNA, 14 bp, Homo sapiens
actccatttctttc

SEQ ID NO: 3587435 - DNA, 16 bp, Homo sapiens
actccatttctttctt

SEQ ID NO: 3587436 - DNA, 19 bp, Homo sapiens
actccatttctttcttcca

SEQ ID NO: 3587437 - DNA, 13 bp, Homo sapiens
actcccaaactga

SEQ ID NO: 3587438 - DNA, 17 bp, Homo sapiens
actcccaacttcttcct

SEQ ID NO: 3587439 - DNA, 18 bp, Homo sapiens
actcccaacttcttcctg

SEQ ID NO: 3587440 - DNA, 14 bp, Homo sapiens
actcccacctgaca

SEQ ID NO: 3587441 - DNA, 13 bp, Homo sapiens
actcccagaacct

SEQ ID NO: 3587442 - DNA, 22 bp, Homo sapiens
actcccagaacctctaagtgct

SEQ ID NO: 3587443 - DNA, 16 bp, Homo sapiens
actcccattcctgaag

SEQ ID NO: 3587444 - DNA, 20 bp, Homo sapiens
actcccattcctgaagaacc

SEQ ID NO: 3587445 - DNA, 22 bp, Homo sapiens
actcccattcctgaagaaccag

SEQ ID NO: 3587446 - DNA, 15 bp, Homo sapiens
actccccagcccagc

SEQ ID NO: 3587447 - DNA, 11 bp, Homo sapiens
actccccaggg

SEQ ID NO: 3587448 - DNA, 16 bp, Homo sapiens
actccccagggagctc

SEQ ID NO: 3587449 - DNA, 20 bp, Homo sapiens
actccccagggagctctggg

SEQ ID NO: 3587450 - DNA, 20 bp, Homo sapiens
actcccccaccactcaggcc

SEQ ID NO: 3587451 - DNA, 17 bp, Homo sapiens
actcccccgtttctcct

SEQ ID NO: 3587452 - DNA, 16 bp, Homo sapiens
actccctacactgatg

SEQ ID NO: 3587453 - DNA, 19 bp, Homo sapiens
actccgtaacagattttgt

SEQ ID NO: 3587454 - DNA, 20 bp, Homo sapiens
actcctataaagtgcctcgg

SEQ ID NO: 3587455 - DNA, 13 bp, Homo sapiens
actcctctgtcca

SEQ ID NO: 3587456 - DNA, 14 bp, Homo sapiens
actcctggaggctg

SEQ ID NO: 3587457 - DNA, 13 bp, Homo sapiens
actcctggcaggg

SEQ ID NO: 3587458 - DNA, 19 bp, Homo sapiens
actcctggcagggccacct

SEQ ID NO: 3587459 - DNA, 19 bp, Homo sapiens
actcctggctcaagccctg

SEQ ID NO: 3587460 - DNA, 13 bp, Homo sapiens
actcctgtccctt

SEQ ID NO: 3587461 - DNA, 19 bp, Homo sapiens
actcctgtcccttttccct

SEQ ID NO: 3587462 - DNA, 21 bp, Homo sapiens
actcctgtcccttttccctta

SEQ ID NO: 3587463 - DNA, 17 bp, Homo sapiens
actcctgtcttctttct

SEQ ID NO: 3587464 - DNA, 20 bp, Homo sapiens
actcctgtcttctttctcca

SEQ ID NO: 3587465 - DNA, 23 bp, Homo sapiens
actcggtgtccccaccatctgct

SEQ ID NO: 3587466 - DNA, 22 bp, Homo sapiens
actctaactctgagagctgttt

SEQ ID NO: 3587467 - DNA, 20 bp, Homo sapiens
actctagctgggggtgggcc

SEQ ID NO: 3587468 - DNA, 12 bp, Homo sapiens
actctcaccatg

SEQ ID NO: 3587469 - DNA, 12 bp, Homo sapiens
actctcagaaat

SEQ ID NO: 3587470 - DNA, 22 bp, Homo sapiens
actctcattttatttacagctg

SEQ ID NO: 3587471 - DNA, 24 bp, Homo sapiens
actctcattttatttacagctgtg

SEQ ID NO: 3587472 - DNA, 23 bp, Homo sapiens
actctccccgctcaggggcctgg

SEQ ID NO: 3587473 - DNA, 12 bp, Homo sapiens
actctcctgcct

SEQ ID NO: 3587474 - DNA, 21 bp, Homo sapiens
actctctccaggagggctcgg

SEQ ID NO: 3587475 - DNA, 13 bp, Homo sapiens
actctcttatgca

SEQ ID NO: 3587476 - DNA, 21 bp, Homo sapiens
actctgcactggggcgtttcc

SEQ ID NO: 3587477 - DNA, 19 bp, Homo sapiens
actctggaggtcatctggc

SEQ ID NO: 3587478 - DNA, 20 bp, Homo sapiens
actctggcagcaccgcctct

SEQ ID NO: 3587479 - DNA, 22 bp, Homo sapiens
actctggcagcaccgcctcttc

SEQ ID NO: 3587480 - DNA, 15 bp, Homo sapiens
actctgggcaaagcc

SEQ ID NO: 3587481 - DNA, 21 bp, Homo sapiens
actctgggcaaagcccctcac

SEQ ID NO: 3587482 - DNA, 14 bp, Homo sapiens
actctgggctccag

SEQ ID NO: 3587483 - DNA, 21 bp, Homo sapiens
actctgggggtggacatctga

SEQ ID NO: 3587484 - DNA, 20 bp, Homo sapiens
actctggtgagtcaccactt

SEQ ID NO: 3587485 - DNA, 17 bp, Homo sapiens
actctgtccctgtcctt

SEQ ID NO: 3587486 - DNA, 17 bp, Homo sapiens
actctgtgaaagaagag

SEQ ID NO: 3587487 - DNA, 20 bp, Homo sapiens
actctgttgcaagtgcaata

SEQ ID NO: 3587488 - DNA, 13 bp, Homo sapiens
actcttcctcctc

SEQ ID NO: 3587489 - DNA, 20 bp, Homo sapiens
actcttcgaagccttgccta

SEQ ID NO: 3587490 - DNA, 21 bp, Homo sapiens
actcttggttcgatacctgga

SEQ ID NO: 3587491 - DNA, 13 bp, Homo sapiens
actctttaataaa

SEQ ID NO: 3587492 - DNA, 16 bp, Homo sapiens
actctttctaatgctg

SEQ ID NO: 3587493 - DNA, 12 bp, Homo sapiens
actctttgatat

SEQ ID NO: 3587494 - DNA, 18 bp, Homo sapiens
actgaaaatattgtttta

SEQ ID NO: 3587495 - DNA, 21 bp, Homo sapiens
actgaaatttgttatacttca

SEQ ID NO: 3587496 - DNA, 18 bp, Homo sapiens
actgaacaggttctcttc

SEQ ID NO: 3587497 - DNA, 16 bp, Homo sapiens
actgaaccaaattgca

SEQ ID NO: 3587498 - DNA, 14 bp, Homo sapiens
actgaagtttttga

SEQ ID NO: 3587499 - DNA, 20 bp, Homo sapiens
actgaagtttttgaaatacc

SEQ ID NO: 3587500 - DNA, 22 bp, Homo sapiens
actgaagtttttgaaatacctt

SEQ ID NO: 3587501 - DNA, 23 bp, Homo sapiens
actgacaattttacctattctga

SEQ ID NO: 3587502 - DNA, 13 bp, Homo sapiens
actgaccactggg

SEQ ID NO: 3587503 - DNA, 12 bp, Homo sapiens
actgaccagaac

SEQ ID NO: 3587504 - DNA, 13 bp, Homo sapiens
actgaccagcctc

SEQ ID NO: 3587505 - DNA, 14 bp, Homo sapiens
actgaccatcatgc

SEQ ID NO: 3587506 - DNA, 21 bp, Homo sapiens
actgacccccatctgagctgg

SEQ ID NO: 3587507 - DNA, 17 bp, Homo sapiens
actgaccctcaggcaca

SEQ ID NO: 3587508 - DNA, 15 bp, Homo sapiens
actgagaaaacctgt

SEQ ID NO: 3587509 - DNA, 22 bp, Homo sapiens
actgagatgtgaacacatcagc

SEQ ID NO: 3587510 - DNA, 15 bp, Homo sapiens
actgagcagccgcca

SEQ ID NO: 3587511 - DNA, 15 bp, Homo sapiens
actgagctgggggaa

SEQ ID NO: 3587512 - DNA, 16 bp, Homo sapiens
actgaggcccagagag

SEQ ID NO: 3587513 - DNA, 20 bp, Homo sapiens
actgaggcccagagagggaa

SEQ ID NO: 3587514 - DNA, 20 bp, Homo sapiens
actgatgagagaatgtggaa

SEQ ID NO: 3587515 - DNA, 21 bp, Homo sapiens
actgatgagagaatgtggaaa

SEQ ID NO: 3587516 - DNA, 23 bp, Homo sapiens
actgatgcaaggattacagaaac

SEQ ID NO: 3587517 - DNA, 12 bp, Homo sapiens
actgatgccaag

SEQ ID NO: 3587518 - DNA, 15 bp, Homo sapiens
actgatgctgcccct

SEQ ID NO: 3587519 - DNA, 22 bp, Homo sapiens
actgatggctaatgtactgcat

SEQ ID NO: 3587520 - DNA, 14 bp, Homo sapiens
actgatttcttgcg

SEQ ID NO: 3587521 - DNA, 17 bp, Homo sapiens
actgcaaaaaaagcctc

SEQ ID NO: 3587522 - DNA, 22 bp, Homo sapiens
actgcaagagccaagttccaaa

SEQ ID NO: 3587523 - DNA, 16 bp, Homo sapiens
actgcacagtgcatct

SEQ ID NO: 3587524 - DNA, 21 bp, Homo sapiens
actgcagcctcaacctcctgg

SEQ ID NO: 3587525 - DNA, 20 bp, Homo sapiens
actgcagcttgagtttttag

SEQ ID NO: 3587526 - DNA, 16 bp, Homo sapiens
actgcagggactgcca

SEQ ID NO: 3587527 - DNA, 15 bp, Homo sapiens
actgcagtctttatt

SEQ ID NO: 3587528 - DNA, 15 bp, Homo sapiens
actgcattattctct

SEQ ID NO: 3587529 - DNA, 20 bp, Homo sapiens
actgcattattctcttttat

SEQ ID NO: 3587530 - DNA, 17 bp, Homo sapiens
actgcattcctgtgccc

SEQ ID NO: 3587531 - DNA, 17 bp, Homo sapiens
actgcattctctcccat

SEQ ID NO: 3587532 - DNA, 15 bp, Homo sapiens
actgccaagccagat

SEQ ID NO: 3587533 - DNA, 17 bp, Homo sapiens
actgccaagccagattc

SEQ ID NO: 3587534 - DNA, 21 bp, Homo sapiens
actgccaagccagattctctt

SEQ ID NO: 3587535 - DNA, 21 bp, Homo sapiens
actgccaggctgcctcctgcc

SEQ ID NO: 3587536 - DNA, 15 bp, Homo sapiens
aataaatctgaccca

SEQ ID NO: 3587537 - DNA, 16 bp, Homo sapiens
aataaatctgacccag

SEQ ID NO: 3587538 - DNA, 21 bp, Homo sapiens
aataaatgaaacttggccagt

SEQ ID NO: 3587539 - DNA, 15 bp, Homo sapiens
aataaatgtcacttt

SEQ ID NO: 3587540 - DNA, 19 bp, Homo sapiens
aataaatgtcactttttga

SEQ ID NO: 3587541 - DNA, 12 bp, Homo sapiens
aataaatgtgcc

SEQ ID NO: 3587542 - DNA, 21 bp, Homo sapiens
aataaattcccaacttctctt

SEQ ID NO: 3587543 - DNA, 13 bp, Homo sapiens
aataaattgctta

SEQ ID NO: 3587544 - DNA, 13 bp, Homo sapiens
aataaatttaact

SEQ ID NO: 3587545 - DNA, 19 bp, Homo sapiens
aataaattttttttggtca

SEQ ID NO: 3587546 - DNA, 15 bp, Homo sapiens
aataacaaaatggac

SEQ ID NO: 3587547 - DNA, 14 bp, Homo sapiens
aataacagatttct

SEQ ID NO: 3587548 - DNA, 21 bp, Homo sapiens
aataactgaaccaaattgcac

SEQ ID NO: 3587549 - DNA, 14 bp, Homo sapiens
aataatagactgta

SEQ ID NO: 3587550 - DNA, 18 bp, Homo sapiens
aataatgaagtagaagtt

SEQ ID NO: 3587551 - DNA, 15 bp, Homo sapiens
aataattttgtaatg

SEQ ID NO: 3587552 - DNA, 13 bp, Homo sapiens
aatacaaccagcc

SEQ ID NO: 3587553 - DNA, 20 bp, Homo sapiens
aatacaaccagcccaaccat

SEQ ID NO: 3587554 - DNA, 19 bp, Homo sapiens
aatacaagtaatattatta

SEQ ID NO: 3587555 - DNA, 20 bp, Homo sapiens
aatacaagtaatattattac

SEQ ID NO: 3587556 - DNA, 14 bp, Homo sapiens
aatacacactcaaa

SEQ ID NO: 3587557 - DNA, 16 bp, Homo sapiens
aatacacatgcaggac

SEQ ID NO: 3587558 - DNA, 22 bp, Homo sapiens
aatacaccgtttagaaaaaaca

SEQ ID NO: 3587559 - DNA, 22 bp, Homo sapiens
aatacacttgtgattataaaat

SEQ ID NO: 3587560 - DNA, 12 bp, Homo sapiens
aatacatttgta

SEQ ID NO: 3587561 - DNA, 20 bp, Homo sapiens
aatacatttgtatttatgtg

SEQ ID NO: 3587562 - DNA, 18 bp, Homo sapiens
aataccatgccatttaaa

SEQ ID NO: 3587563 - DNA, 14 bp, Homo sapiens
aatacccgtcctct

SEQ ID NO: 3587564 - DNA, 20 bp, Homo sapiens
aatacccgtcctctcggctg

SEQ ID NO: 3587565 - DNA, 18 bp, Homo sapiens
aatacctacaataaactg

SEQ ID NO: 3587566 - DNA, 22 bp, Homo sapiens
aatacctttgtagttactcaag

SEQ ID NO: 3587567 - DNA, 17 bp, Homo sapiens
aatactttccatgtttt

SEQ ID NO: 3587568 - DNA, 21 bp, Homo sapiens
aatagactgtaacttccaaat

SEQ ID NO: 3587569 - DNA, 15 bp, Homo sapiens
aatagattcagagaa

SEQ ID NO: 3587570 - DNA, 17 bp, Homo sapiens
aatagattcagagaaat

SEQ ID NO: 3587571 - DNA, 21 bp, Homo sapiens
aatagcaaggctgtgcatcta

SEQ ID NO: 3587572 - DNA, 15 bp, Homo sapiens
aatagcaatattctt

SEQ ID NO: 3587573 - DNA, 20 bp, Homo sapiens
aataggtcatatgttgtgtt

SEQ ID NO: 3587574 - DNA, 14 bp, Homo sapiens
aatagtatcctcca

SEQ ID NO: 3587575 - DNA, 15 bp, Homo sapiens
aatagtatcctccag

SEQ ID NO: 3587576 - DNA, 17 bp, Homo sapiens
aatagtatcctccaggt

SEQ ID NO: 3587577 - DNA, 20 bp, Homo sapiens
aatagtctagatggctcctc

SEQ ID NO: 3587578 - DNA, 21 bp, Homo sapiens
aatagtctagatggctcctct

SEQ ID NO: 3587579 - DNA, 20 bp, Homo sapiens
aatagtttttcactttgtgt

SEQ ID NO: 3587580 - DNA, 14 bp, Homo sapiens
aatagttttttact

SEQ ID NO: 3587581 - DNA, 17 bp, Homo sapiens
aatataataatgatgat

SEQ ID NO: 3587582 - DNA, 22 bp, Homo sapiens
aatatatctgttggagaaagaa

SEQ ID NO: 3587583 - DNA, 14 bp, Homo sapiens
aatatcaaagtcat

SEQ ID NO: 3587584 - DNA, 20 bp, Homo sapiens
aatatcaaagtcattaaaga

SEQ ID NO: 3587585 - DNA, 22 bp, Homo sapiens
aatatcccagaaaaagtaactc

SEQ ID NO: 3587586 - DNA, 21 bp, Homo sapiens
aatatcccttggacattttat

SEQ ID NO: 3587587 - DNA, 22 bp, Homo sapiens
aatatcccttggacattttatg

SEQ ID NO: 3587588 - DNA, 20 bp, Homo sapiens
aatatgaaattttttttcat

SEQ ID NO: 3587589 - DNA, 18 bp, Homo sapiens
aagcattgtaaatgtgct

SEQ ID NO: 3587590 - DNA, 16 bp, Homo sapiens
aagcatttcatgaaaa

SEQ ID NO: 3587591 - DNA, 22 bp, Homo sapiens
aagcattttcgttacattgtgt

SEQ ID NO: 3587592 - DNA, 20 bp, Homo sapiens
aagccaaactcaggcccaga

SEQ ID NO: 3587593 - DNA, 15 bp, Homo sapiens
aagccaaagaaacaa

SEQ ID NO: 3587594 - DNA, 23 bp, Homo sapiens
aagccaaagaaacaagctgtgca

SEQ ID NO: 3587595 - DNA, 13 bp, Homo sapiens
aagccaagaggca

SEQ ID NO: 3587596 - DNA, 21 bp, Homo sapiens
aagccaaggcagcgaccccag

SEQ ID NO: 3587597 - DNA, 23 bp, Homo sapiens
aagccaccctgggctacagaaac

SEQ ID NO: 3587598 - DNA, 17 bp, Homo sapiens
aagccagattctcttga

SEQ ID NO: 3587599 - DNA, 10 bp, Homo sapiens
aagccagcca

SEQ ID NO: 3587600 - DNA, 11 bp, Homo sapiens
aagccagccac

SEQ ID NO: 3587601 - DNA, 13 bp, Homo sapiens
aagccagccacag

SEQ ID NO: 3587602 - DNA, 21 bp, Homo sapiens
aagccagccacagacccctgg

SEQ ID NO: 3587603 - DNA, 23 bp, Homo sapiens
aagccagccacagacccctggga

SEQ ID NO: 3587604 - DNA, 22 bp, Homo sapiens
aagccaggaatttcccaggacc

SEQ ID NO: 3587605 - DNA, 14 bp, Homo sapiens
aagccaggtacagg

SEQ ID NO: 3587606 - DNA, 15 bp, Homo sapiens
aagccaggtacagga

SEQ ID NO: 3587607 - DNA, 22 bp, Homo sapiens
aagccaggtacaggagaggcag

SEQ ID NO: 3587608 - DNA, 21 bp, Homo sapiens
aagccaggttccacagaggac

SEQ ID NO: 3587609 - DNA, 23 bp, Homo sapiens
aagccaggttccacagaggacac

SEQ ID NO: 3587610 - DNA, 17 bp, Homo sapiens
aagccatatgaacagct

SEQ ID NO: 3587611 - DNA, 21 bp, Homo sapiens
aagccatgtataaatgtgata

SEQ ID NO: 3587612 - DNA, 20 bp, Homo sapiens
aagccatgtggggttgctga

SEQ ID NO: 3587613 - DNA, 12 bp, Homo sapiens
aagcccaactgg

SEQ ID NO: 3587614 - DNA, 15 bp, Homo sapiens
aagcccaggggccgg

SEQ ID NO: 3587615 - DNA, 14 bp, Homo sapiens
aagcccagttcatc

SEQ ID NO: 3587616 - DNA, 21 bp, Homo sapiens
aagcccccagctaagaacctg

SEQ ID NO: 3587617 - DNA, 23 bp, Homo sapiens
aagcccccagctaagaacctgga

SEQ ID NO: 3587618 - DNA, 12 bp, Homo sapiens
aagcccccaggg

SEQ ID NO: 3587619 - DNA, 13 bp, Homo sapiens
aagcccccagggc

SEQ ID NO: 3587620 - DNA, 19 bp, Homo sapiens
aagcccccagggcctccag

SEQ ID NO: 3587621 - DNA, 23 bp, Homo sapiens
aagcccgaccgggccaggcctgg

SEQ ID NO: 3587622 - DNA, 20 bp, Homo sapiens
aagcccttggaacaccctgg

SEQ ID NO: 3587623 - DNA, 21 bp, Homo sapiens
aagcccttggaacaccctgga

SEQ ID NO: 3587624 - DNA, 15 bp, Homo sapiens
aagccgaccttccct

SEQ ID NO: 3587625 - DNA, 13 bp, Homo sapiens
cagatattttatc

SEQ ID NO: 3587626 - DNA, 14 bp, Homo sapiens
cagatcactcctgg

SEQ ID NO: 3587627 - DNA, 17 bp, Homo sapiens
cagatcagaacatgaaa

SEQ ID NO: 3587628 - DNA, 19 bp, Homo sapiens
cagatcatgggtcaagaga

SEQ ID NO: 3587629 - DNA, 13 bp, Homo sapiens
cagatccagcctg

SEQ ID NO: 3587630 - DNA, 14 bp, Homo sapiens
cagatccagcctgg

SEQ ID NO: 3587631 - DNA, 18 bp, Homo sapiens
cagatccagcctggggtc

SEQ ID NO: 3587632 - DNA, 12 bp, Homo sapiens
cagatccaggac

SEQ ID NO: 3587633 - DNA, 13 bp, Homo sapiens
cagatccagggac

SEQ ID NO: 3587634 - DNA, 14 bp, Homo sapiens
cagatccagggaca

SEQ ID NO: 3587635 - DNA, 20 bp, Homo sapiens
cagatctattgtttgttgca

SEQ ID NO: 3587636 - DNA, 20 bp, Homo sapiens
cagatctggaacctcagcct

SEQ ID NO: 3587637 - DNA, 18 bp, Homo sapiens
cactccagactctggggg

SEQ ID NO: 3587638 - DNA, 13 bp, Homo sapiens
cactccagctcct

SEQ ID NO: 3587639 - DNA, 16 bp, Homo sapiens
cagaagaatcttcctg

SEQ ID NO: 3587640 - DNA, 18 bp, Homo sapiens
cagaagaatcttcctggc

SEQ ID NO: 3587641 - DNA, 23 bp, Homo sapiens
cacccacctccctgcctccagga

SEQ ID NO: 3587642 - DNA, 17 bp, Homo sapiens
cacccacctctgggtcc

SEQ ID NO: 3587643 - DNA, 14 bp, Homo sapiens
cacccactctgcac

SEQ ID NO: 3587644 - DNA, 15 bp, Homo sapiens
cacccactctgcact

SEQ ID NO: 3587645 - DNA, 16 bp, Homo sapiens
cacccactctgcactg

SEQ ID NO: 3587646 - DNA, 12 bp, Homo sapiens
cacccagcaggc

SEQ ID NO: 3587647 - DNA, 15 bp, Homo sapiens
cacccagcaggcaga

SEQ ID NO: 3587648 - DNA, 19 bp, Homo sapiens
cacccagccccagccaggg

SEQ ID NO: 3587649 - DNA, 16 bp, Homo sapiens
cacccagtgggaagag

SEQ ID NO: 3587650 - DNA, 16 bp, Homo sapiens
cacccatgccagagag

SEQ ID NO: 3587651 - DNA, 14 bp, Homo sapiens
attgtgatgtgtcc

SEQ ID NO: 3587652 - DNA, 15 bp, Homo sapiens
attgtgatgtgtcct

SEQ ID NO: 3587653 - DNA, 16 bp, Homo sapiens
attgtgcccctaaaga

SEQ ID NO: 3587654 - DNA, 22 bp, Homo sapiens
attgtgcccctaaagagcatcc

SEQ ID NO: 3587655 - DNA, 12 bp, Homo sapiens
attgtgtatctg

SEQ ID NO: 3587656 - DNA, 23 bp, Homo sapiens
attgtgtggtctggttcctgtgt

SEQ ID NO: 3587657 - DNA, 14 bp, Homo sapiens
attgttacaatttt

SEQ ID NO: 3587658 - DNA, 16 bp, Homo sapiens
attgttagaaaatgac

SEQ ID NO: 3587659 - DNA, 22 bp, Homo sapiens
attgttatatacatactatgaa

SEQ ID NO: 3587660 - DNA, 14 bp, Homo sapiens
attgttcttttcaa

SEQ ID NO: 3587661 - DNA, 16 bp, Homo sapiens
attgttgctgaaactt

SEQ ID NO: 3587662 - DNA, 15 bp, Homo sapiens
attgtttaatctttt

SEQ ID NO: 3587663 - DNA, 16 bp, Homo sapiens
attgtttatatggata

SEQ ID NO: 3587664 - DNA, 19 bp, Homo sapiens
attgtttgttgcactaaaa

SEQ ID NO: 3587665 - DNA, 13 bp, Homo sapiens
attgttttacaat

SEQ ID NO: 3587666 - DNA, 15 bp, Homo sapiens
attgttttctattta

SEQ ID NO: 3587667 - DNA, 22 bp, Homo sapiens
attgttttctatttatgccttg

SEQ ID NO: 3587668 - DNA, 15 bp, Homo sapiens
attgtttttgtattt

SEQ ID NO: 3587669 - DNA, 17 bp, Homo sapiens
attgtttttgtatttat

SEQ ID NO: 3587670 - DNA, 19 bp, Homo sapiens
atttaaaaaatgaatagta

SEQ ID NO: 3587671 - DNA, 15 bp, Homo sapiens
atttaaaaacacaaa

SEQ ID NO: 3587672 - DNA, 15 bp, Homo sapiens
atttaaaaatatatt

SEQ ID NO: 3587673 - DNA, 21 bp, Homo sapiens
atttaaaacattaaaatataa

SEQ ID NO: 3587674 - DNA, 14 bp, Homo sapiens
atttaaaagacagc

SEQ ID NO: 3587675 - DNA, 23 bp, Homo sapiens
atttaaaatgctcaatttcagca

SEQ ID NO: 3587676 - DNA, 19 bp, Homo sapiens
atttaaaattgtgatgtgt

SEQ ID NO: 3587677 - DNA, 17 bp, Homo sapiens
atttaaactgtgtttta

SEQ ID NO: 3587678 - DNA, 23 bp, Homo sapiens
atttaaaggttgagtatgtgaag

SEQ ID NO: 3587679 - DNA, 12 bp, Homo sapiens
atttaagacata

SEQ ID NO: 3587680 - DNA, 15 bp, Homo sapiens
atttaagacataaac

SEQ ID NO: 3587681 - DNA, 22 bp, Homo sapiens
atttaagacataaacaaagaca

SEQ ID NO: 3587682 - DNA, 23 bp, Homo sapiens
atttaagacataaacaaagacat

SEQ ID NO: 3587683 - DNA, 16 bp, Homo sapiens
atttaagcaacatctt

SEQ ID NO: 3587684 - DNA, 16 bp, Homo sapiens
atttaagccttacaaa

SEQ ID NO: 3587685 - DNA, 21 bp, Homo sapiens
atttaagccttacaaagggaa

SEQ ID NO: 3587686 - DNA, 17 bp, Homo sapiens
atttaagccttataaac

SEQ ID NO: 3587687 - DNA, 20 bp, Homo sapiens
atttaagccttataaaccaa

SEQ ID NO: 3587688 - DNA, 14 bp, Homo sapiens
atttaatattacag

SEQ ID NO: 3587689 - DNA, 16 bp, Homo sapiens
atttaatattacagat

SEQ ID NO: 3587690 - DNA, 14 bp, Homo sapiens
atttaatatttact

SEQ ID NO: 3587691 - DNA, 18 bp, Homo sapiens
atttaatccttctttgta

SEQ ID NO: 3587692 - DNA, 18 bp, Homo sapiens
atttaatgatgattatgg

SEQ ID NO: 3587693 - DNA, 17 bp, Homo sapiens
atttaatggggaggaca

SEQ ID NO: 3587694 - DNA, 17 bp, Homo sapiens
atttaattacaaacaat

SEQ ID NO: 3587695 - DNA, 13 bp, Homo sapiens
atttaatttgaag

SEQ ID NO: 3587696 - DNA, 17 bp, Homo sapiens
atttaatttttcctttt

SEQ ID NO: 3587697 - DNA, 20 bp, Homo sapiens
atttacactattatttccta

SEQ ID NO: 3587698 - DNA, 13 bp, Homo sapiens
atttaccaaagta

SEQ ID NO: 3587699 - DNA, 16 bp, Homo sapiens
atttaccatcatctct

SEQ ID NO: 3587700 - DNA, 17 bp, Homo sapiens
atttacctttttttagt

SEQ ID NO: 3587701 - DNA, 20 bp, Homo sapiens
atttactgatgagagaatgt

SEQ ID NO: 3587702 - DNA, 19 bp, Homo sapiens
atttagagataggaaactg

SEQ ID NO: 3587703 - DNA, 14 bp, Homo sapiens
atttaggagaagcc

SEQ ID NO: 3587704 - DNA, 15 bp, Homo sapiens
atttagtcaacatat

SEQ ID NO: 3587705 - DNA, 12 bp, Homo sapiens
atttagtcctgt

SEQ ID NO: 3587706 - DNA, 10 bp, Homo sapiens
atttagtgtg

SEQ ID NO: 3587707 - DNA, 13 bp, Homo sapiens
atttagtgtgaat

SEQ ID NO: 3587708 - DNA, 17 bp, Homo sapiens
atttataatgtatttga

SEQ ID NO: 3587709 - DNA, 19 bp, Homo sapiens
atttataatgtatttgaaa

SEQ ID NO: 3587710 - DNA, 20 bp, Homo sapiens
atttatacaccagcaattta

SEQ ID NO: 3587711 - DNA, 19 bp, Homo sapiens
cacacgctgctctgcccca

SEQ ID NO: 3587712 - DNA, 13 bp, Homo sapiens
cacacgtggctgg

SEQ ID NO: 3587713 - DNA, 14 bp, Homo sapiens
cacacgtggctggc

SEQ ID NO: 3587714 - DNA, 16 bp, Homo sapiens
cacacgtggctggcgg

SEQ ID NO: 3587715 - DNA, 13 bp, Homo sapiens
cacactcagaaaa

SEQ ID NO: 3587716 - DNA, 15 bp, Homo sapiens
cacactcagaaaatt

SEQ ID NO: 3587717 - DNA, 21 bp, Homo sapiens
cacactcagaaaattccctgg

SEQ ID NO: 3587718 - DNA, 21 bp, Homo sapiens
cacactgcttggcccttcaag

SEQ ID NO: 3587719 - DNA, 23 bp, Homo sapiens
cacactggaaattgaaataaaga

SEQ ID NO: 3587720 - DNA, 18 bp, Homo sapiens
cacactggtacttagagt

SEQ ID NO: 3587721 - DNA, 19 bp, Homo sapiens
cacactggtacttagagtt

SEQ ID NO: 3587722 - DNA, 22 bp, Homo sapiens
cacactggtacttagagtttct

SEQ ID NO: 3587723 - DNA, 21 bp, Homo sapiens
cacacttcaggctcttctcct

SEQ ID NO: 3587724 - DNA, 22 bp, Homo sapiens
cacacttcaggctcttctcctt

SEQ ID NO: 3587725 - DNA, 14 bp, Homo sapiens
cacacttgttttct

SEQ ID NO: 3587726 - DNA, 19 bp, Homo sapiens
cacagaaccttcaacccag

SEQ ID NO: 3587727 - DNA, 21 bp, Homo sapiens
cacagaaccttcaacccagtg

SEQ ID NO: 3587728 - DNA, 15 bp, Homo sapiens
cacagacaagcagcc

SEQ ID NO: 3587729 - DNA, 16 bp, Homo sapiens
cacagacaagcagccc

SEQ ID NO: 3587730 - DNA, 19 bp, Homo sapiens
cacagacaagcagcccttg

SEQ ID NO: 3587731 - DNA, 14 bp, Homo sapiens
cacagaccaggcct

SEQ ID NO: 3587732 - DNA, 16 bp, Homo sapiens
cacagacccctgggag

SEQ ID NO: 3587733 - DNA, 23 bp, Homo sapiens
cacagagaagtttgtagccaggt

SEQ ID NO: 3587734 - DNA, 10 bp, Homo sapiens
cacagagagg

SEQ ID NO: 3587735 - DNA, 19 bp, Homo sapiens
cacagatgcatatagacac

SEQ ID NO: 3587736 - DNA, 16 bp, Homo sapiens
cacagcaattcctcag

SEQ ID NO: 3587737 - DNA, 13 bp, Homo sapiens
cacagcagagcat

SEQ ID NO: 3587738 - DNA, 14 bp, Homo sapiens
cacagcatcgggag

SEQ ID NO: 3587739 - DNA, 23 bp, Homo sapiens
cacagcccttatgcggttaattt

SEQ ID NO: 3587740 - DNA, 21 bp, Homo sapiens
cacagcctataggccaatgca

SEQ ID NO: 3587741 - DNA, 17 bp, Homo sapiens
cacagccttgcagcggc

SEQ ID NO: 3587742 - DNA, 21 bp, Homo sapiens
cacagccttgcagcggctcct

SEQ ID NO: 3587743 - DNA, 23 bp, Homo sapiens
cacagccttgcagcggctcctgc

SEQ ID NO: 3587744 - DNA, 21 bp, Homo sapiens
cacagctactcagtggggctg

SEQ ID NO: 3587745 - DNA, 21 bp, Homo sapiens
cacagctctccggtctctctc

SEQ ID NO: 3587746 - DNA, 18 bp, Homo sapiens
cacagctcttcattccat

SEQ ID NO: 3587747 - DNA, 16 bp, Homo sapiens
cacagctgagcactta

SEQ ID NO: 3587748 - DNA, 13 bp, Homo sapiens
cacagctgggagc

SEQ ID NO: 3587749 - DNA, 17 bp, Homo sapiens
cacagctgggagcctgg

SEQ ID NO: 3587750 - DNA, 15 bp, Homo sapiens
cacagctgggctgtg

SEQ ID NO: 3587751 - DNA, 15 bp, Homo sapiens
cacagcttcctgagg

SEQ ID NO: 3587752 - DNA, 19 bp, Homo sapiens
cacaggataggactccatt

SEQ ID NO: 3587753 - DNA, 16 bp, Homo sapiens
cacaggcaaaatcctt

SEQ ID NO: 3587754 - DNA, 15 bp, Homo sapiens
cacaggcccttcctc

SEQ ID NO: 3587755 - DNA, 17 bp, Homo sapiens
cacaggcccttcctctc

SEQ ID NO: 3587756 - DNA, 23 bp, Homo sapiens
cacaggcccttcctctccactgc

SEQ ID NO: 3587757 - DNA, 14 bp, Homo sapiens
cacagggaatggcc

SEQ ID NO: 3587758 - DNA, 23 bp, Homo sapiens
cacagggaatggccacaaacctg

SEQ ID NO: 3587759 - DNA, 22 bp, Homo sapiens
cacagggactgaaaacctctcc

SEQ ID NO: 3587760 - DNA, 21 bp, Homo sapiens
cacagggtgagggccacctcc

SEQ ID NO: 3587761 - DNA, 19 bp, Homo sapiens
cacagtatctgctgttctt

SEQ ID NO: 3587762 - DNA, 21 bp, Homo sapiens
cacagtatctgctgttcttca

SEQ ID NO: 3587763 - DNA, 16 bp, Homo sapiens
cacagtgctcttttct

SEQ ID NO: 3587764 - DNA, 18 bp, Homo sapiens
cacagtggggctgcaggc

SEQ ID NO: 3587765 - DNA, 20 bp, Homo sapiens
cacagtggggctgcaggcag

SEQ ID NO: 3587766 - DNA, 21 bp, Homo sapiens
cacagttctttgggccagaca

SEQ ID NO: 3587767 - DNA, 16 bp, Homo sapiens
cacataaaagccccag

SEQ ID NO: 3587768 - DNA, 18 bp, Homo sapiens
cacataaaagccccagct

SEQ ID NO: 3587769 - DNA, 23 bp, Homo sapiens
cacataaccctgtcacccacaga

SEQ ID NO: 3587770 - DNA, 19 bp, Homo sapiens
cacataagcccagttcatc

SEQ ID NO: 3587771 - DNA, 13 bp, Homo sapiens
cacatatgagggg

SEQ ID NO: 3587772 - DNA, 17 bp, Homo sapiens
cacatatttcagtgagg

SEQ ID NO: 3587773 - DNA, 20 bp, Homo sapiens
cacatccttctcactgccat

SEQ ID NO: 3587774 - DNA, 17 bp, Homo sapiens
cacatctaagcctgaag

SEQ ID NO: 3587775 - DNA, 22 bp, Homo sapiens
cacatctaagcctgaaggggcg

SEQ ID NO: 3587776 - DNA, 12 bp, Homo sapiens
cacatctggctg

SEQ ID NO: 3587777 - DNA, 13 bp, Homo sapiens
cacatctggctgc

SEQ ID NO: 3587778 - DNA, 20 bp, Homo sapiens
cacatctggctgcacaggct

SEQ ID NO: 3587779 - DNA, 14 bp, Homo sapiens
cacatcttgctctg

SEQ ID NO: 3587780 - DNA, 16 bp, Homo sapiens
cacatgaggccatctc

SEQ ID NO: 3587781 - DNA, 21 bp, Homo sapiens
cacatgaggccatctcaggag

SEQ ID NO: 3587782 - DNA, 22 bp, Homo sapiens
cacatgaggccatctcaggaga

SEQ ID NO: 3587783 - DNA, 23 bp, Homo sapiens
cacatgaggccatctcaggagat

SEQ ID NO: 3587784 - DNA, 14 bp, Homo sapiens
cacatgccacctgg

SEQ ID NO: 3587785 - DNA, 19 bp, Homo sapiens
cacatgccaggggcctttg

SEQ ID NO: 3587786 - DNA, 15 bp, Homo sapiens
cacatgctgcctggc

SEQ ID NO: 3587787 - DNA, 18 bp, Homo sapiens
cacatgctgcctggcaca

SEQ ID NO: 3587788 - DNA, 21 bp, Homo sapiens
cacatggccatcttctttctt

SEQ ID NO: 3587789 - DNA, 12 bp, Homo sapiens
cacattcaggga

SEQ ID NO: 3587790 - DNA, 13 bp, Homo sapiens
cacattgaagaat

SEQ ID NO: 3587791 - DNA, 15 bp, Homo sapiens
cacattgctggctgc

SEQ ID NO: 3587792 - DNA, 16 bp, Homo sapiens
cacattgctggctgcc

SEQ ID NO: 3587793 - DNA, 21 bp, Homo sapiens
cacatttcctctgttcttttc

SEQ ID NO: 3587794 - DNA, 19 bp, Homo sapiens
cacatttgggatgttcctt

SEQ ID NO: 3587795 - DNA, 22 bp, Homo sapiens
cacatttgggatgttccttttt

SEQ ID NO: 3587796 - DNA, 13 bp, Homo sapiens
caccaaccctcag

SEQ ID NO: 3587797 - DNA, 12 bp, Homo sapiens
caccaacctcca

SEQ ID NO: 3587798 - DNA, 13 bp, Homo sapiens
caccaacctccag

SEQ ID NO: 3587799 - DNA, 14 bp, Homo sapiens
caccaacctccaga

SEQ ID NO: 3587800 - DNA, 20 bp, Homo sapiens
caccaacctccagactcagc

SEQ ID NO: 3587801 - DNA, 16 bp, Homo sapiens
caccaagctcaccctt

SEQ ID NO: 3587802 - DNA, 17 bp, Homo sapiens
caccactaccagccagc

SEQ ID NO: 3587803 - DNA, 16 bp, Homo sapiens
caccactcaggccaca

SEQ ID NO: 3587804 - DNA, 18 bp, Homo sapiens
caccactccccaacccct

SEQ ID NO: 3587805 - DNA, 23 bp, Homo sapiens
caccactccccaacccctctcca

SEQ ID NO: 3587806 - DNA, 20 bp, Homo sapiens
caccagacacccaggactta

SEQ ID NO: 3587807 - DNA, 13 bp, Homo sapiens
caccagagccggg

SEQ ID NO: 3587808 - DNA, 15 bp, Homo sapiens
caccagcattccttt

SEQ ID NO: 3587809 - DNA, 17 bp, Homo sapiens
caccaggcgctaattca

SEQ ID NO: 3587810 - DNA, 23 bp, Homo sapiens
caccaggcgctaattcaaggaat

SEQ ID NO: 3587811 - DNA, 15 bp, Homo sapiens
caccaggggaggagc

SEQ ID NO: 3587812 - DNA, 17 bp, Homo sapiens
caccagtgttcctgaag

SEQ ID NO: 3587813 - DNA, 23 bp, Homo sapiens
caccagtgttcctgaagctgctg

SEQ ID NO: 3587814 - DNA, 19 bp, Homo sapiens
caccagttaaaagcatttt

SEQ ID NO: 3587815 - DNA, 22 bp, Homo sapiens
caccagttaaaagcattttaat

SEQ ID NO: 3587816 - DNA, 11 bp, Homo sapiens
caccagttctc

SEQ ID NO: 3587817 - DNA, 19 bp, Homo sapiens
caccataccttagagactt

SEQ ID NO: 3587818 - DNA, 15 bp, Homo sapiens
caccatcagcctgtt

SEQ ID NO: 3587819 - DNA, 18 bp, Homo sapiens
caccatgatgtgaagagt

SEQ ID NO: 3587820 - DNA, 22 bp, Homo sapiens
caccatgctgctggggaagaca

SEQ ID NO: 3587821 - DNA, 22 bp, Homo sapiens
caccatggcatgcgccaccatg

SEQ ID NO: 3587822 - DNA, 11 bp, Homo sapiens
caccattcctg

SEQ ID NO: 3587823 - DNA, 15 bp, Homo sapiens
caccattcctgcctt

SEQ ID NO: 3587824 - DNA, 22 bp, Homo sapiens
cacccaaagaggtatttatctt

SEQ ID NO: 3587825 - DNA, 16 bp, Homo sapiens
cacccacaaactccag

SEQ ID NO: 3587826 - DNA, 18 bp, Homo sapiens
cacccacaaactccaggc

SEQ ID NO: 3587827 - DNA, 21 bp, Homo sapiens
cacccacctccctgcctccag

SEQ ID NO: 3587828 - DNA, 23 bp, Homo sapiens
caggcataagctatcacctagca

SEQ ID NO: 3587829 - DNA, 12 bp, Homo sapiens
caggcatgtgtc

SEQ ID NO: 3587830 - DNA, 16 bp, Homo sapiens
caggccaacagcacct

SEQ ID NO: 3587831 - DNA, 12 bp, Homo sapiens
caggccagagaa

SEQ ID NO: 3587832 - DNA, 13 bp, Homo sapiens
caggccagagaaa

SEQ ID NO: 3587833 - DNA, 16 bp, Homo sapiens
caggccagagaaagca

SEQ ID NO: 3587834 - DNA, 17 bp, Homo sapiens
caggccagcccagccag

SEQ ID NO: 3587835 - DNA, 19 bp, Homo sapiens
caggccagcccagccaggc

SEQ ID NO: 3587836 - DNA, 18 bp, Homo sapiens
caggccagtcagacgcca

SEQ ID NO: 3587837 - DNA, 18 bp, Homo sapiens
caggcccaatgctgcttt

SEQ ID NO: 3587838 - DNA, 12 bp, Homo sapiens
caggcccactcc

SEQ ID NO: 3587839 - DNA, 13 bp, Homo sapiens
caggcccactccc

SEQ ID NO: 3587840 - DNA, 22 bp, Homo sapiens
caggcccatgggaggctggagt

SEQ ID NO: 3587841 - DNA, 20 bp, Homo sapiens
caggccccaccggccaggcc

SEQ ID NO: 3587842 - DNA, 21 bp, Homo sapiens
caggccccaccggccaggccg

SEQ ID NO: 3587843 - DNA, 19 bp, Homo sapiens
caggcccccaggtgccagt

SEQ ID NO: 3587844 - DNA, 20 bp, Homo sapiens
caggcccccaggtgccagtt

SEQ ID NO: 3587845 - DNA, 14 bp, Homo sapiens
caggcccctccctc

SEQ ID NO: 3587846 - DNA, 16 bp, Homo sapiens
caggccctccctgtct

SEQ ID NO: 3587847 - DNA, 22 bp, Homo sapiens
caggccctccctgtctccaggg

SEQ ID NO: 3587848 - DNA, 23 bp, Homo sapiens
caggccctccctgttccccagag

SEQ ID NO: 3587849 - DNA, 19 bp, Homo sapiens
caggcccttcctctccact

SEQ ID NO: 3587850 - DNA, 20 bp, Homo sapiens
caggcccttcctctccactg

SEQ ID NO: 3587851 - DNA, 19 bp, Homo sapiens
caggccgcgcccagcagag

SEQ ID NO: 3587852 - DNA, 21 bp, Homo sapiens
caggccgcgcccagcagaggc

SEQ ID NO: 3587853 - DNA, 20 bp, Homo sapiens
caggcctaggtgcagctcct

SEQ ID NO: 3587854 - DNA, 12 bp, Homo sapiens
caggcctctggg

SEQ ID NO: 3587855 - DNA, 20 bp, Homo sapiens
caggcctctgggacccacag

SEQ ID NO: 3587856 - DNA, 21 bp, Homo sapiens
caggcctctgggacccacaga

SEQ ID NO: 3587857 - DNA, 23 bp, Homo sapiens
caggcctctgggacccacagaac

SEQ ID NO: 3587858 - DNA, 20 bp, Homo sapiens
caggcctgcctgttcccatt

SEQ ID NO: 3587859 - DNA, 20 bp, Homo sapiens
caggccttacatctggctgg

SEQ ID NO: 3587860 - DNA, 15 bp, Homo sapiens
caggcgcctggtgtg

SEQ ID NO: 3587861 - DNA, 17 bp, Homo sapiens
caggcggctcctcctca

SEQ ID NO: 3587862 - DNA, 18 bp, Homo sapiens
caggcggctcctcctcac

SEQ ID NO: 3587863 - DNA, 22 bp, Homo sapiens
caggcgtagatcaccagaataa

SEQ ID NO: 3587864 - DNA, 21 bp, Homo sapiens
caggcgtgagccactgttccc

SEQ ID NO: 3587865 - DNA, 17 bp, Homo sapiens
caggctaagaccctgtg

SEQ ID NO: 3587866 - DNA, 14 bp, Homo sapiens
caggctagctgtgc

SEQ ID NO: 3587867 - DNA, 14 bp, Homo sapiens
caggctcaggagaa

SEQ ID NO: 3587868 - DNA, 18 bp, Homo sapiens
caggctcaggagaagcca

SEQ ID NO: 3587869 - DNA, 22 bp, Homo sapiens
caggctcctacctgtctgctgc

SEQ ID NO: 3587870 - DNA, 23 bp, Homo sapiens
caggctcctacctgtctgctgcc

SEQ ID NO: 3587871 - DNA, 14 bp, Homo sapiens
caggctcgtcagcc

SEQ ID NO: 3587872 - DNA, 12 bp, Homo sapiens
caggctctgcac

SEQ ID NO: 3587873 - DNA, 18 bp, Homo sapiens
caggctcttctcctttca

SEQ ID NO: 3587874 - DNA, 20 bp, Homo sapiens
caggctgaaatatccaccca

SEQ ID NO: 3587875 - DNA, 22 bp, Homo sapiens
caggctgaaatatccacccagc

SEQ ID NO: 3587876 - DNA, 23 bp, Homo sapiens
caggctgagaactcgttcacctc

SEQ ID NO: 3587877 - DNA, 17 bp, Homo sapiens
caggcttagggacagga

SEQ ID NO: 3587878 - DNA, 13 bp, Homo sapiens
caggcttgtggca

SEQ ID NO: 3587879 - DNA, 18 bp, Homo sapiens
caggctttctagaaagaa

SEQ ID NO: 3587880 - DNA, 19 bp, Homo sapiens
cagggaaaagcagctctcc

SEQ ID NO: 3587881 - DNA, 20 bp, Homo sapiens
cagggaaaatgcagcaggga

SEQ ID NO: 3587882 - DNA, 18 bp, Homo sapiens
cagggaagctgtcctgga

SEQ ID NO: 3587883 - DNA, 14 bp, Homo sapiens
cagggaaggagaca

SEQ ID NO: 3587884 - DNA, 20 bp, Homo sapiens
cagggaatggccacaaacct

SEQ ID NO: 3587885 - DNA, 23 bp, Homo sapiens
cagggaatggccacaaacctgcc

SEQ ID NO: 3587886 - DNA, 21 bp, Homo sapiens
cagggacagaggccccagcct

SEQ ID NO: 3587887 - DNA, 23 bp, Homo sapiens
cagggacagaggccccagcctcc

SEQ ID NO: 3587888 - DNA, 22 bp, Homo sapiens
cagggaccggtgctgcaggagt

SEQ ID NO: 3587889 - DNA, 15 bp, Homo sapiens
cagggaccgtccagg

SEQ ID NO: 3587890 - DNA, 17 bp, Homo sapiens
cagggaccgtccagggg

SEQ ID NO: 3587891 - DNA, 15 bp, Homo sapiens
cagggacctaaaggg

SEQ ID NO: 3587892 - DNA, 14 bp, Homo sapiens
cagggacctgagag

SEQ ID NO: 3587893 - DNA, 15 bp, Homo sapiens
cagggacctgagagc

SEQ ID NO: 3587894 - DNA, 20 bp, Homo sapiens
cagggactgaaaacctctcc

SEQ ID NO: 3587895 - DNA, 12 bp, Homo sapiens
cagggagaagct

SEQ ID NO: 3587896 - DNA, 19 bp, Homo sapiens
cagggagagagtagctgca

SEQ ID NO: 3587897 - DNA, 22 bp, Homo sapiens
cagggagagagtagctgcagcc

SEQ ID NO: 3587898 - DNA, 23 bp, Homo sapiens
cagggagcatttaatggcagcta

SEQ ID NO: 3587899 - DNA, 16 bp, Homo sapiens
cagggagctctgggga

SEQ ID NO: 3587900 - DNA, 17 bp, Homo sapiens
cagggagctctggggac

SEQ ID NO: 3587901 - DNA, 19 bp, Homo sapiens
cagggagctctggggacag

SEQ ID NO: 3587902 - DNA, 16 bp, Homo sapiens
cagggaggtccgggag

SEQ ID NO: 3587903 - DNA, 16 bp, Homo sapiens
cagggatcacactgcc

SEQ ID NO: 3587904 - DNA, 22 bp, Homo sapiens
cagggatctgtttgaacactta

SEQ ID NO: 3587905 - DNA, 19 bp, Homo sapiens
cagggatgatggcagagcc

SEQ ID NO: 3587906 - DNA, 20 bp, Homo sapiens
cagggatgatggcagagcca

SEQ ID NO: 3587907 - DNA, 13 bp, Homo sapiens
cagggatgccctg

SEQ ID NO: 3587908 - DNA, 16 bp, Homo sapiens
cagggatgccctggag

SEQ ID NO: 3587909 - DNA, 20 bp, Homo sapiens
cagggatgccctggaggtgg

SEQ ID NO: 3587910 - DNA, 22 bp, Homo sapiens
cagggatgccctggaggtggct

SEQ ID NO: 3587911 - DNA, 19 bp, Homo sapiens
cagggatgctgggctgggc

SEQ ID NO: 3587912 - DNA, 20 bp, Homo sapiens
cagggatgctgggctgggcc

SEQ ID NO: 3587913 - DNA, 22 bp, Homo sapiens
cagggatgctgggctgggccct

SEQ ID NO: 3587914 - DNA, 16 bp, Homo sapiens
cagggatggagggaag

SEQ ID NO: 3587915 - DNA, 14 bp, Homo sapiens
cagggcagcaggcc

SEQ ID NO: 3587916 - DNA, 15 bp, Homo sapiens
cagggcagcaggcca

SEQ ID NO: 3587917 - DNA, 16 bp, Homo sapiens
cagggcagcaggccag

SEQ ID NO: 3587918 - DNA, 17 bp, Homo sapiens
cagggcagcaggccaga

SEQ ID NO: 3587919 - DNA, 17 bp, Homo sapiens
cagggcagcggctccac

SEQ ID NO: 3587920 - DNA, 21 bp, Homo sapiens
cagggcagtggcttctttcca

SEQ ID NO: 3587921 - DNA, 12 bp, Homo sapiens
cagggccacctg

SEQ ID NO: 3587922 - DNA, 17 bp, Homo sapiens
cagggccacctgcagga

SEQ ID NO: 3587923 - DNA, 19 bp, Homo sapiens
cagggccaggtgcagacct

SEQ ID NO: 3587924 - DNA, 16 bp, Homo sapiens
cagggccagtgcagtt

SEQ ID NO: 3587925 - DNA, 14 bp, Homo sapiens
cagggccagtggga

SEQ ID NO: 3587926 - DNA, 18 bp, Homo sapiens
cagggccatctgactgcc

SEQ ID NO: 3587927 - DNA, 18 bp, Homo sapiens
cagggcccagagcccagc

SEQ ID NO: 3587928 - DNA, 22 bp, Homo sapiens
cagggcccagagcccagctcca

SEQ ID NO: 3587929 - DNA, 16 bp, Homo sapiens
cagggcccctggatct

SEQ ID NO: 3587930 - DNA, 14 bp, Homo sapiens
cagggccgggcagg

SEQ ID NO: 3587931 - DNA, 21 bp, Homo sapiens
cagggccgggcagggggacag

SEQ ID NO: 3587932 - DNA, 13 bp, Homo sapiens
cagggcctagagg

SEQ ID NO: 3587933 - DNA, 15 bp, Homo sapiens
cagggcctccagggc

SEQ ID NO: 3587934 - DNA, 13 bp, Homo sapiens
cagggcctgcgga

SEQ ID NO: 3587935 - DNA, 22 bp, Homo sapiens
cagggcctgcggaggcggtggc

SEQ ID NO: 3587936 - DNA, 19 bp, Homo sapiens
cagggctaaataaagagga

SEQ ID NO: 3587937 - DNA, 16 bp, Homo sapiens
cagggctgaggcctct

SEQ ID NO: 3587938 - DNA, 16 bp, Homo sapiens
cagggctggagcctgg

SEQ ID NO: 3587939 - DNA, 19 bp, Homo sapiens
cagggctggagcctggggt

SEQ ID NO: 3587940 - DNA, 10 bp, Homo sapiens
cagggctggg

SEQ ID NO: 3587941 - DNA, 17 bp, Homo sapiens
cagggcttctcctcctc

SEQ ID NO: 3587942 - DNA, 18 bp, Homo sapiens
caggggagacaggagcct

SEQ ID NO: 3587943 - DNA, 21 bp, Homo sapiens
caggggagacaggagcctagc

SEQ ID NO: 3587944 - DNA, 17 bp, Homo sapiens
caggggagatggggagg

SEQ ID NO: 3587945 - DNA, 14 bp, Homo sapiens
caggggaggagcct

SEQ ID NO: 3587946 - DNA, 17 bp, Homo sapiens
caggggaggccatctgg

SEQ ID NO: 3587947 - DNA, 18 bp, Homo sapiens
caggggccaacctcaggc

SEQ ID NO: 3587948 - DNA, 21 bp, Homo sapiens
caggggccaacctcaggctcc

SEQ ID NO: 3587949 - DNA, 22 bp, Homo sapiens
caggggccggccagtggccttc

SEQ ID NO: 3587950 - DNA, 13 bp, Homo sapiens
caggggcctgcag

SEQ ID NO: 3587951 - DNA, 14 bp, Homo sapiens
caggggcctgcaga

SEQ ID NO: 3587952 - DNA, 18 bp, Homo sapiens
caggggcctggaggtctg

SEQ ID NO: 3587953 - DNA, 22 bp, Homo sapiens
caggggcctggaggtctggctg

SEQ ID NO: 3587954 - DNA, 13 bp, Homo sapiens
caggggctctgtg

SEQ ID NO: 3587955 - DNA, 15 bp, Homo sapiens
cagggggcaagagga

SEQ ID NO: 3587956 - DNA, 23 bp, Homo sapiens
cagggggccccgccagggctggg

SEQ ID NO: 3587957 - DNA, 11 bp, Homo sapiens
cagggggccct

SEQ ID NO: 3587958 - DNA, 14 bp, Homo sapiens
cagggggccctgcc

SEQ ID NO: 3587959 - DNA, 19 bp, Homo sapiens
cagctggcccccagccctg

SEQ ID NO: 3587960 - DNA, 21 bp, Homo sapiens
cagctggcccccagccctggg

SEQ ID NO: 3587961 - DNA, 15 bp, Homo sapiens
cagctggcggaggct

SEQ ID NO: 3587962 - DNA, 11 bp, Homo sapiens
cagctggctgg

SEQ ID NO: 3587963 - DNA, 13 bp, Homo sapiens
cagctggctgggc

SEQ ID NO: 3587964 - DNA, 14 bp, Homo sapiens
cagctggctgggcc

SEQ ID NO: 3587965 - DNA, 20 bp, Homo sapiens
cagctgggaagcccttttta

SEQ ID NO: 3587966 - DNA, 16 bp, Homo sapiens
cagctgggtgcagaag

SEQ ID NO: 3587967 - DNA, 22 bp, Homo sapiens
cagctgggtgcagaagctgtgg

SEQ ID NO: 3587968 - DNA, 13 bp, Homo sapiens
cagctggttgctc

SEQ ID NO: 3587969 - DNA, 11 bp, Homo sapiens
cagctgtgcct

SEQ ID NO: 3587970 - DNA, 11 bp, Homo sapiens
cagctgtgctc

SEQ ID NO: 3587971 - DNA, 21 bp, Homo sapiens
cagctgtggggaacacagcta

SEQ ID NO: 3587972 - DNA, 15 bp, Homo sapiens
cagcttacaggagcc

SEQ ID NO: 3587973 - DNA, 18 bp, Homo sapiens
cagcttacaggagccagc

SEQ ID NO: 3587974 - DNA, 23 bp, Homo sapiens
cagcttacaggagccagcctgct

SEQ ID NO: 3587975 - DNA, 18 bp, Homo sapiens
cagcttcaacttttctct

SEQ ID NO: 3587976 - DNA, 14 bp, Homo sapiens
cagcttcctcacac

SEQ ID NO: 3587977 - DNA, 15 bp, Homo sapiens
cagcttcctcacacc

SEQ ID NO: 3587978 - DNA, 17 bp, Homo sapiens
cagcttctactcctgcc

SEQ ID NO: 3587979 - DNA, 16 bp, Homo sapiens
cagcttctctctccag

SEQ ID NO: 3587980 - DNA, 19 bp, Homo sapiens
cagcttctctctccagggt

SEQ ID NO: 3587981 - DNA, 13 bp, Homo sapiens
cagcttctctgca

SEQ ID NO: 3587982 - DNA, 15 bp, Homo sapiens
cagcttgctgggctt

SEQ ID NO: 3587983 - DNA, 21 bp, Homo sapiens
cagcttgctgggctttgggaa

SEQ ID NO: 3587984 - DNA, 23 bp, Homo sapiens
cagcttgctgggctttgggaagt

SEQ ID NO: 3587985 - DNA, 13 bp, Homo sapiens
cagcttggcaggg

SEQ ID NO: 3587986 - DNA, 22 bp, Homo sapiens
cagcttggctcacaaggcccag

SEQ ID NO: 3587987 - DNA, 23 bp, Homo sapiens
cagcttggctcacaaggcccagg

SEQ ID NO: 3587988 - DNA, 20 bp, Homo sapiens
caggtgtgggatctggggag

SEQ ID NO: 3587989 - DNA, 15 bp, Homo sapiens
caggttccacagagg

SEQ ID NO: 3587990 - DNA, 17 bp, Homo sapiens
caggttccccaagggcc

SEQ ID NO: 3587991 - DNA, 16 bp, Homo sapiens
caggttcccccagcaa

SEQ ID NO: 3587992 - DNA, 18 bp, Homo sapiens
caggttcccccagcaagc

SEQ ID NO: 3587993 - DNA, 18 bp, Homo sapiens
caggttccctcccagagg

SEQ ID NO: 3587994 - DNA, 18 bp, Homo sapiens
caggttgggctagagaaa

SEQ ID NO: 3587995 - DNA, 15 bp, Homo sapiens
caggttggttttgct

SEQ ID NO: 3587996 - DNA, 23 bp, Homo sapiens
caggttgtctgaagtcactgcac

SEQ ID NO: 3587997 - DNA, 18 bp, Homo sapiens
caggttttcagagaatta

SEQ ID NO: 3587998 - DNA, 21 bp, Homo sapiens
caggtttttcaattaaacgga

SEQ ID NO: 3587999 - DNA, 14 bp, Homo sapiens
cagtaactgtgctg

SEQ ID NO: 3588000 - DNA, 20 bp, Homo sapiens
cagtaaggatttttatgtac

SEQ ID NO: 3588001 - DNA, 15 bp, Homo sapiens
cagtaagttatcttt

SEQ ID NO: 3588002 - DNA, 20 bp, Homo sapiens
cagtaagttatctttgaata

SEQ ID NO: 3588003 - DNA, 13 bp, Homo sapiens
cagtaagttctgt

SEQ ID NO: 3588004 - DNA, 17 bp, Homo sapiens
cagtaatttgaggacaa

SEQ ID NO: 3588005 - DNA, 23 bp, Homo sapiens
cagtaccatttaatggggaggac

SEQ ID NO: 3588006 - DNA, 15 bp, Homo sapiens
cagtacccttggcct

SEQ ID NO: 3588007 - DNA, 15 bp, Homo sapiens
cagtactaaaattaa

SEQ ID NO: 3588008 - DNA, 19 bp, Homo sapiens
cagtagcttgaaattgatt

SEQ ID NO: 3588009 - DNA, 22 bp, Homo sapiens
cagtaggggcttataataaagg

SEQ ID NO: 3588010 - DNA, 19 bp, Homo sapiens
cagtaggtcccggccagct

SEQ ID NO: 3588011 - DNA, 22 bp, Homo sapiens
cagtaggtcccggccagctctg

SEQ ID NO: 3588012 - DNA, 23 bp, Homo sapiens
cagtaggtcccggccagctctgg

SEQ ID NO: 3588013 - DNA, 18 bp, Homo sapiens
cagtagttctcaaagtgt

SEQ ID NO: 3588014 - DNA, 15 bp, Homo sapiens
cagtatataagcttt

SEQ ID NO: 3588015 - DNA, 13 bp, Homo sapiens
cagtatctgctgt

SEQ ID NO: 3588016 - DNA, 14 bp, Homo sapiens
cagtatctgctgtt

SEQ ID NO: 3588017 - DNA, 17 bp, Homo sapiens
cagtattaacactaaat

SEQ ID NO: 3588018 - DNA, 14 bp, Homo sapiens
cagtattaaggttt

SEQ ID NO: 3588019 - DNA, 18 bp, Homo sapiens
cagtattgaaaacttcaa

SEQ ID NO: 3588020 - DNA, 19 bp, Homo sapiens
cagtattgaaaacttcaaa

SEQ ID NO: 3588021 - DNA, 20 bp, Homo sapiens
cagtattgccccctctcact

SEQ ID NO: 3588022 - DNA, 16 bp, Homo sapiens
cagtatttaacttctg

SEQ ID NO: 3588023 - DNA, 16 bp, Homo sapiens
cagtatttagaagcca

SEQ ID NO: 3588024 - DNA, 17 bp, Homo sapiens
cagtatttagaagccaa

SEQ ID NO: 3588025 - DNA, 16 bp, Homo sapiens
cagtatttctacatta

SEQ ID NO: 3588026 - DNA, 23 bp, Homo sapiens
cagtcagacgccaggcaccacag

SEQ ID NO: 3588027 - DNA, 14 bp, Homo sapiens
cagtccacaggggc

SEQ ID NO: 3588028 - DNA, 18 bp, Homo sapiens
cagtccacaggggccacc

SEQ ID NO: 3588029 - DNA, 19 bp, Homo sapiens
cagtcccacactgtgcaga

SEQ ID NO: 3588030 - DNA, 16 bp, Homo sapiens
cagtccccctgcccca

SEQ ID NO: 3588031 - DNA, 17 bp, Homo sapiens
cagtccccctgccccag

SEQ ID NO: 3588032 - DNA, 12 bp, Homo sapiens
cagtcctcagga

SEQ ID NO: 3588033 - DNA, 20 bp, Homo sapiens
cagtcctccactcgacccag

SEQ ID NO: 3588034 - DNA, 14 bp, Homo sapiens
cagtcctggaggca

SEQ ID NO: 3588035 - DNA, 17 bp, Homo sapiens
cagtccttactccccca

SEQ ID NO: 3588036 - DNA, 13 bp, Homo sapiens
cagtcctttccca

SEQ ID NO: 3588037 - DNA, 21 bp, Homo sapiens
cagtcctttcccaccattcct

SEQ ID NO: 3588038 - DNA, 23 bp, Homo sapiens
cagtcctttcccaccattcctgc

SEQ ID NO: 3588039 - DNA, 23 bp, Homo sapiens
cagtcctttgtctttctttgtca

SEQ ID NO: 3588040 - DNA, 13 bp, Homo sapiens
cagtcgcctgcct

SEQ ID NO: 3588041 - DNA, 14 bp, Homo sapiens
cagtcgcctgcctg

SEQ ID NO: 3588042 - DNA, 15 bp, Homo sapiens
cagtcgcctgcctgc

SEQ ID NO: 3588043 - DNA, 16 bp, Homo sapiens
cagtcgcctgcctgca

SEQ ID NO: 3588044 - DNA, 17 bp, Homo sapiens
cagtcgcctgcctgcag

SEQ ID NO: 3588045 - DNA, 22 bp, Homo sapiens
cagtcgcctgcctgcagcaggc

SEQ ID NO: 3588046 - DNA, 20 bp, Homo sapiens
cagtcgtggggaacggagga

SEQ ID NO: 3588047 - DNA, 16 bp, Homo sapiens
cagtctaaattttcta

SEQ ID NO: 3588048 - DNA, 13 bp, Homo sapiens
cagtctcatttct

SEQ ID NO: 3588049 - DNA, 15 bp, Homo sapiens
cagtctcctcactct

SEQ ID NO: 3588050 - DNA, 17 bp, Homo sapiens
cagtctccttcagcacg

SEQ ID NO: 3588051 - DNA, 16 bp, Homo sapiens
cagtctgataaactga

SEQ ID NO: 3588052 - DNA, 15 bp, Homo sapiens
cagtctgctcctctt

SEQ ID NO: 3588053 - DNA, 14 bp, Homo sapiens
cagtctttattttt

SEQ ID NO: 3588054 - DNA, 15 bp, Homo sapiens
cagtgaatatttttg

SEQ ID NO: 3588055 - DNA, 20 bp, Homo sapiens
cagtgaatatttttgtattt

SEQ ID NO: 3588056 - DNA, 15 bp, Homo sapiens
cagtgacgctgctga

SEQ ID NO: 3588057 - DNA, 10 bp, Homo sapiens
cagtgactcc

SEQ ID NO: 3588058 - DNA, 16 bp, Homo sapiens
cagtgactccagggtg

SEQ ID NO: 3588059 - DNA, 19 bp, Homo sapiens
cagtgactccccagcccag

SEQ ID NO: 3588060 - DNA, 14 bp, Homo sapiens
cagtgactccctgg

SEQ ID NO: 3588061 - DNA, 16 bp, Homo sapiens
cagtgactccctggga

SEQ ID NO: 3588062 - DNA, 17 bp, Homo sapiens
cagtgactccctgggag

SEQ ID NO: 3588063 - DNA, 15 bp, Homo sapiens
cagtgagcccctccc

SEQ ID NO: 3588064 - DNA, 19 bp, Homo sapiens
cagtgagcccctccccagc

SEQ ID NO: 3588065 - DNA, 20 bp, Homo sapiens
cagtgagcccctccccagcc

SEQ ID NO: 3588066 - DNA, 18 bp, Homo sapiens
cagtgattatttttccag

SEQ ID NO: 3588067 - DNA, 15 bp, Homo sapiens
cagtgcactcgagcc

SEQ ID NO: 3588068 - DNA, 12 bp, Homo sapiens
cagtgcagccac

SEQ ID NO: 3588069 - DNA, 13 bp, Homo sapiens
cagtgcagccact

SEQ ID NO: 3588070 - DNA, 15 bp, Homo sapiens
cagtgcagccactgg

SEQ ID NO: 3588071 - DNA, 21 bp, Homo sapiens
cagtgcagtttcttttcacat

SEQ ID NO: 3588072 - DNA, 15 bp, Homo sapiens
cattttgcctctgtc

SEQ ID NO: 3588073 - DNA, 12 bp, Homo sapiens
cattttgtaata

SEQ ID NO: 3588074 - DNA, 16 bp, Homo sapiens
catttttaaattgtta

SEQ ID NO: 3588075 - DNA, 22 bp, Homo sapiens
catttttctcccaagaaacctg

SEQ ID NO: 3588076 - DNA, 14 bp, Homo sapiens
catttttgccaaaa

SEQ ID NO: 3588077 - DNA, 17 bp, Homo sapiens
cattttttaggtgcttt

SEQ ID NO: 3588078 - DNA, 12 bp, Homo sapiens
catttttttaga

SEQ ID NO: 3588079 - DNA, 17 bp, Homo sapiens
cattttttttctttgaa

SEQ ID NO: 3588080 - DNA, 21 bp, Homo sapiens
cattttttttctttgaataaa

SEQ ID NO: 3588081 - DNA, 13 bp, Homo sapiens
ccaaaagacatta

SEQ ID NO: 3588082 - DNA, 23 bp, Homo sapiens
ccaaaataccactagtggaaagt

SEQ ID NO: 3588083 - DNA, 12 bp, Homo sapiens
ccaaaatcaaga

SEQ ID NO: 3588084 - DNA, 22 bp, Homo sapiens
ccaaaatgctctagtgccttct

SEQ ID NO: 3588085 - DNA, 11 bp, Homo sapiens
ccaaaattatt

SEQ ID NO: 3588086 - DNA, 13 bp, Homo sapiens
ccaaacccactca

SEQ ID NO: 3588087 - DNA, 18 bp, Homo sapiens
ccaaacccactcatgact

SEQ ID NO: 3588088 - DNA, 17 bp, Homo sapiens
ccaaaccccagccccaa

SEQ ID NO: 3588089 - DNA, 15 bp, Homo sapiens
ccaaactcaggccca

SEQ ID NO: 3588090 - DNA, 16 bp, Homo sapiens
ccaaactcaggcccag

SEQ ID NO: 3588091 - DNA, 12 bp, Homo sapiens
ccaaactgacaa

SEQ ID NO: 3588092 - DNA, 12 bp, Homo sapiens
ccaaagaaacaa

SEQ ID NO: 3588093 - DNA, 14 bp, Homo sapiens
ccaaagaaacaagc

SEQ ID NO: 3588094 - DNA, 15 bp, Homo sapiens
ccaaagaaacaagct

SEQ ID NO: 3588095 - DNA, 17 bp, Homo sapiens
ccaaagaaacaagctgt

SEQ ID NO: 3588096 - DNA, 17 bp, Homo sapiens
ccaaagaagatagctct

SEQ ID NO: 3588097 - DNA, 15 bp, Homo sapiens
ccaaagactctggag

SEQ ID NO: 3588098 - DNA, 16 bp, Homo sapiens
ccaaagcggtccctgt

SEQ ID NO: 3588099 - DNA, 12 bp, Homo sapiens
ccaaagctttat

SEQ ID NO: 3588100 - DNA, 14 bp, Homo sapiens
ccaaaggaactcta

SEQ ID NO: 3588101 - DNA, 22 bp, Homo sapiens
ccaaagtgctgggattacaggg

SEQ ID NO: 3588102 - DNA, 19 bp, Homo sapiens
ccaaatatgttaaagttta

SEQ ID NO: 3588103 - DNA, 18 bp, Homo sapiens
ccaaatctgacatattat

SEQ ID NO: 3588104 - DNA, 19 bp, Homo sapiens
ccaaatcttgaatttctgc

SEQ ID NO: 3588105 - DNA, 21 bp, Homo sapiens
ccaaatgaccgagccctggag

SEQ ID NO: 3588106 - DNA, 19 bp, Homo sapiens
ccaaattgcactgaagttt

SEQ ID NO: 3588107 - DNA, 19 bp, Homo sapiens
ccaacaaagaacactaact

SEQ ID NO: 3588108 - DNA, 15 bp, Homo sapiens
ccaacagcacctccc

SEQ ID NO: 3588109 - DNA, 13 bp, Homo sapiens
ccaacatcaacat

SEQ ID NO: 3588110 - DNA, 23 bp, Homo sapiens
ccaacatgatccccgtctctgcc

SEQ ID NO: 3588111 - DNA, 13 bp, Homo sapiens
ccaacatttcttg

SEQ ID NO: 3588112 - DNA, 13 bp, Homo sapiens
ccaaccagcccga

SEQ ID NO: 3588113 - DNA, 13 bp, Homo sapiens
ccaacccctctcc

SEQ ID NO: 3588114 - DNA, 19 bp, Homo sapiens
ccaacccctctccaggcct

SEQ ID NO: 3588115 - DNA, 21 bp, Homo sapiens
ccaacccctctccaggcctgt

SEQ ID NO: 3588116 - DNA, 21 bp, Homo sapiens
ccaacccctgacctaccccag

SEQ ID NO: 3588117 - DNA, 22 bp, Homo sapiens
ccaacccgtctggcccaccagg

SEQ ID NO: 3588118 - DNA, 15 bp, Homo sapiens
ccaaccctcagagcc

SEQ ID NO: 3588119 - DNA, 14 bp, Homo sapiens
ccaacctacattcc

SEQ ID NO: 3588120 - DNA, 16 bp, Homo sapiens
ccaacctacattccac

SEQ ID NO: 3588121 - DNA, 23 bp, Homo sapiens
ccaacctctgtggtcacccatgc

SEQ ID NO: 3588122 - DNA, 18 bp, Homo sapiens
ccaacctgttcttagagt

SEQ ID NO: 3588123 - DNA, 14 bp, Homo sapiens
ccaacgcccctgtg

SEQ ID NO: 3588124 - DNA, 14 bp, Homo sapiens
ccaactcacctgag

SEQ ID NO: 3588125 - DNA, 16 bp, Homo sapiens
ccaactccaggggcac

SEQ ID NO: 3588126 - DNA, 21 bp, Homo sapiens
ccaactctaaagccaagcact

SEQ ID NO: 3588127 - DNA, 20 bp, Homo sapiens
ccaactgcaaaaaaagcctc

SEQ ID NO: 3588128 - DNA, 21 bp, Homo sapiens
ccaactgcaaaaaaagcctcc

SEQ ID NO: 3588129 - DNA, 21 bp, Homo sapiens
ccaactgccctaagcccccag

SEQ ID NO: 3588130 - DNA, 20 bp, Homo sapiens
ccaactgggcatttcaatcc

SEQ ID NO: 3588131 - DNA, 18 bp, Homo sapiens
ccaactgtttccctgctg

SEQ ID NO: 3588132 - DNA, 16 bp, Homo sapiens
ccaacttcttcctgtg

SEQ ID NO: 3588133 - DNA, 17 bp, Homo sapiens
ccaagagatctgtgtgg

SEQ ID NO: 3588134 - DNA, 19 bp, Homo sapiens
ccaagagatctgtgtggct

SEQ ID NO: 3588135 - DNA, 22 bp, Homo sapiens
ccaagagatctgtgtggctcct

SEQ ID NO: 3588136 - DNA, 22 bp, Homo sapiens
ccaagcataccaacacgagcag

SEQ ID NO: 3588137 - DNA, 18 bp, Homo sapiens
ccaagcatataaaatttt

SEQ ID NO: 3588138 - DNA, 13 bp, Homo sapiens
ccaagcatttcat

SEQ ID NO: 3588139 - DNA, 16 bp, Homo sapiens
ccaagccagattctct

SEQ ID NO: 3588140 - DNA, 13 bp, Homo sapiens
ccaagccgtggct

SEQ ID NO: 3588141 - DNA, 23 bp, Homo sapiens
ccaagccgtggcttcccgctcag

SEQ ID NO: 3588142 - DNA, 13 bp, Homo sapiens
ccaagctcaccct

SEQ ID NO: 3588143 - DNA, 12 bp, Homo sapiens
ccaagcttccca

SEQ ID NO: 3588144 - DNA, 15 bp, Homo sapiens
ccaaggagctgctat

SEQ ID NO: 3588145 - DNA, 22 bp, Homo sapiens
ccaaggagtctgattgcaggaa

SEQ ID NO: 3588146 - DNA, 13 bp, Homo sapiens
ccaaggcaaacaa

SEQ ID NO: 3588147 - DNA, 15 bp, Homo sapiens
ccaaggcagcgaccc

SEQ ID NO: 3588148 - DNA, 20 bp, Homo sapiens
ccaaggcagcgaccccagga

SEQ ID NO: 3588149 - DNA, 13 bp, Homo sapiens
ccaagggccctgg

SEQ ID NO: 3588150 - DNA, 14 bp, Homo sapiens
ccaagggccctggc

SEQ ID NO: 3588151 - DNA, 19 bp, Homo sapiens
ccaaggggaatcagaactc

SEQ ID NO: 3588152 - DNA, 15 bp, Homo sapiens
ccaagggggctgctg

SEQ ID NO: 3588153 - DNA, 16 bp, Homo sapiens
ccaagggggctgctgc

SEQ ID NO: 3588154 - DNA, 21 bp, Homo sapiens
ccaaggtgaggtgaactccag

SEQ ID NO: 3588155 - DNA, 23 bp, Homo sapiens
ccaaggtgaggtgaactccaggc

SEQ ID NO: 3588156 - DNA, 15 bp, Homo sapiens
ccaaggtgccaccac

SEQ ID NO: 3588157 - DNA, 20 bp, Homo sapiens
ccaagtggacgttaggccag

SEQ ID NO: 3588158 - DNA, 16 bp, Homo sapiens
ccaagtggctcccaca

SEQ ID NO: 3588159 - DNA, 14 bp, Homo sapiens
ccaagtggtgagca

SEQ ID NO: 3588160 - DNA, 18 bp, Homo sapiens
ccaataaagcttttggaa

SEQ ID NO: 3588161 - DNA, 23 bp, Homo sapiens
ccaataaagcttttggaagccgg

SEQ ID NO: 3588162 - DNA, 18 bp, Homo sapiens
ccaatcccagctacctca

SEQ ID NO: 3588163 - DNA, 18 bp, Homo sapiens
ccaatgcttgcatggaga

SEQ ID NO: 3588164 - DNA, 22 bp, Homo sapiens
ccaatgcttgcatggagaatgg

SEQ ID NO: 3588165 - DNA, 20 bp, Homo sapiens
ccaattatatctcccccact

SEQ ID NO: 3588166 - DNA, 10 bp, Homo sapiens
ccaatttaag

SEQ ID NO: 3588167 - DNA, 16 bp, Homo sapiens
ccaatttcagactccc

SEQ ID NO: 3588168 - DNA, 12 bp, Homo sapiens
ccaattttcctt

SEQ ID NO: 3588169 - DNA, 17 bp, Homo sapiens
ccacaaaaatagagaaa

SEQ ID NO: 3588170 - DNA, 16 bp, Homo sapiens
ccacaaaacaaagcaa

SEQ ID NO: 3588171 - DNA, 14 bp, Homo sapiens
ccacaaacctgccc

SEQ ID NO: 3588172 - DNA, 21 bp, Homo sapiens
ccacaaactccaggctggaag

SEQ ID NO: 3588173 - DNA, 22 bp, Homo sapiens
ccacaaatgggaaaaccagact

SEQ ID NO: 3588174 - DNA, 18 bp, Homo sapiens
ccacaagctgtccctgca

SEQ ID NO: 3588175 - DNA, 18 bp, Homo sapiens
ccacaaggaaccctcagg

SEQ ID NO: 3588176 - DNA, 21 bp, Homo sapiens
ccacaaggacttcctgtccag

SEQ ID NO: 3588177 - DNA, 15 bp, Homo sapiens
ccacaagtggtggta

SEQ ID NO: 3588178 - DNA, 21 bp, Homo sapiens
ccacaataaagatcgccccca

SEQ ID NO: 3588179 - DNA, 20 bp, Homo sapiens
ccacacaaggatagatgctg

SEQ ID NO: 3588180 - DNA, 20 bp, Homo sapiens
ccacacagacttgggcaggg

SEQ ID NO: 3588181 - DNA, 15 bp, Homo sapiens
ccacacagctgccct

SEQ ID NO: 3588182 - DNA, 19 bp, Homo sapiens
ccacacagctgccctagct

SEQ ID NO: 3588183 - DNA, 13 bp, Homo sapiens
ccacaccacatct

SEQ ID NO: 3588184 - DNA, 16 bp, Homo sapiens
ccacacccaccccctc

SEQ ID NO: 3588185 - DNA, 12 bp, Homo sapiens
ccacacccagga

SEQ ID NO: 3588186 - DNA, 18 bp, Homo sapiens
ccacacctgaacttgcct

SEQ ID NO: 3588187 - DNA, 13 bp, Homo sapiens
ccacacctggtgg

SEQ ID NO: 3588188 - DNA, 16 bp, Homo sapiens
ccacacttcaggctct

SEQ ID NO: 3588189 - DNA, 20 bp, Homo sapiens
ccacacttcaggctcttctc

SEQ ID NO: 3588190 - DNA, 12 bp, Homo sapiens
ccacagaacttg

SEQ ID NO: 3588191 - DNA, 15 bp, Homo sapiens
ccacagaacttgtgg

SEQ ID NO: 3588192 - DNA, 16 bp, Homo sapiens
ccacagacccctggga

SEQ ID NO: 3588193 - DNA, 20 bp, Homo sapiens
ccacagactcaatgtgctct

SEQ ID NO: 3588194 - DNA, 22 bp, Homo sapiens
ccacagagaagtttgtagccag

SEQ ID NO: 3588195 - DNA, 17 bp, Homo sapiens
ccacagagaggagggga

SEQ ID NO: 3588196 - DNA, 13 bp, Homo sapiens
ccacagaggacac

SEQ ID NO: 3588197 - DNA, 14 bp, Homo sapiens
ccacagcagagcat

SEQ ID NO: 3588198 - DNA, 19 bp, Homo sapiens
ccacagcagccccaggaga

SEQ ID NO: 3588199 - DNA, 18 bp, Homo sapiens
ccacagccttgcagcggc

SEQ ID NO: 3588200 - DNA, 21 bp, Homo sapiens
ccacagccttgcagcggctcc

SEQ ID NO: 3588201 - DNA, 17 bp, Homo sapiens
ccacaggcccttcctct

SEQ ID NO: 3588202 - DNA, 22 bp, Homo sapiens
ccacaggcccttcctctccact

SEQ ID NO: 3588203 - DNA, 15 bp, Homo sapiens
ccacaggcttaggga

SEQ ID NO: 3588204 - DNA, 21 bp, Homo sapiens
ccacaggcttagggacaggac

SEQ ID NO: 3588205 - DNA, 18 bp, Homo sapiens
cctccctctccagcaggc

SEQ ID NO: 3588206 - DNA, 21 bp, Homo sapiens
cctccctgcatctgaccagca

SEQ ID NO: 3588207 - DNA, 22 bp, Homo sapiens
cctccctgcatctgaccagcag

SEQ ID NO: 3588208 - DNA, 11 bp, Homo sapiens
cctccctgcct

SEQ ID NO: 3588209 - DNA, 14 bp, Homo sapiens
cctccctgcctcca

SEQ ID NO: 3588210 - DNA, 12 bp, Homo sapiens
cctccctgcctg

SEQ ID NO: 3588211 - DNA, 13 bp, Homo sapiens
cctccctgcctgc

SEQ ID NO: 3588212 - DNA, 19 bp, Homo sapiens
cctccctgcctgctccttg

SEQ ID NO: 3588213 - DNA, 20 bp, Homo sapiens
cctccctgcctgctccttgg

SEQ ID NO: 3588214 - DNA, 12 bp, Homo sapiens
cctccctgctgt

SEQ ID NO: 3588215 - DNA, 13 bp, Homo sapiens
cctccctgtctcc

SEQ ID NO: 3588216 - DNA, 14 bp, Homo sapiens
cctccctgtctcca

SEQ ID NO: 3588217 - DNA, 19 bp, Homo sapiens
cctccctgttccccagaga

SEQ ID NO: 3588218 - DNA, 15 bp, Homo sapiens
cctcccttctgctac

SEQ ID NO: 3588219 - DNA, 16 bp, Homo sapiens
cctcccttctgctact

SEQ ID NO: 3588220 - DNA, 13 bp, Homo sapiens
cctccgcccctgc

SEQ ID NO: 3588221 - DNA, 20 bp, Homo sapiens
cctccgcgtgatcaaagcca

SEQ ID NO: 3588222 - DNA, 22 bp, Homo sapiens
cctccggagcgccctgcagggc

SEQ ID NO: 3588223 - DNA, 20 bp, Homo sapiens
cctccggcgggtgacagctc

SEQ ID NO: 3588224 - DNA, 22 bp, Homo sapiens
cctccgtagggtctttcttggg

SEQ ID NO: 3588225 - DNA, 14 bp, Homo sapiens
cctccgtcactacc

SEQ ID NO: 3588226 - DNA, 12 bp, Homo sapiens
cctccgttgtct

SEQ ID NO: 3588227 - DNA, 13 bp, Homo sapiens
cctcctaccctcc

SEQ ID NO: 3588228 - DNA, 14 bp, Homo sapiens
cctcctaccctccc

SEQ ID NO: 3588229 - DNA, 13 bp, Homo sapiens
cctcctacctcag

SEQ ID NO: 3588230 - DNA, 14 bp, Homo sapiens
cctcctacctcagc

SEQ ID NO: 3588231 - DNA, 18 bp, Homo sapiens
cctcctatctccctggct

SEQ ID NO: 3588232 - DNA, 22 bp, Homo sapiens
cctcctatctccctggctcact

SEQ ID NO: 3588233 - DNA, 14 bp, Homo sapiens
cctcctcaccccca

SEQ ID NO: 3588234 - DNA, 16 bp, Homo sapiens
cctcctcacccccagc

SEQ ID NO: 3588235 - DNA, 12 bp, Homo sapiens
cctcctccaggt

SEQ ID NO: 3588236 - DNA, 22 bp, Homo sapiens
cctcctcccactgcccactggc

SEQ ID NO: 3588237 - DNA, 13 bp, Homo sapiens
cctcctcccccag

SEQ ID NO: 3588238 - DNA, 20 bp, Homo sapiens
cctcctgagtgccccacttc

SEQ ID NO: 3588239 - DNA, 15 bp, Homo sapiens
cctcctgcacacagg

SEQ ID NO: 3588240 - DNA, 14 bp, Homo sapiens
cctcctgccccctg

SEQ ID NO: 3588241 - DNA, 18 bp, Homo sapiens
cctcctgggaacacatct

SEQ ID NO: 3588242 - DNA, 19 bp, Homo sapiens
cctcctgtacctcagtgga

SEQ ID NO: 3588243 - DNA, 22 bp, Homo sapiens
cctccttggctttatgcaaata

SEQ ID NO: 3588244 - DNA, 23 bp, Homo sapiens
cctccttggctttatgcaaatac

SEQ ID NO: 3588245 - DNA, 17 bp, Homo sapiens
cctcgacagggcctgga

SEQ ID NO: 3588246 - DNA, 19 bp, Homo sapiens
cctcgacagggcctggagc

SEQ ID NO: 3588247 - DNA, 19 bp, Homo sapiens
cctcgccggatctgaggga

SEQ ID NO: 3588248 - DNA, 14 bp, Homo sapiens
cctcggagaagagc

SEQ ID NO: 3588249 - DNA, 14 bp, Homo sapiens
cctcggagagcagc

SEQ ID NO: 3588250 - DNA, 21 bp, Homo sapiens
cctcggagagcagcagcacca

SEQ ID NO: 3588251 - DNA, 17 bp, Homo sapiens
cctcggtatctggcttc

SEQ ID NO: 3588252 - DNA, 23 bp, Homo sapiens
cctcggtatctggcttccctgga

SEQ ID NO: 3588253 - DNA, 13 bp, Homo sapiens
cctcgtcaagagc

SEQ ID NO: 3588254 - DNA, 22 bp, Homo sapiens
cctcgtcaagagcatgcacatg

SEQ ID NO: 3588255 - DNA, 19 bp, Homo sapiens
cctcgtgctccgcagggcg

SEQ ID NO: 3588256 - DNA, 21 bp, Homo sapiens
cctcgtgggtcccagagacct

SEQ ID NO: 3588257 - DNA, 17 bp, Homo sapiens
cctctaagtgctgctgt

SEQ ID NO: 3588258 - DNA, 20 bp, Homo sapiens
cctctaagtgctgctgtgga

SEQ ID NO: 3588259 - DNA, 13 bp, Homo sapiens
cctctagtgcctt

SEQ ID NO: 3588260 - DNA, 23 bp, Homo sapiens
cctctagttgagtttctggcgcc

SEQ ID NO: 3588261 - DNA, 17 bp, Homo sapiens
cctctatttattagcca

SEQ ID NO: 3588262 - DNA, 18 bp, Homo sapiens
cctctatttattagccaa

SEQ ID NO: 3588263 - DNA, 19 bp, Homo sapiens
cctctatttattagccaac

SEQ ID NO: 3588264 - DNA, 21 bp, Homo sapiens
cctctatttattagccaactg

SEQ ID NO: 3588265 - DNA, 22 bp, Homo sapiens
cctctcagaggcctgctgccag

SEQ ID NO: 3588266 - DNA, 19 bp, Homo sapiens
cctctcaggctgggccccg

SEQ ID NO: 3588267 - DNA, 18 bp, Homo sapiens
cctctcattccagaggaa

SEQ ID NO: 3588268 - DNA, 12 bp, Homo sapiens
cctctccactgc

SEQ ID NO: 3588269 - DNA, 14 bp, Homo sapiens
cctctccactgcct

SEQ ID NO: 3588270 - DNA, 12 bp, Homo sapiens
cctctccaggcc

SEQ ID NO: 3588271 - DNA, 11 bp, Homo sapiens
cctctcccagg

SEQ ID NO: 3588272 - DNA, 20 bp, Homo sapiens
cctctccccagcccagagac

SEQ ID NO: 3588273 - DNA, 21 bp, Homo sapiens
cctctccccagcccagagaca

SEQ ID NO: 3588274 - DNA, 16 bp, Homo sapiens
cctctccctgggtctg

SEQ ID NO: 3588275 - DNA, 23 bp, Homo sapiens
cctctccgactctgcacccgcct

SEQ ID NO: 3588276 - DNA, 14 bp, Homo sapiens
cctctccgtttatt

SEQ ID NO: 3588277 - DNA, 14 bp, Homo sapiens
cctctcctgccctg

SEQ ID NO: 3588278 - DNA, 15 bp, Homo sapiens
cctctcctgccctgt

SEQ ID NO: 3588279 - DNA, 18 bp, Homo sapiens
cctctcctgccctgtgat

SEQ ID NO: 3588280 - DNA, 13 bp, Homo sapiens
cctctccttcctg

SEQ ID NO: 3588281 - DNA, 17 bp, Homo sapiens
cctctccttttgaggct

SEQ ID NO: 3588282 - DNA, 15 bp, Homo sapiens
cctctcgccccatcc

SEQ ID NO: 3588283 - DNA, 20 bp, Homo sapiens
cctctcgccccatccctgct

SEQ ID NO: 3588284 - DNA, 16 bp, Homo sapiens
cctctcggctgccagg

SEQ ID NO: 3588285 - DNA, 15 bp, Homo sapiens
cctctctccttggcc

SEQ ID NO: 3588286 - DNA, 22 bp, Homo sapiens
cctctctgagtcaaatccagtg

SEQ ID NO: 3588287 - DNA, 13 bp, Homo sapiens
cctctcttcccct

SEQ ID NO: 3588288 - DNA, 17 bp, Homo sapiens
cctctcttccccttccc

SEQ ID NO: 3588289 - DNA, 20 bp, Homo sapiens
cctctcttccccttccctta

SEQ ID NO: 3588290 - DNA, 21 bp, Homo sapiens
cctctcttccccttcccttat

SEQ ID NO: 3588291 - DNA, 15 bp, Homo sapiens
cctctgacagtccac

SEQ ID NO: 3588292 - DNA, 18 bp, Homo sapiens
cctctgacagtccacagg

SEQ ID NO: 3588293 - DNA, 19 bp, Homo sapiens
cctctgacagtccacaggg

SEQ ID NO: 3588294 - DNA, 22 bp, Homo sapiens
cctctgcacgctcaatgcccag

SEQ ID NO: 3588295 - DNA, 18 bp, Homo sapiens
cctctgcagtctcatttc

SEQ ID NO: 3588296 - DNA, 21 bp, Homo sapiens
cctctgcagtctcatttctca

SEQ ID NO: 3588297 - DNA, 20 bp, Homo sapiens
cctctgccaaaggatgtgat

SEQ ID NO: 3588298 - DNA, 12 bp, Homo sapiens
cctctgccctgg

SEQ ID NO: 3588299 - DNA, 15 bp, Homo sapiens
cctctgccctggatt

SEQ ID NO: 3588300 - DNA, 19 bp, Homo sapiens
cctctgcctgtctccccca

SEQ ID NO: 3588301 - DNA, 20 bp, Homo sapiens
cctctgctgccggctctggg

SEQ ID NO: 3588302 - DNA, 11 bp, Homo sapiens
cctctgctggg

SEQ ID NO: 3588303 - DNA, 13 bp, Homo sapiens
cctctggactgga

SEQ ID NO: 3588304 - DNA, 17 bp, Homo sapiens
cctctggactggaaagc

SEQ ID NO: 3588305 - DNA, 14 bp, Homo sapiens
cctctggagtggcc

SEQ ID NO: 3588306 - DNA, 15 bp, Homo sapiens
cctctggagtggcca

SEQ ID NO: 3588307 - DNA, 16 bp, Homo sapiens
cctctggagtggccac

SEQ ID NO: 3588308 - DNA, 20 bp, Homo sapiens
cctctggctccccaaggctg

SEQ ID NO: 3588309 - DNA, 23 bp, Homo sapiens
cctctggcttccctaaactgcag

SEQ ID NO: 3588310 - DNA, 16 bp, Homo sapiens
cctctgggacccacag

SEQ ID NO: 3588311 - DNA, 20 bp, Homo sapiens
cctctgggacccacagaact

SEQ ID NO: 3588312 - DNA, 20 bp, Homo sapiens
cctctgggggtcctctctga

SEQ ID NO: 3588313 - DNA, 19 bp, Homo sapiens
cctctgggtccttggctcc

SEQ ID NO: 3588314 - DNA, 23 bp, Homo sapiens
cctctggtgtgtggtgaggggct

SEQ ID NO: 3588315 - DNA, 17 bp, Homo sapiens
cctctgtccaggcactg

SEQ ID NO: 3588316 - DNA, 18 bp, Homo sapiens
cctctgtccgtgcccctt

SEQ ID NO: 3588317 - DNA, 18 bp, Homo sapiens
cctctgtctgagacaggt

SEQ ID NO: 3588318 - DNA, 20 bp, Homo sapiens
cctctgttcctttctctggg

SEQ ID NO: 3588319 - DNA, 22 bp, Homo sapiens
cctctgttcctttctctgggct

SEQ ID NO: 3588320 - DNA, 16 bp, Homo sapiens
cctcttactaatgtaa

SEQ ID NO: 3588321 - DNA, 18 bp, Homo sapiens
cctcttcatggatggggg

SEQ ID NO: 3588322 - DNA, 18 bp, Homo sapiens
cctcttccgtgacgtcac

SEQ ID NO: 3588323 - DNA, 17 bp, Homo sapiens
cctcttctattttgtaa

SEQ ID NO: 3588324 - DNA, 18 bp, Homo sapiens
cctcttctattttgtaaa

SEQ ID NO: 3588325 - DNA, 19 bp, Homo sapiens
cctcttctgctcttttcct

SEQ ID NO: 3588326 - DNA, 20 bp, Homo sapiens
cctcttctgctcttttcctg

SEQ ID NO: 3588327 - DNA, 18 bp, Homo sapiens
cctcttctttgtgccttt

SEQ ID NO: 3588328 - DNA, 20 bp, Homo sapiens
cctcttctttgtgcctttgg

SEQ ID NO: 3588329 - DNA, 22 bp, Homo sapiens
cctcttctttgtgcctttggcc

SEQ ID NO: 3588330 - DNA, 18 bp, Homo sapiens
cctcttgagttcctctgc

SEQ ID NO: 3588331 - DNA, 22 bp, Homo sapiens
cctcttgagttcctctgcagtt

SEQ ID NO: 3588332 - DNA, 22 bp, Homo sapiens
cctcttgccactgcctcttcct

SEQ ID NO: 3588333 - DNA, 23 bp, Homo sapiens
cctcttgccactgcctcttcctc

SEQ ID NO: 3588334 - DNA, 19 bp, Homo sapiens
cctcttgtccctttcccta

SEQ ID NO: 3588335 - DNA, 15 bp, Homo sapiens
cctctttcatctgta

SEQ ID NO: 3588336 - DNA, 14 bp, Homo sapiens
cctgaaagagagga

SEQ ID NO: 3588337 - DNA, 16 bp, Homo sapiens
cctgaaatatccagga

SEQ ID NO: 3588338 - DNA, 14 bp, Homo sapiens
cctgaaatttcaga

SEQ ID NO: 3588339 - DNA, 13 bp, Homo sapiens
cctgaacaagaat

SEQ ID NO: 3588340 - DNA, 14 bp, Homo sapiens
cctgaactgaggag

SEQ ID NO: 3588341 - DNA, 18 bp, Homo sapiens
ccctgacctccgcccctg

SEQ ID NO: 3588342 - DNA, 22 bp, Homo sapiens
ccctgagcagggtccacagctg

SEQ ID NO: 3588343 - DNA, 20 bp, Homo sapiens
ccctgatcccaccccctcct

SEQ ID NO: 3588344 - DNA, 19 bp, Homo sapiens
ccctgcaaaactccaggca

SEQ ID NO: 3588345 - DNA, 18 bp, Homo sapiens
ccctgcaagaccacggag

SEQ ID NO: 3588346 - DNA, 23 bp, Homo sapiens
ccctgcacaaagcccttccatgt

SEQ ID NO: 3588347 - DNA, 14 bp, Homo sapiens
ccctgcagaaccca

SEQ ID NO: 3588348 - DNA, 14 bp, Homo sapiens
ccactaccagccag

SEQ ID NO: 3588349 - DNA, 18 bp, Homo sapiens
ccactaccagccagcctc

SEQ ID NO: 3588350 - DNA, 20 bp, Homo sapiens
ccactaccagccagcctcag

SEQ ID NO: 3588351 - DNA, 19 bp, Homo sapiens
ccactactctcttcctcca

SEQ ID NO: 3588352 - DNA, 20 bp, Homo sapiens
ccactatctccgttccatct

SEQ ID NO: 3588353 - DNA, 19 bp, Homo sapiens
ccactcaggggaccccact

SEQ ID NO: 3588354 - DNA, 14 bp, Homo sapiens
ccactcagtgcctc

SEQ ID NO: 3588355 - DNA, 18 bp, Homo sapiens
ccactcatgactgcatga

SEQ ID NO: 3588356 - DNA, 21 bp, Homo sapiens
ccactccagacccctggcttt

SEQ ID NO: 3588357 - DNA, 20 bp, Homo sapiens
ccactccagctccttcgctt

SEQ ID NO: 3588358 - DNA, 22 bp, Homo sapiens
ccactcccagcatcgcactctg

SEQ ID NO: 3588359 - DNA, 16 bp, Homo sapiens
ccactccccaacccct

SEQ ID NO: 3588360 - DNA, 13 bp, Homo sapiens
ccactccccagcc

SEQ ID NO: 3588361 - DNA, 20 bp, Homo sapiens
ccactcccccgtttctcctt

SEQ ID NO: 3588362 - DNA, 14 bp, Homo sapiens
ccactcccctcaca

SEQ ID NO: 3588363 - DNA, 19 bp, Homo sapiens
ccactccttcatgtttgga

SEQ ID NO: 3588364 - DNA, 17 bp, Homo sapiens
ccactcttgatctctct

SEQ ID NO: 3588365 - DNA, 15 bp, Homo sapiens
ccactgcccactggc

SEQ ID NO: 3588366 - DNA, 16 bp, Homo sapiens
ccactgcccactggcc

SEQ ID NO: 3588367 - DNA, 17 bp, Homo sapiens
ccactgcccactggccg

SEQ ID NO: 3588368 - DNA, 21 bp, Homo sapiens
ccactgctcgtggactgtgct

SEQ ID NO: 3588369 - DNA, 13 bp, Homo sapiens
ccactgctgagct

SEQ ID NO: 3588370 - DNA, 14 bp, Homo sapiens
ccactgctgagctg

SEQ ID NO: 3588371 - DNA, 17 bp, Homo sapiens
ccactgggacagctggc

SEQ ID NO: 3588372 - DNA, 17 bp, Homo sapiens
ccactggggactttatt

SEQ ID NO: 3588373 - DNA, 18 bp, Homo sapiens
ccactggggactttattt

SEQ ID NO: 3588374 - DNA, 17 bp, Homo sapiens
ccactgggtgagagagg

SEQ ID NO: 3588375 - DNA, 22 bp, Homo sapiens
ccactgtaatacgtagctctct

SEQ ID NO: 3588376 - DNA, 20 bp, Homo sapiens
ccacttacatatatttttaa

SEQ ID NO: 3588377 - DNA, 21 bp, Homo sapiens
ccacttagaaattgcatttcc

SEQ ID NO: 3588378 - DNA, 20 bp, Homo sapiens
ccacttcaatgcacatggtg

SEQ ID NO: 3588379 - DNA, 12 bp, Homo sapiens
ccacttctggcc

SEQ ID NO: 3588380 - DNA, 18 bp, Homo sapiens
ccacttgagtgtcaagct

SEQ ID NO: 3588381 - DNA, 15 bp, Homo sapiens
ccacttttttttccc

SEQ ID NO: 3588382 - DNA, 23 bp, Homo sapiens
ccagaaagcctcctgccccctgc

SEQ ID NO: 3588383 - DNA, 18 bp, Homo sapiens
ccagaacgtggctctgct

SEQ ID NO: 3588384 - DNA, 21 bp, Homo sapiens
ccagaacgtggtttgcctgag

SEQ ID NO: 3588385 - DNA, 19 bp, Homo sapiens
ccagaactattctgggggc

SEQ ID NO: 3588386 - DNA, 15 bp, Homo sapiens
ccagaactttttcct

SEQ ID NO: 3588387 - DNA, 22 bp, Homo sapiens
ccagaagatagcttcaccccaa

SEQ ID NO: 3588388 - DNA, 18 bp, Homo sapiens
ccagaagatgccagcttc

SEQ ID NO: 3588389 - DNA, 16 bp, Homo sapiens
ccagaataaacccagc

SEQ ID NO: 3588390 - DNA, 23 bp, Homo sapiens
ccagaatggtctttctaatgtgt

SEQ ID NO: 3588391 - DNA, 15 bp, Homo sapiens
ccagacacaggccct

SEQ ID NO: 3588392 - DNA, 16 bp, Homo sapiens
ccagacacccaggact

SEQ ID NO: 3588393 - DNA, 13 bp, Homo sapiens
ccagacaggccct

SEQ ID NO: 3588394 - DNA, 15 bp, Homo sapiens
ccagacaggccctcc

SEQ ID NO: 3588395 - DNA, 20 bp, Homo sapiens
ccagacatgccacaaggact

SEQ ID NO: 3588396 - DNA, 18 bp, Homo sapiens
ccagactagatgtagtat

SEQ ID NO: 3588397 - DNA, 15 bp, Homo sapiens
ccagactcagcagag

SEQ ID NO: 3588398 - DNA, 19 bp, Homo sapiens
ccagacttctctttcttat

SEQ ID NO: 3588399 - DNA, 11 bp, Homo sapiens
cccctggcttt

SEQ ID NO: 3588400 - DNA, 21 bp, Homo sapiens
cccctggctttgcctcttctt

SEQ ID NO: 3588401 - DNA, 22 bp, Homo sapiens
cccctggctttgcctcttcttt

SEQ ID NO: 3588402 - DNA, 22 bp, Homo sapiens
cccctggcttttcactgctggc

SEQ ID NO: 3588403 - DNA, 21 bp, Homo sapiens
cccctgggctggggcctcaga

SEQ ID NO: 3588404 - DNA, 20 bp, Homo sapiens
cccctggggacgccaaggag

SEQ ID NO: 3588405 - DNA, 19 bp, Homo sapiens
cccctgggggctctcatgt

SEQ ID NO: 3588406 - DNA, 15 bp, Homo sapiens
cccctgtaggcctca

SEQ ID NO: 3588407 - DNA, 15 bp, Homo sapiens
cccctgtctggaaga

SEQ ID NO: 3588408 - DNA, 12 bp, Homo sapiens
cccctgtggcca

SEQ ID NO: 3588409 - DNA, 14 bp, Homo sapiens
cccctgtggccaac

SEQ ID NO: 3588410 - DNA, 20 bp, Homo sapiens
cccctgtggccaactgcaaa

SEQ ID NO: 3588411 - DNA, 16 bp, Homo sapiens
ccccttcaggagcctg

SEQ ID NO: 3588412 - DNA, 10 bp, Homo sapiens
ccccttccca

SEQ ID NO: 3588413 - DNA, 13 bp, Homo sapiens
ccccttcccattt

SEQ ID NO: 3588414 - DNA, 10 bp, Homo sapiens
ccccttccct

SEQ ID NO: 3588415 - DNA, 12 bp, Homo sapiens
ccccttccctgg

SEQ ID NO: 3588416 - DNA, 13 bp, Homo sapiens
ccccttccctggg

SEQ ID NO: 3588417 - DNA, 10 bp, Homo sapiens
ccccttcctg

SEQ ID NO: 3588418 - DNA, 11 bp, Homo sapiens
ccccttcctgt

SEQ ID NO: 3588419 - DNA, 15 bp, Homo sapiens
ccccttcctgtttca

SEQ ID NO: 3588420 - DNA, 18 bp, Homo sapiens
ccccttgattcccaccgt

SEQ ID NO: 3588421 - DNA, 13 bp, Homo sapiens
ccccttgccccac

SEQ ID NO: 3588422 - DNA, 22 bp, Homo sapiens
ccccttggaggagagagacccc

SEQ ID NO: 3588423 - DNA, 18 bp, Homo sapiens
cccgaagacactccttcc

SEQ ID NO: 3588424 - DNA, 13 bp, Homo sapiens
cccgacaggtggg

SEQ ID NO: 3588425 - DNA, 15 bp, Homo sapiens
cccgaccgggccagg

SEQ ID NO: 3588426 - DNA, 22 bp, Homo sapiens
cccgaggacgctccctgctcca

SEQ ID NO: 3588427 - DNA, 15 bp, Homo sapiens
cccgagtctccggga

SEQ ID NO: 3588428 - DNA, 13 bp, Homo sapiens
cccgatggggcat

SEQ ID NO: 3588429 - DNA, 19 bp, Homo sapiens
cccgcagacggtctgtgtg

SEQ ID NO: 3588430 - DNA, 22 bp, Homo sapiens
cccgcagtgtgcactaaggggc

SEQ ID NO: 3588431 - DNA, 13 bp, Homo sapiens
cccgccagggctg

SEQ ID NO: 3588432 - DNA, 13 bp, Homo sapiens
cccgccccagagc

SEQ ID NO: 3588433 - DNA, 15 bp, Homo sapiens
cccgccccagagctc

SEQ ID NO: 3588434 - DNA, 20 bp, Homo sapiens
cccgcccccacgtcgtgggg

SEQ ID NO: 3588435 - DNA, 14 bp, Homo sapiens
cccgcccctgtggc

SEQ ID NO: 3588436 - DNA, 20 bp, Homo sapiens
cccgcccctgtggccctggc

SEQ ID NO: 3588437 - DNA, 13 bp, Homo sapiens
cccgcctccctct

SEQ ID NO: 3588438 - DNA, 16 bp, Homo sapiens
cccgcgcagctgccta

SEQ ID NO: 3588439 - DNA, 15 bp, Homo sapiens
cccgcgccaggccct

SEQ ID NO: 3588440 - DNA, 21 bp, Homo sapiens
cccgctcaggggcctggaggt

SEQ ID NO: 3588441 - DNA, 12 bp, Homo sapiens
cccgctcccaca

SEQ ID NO: 3588442 - DNA, 14 bp, Homo sapiens
cccgctcccaggtt

SEQ ID NO: 3588443 - DNA, 16 bp, Homo sapiens
cccggaagggctttgg

SEQ ID NO: 3588444 - DNA, 14 bp, Homo sapiens
cccggagcaagcag

SEQ ID NO: 3588445 - DNA, 11 bp, Homo sapiens
cccggccagcc

SEQ ID NO: 3588446 - DNA, 19 bp, Homo sapiens
cccgggagctgctgccctg

SEQ ID NO: 3588447 - DNA, 19 bp, Homo sapiens
cccgggcgggcgtgggagg

SEQ ID NO: 3588448 - DNA, 13 bp, Homo sapiens
cccgggctggaga

SEQ ID NO: 3588449 - DNA, 14 bp, Homo sapiens
cccgggctggagaa

SEQ ID NO: 3588450 - DNA, 13 bp, Homo sapiens
cccggggagtttc

SEQ ID NO: 3588451 - DNA, 21 bp, Homo sapiens
cccggggccagcttggcaggg

SEQ ID NO: 3588452 - DNA, 22 bp, Homo sapiens
cccggggccagcttggcaggga

SEQ ID NO: 3588453 - DNA, 18 bp, Homo sapiens
cccgggggagcccagtga

SEQ ID NO: 3588454 - DNA, 23 bp, Homo sapiens
cccgtcggactgcccccagaaag

SEQ ID NO: 3588455 - DNA, 14 bp, Homo sapiens
cccgtctctgccct

SEQ ID NO: 3588456 - DNA, 17 bp, Homo sapiens
cccgtctggcccaccag

SEQ ID NO: 3588457 - DNA, 21 bp, Homo sapiens
cccgtggtggcggtggctgcc

SEQ ID NO: 3588458 - DNA, 22 bp, Homo sapiens
ccctaaaatggcgaacatgtgt

SEQ ID NO: 3588459 - DNA, 21 bp, Homo sapiens
ccctaaagccaggctcaggag

SEQ ID NO: 3588460 - DNA, 15 bp, Homo sapiens
ccctaaccaagttcc

SEQ ID NO: 3588461 - DNA, 19 bp, Homo sapiens
ccctaatttatcttcatgt

SEQ ID NO: 3588462 - DNA, 13 bp, Homo sapiens
ccctacagacagc

SEQ ID NO: 3588463 - DNA, 15 bp, Homo sapiens
ccctacagtatataa

SEQ ID NO: 3588464 - DNA, 15 bp, Homo sapiens
ccctaccctggcagg

SEQ ID NO: 3588465 - DNA, 11 bp, Homo sapiens
ccctactgtgg

SEQ ID NO: 3588466 - DNA, 19 bp, Homo sapiens
ccctacttcttttgctctt

SEQ ID NO: 3588467 - DNA, 12 bp, Homo sapiens
ccctagccctgc

SEQ ID NO: 3588468 - DNA, 14 bp, Homo sapiens
ccctagccctggtt

SEQ ID NO: 3588469 - DNA, 14 bp, Homo sapiens
ccctaggtgcccag

SEQ ID NO: 3588470 - DNA, 15 bp, Homo sapiens
ccctatgctggtaga

SEQ ID NO: 3588471 - DNA, 18 bp, Homo sapiens
ccctcaaactgcacatct

SEQ ID NO: 3588472 - DNA, 23 bp, Homo sapiens
ccctcaccttggcaccagacacc

SEQ ID NO: 3588473 - DNA, 12 bp, Homo sapiens
ccctcactcccc

SEQ ID NO: 3588474 - DNA, 19 bp, Homo sapiens
ccctcagccccaccccagg

SEQ ID NO: 3588475 - DNA, 12 bp, Homo sapiens
ccctcaggccac

SEQ ID NO: 3588476 - DNA, 19 bp, Homo sapiens
ccctcagtcttcctgccgg

SEQ ID NO: 3588477 - DNA, 14 bp, Homo sapiens
ccctcattctcatt

SEQ ID NO: 3588478 - DNA, 16 bp, Homo sapiens
ccctccaaacctccag

SEQ ID NO: 3588479 - DNA, 19 bp, Homo sapiens
ccctccaaacctccagcct

SEQ ID NO: 3588480 - DNA, 15 bp, Homo sapiens
ccctccaccccacag

SEQ ID NO: 3588481 - DNA, 16 bp, Homo sapiens
ccctccaccccacaga

SEQ ID NO: 3588482 - DNA, 16 bp, Homo sapiens
ccctccactccactgc

SEQ ID NO: 3588483 - DNA, 12 bp, Homo sapiens
ccctccaggaga

SEQ ID NO: 3588484 - DNA, 21 bp, Homo sapiens
ccctcccaccagaacgcaccc

SEQ ID NO: 3588485 - DNA, 14 bp, Homo sapiens
ccctcccagacagg

SEQ ID NO: 3588486 - DNA, 19 bp, Homo sapiens
ccctcccagacaggccctc

SEQ ID NO: 3588487 - DNA, 17 bp, Homo sapiens
ccctccccagccagccc

SEQ ID NO: 3588488 - DNA, 18 bp, Homo sapiens
ccctccccagccagccct

SEQ ID NO: 3588489 - DNA, 15 bp, Homo sapiens
ccctcccccccatgc

SEQ ID NO: 3588490 - DNA, 18 bp, Homo sapiens
ccctcccccccatgcact

SEQ ID NO: 3588491 - DNA, 20 bp, Homo sapiens
ccctcccccccatgcactgt

SEQ ID NO: 3588492 - DNA, 19 bp, Homo sapiens
ccctcccccctcggccgcc

SEQ ID NO: 3588493 - DNA, 18 bp, Homo sapiens
ccctcccctggggacgcc

SEQ ID NO: 3588494 - DNA, 15 bp, Homo sapiens
ccctccctaccctaa

SEQ ID NO: 3588495 - DNA, 16 bp, Homo sapiens
ccctccctaccctaac

SEQ ID NO: 3588496 - DNA, 14 bp, Homo sapiens
ccctccctgcccct

SEQ ID NO: 3588497 - DNA, 14 bp, Homo sapiens
ccctccctgcctgc

SEQ ID NO: 3588498 - DNA, 18 bp, Homo sapiens
ccctccctgcctgctcct

SEQ ID NO: 3588499 - DNA, 16 bp, Homo sapiens
ccctccctgtctccag

SEQ ID NO: 3588500 - DNA, 13 bp, Homo sapiens
ccctcctccaggt

SEQ ID NO: 3588501 - DNA, 13 bp, Homo sapiens
ccctcctgagggc

SEQ ID NO: 3588502 - DNA, 21 bp, Homo sapiens
ccctcctgagtgccccacttc

SEQ ID NO: 3588503 - DNA, 20 bp, Homo sapiens
ccctcctgcacacagggcag

SEQ ID NO: 3588504 - DNA, 16 bp, Homo sapiens
ccctctccaggcctgt

SEQ ID NO: 3588505 - DNA, 18 bp, Homo sapiens
ccctctccaggcctgtca

SEQ ID NO: 3588506 - DNA, 15 bp, Homo sapiens
ccctctcgccccatc

SEQ ID NO: 3588507 - DNA, 21 bp, Homo sapiens
ccctctcgccccatccctgct

SEQ ID NO: 3588508 - DNA, 18 bp, Homo sapiens
ccctctctcataccctcc

SEQ ID NO: 3588509 - DNA, 13 bp, Homo sapiens
ccctctgccccat

SEQ ID NO: 3588510 - DNA, 20 bp, Homo sapiens
ccctctgccggtcgggcagc

SEQ ID NO: 3588511 - DNA, 12 bp, Homo sapiens
ccctctgctgcc

SEQ ID NO: 3588512 - DNA, 20 bp, Homo sapiens
ccctctggagaaggcctgga

SEQ ID NO: 3588513 - DNA, 22 bp, Homo sapiens
ccctctggagaaggcctggaag

SEQ ID NO: 3588514 - DNA, 18 bp, Homo sapiens
ccctctggagtggccact

SEQ ID NO: 3588515 - DNA, 21 bp, Homo sapiens
ccctctggagtggccactaag

SEQ ID NO: 3588516 - DNA, 18 bp, Homo sapiens
ccctctttccctgcgaga

SEQ ID NO: 3588517 - DNA, 19 bp, Homo sapiens
ccctctttcgtctactgca

SEQ ID NO: 3588518 - DNA, 17 bp, Homo sapiens
ccctgaaggggccatga

SEQ ID NO: 3588519 - DNA, 19 bp, Homo sapiens
ccctgaatccgtacttggg

SEQ ID NO: 3588520 - DNA, 22 bp, Homo sapiens
ccctgaatttcttcttttcctg

SEQ ID NO: 3588521 - DNA, 16 bp, Homo sapiens
ccctgacctaccccag

SEQ ID NO: 3588522 - DNA, 19 bp, Homo sapiens
cctgcttcttctctccaca

SEQ ID NO: 3588523 - DNA, 21 bp, Homo sapiens
cctgcttgactttccagaatg

SEQ ID NO: 3588524 - DNA, 17 bp, Homo sapiens
cctgcttgcccgctccc

SEQ ID NO: 3588525 - DNA, 20 bp, Homo sapiens
cctgcttgcccgctcccaca

SEQ ID NO: 3588526 - DNA, 21 bp, Homo sapiens
cctgcttgcccgctcccacag

SEQ ID NO: 3588527 - DNA, 14 bp, Homo sapiens
cctgctttgcatct

SEQ ID NO: 3588528 - DNA, 18 bp, Homo sapiens
cctgctttgcatctttgt

SEQ ID NO: 3588529 - DNA, 18 bp, Homo sapiens
cctgctttgggctgccct

SEQ ID NO: 3588530 - DNA, 19 bp, Homo sapiens
cctgctttgggctgccctg

SEQ ID NO: 3588531 - DNA, 20 bp, Homo sapiens
cctgctttgggctgccctgg

SEQ ID NO: 3588532 - DNA, 13 bp, Homo sapiens
cctgcttttcaat

SEQ ID NO: 3588533 - DNA, 16 bp, Homo sapiens
cctgcttttctgtcct

SEQ ID NO: 3588534 - DNA, 17 bp, Homo sapiens
cctgcttttctgtcctg

SEQ ID NO: 3588535 - DNA, 18 bp, Homo sapiens
cctgcttttctgtcctgg

SEQ ID NO: 3588536 - DNA, 20 bp, Homo sapiens
cctgcttttctgtcctgggc

SEQ ID NO: 3588537 - DNA, 17 bp, Homo sapiens
cctggaactcctggcct

SEQ ID NO: 3588538 - DNA, 19 bp, Homo sapiens
cctggaagagctgagacct

SEQ ID NO: 3588539 - DNA, 23 bp, Homo sapiens
cctggaagctctccgagctctgg

SEQ ID NO: 3588540 - DNA, 15 bp, Homo sapiens
cctggacacagctct

SEQ ID NO: 3588541 - DNA, 17 bp, Homo sapiens
cctggacacagctcttc

SEQ ID NO: 3588542 - DNA, 19 bp, Homo sapiens
cctggacacagctcttcat

SEQ ID NO: 3588543 - DNA, 19 bp, Homo sapiens
cctggaccttttgttttct

SEQ ID NO: 3588544 - DNA, 22 bp, Homo sapiens
cctggactagagggacctctcc

SEQ ID NO: 3588545 - DNA, 24 bp, Homo sapiens
cctggacttaagcatctggctcta

SEQ ID NO: 3588546 - DNA, 13 bp, Homo sapiens
cctggagaactag

SEQ ID NO: 3588547 - DNA, 16 bp, Homo sapiens
cctggagacaaggtgc

SEQ ID NO: 3588548 - DNA, 17 bp, Homo sapiens
cctggagacaaggtgct

SEQ ID NO: 3588549 - DNA, 18 bp, Homo sapiens
cctggagacaaggtgcta

SEQ ID NO: 3588550 - DNA, 20 bp, Homo sapiens
cctggagacaaggtgctaac

SEQ ID NO: 3588551 - DNA, 14 bp, Homo sapiens
cctggagagcccca

SEQ ID NO: 3588552 - DNA, 12 bp, Homo sapiens
cctggagcagag

SEQ ID NO: 3588553 - DNA, 17 bp, Homo sapiens
cctggagcagaggaggg

SEQ ID NO: 3588554 - DNA, 14 bp, Homo sapiens
cctggagcaggccc

SEQ ID NO: 3588555 - DNA, 15 bp, Homo sapiens
cctggagcaggccca

SEQ ID NO: 3588556 - DNA, 20 bp, Homo sapiens
cctggagcaggcccaatgct

SEQ ID NO: 3588557 - DNA, 22 bp, Homo sapiens
cctggagccccatcggccaaga

SEQ ID NO: 3588558 - DNA, 17 bp, Homo sapiens
cctggagcttcagccag

SEQ ID NO: 3588559 - DNA, 16 bp, Homo sapiens
cctggaggcaaaggcc

SEQ ID NO: 3588560 - DNA, 23 bp, Homo sapiens
cctggaggcaaaggcctggacag

SEQ ID NO: 3588561 - DNA, 14 bp, Homo sapiens
cctggaggcagggg

SEQ ID NO: 3588562 - DNA, 13 bp, Homo sapiens
cctggaggctcct

SEQ ID NO: 3588563 - DNA, 19 bp, Homo sapiens
cctggaggctcctctaggc

SEQ ID NO: 3588564 - DNA, 23 bp, Homo sapiens
cctggaggctcctctaggccctg

SEQ ID NO: 3588565 - DNA, 14 bp, Homo sapiens
cctggaggtggctg

SEQ ID NO: 3588566 - DNA, 22 bp, Homo sapiens
cctggaggtggctgagcccctg

SEQ ID NO: 3588567 - DNA, 13 bp, Homo sapiens
cctggagtcaggt

SEQ ID NO: 3588568 - DNA, 14 bp, Homo sapiens
cctggataattata

SEQ ID NO: 3588569 - DNA, 15 bp, Homo sapiens
cctggattaccaggg

SEQ ID NO: 3588570 - DNA, 20 bp, Homo sapiens
cctggattgcgcctaatgtg

SEQ ID NO: 3588571 - DNA, 16 bp, Homo sapiens
cctggcacagggcagt

SEQ ID NO: 3588572 - DNA, 18 bp, Homo sapiens
cctggcagccgtgccttc

SEQ ID NO: 3588573 - DNA, 17 bp, Homo sapiens
cctggcagctctggaca

SEQ ID NO: 3588574 - DNA, 19 bp, Homo sapiens
cctggcagctctggacagc

SEQ ID NO: 3588575 - DNA, 21 bp, Homo sapiens
cctggcagggccacctgcagg

SEQ ID NO: 3588576 - DNA, 12 bp, Homo sapiens
cctggccagaca

SEQ ID NO: 3588577 - DNA, 13 bp, Homo sapiens
cctggccagacac

SEQ ID NO: 3588578 - DNA, 15 bp, Homo sapiens
cctggccagacacag

SEQ ID NO: 3588579 - DNA, 16 bp, Homo sapiens
cctggccaggcaggga

SEQ ID NO: 3588580 - DNA, 14 bp, Homo sapiens
cctggccatcccac

SEQ ID NO: 3588581 - DNA, 20 bp, Homo sapiens
cctggccctgggggtctggg

SEQ ID NO: 3588582 - DNA, 14 bp, Homo sapiens
cctggcctagaaag

SEQ ID NO: 3588583 - DNA, 17 bp, Homo sapiens
cctggcctggctgggtg

SEQ ID NO: 3588584 - DNA, 14 bp, Homo sapiens
cctggccttttgtg

SEQ ID NO: 3588585 - DNA, 17 bp, Homo sapiens
cctggctcactggcagg

SEQ ID NO: 3588586 - DNA, 12 bp, Homo sapiens
cctggctccact

SEQ ID NO: 3588587 - DNA, 17 bp, Homo sapiens
cctggctcccacaggcc

SEQ ID NO: 3588588 - DNA, 23 bp, Homo sapiens
cctggctcccacaggcccttcct

SEQ ID NO: 3588589 - DNA, 15 bp, Homo sapiens
cctggctctgccccc

SEQ ID NO: 3588590 - DNA, 21 bp, Homo sapiens
cctggctgggactgggaacag

SEQ ID NO: 3588591 - DNA, 19 bp, Homo sapiens
cctggctggtgggaaggcc

SEQ ID NO: 3588592 - DNA, 22 bp, Homo sapiens
cctggcttttcactgctggctg

SEQ ID NO: 3588593 - DNA, 23 bp, Homo sapiens
cctggcttttcactgctggctgc

SEQ ID NO: 3588594 - DNA, 14 bp, Homo sapiens
cctgggaacacagt

SEQ ID NO: 3588595 - DNA, 20 bp, Homo sapiens
cctgggaaccactcccacca

SEQ ID NO: 3588596 - DNA, 22 bp, Homo sapiens
cctgggagggaggtggtcctcc

SEQ ID NO: 3588597 - DNA, 19 bp, Homo sapiens
cctgggcacacgctgctct

SEQ ID NO: 3588598 - DNA, 20 bp, Homo sapiens
cctgggcattagcaaggcag

SEQ ID NO: 3588599 - DNA, 21 bp, Homo sapiens
cctgggcattagcaaggcaga

SEQ ID NO: 3588600 - DNA, 15 bp, Homo sapiens
cctgggccggctgag

SEQ ID NO: 3588601 - DNA, 17 bp, Homo sapiens
cctgggccgtggcacag

SEQ ID NO: 3588602 - DNA, 19 bp, Homo sapiens
cctgggctacagaaaccac

SEQ ID NO: 3588603 - DNA, 16 bp, Homo sapiens
cctgggctcactgtgc

SEQ ID NO: 3588604 - DNA, 22 bp, Homo sapiens
cctgggctcactgtgctggggc

SEQ ID NO: 3588605 - DNA, 23 bp, Homo sapiens
cctgggctcactgtgctggggca

SEQ ID NO: 3588606 - DNA, 21 bp, Homo sapiens
cctgggctcagcctggtttct

SEQ ID NO: 3588607 - DNA, 19 bp, Homo sapiens
cctgggctggggcctcaga

SEQ ID NO: 3588608 - DNA, 14 bp, Homo sapiens
cctgggctggttgg

SEQ ID NO: 3588609 - DNA, 16 bp, Homo sapiens
cctggggatcttccca

SEQ ID NO: 3588610 - DNA, 23 bp, Homo sapiens
cctgggggattcctgagctggcc

SEQ ID NO: 3588611 - DNA, 12 bp, Homo sapiens
cctgggggctct

SEQ ID NO: 3588612 - DNA, 14 bp, Homo sapiens
cctgggggctctca

SEQ ID NO: 3588613 - DNA, 19 bp, Homo sapiens
cctgggggcttttgccact

SEQ ID NO: 3588614 - DNA, 23 bp, Homo sapiens
cctgggggttctttcttcctctg

SEQ ID NO: 3588615 - DNA, 14 bp, Homo sapiens
cctggggtctggag

SEQ ID NO: 3588616 - DNA, 15 bp, Homo sapiens
cctggggtggggtca

SEQ ID NO: 3588617 - DNA, 22 bp, Homo sapiens
cctgggtctggggacaggcccg

SEQ ID NO: 3588618 - DNA, 17 bp, Homo sapiens
cctgggtttgggagcca

SEQ ID NO: 3588619 - DNA, 19 bp, Homo sapiens
cctgggtttgggagccagg

SEQ ID NO: 3588620 - DNA, 21 bp, Homo sapiens
cctgggtttgggagccaggac

SEQ ID NO: 3588621 - DNA, 23 bp, Homo sapiens
cctgggtttgggagccaggactc

SEQ ID NO: 3588622 - DNA, 20 bp, Homo sapiens
cctggtcccacgagggtgcc

SEQ ID NO: 3588623 - DNA, 21 bp, Homo sapiens
cctggtccccactgctgagct

SEQ ID NO: 3588624 - DNA, 22 bp, Homo sapiens
cctggtgccctggatgcccagg

SEQ ID NO: 3588625 - DNA, 22 bp, Homo sapiens
cctggtgcctatctgcctggag

SEQ ID NO: 3588626 - DNA, 18 bp, Homo sapiens
cctggtgctgccacactt

SEQ ID NO: 3588627 - DNA, 23 bp, Homo sapiens
cctggtggatacctggttgagtg

SEQ ID NO: 3588628 - DNA, 14 bp, Homo sapiens
cctggtgggccaac

SEQ ID NO: 3588629 - DNA, 13 bp, Homo sapiens
cctggtttaattc

SEQ ID NO: 3588630 - DNA, 18 bp, Homo sapiens
cctggtttcgtgtgctgc

SEQ ID NO: 3588631 - DNA, 18 bp, Homo sapiens
cctgtaccaaatctgaca

SEQ ID NO: 3588632 - DNA, 17 bp, Homo sapiens
cctgtatgtctccagta

SEQ ID NO: 3588633 - DNA, 10 bp, Homo sapiens
cctgtcccaa

SEQ ID NO: 3588634 - DNA, 13 bp, Homo sapiens
cctgtccctctag

SEQ ID NO: 3588635 - DNA, 14 bp, Homo sapiens
cctgtccctctagt

SEQ ID NO: 3588636 - DNA, 14 bp, Homo sapiens
cctgtcccttgcct

SEQ ID NO: 3588637 - DNA, 12 bp, Homo sapiens
cctgtccctttt

SEQ ID NO: 3588638 - DNA, 14 bp, Homo sapiens
cctgtcccttttcc

SEQ ID NO: 3588639 - DNA, 18 bp, Homo sapiens
cctgtcccttttccctta

SEQ ID NO: 3588640 - DNA, 13 bp, Homo sapiens
cctgtccttccct

SEQ ID NO: 3588641 - DNA, 22 bp, Homo sapiens
cctgtccttgtcacgatcacag

SEQ ID NO: 3588642 - DNA, 23 bp, Homo sapiens
cctgtcgaaggggaggcacactt

SEQ ID NO: 3588643 - DNA, 17 bp, Homo sapiens
cctgtctagagagggag

SEQ ID NO: 3588644 - DNA, 18 bp, Homo sapiens
cctgtctccagctgcctg

SEQ ID NO: 3588645 - DNA, 12 bp, Homo sapiens
cctgtctccttt

SEQ ID NO: 3588646 - DNA, 15 bp, Homo sapiens
cctgtctgcgtgggt

SEQ ID NO: 3588647 - DNA, 14 bp, Homo sapiens
cctgtctgctgcca

SEQ ID NO: 3588648 - DNA, 16 bp, Homo sapiens
cctgtctgctgccagc

SEQ ID NO: 3588649 - DNA, 17 bp, Homo sapiens
cctgtctgctgccagca

SEQ ID NO: 3588650 - DNA, 18 bp, Homo sapiens
cctgtctgctgccagcac

SEQ ID NO: 3588651 - DNA, 14 bp, Homo sapiens
cctgtctgtttgct

SEQ ID NO: 3588652 - DNA, 15 bp, Homo sapiens
cctgtcttctttctc

SEQ ID NO: 3588653 - DNA, 17 bp, Homo sapiens
cctgtgccagcaccaca

SEQ ID NO: 3588654 - DNA, 16 bp, Homo sapiens
cctactagtcaccaga

SEQ ID NO: 3588655 - DNA, 17 bp, Homo sapiens
cctactctcttatgcat

SEQ ID NO: 3588656 - DNA, 15 bp, Homo sapiens
cctagaaagggcaag

SEQ ID NO: 3588657 - DNA, 16 bp, Homo sapiens
cctagactgctcctgg

SEQ ID NO: 3588658 - DNA, 19 bp, Homo sapiens
cctagactggtgctaatgt

SEQ ID NO: 3588659 - DNA, 23 bp, Homo sapiens
cgtggcctcgtgaggggcaagct

SEQ ID NO: 3588660 - DNA, 17 bp, Homo sapiens
cgtggcctcgtgctccg

SEQ ID NO: 3588661 - DNA, 21 bp, Homo sapiens
cgtggcttcccgctcagccct

SEQ ID NO: 3588662 - DNA, 14 bp, Homo sapiens
cgtggcttggggat

SEQ ID NO: 3588663 - DNA, 16 bp, Homo sapiens
cgtgggaaaggggagt

SEQ ID NO: 3588664 - DNA, 23 bp, Homo sapiens
cgtgggaacccccctcccaccca

SEQ ID NO: 3588665 - DNA, 13 bp, Homo sapiens
cgtggggcccact

SEQ ID NO: 3588666 - DNA, 16 bp, Homo sapiens
cgtggggccgggagcg

SEQ ID NO: 3588667 - DNA, 23 bp, Homo sapiens
cgtgggtttttgtatccagagct

SEQ ID NO: 3588668 - DNA, 14 bp, Homo sapiens
cgtggtgaggctga

SEQ ID NO: 3588669 - DNA, 21 bp, Homo sapiens
cgtggtgggggaggagcctct

SEQ ID NO: 3588670 - DNA, 23 bp, Homo sapiens
cgtggtgggggaggagcctctgg

SEQ ID NO: 3588671 - DNA, 19 bp, Homo sapiens
cgtggtttgcctgaggctg

SEQ ID NO: 3588672 - DNA, 20 bp, Homo sapiens
cgtgtaccacctaatgttta

SEQ ID NO: 3588673 - DNA, 19 bp, Homo sapiens
cgtgtcccctgacagggcc

SEQ ID NO: 3588674 - DNA, 20 bp, Homo sapiens
cgtgtttctctaaggaatta

SEQ ID NO: 3588675 - DNA, 14 bp, Homo sapiens
cgttaaaaacagat

SEQ ID NO: 3588676 - DNA, 23 bp, Homo sapiens
cgttcacctccaagcatttcatg

SEQ ID NO: 3588677 - DNA, 15 bp, Homo sapiens
cgttcagcagactgg

SEQ ID NO: 3588678 - DNA, 15 bp, Homo sapiens
cgttctcccaaagat

SEQ ID NO: 3588679 - DNA, 16 bp, Homo sapiens
cgttctcccaaagatt

SEQ ID NO: 3588680 - DNA, 12 bp, Homo sapiens
cgttctctgcct

SEQ ID NO: 3588681 - DNA, 18 bp, Homo sapiens
cgttgttgtggaagcatg

SEQ ID NO: 3588682 - DNA, 23 bp, Homo sapiens
cgtttagaaaaaacaatttttga

SEQ ID NO: 3588683 - DNA, 22 bp, Homo sapiens
cgtttcactgcaaacacacctt

SEQ ID NO: 3588684 - DNA, 22 bp, Homo sapiens
cgtttcatttagtcatgtgacc

SEQ ID NO: 3588685 - DNA, 12 bp, Homo sapiens
cgtttctccttt

SEQ ID NO: 3588686 - DNA, 11 bp, Homo sapiens
cgtttggagaa

SEQ ID NO: 3588687 - DNA, 22 bp, Homo sapiens
cgttttaataatttttgctgaa

SEQ ID NO: 3588688 - DNA, 12 bp, Homo sapiens
cgttttgtatag

SEQ ID NO: 3588689 - DNA, 11 bp, Homo sapiens
cgttttgtcac

SEQ ID NO: 3588690 - DNA, 18 bp, Homo sapiens
ctaaaaaggcccttagag

SEQ ID NO: 3588691 - DNA, 15 bp, Homo sapiens
ctaaaaagtataaaa

SEQ ID NO: 3588692 - DNA, 19 bp, Homo sapiens
ctaaaaatatatctgttgg

SEQ ID NO: 3588693 - DNA, 23 bp, Homo sapiens
ctaaaactgggattaagaaacct

SEQ ID NO: 3588694 - DNA, 15 bp, Homo sapiens
ctaaaagctctgttc

SEQ ID NO: 3588695 - DNA, 18 bp, Homo sapiens
ctaaaataattttgtaat

SEQ ID NO: 3588696 - DNA, 16 bp, Homo sapiens
ctaaaatataatagaa

SEQ ID NO: 3588697 - DNA, 15 bp, Homo sapiens
ctaaaatctgcttgt

SEQ ID NO: 3588698 - DNA, 22 bp, Homo sapiens
ctaaaatctgcttgtattccaa

SEQ ID NO: 3588699 - DNA, 20 bp, Homo sapiens
ctaaaatggcgaacatgtgt

SEQ ID NO: 3588700 - DNA, 13 bp, Homo sapiens
ctaaaatttcata

SEQ ID NO: 3588701 - DNA, 23 bp, Homo sapiens
ctaaaatttcataattctgaaac

SEQ ID NO: 3588702 - DNA, 18 bp, Homo sapiens
ctaaactttttttctgta

SEQ ID NO: 3588703 - DNA, 17 bp, Homo sapiens
ctaaagaagaggagaaa

SEQ ID NO: 3588704 - DNA, 21 bp, Homo sapiens
ctaaagaagaggagaaaaaga

SEQ ID NO: 3588705 - DNA, 16 bp, Homo sapiens
ctaaagagcatcctga

SEQ ID NO: 3588706 - DNA, 15 bp, Homo sapiens
ctaaagccaggctca

SEQ ID NO: 3588707 - DNA, 18 bp, Homo sapiens
ctaaagccaggctcagga

SEQ ID NO: 3588708 - DNA, 17 bp, Homo sapiens
ctaaagggaccatctgc

SEQ ID NO: 3588709 - DNA, 23 bp, Homo sapiens
ctaaagggactacctctgtgcct

SEQ ID NO: 3588710 - DNA, 13 bp, Homo sapiens
ctaaagggcaggg

SEQ ID NO: 3588711 - DNA, 15 bp, Homo sapiens
ctaaagggcagggcc

SEQ ID NO: 3588712 - DNA, 19 bp, Homo sapiens
ctaaaggtgttgtcccttc

SEQ ID NO: 3588713 - DNA, 14 bp, Homo sapiens
ctaaataaagagga

SEQ ID NO: 3588714 - DNA, 21 bp, Homo sapiens
ctaaataaatgtaatagccaa

SEQ ID NO: 3588715 - DNA, 21 bp, Homo sapiens
ctaaatactgagaaaacctgt

SEQ ID NO: 3588716 - DNA, 15 bp, Homo sapiens
ctaaatggtgctgca

SEQ ID NO: 3588717 - DNA, 19 bp, Homo sapiens
ctaaatggtgctgcagatt

SEQ ID NO: 3588718 - DNA, 20 bp, Homo sapiens
ctaaattgcagtttacagta

SEQ ID NO: 3588719 - DNA, 22 bp, Homo sapiens
ctaaattgcagtttacagtatt

SEQ ID NO: 3588720 - DNA, 23 bp, Homo sapiens
ctaaattgcagtttacagtattt

SEQ ID NO: 3588721 - DNA, 22 bp, Homo sapiens
ctaaattggctccatatcattt

SEQ ID NO: 3588722 - DNA, 17 bp, Homo sapiens
ctaaatttaatgctgcc

SEQ ID NO: 3588723 - DNA, 22 bp, Homo sapiens
ctaacaagtcataggttaatat

SEQ ID NO: 3588724 - DNA, 12 bp, Homo sapiens
ctaacatgaaat

SEQ ID NO: 3588725 - DNA, 17 bp, Homo sapiens
ctaacatgtcctgccta

SEQ ID NO: 3588726 - DNA, 10 bp, Homo sapiens
ctaaccaagt

SEQ ID NO: 3588727 - DNA, 23 bp, Homo sapiens
ctaacccaagacatgacattctt

SEQ ID NO: 3588728 - DNA, 17 bp, Homo sapiens
ctaacccagtctttctt

SEQ ID NO: 3588729 - DNA, 13 bp, Homo sapiens
ctaacctgggacc

SEQ ID NO: 3588730 - DNA, 15 bp, Homo sapiens
ctaactaactggcag

SEQ ID NO: 3588731 - DNA, 14 bp, Homo sapiens
ctaactatgcaata

SEQ ID NO: 3588732 - DNA, 17 bp, Homo sapiens
ctaactgggttaaatat

SEQ ID NO: 3588733 - DNA, 14 bp, Homo sapiens
ctaagaccctgtgt

SEQ ID NO: 3588734 - DNA, 15 bp, Homo sapiens
ctaagactttactta

SEQ ID NO: 3588735 - DNA, 19 bp, Homo sapiens
ctaagattacaaatcagaa

SEQ ID NO: 3588736 - DNA, 21 bp, Homo sapiens
ctaagattacaaatcagaagt

SEQ ID NO: 3588737 - DNA, 22 bp, Homo sapiens
ctaagattacaaatcagaagtc

SEQ ID NO: 3588738 - DNA, 21 bp, Homo sapiens
ctagagggaggggcctaggcc

SEQ ID NO: 3588739 - DNA, 22 bp, Homo sapiens
ctagagggaggggcctaggcct

SEQ ID NO: 3588740 - DNA, 23 bp, Homo sapiens
ctagagggcgagggatgatgagg

SEQ ID NO: 3588741 - DNA, 23 bp, Homo sapiens
ctagagtgtagcctaaagggcag

SEQ ID NO: 3588742 - DNA, 21 bp, Homo sapiens
ctagataacgaagtgcactta

SEQ ID NO: 3588743 - DNA, 22 bp, Homo sapiens
ctagatgcacgtggggcccact

SEQ ID NO: 3588744 - DNA, 16 bp, Homo sapiens
ctagatgtagtatttt

SEQ ID NO: 3588745 - DNA, 21 bp, Homo sapiens
ctagcacacctgaatcagctg

SEQ ID NO: 3588746 - DNA, 22 bp, Homo sapiens
ctagcacacctgaatcagctgg

SEQ ID NO: 3588747 - DNA, 17 bp, Homo sapiens
ctagcatgggtattttt

SEQ ID NO: 3588748 - DNA, 18 bp, Homo sapiens
ctagcatgggtattttta

SEQ ID NO: 3588749 - DNA, 20 bp, Homo sapiens
ctagccagagaatagatcag

SEQ ID NO: 3588750 - DNA, 12 bp, Homo sapiens
ctagcccaacct

SEQ ID NO: 3588751 - DNA, 13 bp, Homo sapiens
ctagccctctcac

SEQ ID NO: 3588752 - DNA, 19 bp, Homo sapiens
ctagccctctcacatttat

SEQ ID NO: 3588753 - DNA, 11 bp, Homo sapiens
ctagccctgct

SEQ ID NO: 3588754 - DNA, 15 bp, Homo sapiens
ctagccctgctccaa

SEQ ID NO: 3588755 - DNA, 16 bp, Homo sapiens
ctagccctgctccaac

SEQ ID NO: 3588756 - DNA, 21 bp, Homo sapiens
ctagccctggttagctgacag

SEQ ID NO: 3588757 - DNA, 14 bp, Homo sapiens
ctagcctctggact

SEQ ID NO: 3588758 - DNA, 17 bp, Homo sapiens
ctagcctctggactgga

SEQ ID NO: 3588759 - DNA, 19 bp, Homo sapiens
ctagcctgtgcctctggga

SEQ ID NO: 3588760 - DNA, 21 bp, Homo sapiens
ctagcctgtgcctctgggact

SEQ ID NO: 3588761 - DNA, 17 bp, Homo sapiens
ctagcggagcccagcct

SEQ ID NO: 3588762 - DNA, 14 bp, Homo sapiens
ctagctaggagcag

SEQ ID NO: 3588763 - DNA, 17 bp, Homo sapiens
ctagctcctgccacatg

SEQ ID NO: 3588764 - DNA, 14 bp, Homo sapiens
ctagctctcacaga

SEQ ID NO: 3588765 - DNA, 17 bp, Homo sapiens
ctagctctcacagacat

SEQ ID NO: 3588766 - DNA, 12 bp, Homo sapiens
ctagctgggggt

SEQ ID NO: 3588767 - DNA, 21 bp, Homo sapiens
ctagctgggggtgggccaggc

SEQ ID NO: 3588768 - DNA, 22 bp, Homo sapiens
ctagctgggggtgggccaggct

SEQ ID NO: 3588769 - DNA, 20 bp, Homo sapiens
ctaggagcaggcttgtggca

SEQ ID NO: 3588770 - DNA, 15 bp, Homo sapiens
ctaggcactgagcag

SEQ ID NO: 3588771 - DNA, 23 bp, Homo sapiens
ctaggccccagaggccctggagg

SEQ ID NO: 3588772 - DNA, 15 bp, Homo sapiens
ctaggcctcagccag

SEQ ID NO: 3588773 - DNA, 18 bp, Homo sapiens
ctaggcctcagccagaga

SEQ ID NO: 3588774 - DNA, 19 bp, Homo sapiens
ctaggcctcagccagagaa

SEQ ID NO: 3588775 - DNA, 17 bp, Homo sapiens
ctaggcctttcctctgc

SEQ ID NO: 3588776 - DNA, 19 bp, Homo sapiens
ctaggcctttcctctgcac

SEQ ID NO: 3588777 - DNA, 21 bp, Homo sapiens
ctaggcctttcctctgcacgc

SEQ ID NO: 3588778 - DNA, 19 bp, Homo sapiens
ctagggactgccaggctgt

SEQ ID NO: 3588779 - DNA, 15 bp, Homo sapiens
ctaggtgcccagggc

SEQ ID NO: 3588780 - DNA, 15 bp, Homo sapiens
ctagtaggaatgtac

SEQ ID NO: 3588781 - DNA, 14 bp, Homo sapiens
ctagtagtgtggcc

SEQ ID NO: 3588782 - DNA, 15 bp, Homo sapiens
ctagtcaagctcctc

SEQ ID NO: 3588783 - DNA, 19 bp, Homo sapiens
ctagtcaagctcctcctcc

SEQ ID NO: 3588784 - DNA, 22 bp, Homo sapiens
ctagtcaagctcctcctccctg

SEQ ID NO: 3588785 - DNA, 14 bp, Homo sapiens
ctagtcaccagaga

SEQ ID NO: 3588786 - DNA, 23 bp, Homo sapiens
ctagtcatttgttaatatttctt

SEQ ID NO: 3588787 - DNA, 18 bp, Homo sapiens
ctagtgaaagaggcagct

SEQ ID NO: 3588788 - DNA, 20 bp, Homo sapiens
ctagtgaccccttccctgtc

SEQ ID NO: 3588789 - DNA, 21 bp, Homo sapiens
ctagtggaaagtcaggctagc

SEQ ID NO: 3588790 - DNA, 19 bp, Homo sapiens
ctagtggtatggggctgag

SEQ ID NO: 3588791 - DNA, 17 bp, Homo sapiens
ctagtgttgtatttcta

SEQ ID NO: 3588792 - DNA, 23 bp, Homo sapiens
ctagttctttcctccccctgcaa

SEQ ID NO: 3588793 - DNA, 18 bp, Homo sapiens
ctagttttctcctcccag

SEQ ID NO: 3588794 - DNA, 19 bp, Homo sapiens
ctagttttttcttcctttt

SEQ ID NO: 3588795 - DNA, 20 bp, Homo sapiens
ctataaagtgcctcggacag

SEQ ID NO: 3588796 - DNA, 17 bp, Homo sapiens
ctataaatagtattcca

SEQ ID NO: 3588797 - DNA, 22 bp, Homo sapiens
ctataaattcctctttgctttg

SEQ ID NO: 3588798 - DNA, 21 bp, Homo sapiens
ctataaattttttgaaacaca

SEQ ID NO: 3588799 - DNA, 12 bp, Homo sapiens
ctatacatgttg

SEQ ID NO: 3588800 - DNA, 21 bp, Homo sapiens
ctatacatgttggaaatgtgt

SEQ ID NO: 3588801 - DNA, 22 bp, Homo sapiens
ctatacatgttggaaatgtgtt

SEQ ID NO: 3588802 - DNA, 15 bp, Homo sapiens
ctatacccacccaga

SEQ ID NO: 3588803 - DNA, 21 bp, Homo sapiens
ctatagcctggggtggggtca

SEQ ID NO: 3588804 - DNA, 18 bp, Homo sapiens
ctatagctacatgttctt

SEQ ID NO: 3588805 - DNA, 21 bp, Homo sapiens
ctataggtgctacaaaaacac

SEQ ID NO: 3588806 - DNA, 22 bp, Homo sapiens
ctataggtgctacaaaaacaca

SEQ ID NO: 3588807 - DNA, 15 bp, Homo sapiens
ctatataaaatgtat

SEQ ID NO: 3588808 - DNA, 16 bp, Homo sapiens
ctatattcctccagct

SEQ ID NO: 3588809 - DNA, 14 bp, Homo sapiens
ctatattgcccagg

SEQ ID NO: 3588810 - DNA, 16 bp, Homo sapiens
ctatatttaacaagat

SEQ ID NO: 3588811 - DNA, 13 bp, Homo sapiens
ctatcaactacaa

SEQ ID NO: 3588812 - DNA, 23 bp, Homo sapiens
ctatcagttttatagctttattt

SEQ ID NO: 3588813 - DNA, 13 bp, Homo sapiens
ctatctcagccat

SEQ ID NO: 3588814 - DNA, 14 bp, Homo sapiens
ctatctcagccata

SEQ ID NO: 3588815 - DNA, 15 bp, Homo sapiens
ctatctcatctgtct

SEQ ID NO: 3588816 - DNA, 13 bp, Homo sapiens
ctatctccctggc

SEQ ID NO: 3588817 - DNA, 20 bp, Homo sapiens
ctatgaaacaatcttccaaa

SEQ ID NO: 3588818 - DNA, 16 bp, Homo sapiens
ctatgaaactggttta

SEQ ID NO: 3588819 - DNA, 13 bp, Homo sapiens
ctatgaaaggcag

SEQ ID NO: 3588820 - DNA, 17 bp, Homo sapiens
ctatgaaatactttata

SEQ ID NO: 3588821 - DNA, 21 bp, Homo sapiens
ctatgacctcgccctccacaa

SEQ ID NO: 3588822 - DNA, 17 bp, Homo sapiens
ctatgatactgtctctc

SEQ ID NO: 3588823 - DNA, 17 bp, Homo sapiens
ctatgatggatggcaga

SEQ ID NO: 3588824 - DNA, 20 bp, Homo sapiens
ctatgatgttagttttcctt

SEQ ID NO: 3588825 - DNA, 19 bp, Homo sapiens
ctatgatttaatttgaaat

SEQ ID NO: 3588826 - DNA, 18 bp, Homo sapiens
ctatgcaataatccaccc

SEQ ID NO: 3588827 - DNA, 13 bp, Homo sapiens
ctatgcatggtgc

SEQ ID NO: 3588828 - DNA, 23 bp, Homo sapiens
ctatgcatggtgccccaggacca

SEQ ID NO: 3588829 - DNA, 20 bp, Homo sapiens
ctatgctggtagatgctgag

SEQ ID NO: 3588830 - DNA, 18 bp, Homo sapiens
ctatgctgtttgtagtga

SEQ ID NO: 3588831 - DNA, 22 bp, Homo sapiens
ctatgtgacatttctcttcccc

SEQ ID NO: 3588832 - DNA, 12 bp, Homo sapiens
ctatgttaatat

SEQ ID NO: 3588833 - DNA, 15 bp, Homo sapiens
ctatgttaatatttt

SEQ ID NO: 3588834 - DNA, 17 bp, Homo sapiens
ctatgttaatattttag

SEQ ID NO: 3588835 - DNA, 22 bp, Homo sapiens
ctattattttcactgtagaatg

SEQ ID NO: 3588836 - DNA, 23 bp, Homo sapiens
ctattcaaacagtctcaggaaat

SEQ ID NO: 3588837 - DNA, 17 bp, Homo sapiens
ctattcacaaaatatca

SEQ ID NO: 3588838 - DNA, 23 bp, Homo sapiens
ctattccaactgggcatttcaat

SEQ ID NO: 3588839 - DNA, 19 bp, Homo sapiens
ctattctcaaatgctggca

SEQ ID NO: 3588840 - DNA, 14 bp, Homo sapiens
ctattctccagaca

SEQ ID NO: 3588841 - DNA, 18 bp, Homo sapiens
ctattctgaaaaagacat

SEQ ID NO: 3588842 - DNA, 17 bp, Homo sapiens
ctattgcatttatatgt

SEQ ID NO: 3588843 - DNA, 19 bp, Homo sapiens
ctattgcatttatatgtac

SEQ ID NO: 3588844 - DNA, 20 bp, Homo sapiens
ctatttatgccttgatgatt

SEQ ID NO: 3588845 - DNA, 15 bp, Homo sapiens
ctatttattagccaa

SEQ ID NO: 3588846 - DNA, 14 bp, Homo sapiens
ctatttcttgaaga

SEQ ID NO: 3588847 - DNA, 15 bp, Homo sapiens
ctattttagaataaa

SEQ ID NO: 3588848 - DNA, 21 bp, Homo sapiens
ctatttttatacactgtaagc

SEQ ID NO: 3588849 - DNA, 17 bp, Homo sapiens
ctatttttcatcctaaa

SEQ ID NO: 3588850 - DNA, 22 bp, Homo sapiens
ctcaaaaaaaagaaaatgtctt

SEQ ID NO: 3588851 - DNA, 13 bp, Homo sapiens
ctcaaaacaaagg

SEQ ID NO: 3588852 - DNA, 14 bp, Homo sapiens
ctcaaaacaaaggc

SEQ ID NO: 3588853 - DNA, 13 bp, Homo sapiens
ctcaaaactgcac

SEQ ID NO: 3588854 - DNA, 13 bp, Homo sapiens
ctcaaaatatttg

SEQ ID NO: 3588855 - DNA, 12 bp, Homo sapiens
ctcaaaatgtgt

SEQ ID NO: 3588856 - DNA, 19 bp, Homo sapiens
ctcaaaattgcttctaaaa

SEQ ID NO: 3588857 - DNA, 12 bp, Homo sapiens
ctcaaactgcac

SEQ ID NO: 3588858 - DNA, 17 bp, Homo sapiens
ctcaaactgcacatcta

SEQ ID NO: 3588859 - DNA, 17 bp, Homo sapiens
ctcaaagaaagtgtatt

SEQ ID NO: 3588860 - DNA, 16 bp, Homo sapiens
ctcaaatgctcagacc

SEQ ID NO: 3588861 - DNA, 15 bp, Homo sapiens
ctcaaatggggccag

SEQ ID NO: 3588862 - DNA, 17 bp, Homo sapiens
ctcaaatggggccagat

SEQ ID NO: 3588863 - DNA, 20 bp, Homo sapiens
ctcaaatggggccagatcca

SEQ ID NO: 3588864 - DNA, 21 bp, Homo sapiens
ctcaaatggggccagatccag

SEQ ID NO: 3588865 - DNA, 17 bp, Homo sapiens
ctcaaattgtcagcaat

SEQ ID NO: 3588866 - DNA, 16 bp, Homo sapiens
ctcaacccccctccca

SEQ ID NO: 3588867 - DNA, 18 bp, Homo sapiens
ctcaacccccctcccaga

SEQ ID NO: 3588868 - DNA, 17 bp, Homo sapiens
ctcaacctcctgggttc

SEQ ID NO: 3588869 - DNA, 22 bp, Homo sapiens
ctcaacgcctccccctccccca

SEQ ID NO: 3588870 - DNA, 11 bp, Homo sapiens
ctttgtggcca

SEQ ID NO: 3588871 - DNA, 21 bp, Homo sapiens
ctttgtggccaaggagctgct

SEQ ID NO: 3588872 - DNA, 18 bp, Homo sapiens
ctttgtgtagctttgctc

SEQ ID NO: 3588873 - DNA, 16 bp, Homo sapiens
ctttgttgaaagaaag

SEQ ID NO: 3588874 - DNA, 15 bp, Homo sapiens
ctttgttgtacgcag

SEQ ID NO: 3588875 - DNA, 15 bp, Homo sapiens
ctttgttgtgagaat

SEQ ID NO: 3588876 - DNA, 22 bp, Homo sapiens
ctttgttgtgagaatggcctgg

SEQ ID NO: 3588877 - DNA, 17 bp, Homo sapiens
cttttaatccatttcag

SEQ ID NO: 3588878 - DNA, 16 bp, Homo sapiens
cttttaggccaaaaaa

SEQ ID NO: 3588879 - DNA, 16 bp, Homo sapiens
cttttatattctaata

SEQ ID NO: 3588880 - DNA, 13 bp, Homo sapiens
cttttatctattt

SEQ ID NO: 3588881 - DNA, 15 bp, Homo sapiens
cttttatgtaaattt

SEQ ID NO: 3588882 - DNA, 18 bp, Homo sapiens
cttttatgtattttccaa

SEQ ID NO: 3588883 - DNA, 18 bp, Homo sapiens
cttttcaatatatttgta

SEQ ID NO: 3588884 - DNA, 19 bp, Homo sapiens
cttttcacattaggctgtt

SEQ ID NO: 3588885 - DNA, 17 bp, Homo sapiens
cttttcactgctggctg

SEQ ID NO: 3588886 - DNA, 18 bp, Homo sapiens
cttttcaggagatgggga

SEQ ID NO: 3588887 - DNA, 23 bp, Homo sapiens
cttttcatatctcttgcccttcc

SEQ ID NO: 3588888 - DNA, 16 bp, Homo sapiens
cttttcccccttccca

SEQ ID NO: 3588889 - DNA, 22 bp, Homo sapiens
cttttcccttacaaggtgggga

SEQ ID NO: 3588890 - DNA, 17 bp, Homo sapiens
cttttccttatttgcct

SEQ ID NO: 3588891 - DNA, 23 bp, Homo sapiens
cttttccttatttgccttctact

SEQ ID NO: 3588892 - DNA, 19 bp, Homo sapiens
cttttctaaaatctaaaat

SEQ ID NO: 3588893 - DNA, 16 bp, Homo sapiens
cttttctgtcctgggc

SEQ ID NO: 3588894 - DNA, 15 bp, Homo sapiens
cttttctttaacttt

SEQ ID NO: 3588895 - DNA, 21 bp, Homo sapiens
cttttgaacgcccccccccac

SEQ ID NO: 3588896 - DNA, 17 bp, Homo sapiens
cttttgacactgctcta

SEQ ID NO: 3588897 - DNA, 16 bp, Homo sapiens
cttttgaggcttctcc

SEQ ID NO: 3588898 - DNA, 18 bp, Homo sapiens
cttttgctaataccaaaa

SEQ ID NO: 3588899 - DNA, 22 bp, Homo sapiens
cttttgctcttagctgtctgct

SEQ ID NO: 3588900 - DNA, 21 bp, Homo sapiens
cttttgggggtcagcatccag

SEQ ID NO: 3588901 - DNA, 20 bp, Homo sapiens
cttttgtagttttatttgta

SEQ ID NO: 3588902 - DNA, 22 bp, Homo sapiens
cttttgtagttttatttgtatt

SEQ ID NO: 3588903 - DNA, 16 bp, Homo sapiens
cttttgtctaattaaa

SEQ ID NO: 3588904 - DNA, 13 bp, Homo sapiens
cttttgtgaatta

SEQ ID NO: 3588905 - DNA, 21 bp, Homo sapiens
cttttgtggaggggagggatg

SEQ ID NO: 3588906 - DNA, 13 bp, Homo sapiens
ctttttacctggc

SEQ ID NO: 3588907 - DNA, 13 bp, Homo sapiens
ctttttattaaaa

SEQ ID NO: 3588908 - DNA, 18 bp, Homo sapiens
ctttttattaaaatattt

SEQ ID NO: 3588909 - DNA, 15 bp, Homo sapiens
ctttttattccctgc

SEQ ID NO: 3588910 - DNA, 13 bp, Homo sapiens
ctttttccagagg

SEQ ID NO: 3588911 - DNA, 12 bp, Homo sapiens
ctttttcctctc

SEQ ID NO: 3588912 - DNA, 22 bp, Homo sapiens
ctttttcttaccagtctcctcc

SEQ ID NO: 3588913 - DNA, 20 bp, Homo sapiens
ctttttgaggcaaaagaagg

SEQ ID NO: 3588914 - DNA, 11 bp, Homo sapiens
ctttttgtcat

SEQ ID NO: 3588915 - DNA, 17 bp, Homo sapiens
cttttttcaatatgcaa

SEQ ID NO: 3588916 - DNA, 16 bp, Homo sapiens
ctttttttacatttca

SEQ ID NO: 3588917 - DNA, 13 bp, Homo sapiens
ctttttttgcttt

SEQ ID NO: 3588918 - DNA, 15 bp, Homo sapiens
cttttttttgttttg

SEQ ID NO: 3588919 - DNA, 19 bp, Homo sapiens
gaaaaaaaaaaagaaagaa

SEQ ID NO: 3588920 - DNA, 13 bp, Homo sapiens
gaaaaaaaaagca

SEQ ID NO: 3588921 - DNA, 15 bp, Homo sapiens
gaaaaaaaaagcaaa

SEQ ID NO: 3588922 - DNA, 21 bp, Homo sapiens
gaaaaaaaaagcaaatcagaa

SEQ ID NO: 3588923 - DNA, 14 bp, Homo sapiens
gaaaaaaacttcat

SEQ ID NO: 3588924 - DNA, 11 bp, Homo sapiens
gaaaaaacaat

SEQ ID NO: 3588925 - DNA, 19 bp, Homo sapiens
gaaaaactctttattttcc

SEQ ID NO: 3588926 - DNA, 12 bp, Homo sapiens
gaaaaagacata

SEQ ID NO: 3588927 - DNA, 12 bp, Homo sapiens
gaaaaagtaact

SEQ ID NO: 3588928 - DNA, 20 bp, Homo sapiens
gaaaaatggttgatggaaaa

SEQ ID NO: 3588929 - DNA, 18 bp, Homo sapiens
gaaaacagggtctgggac

SEQ ID NO: 3588930 - DNA, 19 bp, Homo sapiens
gaaaaccttaaaagtaata

SEQ ID NO: 3588931 - DNA, 21 bp, Homo sapiens
gaaaaccttaaaagtaataaa

SEQ ID NO: 3588932 - DNA, 13 bp, Homo sapiens
gaaaacgaagctc

SEQ ID NO: 3588933 - DNA, 13 bp, Homo sapiens
gaaaacggagagg

SEQ ID NO: 3588934 - DNA, 16 bp, Homo sapiens
gaaaactaaggatttt

SEQ ID NO: 3588935 - DNA, 21 bp, Homo sapiens
gaaaagaaaatttttgtagta

SEQ ID NO: 3588936 - DNA, 14 bp, Homo sapiens
gaaaagaatagaag

SEQ ID NO: 3588937 - DNA, 18 bp, Homo sapiens
gaaaagcggacatcagct

SEQ ID NO: 3588938 - DNA, 20 bp, Homo sapiens
gaaaagcggacatcagctgg

SEQ ID NO: 3588939 - DNA, 16 bp, Homo sapiens
gaaaagctaagagaag

SEQ ID NO: 3588940 - DNA, 22 bp, Homo sapiens
gaaaagctgccatttcccttct

SEQ ID NO: 3588941 - DNA, 21 bp, Homo sapiens
gaaaagtcaaagtgttgctgt

SEQ ID NO: 3588942 - DNA, 11 bp, Homo sapiens
gaaaagtcttc

SEQ ID NO: 3588943 - DNA, 17 bp, Homo sapiens
gaaaagtgcctgagctg

SEQ ID NO: 3588944 - DNA, 21 bp, Homo sapiens
gaaaagtgcctgagctgggga

SEQ ID NO: 3588945 - DNA, 10 bp, Homo sapiens
gaaaagttca

SEQ ID NO: 3588946 - DNA, 14 bp, Homo sapiens
gaaaataaatttaa

SEQ ID NO: 3588947 - DNA, 16 bp, Homo sapiens
gaaaataatgtttgat

SEQ ID NO: 3588948 - DNA, 15 bp, Homo sapiens
gaaaataatttctct

SEQ ID NO: 3588949 - DNA, 19 bp, Homo sapiens
gaaaataatttctcttgta

SEQ ID NO: 3588950 - DNA, 15 bp, Homo sapiens
gaaaatgaagaagga

SEQ ID NO: 3588951 - DNA, 14 bp, Homo sapiens
gaaaatgacttatt

SEQ ID NO: 3588952 - DNA, 15 bp, Homo sapiens
gaaaatgacttattt

SEQ ID NO: 3588953 - DNA, 18 bp, Homo sapiens
gaaaatgacttatttctg

SEQ ID NO: 3588954 - DNA, 23 bp, Homo sapiens
gaaaatggctttctcagccaggc

SEQ ID NO: 3588955 - DNA, 15 bp, Homo sapiens
gaaccactcccacca

SEQ ID NO: 3588956 - DNA, 16 bp, Homo sapiens
gaaccagccgtatttt

SEQ ID NO: 3588957 - DNA, 20 bp, Homo sapiens
gaaccatccacttacatata

SEQ ID NO: 3588958 - DNA, 17 bp, Homo sapiens
gaacccaagtccaagca

SEQ ID NO: 3588959 - DNA, 21 bp, Homo sapiens
gaacccacataaaagccccag

SEQ ID NO: 3588960 - DNA, 13 bp, Homo sapiens
gaacccagactca

SEQ ID NO: 3588961 - DNA, 13 bp, Homo sapiens
gaaccctccaaag

SEQ ID NO: 3588962 - DNA, 14 bp, Homo sapiens
gaaccctgagcagg

SEQ ID NO: 3588963 - DNA, 21 bp, Homo sapiens
gaaccgcagaagcctccccag

SEQ ID NO: 3588964 - DNA, 21 bp, Homo sapiens
gaacctacagactccatctct

SEQ ID NO: 3588965 - DNA, 15 bp, Homo sapiens
gaacctcagattctt

SEQ ID NO: 3588966 - DNA, 19 bp, Homo sapiens
gaacctggatgtacttaag

SEQ ID NO: 3588967 - DNA, 15 bp, Homo sapiens
gaacctgggaggcag

SEQ ID NO: 3588968 - DNA, 16 bp, Homo sapiens
gaacctgggaggcaga

SEQ ID NO: 3588969 - DNA, 14 bp, Homo sapiens
gaaccttctttggt

SEQ ID NO: 3588970 - DNA, 17 bp, Homo sapiens
gaacgagcagcccaggg

SEQ ID NO: 3588971 - DNA, 20 bp, Homo sapiens
gaacgccctggtaaggctgg

SEQ ID NO: 3588972 - DNA, 15 bp, Homo sapiens
gaacggaggaggaca

SEQ ID NO: 3588973 - DNA, 16 bp, Homo sapiens
gaacgtggctctgctg

SEQ ID NO: 3588974 - DNA, 22 bp, Homo sapiens
gaactacctatccttacatttc

SEQ ID NO: 3588975 - DNA, 18 bp, Homo sapiens
gaactagcatatagccat

SEQ ID NO: 3588976 - DNA, 21 bp, Homo sapiens
gaactagcatatagccattga

SEQ ID NO: 3588977 - DNA, 19 bp, Homo sapiens
gaactcaaatggggccaga

SEQ ID NO: 3588978 - DNA, 20 bp, Homo sapiens
gaactcaaatggggccagat

SEQ ID NO: 3588979 - DNA, 22 bp, Homo sapiens
gaactcaaatggggccagatcc

SEQ ID NO: 3588980 - DNA, 23 bp, Homo sapiens
gaactcaaatggggccagatcca

SEQ ID NO: 3588981 - DNA, 16 bp, Homo sapiens
gaactcaccctgggag

SEQ ID NO: 3588982 - DNA, 19 bp, Homo sapiens
gaactcagatccagggaca

SEQ ID NO: 3588983 - DNA, 11 bp, Homo sapiens
gaactccaggc

SEQ ID NO: 3588984 - DNA, 20 bp, Homo sapiens
gaactcctgtcttctttctc

SEQ ID NO: 3588985 - DNA, 17 bp, Homo sapiens
gaactcggtgtccccac

SEQ ID NO: 3588986 - DNA, 20 bp, Homo sapiens
gaactcggtgtccccaccat

SEQ ID NO: 3588987 - DNA, 22 bp, Homo sapiens
gaactctagagggcgagggatg

SEQ ID NO: 3588988 - DNA, 18 bp, Homo sapiens
gaactctcagaaataaat

SEQ ID NO: 3588989 - DNA, 15 bp, Homo sapiens
gaactcttcctcctc

SEQ ID NO: 3588990 - DNA, 19 bp, Homo sapiens
gaactgaaatccttgagag

SEQ ID NO: 3588991 - DNA, 15 bp, Homo sapiens
gaactgaccctcagg

SEQ ID NO: 3588992 - DNA, 17 bp, Homo sapiens
gaactgaccctcaggca

SEQ ID NO: 3588993 - DNA, 16 bp, Homo sapiens
gaactgcccttgctgc

SEQ ID NO: 3588994 - DNA, 16 bp, Homo sapiens
gaactgggcatatttc

SEQ ID NO: 3588995 - DNA, 18 bp, Homo sapiens
gaacttccaggaaagtgt

SEQ ID NO: 3588996 - DNA, 12 bp, Homo sapiens
gaacttgctgcc

SEQ ID NO: 3588997 - DNA, 13 bp, Homo sapiens
gaacttgctgcct

SEQ ID NO: 3588998 - DNA, 13 bp, Homo sapiens
gaacttgctgctg

SEQ ID NO: 3588999 - DNA, 16 bp, Homo sapiens
gaacttgctgctgcct

SEQ ID NO: 3589000 - DNA, 22 bp, Homo sapiens
gaagaactagcatatagccatt

SEQ ID NO: 3589001 - DNA, 18 bp, Homo sapiens
gaagaactagtagaagaa

SEQ ID NO: 3589002 - DNA, 20 bp, Homo sapiens
gaagaagacctctaggagga

SEQ ID NO: 3589003 - DNA, 13 bp, Homo sapiens
gaagaaggccaga

SEQ ID NO: 3589004 - DNA, 16 bp, Homo sapiens
gaagaaggccagagag

SEQ ID NO: 3589005 - DNA, 17 bp, Homo sapiens
gaagaatccagtattat

SEQ ID NO: 3589006 - DNA, 16 bp, Homo sapiens
gaagaatgcattcaaa

SEQ ID NO: 3589007 - DNA, 21 bp, Homo sapiens
gaagacacagactgcgatttg

SEQ ID NO: 3589008 - DNA, 17 bp, Homo sapiens
gaagacactccttcccc

SEQ ID NO: 3589009 - DNA, 16 bp, Homo sapiens
gaagacccaaaacagc

SEQ ID NO: 3589010 - DNA, 20 bp, Homo sapiens
gaagactttaaaccacctag

SEQ ID NO: 3589011 - DNA, 23 bp, Homo sapiens
gaagagctgttcacagccagact

SEQ ID NO: 3589012 - DNA, 17 bp, Homo sapiens
gaagaggtctgattggc

SEQ ID NO: 3589013 - DNA, 22 bp, Homo sapiens
gaagaggtctgattggctgctt

SEQ ID NO: 3589014 - DNA, 15 bp, Homo sapiens
gaagagttttagaga

SEQ ID NO: 3589015 - DNA, 15 bp, Homo sapiens
cttcagccaggtctg

SEQ ID NO: 3589016 - DNA, 11 bp, Homo sapiens
cttcaggagcc

SEQ ID NO: 3589017 - DNA, 12 bp, Homo sapiens
cttcaggagcct

SEQ ID NO: 3589018 - DNA, 13 bp, Homo sapiens
cttcaggagcctg

SEQ ID NO: 3589019 - DNA, 15 bp, Homo sapiens
cttcaggagcctggc

SEQ ID NO: 3589020 - DNA, 18 bp, Homo sapiens
cttcaggagcctggccag

SEQ ID NO: 3589021 - DNA, 14 bp, Homo sapiens
cttcaggctcttct

SEQ ID NO: 3589022 - DNA, 18 bp, Homo sapiens
cttcaggtcaggagttcg

SEQ ID NO: 3589023 - DNA, 16 bp, Homo sapiens
cttcagtcctttgtct

SEQ ID NO: 3589024 - DNA, 21 bp, Homo sapiens
cttcagtcctttgtctttctt

SEQ ID NO: 3589025 - DNA, 19 bp, Homo sapiens
cttcagtgaatatttttgt

SEQ ID NO: 3589026 - DNA, 23 bp, Homo sapiens
cttcagtgaatatttttgtattt

SEQ ID NO: 3589027 - DNA, 19 bp, Homo sapiens
cttcagtgactcctgctgg

SEQ ID NO: 3589028 - DNA, 19 bp, Homo sapiens
cttcagtgagcccctcccc

SEQ ID NO: 3589029 - DNA, 20 bp, Homo sapiens
cttcagtgagcccctcccca

SEQ ID NO: 3589030 - DNA, 14 bp, Homo sapiens
cttcatacatccct

SEQ ID NO: 3589031 - DNA, 14 bp, Homo sapiens
cttcatcagaactc

SEQ ID NO: 3589032 - DNA, 22 bp, Homo sapiens
cttcatcagaactcttcctcct

SEQ ID NO: 3589033 - DNA, 18 bp, Homo sapiens
cttcatccaatgtgaagt

SEQ ID NO: 3589034 - DNA, 16 bp, Homo sapiens
cttcatccatcctgag

SEQ ID NO: 3589035 - DNA, 13 bp, Homo sapiens
cttcatggatggg

SEQ ID NO: 3589036 - DNA, 16 bp, Homo sapiens
cttcatgtccagtgag

SEQ ID NO: 3589037 - DNA, 21 bp, Homo sapiens
cttcatgtccagtgagcagtg

SEQ ID NO: 3589038 - DNA, 14 bp, Homo sapiens
cttcattccattga

SEQ ID NO: 3589039 - DNA, 22 bp, Homo sapiens
cttcattctcgtgagtcattta

SEQ ID NO: 3589040 - DNA, 16 bp, Homo sapiens
cttcattctttactgc

SEQ ID NO: 3589041 - DNA, 18 bp, Homo sapiens
cttcattctttactgcac

SEQ ID NO: 3589042 - DNA, 19 bp, Homo sapiens
cttcattctttactgcact

SEQ ID NO: 3589043 - DNA, 22 bp, Homo sapiens
cttcattttattaatatttttc

SEQ ID NO: 3589044 - DNA, 12 bp, Homo sapiens
cttccacccagt

SEQ ID NO: 3589045 - DNA, 22 bp, Homo sapiens
cttccaggaaagtgtgaagacc

SEQ ID NO: 3589046 - DNA, 20 bp, Homo sapiens
cttccagggcagcggctcca

SEQ ID NO: 3589047 - DNA, 17 bp, Homo sapiens
cttccatgatgcacagt

SEQ ID NO: 3589048 - DNA, 18 bp, Homo sapiens
cttccatgatgcacagta

SEQ ID NO: 3589049 - DNA, 22 bp, Homo sapiens
cttccatgatgcacagtatctg

SEQ ID NO: 3589050 - DNA, 15 bp, Homo sapiens
cttccatgtcgcctc

SEQ ID NO: 3589051 - DNA, 17 bp, Homo sapiens
cttccatgtcgcctctg

SEQ ID NO: 3589052 - DNA, 22 bp, Homo sapiens
cttccatgtgcctttctttgcc

SEQ ID NO: 3589053 - DNA, 22 bp, Homo sapiens
cttcccacaactactagtgtga

SEQ ID NO: 3589054 - DNA, 12 bp, Homo sapiens
cttcccagggag

SEQ ID NO: 3589055 - DNA, 20 bp, Homo sapiens
cttcccagggagaaacccac

SEQ ID NO: 3589056 - DNA, 15 bp, Homo sapiens
cttcccatttctcta

SEQ ID NO: 3589057 - DNA, 22 bp, Homo sapiens
cttcccatttctctacactaag

SEQ ID NO: 3589058 - DNA, 14 bp, Homo sapiens
cttcccatttcttc

SEQ ID NO: 3589059 - DNA, 15 bp, Homo sapiens
cttccccaccctcag

SEQ ID NO: 3589060 - DNA, 13 bp, Homo sapiens
cttccccctcccc

SEQ ID NO: 3589061 - DNA, 12 bp, Homo sapiens
cttcccctaaac

SEQ ID NO: 3589062 - DNA, 15 bp, Homo sapiens
cttccccttagaaac

SEQ ID NO: 3589063 - DNA, 13 bp, Homo sapiens
cttcccgggcggg

SEQ ID NO: 3589064 - DNA, 17 bp, Homo sapiens
cttccctaaactgcagc

SEQ ID NO: 3589065 - DNA, 22 bp, Homo sapiens
cttccctaaactgcagcctctc

SEQ ID NO: 3589066 - DNA, 23 bp, Homo sapiens
cttccctggaagctctccgagct

SEQ ID NO: 3589067 - DNA, 12 bp, Homo sapiens
cttccctgggag

SEQ ID NO: 3589068 - DNA, 16 bp, Homo sapiens
cttccctgttctccct

SEQ ID NO: 3589069 - DNA, 19 bp, Homo sapiens
cttccctgttctccctttc

SEQ ID NO: 3589070 - DNA, 14 bp, Homo sapiens
cttccgctgagggg

SEQ ID NO: 3589071 - DNA, 22 bp, Homo sapiens
cttccgctgaggggtctcggat

SEQ ID NO: 3589072 - DNA, 19 bp, Homo sapiens
cttccgctttgaaagaagc

SEQ ID NO: 3589073 - DNA, 21 bp, Homo sapiens
cttccgctttgaaagaagcaa

SEQ ID NO: 3589074 - DNA, 22 bp, Homo sapiens
cttcctaccacccggtccccac

SEQ ID NO: 3589075 - DNA, 19 bp, Homo sapiens
cttcctcacacccctgtcc

SEQ ID NO: 3589076 - DNA, 15 bp, Homo sapiens
cttcctcagctgcct

SEQ ID NO: 3589077 - DNA, 19 bp, Homo sapiens
cttcctcagctgcctcctg

SEQ ID NO: 3589078 - DNA, 12 bp, Homo sapiens
cttcctccactt

SEQ ID NO: 3589079 - DNA, 13 bp, Homo sapiens
cttcctccctcat

SEQ ID NO: 3589080 - DNA, 15 bp, Homo sapiens
cttcctccctcattc

SEQ ID NO: 3589081 - DNA, 13 bp, Homo sapiens
cttcctcctccca

SEQ ID NO: 3589082 - DNA, 19 bp, Homo sapiens
cttcctctccactgccttc

SEQ ID NO: 3589083 - DNA, 16 bp, Homo sapiens
cttcctctccatacct

SEQ ID NO: 3589084 - DNA, 13 bp, Homo sapiens
cttcctctgctga

SEQ ID NO: 3589085 - DNA, 20 bp, Homo sapiens
cttcctctggctccccaagg

SEQ ID NO: 3589086 - DNA, 21 bp, Homo sapiens
cttcctctggtaaacattcct

SEQ ID NO: 3589087 - DNA, 13 bp, Homo sapiens
cttcctgctgcac

SEQ ID NO: 3589088 - DNA, 14 bp, Homo sapiens
cttcctgctgcacc

SEQ ID NO: 3589089 - DNA, 15 bp, Homo sapiens
cttcctgctgcaccc

SEQ ID NO: 3589090 - DNA, 22 bp, Homo sapiens
cttcctgctgctgctactgctg

SEQ ID NO: 3589091 - DNA, 22 bp, Homo sapiens
cttcctgggcacacgctgctct

SEQ ID NO: 3589092 - DNA, 23 bp, Homo sapiens
cttcctgggcacacgctgctctg

SEQ ID NO: 3589093 - DNA, 20 bp, Homo sapiens
cttcctggggcatctggcga

SEQ ID NO: 3589094 - DNA, 13 bp, Homo sapiens
cttcctgtgactt

SEQ ID NO: 3589095 - DNA, 12 bp, Homo sapiens
cttcctgtggat

SEQ ID NO: 3589096 - DNA, 23 bp, Homo sapiens
cttcctgtttcagacccccccat

SEQ ID NO: 3589097 - DNA, 23 bp, Homo sapiens
cttccttatgtatcagtgtcctt

SEQ ID NO: 3589098 - DNA, 19 bp, Homo sapiens
cttccttggactcatttta

SEQ ID NO: 3589099 - DNA, 20 bp, Homo sapiens
cttccttggactcattttaa

SEQ ID NO: 3589100 - DNA, 13 bp, Homo sapiens
cttccttggcttt

SEQ ID NO: 3589101 - DNA, 16 bp, Homo sapiens
cttcgatacaccgggc

SEQ ID NO: 3589102 - DNA, 13 bp, Homo sapiens
cttcgctggacta

SEQ ID NO: 3589103 - DNA, 16 bp, Homo sapiens
cttcgggctgtgcccg

SEQ ID NO: 3589104 - DNA, 16 bp, Homo sapiens
cttcggtacccaccac

SEQ ID NO: 3589105 - DNA, 15 bp, Homo sapiens
cttctaaaggtgttg

SEQ ID NO: 3589106 - DNA, 23 bp, Homo sapiens
cttctaaaggtgttgtcccttct

SEQ ID NO: 3589107 - DNA, 15 bp, Homo sapiens
cttctaaattcccaa

SEQ ID NO: 3589108 - DNA, 15 bp, Homo sapiens
cttctaacatgaaat

SEQ ID NO: 3589109 - DNA, 13 bp, Homo sapiens
cttctaagacttt

SEQ ID NO: 3589110 - DNA, 22 bp, Homo sapiens
cttctaagtaaaaccacagcag

SEQ ID NO: 3589111 - DNA, 17 bp, Homo sapiens
cttctacctcttggctg

SEQ ID NO: 3589112 - DNA, 15 bp, Homo sapiens
cttctactcccctta

SEQ ID NO: 3589113 - DNA, 15 bp, Homo sapiens
cttctactcctgcct

SEQ ID NO: 3589114 - DNA, 21 bp, Homo sapiens
cttctagggttattgcatttg

SEQ ID NO: 3589115 - DNA, 15 bp, Homo sapiens
cttctatacccaccc

SEQ ID NO: 3589116 - DNA, 13 bp, Homo sapiens
cttctatgtatta

SEQ ID NO: 3589117 - DNA, 18 bp, Homo sapiens
cttctattaatcaagaga

SEQ ID NO: 3589118 - DNA, 12 bp, Homo sapiens
cttctatttatt

SEQ ID NO: 3589119 - DNA, 22 bp, Homo sapiens
cttctatttatttatttattca

SEQ ID NO: 3589120 - DNA, 15 bp, Homo sapiens
cttctattttgtaaa

SEQ ID NO: 3589121 - DNA, 23 bp, Homo sapiens
cttctcaaagagaattgtatgta

SEQ ID NO: 3589122 - DNA, 18 bp, Homo sapiens
cttctcatcgaagggatt

SEQ ID NO: 3589123 - DNA, 14 bp, Homo sapiens
cttctccactggat

SEQ ID NO: 3589124 - DNA, 18 bp, Homo sapiens
cttctccctattccctct

SEQ ID NO: 3589125 - DNA, 13 bp, Homo sapiens
cttctctctccag

SEQ ID NO: 3589126 - DNA, 16 bp, Homo sapiens
cttctctctccagggt

SEQ ID NO: 3589127 - DNA, 12 bp, Homo sapiens
cttctctgcagt

SEQ ID NO: 3589128 - DNA, 13 bp, Homo sapiens
cttctctgcagta

SEQ ID NO: 3589129 - DNA, 22 bp, Homo sapiens
cttctctgcagtaaaacacatt

SEQ ID NO: 3589130 - DNA, 13 bp, Homo sapiens
cttctctgttggt

SEQ ID NO: 3589131 - DNA, 18 bp, Homo sapiens
cttctctgttggtctgcc

SEQ ID NO: 3589132 - DNA, 17 bp, Homo sapiens
cttctcttgctttctat

SEQ ID NO: 3589133 - DNA, 21 bp, Homo sapiens
cttctctttcttattttgtaa

SEQ ID NO: 3589134 - DNA, 16 bp, Homo sapiens
cttctgaagctgctgc

SEQ ID NO: 3589135 - DNA, 18 bp, Homo sapiens
cttctgaagtctgagccc

SEQ ID NO: 3589136 - DNA, 20 bp, Homo sapiens
cttctgaagtctgagcccat

SEQ ID NO: 3589137 - DNA, 16 bp, Homo sapiens
cttctgaataaagcaa

SEQ ID NO: 3589138 - DNA, 15 bp, Homo sapiens
cttctgaatatttta

SEQ ID NO: 3589139 - DNA, 16 bp, Homo sapiens
cttctgcaagcctcat

SEQ ID NO: 3589140 - DNA, 23 bp, Homo sapiens
cttctgcaagcctcatgccaacc

SEQ ID NO: 3589141 - DNA, 19 bp, Homo sapiens
cttctgctactggcaaaag

SEQ ID NO: 3589142 - DNA, 14 bp, Homo sapiens
cttctgctcttttc

SEQ ID NO: 3589143 - DNA, 18 bp, Homo sapiens
cttctgctcttttcctgg

SEQ ID NO: 3589144 - DNA, 19 bp, Homo sapiens
cttctggagatggaagctt

SEQ ID NO: 3589145 - DNA, 17 bp, Homo sapiens
cttctggcacttggaga

SEQ ID NO: 3589146 - DNA, 20 bp, Homo sapiens
cttctggccacatcagcccc

SEQ ID NO: 3589147 - DNA, 18 bp, Homo sapiens
cttctgggtccagggagg

SEQ ID NO: 3589148 - DNA, 19 bp, Homo sapiens
cttctgggtccagggaggg

SEQ ID NO: 3589149 - DNA, 13 bp, Homo sapiens
cttctgtggctca

SEQ ID NO: 3589150 - DNA, 15 bp, Homo sapiens
cttctgtggctcaca

SEQ ID NO: 3589151 - DNA, 22 bp, Homo sapiens
cttctgtggctcacagaaccct

SEQ ID NO: 3589152 - DNA, 18 bp, Homo sapiens
ctggagttgatctggaac

SEQ ID NO: 3589153 - DNA, 22 bp, Homo sapiens
ctggagttgatctggaacccag

SEQ ID NO: 3589154 - DNA, 13 bp, Homo sapiens
ctggatatttcaa

SEQ ID NO: 3589155 - DNA, 19 bp, Homo sapiens
ctggatccatcaggccact

SEQ ID NO: 3589156 - DNA, 16 bp, Homo sapiens
ctggatctatccctgc

SEQ ID NO: 3589157 - DNA, 19 bp, Homo sapiens
ctggatgagaaacagctca

SEQ ID NO: 3589158 - DNA, 22 bp, Homo sapiens
ctggatgagaaacagctcagcc

SEQ ID NO: 3589159 - DNA, 23 bp, Homo sapiens
ctggatgagaaacagctcagcca

SEQ ID NO: 3589160 - DNA, 16 bp, Homo sapiens
ctggatgctgttgagg

SEQ ID NO: 3589161 - DNA, 21 bp, Homo sapiens
ctggatgctgttgagggccaa

SEQ ID NO: 3589162 - DNA, 20 bp, Homo sapiens
ctggattataagttctattt

SEQ ID NO: 3589163 - DNA, 23 bp, Homo sapiens
ctggattataagttctattttac

SEQ ID NO: 3589164 - DNA, 21 bp, Homo sapiens
ctggcaaaaggatctttgtgg

SEQ ID NO: 3589165 - DNA, 23 bp, Homo sapiens
ctggcaaaaggatctttgtggcc

SEQ ID NO: 3589166 - DNA, 14 bp, Homo sapiens
ctggcaaatccagg

SEQ ID NO: 3589167 - DNA, 18 bp, Homo sapiens
ctggcaaatgcctgactc

SEQ ID NO: 3589168 - DNA, 16 bp, Homo sapiens
ctggcaaccagccagc

SEQ ID NO: 3589169 - DNA, 19 bp, Homo sapiens
ctggcaaccagccagcgtc

SEQ ID NO: 3589170 - DNA, 12 bp, Homo sapiens
ctggcacaaaag

SEQ ID NO: 3589171 - DNA, 19 bp, Homo sapiens
ctggcacaatgttggagca

SEQ ID NO: 3589172 - DNA, 16 bp, Homo sapiens
ctggcacagaccaggc

SEQ ID NO: 3589173 - DNA, 18 bp, Homo sapiens
ctggcacagaccaggcct

SEQ ID NO: 3589174 - DNA, 16 bp, Homo sapiens
ctggcacagggcagtg

SEQ ID NO: 3589175 - DNA, 19 bp, Homo sapiens
ctggcacagttttctgaga

SEQ ID NO: 3589176 - DNA, 22 bp, Homo sapiens
ctggcacagttttctgagaaag

SEQ ID NO: 3589177 - DNA, 14 bp, Homo sapiens
ctggcaccatcagc

SEQ ID NO: 3589178 - DNA, 13 bp, Homo sapiens
ctggcagccgtgc

SEQ ID NO: 3589179 - DNA, 18 bp, Homo sapiens
ctggcagccgtgccttca

SEQ ID NO: 3589180 - DNA, 15 bp, Homo sapiens
ctggcagggccacct

SEQ ID NO: 3589181 - DNA, 19 bp, Homo sapiens
ctggcagggccacctgcag

SEQ ID NO: 3589182 - DNA, 22 bp, Homo sapiens
ctggcatcaagggagacaccag

SEQ ID NO: 3589183 - DNA, 15 bp, Homo sapiens
ctggccacatcagcc

SEQ ID NO: 3589184 - DNA, 16 bp, Homo sapiens
ctggccacatcagccc

SEQ ID NO: 3589185 - DNA, 19 bp, Homo sapiens
ctggccacatcagccccac

SEQ ID NO: 3589186 - DNA, 22 bp, Homo sapiens
ctggccacatcagccccacagg

SEQ ID NO: 3589187 - DNA, 17 bp, Homo sapiens
ctggccactaaagcttc

SEQ ID NO: 3589188 - DNA, 15 bp, Homo sapiens
ctggccagacacagg

SEQ ID NO: 3589189 - DNA, 19 bp, Homo sapiens
ctggccagacacaggccct

SEQ ID NO: 3589190 - DNA, 21 bp, Homo sapiens
ctggccagacacaggccctcc

SEQ ID NO: 3589191 - DNA, 14 bp, Homo sapiens
ctggccaggcaggg

SEQ ID NO: 3589192 - DNA, 14 bp, Homo sapiens
ctggcccaccaggg

SEQ ID NO: 3589193 - DNA, 11 bp, Homo sapiens
ctggcccaggg

SEQ ID NO: 3589194 - DNA, 13 bp, Homo sapiens
ctggcccagggcc

SEQ ID NO: 3589195 - DNA, 17 bp, Homo sapiens
ctggcccagggcccaga

SEQ ID NO: 3589196 - DNA, 18 bp, Homo sapiens
ctggcccagggcccagag

SEQ ID NO: 3589197 - DNA, 12 bp, Homo sapiens
ctggcccagtgc

SEQ ID NO: 3589198 - DNA, 21 bp, Homo sapiens
ctggccccagtgcggttcctc

SEQ ID NO: 3589199 - DNA, 15 bp, Homo sapiens
ctggcccccagccct

SEQ ID NO: 3589200 - DNA, 24 bp, Homo sapiens
ctggccccgcccgtggcctcgtgc

SEQ ID NO: 3589201 - DNA, 13 bp, Homo sapiens
ctggccctggggg

SEQ ID NO: 3589202 - DNA, 13 bp, Homo sapiens
ctggccctgtgcc

SEQ ID NO: 3589203 - DNA, 15 bp, Homo sapiens
ctggcccttggggag

SEQ ID NO: 3589204 - DNA, 15 bp, Homo sapiens
ctggccgcctgcagc

SEQ ID NO: 3589205 - DNA, 14 bp, Homo sapiens
ctggcctcccacag

SEQ ID NO: 3589206 - DNA, 21 bp, Homo sapiens
ctggcctgaactgaggagatg

SEQ ID NO: 3589207 - DNA, 19 bp, Homo sapiens
ctggccttgggatccaggc

SEQ ID NO: 3589208 - DNA, 20 bp, Homo sapiens
ctggccttgggatccaggcc

SEQ ID NO: 3589209 - DNA, 19 bp, Homo sapiens
ctggcctttttcatttatc

SEQ ID NO: 3589210 - DNA, 18 bp, Homo sapiens
ctggcgacacactccgtc

SEQ ID NO: 3589211 - DNA, 19 bp, Homo sapiens
ctggcgccatcgccgggac

SEQ ID NO: 3589212 - DNA, 16 bp, Homo sapiens
ctggcgcccctgcctg

SEQ ID NO: 3589213 - DNA, 14 bp, Homo sapiens
ctggcggaggctgc

SEQ ID NO: 3589214 - DNA, 15 bp, Homo sapiens
ctggcggaggctgct

SEQ ID NO: 3589215 - DNA, 21 bp, Homo sapiens
ctggcggaggtctctgggagc

SEQ ID NO: 3589216 - DNA, 22 bp, Homo sapiens
ctggcggaggtctctgggagcc

SEQ ID NO: 3589217 - DNA, 18 bp, Homo sapiens
ctggcgtgctcagaccca

SEQ ID NO: 3589218 - DNA, 22 bp, Homo sapiens
ctggcgtgctcagacccaacag

SEQ ID NO: 3589219 - DNA, 14 bp, Homo sapiens
ctggctcactggca

SEQ ID NO: 3589220 - DNA, 15 bp, Homo sapiens
ctggctcactggcag

SEQ ID NO: 3589221 - DNA, 13 bp, Homo sapiens
ctggctcatctct

SEQ ID NO: 3589222 - DNA, 15 bp, Homo sapiens
ctggctccactcttg

SEQ ID NO: 3589223 - DNA, 18 bp, Homo sapiens
ctggctcccacaggccct

SEQ ID NO: 3589224 - DNA, 13 bp, Homo sapiens
ctggctccccaag

SEQ ID NO: 3589225 - DNA, 19 bp, Homo sapiens
ctggctccccaaggctgca

SEQ ID NO: 3589226 - DNA, 15 bp, Homo sapiens
ctggctctaattcac

SEQ ID NO: 3589227 - DNA, 18 bp, Homo sapiens
ctggctgagcccctgggg

SEQ ID NO: 3589228 - DNA, 13 bp, Homo sapiens
ctggctgcacagg

SEQ ID NO: 3589229 - DNA, 15 bp, Homo sapiens
ctggctgcacaggct

SEQ ID NO: 3589230 - DNA, 18 bp, Homo sapiens
ctggctggaaagcagagc

SEQ ID NO: 3589231 - DNA, 23 bp, Homo sapiens
ctggctggaaagcagagcctcct

SEQ ID NO: 3589232 - DNA, 15 bp, Homo sapiens
ctggctgggccttca

SEQ ID NO: 3589233 - DNA, 16 bp, Homo sapiens
ctggctgggccttcac

SEQ ID NO: 3589234 - DNA, 12 bp, Homo sapiens
ctggctgggtgg

SEQ ID NO: 3589235 - DNA, 19 bp, Homo sapiens
ctggcttcaaaaagccaca

SEQ ID NO: 3589236 - DNA, 22 bp, Homo sapiens
ctggcttcaaaaagccacagca

SEQ ID NO: 3589237 - DNA, 24 bp, Homo sapiens
ctggcttcaaaaagccacagcaga

SEQ ID NO: 3589238 - DNA, 17 bp, Homo sapiens
ctggcttccctaaactg

SEQ ID NO: 3589239 - DNA, 16 bp, Homo sapiens
ctggctttgcctcttc

SEQ ID NO: 3589240 - DNA, 15 bp, Homo sapiens
ctggcttttcactgc

SEQ ID NO: 3589241 - DNA, 17 bp, Homo sapiens
ctggcttttcactgctg

SEQ ID NO: 3589242 - DNA, 23 bp, Homo sapiens
ctggcttttcactgctggctgcc

SEQ ID NO: 3589243 - DNA, 13 bp, Homo sapiens
ctgggaacacagt

SEQ ID NO: 3589244 - DNA, 17 bp, Homo sapiens
ctgggaacacagttctg

SEQ ID NO: 3589245 - DNA, 19 bp, Homo sapiens
ctgggaacacatctggctg

SEQ ID NO: 3589246 - DNA, 15 bp, Homo sapiens
ctgggaacagaactc

SEQ ID NO: 3589247 - DNA, 18 bp, Homo sapiens
ctgggaaccactcccacc

SEQ ID NO: 3589248 - DNA, 13 bp, Homo sapiens
ctgggaagctccc

SEQ ID NO: 3589249 - DNA, 15 bp, Homo sapiens
ctgggaagctcccac

SEQ ID NO: 3589250 - DNA, 20 bp, Homo sapiens
ctgggaagctcccaccccac

SEQ ID NO: 3589251 - DNA, 19 bp, Homo sapiens
ctgggaaggccagccttgt

SEQ ID NO: 3589252 - DNA, 15 bp, Homo sapiens
ctgggacagctggct

SEQ ID NO: 3589253 - DNA, 20 bp, Homo sapiens
ctgggacagctggctgggcc

SEQ ID NO: 3589254 - DNA, 14 bp, Homo sapiens
ctgggacccacaga

SEQ ID NO: 3589255 - DNA, 16 bp, Homo sapiens
ctgggacccacagaac

SEQ ID NO: 3589256 - DNA, 13 bp, Homo sapiens
ctgggagcccaga

SEQ ID NO: 3589257 - DNA, 17 bp, Homo sapiens
ctgggagcccagaaccc

SEQ ID NO: 3589258 - DNA, 13 bp, Homo sapiens
ctgggagctctgc

SEQ ID NO: 3589259 - DNA, 11 bp, Homo sapiens
ctgggagcttc

SEQ ID NO: 3589260 - DNA, 22 bp, Homo sapiens
ctgggaggcagaggttgcagtg

SEQ ID NO: 3589261 - DNA, 18 bp, Homo sapiens
ctgggagttgctgttaat

SEQ ID NO: 3589262 - DNA, 18 bp, Homo sapiens
ctgggatatggctgccca

SEQ ID NO: 3589263 - DNA, 19 bp, Homo sapiens
ctgggatatggctgcccag

SEQ ID NO: 3589264 - DNA, 20 bp, Homo sapiens
ctgggatatggctgcccagg

SEQ ID NO: 3589265 - DNA, 21 bp, Homo sapiens
ctgggatatggctgcccagga

SEQ ID NO: 3589266 - DNA, 14 bp, Homo sapiens
ctgggattaagaaa

SEQ ID NO: 3589267 - DNA, 21 bp, Homo sapiens
ctgggattacaggcgtgagcc

SEQ ID NO: 3589268 - DNA, 22 bp, Homo sapiens
ctgggattggggggtgggcttt

SEQ ID NO: 3589269 - DNA, 16 bp, Homo sapiens
ctgggcaaagcccctc

SEQ ID NO: 3589270 - DNA, 20 bp, Homo sapiens
ctgggcaaagcccctcacac

SEQ ID NO: 3589271 - DNA, 21 bp, Homo sapiens
ctgggcaaagcccctcacact

SEQ ID NO: 3589272 - DNA, 15 bp, Homo sapiens
ctgggcacaaacaga

SEQ ID NO: 3589273 - DNA, 21 bp, Homo sapiens
ctgggcacacgctgctctgcc

SEQ ID NO: 3589274 - DNA, 15 bp, Homo sapiens
ctgggcagagggagg

SEQ ID NO: 3589275 - DNA, 19 bp, Homo sapiens
ctgggcatgggtccagggc

SEQ ID NO: 3589276 - DNA, 20 bp, Homo sapiens
ctgggcatgggtccagggcc

SEQ ID NO: 3589277 - DNA, 21 bp, Homo sapiens
ctgggcatgggtccagggcct

SEQ ID NO: 3589278 - DNA, 21 bp, Homo sapiens
ctgctccttggcacccccatg

SEQ ID NO: 3589279 - DNA, 22 bp, Homo sapiens
ctgctccttggcacccccatgc

SEQ ID NO: 3589280 - DNA, 13 bp, Homo sapiens
ctgctctataaat

SEQ ID NO: 3589281 - DNA, 17 bp, Homo sapiens
ctgctctcatataagac

SEQ ID NO: 3589282 - DNA, 13 bp, Homo sapiens
ctgctctgcccca

SEQ ID NO: 3589283 - DNA, 15 bp, Homo sapiens
ctgctctgccccagc

SEQ ID NO: 3589284 - DNA, 17 bp, Homo sapiens
ctgctctgccccagctt

SEQ ID NO: 3589285 - DNA, 23 bp, Homo sapiens
ctgctctggaataaagttgcaga

SEQ ID NO: 3589286 - DNA, 16 bp, Homo sapiens
ctgctgaatgcctcgc

SEQ ID NO: 3589287 - DNA, 16 bp, Homo sapiens
ctgctgaattcacctg

SEQ ID NO: 3589288 - DNA, 16 bp, Homo sapiens
ctgctgagttggcctg

SEQ ID NO: 3589289 - DNA, 20 bp, Homo sapiens
ctgctgagttggcctggcca

SEQ ID NO: 3589290 - DNA, 20 bp, Homo sapiens
ctgctgatactgggtctgcg

SEQ ID NO: 3589291 - DNA, 17 bp, Homo sapiens
ctgctgatatcaacagc

SEQ ID NO: 3589292 - DNA, 18 bp, Homo sapiens
ctgctgatatcaacagct

SEQ ID NO: 3589293 - DNA, 11 bp, Homo sapiens
ctgctgcaccc

SEQ ID NO: 3589294 - DNA, 14 bp, Homo sapiens
ctgctgcaccctgc

SEQ ID NO: 3589295 - DNA, 22 bp, Homo sapiens
ctgctgcagctccctcctcagg

SEQ ID NO: 3589296 - DNA, 11 bp, Homo sapiens
ctgctgcaggg

SEQ ID NO: 3589297 - DNA, 14 bp, Homo sapiens
ctgctgccagcaca

SEQ ID NO: 3589298 - DNA, 15 bp, Homo sapiens
ctgctgccagcacag

SEQ ID NO: 3589299 - DNA, 16 bp, Homo sapiens
ctgctgccagcacagt

SEQ ID NO: 3589300 - DNA, 18 bp, Homo sapiens
ctgctgccggctctgggc

SEQ ID NO: 3589301 - DNA, 23 bp, Homo sapiens
ctgctgccggctctgggcctgag

SEQ ID NO: 3589302 - DNA, 16 bp, Homo sapiens
ctgctgcgctgcttgg

SEQ ID NO: 3589303 - DNA, 18 bp, Homo sapiens
ctgctgctcctctcttgg

SEQ ID NO: 3589304 - DNA, 19 bp, Homo sapiens
ctgctgctgccagggcttc

SEQ ID NO: 3589305 - DNA, 17 bp, Homo sapiens
ctgctggagtccagtgc

SEQ ID NO: 3589306 - DNA, 19 bp, Homo sapiens
ctgctggagtccagtgctt

SEQ ID NO: 3589307 - DNA, 15 bp, Homo sapiens
ctgctggccggagca

SEQ ID NO: 3589308 - DNA, 16 bp, Homo sapiens
ctgctggccggagcaa

SEQ ID NO: 3589309 - DNA, 13 bp, Homo sapiens
ctgctggctgcct

SEQ ID NO: 3589310 - DNA, 13 bp, Homo sapiens
ctgctgggctctg

SEQ ID NO: 3589311 - DNA, 14 bp, Homo sapiens
ctgctggggaagac

SEQ ID NO: 3589312 - DNA, 17 bp, Homo sapiens
ctgctggggaagacagt

SEQ ID NO: 3589313 - DNA, 21 bp, Homo sapiens
ctgctggggaagacagtggcc

SEQ ID NO: 3589314 - DNA, 18 bp, Homo sapiens
ctgctggtacctgccctc

SEQ ID NO: 3589315 - DNA, 21 bp, Homo sapiens
ctgctggtacctgccctctat

SEQ ID NO: 3589316 - DNA, 19 bp, Homo sapiens
ctgctgtcttttctttgcc

SEQ ID NO: 3589317 - DNA, 17 bp, Homo sapiens
ctgctgtgccatgctgg

SEQ ID NO: 3589318 - DNA, 16 bp, Homo sapiens
ctgctgtgctgctcaa

SEQ ID NO: 3589319 - DNA, 16 bp, Homo sapiens
ctgctgtggagtgagg

SEQ ID NO: 3589320 - DNA, 17 bp, Homo sapiens
ctgctgttcttcagtcc

SEQ ID NO: 3589321 - DNA, 21 bp, Homo sapiens
ctgctgttcttcagtcctttg

SEQ ID NO: 3589322 - DNA, 17 bp, Homo sapiens
ctgcttaaactggaaag

SEQ ID NO: 3589323 - DNA, 19 bp, Homo sapiens
ctgcttcagtgtatggaaa

SEQ ID NO: 3589324 - DNA, 21 bp, Homo sapiens
ctgcttcagtgtatggaaata

SEQ ID NO: 3589325 - DNA, 15 bp, Homo sapiens
ctgcttcccacaact

SEQ ID NO: 3589326 - DNA, 18 bp, Homo sapiens
ctgcttcttctctccaca

SEQ ID NO: 3589327 - DNA, 22 bp, Homo sapiens
ctgcttgtcctgggcctgcccc

SEQ ID NO: 3589328 - DNA, 19 bp, Homo sapiens
ctgctttaaaaatgtctta

SEQ ID NO: 3589329 - DNA, 14 bp, Homo sapiens
ctgctttgcatctt

SEQ ID NO: 3589330 - DNA, 24 bp, Homo sapiens
ctgctttggatagtctcctacgca

SEQ ID NO: 3589331 - DNA, 16 bp, Homo sapiens
ctgctttgggctgccc

SEQ ID NO: 3589332 - DNA, 22 bp, Homo sapiens
ctgcttttatgtagtttaggct

SEQ ID NO: 3589333 - DNA, 12 bp, Homo sapiens
ctgcttttcaat

SEQ ID NO: 3589334 - DNA, 13 bp, Homo sapiens
ctgcttttctgtc

SEQ ID NO: 3589335 - DNA, 17 bp, Homo sapiens
ctgcttttctgtcctgg

SEQ ID NO: 3589336 - DNA, 18 bp, Homo sapiens
ctgcttttctgtcctggg

SEQ ID NO: 3589337 - DNA, 20 bp, Homo sapiens
ctgcttttgggggtcagcat

SEQ ID NO: 3589338 - DNA, 16 bp, Homo sapiens
ctggaaacagcatgaa

SEQ ID NO: 3589339 - DNA, 17 bp, Homo sapiens
ctggaaaccttccaccc

SEQ ID NO: 3589340 - DNA, 20 bp, Homo sapiens
ctggaaaccttccacccagt

SEQ ID NO: 3589341 - DNA, 20 bp, Homo sapiens
ctggaaagcacaagactggc

SEQ ID NO: 3589342 - DNA, 22 bp, Homo sapiens
ctggaaagcagagcctcctggg

SEQ ID NO: 3589343 - DNA, 20 bp, Homo sapiens
ctggaaagttgggcccctga

SEQ ID NO: 3589344 - DNA, 17 bp, Homo sapiens
ctggaaccacattgaag

SEQ ID NO: 3589345 - DNA, 13 bp, Homo sapiens
ctggaacccagac

SEQ ID NO: 3589346 - DNA, 14 bp, Homo sapiens
ctggaacccagact

SEQ ID NO: 3589347 - DNA, 17 bp, Homo sapiens
ctggaacctcagcctgg

SEQ ID NO: 3589348 - DNA, 23 bp, Homo sapiens
ctggaacctcagcctggccagac

SEQ ID NO: 3589349 - DNA, 23 bp, Homo sapiens
ctggaagctctccgagctctggt

SEQ ID NO: 3589350 - DNA, 18 bp, Homo sapiens
ctggaataaagttgcaga

SEQ ID NO: 3589351 - DNA, 17 bp, Homo sapiens
ctggaattcttctgcaa

SEQ ID NO: 3589352 - DNA, 22 bp, Homo sapiens
ctggacaatgtccaaacccact

SEQ ID NO: 3589353 - DNA, 22 bp, Homo sapiens
ctggacacaataggtctttctc

SEQ ID NO: 3589354 - DNA, 11 bp, Homo sapiens
ctggacacagc

SEQ ID NO: 3589355 - DNA, 12 bp, Homo sapiens
ctggacacagct

SEQ ID NO: 3589356 - DNA, 17 bp, Homo sapiens
ctggacacagctcttca

SEQ ID NO: 3589357 - DNA, 20 bp, Homo sapiens
ctggacacttcacgcccttg

SEQ ID NO: 3589358 - DNA, 13 bp, Homo sapiens
ctggacagcccca

SEQ ID NO: 3589359 - DNA, 14 bp, Homo sapiens
ctggacagccccac

SEQ ID NO: 3589360 - DNA, 16 bp, Homo sapiens
ctggacagccccaccc

SEQ ID NO: 3589361 - DNA, 18 bp, Homo sapiens
ctggacagccccaccctg

SEQ ID NO: 3589362 - DNA, 18 bp, Homo sapiens
ctggacagtacctgattg

SEQ ID NO: 3589363 - DNA, 20 bp, Homo sapiens
ctggacagtacctgattgta

SEQ ID NO: 3589364 - DNA, 17 bp, Homo sapiens
ctggacataacattttc

SEQ ID NO: 3589365 - DNA, 14 bp, Homo sapiens
ctggacggaagtgg

SEQ ID NO: 3589366 - DNA, 14 bp, Homo sapiens
ctggactcctctgt

SEQ ID NO: 3589367 - DNA, 23 bp, Homo sapiens
ctggactcctctgtccaggcact

SEQ ID NO: 3589368 - DNA, 24 bp, Homo sapiens
ctggactcctgccaccagcatcca

SEQ ID NO: 3589369 - DNA, 13 bp, Homo sapiens
ctggagaaagagc

SEQ ID NO: 3589370 - DNA, 14 bp, Homo sapiens
ctggagaaagagct

SEQ ID NO: 3589371 - DNA, 22 bp, Homo sapiens
ctggagaaagagctgcctggat

SEQ ID NO: 3589372 - DNA, 14 bp, Homo sapiens
ctggagaacagtgg

SEQ ID NO: 3589373 - DNA, 21 bp, Homo sapiens
ctggagaacagtggttgcctg

SEQ ID NO: 3589374 - DNA, 14 bp, Homo sapiens
ctggagaaggcctg

SEQ ID NO: 3589375 - DNA, 16 bp, Homo sapiens
ctggagaaggcctgga

SEQ ID NO: 3589376 - DNA, 17 bp, Homo sapiens
ctggagaaggcctggaa

SEQ ID NO: 3589377 - DNA, 18 bp, Homo sapiens
ctggagaaggcctggaag

SEQ ID NO: 3589378 - DNA, 19 bp, Homo sapiens
ctggagaaggcctggaaga

SEQ ID NO: 3589379 - DNA, 21 bp, Homo sapiens
ctggagaaggcctggaagagc

SEQ ID NO: 3589380 - DNA, 18 bp, Homo sapiens
ctggagacaaggtgctaa

SEQ ID NO: 3589381 - DNA, 14 bp, Homo sapiens
ctggagacttcctc

SEQ ID NO: 3589382 - DNA, 22 bp, Homo sapiens
ctggagatactggtggaagttc

SEQ ID NO: 3589383 - DNA, 13 bp, Homo sapiens
ctggagatatgaa

SEQ ID NO: 3589384 - DNA, 22 bp, Homo sapiens
ctggagcagaggaggggaaagt

SEQ ID NO: 3589385 - DNA, 13 bp, Homo sapiens
ctggagcaggccc

SEQ ID NO: 3589386 - DNA, 24 bp, Homo sapiens
ctggagcaggcccaatgctgcttt

SEQ ID NO: 3589387 - DNA, 17 bp, Homo sapiens
ctggagcttcagccagg

SEQ ID NO: 3589388 - DNA, 19 bp, Homo sapiens
ctggagcttcagccaggtc

SEQ ID NO: 3589389 - DNA, 14 bp, Homo sapiens
ctggaggaggcctg

SEQ ID NO: 3589390 - DNA, 15 bp, Homo sapiens
ctggaggaggcctgt

SEQ ID NO: 3589391 - DNA, 19 bp, Homo sapiens
ctcagcctgctttcctgca

SEQ ID NO: 3589392 - DNA, 21 bp, Homo sapiens
ctcagcctgctttcctgcagc

SEQ ID NO: 3589393 - DNA, 13 bp, Homo sapiens
ctcagcctggcca

SEQ ID NO: 3589394 - DNA, 15 bp, Homo sapiens
ctcagcctggccaga

SEQ ID NO: 3589395 - DNA, 16 bp, Homo sapiens
ctcagcctggccagac

SEQ ID NO: 3589396 - DNA, 18 bp, Homo sapiens
ctcagccttgccagagat

SEQ ID NO: 3589397 - DNA, 19 bp, Homo sapiens
ctcagccttgccagagatc

SEQ ID NO: 3589398 - DNA, 15 bp, Homo sapiens
ctcagctcccaaggc

SEQ ID NO: 3589399 - DNA, 12 bp, Homo sapiens
ctcagctccctg

SEQ ID NO: 3589400 - DNA, 21 bp, Homo sapiens
ctcagctccctgcctgtttcc

SEQ ID NO: 3589401 - DNA, 18 bp, Homo sapiens
ctcagctcttggctccac

SEQ ID NO: 3589402 - DNA, 19 bp, Homo sapiens
ctcagctgcctcctgcgcc

SEQ ID NO: 3589403 - DNA, 20 bp, Homo sapiens
ctcagctgcctcctgcgccc

SEQ ID NO: 3589404 - DNA, 19 bp, Homo sapiens
ctcagctgtcaaggctcag

SEQ ID NO: 3589405 - DNA, 14 bp, Homo sapiens
ctcagctgtgcctt

SEQ ID NO: 3589406 - DNA, 19 bp, Homo sapiens
ctcagctgtgccttccctt

SEQ ID NO: 3589407 - DNA, 20 bp, Homo sapiens
ctcagcttcttcacaggcac

SEQ ID NO: 3589408 - DNA, 14 bp, Homo sapiens
ctcaggaattcagt

SEQ ID NO: 3589409 - DNA, 21 bp, Homo sapiens
ctcaggaattcagtgccttca

SEQ ID NO: 3589410 - DNA, 12 bp, Homo sapiens
ctcaggaccagg

SEQ ID NO: 3589411 - DNA, 12 bp, Homo sapiens
ctcaggacccat

SEQ ID NO: 3589412 - DNA, 23 bp, Homo sapiens
ctcaggacccatccctgcctgga

SEQ ID NO: 3589413 - DNA, 12 bp, Homo sapiens
ctcaggagaagc

SEQ ID NO: 3589414 - DNA, 23 bp, Homo sapiens
ctcaggagaattcatgtctgcct

SEQ ID NO: 3589415 - DNA, 16 bp, Homo sapiens
ctcaggagatggaggg

SEQ ID NO: 3589416 - DNA, 22 bp, Homo sapiens
ctcaggagatggagggcttggc

SEQ ID NO: 3589417 - DNA, 16 bp, Homo sapiens
ctcaggaggcaggacc

SEQ ID NO: 3589418 - DNA, 18 bp, Homo sapiens
ctcaggaggcaggacctt

SEQ ID NO: 3589419 - DNA, 18 bp, Homo sapiens
ctcaggaggctgaggcag

SEQ ID NO: 3589420 - DNA, 20 bp, Homo sapiens
ctcaggaggctgaggcagga

SEQ ID NO: 3589421 - DNA, 15 bp, Homo sapiens
ctcaggcacaccttg

SEQ ID NO: 3589422 - DNA, 17 bp, Homo sapiens
ctcaggcacaccttgca

SEQ ID NO: 3589423 - DNA, 16 bp, Homo sapiens
ctcagggaactgaccc

SEQ ID NO: 3589424 - DNA, 21 bp, Homo sapiens
ctcagggaactgaccctcagg

SEQ ID NO: 3589425 - DNA, 22 bp, Homo sapiens
ctcagggaactgaccctcaggc

SEQ ID NO: 3589426 - DNA, 20 bp, Homo sapiens
ctcagggaccggtgctgcag

SEQ ID NO: 3589427 - DNA, 22 bp, Homo sapiens
ctcagggaccggtgctgcagga

SEQ ID NO: 3589428 - DNA, 23 bp, Homo sapiens
ctcagggaccggtgctgcaggag

SEQ ID NO: 3589429 - DNA, 22 bp, Homo sapiens
ctcagggcagtggcttctttcc

SEQ ID NO: 3589430 - DNA, 10 bp, Homo sapiens
ctcagggctg

SEQ ID NO: 3589431 - DNA, 12 bp, Homo sapiens
ctcagggctgga

SEQ ID NO: 3589432 - DNA, 12 bp, Homo sapiens
ctcaggggaccc

SEQ ID NO: 3589433 - DNA, 13 bp, Homo sapiens
ctcaggggacccc

SEQ ID NO: 3589434 - DNA, 22 bp, Homo sapiens
ctcaggggaccccactcccctc

SEQ ID NO: 3589435 - DNA, 14 bp, Homo sapiens
ctcaggggcctgga

SEQ ID NO: 3589436 - DNA, 17 bp, Homo sapiens
ctcaggtccctgcaggg

SEQ ID NO: 3589437 - DNA, 19 bp, Homo sapiens
ctcagtctctcttctctcc

SEQ ID NO: 3589438 - DNA, 14 bp, Homo sapiens
ctcagtgaccagtg

SEQ ID NO: 3589439 - DNA, 23 bp, Homo sapiens
ctcagtggatcttcagaactgcc

SEQ ID NO: 3589440 - DNA, 18 bp, Homo sapiens
ctcagtggggctggcatc

SEQ ID NO: 3589441 - DNA, 14 bp, Homo sapiens
ctcataaattggcc

SEQ ID NO: 3589442 - DNA, 21 bp, Homo sapiens
ctcatccgaagatggtggcca

SEQ ID NO: 3589443 - DNA, 20 bp, Homo sapiens
ctcatctgagaggctctccg

SEQ ID NO: 3589444 - DNA, 20 bp, Homo sapiens
ctcatcttggccctcctcag

SEQ ID NO: 3589445 - DNA, 16 bp, Homo sapiens
ctcatgagtgtgcccc

SEQ ID NO: 3589446 - DNA, 18 bp, Homo sapiens
ctcatgagtgtgccccat

SEQ ID NO: 3589447 - DNA, 23 bp, Homo sapiens
ctcatgatagaaggctatgggga

SEQ ID NO: 3589448 - DNA, 18 bp, Homo sapiens
ctcatgcgtacgtcccac

SEQ ID NO: 3589449 - DNA, 21 bp, Homo sapiens
ctcatgtacttttaaattata

SEQ ID NO: 3589450 - DNA, 20 bp, Homo sapiens
ctcatgttttcaactgccaa

SEQ ID NO: 3589451 - DNA, 13 bp, Homo sapiens
ctcattaaaaaaa

SEQ ID NO: 3589452 - DNA, 18 bp, Homo sapiens
ctcattatgccacttcct

SEQ ID NO: 3589453 - DNA, 22 bp, Homo sapiens
ctcattcagaagatgcttagct

SEQ ID NO: 3589454 - DNA, 18 bp, Homo sapiens
ctcattccataaatgtcg

SEQ ID NO: 3589455 - DNA, 17 bp, Homo sapiens
ctgccagtccccctgcc

SEQ ID NO: 3589456 - DNA, 20 bp, Homo sapiens
ctgccagtccccctgcccca

SEQ ID NO: 3589457 - DNA, 21 bp, Homo sapiens
ctgccagtccccctgccccag

SEQ ID NO: 3589458 - DNA, 19 bp, Homo sapiens
ctgccagtgaagtccttca

SEQ ID NO: 3589459 - DNA, 14 bp, Homo sapiens
ctgccagtgcagcc

SEQ ID NO: 3589460 - DNA, 18 bp, Homo sapiens
ctgccagtgcagccactg

SEQ ID NO: 3589461 - DNA, 19 bp, Homo sapiens
ctgccagtgcagccactgg

SEQ ID NO: 3589462 - DNA, 22 bp, Homo sapiens
ctgccatcatgtttacagagga

SEQ ID NO: 3589463 - DNA, 23 bp, Homo sapiens
ctgccatgccagtaactgtgctg

SEQ ID NO: 3589464 - DNA, 15 bp, Homo sapiens
ctgccatttcccttc

SEQ ID NO: 3589465 - DNA, 23 bp, Homo sapiens
ctgccatttcccttctggacact

SEQ ID NO: 3589466 - DNA, 17 bp, Homo sapiens
ctgcccacctggctgcc

SEQ ID NO: 3589467 - DNA, 16 bp, Homo sapiens
ctgcccactggccggc

SEQ ID NO: 3589468 - DNA, 17 bp, Homo sapiens
ctgcccagcctccaagc

SEQ ID NO: 3589469 - DNA, 17 bp, Homo sapiens
ctgcccaggcctgcctg

SEQ ID NO: 3589470 - DNA, 19 bp, Homo sapiens
ctgcccagtcgaccccaaa

SEQ ID NO: 3589471 - DNA, 14 bp, Homo sapiens
ctgccccaccccac

SEQ ID NO: 3589472 - DNA, 14 bp, Homo sapiens
ctgccccaccccat

SEQ ID NO: 3589473 - DNA, 14 bp, Homo sapiens
ctgccccagcctgt

SEQ ID NO: 3589474 - DNA, 18 bp, Homo sapiens
ctgccccagcctgtcctt

SEQ ID NO: 3589475 - DNA, 19 bp, Homo sapiens
ctgccccagcttgggcaga

SEQ ID NO: 3589476 - DNA, 15 bp, Homo sapiens
ctgcccccagaaagc

SEQ ID NO: 3589477 - DNA, 22 bp, Homo sapiens
ctgcccccagaaagcctcctgc

SEQ ID NO: 3589478 - DNA, 17 bp, Homo sapiens
ctgccccccctaagaga

SEQ ID NO: 3589479 - DNA, 22 bp, Homo sapiens
ctgcccccgctcccgctcccag

SEQ ID NO: 3589480 - DNA, 21 bp, Homo sapiens
ctgccccctcccccatgggct

SEQ ID NO: 3589481 - DNA, 22 bp, Homo sapiens
ctgccccctcccccatgggctg

SEQ ID NO: 3589482 - DNA, 14 bp, Homo sapiens
ctgccccctctttg

SEQ ID NO: 3589483 - DNA, 22 bp, Homo sapiens
ctgccccctctttgtagctcct

SEQ ID NO: 3589484 - DNA, 12 bp, Homo sapiens
ctgccccctgcc

SEQ ID NO: 3589485 - DNA, 15 bp, Homo sapiens
ctgccccctgccagt

SEQ ID NO: 3589486 - DNA, 12 bp, Homo sapiens
ctgccccctggg

SEQ ID NO: 3589487 - DNA, 14 bp, Homo sapiens
ctgccccctgggct

SEQ ID NO: 3589488 - DNA, 15 bp, Homo sapiens
ctgccccctgggctg

SEQ ID NO: 3589489 - DNA, 21 bp, Homo sapiens
ctgccccctgggctggggcct

SEQ ID NO: 3589490 - DNA, 17 bp, Homo sapiens
ctgccccggcctcctcg

SEQ ID NO: 3589491 - DNA, 20 bp, Homo sapiens
ctgcccctgctgtgctgctc

SEQ ID NO: 3589492 - DNA, 17 bp, Homo sapiens
ctgcccctgtctggaag

SEQ ID NO: 3589493 - DNA, 18 bp, Homo sapiens
ctgcccctgtctggaaga

SEQ ID NO: 3589494 - DNA, 17 bp, Homo sapiens
ctgccctaagcccccag

SEQ ID NO: 3589495 - DNA, 20 bp, Homo sapiens
ctgccctaagcccccagggc

SEQ ID NO: 3589496 - DNA, 12 bp, Homo sapiens
ctgccctagctg

SEQ ID NO: 3589497 - DNA, 20 bp, Homo sapiens
ctgccctagctgaccccgag

SEQ ID NO: 3589498 - DNA, 12 bp, Homo sapiens
ctgccctgccca

SEQ ID NO: 3589499 - DNA, 14 bp, Homo sapiens
ctgccctgccccac

SEQ ID NO: 3589500 - DNA, 23 bp, Homo sapiens
ctgccctgccccaccccacctca

SEQ ID NO: 3589501 - DNA, 12 bp, Homo sapiens
ctgccctgggct

SEQ ID NO: 3589502 - DNA, 19 bp, Homo sapiens
ctgccctgggctcctctta

SEQ ID NO: 3589503 - DNA, 23 bp, Homo sapiens
ctgccctgggctcctcttagctc

SEQ ID NO: 3589504 - DNA, 15 bp, Homo sapiens
ctgccctggtgctgc

SEQ ID NO: 3589505 - DNA, 20 bp, Homo sapiens
ctgccctgtgatatgtctgc

SEQ ID NO: 3589506 - DNA, 22 bp, Homo sapiens
ctgccctgtgatatgtctgctg

SEQ ID NO: 3589507 - DNA, 14 bp, Homo sapiens
ctgcccttgctgcc

SEQ ID NO: 3589508 - DNA, 16 bp, Homo sapiens
ctgcccttgctgcccg

SEQ ID NO: 3589509 - DNA, 20 bp, Homo sapiens
ctgcccttgggtccccccga

SEQ ID NO: 3589510 - DNA, 16 bp, Homo sapiens
ctgccggtcgggcagc

SEQ ID NO: 3589511 - DNA, 21 bp, Homo sapiens
ctgccggtcgggcagccagca

SEQ ID NO: 3589512 - DNA, 22 bp, Homo sapiens
ctgccggtcgggcagccagcag

SEQ ID NO: 3589513 - DNA, 18 bp, Homo sapiens
ctgccggttccgcccgcc

SEQ ID NO: 3589514 - DNA, 20 bp, Homo sapiens
ctgccgtcacccactctgca

SEQ ID NO: 3589515 - DNA, 23 bp, Homo sapiens
ctgccgtcacccactctgcactg

SEQ ID NO: 3589516 - DNA, 17 bp, Homo sapiens
ctgcctattatctgtca

SEQ ID NO: 3589517 - DNA, 13 bp, Homo sapiens
ctgcctcaggacc

SEQ ID NO: 3589518 - DNA, 23 bp, Homo sapiens
ctgcctcaggaggcaggaccttc

SEQ ID NO: 3589519 - DNA, 13 bp, Homo sapiens
ctgcctcaggcca

SEQ ID NO: 3589520 - DNA, 15 bp, Homo sapiens
ctgcctcaggccaag

SEQ ID NO: 3589521 - DNA, 14 bp, Homo sapiens
ctgcctccaccagc

SEQ ID NO: 3589522 - DNA, 17 bp, Homo sapiens
ctgcctccaccagcaag

SEQ ID NO: 3589523 - DNA, 18 bp, Homo sapiens
ctgcctccaccagcaagg

SEQ ID NO: 3589524 - DNA, 14 bp, Homo sapiens
ctgcctccagaatg

SEQ ID NO: 3589525 - DNA, 14 bp, Homo sapiens
ctgcctctccctgg

SEQ ID NO: 3589526 - DNA, 16 bp, Homo sapiens
ctgcctctccctgggt

SEQ ID NO: 3589527 - DNA, 17 bp, Homo sapiens
ctgcctctccctgggtc

SEQ ID NO: 3589528 - DNA, 16 bp, Homo sapiens
ctgcctgcagcaggca

SEQ ID NO: 3589529 - DNA, 15 bp, Homo sapiens
ctgcctgcatgagct

SEQ ID NO: 3589530 - DNA, 22 bp, Homo sapiens
ctgcctgcatgagctggcaacc

SEQ ID NO: 3589531 - DNA, 16 bp, Homo sapiens
ctgcctgccagctgca

SEQ ID NO: 3589532 - DNA, 21 bp, Homo sapiens
ctgcctgccagctgcactgat

SEQ ID NO: 3589533 - DNA, 17 bp, Homo sapiens
ctgcctgctgtgctggg

SEQ ID NO: 3589534 - DNA, 18 bp, Homo sapiens
ctgcctggactagaggga

SEQ ID NO: 3589535 - DNA, 14 bp, Homo sapiens
ctgcctggaggcaa

SEQ ID NO: 3589536 - DNA, 20 bp, Homo sapiens
ctgcctggaggcaaaggcct

SEQ ID NO: 3589537 - DNA, 14 bp, Homo sapiens
ctgcctggaggctc

SEQ ID NO: 3589538 - DNA, 22 bp, Homo sapiens
ctgcctggaggctcctctaggc

SEQ ID NO: 3589539 - DNA, 18 bp, Homo sapiens
ctgcctggatgagaaaca

SEQ ID NO: 3589540 - DNA, 19 bp, Homo sapiens
ctgcctggatgagaaacag

SEQ ID NO: 3589541 - DNA, 22 bp, Homo sapiens
ctgcctgggcccggaagggctt

SEQ ID NO: 3589542 - DNA, 15 bp, Homo sapiens
ctgcctgttcccatt

SEQ ID NO: 3589543 - DNA, 16 bp, Homo sapiens
ctgcctgttggcaggc

SEQ ID NO: 3589544 - DNA, 22 bp, Homo sapiens
ctgccttaatgacattcccctc

SEQ ID NO: 3589545 - DNA, 20 bp, Homo sapiens
ctgccttcggtacccaccac

SEQ ID NO: 3589546 - DNA, 15 bp, Homo sapiens
ctgccttctgctgaa

SEQ ID NO: 3589547 - DNA, 18 bp, Homo sapiens
ctgccttgtttaatgtta

SEQ ID NO: 3589548 - DNA, 23 bp, Homo sapiens
ctgcgagacgcacacagctgagc

SEQ ID NO: 3589549 - DNA, 19 bp, Homo sapiens
ctgcgccgccgccggagtc

SEQ ID NO: 3589550 - DNA, 15 bp, Homo sapiens
ctgcgcctccagagg

SEQ ID NO: 3589551 - DNA, 17 bp, Homo sapiens
ctgcgcctccagaggtc

SEQ ID NO: 3589552 - DNA, 16 bp, Homo sapiens
ctgcgctgcttggtgt

SEQ ID NO: 3589553 - DNA, 19 bp, Homo sapiens
ctgcggggcgggcacacct

SEQ ID NO: 3589554 - DNA, 18 bp, Homo sapiens
ctgcgtcggtcctggtgc

SEQ ID NO: 3589555 - DNA, 22 bp, Homo sapiens
ctgctaagtaatttagaagata

SEQ ID NO: 3589556 - DNA, 17 bp, Homo sapiens
ctgctaagtcattggca

SEQ ID NO: 3589557 - DNA, 14 bp, Homo sapiens
ctgctacctgttct

SEQ ID NO: 3589558 - DNA, 12 bp, Homo sapiens
cgaccacctgcc

SEQ ID NO: 3589559 - DNA, 14 bp, Homo sapiens
cgaccgggccaggc

SEQ ID NO: 3589560 - DNA, 17 bp, Homo sapiens
cgacctgtcctgtcttt

SEQ ID NO: 3589561 - DNA, 18 bp, Homo sapiens
cgacctgtcctgtctttg

SEQ ID NO: 3589562 - DNA, 11 bp, Homo sapiens
cgactcaggga

SEQ ID NO: 3589563 - DNA, 13 bp, Homo sapiens
cgactcagggacc

SEQ ID NO: 3589564 - DNA, 17 bp, Homo sapiens
cgactgaaaatattgtt

SEQ ID NO: 3589565 - DNA, 13 bp, Homo sapiens
cgactgcccctgc

SEQ ID NO: 3589566 - DNA, 17 bp, Homo sapiens
cgactgcccctgctgtg

SEQ ID NO: 3589567 - DNA, 12 bp, Homo sapiens
cgactggtccag

SEQ ID NO: 3589568 - DNA, 19 bp, Homo sapiens
cgactggtccagctctgac

SEQ ID NO: 3589569 - DNA, 12 bp, Homo sapiens
cgacttcaggtc

SEQ ID NO: 3589570 - DNA, 15 bp, Homo sapiens
cgagaaccctgagca

SEQ ID NO: 3589571 - DNA, 22 bp, Homo sapiens
cgagaaccctgagcagggtcca

SEQ ID NO: 3589572 - DNA, 23 bp, Homo sapiens
cgagaagtgctcttggctgaccc

SEQ ID NO: 3589573 - DNA, 21 bp, Homo sapiens
cgagacgcacacagctgagca

SEQ ID NO: 3589574 - DNA, 17 bp, Homo sapiens
cgagcagcccagggcct

SEQ ID NO: 3589575 - DNA, 19 bp, Homo sapiens
cgagcagcccagggcctag

SEQ ID NO: 3589576 - DNA, 18 bp, Homo sapiens
cgagccaccatgcttgcc

SEQ ID NO: 3589577 - DNA, 19 bp, Homo sapiens
cgagccctggagagcccca

SEQ ID NO: 3589578 - DNA, 15 bp, Homo sapiens
cgaggaaaggatttt

SEQ ID NO: 3589579 - DNA, 23 bp, Homo sapiens
cgaggaaaggattttaccaaagc

SEQ ID NO: 3589580 - DNA, 22 bp, Homo sapiens
cgaggacatttgtgggcaagca

SEQ ID NO: 3589581 - DNA, 17 bp, Homo sapiens
cgaggccacattgctgg

SEQ ID NO: 3589582 - DNA, 22 bp, Homo sapiens
cgaggccacattgctggctgcc

SEQ ID NO: 3589583 - DNA, 12 bp, Homo sapiens
cgaggggcaggg

SEQ ID NO: 3589584 - DNA, 23 bp, Homo sapiens
cgaggtcactctgggcctgggga

SEQ ID NO: 3589585 - DNA, 17 bp, Homo sapiens
cgaggttcccagggctg

SEQ ID NO: 3589586 - DNA, 13 bp, Homo sapiens
cgaggttgagagg

SEQ ID NO: 3589587 - DNA, 19 bp, Homo sapiens
cgagtaaagtctgggccag

SEQ ID NO: 3589588 - DNA, 18 bp, Homo sapiens
cgagtctcttctccactg

SEQ ID NO: 3589589 - DNA, 20 bp, Homo sapiens
cgagtctcttctccactgga

SEQ ID NO: 3589590 - DNA, 21 bp, Homo sapiens
cgagtctcttctccactggat

SEQ ID NO: 3589591 - DNA, 22 bp, Homo sapiens
cgagtgtgaagcttccttggct

SEQ ID NO: 3589592 - DNA, 17 bp, Homo sapiens
cgatacctggagcagag

SEQ ID NO: 3589593 - DNA, 17 bp, Homo sapiens
cgatatttattgatgtt

SEQ ID NO: 3589594 - DNA, 20 bp, Homo sapiens
cgatcacaggccttgctttt

SEQ ID NO: 3589595 - DNA, 12 bp, Homo sapiens
cgatcaggagga

SEQ ID NO: 3589596 - DNA, 19 bp, Homo sapiens
cgatggggcaagacagaaa

SEQ ID NO: 3589597 - DNA, 15 bp, Homo sapiens
cgatgtgtctcccag

SEQ ID NO: 3589598 - DNA, 23 bp, Homo sapiens
cgattgcaggagtccctgccatc

SEQ ID NO: 3589599 - DNA, 21 bp, Homo sapiens
cgattgtgtacttttcctttg

SEQ ID NO: 3589600 - DNA, 14 bp, Homo sapiens
cgatttgtcccagg

SEQ ID NO: 3589601 - DNA, 17 bp, Homo sapiens
cgcacacagctgagcac

SEQ ID NO: 3589602 - DNA, 17 bp, Homo sapiens
cgcaccccccaagctgt

SEQ ID NO: 3589603 - DNA, 18 bp, Homo sapiens
cgcactctccccgctcag

SEQ ID NO: 3589604 - DNA, 15 bp, Homo sapiens
cgcagacctggagct

SEQ ID NO: 3589605 - DNA, 17 bp, Homo sapiens
cgcagagaaatgcccca

SEQ ID NO: 3589606 - DNA, 23 bp, Homo sapiens
cgcagatttttatgttttgaaag

SEQ ID NO: 3589607 - DNA, 17 bp, Homo sapiens
cgcagccccgggcggag

SEQ ID NO: 3589608 - DNA, 10 bp, Homo sapiens
cgcagccctc

SEQ ID NO: 3589609 - DNA, 23 bp, Homo sapiens
cgcagctgggtgcagaagctgtg

SEQ ID NO: 3589610 - DNA, 19 bp, Homo sapiens
cgcaggcacagcagctgca

SEQ ID NO: 3589611 - DNA, 20 bp, Homo sapiens
cgcaggcagcgcagggctgg

SEQ ID NO: 3589612 - DNA, 18 bp, Homo sapiens
cgcaggcccccaggtgcc

SEQ ID NO: 3589613 - DNA, 19 bp, Homo sapiens
cgcagggaatgcagcagga

SEQ ID NO: 3589614 - DNA, 19 bp, Homo sapiens
cgcaggtgctcatgctgct

SEQ ID NO: 3589615 - DNA, 11 bp, Homo sapiens
cgcatgtgtgc

SEQ ID NO: 3589616 - DNA, 18 bp, Homo sapiens
cgccaggcaccacagcct

SEQ ID NO: 3589617 - DNA, 21 bp, Homo sapiens
cgccagggctggggacagagg

SEQ ID NO: 3589618 - DNA, 13 bp, Homo sapiens
cgccatcgcggga

SEQ ID NO: 3589619 - DNA, 22 bp, Homo sapiens
cgcccagagacccaagctgcct

SEQ ID NO: 3589620 - DNA, 12 bp, Homo sapiens
cgccccagagct

SEQ ID NO: 3589621 - DNA, 12 bp, Homo sapiens
cgcccccacctc

SEQ ID NO: 3589622 - DNA, 16 bp, Homo sapiens
cgccccgccccagagc

SEQ ID NO: 3589623 - DNA, 12 bp, Homo sapiens
cgcccctgtggc

SEQ ID NO: 3589624 - DNA, 20 bp, Homo sapiens
cgcccctgtggccaactgca

SEQ ID NO: 3589625 - DNA, 19 bp, Homo sapiens
cgcccctgtggccctggcc

SEQ ID NO: 3589626 - DNA, 19 bp, Homo sapiens
cgcccggcagtgcacgcgg

SEQ ID NO: 3589627 - DNA, 23 bp, Homo sapiens
cgcccggggagtttccgcggcgg

SEQ ID NO: 3589628 - DNA, 16 bp, Homo sapiens
cgccctgcagggccgg

SEQ ID NO: 3589629 - DNA, 20 bp, Homo sapiens
cgccctgcagggccgggcag

SEQ ID NO: 3589630 - DNA, 14 bp, Homo sapiens
cgcccttccatgtg

SEQ ID NO: 3589631 - DNA, 22 bp, Homo sapiens
cgccgctgcccttgggtccccc

SEQ ID NO: 3589632 - DNA, 19 bp, Homo sapiens
cgccggaagtggctccgtg

SEQ ID NO: 3589633 - DNA, 13 bp, Homo sapiens
cgccgtccggcgg

SEQ ID NO: 3589634 - DNA, 22 bp, Homo sapiens
cgcctccccctcccccattccc

SEQ ID NO: 3589635 - DNA, 22 bp, Homo sapiens
cgcctccctctcagaggcctgc

SEQ ID NO: 3589636 - DNA, 15 bp, Homo sapiens
cgcctctttgacatt

SEQ ID NO: 3589637 - DNA, 18 bp, Homo sapiens
cgcctttgcgctctcggg

SEQ ID NO: 3589638 - DNA, 12 bp, Homo sapiens
cgcgcagctgcc

SEQ ID NO: 3589639 - DNA, 14 bp, Homo sapiens
cgcgcagctgccta

SEQ ID NO: 3589640 - DNA, 16 bp, Homo sapiens
cgcgcagctgcctagg

SEQ ID NO: 3589641 - DNA, 16 bp, Homo sapiens
cgcgcccagcagaggc

SEQ ID NO: 3589642 - DNA, 16 bp, Homo sapiens
cgcgctcgcccagcag

SEQ ID NO: 3589643 - DNA, 18 bp, Homo sapiens
cgcgctggaatccagaag

SEQ ID NO: 3589644 - DNA, 21 bp, Homo sapiens
cgcggatgctactactgcagt

SEQ ID NO: 3589645 - DNA, 20 bp, Homo sapiens
cgcggcccgcgcagctgcct

SEQ ID NO: 3589646 - DNA, 17 bp, Homo sapiens
cgcgggatggtgcagac

SEQ ID NO: 3589647 - DNA, 14 bp, Homo sapiens
cgcgtctgcctggg

SEQ ID NO: 3589648 - DNA, 15 bp, Homo sapiens
cgcgtctgcctgggc

SEQ ID NO: 3589649 - DNA, 23 bp, Homo sapiens
cgctaattcaaggaatttcttaa

SEQ ID NO: 3589650 - DNA, 21 bp, Homo sapiens
gaagatattatttgtcttaaa

SEQ ID NO: 3589651 - DNA, 19 bp, Homo sapiens
gaagatgccagcttctctc

SEQ ID NO: 3589652 - DNA, 15 bp, Homo sapiens
gaagattctatgtta

SEQ ID NO: 3589653 - DNA, 17 bp, Homo sapiens
gaagattctatgttaat

SEQ ID NO: 3589654 - DNA, 14 bp, Homo sapiens
gaagcaactgtgaa

SEQ ID NO: 3589655 - DNA, 16 bp, Homo sapiens
gaagcaactgtgaatt

SEQ ID NO: 3589656 - DNA, 17 bp, Homo sapiens
gaagcaagacacgtggc

SEQ ID NO: 3589657 - DNA, 19 bp, Homo sapiens
gaagcaagacacgtggcct

SEQ ID NO: 3589658 - DNA, 11 bp, Homo sapiens
gaagccagcca

SEQ ID NO: 3589659 - DNA, 17 bp, Homo sapiens
gaagccaggtacaggag

SEQ ID NO: 3589660 - DNA, 19 bp, Homo sapiens
gaagccaggtacaggagag

SEQ ID NO: 3589661 - DNA, 21 bp, Homo sapiens
gaagcccccagctaagaacct

SEQ ID NO: 3589662 - DNA, 22 bp, Homo sapiens
gaagccttgcctaaatttaatg

SEQ ID NO: 3589663 - DNA, 16 bp, Homo sapiens
gaagctaatgtcacaa

SEQ ID NO: 3589664 - DNA, 19 bp, Homo sapiens
gaagctcctctccccagcc

SEQ ID NO: 3589665 - DNA, 18 bp, Homo sapiens
gaagctctccgagctctg

SEQ ID NO: 3589666 - DNA, 19 bp, Homo sapiens
gaagctctccgagctctgg

SEQ ID NO: 3589667 - DNA, 20 bp, Homo sapiens
gaagctctccgagctctggt

SEQ ID NO: 3589668 - DNA, 15 bp, Homo sapiens
gaagctgctgcagct

SEQ ID NO: 3589669 - DNA, 20 bp, Homo sapiens
gaagctgtgttgaaacagaa

SEQ ID NO: 3589670 - DNA, 17 bp, Homo sapiens
gaagcttccatgatgca

SEQ ID NO: 3589671 - DNA, 21 bp, Homo sapiens
gaagcttccatgatgcacagt

SEQ ID NO: 3589672 - DNA, 15 bp, Homo sapiens
gaaggaaaagcaaga

SEQ ID NO: 3589673 - DNA, 15 bp, Homo sapiens
gaaggaacaaagaca

SEQ ID NO: 3589674 - DNA, 19 bp, Homo sapiens
gaaggaatgtcagggccag

SEQ ID NO: 3589675 - DNA, 14 bp, Homo sapiens
gaaggaattacatt

SEQ ID NO: 3589676 - DNA, 17 bp, Homo sapiens
gaaggaatttgggagga

SEQ ID NO: 3589677 - DNA, 23 bp, Homo sapiens
gaaggacccggaggggcctggca

SEQ ID NO: 3589678 - DNA, 12 bp, Homo sapiens
gaaggacttgac

SEQ ID NO: 3589679 - DNA, 19 bp, Homo sapiens
gaaggagacaccaagctca

SEQ ID NO: 3589680 - DNA, 20 bp, Homo sapiens
gaaggaggccaaccagcccg

SEQ ID NO: 3589681 - DNA, 19 bp, Homo sapiens
gaaggcaaggccctgccct

SEQ ID NO: 3589682 - DNA, 13 bp, Homo sapiens
gaaggcagtggca

SEQ ID NO: 3589683 - DNA, 21 bp, Homo sapiens
gaaggcagtggcaggggagca

SEQ ID NO: 3589684 - DNA, 13 bp, Homo sapiens
gaaggccagagag

SEQ ID NO: 3589685 - DNA, 14 bp, Homo sapiens
gaaggccagagagg

SEQ ID NO: 3589686 - DNA, 17 bp, Homo sapiens
gaaggccagagagggaa

SEQ ID NO: 3589687 - DNA, 15 bp, Homo sapiens
gaaggctatggggat

SEQ ID NO: 3589688 - DNA, 18 bp, Homo sapiens
gaagggaaagcgggcagc

SEQ ID NO: 3589689 - DNA, 23 bp, Homo sapiens
gaagggaaagcgggcagccccgt

SEQ ID NO: 3589690 - DNA, 13 bp, Homo sapiens
gaagggagccaag

SEQ ID NO: 3589691 - DNA, 22 bp, Homo sapiens
gaagggagccaagggatggaca

SEQ ID NO: 3589692 - DNA, 14 bp, Homo sapiens
gaaggggaggcaca

SEQ ID NO: 3589693 - DNA, 15 bp, Homo sapiens
gaaggggaggcacac

SEQ ID NO: 3589694 - DNA, 23 bp, Homo sapiens
gaaggggccccatggcagctcct

SEQ ID NO: 3589695 - DNA, 16 bp, Homo sapiens
gaagggggccctgcta

SEQ ID NO: 3589696 - DNA, 19 bp, Homo sapiens
gaagggtctctctccaggt

SEQ ID NO: 3589697 - DNA, 22 bp, Homo sapiens
gaagggtctctctccaggtcag

SEQ ID NO: 3589698 - DNA, 16 bp, Homo sapiens
gaaggtagaatgtttt

SEQ ID NO: 3589699 - DNA, 22 bp, Homo sapiens
gaagtaattatcagttggtttg

SEQ ID NO: 3589700 - DNA, 22 bp, Homo sapiens
gaagtcaataggcctatttatt

SEQ ID NO: 3589701 - DNA, 23 bp, Homo sapiens
gaagtcacccctttctgtcccac

SEQ ID NO: 3589702 - DNA, 18 bp, Homo sapiens
gaagtctgagcccatttc

SEQ ID NO: 3589703 - DNA, 17 bp, Homo sapiens
gaagtcttctatttatt

SEQ ID NO: 3589704 - DNA, 21 bp, Homo sapiens
gaagtgacctcactggcctgc

SEQ ID NO: 3589705 - DNA, 23 bp, Homo sapiens
gaagtgagcagtcgcctgcctgc

SEQ ID NO: 3589706 - DNA, 15 bp, Homo sapiens
gaagtgcagctcatg

SEQ ID NO: 3589707 - DNA, 24 bp, Homo sapiens
gaagtgtgggtctgtgtgtgtgta

SEQ ID NO: 3589708 - DNA, 17 bp, Homo sapiens
gaagtgtgtgccaagag

SEQ ID NO: 3589709 - DNA, 21 bp, Homo sapiens
gaagttgacttatagtacatg

SEQ ID NO: 3589710 - DNA, 17 bp, Homo sapiens
gaagtttgctgtgcttt

SEQ ID NO: 3589711 - DNA, 15 bp, Homo sapiens
gaagtttgtagccag

SEQ ID NO: 3589712 - DNA, 18 bp, Homo sapiens
gaataaaacactcatccc

SEQ ID NO: 3589713 - DNA, 14 bp, Homo sapiens
gaataaagaaaaac

SEQ ID NO: 3589714 - DNA, 19 bp, Homo sapiens
gaataaaggcagttttcta

SEQ ID NO: 3589715 - DNA, 21 bp, Homo sapiens
gaataaattctacctccttgt

SEQ ID NO: 3589716 - DNA, 13 bp, Homo sapiens
gaataacttgaag

SEQ ID NO: 3589717 - DNA, 12 bp, Homo sapiens
gaataattgcat

SEQ ID NO: 3589718 - DNA, 19 bp, Homo sapiens
gactttgtgttcatttcat

SEQ ID NO: 3589719 - DNA, 18 bp, Homo sapiens
gacttttggtagagaagg

SEQ ID NO: 3589720 - DNA, 17 bp, Homo sapiens
gagaaaaaaaaagcaaa

SEQ ID NO: 3589721 - DNA, 18 bp, Homo sapiens
gagaaaaaaaaagcaaat

SEQ ID NO: 3589722 - DNA, 13 bp, Homo sapiens
gagaaaaagaaga

SEQ ID NO: 3589723 - DNA, 16 bp, Homo sapiens
gagaaaaagaagaaaa

SEQ ID NO: 3589724 - DNA, 14 bp, Homo sapiens
gagaaaattcaggt

SEQ ID NO: 3589725 - DNA, 16 bp, Homo sapiens
gagaaacaaaatcctc

SEQ ID NO: 3589726 - DNA, 19 bp, Homo sapiens
gagaaacagttggtaactt

SEQ ID NO: 3589727 - DNA, 17 bp, Homo sapiens
gagaaactgctgcagat

SEQ ID NO: 3589728 - DNA, 17 bp, Homo sapiens
gagaaagactattcaaa

SEQ ID NO: 3589729 - DNA, 17 bp, Homo sapiens
gagaaagagctgcctgg

SEQ ID NO: 3589730 - DNA, 18 bp, Homo sapiens
gagaaaggggagcccact

SEQ ID NO: 3589731 - DNA, 19 bp, Homo sapiens
gagaaatatatttgtcact

SEQ ID NO: 3589732 - DNA, 23 bp, Homo sapiens
gagaacaacaaatatgttctctg

SEQ ID NO: 3589733 - DNA, 20 bp, Homo sapiens
gagaacagtggttgcctggg

SEQ ID NO: 3589734 - DNA, 14 bp, Homo sapiens
gagaaccaaccagg

SEQ ID NO: 3589735 - DNA, 18 bp, Homo sapiens
gagaaccaaccagggaag

SEQ ID NO: 3589736 - DNA, 19 bp, Homo sapiens
gagaaccagtctcctcact

SEQ ID NO: 3589737 - DNA, 22 bp, Homo sapiens
gagaaccagtctcctcactctg

SEQ ID NO: 3589738 - DNA, 16 bp, Homo sapiens
gagaaccctgagcagg

SEQ ID NO: 3589739 - DNA, 17 bp, Homo sapiens
gagaacctcagattctt

SEQ ID NO: 3589740 - DNA, 20 bp, Homo sapiens
gagaagagggcccagcccag

SEQ ID NO: 3589741 - DNA, 19 bp, Homo sapiens
gagaagccagccacagacc

SEQ ID NO: 3589742 - DNA, 12 bp, Homo sapiens
gagaagccagga

SEQ ID NO: 3589743 - DNA, 23 bp, Homo sapiens
gagaagccaggaatttcccagga

SEQ ID NO: 3589744 - DNA, 19 bp, Homo sapiens
gagaagctcctctccccag

SEQ ID NO: 3589745 - DNA, 22 bp, Homo sapiens
gagaaggacccggaggggcctg

SEQ ID NO: 3589746 - DNA, 19 bp, Homo sapiens
gagaaggtaaggtgtgaac

SEQ ID NO: 3589747 - DNA, 22 bp, Homo sapiens
gagaaggtcacaacccttctct

SEQ ID NO: 3589748 - DNA, 20 bp, Homo sapiens
gagaagtcttctatttattt

SEQ ID NO: 3589749 - DNA, 21 bp, Homo sapiens
gagaagtcttctatttattta

SEQ ID NO: 3589750 - DNA, 23 bp, Homo sapiens
gagaagtttgtagccaggtactg

SEQ ID NO: 3589751 - DNA, 22 bp, Homo sapiens
gagaatctatatttaacaagat

SEQ ID NO: 3589752 - DNA, 13 bp, Homo sapiens
gagaatgagcctc

SEQ ID NO: 3589753 - DNA, 16 bp, Homo sapiens
gagaatggcatggcag

SEQ ID NO: 3589754 - DNA, 20 bp, Homo sapiens
gagaatggcatggcaggagt

SEQ ID NO: 3589755 - DNA, 15 bp, Homo sapiens
gagaatggcctggag

SEQ ID NO: 3589756 - DNA, 15 bp, Homo sapiens
gagaattatctcaag

SEQ ID NO: 3589757 - DNA, 16 bp, Homo sapiens
gagaattatctcaagt

SEQ ID NO: 3589758 - DNA, 13 bp, Homo sapiens
gagacaaatcttt

SEQ ID NO: 3589759 - DNA, 15 bp, Homo sapiens
gagacaaggtgctaa

SEQ ID NO: 3589760 - DNA, 16 bp, Homo sapiens
gagacaaggtgctaac

SEQ ID NO: 3589761 - DNA, 14 bp, Homo sapiens
gagacaccaagctc

SEQ ID NO: 3589762 - DNA, 14 bp, Homo sapiens
gagacaccctctgg

SEQ ID NO: 3589763 - DNA, 18 bp, Homo sapiens
gagacaccctctgggggt

SEQ ID NO: 3589764 - DNA, 22 bp, Homo sapiens
gagacaccctctgggggtcctc

SEQ ID NO: 3589765 - DNA, 16 bp, Homo sapiens
gagacactgttgataa

SEQ ID NO: 3589766 - DNA, 20 bp, Homo sapiens
gagacagatcactcctggag

SEQ ID NO: 3589767 - DNA, 16 bp, Homo sapiens
gagacagcagtttcca

SEQ ID NO: 3589768 - DNA, 21 bp, Homo sapiens
gagacagcagtttccagagag

SEQ ID NO: 3589769 - DNA, 16 bp, Homo sapiens
gagacagcttctctgc

SEQ ID NO: 3589770 - DNA, 16 bp, Homo sapiens
gagacaggagcctagc

SEQ ID NO: 3589771 - DNA, 18 bp, Homo sapiens
gagacatacttgaagggc

SEQ ID NO: 3589772 - DNA, 11 bp, Homo sapiens
gagacatccag

SEQ ID NO: 3589773 - DNA, 15 bp, Homo sapiens
gagaccataagagaa

SEQ ID NO: 3589774 - DNA, 16 bp, Homo sapiens
gagaccatcctggcca

SEQ ID NO: 3589775 - DNA, 18 bp, Homo sapiens
gagaccccaaagactctg

SEQ ID NO: 3589776 - DNA, 23 bp, Homo sapiens
gagaccccaaagactctggaggt

SEQ ID NO: 3589777 - DNA, 16 bp, Homo sapiens
gagacccccaggcaga

SEQ ID NO: 3589778 - DNA, 13 bp, Homo sapiens
gagaccccgcacc

SEQ ID NO: 3589779 - DNA, 18 bp, Homo sapiens
gagaccccgcacccggct

SEQ ID NO: 3589780 - DNA, 19 bp, Homo sapiens
gagacctcatcagccttgg

SEQ ID NO: 3589781 - DNA, 19 bp, Homo sapiens
gagacgcacacagctgagc

SEQ ID NO: 3589782 - DNA, 21 bp, Homo sapiens
gagacgccacggagggctggg

SEQ ID NO: 3589783 - DNA, 13 bp, Homo sapiens
gagactcctcagc

SEQ ID NO: 3589784 - DNA, 14 bp, Homo sapiens
gagactcctcagca

SEQ ID NO: 3589785 - DNA, 14 bp, Homo sapiens
gagactgagcagcc

SEQ ID NO: 3589786 - DNA, 16 bp, Homo sapiens
gagactgagcagccgc

SEQ ID NO: 3589787 - DNA, 14 bp, Homo sapiens
gagacttcctctgg

SEQ ID NO: 3589788 - DNA, 15 bp, Homo sapiens
gagacttcctctggt

SEQ ID NO: 3589789 - DNA, 16 bp, Homo sapiens
gagagaaagtgacatg

SEQ ID NO: 3589790 - DNA, 13 bp, Homo sapiens
gagagaagccagc

SEQ ID NO: 3589791 - DNA, 15 bp, Homo sapiens
gagagaatgtggaaa

SEQ ID NO: 3589792 - DNA, 15 bp, Homo sapiens
gagagaccccgcacc

SEQ ID NO: 3589793 - DNA, 19 bp, Homo sapiens
gagagaccccgcacccggc

SEQ ID NO: 3589794 - DNA, 17 bp, Homo sapiens
gagagaccctggcctca

SEQ ID NO: 3589795 - DNA, 13 bp, Homo sapiens
gagagagcagggc

SEQ ID NO: 3589796 - DNA, 12 bp, Homo sapiens
gagagcataatt

SEQ ID NO: 3589797 - DNA, 13 bp, Homo sapiens
gagagcatctcag

SEQ ID NO: 3589798 - DNA, 15 bp, Homo sapiens
gagagcatctcagga

SEQ ID NO: 3589799 - DNA, 16 bp, Homo sapiens
gagagccatacataaa

SEQ ID NO: 3589800 - DNA, 19 bp, Homo sapiens
gagagcccagagtcccccc

SEQ ID NO: 3589801 - DNA, 16 bp, Homo sapiens
gagagcggctggagaa

SEQ ID NO: 3589802 - DNA, 17 bp, Homo sapiens
gagagcggctggagaaa

SEQ ID NO: 3589803 - DNA, 19 bp, Homo sapiens
gagagctgtttttgacagc

SEQ ID NO: 3589804 - DNA, 15 bp, Homo sapiens
gagagctttctgcct

SEQ ID NO: 3589805 - DNA, 18 bp, Homo sapiens
gagaggccttttggaatg

SEQ ID NO: 3589806 - DNA, 14 bp, Homo sapiens
gagaggctctccgt

SEQ ID NO: 3589807 - DNA, 13 bp, Homo sapiens
gagaggctgtggt

SEQ ID NO: 3589808 - DNA, 18 bp, Homo sapiens
gagagggaaaaggcaggt

SEQ ID NO: 3589809 - DNA, 22 bp, Homo sapiens
gagagggacatagaatctgtga

SEQ ID NO: 3589810 - DNA, 17 bp, Homo sapiens
gaggccaaccagcccga

SEQ ID NO: 3589811 - DNA, 21 bp, Homo sapiens
gaggccacattgctggctgcc

SEQ ID NO: 3589812 - DNA, 13 bp, Homo sapiens
gaggccaccccaa

SEQ ID NO: 3589813 - DNA, 12 bp, Homo sapiens
gaggccagaaag

SEQ ID NO: 3589814 - DNA, 15 bp, Homo sapiens
gaggccatctcagga

SEQ ID NO: 3589815 - DNA, 19 bp, Homo sapiens
gaggccatctggagagccc

SEQ ID NO: 3589816 - DNA, 13 bp, Homo sapiens
gaggcccagttca

SEQ ID NO: 3589817 - DNA, 18 bp, Homo sapiens
gaggcccagttcaccctg

SEQ ID NO: 3589818 - DNA, 12 bp, Homo sapiens
gaggccccagcc

SEQ ID NO: 3589819 - DNA, 13 bp, Homo sapiens
gaggccccagcct

SEQ ID NO: 3589820 - DNA, 21 bp, Homo sapiens
gaggcccctaggtgcccaggg

SEQ ID NO: 3589821 - DNA, 22 bp, Homo sapiens
gaggcccctaggtgcccagggc

SEQ ID NO: 3589822 - DNA, 24 bp, Homo sapiens
gaggcccctatgtagtccgtgctg

SEQ ID NO: 3589823 - DNA, 19 bp, Homo sapiens
gaggccctctggagtggcc

SEQ ID NO: 3589824 - DNA, 19 bp, Homo sapiens
gaggccctggaggtctcca

SEQ ID NO: 3589825 - DNA, 22 bp, Homo sapiens
gaggccgtatgaagacagaggc

SEQ ID NO: 3589826 - DNA, 18 bp, Homo sapiens
gaggcctgccccctgggc

SEQ ID NO: 3589827 - DNA, 18 bp, Homo sapiens
gaggcggcctccatgcac

SEQ ID NO: 3589828 - DNA, 18 bp, Homo sapiens
gaggctacctcacctggg

SEQ ID NO: 3589829 - DNA, 14 bp, Homo sapiens
gaggctcagattgt

SEQ ID NO: 3589830 - DNA, 12 bp, Homo sapiens
gaggctcctcta

SEQ ID NO: 3589831 - DNA, 15 bp, Homo sapiens
gaggctctccgtgca

SEQ ID NO: 3589832 - DNA, 23 bp, Homo sapiens
gaggctgacatgctcacacatta

SEQ ID NO: 3589833 - DNA, 18 bp, Homo sapiens
gaggctgcctgctgtgct

SEQ ID NO: 3589834 - DNA, 19 bp, Homo sapiens
gaggctgcctgctgtgctg

SEQ ID NO: 3589835 - DNA, 15 bp, Homo sapiens
gagggaaaaggcagg

SEQ ID NO: 3589836 - DNA, 16 bp, Homo sapiens
gagggaaaaggcaggt

SEQ ID NO: 3589837 - DNA, 22 bp, Homo sapiens
gagggaacatcctaagacagag

SEQ ID NO: 3589838 - DNA, 15 bp, Homo sapiens
gagggaagacctgaa

SEQ ID NO: 3589839 - DNA, 21 bp, Homo sapiens
gagggaagatgacctgcccca

SEQ ID NO: 3589840 - DNA, 17 bp, Homo sapiens
gagggaagggagccaag

SEQ ID NO: 3589841 - DNA, 17 bp, Homo sapiens
gagggacaggctgaaga

SEQ ID NO: 3589842 - DNA, 20 bp, Homo sapiens
gagggacaggctgaagagag

SEQ ID NO: 3589843 - DNA, 13 bp, Homo sapiens
gagggacctctcc

SEQ ID NO: 3589844 - DNA, 15 bp, Homo sapiens
gagggacctctccca

SEQ ID NO: 3589845 - DNA, 18 bp, Homo sapiens
gagggacctctcccaggg

SEQ ID NO: 3589846 - DNA, 16 bp, Homo sapiens
gagggagaacaagacc

SEQ ID NO: 3589847 - DNA, 17 bp, Homo sapiens
gagggagggcagctggc

SEQ ID NO: 3589848 - DNA, 12 bp, Homo sapiens
gagggaggggcc

SEQ ID NO: 3589849 - DNA, 19 bp, Homo sapiens
gagggatgaccttcccagg

SEQ ID NO: 3589850 - DNA, 18 bp, Homo sapiens
gagggatgatgagggaag

SEQ ID NO: 3589851 - DNA, 16 bp, Homo sapiens
gagggattgaggggcc

SEQ ID NO: 3589852 - DNA, 16 bp, Homo sapiens
gagggcactggtggcc

SEQ ID NO: 3589853 - DNA, 18 bp, Homo sapiens
gagggcactggtggcccg

SEQ ID NO: 3589854 - DNA, 16 bp, Homo sapiens
gagggcaggaccctca

SEQ ID NO: 3589855 - DNA, 17 bp, Homo sapiens
gagggccaagagatctg

SEQ ID NO: 3589856 - DNA, 16 bp, Homo sapiens
gagggccacgggtctg

SEQ ID NO: 3589857 - DNA, 14 bp, Homo sapiens
gagggcccagccca

SEQ ID NO: 3589858 - DNA, 15 bp, Homo sapiens
gagggcccagcccag

SEQ ID NO: 3589859 - DNA, 16 bp, Homo sapiens
gagggcccagcccaga

SEQ ID NO: 3589860 - DNA, 21 bp, Homo sapiens
gagggcccagcccagagccac

SEQ ID NO: 3589861 - DNA, 19 bp, Homo sapiens
gagggctaattctgggaag

SEQ ID NO: 3589862 - DNA, 14 bp, Homo sapiens
gagggctcagggca

SEQ ID NO: 3589863 - DNA, 13 bp, Homo sapiens
gagggctgccctg

SEQ ID NO: 3589864 - DNA, 15 bp, Homo sapiens
gaggggatccagcca

SEQ ID NO: 3589865 - DNA, 16 bp, Homo sapiens
gaggggatgataaagg

SEQ ID NO: 3589866 - DNA, 19 bp, Homo sapiens
gaggggcagcgcatgtgtg

SEQ ID NO: 3589867 - DNA, 20 bp, Homo sapiens
gaggggcagggaaggacagg

SEQ ID NO: 3589868 - DNA, 18 bp, Homo sapiens
gaggggccctggccagga

SEQ ID NO: 3589869 - DNA, 19 bp, Homo sapiens
gaggggccctggccaggac

SEQ ID NO: 3589870 - DNA, 19 bp, Homo sapiens
gaggggcctaggcctcagc

SEQ ID NO: 3589871 - DNA, 14 bp, Homo sapiens
gagggggagtagcc

SEQ ID NO: 3589872 - DNA, 17 bp, Homo sapiens
gagggggagtagccaag

SEQ ID NO: 3589873 - DNA, 14 bp, Homo sapiens
gaggggtctcggat

SEQ ID NO: 3589874 - DNA, 16 bp, Homo sapiens
gaggggtctcggatga

SEQ ID NO: 3589875 - DNA, 23 bp, Homo sapiens
gaggggtctcggatgacaccctg

SEQ ID NO: 3589876 - DNA, 21 bp, Homo sapiens
gaggggtgggggtgccgctct

SEQ ID NO: 3589877 - DNA, 14 bp, Homo sapiens
gagggtccacctgg

SEQ ID NO: 3589878 - DNA, 13 bp, Homo sapiens
gagggtcctgcag

SEQ ID NO: 3589879 - DNA, 21 bp, Homo sapiens
gagggtcctgcagcctgcagg

SEQ ID NO: 3589880 - DNA, 17 bp, Homo sapiens
gagggtcgtgggaaagg

SEQ ID NO: 3589881 - DNA, 17 bp, Homo sapiens
gagggtctcccctcctg

SEQ ID NO: 3589882 - DNA, 15 bp, Homo sapiens
gagggtgagtgcaag

SEQ ID NO: 3589883 - DNA, 23 bp, Homo sapiens
gagggtgccgtgtcccctgacag

SEQ ID NO: 3589884 - DNA, 20 bp, Homo sapiens
gagggttgctggtcctgcac

SEQ ID NO: 3589885 - DNA, 24 bp, Homo sapiens
gagggttgctggtcctgcacatga

SEQ ID NO: 3589886 - DNA, 23 bp, Homo sapiens
gagggtttttaaaaataaagcaa

SEQ ID NO: 3589887 - DNA, 17 bp, Homo sapiens
gaggtactagaatgctt

SEQ ID NO: 3589888 - DNA, 21 bp, Homo sapiens
gaggtaggcgggaaaggatgg

SEQ ID NO: 3589889 - DNA, 15 bp, Homo sapiens
gaggtcactctgggc

SEQ ID NO: 3589890 - DNA, 13 bp, Homo sapiens
gaggtcactgcta

SEQ ID NO: 3589891 - DNA, 15 bp, Homo sapiens
gaggtctagagagaa

SEQ ID NO: 3589892 - DNA, 12 bp, Homo sapiens
gaggtctccagg

SEQ ID NO: 3589893 - DNA, 20 bp, Homo sapiens
gaggtctctgggagcccaga

SEQ ID NO: 3589894 - DNA, 20 bp, Homo sapiens
gaggtctggctgagcccctg

SEQ ID NO: 3589895 - DNA, 21 bp, Homo sapiens
gaggtctggctgagcccctgg

SEQ ID NO: 3589896 - DNA, 23 bp, Homo sapiens
gaggtctggctgagcccctgggg

SEQ ID NO: 3589897 - DNA, 12 bp, Homo sapiens
gaggtctgttta

SEQ ID NO: 3589898 - DNA, 16 bp, Homo sapiens
gaggtcttggccgact

SEQ ID NO: 3589899 - DNA, 14 bp, Homo sapiens
gaggtgaaaatgaa

SEQ ID NO: 3589900 - DNA, 16 bp, Homo sapiens
gaggtgaactccaggc

SEQ ID NO: 3589901 - DNA, 13 bp, Homo sapiens
gaggtggccgcca

SEQ ID NO: 3589902 - DNA, 17 bp, Homo sapiens
gaggtgggccacaccca

SEQ ID NO: 3589903 - DNA, 21 bp, Homo sapiens
gaggtgtgactaactatgcaa

SEQ ID NO: 3589904 - DNA, 16 bp, Homo sapiens
gaggttcccactctgg

SEQ ID NO: 3589905 - DNA, 18 bp, Homo sapiens
gaggttcccactctgggc

SEQ ID NO: 3589906 - DNA, 19 bp, Homo sapiens
gaggttcccactctgggca

SEQ ID NO: 3589907 - DNA, 21 bp, Homo sapiens
gaggttgtggggcctcaggct

SEQ ID NO: 3589908 - DNA, 23 bp, Homo sapiens
gaggttgtggggcctcaggctcc

SEQ ID NO: 3589909 - DNA, 22 bp, Homo sapiens
gaggtttttaaatatatatttt

SEQ ID NO: 3589910 - DNA, 14 bp, Homo sapiens
gagtaaataaaagc

SEQ ID NO: 3589911 - DNA, 23 bp, Homo sapiens
gagtacaaatgccttaaaatgga

SEQ ID NO: 3589912 - DNA, 18 bp, Homo sapiens
gagtacaccctttccagg

SEQ ID NO: 3589913 - DNA, 21 bp, Homo sapiens
gagtacaccctttccaggaat

SEQ ID NO: 3589914 - DNA, 13 bp, Homo sapiens
gagtagccaagct

SEQ ID NO: 3589915 - DNA, 15 bp, Homo sapiens
gagtatgtgaagata

SEQ ID NO: 3589916 - DNA, 14 bp, Homo sapiens
gagtcaaaacaaag

SEQ ID NO: 3589917 - DNA, 13 bp, Homo sapiens
gagtcaaatccag

SEQ ID NO: 3589918 - DNA, 17 bp, Homo sapiens
gagtcacctgctccaga

SEQ ID NO: 3589919 - DNA, 21 bp, Homo sapiens
gagtcaggtgtcgaggccaca

SEQ ID NO: 3589920 - DNA, 15 bp, Homo sapiens
gagtcatttaaatgt

SEQ ID NO: 3589921 - DNA, 18 bp, Homo sapiens
gagtcatttgtttaaaca

SEQ ID NO: 3589922 - DNA, 22 bp, Homo sapiens
gagtccccccactcccagcatc

SEQ ID NO: 3589923 - DNA, 11 bp, Homo sapiens
gagtccctgct

SEQ ID NO: 3589924 - DNA, 17 bp, Homo sapiens
gagtctcttctccactg

SEQ ID NO: 3589925 - DNA, 18 bp, Homo sapiens
gagtctcttctccactgg

SEQ ID NO: 3589926 - DNA, 16 bp, Homo sapiens
gagtctgattgcagga

SEQ ID NO: 3589927 - DNA, 14 bp, Homo sapiens
gagtgagacagact

SEQ ID NO: 3589928 - DNA, 19 bp, Homo sapiens
gagtgagcacacccgtgtg

SEQ ID NO: 3589929 - DNA, 19 bp, Homo sapiens
gagtgagtcacctgctcca

SEQ ID NO: 3589930 - DNA, 19 bp, Homo sapiens
gagtgcaatgacacagtct

SEQ ID NO: 3589931 - DNA, 18 bp, Homo sapiens
gagtgccaacttctttca

SEQ ID NO: 3589932 - DNA, 13 bp, Homo sapiens
gagtgccccactt

SEQ ID NO: 3589933 - DNA, 15 bp, Homo sapiens
gagtgcctggagtca

SEQ ID NO: 3589934 - DNA, 14 bp, Homo sapiens
gagtggaaatacac

SEQ ID NO: 3589935 - DNA, 19 bp, Homo sapiens
gagtggaatagtatcctcc

SEQ ID NO: 3589936 - DNA, 23 bp, Homo sapiens
gagtggaatagtatcctccaggt

SEQ ID NO: 3589937 - DNA, 13 bp, Homo sapiens
gagtggcagcagc

SEQ ID NO: 3589938 - DNA, 16 bp, Homo sapiens
gagtggcagcagcccc

SEQ ID NO: 3589939 - DNA, 18 bp, Homo sapiens
gagtggcctcatttcact

SEQ ID NO: 3589940 - DNA, 13 bp, Homo sapiens
gagtggctcctcc

SEQ ID NO: 3589941 - DNA, 15 bp, Homo sapiens
gagtggctcctcccg

SEQ ID NO: 3589942 - DNA, 23 bp, Homo sapiens
gagtgggaagggagcattgcagc

SEQ ID NO: 3589943 - DNA, 21 bp, Homo sapiens
gatgctactactgcagtcttt

SEQ ID NO: 3589944 - DNA, 12 bp, Homo sapiens
gatgctgaggcc

SEQ ID NO: 3589945 - DNA, 15 bp, Homo sapiens
gatgctgaggcccct

SEQ ID NO: 3589946 - DNA, 21 bp, Homo sapiens
gatgctggcccagggcccaga

SEQ ID NO: 3589947 - DNA, 23 bp, Homo sapiens
gatgctggcccagggcccagagc

SEQ ID NO: 3589948 - DNA, 17 bp, Homo sapiens
gatgctgttgagggcca

SEQ ID NO: 3589949 - DNA, 16 bp, Homo sapiens
gatgctgttgtgaagc

SEQ ID NO: 3589950 - DNA, 22 bp, Homo sapiens
gatggaaagaggtgaaaatgaa

SEQ ID NO: 3589951 - DNA, 14 bp, Homo sapiens
gatggactcaggat

SEQ ID NO: 3589952 - DNA, 21 bp, Homo sapiens
gatggactcaggatccagtga

SEQ ID NO: 3589953 - DNA, 22 bp, Homo sapiens
gatggacttgtgattggctgca

SEQ ID NO: 3589954 - DNA, 16 bp, Homo sapiens
gatggagaaagaagtg

SEQ ID NO: 3589955 - DNA, 19 bp, Homo sapiens
gatggagaaagaagtggag

SEQ ID NO: 3589956 - DNA, 18 bp, Homo sapiens
gatggagacaccctctgg

SEQ ID NO: 3589957 - DNA, 20 bp, Homo sapiens
gatggagacaccctctgggg

SEQ ID NO: 3589958 - DNA, 14 bp, Homo sapiens
gatggagccccagg

SEQ ID NO: 3589959 - DNA, 16 bp, Homo sapiens
gatggagtttctctct

SEQ ID NO: 3589960 - DNA, 21 bp, Homo sapiens
gatggcaacagatctggaacc

SEQ ID NO: 3589961 - DNA, 23 bp, Homo sapiens
gatggcagactctttaataaatt

SEQ ID NO: 3589962 - DNA, 14 bp, Homo sapiens
gatggcagagccag

SEQ ID NO: 3589963 - DNA, 13 bp, Homo sapiens
gatggctgtgcct

SEQ ID NO: 3589964 - DNA, 19 bp, Homo sapiens
gatggctgtgcctctgcct

SEQ ID NO: 3589965 - DNA, 16 bp, Homo sapiens
gatgggcaaagcttgt

SEQ ID NO: 3589966 - DNA, 22 bp, Homo sapiens
gatgggcaaagcttgtcaaaga

SEQ ID NO: 3589967 - DNA, 15 bp, Homo sapiens
gatgggctaggcctc

SEQ ID NO: 3589968 - DNA, 22 bp, Homo sapiens
gatgggtgggtggggtattttt

SEQ ID NO: 3589969 - DNA, 21 bp, Homo sapiens
gatggttcccctgttcactct

SEQ ID NO: 3589970 - DNA, 12 bp, Homo sapiens
gatgtaaagatg

SEQ ID NO: 3589971 - DNA, 21 bp, Homo sapiens
gatgtaagtttgtgtaaatta

SEQ ID NO: 3589972 - DNA, 13 bp, Homo sapiens
gatgtagaaagtt

SEQ ID NO: 3589973 - DNA, 13 bp, Homo sapiens
gatgtataatgta

SEQ ID NO: 3589974 - DNA, 14 bp, Homo sapiens
gatgtataatgtaa

SEQ ID NO: 3589975 - DNA, 17 bp, Homo sapiens
gatgtatggtatcttta

SEQ ID NO: 3589976 - DNA, 17 bp, Homo sapiens
gatgtcccaacttgtaa

SEQ ID NO: 3589977 - DNA, 18 bp, Homo sapiens
gatgtcccaacttgtaaa

SEQ ID NO: 3589978 - DNA, 18 bp, Homo sapiens
gatgtgtctcccagaact

SEQ ID NO: 3589979 - DNA, 14 bp, Homo sapiens
gatgttctcctgat

SEQ ID NO: 3589980 - DNA, 13 bp, Homo sapiens
gatgtttacattt

SEQ ID NO: 3589981 - DNA, 23 bp, Homo sapiens
gatgttttgccgtggcttgggga

SEQ ID NO: 3589982 - DNA, 13 bp, Homo sapiens
gattaaaaatacc

SEQ ID NO: 3589983 - DNA, 21 bp, Homo sapiens
gattaaaaataccttctatgt

SEQ ID NO: 3589984 - DNA, 15 bp, Homo sapiens
gattaaccttttcaa

SEQ ID NO: 3589985 - DNA, 15 bp, Homo sapiens
gattaactaaagaag

SEQ ID NO: 3589986 - DNA, 18 bp, Homo sapiens
gattaactaaagaagagg

SEQ ID NO: 3589987 - DNA, 20 bp, Homo sapiens
gattacaaatcagaagtcat

SEQ ID NO: 3589988 - DNA, 16 bp, Homo sapiens
gattacagaaactgat

SEQ ID NO: 3589989 - DNA, 18 bp, Homo sapiens
gattacagggatgagcca

SEQ ID NO: 3589990 - DNA, 23 bp, Homo sapiens
gattaccagggactatctttgct

SEQ ID NO: 3589991 - DNA, 23 bp, Homo sapiens
gattactctccatatcccttcct

SEQ ID NO: 3589992 - DNA, 14 bp, Homo sapiens
gattatatgaagtt

SEQ ID NO: 3589993 - DNA, 19 bp, Homo sapiens
gattattaacgatgtccaa

SEQ ID NO: 3589994 - DNA, 12 bp, Homo sapiens
gattattggaaa

SEQ ID NO: 3589995 - DNA, 17 bp, Homo sapiens
gattatttaagactaaa

SEQ ID NO: 3589996 - DNA, 14 bp, Homo sapiens
gattatttttccag

SEQ ID NO: 3589997 - DNA, 22 bp, Homo sapiens
gattattttttaaaaaggtaaa

SEQ ID NO: 3589998 - DNA, 14 bp, Homo sapiens
gattattttttcag

SEQ ID NO: 3589999 - DNA, 16 bp, Homo sapiens
gattcaagacaagagc

SEQ ID NO: 3590000 - DNA, 23 bp, Homo sapiens
gattcaagacaagagctgttatg

SEQ ID NO: 3590001 - DNA, 20 bp, Homo sapiens
gattcacccccctctgctgc

SEQ ID NO: 3590002 - DNA, 21 bp, Homo sapiens
gattcacccccctctgctgcc

SEQ ID NO: 3590003 - DNA, 13 bp, Homo sapiens
gattcagagaaat

SEQ ID NO: 3590004 - DNA, 15 bp, Homo sapiens
gattcaggccagccc

SEQ ID NO: 3590005 - DNA, 16 bp, Homo sapiens
gattcaggccagccca

SEQ ID NO: 3590006 - DNA, 15 bp, Homo sapiens
gattcatagtaaaat

SEQ ID NO: 3590007 - DNA, 12 bp, Homo sapiens
gattcatattta

SEQ ID NO: 3590008 - DNA, 13 bp, Homo sapiens
gattcatatttaa

SEQ ID NO: 3590009 - DNA, 15 bp, Homo sapiens
gattcatatttaatt

SEQ ID NO: 3590010 - DNA, 22 bp, Homo sapiens
gattcatatttaatttgaagat

SEQ ID NO: 3590011 - DNA, 22 bp, Homo sapiens
gattcatgcaagtggagctgtc

SEQ ID NO: 3590012 - DNA, 21 bp, Homo sapiens
gattcatgccaattagcaatt

SEQ ID NO: 3590013 - DNA, 16 bp, Homo sapiens
gattccatcaaagaga

SEQ ID NO: 3590014 - DNA, 16 bp, Homo sapiens
gattcccacatttgtc

SEQ ID NO: 3590015 - DNA, 23 bp, Homo sapiens
gattcctatgatggatggcagac

SEQ ID NO: 3590016 - DNA, 16 bp, Homo sapiens
gattcggggctgacct

SEQ ID NO: 3590017 - DNA, 21 bp, Homo sapiens
gattctatgttaatattttat

SEQ ID NO: 3590018 - DNA, 14 bp, Homo sapiens
gattctcagggctg

SEQ ID NO: 3590019 - DNA, 15 bp, Homo sapiens
gattctctgcagccc

SEQ ID NO: 3590020 - DNA, 21 bp, Homo sapiens
gattctgaccttaaatgcaac

SEQ ID NO: 3590021 - DNA, 15 bp, Homo sapiens
gattctgattgctat

SEQ ID NO: 3590022 - DNA, 17 bp, Homo sapiens
gattctgattgctatca

SEQ ID NO: 3590023 - DNA, 21 bp, Homo sapiens
gattcttgtatttattacaac

SEQ ID NO: 3590024 - DNA, 17 bp, Homo sapiens
gattgacagctttgctg

SEQ ID NO: 3590025 - DNA, 13 bp, Homo sapiens
gattgatcattct

SEQ ID NO: 3590026 - DNA, 19 bp, Homo sapiens
gattgcccctggctttgcc

SEQ ID NO: 3590027 - DNA, 15 bp, Homo sapiens
gattgctatcagcaa

SEQ ID NO: 3590028 - DNA, 21 bp, Homo sapiens
gattgctgaggcaccgtccag

SEQ ID NO: 3590029 - DNA, 11 bp, Homo sapiens
gattgtacacg

SEQ ID NO: 3590030 - DNA, 19 bp, Homo sapiens
gattgtcaacacaaactgg

SEQ ID NO: 3590031 - DNA, 18 bp, Homo sapiens
gattgtgcctaatgtgtt

SEQ ID NO: 3590032 - DNA, 16 bp, Homo sapiens
gatttaaagaaaacca

SEQ ID NO: 3590033 - DNA, 18 bp, Homo sapiens
gatttaagccttacaaag

SEQ ID NO: 3590034 - DNA, 17 bp, Homo sapiens
gatttaagtgaatacat

SEQ ID NO: 3590035 - DNA, 22 bp, Homo sapiens
gatttaagtgaatacattaacg

SEQ ID NO: 3590036 - DNA, 11 bp, Homo sapiens
gatttcaaact

SEQ ID NO: 3590037 - DNA, 20 bp, Homo sapiens
gatttcaaacttaaacaaaa

SEQ ID NO: 3590038 - DNA, 21 bp, Homo sapiens
gatttcagtcatagcaagctt

SEQ ID NO: 3590039 - DNA, 16 bp, Homo sapiens
gatttcatgctatctc

SEQ ID NO: 3590040 - DNA, 15 bp, Homo sapiens
gatttccagccttct

SEQ ID NO: 3590041 - DNA, 15 bp, Homo sapiens
gatttccatttctga

SEQ ID NO: 3590042 - DNA, 16 bp, Homo sapiens
gatttgatatttgcat

SEQ ID NO: 3590043 - DNA, 13 bp, Homo sapiens
gattttacaagta

SEQ ID NO: 3590044 - DNA, 14 bp, Homo sapiens
gattttaccaaagc

SEQ ID NO: 3590045 - DNA, 14 bp, Homo sapiens
gattttgagggtgg

SEQ ID NO: 3590046 - DNA, 18 bp, Homo sapiens
gatttttaagaaagtaat

SEQ ID NO: 3590047 - DNA, 12 bp, Homo sapiens
gatttttatcac

SEQ ID NO: 3590048 - DNA, 16 bp, Homo sapiens
gatttttatgtacata

SEQ ID NO: 3590049 - DNA, 20 bp, Homo sapiens
gattttttacagctgcctgc

SEQ ID NO: 3590050 - DNA, 13 bp, Homo sapiens
gatttttttcctg

SEQ ID NO: 3590051 - DNA, 18 bp, Homo sapiens
gatttttttttttaattt

SEQ ID NO: 3590052 - DNA, 19 bp, Homo sapiens
gcaaaaaaaaatttagcta

SEQ ID NO: 3590053 - DNA, 22 bp, Homo sapiens
gcaaaaaaagcctccaagggtt

SEQ ID NO: 3590054 - DNA, 20 bp, Homo sapiens
gcaaaaacaaaaagaaaaga

SEQ ID NO: 3590055 - DNA, 21 bp, Homo sapiens
gcaaaaacaaaaagaaaagaa

SEQ ID NO: 3590056 - DNA, 16 bp, Homo sapiens
gcaaaaagaggatccg

SEQ ID NO: 3590057 - DNA, 10 bp, Homo sapiens
gcaaaagaaa

SEQ ID NO: 3590058 - DNA, 22 bp, Homo sapiens
gcaaaagatgtgcaaaatcact

SEQ ID NO: 3590059 - DNA, 20 bp, Homo sapiens
gcaaaaggatctttgtggcc

SEQ ID NO: 3590060 - DNA, 23 bp, Homo sapiens
gcaaaaggatctttgtggccaag

SEQ ID NO: 3590061 - DNA, 15 bp, Homo sapiens
gcaaaataattttaa

SEQ ID NO: 3590062 - DNA, 13 bp, Homo sapiens
gcaaacacacctt

SEQ ID NO: 3590063 - DNA, 21 bp, Homo sapiens
gcaaacatcaaataaatttct

SEQ ID NO: 3590064 - DNA, 22 bp, Homo sapiens
gcaaacggcaacgtagcctggg

SEQ ID NO: 3590065 - DNA, 23 bp, Homo sapiens
gcaaactggccgcgggggcaggg

SEQ ID NO: 3590066 - DNA, 12 bp, Homo sapiens
gcaaagaaaatg

SEQ ID NO: 3590067 - DNA, 21 bp, Homo sapiens
gcaaagataatttatttcaat

SEQ ID NO: 3590068 - DNA, 19 bp, Homo sapiens
gcaaagatctgtcctcagc

SEQ ID NO: 3590069 - DNA, 22 bp, Homo sapiens
gcaaagatctgtcctcagcctt

SEQ ID NO: 3590070 - DNA, 23 bp, Homo sapiens
gcaaagcactgacttctaagtaa

SEQ ID NO: 3590071 - DNA, 22 bp, Homo sapiens
gcaaagcagcaactattcacaa

SEQ ID NO: 3590072 - DNA, 16 bp, Homo sapiens
gcaaagcccctcacac

SEQ ID NO: 3590073 - DNA, 19 bp, Homo sapiens
gcaaaggacccttgagtaa

SEQ ID NO: 3590074 - DNA, 17 bp, Homo sapiens
gcaaaggtgcactccag

SEQ ID NO: 3590075 - DNA, 13 bp, Homo sapiens
gctctatactgtg

SEQ ID NO: 3590076 - DNA, 14 bp, Homo sapiens
gctctatactgtgg

SEQ ID NO: 3590077 - DNA, 21 bp, Homo sapiens
gctctatactgtggcctgcag

SEQ ID NO: 3590078 - DNA, 13 bp, Homo sapiens
gctctcacagaca

SEQ ID NO: 3590079 - DNA, 19 bp, Homo sapiens
gctctcctcttgccactgc

SEQ ID NO: 3590080 - DNA, 22 bp, Homo sapiens
gctctcctcttgccactgcctc

SEQ ID NO: 3590081 - DNA, 16 bp, Homo sapiens
gctctcctgactttta

SEQ ID NO: 3590082 - DNA, 14 bp, Homo sapiens
gctctgaaaacaag

SEQ ID NO: 3590083 - DNA, 18 bp, Homo sapiens
gctctgacatcccttcct

SEQ ID NO: 3590084 - DNA, 21 bp, Homo sapiens
gctctgacatcccttcctgga

SEQ ID NO: 3590085 - DNA, 13 bp, Homo sapiens
gctctgcacagac

SEQ ID NO: 3590086 - DNA, 17 bp, Homo sapiens
gctctgcatgttttcca

SEQ ID NO: 3590087 - DNA, 13 bp, Homo sapiens
gctctgccccagc

SEQ ID NO: 3590088 - DNA, 13 bp, Homo sapiens
gctctgctgctga

SEQ ID NO: 3590089 - DNA, 11 bp, Homo sapiens
gctctggagaa

SEQ ID NO: 3590090 - DNA, 21 bp, Homo sapiens
gctctggcaccatcagcctgt

SEQ ID NO: 3590091 - DNA, 19 bp, Homo sapiens
gctcttaagcagcatggaa

SEQ ID NO: 3590092 - DNA, 15 bp, Homo sapiens
gctcttcccactttt

SEQ ID NO: 3590093 - DNA, 20 bp, Homo sapiens
gctcttccgaaaaccaggcc

SEQ ID NO: 3590094 - DNA, 13 bp, Homo sapiens
gctcttctccttt

SEQ ID NO: 3590095 - DNA, 17 bp, Homo sapiens
gctcttggcaggagtgg

SEQ ID NO: 3590096 - DNA, 18 bp, Homo sapiens
gctcttggctgacccctc

SEQ ID NO: 3590097 - DNA, 19 bp, Homo sapiens
gctcttggctgacccctct

SEQ ID NO: 3590098 - DNA, 18 bp, Homo sapiens
gctcttgtgttcagaaga

SEQ ID NO: 3590099 - DNA, 20 bp, Homo sapiens
gctcttgtgttcagaagaat

SEQ ID NO: 3590100 - DNA, 19 bp, Homo sapiens
gctctttgactgtcagcaa

SEQ ID NO: 3590101 - DNA, 16 bp, Homo sapiens
gctgaaaacggagagg

SEQ ID NO: 3590102 - DNA, 18 bp, Homo sapiens
gctgaaattcaccaagaa

SEQ ID NO: 3590103 - DNA, 20 bp, Homo sapiens
gctgaaattcaccaagaaca

SEQ ID NO: 3590104 - DNA, 12 bp, Homo sapiens
gctgaaatttac

SEQ ID NO: 3590105 - DNA, 15 bp, Homo sapiens
gctgaacaggaaaga

SEQ ID NO: 3590106 - DNA, 15 bp, Homo sapiens
gctgaagatgccttg

SEQ ID NO: 3590107 - DNA, 18 bp, Homo sapiens
gctgaaggcagtggcagg

SEQ ID NO: 3590108 - DNA, 17 bp, Homo sapiens
gctgaattcacctgtgg

SEQ ID NO: 3590109 - DNA, 24 bp, Homo sapiens
gctgaatttccctctctcataccc

SEQ ID NO: 3590110 - DNA, 23 bp, Homo sapiens
gctgacagccacaccgtggcagc

SEQ ID NO: 3590111 - DNA, 15 bp, Homo sapiens
gctgacagctcttca

SEQ ID NO: 3590112 - DNA, 13 bp, Homo sapiens
gctgacagctgct

SEQ ID NO: 3590113 - DNA, 15 bp, Homo sapiens
gctgacagctgctcc

SEQ ID NO: 3590114 - DNA, 18 bp, Homo sapiens
gctgacagctgctcctag

SEQ ID NO: 3590115 - DNA, 22 bp, Homo sapiens
gctgaccccgagaagtgctctt

SEQ ID NO: 3590116 - DNA, 12 bp, Homo sapiens
gctgacccctct

SEQ ID NO: 3590117 - DNA, 13 bp, Homo sapiens
gctgacggccagg

SEQ ID NO: 3590118 - DNA, 18 bp, Homo sapiens
gctgactgtactcctccc

SEQ ID NO: 3590119 - DNA, 19 bp, Homo sapiens
gctgactgtactcctccca

SEQ ID NO: 3590120 - DNA, 19 bp, Homo sapiens
gctgagagaccctggcctc

SEQ ID NO: 3590121 - DNA, 20 bp, Homo sapiens
gctgagcacttagcaggcac

SEQ ID NO: 3590122 - DNA, 22 bp, Homo sapiens
gctgagcacttagcaggcaccg

SEQ ID NO: 3590123 - DNA, 13 bp, Homo sapiens
gctgagcagcttt

SEQ ID NO: 3590124 - DNA, 16 bp, Homo sapiens
gctgagcccctgggga

SEQ ID NO: 3590125 - DNA, 13 bp, Homo sapiens
gctgagcccctgt

SEQ ID NO: 3590126 - DNA, 23 bp, Homo sapiens
gctgagcccctgtctagagaggg

SEQ ID NO: 3590127 - DNA, 11 bp, Homo sapiens
gctgagctggc

SEQ ID NO: 3590128 - DNA, 16 bp, Homo sapiens
gctgaggagcagcagg

SEQ ID NO: 3590129 - DNA, 18 bp, Homo sapiens
gctgaggcaccgtccagg

SEQ ID NO: 3590130 - DNA, 20 bp, Homo sapiens
gctgaggcaccgtccaggcc

SEQ ID NO: 3590131 - DNA, 18 bp, Homo sapiens
gctgagtggcagcagccc

SEQ ID NO: 3590132 - DNA, 14 bp, Homo sapiens
gctgagttggcctg

SEQ ID NO: 3590133 - DNA, 16 bp, Homo sapiens
gctgcacaacagccct

SEQ ID NO: 3590134 - DNA, 13 bp, Homo sapiens
gctgcacaggctg

SEQ ID NO: 3590135 - DNA, 16 bp, Homo sapiens
gctgcaccccttcctg

SEQ ID NO: 3590136 - DNA, 22 bp, Homo sapiens
gctgcaccctgcgcctccagag

SEQ ID NO: 3590137 - DNA, 23 bp, Homo sapiens
gctgcaccctgcgcctccagagg

SEQ ID NO: 3590138 - DNA, 19 bp, Homo sapiens
gctgcagattagttctttt

SEQ ID NO: 3590139 - DNA, 16 bp, Homo sapiens
gctgcagcctgcgcca

SEQ ID NO: 3590140 - DNA, 14 bp, Homo sapiens
gctgcaggaagaaa

SEQ ID NO: 3590141 - DNA, 18 bp, Homo sapiens
gctgcaggaagaaacttt

SEQ ID NO: 3590142 - DNA, 21 bp, Homo sapiens
gctgcaggagtgtcctgccca

SEQ ID NO: 3590143 - DNA, 12 bp, Homo sapiens
gctgcaggcagg

SEQ ID NO: 3590144 - DNA, 20 bp, Homo sapiens
gctgcaggcaggcggctcct

SEQ ID NO: 3590145 - DNA, 16 bp, Homo sapiens
gctgcaggggcctctg

SEQ ID NO: 3590146 - DNA, 23 bp, Homo sapiens
gctgcattaccagcttaaaacac

SEQ ID NO: 3590147 - DNA, 20 bp, Homo sapiens
gctgccacccacctccctgc

SEQ ID NO: 3590148 - DNA, 13 bp, Homo sapiens
gctgccagcacag

SEQ ID NO: 3590149 - DNA, 16 bp, Homo sapiens
gctgccagcacagtag

SEQ ID NO: 3590150 - DNA, 16 bp, Homo sapiens
gctgccagggcttcct

SEQ ID NO: 3590151 - DNA, 13 bp, Homo sapiens
gctgccaggggct

SEQ ID NO: 3590152 - DNA, 22 bp, Homo sapiens
gctgccagtgcagccactggct

SEQ ID NO: 3590153 - DNA, 16 bp, Homo sapiens
gctgcccacctggctg

SEQ ID NO: 3590154 - DNA, 17 bp, Homo sapiens
gctgcccacctggctgc

SEQ ID NO: 3590155 - DNA, 18 bp, Homo sapiens
gctgcccacctggctgcc

SEQ ID NO: 3590156 - DNA, 19 bp, Homo sapiens
gctgcccaggggagccctc

SEQ ID NO: 3590157 - DNA, 14 bp, Homo sapiens
gctgccctagctga

SEQ ID NO: 3590158 - DNA, 18 bp, Homo sapiens
gctgccctagctgacccc

SEQ ID NO: 3590159 - DNA, 13 bp, Homo sapiens
gctgccctggtgc

SEQ ID NO: 3590160 - DNA, 15 bp, Homo sapiens
gctgccctggtgctg

SEQ ID NO: 3590161 - DNA, 14 bp, Homo sapiens
gctgccggctctgg

SEQ ID NO: 3590162 - DNA, 16 bp, Homo sapiens
gctgcctcaggaccca

SEQ ID NO: 3590163 - DNA, 22 bp, Homo sapiens
gctgcctcaggacccatccctg

SEQ ID NO: 3590164 - DNA, 15 bp, Homo sapiens
gctgcctcctgcgcc

SEQ ID NO: 3590165 - DNA, 19 bp, Homo sapiens
gctgcctcggatccccttc

SEQ ID NO: 3590166 - DNA, 20 bp, Homo sapiens
gctgcctcggatccccttcc

SEQ ID NO: 3590167 - DNA, 16 bp, Homo sapiens
gctgcctggatgagaa

SEQ ID NO: 3590168 - DNA, 12 bp, Homo sapiens
gctgcctgggcc

SEQ ID NO: 3590169 - DNA, 22 bp, Homo sapiens
gctgccttaatgacattcccct

SEQ ID NO: 3590170 - DNA, 14 bp, Homo sapiens
gctgccttcaggga

SEQ ID NO: 3590171 - DNA, 14 bp, Homo sapiens
gctgctactgctgc

SEQ ID NO: 3590172 - DNA, 16 bp, Homo sapiens
gctgctatagcctggg

SEQ ID NO: 3590173 - DNA, 20 bp, Homo sapiens
gctgctcccctaaagccagg

SEQ ID NO: 3590174 - DNA, 16 bp, Homo sapiens
gctgctcctagaggga

SEQ ID NO: 3590175 - DNA, 18 bp, Homo sapiens
gctgctcctagagggagg

SEQ ID NO: 3590176 - DNA, 19 bp, Homo sapiens
gctgctcctagagggaggg

SEQ ID NO: 3590177 - DNA, 21 bp, Homo sapiens
gctgctcctagagggaggggc

SEQ ID NO: 3590178 - DNA, 21 bp, Homo sapiens
gctgctctctccgaggggtgg

SEQ ID NO: 3590179 - DNA, 22 bp, Homo sapiens
gctgctctctccgaggggtgga

SEQ ID NO: 3590180 - DNA, 23 bp, Homo sapiens
gctgctctgccccagcttgggca

SEQ ID NO: 3590181 - DNA, 20 bp, Homo sapiens
gctgctgctcctctcttggg

SEQ ID NO: 3590182 - DNA, 14 bp, Homo sapiens
gctgctgctgctgc

SEQ ID NO: 3590183 - DNA, 16 bp, Homo sapiens
gctgctgtggagtgag

SEQ ID NO: 3590184 - DNA, 19 bp, Homo sapiens
gctgcttttgggggtcagc

SEQ ID NO: 3590185 - DNA, 18 bp, Homo sapiens
gctggaaagcagagcctc

SEQ ID NO: 3590186 - DNA, 20 bp, Homo sapiens
gctggaaagcagagcctcct

SEQ ID NO: 3590187 - DNA, 21 bp, Homo sapiens
gctggaaagcagagcctcctg

SEQ ID NO: 3590188 - DNA, 24 bp, Homo sapiens
gctggaaagttgggcccctgagga

SEQ ID NO: 3590189 - DNA, 15 bp, Homo sapiens
gctggaagtacttgg

SEQ ID NO: 3590190 - DNA, 22 bp, Homo sapiens
gctggaatccagaaggaagctc

SEQ ID NO: 3590191 - DNA, 12 bp, Homo sapiens
gctggagaaaga

SEQ ID NO: 3590192 - DNA, 17 bp, Homo sapiens
gctggagaaagagctgc

SEQ ID NO: 3590193 - DNA, 19 bp, Homo sapiens
gctggagacttcctctggt

SEQ ID NO: 3590194 - DNA, 15 bp, Homo sapiens
gctggagtgtgaggg

SEQ ID NO: 3590195 - DNA, 17 bp, Homo sapiens
gctggagttggggcaga

SEQ ID NO: 3590196 - DNA, 13 bp, Homo sapiens
gctggatctgtga

SEQ ID NO: 3590197 - DNA, 14 bp, Homo sapiens
gctggcaaatccag

SEQ ID NO: 3590198 - DNA, 17 bp, Homo sapiens
gctggcaaccagccagc

SEQ ID NO: 3590199 - DNA, 18 bp, Homo sapiens
gctggcaaccagccagcg

SEQ ID NO: 3590200 - DNA, 19 bp, Homo sapiens
gctggcaaccagccagcgt

SEQ ID NO: 3590201 - DNA, 16 bp, Homo sapiens
gctggcacaaaagaca

SEQ ID NO: 3590202 - DNA, 19 bp, Homo sapiens
gctggcacaaaagacagct

SEQ ID NO: 3590203 - DNA, 15 bp, Homo sapiens
gctggcccagggccc

SEQ ID NO: 3590204 - DNA, 19 bp, Homo sapiens
gctggcccagggcccagag

SEQ ID NO: 3590205 - DNA, 21 bp, Homo sapiens
gctggcccagggcccagagcc

SEQ ID NO: 3590206 - DNA, 22 bp, Homo sapiens
gctggccggagcaaactctgct

SEQ ID NO: 3590207 - DNA, 20 bp, Homo sapiens
gctggcgacacactccgtcc

SEQ ID NO: 3590208 - DNA, 22 bp, Homo sapiens
gctggcggaggctgctcggcta

SEQ ID NO: 3590209 - DNA, 11 bp, Homo sapiens
gctggctgcct

SEQ ID NO: 3590210 - DNA, 20 bp, Homo sapiens
gctgggaagagaagagggcc

SEQ ID NO: 3590211 - DNA, 14 bp, Homo sapiens
gctgggactgggaa

SEQ ID NO: 3590212 - DNA, 14 bp, Homo sapiens
gctgggagcactgg

SEQ ID NO: 3590213 - DNA, 13 bp, Homo sapiens
gctgggagcctgg

SEQ ID NO: 3590214 - DNA, 16 bp, Homo sapiens
gctgggagctctgcag

SEQ ID NO: 3590215 - DNA, 21 bp, Homo sapiens
gctgggaggtataggggtcct

SEQ ID NO: 3590216 - DNA, 23 bp, Homo sapiens
gctgggattggggggtgggcttt

SEQ ID NO: 3590217 - DNA, 17 bp, Homo sapiens
gctgggcagagggaggt

SEQ ID NO: 3590218 - DNA, 24 bp, Homo sapiens
gctgggccctctttccctgcgaga

SEQ ID NO: 3590219 - DNA, 12 bp, Homo sapiens
gctgggctgggc

SEQ ID NO: 3590220 - DNA, 15 bp, Homo sapiens
gctgggctgggccct

SEQ ID NO: 3590221 - DNA, 15 bp, Homo sapiens
gctggggaagacagt

SEQ ID NO: 3590222 - DNA, 16 bp, Homo sapiens
gctggggaagacagtg

SEQ ID NO: 3590223 - DNA, 14 bp, Homo sapiens
gctggggactcagg

SEQ ID NO: 3590224 - DNA, 16 bp, Homo sapiens
gctggggatgcgcctg

SEQ ID NO: 3590225 - DNA, 22 bp, Homo sapiens
gctggggccgccacggcctggc

SEQ ID NO: 3590226 - DNA, 21 bp, Homo sapiens
gctgggggaggtccaagcaga

SEQ ID NO: 3590227 - DNA, 19 bp, Homo sapiens
gctgggggtgggccaggct

SEQ ID NO: 3590228 - DNA, 14 bp, Homo sapiens
gctggtacctgccc

SEQ ID NO: 3590229 - DNA, 22 bp, Homo sapiens
gctggtcaaacaaactctctga

SEQ ID NO: 3590230 - DNA, 20 bp, Homo sapiens
gctggtctcaaactcctgac

SEQ ID NO: 3590231 - DNA, 21 bp, Homo sapiens
gctggtcttcactttcctcag

SEQ ID NO: 3590232 - DNA, 16 bp, Homo sapiens
gctggtgggaaggccg

SEQ ID NO: 3590233 - DNA, 14 bp, Homo sapiens
gctggttaatgtag

SEQ ID NO: 3590234 - DNA, 14 bp, Homo sapiens
gctggttagaaatg

SEQ ID NO: 3590235 - DNA, 18 bp, Homo sapiens
gctgtaactgagagaaag

SEQ ID NO: 3590236 - DNA, 19 bp, Homo sapiens
gctgtaagggcagtgccca

SEQ ID NO: 3590237 - DNA, 13 bp, Homo sapiens
gctgtactgagca

SEQ ID NO: 3590238 - DNA, 21 bp, Homo sapiens
gcaggagtgtcctgcccatgc

SEQ ID NO: 3590239 - DNA, 22 bp, Homo sapiens
gcaggagtgtcctgcccatgcc

SEQ ID NO: 3590240 - DNA, 23 bp, Homo sapiens
gcaggcaccgccacgtcccagca

SEQ ID NO: 3590241 - DNA, 22 bp, Homo sapiens
gcaggcagcttctactcctgcc

SEQ ID NO: 3590242 - DNA, 12 bp, Homo sapiens
gcaggccagaga

SEQ ID NO: 3590243 - DNA, 15 bp, Homo sapiens
gcaggcccaatgctg

SEQ ID NO: 3590244 - DNA, 16 bp, Homo sapiens
gcaggcccaatgctgc

SEQ ID NO: 3590245 - DNA, 14 bp, Homo sapiens
gccccgcccctccc

SEQ ID NO: 3590246 - DNA, 14 bp, Homo sapiens
gccccgccctcagg

SEQ ID NO: 3590247 - DNA, 16 bp, Homo sapiens
gccccgggcggagcct

SEQ ID NO: 3590248 - DNA, 15 bp, Homo sapiens
gccccgttttgggga

SEQ ID NO: 3590249 - DNA, 15 bp, Homo sapiens
gcccctaaagagcat

SEQ ID NO: 3590250 - DNA, 16 bp, Homo sapiens
gcccctcacactgcaa

SEQ ID NO: 3590251 - DNA, 18 bp, Homo sapiens
gcccctcacactgcaagg

SEQ ID NO: 3590252 - DNA, 19 bp, Homo sapiens
gcccctccaaacctccagc

SEQ ID NO: 3590253 - DNA, 20 bp, Homo sapiens
gcccctccaaacctccagcc

SEQ ID NO: 3590254 - DNA, 12 bp, Homo sapiens
gcccctccccag

SEQ ID NO: 3590255 - DNA, 13 bp, Homo sapiens
gcccctccccagc

SEQ ID NO: 3590256 - DNA, 20 bp, Homo sapiens
gcccctccctctccagcagg

SEQ ID NO: 3590257 - DNA, 23 bp, Homo sapiens
gcccctccctctccagcaggccc

SEQ ID NO: 3590258 - DNA, 15 bp, Homo sapiens
gcccctgcaatgtgg

SEQ ID NO: 3590259 - DNA, 14 bp, Homo sapiens
gcccctgcctgaca

SEQ ID NO: 3590260 - DNA, 19 bp, Homo sapiens
gcccctggatctcctccct

SEQ ID NO: 3590261 - DNA, 13 bp, Homo sapiens
gcccctggctttg

SEQ ID NO: 3590262 - DNA, 15 bp, Homo sapiens
gcccctggctttgcc

SEQ ID NO: 3590263 - DNA, 17 bp, Homo sapiens
gcccctggctttgcctc

SEQ ID NO: 3590264 - DNA, 18 bp, Homo sapiens
gcccctggctttgcctct

SEQ ID NO: 3590265 - DNA, 16 bp, Homo sapiens
gcccctgtggccaact

SEQ ID NO: 3590266 - DNA, 21 bp, Homo sapiens
gcccctgtgtattcaccacca

SEQ ID NO: 3590267 - DNA, 21 bp, Homo sapiens
gccccttaaacacaggctgtc

SEQ ID NO: 3590268 - DNA, 16 bp, Homo sapiens
gccccttccctgggtt

SEQ ID NO: 3590269 - DNA, 22 bp, Homo sapiens
gccccttccctgggtttgggag

SEQ ID NO: 3590270 - DNA, 12 bp, Homo sapiens
gcccgacagcct

SEQ ID NO: 3590271 - DNA, 19 bp, Homo sapiens
gcccgacaggtgggcctgg

SEQ ID NO: 3590272 - DNA, 23 bp, Homo sapiens
gcccgacagtgccatccccacct

SEQ ID NO: 3590273 - DNA, 17 bp, Homo sapiens
gcccgactgactggagg

SEQ ID NO: 3590274 - DNA, 15 bp, Homo sapiens
gcccgcatgtgtgcc

SEQ ID NO: 3590275 - DNA, 17 bp, Homo sapiens
gcccgccctcccggaga

SEQ ID NO: 3590276 - DNA, 14 bp, Homo sapiens
gcccgcgcagctgc

SEQ ID NO: 3590277 - DNA, 14 bp, Homo sapiens
gcccgcgccaggcc

SEQ ID NO: 3590278 - DNA, 22 bp, Homo sapiens
gcccgcgggagacagcttctct

SEQ ID NO: 3590279 - DNA, 21 bp, Homo sapiens
gcccggccgccccgccccaga

SEQ ID NO: 3590280 - DNA, 18 bp, Homo sapiens
gccctaaatagcagaaag

SEQ ID NO: 3590281 - DNA, 14 bp, Homo sapiens
gccctaagccccca

SEQ ID NO: 3590282 - DNA, 21 bp, Homo sapiens
gccctaagtggctgccttctt

SEQ ID NO: 3590283 - DNA, 18 bp, Homo sapiens
gccctaattaaaaactgt

SEQ ID NO: 3590284 - DNA, 12 bp, Homo sapiens
gccctagccctg

SEQ ID NO: 3590285 - DNA, 18 bp, Homo sapiens
gccctagccctgctccaa

SEQ ID NO: 3590286 - DNA, 14 bp, Homo sapiens
gccctagctgaccc

SEQ ID NO: 3590287 - DNA, 15 bp, Homo sapiens
gccctagctgacccc

SEQ ID NO: 3590288 - DNA, 22 bp, Homo sapiens
gccctattgctgctaagtcatt

SEQ ID NO: 3590289 - DNA, 17 bp, Homo sapiens
gccctatttcttgataa

SEQ ID NO: 3590290 - DNA, 17 bp, Homo sapiens
gccctcaagtaaaagaa

SEQ ID NO: 3590291 - DNA, 18 bp, Homo sapiens
gccctcaagtaaaagaaa

SEQ ID NO: 3590292 - DNA, 14 bp, Homo sapiens
gccctcaccacagc

SEQ ID NO: 3590293 - DNA, 16 bp, Homo sapiens
gccctcattctcattt

SEQ ID NO: 3590294 - DNA, 21 bp, Homo sapiens
gccctccacgccggctcttcc

SEQ ID NO: 3590295 - DNA, 23 bp, Homo sapiens
gccctccactccactgcctttgg

SEQ ID NO: 3590296 - DNA, 15 bp, Homo sapiens
gccctccctgcccct

SEQ ID NO: 3590297 - DNA, 20 bp, Homo sapiens
gccctccctgttccccagag

SEQ ID NO: 3590298 - DNA, 21 bp, Homo sapiens
gccctccctgttccccagaga

SEQ ID NO: 3590299 - DNA, 22 bp, Homo sapiens
gccctccctgttccccagagaa

SEQ ID NO: 3590300 - DNA, 12 bp, Homo sapiens
gccctcctcagc

SEQ ID NO: 3590301 - DNA, 16 bp, Homo sapiens
gccctcctcagctccc

SEQ ID NO: 3590302 - DNA, 19 bp, Homo sapiens
gccctcctcagctccctgc

SEQ ID NO: 3590303 - DNA, 22 bp, Homo sapiens
gccctctctcgggagccctagc

SEQ ID NO: 3590304 - DNA, 18 bp, Homo sapiens
gccctctggagtggccac

SEQ ID NO: 3590305 - DNA, 13 bp, Homo sapiens
gccctctttccct

SEQ ID NO: 3590306 - DNA, 16 bp, Homo sapiens
gccctctttccctgcg

SEQ ID NO: 3590307 - DNA, 20 bp, Homo sapiens
gccctctttccctgcgagac

SEQ ID NO: 3590308 - DNA, 16 bp, Homo sapiens
gccctgaatttcttct

SEQ ID NO: 3590309 - DNA, 20 bp, Homo sapiens
gccctgaatttcttcttttc

SEQ ID NO: 3590310 - DNA, 17 bp, Homo sapiens
gccctgacattggagcc

SEQ ID NO: 3590311 - DNA, 17 bp, Homo sapiens
gccctgcaccatgctgc

SEQ ID NO: 3590312 - DNA, 13 bp, Homo sapiens
gccctgcctgaga

SEQ ID NO: 3590313 - DNA, 15 bp, Homo sapiens
gccctgcggccccgt

SEQ ID NO: 3590314 - DNA, 22 bp, Homo sapiens
gccctgctttgggctgccctgg

SEQ ID NO: 3590315 - DNA, 14 bp, Homo sapiens
gccctggagagccc

SEQ ID NO: 3590316 - DNA, 14 bp, Homo sapiens
gccctggaggtctc

SEQ ID NO: 3590317 - DNA, 19 bp, Homo sapiens
gccctggaggtctccaggg

SEQ ID NO: 3590318 - DNA, 14 bp, Homo sapiens
gccctggaggtggc

SEQ ID NO: 3590319 - DNA, 20 bp, Homo sapiens
gccctggaggtggctgagcc

SEQ ID NO: 3590320 - DNA, 20 bp, Homo sapiens
gccctggccactaaagcttc

SEQ ID NO: 3590321 - DNA, 12 bp, Homo sapiens
gccctgggctcc

SEQ ID NO: 3590322 - DNA, 16 bp, Homo sapiens
gccctgggctcctctt

SEQ ID NO: 3590323 - DNA, 22 bp, Homo sapiens
gccctggggatcttcccacagg

SEQ ID NO: 3590324 - DNA, 23 bp, Homo sapiens
gccctggggatcttcccacagga

SEQ ID NO: 3590325 - DNA, 21 bp, Homo sapiens
gccctgggggattcctgagct

SEQ ID NO: 3590326 - DNA, 23 bp, Homo sapiens
gccctgggggattcctgagctgg

SEQ ID NO: 3590327 - DNA, 16 bp, Homo sapiens
gccctgggggtctggg

SEQ ID NO: 3590328 - DNA, 16 bp, Homo sapiens
gccctggtgctgccac

SEQ ID NO: 3590329 - DNA, 18 bp, Homo sapiens
gccctggttagctgacag

SEQ ID NO: 3590330 - DNA, 24 bp, Homo sapiens
gccctggttagctgacagtcagct

SEQ ID NO: 3590331 - DNA, 17 bp, Homo sapiens
gccctgtgagcacaaag

SEQ ID NO: 3590332 - DNA, 17 bp, Homo sapiens
gccctgttaaaagatga

SEQ ID NO: 3590333 - DNA, 16 bp, Homo sapiens
gccctgttgacacagg

SEQ ID NO: 3590334 - DNA, 22 bp, Homo sapiens
gcccttaagccaaactcaggcc

SEQ ID NO: 3590335 - DNA, 23 bp, Homo sapiens
gcccttaagccaaactcaggccc

SEQ ID NO: 3590336 - DNA, 13 bp, Homo sapiens
gcccttagaggga

SEQ ID NO: 3590337 - DNA, 17 bp, Homo sapiens
gcccttattttcaagaa

SEQ ID NO: 3590338 - DNA, 17 bp, Homo sapiens
gcccttcctctccactg

SEQ ID NO: 3590339 - DNA, 19 bp, Homo sapiens
gcccttcctctccactgcc

SEQ ID NO: 3590340 - DNA, 21 bp, Homo sapiens
gcccttctatacccacccaga

SEQ ID NO: 3590341 - DNA, 19 bp, Homo sapiens
gccgaccacgccccaggac

SEQ ID NO: 3590342 - DNA, 18 bp, Homo sapiens
gccgcagaccagctggcg

SEQ ID NO: 3590343 - DNA, 12 bp, Homo sapiens
gccgcagacctg

SEQ ID NO: 3590344 - DNA, 21 bp, Homo sapiens
gccgcagacctggagcttcag

SEQ ID NO: 3590345 - DNA, 12 bp, Homo sapiens
gccgcagagaaa

SEQ ID NO: 3590346 - DNA, 20 bp, Homo sapiens
gccgcagagaaatgccccag

SEQ ID NO: 3590347 - DNA, 21 bp, Homo sapiens
gccgccccgccccagagctcc

SEQ ID NO: 3590348 - DNA, 22 bp, Homo sapiens
gccgccccgccccagagctccg

SEQ ID NO: 3590349 - DNA, 17 bp, Homo sapiens
gccgccggaagtggctc

SEQ ID NO: 3590350 - DNA, 15 bp, Homo sapiens
gccgcgcccagcaga

SEQ ID NO: 3590351 - DNA, 23 bp, Homo sapiens
gccgctctctctgagggggtggg

SEQ ID NO: 3590352 - DNA, 23 bp, Homo sapiens
gccgctgcccttgggtccccccg

SEQ ID NO: 3590353 - DNA, 19 bp, Homo sapiens
gccgctgtataaagcatgt

SEQ ID NO: 3590354 - DNA, 12 bp, Homo sapiens
gccgctgtctct

SEQ ID NO: 3590355 - DNA, 16 bp, Homo sapiens
gccgctgtctctgagg

SEQ ID NO: 3590356 - DNA, 22 bp, Homo sapiens
gccgctgtctctgaggggtggg

SEQ ID NO: 3590357 - DNA, 23 bp, Homo sapiens
gccgctttctctgagggggtggg

SEQ ID NO: 3590358 - DNA, 22 bp, Homo sapiens
gccggaaggaatgtcagggcca

SEQ ID NO: 3590359 - DNA, 13 bp, Homo sapiens
gccggagggcagg

SEQ ID NO: 3590360 - DNA, 15 bp, Homo sapiens
gccggagtcagtgcc

SEQ ID NO: 3590361 - DNA, 16 bp, Homo sapiens
gccggagtcagtgcca

SEQ ID NO: 3590362 - DNA, 16 bp, Homo sapiens
gccggagtccactccc

SEQ ID NO: 3590363 - DNA, 17 bp, Homo sapiens
gccggatctgagggaga

SEQ ID NO: 3590364 - DNA, 18 bp, Homo sapiens
gccgtaggggctcctgag

SEQ ID NO: 3590365 - DNA, 23 bp, Homo sapiens
gccgtattttacatgaagctgta

SEQ ID NO: 3590366 - DNA, 15 bp, Homo sapiens
gccgtgccttcagct

SEQ ID NO: 3590367 - DNA, 16 bp, Homo sapiens
gccgtggcacagctgg

SEQ ID NO: 3590368 - DNA, 12 bp, Homo sapiens
gccgtggcttcc

SEQ ID NO: 3590369 - DNA, 15 bp, Homo sapiens
gccgtggcttcccgc

SEQ ID NO: 3590370 - DNA, 12 bp, Homo sapiens
gccgtggcttgg

SEQ ID NO: 3590371 - DNA, 13 bp, Homo sapiens
gccgtggcttggg

SEQ ID NO: 3590372 - DNA, 21 bp, Homo sapiens
gccgtgtctcagcctctgcca

SEQ ID NO: 3590373 - DNA, 15 bp, Homo sapiens
gcctaaagggcaggg

SEQ ID NO: 3590374 - DNA, 16 bp, Homo sapiens
gcctaaagggcagggc

SEQ ID NO: 3590375 - DNA, 19 bp, Homo sapiens
gcctaaatttaatgctgcc

SEQ ID NO: 3590376 - DNA, 18 bp, Homo sapiens
gcctaagaagaaggccag

SEQ ID NO: 3590377 - DNA, 18 bp, Homo sapiens
gcctaagaataaacattt

SEQ ID NO: 3590378 - DNA, 12 bp, Homo sapiens
gcctaagaccct

SEQ ID NO: 3590379 - DNA, 20 bp, Homo sapiens
gcctaccgctggccctgccg

SEQ ID NO: 3590380 - DNA, 22 bp, Homo sapiens
gcctacctctgtctgagacagg

SEQ ID NO: 3590381 - DNA, 17 bp, Homo sapiens
gcctagcctggctctgc

SEQ ID NO: 3590382 - DNA, 19 bp, Homo sapiens
gcctagcggagcccagcct

SEQ ID NO: 3590383 - DNA, 20 bp, Homo sapiens
gcctagcggagcccagcctg

SEQ ID NO: 3590384 - DNA, 17 bp, Homo sapiens
gcctaggcctcagccag

SEQ ID NO: 3590385 - DNA, 20 bp, Homo sapiens
gcctaggcctcagccagaga

SEQ ID NO: 3590386 - DNA, 15 bp, Homo sapiens
gcctatagtaaatgt

SEQ ID NO: 3590387 - DNA, 19 bp, Homo sapiens
gcctatgaaactggtttat

SEQ ID NO: 3590388 - DNA, 19 bp, Homo sapiens
gcctatgatactgtctctc

SEQ ID NO: 3590389 - DNA, 20 bp, Homo sapiens
gcctcaaaacgggtcagtat

SEQ ID NO: 3590390 - DNA, 16 bp, Homo sapiens
gcctcaacctcctggg

SEQ ID NO: 3590391 - DNA, 18 bp, Homo sapiens
gcctcacactggcgtctg

SEQ ID NO: 3590392 - DNA, 14 bp, Homo sapiens
gcctcaccagcccc

SEQ ID NO: 3590393 - DNA, 17 bp, Homo sapiens
gcctcagaaggccccag

SEQ ID NO: 3590394 - DNA, 20 bp, Homo sapiens
gcctcagaaggccccagaga

SEQ ID NO: 3590395 - DNA, 18 bp, Homo sapiens
gcctcagaccccctcagc

SEQ ID NO: 3590396 - DNA, 19 bp, Homo sapiens
gcctcagaccccctcagcc

SEQ ID NO: 3590397 - DNA, 20 bp, Homo sapiens
gcctcagaccccctcagcct

SEQ ID NO: 3590398 - DNA, 22 bp, Homo sapiens
gcctcagaccccctcagccttg

SEQ ID NO: 3590399 - DNA, 13 bp, Homo sapiens
gcctcagccagag

SEQ ID NO: 3590400 - DNA, 16 bp, Homo sapiens
gcctcagccagagaag

SEQ ID NO: 3590401 - DNA, 16 bp, Homo sapiens
gcctcagcctcctgag

SEQ ID NO: 3590402 - DNA, 12 bp, Homo sapiens
gcctcaggaccc

SEQ ID NO: 3590403 - DNA, 14 bp, Homo sapiens
gcctcaggacccat

SEQ ID NO: 3590404 - DNA, 17 bp, Homo sapiens
gcctcaggacccatccc

SEQ ID NO: 3590405 - DNA, 12 bp, Homo sapiens
gcctcaggctcc

SEQ ID NO: 3590406 - DNA, 19 bp, Homo sapiens
gcctcatgtcaaatattta

SEQ ID NO: 3590407 - DNA, 20 bp, Homo sapiens
gcctccaacgcccctgtggc

SEQ ID NO: 3590408 - DNA, 17 bp, Homo sapiens
gcctccaagctccatct

SEQ ID NO: 3590409 - DNA, 15 bp, Homo sapiens
gcctccaagggtttc

SEQ ID NO: 3590410 - DNA, 22 bp, Homo sapiens
gcctccacatgctgcctggcac

SEQ ID NO: 3590411 - DNA, 13 bp, Homo sapiens
gcctccaccagca

SEQ ID NO: 3590412 - DNA, 15 bp, Homo sapiens
gcctccaccagcaag

SEQ ID NO: 3590413 - DNA, 16 bp, Homo sapiens
gcctccaccagcaagg

SEQ ID NO: 3590414 - DNA, 19 bp, Homo sapiens
gcctccaggaaccacacca

SEQ ID NO: 3590415 - DNA, 17 bp, Homo sapiens
gcctcccagagtgctgg

SEQ ID NO: 3590416 - DNA, 14 bp, Homo sapiens
gcctcccctcccct

SEQ ID NO: 3590417 - DNA, 16 bp, Homo sapiens
gcctcccctcccctgg

SEQ ID NO: 3590418 - DNA, 18 bp, Homo sapiens
gcctcccctctccttcct

SEQ ID NO: 3590419 - DNA, 21 bp, Homo sapiens
gcctccctctcagaggcctgc

SEQ ID NO: 3590420 - DNA, 22 bp, Homo sapiens
gcctccctctcagaggcctgct

SEQ ID NO: 3590421 - DNA, 13 bp, Homo sapiens
gcctccctgaagc

SEQ ID NO: 3590422 - DNA, 16 bp, Homo sapiens
gcctccctgtctccag

SEQ ID NO: 3590423 - DNA, 20 bp, Homo sapiens
gcctccctgtctccagctgc

SEQ ID NO: 3590424 - DNA, 22 bp, Homo sapiens
gcctccctgtctccagctgcct

SEQ ID NO: 3590425 - DNA, 19 bp, Homo sapiens
gcctccgtcactacctggc

SEQ ID NO: 3590426 - DNA, 21 bp, Homo sapiens
gcctccgtcactacctggctg

SEQ ID NO: 3590427 - DNA, 17 bp, Homo sapiens
gcctcctcacccccagc

SEQ ID NO: 3590428 - DNA, 12 bp, Homo sapiens
gcctcctcagga

SEQ ID NO: 3590429 - DNA, 23 bp, Homo sapiens
gcctcctcggagagcagcagcac

SEQ ID NO: 3590430 - DNA, 17 bp, Homo sapiens
gcctcctgccccctgcc

SEQ ID NO: 3590431 - DNA, 24 bp, Homo sapiens
gcctcctgccccctgccagtgaag

SEQ ID NO: 3590432 - DNA, 13 bp, Homo sapiens
gcctcctgtacct

SEQ ID NO: 3590433 - DNA, 13 bp, Homo sapiens
gcctcctgtttgg

SEQ ID NO: 3590434 - DNA, 17 bp, Homo sapiens
gcctcggatccccttcc

SEQ ID NO: 3590435 - DNA, 16 bp, Homo sapiens
gcctcgtgaggggcaa

SEQ ID NO: 3590436 - DNA, 19 bp, Homo sapiens
gcctcgtgaggggcaagct

SEQ ID NO: 3590437 - DNA, 21 bp, Homo sapiens
gcctcgtgctccgcagggcgc

SEQ ID NO: 3590438 - DNA, 17 bp, Homo sapiens
gcctctcacaggcgcct

SEQ ID NO: 3590439 - DNA, 21 bp, Homo sapiens
gcctctctccttggccacaga

SEQ ID NO: 3590440 - DNA, 15 bp, Homo sapiens
gcctctgcattcagg

SEQ ID NO: 3590441 - DNA, 17 bp, Homo sapiens
gcctctgccctggattg

SEQ ID NO: 3590442 - DNA, 12 bp, Homo sapiens
gcctctgcctgt

SEQ ID NO: 3590443 - DNA, 13 bp, Homo sapiens
gcctctgcctgtc

SEQ ID NO: 3590444 - DNA, 19 bp, Homo sapiens
gcctctggcttccctaaac

SEQ ID NO: 3590445 - DNA, 15 bp, Homo sapiens
gcctctgggacccac

SEQ ID NO: 3590446 - DNA, 17 bp, Homo sapiens
gcctctgggacccacag

SEQ ID NO: 3590447 - DNA, 18 bp, Homo sapiens
gcctctgggacccacaga

SEQ ID NO: 3590448 - DNA, 21 bp, Homo sapiens
gcctctgggacccacagaact

SEQ ID NO: 3590449 - DNA, 17 bp, Homo sapiens
gcctcttactaatgtaa

SEQ ID NO: 3590450 - DNA, 19 bp, Homo sapiens
gcctcttgagttcctctgc

SEQ ID NO: 3590451 - DNA, 15 bp, Homo sapiens
gcctgaactgaggag

SEQ ID NO: 3590452 - DNA, 20 bp, Homo sapiens
gcctgaagagtcctctgaat

SEQ ID NO: 3590453 - DNA, 18 bp, Homo sapiens
gcctgaaggggcgtctgt

SEQ ID NO: 3590454 - DNA, 22 bp, Homo sapiens
gcctgaaggggcgtctgttccc

SEQ ID NO: 3590455 - DNA, 14 bp, Homo sapiens
gcctgacagccttc

SEQ ID NO: 3590456 - DNA, 22 bp, Homo sapiens
gcctgactagaactcctgtctt

SEQ ID NO: 3590457 - DNA, 22 bp, Homo sapiens
gcctgagggtccacctggagag

SEQ ID NO: 3590458 - DNA, 13 bp, Homo sapiens
gcctgagtcacct

SEQ ID NO: 3590459 - DNA, 21 bp, Homo sapiens
gcctgattcggggctgacctt

SEQ ID NO: 3590460 - DNA, 11 bp, Homo sapiens
gcctgcagaag

SEQ ID NO: 3590461 - DNA, 13 bp, Homo sapiens
gcctgcagcaggc

SEQ ID NO: 3590462 - DNA, 14 bp, Homo sapiens
gcctgcagcaggca

SEQ ID NO: 3590463 - DNA, 17 bp, Homo sapiens
gcctgcagcaggcagct

SEQ ID NO: 3590464 - DNA, 13 bp, Homo sapiens
gcctgcaggacct

SEQ ID NO: 3590465 - DNA, 13 bp, Homo sapiens
gcctgcatgagct

SEQ ID NO: 3590466 - DNA, 15 bp, Homo sapiens
gcctgcatgagctgg

SEQ ID NO: 3590467 - DNA, 15 bp, Homo sapiens
gcctgccagctgcac

SEQ ID NO: 3590468 - DNA, 18 bp, Homo sapiens
gcctgccagctgcactga

SEQ ID NO: 3590469 - DNA, 13 bp, Homo sapiens
gcctgccatgcca

SEQ ID NO: 3590470 - DNA, 15 bp, Homo sapiens
gcctgccccctgggc

SEQ ID NO: 3590471 - DNA, 21 bp, Homo sapiens
gcctgccccctgggctggggc

SEQ ID NO: 3590472 - DNA, 12 bp, Homo sapiens
gcctgcccctgt

SEQ ID NO: 3590473 - DNA, 16 bp, Homo sapiens
gcctgcctgcagcagg

SEQ ID NO: 3590474 - DNA, 14 bp, Homo sapiens
gcctgctgccagtg

SEQ ID NO: 3590475 - DNA, 19 bp, Homo sapiens
gcctgctgccagtgcagcc

SEQ ID NO: 3590476 - DNA, 15 bp, Homo sapiens
gcctgctgtgctggg

SEQ ID NO: 3590477 - DNA, 13 bp, Homo sapiens
gcctgcttcccac

SEQ ID NO: 3590478 - DNA, 14 bp, Homo sapiens
gcctgcttcccaca

SEQ ID NO: 3590479 - DNA, 15 bp, Homo sapiens
gcctgcttcccacaa

SEQ ID NO: 3590480 - DNA, 22 bp, Homo sapiens
gcctgcttcttctctccacatg

SEQ ID NO: 3590481 - DNA, 21 bp, Homo sapiens
gcctgcttgactttccagaat

SEQ ID NO: 3590482 - DNA, 22 bp, Homo sapiens
gcctgcttgactttccagaatg

SEQ ID NO: 3590483 - DNA, 21 bp, Homo sapiens
gcctggaagagctgagacctt

SEQ ID NO: 3590484 - DNA, 12 bp, Homo sapiens
gcctggagcagg

SEQ ID NO: 3590485 - DNA, 20 bp, Homo sapiens
gcctggaggctcctctaggc

SEQ ID NO: 3590486 - DNA, 14 bp, Homo sapiens
gcctggaggtctgg

SEQ ID NO: 3590487 - DNA, 17 bp, Homo sapiens
gcctggaggtctggctg

SEQ ID NO: 3590488 - DNA, 19 bp, Homo sapiens
gcctggaggtctggctgag

SEQ ID NO: 3590489 - DNA, 12 bp, Homo sapiens
gcctggatgaga

SEQ ID NO: 3590490 - DNA, 23 bp, Homo sapiens
gcctggatgagaaacagctcagc

SEQ ID NO: 3590491 - DNA, 15 bp, Homo sapiens
gcctggcaacagagc

SEQ ID NO: 3590492 - DNA, 17 bp, Homo sapiens
gcctggccagacacagg

SEQ ID NO: 3590493 - DNA, 16 bp, Homo sapiens
gcctggccatttccaa

SEQ ID NO: 3590494 - DNA, 13 bp, Homo sapiens
gcctggctctgcc

SEQ ID NO: 3590495 - DNA, 17 bp, Homo sapiens
gcctgggagcccagagg

SEQ ID NO: 3590496 - DNA, 20 bp, Homo sapiens
gcctgggcccggaagggctt

SEQ ID NO: 3590497 - DNA, 15 bp, Homo sapiens
gcctgggccgtggca

SEQ ID NO: 3590498 - DNA, 18 bp, Homo sapiens
gcctgggccgtggcacag

SEQ ID NO: 3590499 - DNA, 13 bp, Homo sapiens
gcctgggctctgg

SEQ ID NO: 3590500 - DNA, 15 bp, Homo sapiens
gcctgggggtggggg

SEQ ID NO: 3590501 - DNA, 14 bp, Homo sapiens
gcctggggtctgga

SEQ ID NO: 3590502 - DNA, 16 bp, Homo sapiens
gcctggggtgcatctc

SEQ ID NO: 3590503 - DNA, 17 bp, Homo sapiens
gcctggggtgcatctcc

SEQ ID NO: 3590504 - DNA, 22 bp, Homo sapiens
gcctggggtggggtcatgccct

SEQ ID NO: 3590505 - DNA, 18 bp, Homo sapiens
gcctggggtgtcctacag

SEQ ID NO: 3590506 - DNA, 20 bp, Homo sapiens
gcctggggtgtcctacagtg

SEQ ID NO: 3590507 - DNA, 14 bp, Homo sapiens
gcctggttagaggc

SEQ ID NO: 3590508 - DNA, 22 bp, Homo sapiens
gcctggttcagacacagctctt

SEQ ID NO: 3590509 - DNA, 18 bp, Homo sapiens
gcctggtttctgggtgct

SEQ ID NO: 3590510 - DNA, 22 bp, Homo sapiens
gcctgtagtcccagctactcag

SEQ ID NO: 3590511 - DNA, 17 bp, Homo sapiens
gcctgtcaagagggagg

SEQ ID NO: 3590512 - DNA, 20 bp, Homo sapiens
gcctgtcccttgcctctgcc

SEQ ID NO: 3590513 - DNA, 13 bp, Homo sapiens
gcctgtcctgggc

SEQ ID NO: 3590514 - DNA, 16 bp, Homo sapiens
gcctgtcctgggctgg

SEQ ID NO: 3590515 - DNA, 18 bp, Homo sapiens
gcctgtgagcatggggcc

SEQ ID NO: 3590516 - DNA, 18 bp, Homo sapiens
gcctgtgccagcaccaca

SEQ ID NO: 3590517 - DNA, 18 bp, Homo sapiens
gcctgtgcgtcccagctg

SEQ ID NO: 3590518 - DNA, 23 bp, Homo sapiens
gcctgtgcgtcccagctgaaggc

SEQ ID NO: 3590519 - DNA, 13 bp, Homo sapiens
gcctgtgggcttc

SEQ ID NO: 3590520 - DNA, 22 bp, Homo sapiens
gcctgttaatttataatgtatt

SEQ ID NO: 3590521 - DNA, 23 bp, Homo sapiens
gcctgttaatttataatgtattt

SEQ ID NO: 3590522 - DNA, 18 bp, Homo sapiens
gcctgttggcaggcccac

SEQ ID NO: 3590523 - DNA, 13 bp, Homo sapiens
gccttaaaatgga

SEQ ID NO: 3590524 - DNA, 14 bp, Homo sapiens
gccttaaagaggga

SEQ ID NO: 3590525 - DNA, 13 bp, Homo sapiens
gccttaaggccct

SEQ ID NO: 3590526 - DNA, 14 bp, Homo sapiens
tccacccccaggtg

SEQ ID NO: 3590527 - DNA, 16 bp, Homo sapiens
tccacccccaggtgca

SEQ ID NO: 3590528 - DNA, 18 bp, Homo sapiens
tccacccgggggagccca

SEQ ID NO: 3590529 - DNA, 18 bp, Homo sapiens
tccaccgaccaactgccc

SEQ ID NO: 3590530 - DNA, 19 bp, Homo sapiens
tccaccgaccaactgccct

SEQ ID NO: 3590531 - DNA, 20 bp, Homo sapiens
tccaccgaccaactgcccta

SEQ ID NO: 3590532 - DNA, 14 bp, Homo sapiens
tccacctcaactcc

SEQ ID NO: 3590533 - DNA, 13 bp, Homo sapiens
tccacctggagag

SEQ ID NO: 3590534 - DNA, 22 bp, Homo sapiens
tccacctggagagtacatttgc

SEQ ID NO: 3590535 - DNA, 16 bp, Homo sapiens
tccaccttcccatgcc

SEQ ID NO: 3590536 - DNA, 19 bp, Homo sapiens
tccaccttcccatgccctg

SEQ ID NO: 3590537 - DNA, 18 bp, Homo sapiens
tccactaccaaaagacat

SEQ ID NO: 3590538 - DNA, 19 bp, Homo sapiens
tccactaccaaaagacatt

SEQ ID NO: 3590539 - DNA, 19 bp, Homo sapiens
tccactatttgcagaggct

SEQ ID NO: 3590540 - DNA, 13 bp, Homo sapiens
tccactccactgc

SEQ ID NO: 3590541 - DNA, 16 bp, Homo sapiens
tccactcgacccagaa

SEQ ID NO: 3590542 - DNA, 18 bp, Homo sapiens
tccactcgacccagaatg

SEQ ID NO: 3590543 - DNA, 20 bp, Homo sapiens
tccactcttgatctctcttg

SEQ ID NO: 3590544 - DNA, 20 bp, Homo sapiens
tccactgaaaatttaacagt

SEQ ID NO: 3590545 - DNA, 15 bp, Homo sapiens
tccactgccttcgat

SEQ ID NO: 3590546 - DNA, 22 bp, Homo sapiens
tccactggaacgtttcactgca

SEQ ID NO: 3590547 - DNA, 23 bp, Homo sapiens
tccactggaacgtttcactgcaa

SEQ ID NO: 3590548 - DNA, 21 bp, Homo sapiens
tccagaagatgccagcttctc

SEQ ID NO: 3590549 - DNA, 23 bp, Homo sapiens
tccagacccctggcttttcactg

SEQ ID NO: 3590550 - DNA, 19 bp, Homo sapiens
tccagacctgatcctggag

SEQ ID NO: 3590551 - DNA, 19 bp, Homo sapiens
tccagacctggctccactc

SEQ ID NO: 3590552 - DNA, 23 bp, Homo sapiens
tccagactgcttccaattttctg

SEQ ID NO: 3590553 - DNA, 15 bp, Homo sapiens
tccagagagtggaga

SEQ ID NO: 3590554 - DNA, 18 bp, Homo sapiens
tccagagagtggagagag

SEQ ID NO: 3590555 - DNA, 17 bp, Homo sapiens
tccagagataaaaatca

SEQ ID NO: 3590556 - DNA, 19 bp, Homo sapiens
tccagagataaaaatcata

SEQ ID NO: 3590557 - DNA, 23 bp, Homo sapiens
tccagagataaaaatcatataga

SEQ ID NO: 3590558 - DNA, 15 bp, Homo sapiens
tccagatgccacaat

SEQ ID NO: 3590559 - DNA, 12 bp, Homo sapiens
tccagcactggt

SEQ ID NO: 3590560 - DNA, 12 bp, Homo sapiens
tccagcaggccc

SEQ ID NO: 3590561 - DNA, 15 bp, Homo sapiens
tccagcaggcccatg

SEQ ID NO: 3590562 - DNA, 12 bp, Homo sapiens
tccagcagggaa

SEQ ID NO: 3590563 - DNA, 9 bp, Homo sapiens
tccagccac

SEQ ID NO: 3590564 - DNA, 10 bp, Homo sapiens
tccagccact

SEQ ID NO: 3590565 - DNA, 23 bp, Homo sapiens
tccagcccaaacctgggaaggcc

SEQ ID NO: 3590566 - DNA, 22 bp, Homo sapiens
tccagcccggggccagcttggc

SEQ ID NO: 3590567 - DNA, 12 bp, Homo sapiens
tccagcctcccc

SEQ ID NO: 3590568 - DNA, 14 bp, Homo sapiens
tccagcctcccctc

SEQ ID NO: 3590569 - DNA, 19 bp, Homo sapiens
tccagcctcccctcccctg

SEQ ID NO: 3590570 - DNA, 16 bp, Homo sapiens
tccagcctccctgtct

SEQ ID NO: 3590571 - DNA, 22 bp, Homo sapiens
tccagcctgggcaacgagtgaa

SEQ ID NO: 3590572 - DNA, 17 bp, Homo sapiens
tccagcctggggtctgg

SEQ ID NO: 3590573 - DNA, 14 bp, Homo sapiens
tccagctcagccct

SEQ ID NO: 3590574 - DNA, 16 bp, Homo sapiens
tccagctcagccctgg

SEQ ID NO: 3590575 - DNA, 19 bp, Homo sapiens
tccagctccaacctgcaaa

SEQ ID NO: 3590576 - DNA, 17 bp, Homo sapiens
tccagctccgtgtttct

SEQ ID NO: 3590577 - DNA, 22 bp, Homo sapiens
tccagctctgacatcccttcct

SEQ ID NO: 3590578 - DNA, 17 bp, Homo sapiens
tccagctctttagaatg

SEQ ID NO: 3590579 - DNA, 21 bp, Homo sapiens
tccagctgactaaactttttt

SEQ ID NO: 3590580 - DNA, 11 bp, Homo sapiens
tccagctgcct

SEQ ID NO: 3590581 - DNA, 16 bp, Homo sapiens
tccagctgcctgggcc

SEQ ID NO: 3590582 - DNA, 18 bp, Homo sapiens
tccagctgggaagccctt

SEQ ID NO: 3590583 - DNA, 18 bp, Homo sapiens
tccaggaaccacaccaca

SEQ ID NO: 3590584 - DNA, 18 bp, Homo sapiens
tccaggacaggagatgct

SEQ ID NO: 3590585 - DNA, 15 bp, Homo sapiens
tccaggactgtttca

SEQ ID NO: 3590586 - DNA, 22 bp, Homo sapiens
tccaggactgtttcaaacatgc

SEQ ID NO: 3590587 - DNA, 16 bp, Homo sapiens
tccaggagagagccag

SEQ ID NO: 3590588 - DNA, 18 bp, Homo sapiens
tccaggagagcctggggg

SEQ ID NO: 3590589 - DNA, 14 bp, Homo sapiens
tccaggagccccgc

SEQ ID NO: 3590590 - DNA, 13 bp, Homo sapiens
tccaggagcctgg

SEQ ID NO: 3590591 - DNA, 14 bp, Homo sapiens
tccaggagcctggc

SEQ ID NO: 3590592 - DNA, 15 bp, Homo sapiens
tccaggagcctgtgc

SEQ ID NO: 3590593 - DNA, 22 bp, Homo sapiens
tccaggatgctaacatctaaaa

SEQ ID NO: 3590594 - DNA, 13 bp, Homo sapiens
tccaggcagatcc

SEQ ID NO: 3590595 - DNA, 16 bp, Homo sapiens
tccaggcagatccagg

SEQ ID NO: 3590596 - DNA, 18 bp, Homo sapiens
tccaggcagatccaggac

SEQ ID NO: 3590597 - DNA, 21 bp, Homo sapiens
tccaggcagatccaggactat

SEQ ID NO: 3590598 - DNA, 19 bp, Homo sapiens
tccagggagcattttcctc

SEQ ID NO: 3590599 - DNA, 18 bp, Homo sapiens
tccagggcagcaggccag

SEQ ID NO: 3590600 - DNA, 19 bp, Homo sapiens
tccagggcagcaggccaga

SEQ ID NO: 3590601 - DNA, 17 bp, Homo sapiens
tccagggcctgacaccc

SEQ ID NO: 3590602 - DNA, 18 bp, Homo sapiens
tccaggggagatggggag

SEQ ID NO: 3590603 - DNA, 19 bp, Homo sapiens
tccaggggagatggggagg

SEQ ID NO: 3590604 - DNA, 19 bp, Homo sapiens
tccagggtgacaaggcctg

SEQ ID NO: 3590605 - DNA, 14 bp, Homo sapiens
tccaggtcagcctg

SEQ ID NO: 3590606 - DNA, 15 bp, Homo sapiens
tccaggtcagcctgg

SEQ ID NO: 3590607 - DNA, 16 bp, Homo sapiens
tccaggtcagcctgga

SEQ ID NO: 3590608 - DNA, 20 bp, Homo sapiens
tccaggtcggagtgcctgga

SEQ ID NO: 3590609 - DNA, 17 bp, Homo sapiens
tccaggttggttttgct

SEQ ID NO: 3590610 - DNA, 23 bp, Homo sapiens
tccaggttggttttgctgttgat

SEQ ID NO: 3590611 - DNA, 14 bp, Homo sapiens
tccaggtttttcaa

SEQ ID NO: 3590612 - DNA, 16 bp, Homo sapiens
tccaggtttttcaatt

SEQ ID NO: 3590613 - DNA, 19 bp, Homo sapiens
tccaggtttttcaattaaa

SEQ ID NO: 3590614 - DNA, 20 bp, Homo sapiens
tccaggtttttcaattaaac

SEQ ID NO: 3590615 - DNA, 21 bp, Homo sapiens
tccaggtttttcaattaaacg

SEQ ID NO: 3590616 - DNA, 22 bp, Homo sapiens
tccaggtttttcaattaaacgg

SEQ ID NO: 3590617 - DNA, 22 bp, Homo sapiens
tccagtaaggatttttatgtac

SEQ ID NO: 3590618 - DNA, 15 bp, Homo sapiens
tccagtgaaatgatt

SEQ ID NO: 3590619 - DNA, 23 bp, Homo sapiens
tccagtgacatgattctgaactt

SEQ ID NO: 3590620 - DNA, 21 bp, Homo sapiens
tccagtggtgggtaattgtac

SEQ ID NO: 3590621 - DNA, 17 bp, Homo sapiens
tccagtgtcagggtcca

SEQ ID NO: 3590622 - DNA, 22 bp, Homo sapiens
tccagtgtgagatactgtgtat

SEQ ID NO: 3590623 - DNA, 14 bp, Homo sapiens
tccagtttttcata

SEQ ID NO: 3590624 - DNA, 21 bp, Homo sapiens
tccataaagacaatcactgcc

SEQ ID NO: 3590625 - DNA, 22 bp, Homo sapiens
tccataatctggactcctctgt

SEQ ID NO: 3590626 - DNA, 14 bp, Homo sapiens
tccatcaggccact

SEQ ID NO: 3590627 - DNA, 22 bp, Homo sapiens
tccatcatttctgtctttaaga

SEQ ID NO: 3590628 - DNA, 16 bp, Homo sapiens
tccatcccctccctgc

SEQ ID NO: 3590629 - DNA, 17 bp, Homo sapiens
tccatcccctccctgcc

SEQ ID NO: 3590630 - DNA, 12 bp, Homo sapiens
tccatcctgagc

SEQ ID NO: 3590631 - DNA, 16 bp, Homo sapiens
tccatcctgagccaaa

SEQ ID NO: 3590632 - DNA, 17 bp, Homo sapiens
tccatctcaaaacaaaa

SEQ ID NO: 3590633 - DNA, 14 bp, Homo sapiens
tccatctcttctgc

SEQ ID NO: 3590634 - DNA, 17 bp, Homo sapiens
tccatctgtttgataca

SEQ ID NO: 3590635 - DNA, 18 bp, Homo sapiens
tccatcttgagccacagt

SEQ ID NO: 3590636 - DNA, 15 bp, Homo sapiens
tccatctttctacag

SEQ ID NO: 3590637 - DNA, 20 bp, Homo sapiens
tccatgatgcacagtatctg

SEQ ID NO: 3590638 - DNA, 23 bp, Homo sapiens
tccatgatgcacagtatctgctg

SEQ ID NO: 3590639 - DNA, 21 bp, Homo sapiens
tccatgcaccctcatacacag

SEQ ID NO: 3590640 - DNA, 17 bp, Homo sapiens
tccatgcctgaccaaca

SEQ ID NO: 3590641 - DNA, 19 bp, Homo sapiens
tccatggagcctacctctg

SEQ ID NO: 3590642 - DNA, 22 bp, Homo sapiens
tccatggagcctacctctgtct

SEQ ID NO: 3590643 - DNA, 16 bp, Homo sapiens
tccatggcaattttgt

SEQ ID NO: 3590644 - DNA, 18 bp, Homo sapiens
tccatgtcgcctctgcat

SEQ ID NO: 3590645 - DNA, 12 bp, Homo sapiens
tccatgtgcctt

SEQ ID NO: 3590646 - DNA, 16 bp, Homo sapiens
tccatgtgcctttctt

SEQ ID NO: 3590647 - DNA, 19 bp, Homo sapiens
tccatgtgcctttctttgc

SEQ ID NO: 3590648 - DNA, 20 bp, Homo sapiens
tccatgtgcctttctttgcc

SEQ ID NO: 3590649 - DNA, 12 bp, Homo sapiens
tccatgttgact

SEQ ID NO: 3590650 - DNA, 22 bp, Homo sapiens
tccatgttggtcaggctggtct

SEQ ID NO: 3590651 - DNA, 20 bp, Homo sapiens
tccattcacaagcctcctgt

SEQ ID NO: 3590652 - DNA, 21 bp, Homo sapiens
tccatttcaggactctctcca

SEQ ID NO: 3590653 - DNA, 12 bp, Homo sapiens
tcccaaactgac

SEQ ID NO: 3590654 - DNA, 14 bp, Homo sapiens
tcccaaactgacaa

SEQ ID NO: 3590655 - DNA, 17 bp, Homo sapiens
tcccaaactgacaattt

SEQ ID NO: 3590656 - DNA, 20 bp, Homo sapiens
tcccaaagtgctgggattac

SEQ ID NO: 3590657 - DNA, 19 bp, Homo sapiens
tcccaacgtgcaaagccaa

SEQ ID NO: 3590658 - DNA, 20 bp, Homo sapiens
tcccaacgtgcaaagccaag

SEQ ID NO: 3590659 - DNA, 17 bp, Homo sapiens
tcccaactctagctggg

SEQ ID NO: 3590660 - DNA, 20 bp, Homo sapiens
tcccaaggcattctcccagc

SEQ ID NO: 3590661 - DNA, 22 bp, Homo sapiens
tcccaaggctctgagcaaatgt

SEQ ID NO: 3590662 - DNA, 15 bp, Homo sapiens
tcataatctttgctt

SEQ ID NO: 3590663 - DNA, 14 bp, Homo sapiens
tcataattctgaaa

SEQ ID NO: 3590664 - DNA, 15 bp, Homo sapiens
tcataattctgaaac

SEQ ID NO: 3590665 - DNA, 13 bp, Homo sapiens
tcataattttgca

SEQ ID NO: 3590666 - DNA, 15 bp, Homo sapiens
tcatacaaactctca

SEQ ID NO: 3590667 - DNA, 16 bp, Homo sapiens
tcatacaaactctcac

SEQ ID NO: 3590668 - DNA, 18 bp, Homo sapiens
tcatacaaactctcacca

SEQ ID NO: 3590669 - DNA, 13 bp, Homo sapiens
tcatacacagaaa

SEQ ID NO: 3590670 - DNA, 14 bp, Homo sapiens
tcatacacttcctt

SEQ ID NO: 3590671 - DNA, 23 bp, Homo sapiens
tcatagaaatgtaacttttgtaa

SEQ ID NO: 3590672 - DNA, 20 bp, Homo sapiens
tcatagcaagcttttgctca

SEQ ID NO: 3590673 - DNA, 14 bp, Homo sapiens
tcatagcatgatat

SEQ ID NO: 3590674 - DNA, 20 bp, Homo sapiens
tcatagcattgtctattttt

SEQ ID NO: 3590675 - DNA, 14 bp, Homo sapiens
tcatagtaaaatac

SEQ ID NO: 3590676 - DNA, 16 bp, Homo sapiens
tcatatttacttctta

SEQ ID NO: 3590677 - DNA, 21 bp, Homo sapiens
tcatatttacttcttatacat

SEQ ID NO: 3590678 - DNA, 12 bp, Homo sapiens
tcatatttgaaa

SEQ ID NO: 3590679 - DNA, 13 bp, Homo sapiens
tcatcatttcagc

SEQ ID NO: 3590680 - DNA, 15 bp, Homo sapiens
tcatcatttcagcca

SEQ ID NO: 3590681 - DNA, 14 bp, Homo sapiens
tcatccatcctgag

SEQ ID NO: 3590682 - DNA, 18 bp, Homo sapiens
tcatccatcctgagccaa

SEQ ID NO: 3590683 - DNA, 15 bp, Homo sapiens
tcatccgcctgtggg

SEQ ID NO: 3590684 - DNA, 17 bp, Homo sapiens
tcatcctcaaagaaagt

SEQ ID NO: 3590685 - DNA, 21 bp, Homo sapiens
tcatcctcaaagaaagtgtat

SEQ ID NO: 3590686 - DNA, 22 bp, Homo sapiens
tcatcctcaaagaaagtgtatt

SEQ ID NO: 3590687 - DNA, 23 bp, Homo sapiens
tcatcctcaaagaaagtgtattg

SEQ ID NO: 3590688 - DNA, 20 bp, Homo sapiens
tcatcgaagggattgtgtat

SEQ ID NO: 3590689 - DNA, 21 bp, Homo sapiens
tcatcgaggagctagaacatt

SEQ ID NO: 3590690 - DNA, 16 bp, Homo sapiens
tcatctgagaggctct

SEQ ID NO: 3590691 - DNA, 23 bp, Homo sapiens
tcatctgagaggctctccgtgca

SEQ ID NO: 3590692 - DNA, 12 bp, Homo sapiens
tcatctgtctcg

SEQ ID NO: 3590693 - DNA, 15 bp, Homo sapiens
tcatcttattcagca

SEQ ID NO: 3590694 - DNA, 17 bp, Homo sapiens
tcatcttgcagcattta

SEQ ID NO: 3590695 - DNA, 21 bp, Homo sapiens
tcatgaaaaagctgcttctta

SEQ ID NO: 3590696 - DNA, 19 bp, Homo sapiens
tcatgaagtgcacaggagc

SEQ ID NO: 3590697 - DNA, 17 bp, Homo sapiens
tcatgaatgtgagtcat

SEQ ID NO: 3590698 - DNA, 18 bp, Homo sapiens
tcatgagtgaataaatgt

SEQ ID NO: 3590699 - DNA, 21 bp, Homo sapiens
tcatgcaagtggagctgtctg

SEQ ID NO: 3590700 - DNA, 16 bp, Homo sapiens
tcatgcacccctgagc

SEQ ID NO: 3590701 - DNA, 14 bp, Homo sapiens
tcatgcagctgtgg

SEQ ID NO: 3590702 - DNA, 23 bp, Homo sapiens
tcatgcattttgctttggacaca

SEQ ID NO: 3590703 - DNA, 15 bp, Homo sapiens
tcatgctatctctgt

SEQ ID NO: 3590704 - DNA, 23 bp, Homo sapiens
tcatggatgggggaactcagatc

SEQ ID NO: 3590705 - DNA, 20 bp, Homo sapiens
tcatggattttccaggactg

SEQ ID NO: 3590706 - DNA, 13 bp, Homo sapiens
tcatggtgaaatt

SEQ ID NO: 3590707 - DNA, 20 bp, Homo sapiens
tcatggtgaaattataacta

SEQ ID NO: 3590708 - DNA, 22 bp, Homo sapiens
tcatggtgaaattataactatt

SEQ ID NO: 3590709 - DNA, 13 bp, Homo sapiens
tcatggttcaagt

SEQ ID NO: 3590710 - DNA, 14 bp, Homo sapiens
tcatggttcaagta

SEQ ID NO: 3590711 - DNA, 15 bp, Homo sapiens
tcatggttcaagtat

SEQ ID NO: 3590712 - DNA, 22 bp, Homo sapiens
tcatggttcaagtattaagcag

SEQ ID NO: 3590713 - DNA, 19 bp, Homo sapiens
tcatgtaaaaagtgcagta

SEQ ID NO: 3590714 - DNA, 20 bp, Homo sapiens
tcatgtccagtgagcagtgt

SEQ ID NO: 3590715 - DNA, 14 bp, Homo sapiens
tcatgtcttgtcat

SEQ ID NO: 3590716 - DNA, 20 bp, Homo sapiens
tcatgttatgcagtgaacta

SEQ ID NO: 3590717 - DNA, 21 bp, Homo sapiens
tcatgttgttgtgtgtatatg

SEQ ID NO: 3590718 - DNA, 22 bp, Homo sapiens
tcatgttgttgtgtgtatatgt

SEQ ID NO: 3590719 - DNA, 22 bp, Homo sapiens
tcatgtttggaaaataatttct

SEQ ID NO: 3590720 - DNA, 20 bp, Homo sapiens
tcatgttttagcatttgtat

SEQ ID NO: 3590721 - DNA, 15 bp, Homo sapiens
tcattaaagacagga

SEQ ID NO: 3590722 - DNA, 16 bp, Homo sapiens
tcattaccctacagac

SEQ ID NO: 3590723 - DNA, 17 bp, Homo sapiens
tcattactgttccagat

SEQ ID NO: 3590724 - DNA, 21 bp, Homo sapiens
tcattactgttccagattcct

SEQ ID NO: 3590725 - DNA, 20 bp, Homo sapiens
tcattatctcaaaactgcac

SEQ ID NO: 3590726 - DNA, 17 bp, Homo sapiens
tcattatgttaatattt

SEQ ID NO: 3590727 - DNA, 20 bp, Homo sapiens
tcattatttttgttagcaaa

SEQ ID NO: 3590728 - DNA, 22 bp, Homo sapiens
tcattatttttgttagcaaaga

SEQ ID NO: 3590729 - DNA, 14 bp, Homo sapiens
tcattcagaaaaaa

SEQ ID NO: 3590730 - DNA, 21 bp, Homo sapiens
tcattcagtaagttctgtggt

SEQ ID NO: 3590731 - DNA, 19 bp, Homo sapiens
tcattcagttctaggcctt

SEQ ID NO: 3590732 - DNA, 23 bp, Homo sapiens
tcattcagttctaggcctttcct

SEQ ID NO: 3590733 - DNA, 23 bp, Homo sapiens
tcattccaccttcccatgccctg

SEQ ID NO: 3590734 - DNA, 14 bp, Homo sapiens
tcattccattgact

SEQ ID NO: 3590735 - DNA, 16 bp, Homo sapiens
tcattctcgtgagtca

SEQ ID NO: 3590736 - DNA, 20 bp, Homo sapiens
tcattctggttccctgctgc

SEQ ID NO: 3590737 - DNA, 15 bp, Homo sapiens
tcattcttactaaaa

SEQ ID NO: 3590738 - DNA, 14 bp, Homo sapiens
tcattctttactgc

SEQ ID NO: 3590739 - DNA, 18 bp, Homo sapiens
tcattctttactgcactc

SEQ ID NO: 3590740 - DNA, 22 bp, Homo sapiens
tcattctttataaaccataaaa

SEQ ID NO: 3590741 - DNA, 19 bp, Homo sapiens
tcattgccaagggcccaaa

SEQ ID NO: 3590742 - DNA, 13 bp, Homo sapiens
tcatttcagccaa

SEQ ID NO: 3590743 - DNA, 22 bp, Homo sapiens
tcatttctcataattttgcaaa

SEQ ID NO: 3590744 - DNA, 18 bp, Homo sapiens
tcatttgactaagagtct

SEQ ID NO: 3590745 - DNA, 13 bp, Homo sapiens
tcatttgtttaaa

SEQ ID NO: 3590746 - DNA, 14 bp, Homo sapiens
tcatttgtttaaac

SEQ ID NO: 3590747 - DNA, 18 bp, Homo sapiens
tcatttgtttaaacaatc

SEQ ID NO: 3590748 - DNA, 17 bp, Homo sapiens
tcattttatttacagct

SEQ ID NO: 3590749 - DNA, 20 bp, Homo sapiens
tcattttatttacagctgtg

SEQ ID NO: 3590750 - DNA, 22 bp, Homo sapiens
tcattttttttctttgaataaa

SEQ ID NO: 3590751 - DNA, 18 bp, Homo sapiens
tccaaaaagctctgaaaa

SEQ ID NO: 3590752 - DNA, 12 bp, Homo sapiens
tccaaaactgcc

SEQ ID NO: 3590753 - DNA, 14 bp, Homo sapiens
tccaaaagaagccc

SEQ ID NO: 3590754 - DNA, 18 bp, Homo sapiens
tccaaaagaagcccccag

SEQ ID NO: 3590755 - DNA, 19 bp, Homo sapiens
tccaaacctccagcctccc

SEQ ID NO: 3590756 - DNA, 20 bp, Homo sapiens
tccaaacctccagcctccct

SEQ ID NO: 3590757 - DNA, 14 bp, Homo sapiens
tccaaacctgtctt

SEQ ID NO: 3590758 - DNA, 16 bp, Homo sapiens
tccaaagctgttccat

SEQ ID NO: 3590759 - DNA, 13 bp, Homo sapiens
tccaaagctttat

SEQ ID NO: 3590760 - DNA, 20 bp, Homo sapiens
tccaaatcttgaatttctgc

SEQ ID NO: 3590761 - DNA, 21 bp, Homo sapiens
tccaaatttttttttaaagca

SEQ ID NO: 3590762 - DNA, 16 bp, Homo sapiens
tccaacactttgagca

SEQ ID NO: 3590763 - DNA, 14 bp, Homo sapiens
tccaacatttcttg

SEQ ID NO: 3590764 - DNA, 15 bp, Homo sapiens
tccaaccactgtaca

SEQ ID NO: 3590765 - DNA, 23 bp, Homo sapiens
tccaacccgtctggcccaccagg

SEQ ID NO: 3590766 - DNA, 16 bp, Homo sapiens
tccaacgcccctgtgg

SEQ ID NO: 3590767 - DNA, 23 bp, Homo sapiens
tccaactactaatagaataaagg

SEQ ID NO: 3590768 - DNA, 22 bp, Homo sapiens
tccaactccatactccactcca

SEQ ID NO: 3590769 - DNA, 19 bp, Homo sapiens
tccaactgggcatttcaat

SEQ ID NO: 3590770 - DNA, 14 bp, Homo sapiens
tccaagaggctgta

SEQ ID NO: 3590771 - DNA, 19 bp, Homo sapiens
tccaagatgttctcctgat

SEQ ID NO: 3590772 - DNA, 14 bp, Homo sapiens
tccaagcatttcat

SEQ ID NO: 3590773 - DNA, 17 bp, Homo sapiens
tccaagcatttcatgaa

SEQ ID NO: 3590774 - DNA, 20 bp, Homo sapiens
tccaagcatttcatgaaaaa

SEQ ID NO: 3590775 - DNA, 18 bp, Homo sapiens
tccaagctccatctccac

SEQ ID NO: 3590776 - DNA, 14 bp, Homo sapiens
tccaaggcaaacaa

SEQ ID NO: 3590777 - DNA, 15 bp, Homo sapiens
tccaaggcaaacaat

SEQ ID NO: 3590778 - DNA, 21 bp, Homo sapiens
tccaaggggaatcagaactca

SEQ ID NO: 3590779 - DNA, 21 bp, Homo sapiens
tccaagggtttcgactggtcc

SEQ ID NO: 3590780 - DNA, 23 bp, Homo sapiens
tccaagggtttcgactggtccag

SEQ ID NO: 3590781 - DNA, 15 bp, Homo sapiens
tccaagtgccccacc

SEQ ID NO: 3590782 - DNA, 22 bp, Homo sapiens
tccaagtgccccaccactcccc

SEQ ID NO: 3590783 - DNA, 22 bp, Homo sapiens
tccaagtggcctccgtcactac

SEQ ID NO: 3590784 - DNA, 22 bp, Homo sapiens
tccaatcactgtgcttaattta

SEQ ID NO: 3590785 - DNA, 13 bp, Homo sapiens
tccaattttcctt

SEQ ID NO: 3590786 - DNA, 18 bp, Homo sapiens
tccaattttctggaatac

SEQ ID NO: 3590787 - DNA, 18 bp, Homo sapiens
tccacaagttaaataaat

SEQ ID NO: 3590788 - DNA, 20 bp, Homo sapiens
tccacacacagctgggctgt

SEQ ID NO: 3590789 - DNA, 16 bp, Homo sapiens
tccacactcagaaaat

SEQ ID NO: 3590790 - DNA, 22 bp, Homo sapiens
tccacactcagaaaattccctg

SEQ ID NO: 3590791 - DNA, 19 bp, Homo sapiens
tccacagaggacacagaga

SEQ ID NO: 3590792 - DNA, 15 bp, Homo sapiens
tccacagcctgcaag

SEQ ID NO: 3590793 - DNA, 12 bp, Homo sapiens
tccacagctgga

SEQ ID NO: 3590794 - DNA, 21 bp, Homo sapiens
tccacataaccctgtcaccca

SEQ ID NO: 3590795 - DNA, 20 bp, Homo sapiens
tccacccacaaactccaggc

SEQ ID NO: 3590796 - DNA, 14 bp, Homo sapiens
tccacccagcaggc

SEQ ID NO: 3590797 - DNA, 21 bp, Homo sapiens
tagagcttgtaataaatactg

SEQ ID NO: 3590798 - DNA, 16 bp, Homo sapiens
tagaggagggggcagg

SEQ ID NO: 3590799 - DNA, 13 bp, Homo sapiens
tagagggaatcta

SEQ ID NO: 3590800 - DNA, 14 bp, Homo sapiens
tagagggaggggcc

SEQ ID NO: 3590801 - DNA, 23 bp, Homo sapiens
tagagggcgagggatgatgaggg

SEQ ID NO: 3590802 - DNA, 15 bp, Homo sapiens
tagagtaatgaaatg

SEQ ID NO: 3590803 - DNA, 17 bp, Homo sapiens
tagagtaatgaaatgga

SEQ ID NO: 3590804 - DNA, 21 bp, Homo sapiens
tagagtgtagctgtaagggca

SEQ ID NO: 3590805 - DNA, 22 bp, Homo sapiens
tagagtgtagctgtaagggcag

SEQ ID NO: 3590806 - DNA, 15 bp, Homo sapiens
tagagtttctgtttg

SEQ ID NO: 3590807 - DNA, 21 bp, Homo sapiens
tagagtttctgtttgattctt

SEQ ID NO: 3590808 - DNA, 20 bp, Homo sapiens
tagataacgaagtgcactta

SEQ ID NO: 3590809 - DNA, 16 bp, Homo sapiens
tagatcaccagaataa

SEQ ID NO: 3590810 - DNA, 13 bp, Homo sapiens
tagatcagtattt

SEQ ID NO: 3590811 - DNA, 14 bp, Homo sapiens
tagatcagtatttc

SEQ ID NO: 3590812 - DNA, 16 bp, Homo sapiens
tagatgactttgcaga

SEQ ID NO: 3590813 - DNA, 17 bp, Homo sapiens
tagatgaggctcagaga

SEQ ID NO: 3590814 - DNA, 18 bp, Homo sapiens
tagatgaggctcagagag

SEQ ID NO: 3590815 - DNA, 20 bp, Homo sapiens
tagatgcacgtggggcccac

SEQ ID NO: 3590816 - DNA, 14 bp, Homo sapiens
tagatgctgactgt

SEQ ID NO: 3590817 - DNA, 13 bp, Homo sapiens
tagatgctggccc

SEQ ID NO: 3590818 - DNA, 14 bp, Homo sapiens
tagatgctggccca

SEQ ID NO: 3590819 - DNA, 14 bp, Homo sapiens
tagatggctcctct

SEQ ID NO: 3590820 - DNA, 13 bp, Homo sapiens
tagatgttttata

SEQ ID NO: 3590821 - DNA, 15 bp, Homo sapiens
tagattcagagaaat

SEQ ID NO: 3590822 - DNA, 13 bp, Homo sapiens
tagcaaactccag

SEQ ID NO: 3590823 - DNA, 17 bp, Homo sapiens
tagcaaactccaggttc

SEQ ID NO: 3590824 - DNA, 22 bp, Homo sapiens
tagcaaactccaggttcctgaa

SEQ ID NO: 3590825 - DNA, 15 bp, Homo sapiens
tagcaacagagcact

SEQ ID NO: 3590826 - DNA, 15 bp, Homo sapiens
tagcaagcttttgct

SEQ ID NO: 3590827 - DNA, 18 bp, Homo sapiens
tagcaaggcagagccttt

SEQ ID NO: 3590828 - DNA, 22 bp, Homo sapiens
tagcaataaatgcttttctaat

SEQ ID NO: 3590829 - DNA, 13 bp, Homo sapiens
tagcactctcaga

SEQ ID NO: 3590830 - DNA, 15 bp, Homo sapiens
tagcagaaagaagag

SEQ ID NO: 3590831 - DNA, 14 bp, Homo sapiens
tagcagcaggctca

SEQ ID NO: 3590832 - DNA, 15 bp, Homo sapiens
tagcagcaggctcag

SEQ ID NO: 3590833 - DNA, 17 bp, Homo sapiens
tagcagcaggctcaggc

SEQ ID NO: 3590834 - DNA, 22 bp, Homo sapiens
tagcaggggaattccctccccc

SEQ ID NO: 3590835 - DNA, 17 bp, Homo sapiens
tagcagtttcctcagtg

SEQ ID NO: 3590836 - DNA, 21 bp, Homo sapiens
tagcatataaatgtttatatt

SEQ ID NO: 3590837 - DNA, 22 bp, Homo sapiens
tagcatataaatgtttatattg

SEQ ID NO: 3590838 - DNA, 16 bp, Homo sapiens
tagcatgaaataaaat

SEQ ID NO: 3590839 - DNA, 19 bp, Homo sapiens
tagccaactgtttccctgc

SEQ ID NO: 3590840 - DNA, 19 bp, Homo sapiens
tagcccaacctacattcca

SEQ ID NO: 3590841 - DNA, 17 bp, Homo sapiens
tatctccttgtggccta

SEQ ID NO: 3590842 - DNA, 22 bp, Homo sapiens
tatctccttgtggcctatgaaa

SEQ ID NO: 3590843 - DNA, 17 bp, Homo sapiens
tatctcttgcccttcct

SEQ ID NO: 3590844 - DNA, 20 bp, Homo sapiens
tatctgaaaggccagcagct

SEQ ID NO: 3590845 - DNA, 16 bp, Homo sapiens
tatctgctgttcttca

SEQ ID NO: 3590846 - DNA, 19 bp, Homo sapiens
tatctgctgttcttcagtc

SEQ ID NO: 3590847 - DNA, 19 bp, Homo sapiens
tatctggccatatttacta

SEQ ID NO: 3590848 - DNA, 16 bp, Homo sapiens
tatctgtgcttctaat

SEQ ID NO: 3590849 - DNA, 14 bp, Homo sapiens
tatcttaaatttga

SEQ ID NO: 3590850 - DNA, 18 bp, Homo sapiens
tatcttcatgtccagtga

SEQ ID NO: 3590851 - DNA, 14 bp, Homo sapiens
tatgaaaatggaaa

SEQ ID NO: 3590852 - DNA, 20 bp, Homo sapiens
tatgaaacaatcttccaaag

SEQ ID NO: 3590853 - DNA, 17 bp, Homo sapiens
tatgaaatgccactggg

SEQ ID NO: 3590854 - DNA, 10 bp, Homo sapiens
tatgaacaga

SEQ ID NO: 3590855 - DNA, 23 bp, Homo sapiens
tatgaacagaaactacatttcta

SEQ ID NO: 3590856 - DNA, 16 bp, Homo sapiens
tatgaagacagaggca

SEQ ID NO: 3590857 - DNA, 18 bp, Homo sapiens
tatgaataaagacaccta

SEQ ID NO: 3590858 - DNA, 14 bp, Homo sapiens
tatgaatgctattt

SEQ ID NO: 3590859 - DNA, 16 bp, Homo sapiens
tatgacagatatattt

SEQ ID NO: 3590860 - DNA, 18 bp, Homo sapiens
tatgagatggccatgctc

SEQ ID NO: 3590861 - DNA, 21 bp, Homo sapiens
tatgagatggccatgctcaac

SEQ ID NO: 3590862 - DNA, 18 bp, Homo sapiens
tatgagcttgctcattaa

SEQ ID NO: 3590863 - DNA, 20 bp, Homo sapiens
tatgaggacaaggtatacac

SEQ ID NO: 3590864 - DNA, 17 bp, Homo sapiens
tatgaggacttgtgtct

SEQ ID NO: 3590865 - DNA, 16 bp, Homo sapiens
tatgagtacaaatgcc

SEQ ID NO: 3590866 - DNA, 20 bp, Homo sapiens
tatgagtacaaatgccttaa

SEQ ID NO: 3590867 - DNA, 15 bp, Homo sapiens
tatgatactgtctct

SEQ ID NO: 3590868 - DNA, 15 bp, Homo sapiens
tatgatctgttttgt

SEQ ID NO: 3590869 - DNA, 20 bp, Homo sapiens
tatgatgttagttttcctta

SEQ ID NO: 3590870 - DNA, 15 bp, Homo sapiens
tatgattactggcct

SEQ ID NO: 3590871 - DNA, 17 bp, Homo sapiens
tatgatttaatttgaaa

SEQ ID NO: 3590872 - DNA, 12 bp, Homo sapiens
tatgcaaagcac

SEQ ID NO: 3590873 - DNA, 13 bp, Homo sapiens
tatgcaaagcact

SEQ ID NO: 3590874 - DNA, 11 bp, Homo sapiens
tatgcaaatac

SEQ ID NO: 3590875 - DNA, 12 bp, Homo sapiens
tatgcaagcagc

SEQ ID NO: 3590876 - DNA, 19 bp, Homo sapiens
tatgcaagcagctttttat

SEQ ID NO: 3590877 - DNA, 19 bp, Homo sapiens
tatgcagccatatatggaa

SEQ ID NO: 3590878 - DNA, 18 bp, Homo sapiens
tatgcagtgaactatttt

SEQ ID NO: 3590879 - DNA, 23 bp, Homo sapiens
tatgcagtgtttccctctgtgtt

SEQ ID NO: 3590880 - DNA, 15 bp, Homo sapiens
tatgcatgtagcata

SEQ ID NO: 3590881 - DNA, 20 bp, Homo sapiens
tatgcatgtagcatataaat

SEQ ID NO: 3590882 - DNA, 22 bp, Homo sapiens
tatgcatgtagcatataaatgt

SEQ ID NO: 3590883 - DNA, 14 bp, Homo sapiens
tatgccacttcctt

SEQ ID NO: 3590884 - DNA, 15 bp, Homo sapiens
tatgccacttccttt

SEQ ID NO: 3590885 - DNA, 13 bp, Homo sapiens
tatgcctgaatga

SEQ ID NO: 3590886 - DNA, 13 bp, Homo sapiens
tatgcggttaatt

SEQ ID NO: 3590887 - DNA, 14 bp, Homo sapiens
tatgctgtttccta

SEQ ID NO: 3590888 - DNA, 19 bp, Homo sapiens
tatggagaaacaaaatcct

SEQ ID NO: 3590889 - DNA, 20 bp, Homo sapiens
tatggagtgagtcacctgct

SEQ ID NO: 3590890 - DNA, 22 bp, Homo sapiens
tatggagtgagtcacctgctcc

SEQ ID NO: 3590891 - DNA, 17 bp, Homo sapiens
tatggctataggtgcta

SEQ ID NO: 3590892 - DNA, 18 bp, Homo sapiens
tatggggatagatgtgtg

SEQ ID NO: 3590893 - DNA, 19 bp, Homo sapiens
tatggggatagatgtgtgg

SEQ ID NO: 3590894 - DNA, 16 bp, Homo sapiens
tatgggggatttcaaa

SEQ ID NO: 3590895 - DNA, 21 bp, Homo sapiens
tatggtaggaactgctgggct

SEQ ID NO: 3590896 - DNA, 20 bp, Homo sapiens
tatggtaggaccctcgagag

SEQ ID NO: 3590897 - DNA, 12 bp, Homo sapiens
tatgtaaatttt

SEQ ID NO: 3590898 - DNA, 18 bp, Homo sapiens
tatgtagtatctatatga

SEQ ID NO: 3590899 - DNA, 18 bp, Homo sapiens
tatgtatattaaaaaaga

SEQ ID NO: 3590900 - DNA, 20 bp, Homo sapiens
tatgtatcagtgtcctttcc

SEQ ID NO: 3590901 - DNA, 12 bp, Homo sapiens
tatgtattccta

SEQ ID NO: 3590902 - DNA, 14 bp, Homo sapiens
tatgtattcctatg

SEQ ID NO: 3590903 - DNA, 21 bp, Homo sapiens
tatgtatttaagatgtacatt

SEQ ID NO: 3590904 - DNA, 23 bp, Homo sapiens
tatgtatttaagatgtacattta

SEQ ID NO: 3590905 - DNA, 17 bp, Homo sapiens
tatgtcagtccaataaa

SEQ ID NO: 3590906 - DNA, 16 bp, Homo sapiens
tatgtcagtgatgact

SEQ ID NO: 3590907 - DNA, 13 bp, Homo sapiens
tatgtcctgtcat

SEQ ID NO: 3590908 - DNA, 17 bp, Homo sapiens
tatgtcttaaaacctgc

SEQ ID NO: 3590909 - DNA, 14 bp, Homo sapiens
tatgtgacatttta

SEQ ID NO: 3590910 - DNA, 20 bp, Homo sapiens
tatgtgcacatctgttttgt

SEQ ID NO: 3590911 - DNA, 17 bp, Homo sapiens
tatgtgcactgcctgca

SEQ ID NO: 3590912 - DNA, 18 bp, Homo sapiens
tatgtgggggtctgtgtg

SEQ ID NO: 3590913 - DNA, 19 bp, Homo sapiens
tatgtgggggtctgtgtgt

SEQ ID NO: 3590914 - DNA, 22 bp, Homo sapiens
tatgtgtgtgtgttgtgtgtgg

SEQ ID NO: 3590915 - DNA, 13 bp, Homo sapiens
tatgtgtttactt

SEQ ID NO: 3590916 - DNA, 19 bp, Homo sapiens
tatgttaaagtttaagtgt

SEQ ID NO: 3590917 - DNA, 18 bp, Homo sapiens
tatgttaatattttatgt

SEQ ID NO: 3590918 - DNA, 12 bp, Homo sapiens
tatgttctctga

SEQ ID NO: 3590919 - DNA, 16 bp, Homo sapiens
tatgttctctgaatga

SEQ ID NO: 3590920 - DNA, 21 bp, Homo sapiens
tatgttctctgaatgagcctt

SEQ ID NO: 3590921 - DNA, 15 bp, Homo sapiens
tatgttcttagcaat

SEQ ID NO: 3590922 - DNA, 16 bp, Homo sapiens
tatgttgtttacctga

SEQ ID NO: 3590923 - DNA, 23 bp, Homo sapiens
tattaaaaaagagacatccaaat

SEQ ID NO: 3590924 - DNA, 16 bp, Homo sapiens
tattaaaatatttcag

SEQ ID NO: 3590925 - DNA, 19 bp, Homo sapiens
tattaaatggtttttaaat

SEQ ID NO: 3590926 - DNA, 16 bp, Homo sapiens
tattaagtaacttatt

SEQ ID NO: 3590927 - DNA, 19 bp, Homo sapiens
tattaatcaagagaaactt

SEQ ID NO: 3590928 - DNA, 18 bp, Homo sapiens
tattaatcttagtgtatg

SEQ ID NO: 3590929 - DNA, 12 bp, Homo sapiens
tattaattaaag

SEQ ID NO: 3590930 - DNA, 13 bp, Homo sapiens
tattaattgcttt

SEQ ID NO: 3590931 - DNA, 12 bp, Homo sapiens
tattaatttgaa

SEQ ID NO: 3590932 - DNA, 17 bp, Homo sapiens
tattacagataaaatgt

SEQ ID NO: 3590933 - DNA, 13 bp, Homo sapiens
tattacagtgttg

SEQ ID NO: 3590934 - DNA, 22 bp, Homo sapiens
tattaccagtggcgttgttgca

SEQ ID NO: 3590935 - DNA, 15 bp, Homo sapiens
tattaccccttttcg

SEQ ID NO: 3590936 - DNA, 12 bp, Homo sapiens
tattagccaact

SEQ ID NO: 3590937 - DNA, 19 bp, Homo sapiens
tattaggaagtgtttatgt

SEQ ID NO: 3590938 - DNA, 19 bp, Homo sapiens
tattagttaatggattaaa

SEQ ID NO: 3590939 - DNA, 14 bp, Homo sapiens
tattataaactgta

SEQ ID NO: 3590940 - DNA, 20 bp, Homo sapiens
tattataaattctactaagt

SEQ ID NO: 3590941 - DNA, 14 bp, Homo sapiens
tattatctgtcagc

SEQ ID NO: 3590942 - DNA, 13 bp, Homo sapiens
tattatgttctta

SEQ ID NO: 3590943 - DNA, 19 bp, Homo sapiens
tattattacttatttttga

SEQ ID NO: 3590944 - DNA, 12 bp, Homo sapiens
tattattatctt

SEQ ID NO: 3590945 - DNA, 13 bp, Homo sapiens
tattattatgttc

SEQ ID NO: 3590946 - DNA, 21 bp, Homo sapiens
tattattgtctgttttccttc

SEQ ID NO: 3590947 - DNA, 17 bp, Homo sapiens
tattattttaaaaattg

SEQ ID NO: 3590948 - DNA, 20 bp, Homo sapiens
tattcaagcaaacatcaaat

SEQ ID NO: 3590949 - DNA, 15 bp, Homo sapiens
tattcagatgtatgt

SEQ ID NO: 3590950 - DNA, 23 bp, Homo sapiens
tattcagcaccaagcatgtccca

SEQ ID NO: 3590951 - DNA, 16 bp, Homo sapiens
taaactactctttgat

SEQ ID NO: 3590952 - DNA, 18 bp, Homo sapiens
taaactatatataatgta

SEQ ID NO: 3590953 - DNA, 20 bp, Homo sapiens
taaactatcttggtgaattt

SEQ ID NO: 3590954 - DNA, 23 bp, Homo sapiens
taaactcaaaatatttgtacata

SEQ ID NO: 3590955 - DNA, 16 bp, Homo sapiens
taaactccatgatatt

SEQ ID NO: 3590956 - DNA, 15 bp, Homo sapiens
taaactgactatcat

SEQ ID NO: 3590957 - DNA, 18 bp, Homo sapiens
taaactgactatcataaa

SEQ ID NO: 3590958 - DNA, 14 bp, Homo sapiens
taaactgtgtttta

SEQ ID NO: 3590959 - DNA, 19 bp, Homo sapiens
taaagaaaaccacagttat

SEQ ID NO: 3590960 - DNA, 20 bp, Homo sapiens
taaagaaaaccacagttatt

SEQ ID NO: 3590961 - DNA, 16 bp, Homo sapiens
taaagaaagtgtattt

SEQ ID NO: 3590962 - DNA, 17 bp, Homo sapiens
taaagaaagtgtatttg

SEQ ID NO: 3590963 - DNA, 20 bp, Homo sapiens
taaagaaagtgtatttggaa

SEQ ID NO: 3590964 - DNA, 17 bp, Homo sapiens
taaagaaatgtcttaat

SEQ ID NO: 3590965 - DNA, 18 bp, Homo sapiens
taaagaagaggagaaaaa

SEQ ID NO: 3590966 - DNA, 17 bp, Homo sapiens
taaagacaatcactgcc

SEQ ID NO: 3590967 - DNA, 14 bp, Homo sapiens
taaagacagggtct

SEQ ID NO: 3590968 - DNA, 16 bp, Homo sapiens
taaagacagggtcttg

SEQ ID NO: 3590969 - DNA, 13 bp, Homo sapiens
taaagagaaatat

SEQ ID NO: 3590970 - DNA, 22 bp, Homo sapiens
taaagagaaatatatttgtcac

SEQ ID NO: 3590971 - DNA, 20 bp, Homo sapiens
taaagatagacctgacaatt

SEQ ID NO: 3590972 - DNA, 18 bp, Homo sapiens
taaagcagttaatttata

SEQ ID NO: 3590973 - DNA, 12 bp, Homo sapiens
taaagcatatag

SEQ ID NO: 3590974 - DNA, 14 bp, Homo sapiens
taaagccaggctca

SEQ ID NO: 3590975 - DNA, 14 bp, Homo sapiens
taaaggactgtaat

SEQ ID NO: 3590976 - DNA, 14 bp, Homo sapiens
taaaggctgttaaa

SEQ ID NO: 3590977 - DNA, 19 bp, Homo sapiens
taaagggaccatctgctgc

SEQ ID NO: 3590978 - DNA, 23 bp, Homo sapiens
taaagggaccatctgctgcagtt

SEQ ID NO: 3590979 - DNA, 17 bp, Homo sapiens
taaagggactacctctg

SEQ ID NO: 3590980 - DNA, 18 bp, Homo sapiens
taaagggactacctctgt

SEQ ID NO: 3590981 - DNA, 19 bp, Homo sapiens
taaagggactacctctgtg

SEQ ID NO: 3590982 - DNA, 22 bp, Homo sapiens
taaaggttgagtatgtgaagat

SEQ ID NO: 3590983 - DNA, 13 bp, Homo sapiens
taaagtaaataca

SEQ ID NO: 3590984 - DNA, 12 bp, Homo sapiens
taaagtcagtga

SEQ ID NO: 3590985 - DNA, 11 bp, Homo sapiens
taaagtcattg

SEQ ID NO: 3590986 - DNA, 16 bp, Homo sapiens
taaagtgcctcggaca

SEQ ID NO: 3590987 - DNA, 21 bp, Homo sapiens
taaagtttaagtgtgcagcca

SEQ ID NO: 3590988 - DNA, 18 bp, Homo sapiens
taaataaaaatttataag

SEQ ID NO: 3590989 - DNA, 12 bp, Homo sapiens
taaataaaattg

SEQ ID NO: 3590990 - DNA, 18 bp, Homo sapiens
taaataacacagatattg

SEQ ID NO: 3590991 - DNA, 16 bp, Homo sapiens
taaataagatgattta

SEQ ID NO: 3590992 - DNA, 13 bp, Homo sapiens
taaataatctcat

SEQ ID NO: 3590993 - DNA, 15 bp, Homo sapiens
taaatacatgcatat

SEQ ID NO: 3590994 - DNA, 16 bp, Homo sapiens
taaatacatgcatata

SEQ ID NO: 3590995 - DNA, 20 bp, Homo sapiens
taaatactgagaaaacctgt

SEQ ID NO: 3590996 - DNA, 18 bp, Homo sapiens
taaatactttccatgttt

SEQ ID NO: 3590997 - DNA, 15 bp, Homo sapiens
taaataggatcctgg

SEQ ID NO: 3590998 - DNA, 14 bp, Homo sapiens
taaatatatctacc

SEQ ID NO: 3590999 - DNA, 18 bp, Homo sapiens
taaatatatctaccccag

SEQ ID NO: 3591000 - DNA, 23 bp, Homo sapiens
gtgtgaactcaccctgggagcca

SEQ ID NO: 3591001 - DNA, 15 bp, Homo sapiens
gtgtgaccctgggca

SEQ ID NO: 3591002 - DNA, 10 bp, Homo sapiens
gtgtgactcc

SEQ ID NO: 3591003 - DNA, 14 bp, Homo sapiens
gtgtgaggagagag

SEQ ID NO: 3591004 - DNA, 21 bp, Homo sapiens
gtgtgattgacagctttgctg

SEQ ID NO: 3591005 - DNA, 23 bp, Homo sapiens
gtgtgcactaaggggcccggcca

SEQ ID NO: 3591006 - DNA, 14 bp, Homo sapiens
gtgtgctgtttgaa

SEQ ID NO: 3591007 - DNA, 19 bp, Homo sapiens
gtgtggcctgtgccagcac

SEQ ID NO: 3591008 - DNA, 13 bp, Homo sapiens
gtgtggctcctgg

SEQ ID NO: 3591009 - DNA, 16 bp, Homo sapiens
gtgtgggtacctgtat

SEQ ID NO: 3591010 - DNA, 21 bp, Homo sapiens
gtgtggtctctgccccagcct

SEQ ID NO: 3591011 - DNA, 13 bp, Homo sapiens
gtgtggtgacatt

SEQ ID NO: 3591012 - DNA, 16 bp, Homo sapiens
gtgtggtgaggggctt

SEQ ID NO: 3591013 - DNA, 20 bp, Homo sapiens
gtgtggtgaggggctttctc

SEQ ID NO: 3591014 - DNA, 21 bp, Homo sapiens
gtgtggtgaggggctttctct

SEQ ID NO: 3591015 - DNA, 13 bp, Homo sapiens
gtgtgtccctgga

SEQ ID NO: 3591016 - DNA, 15 bp, Homo sapiens
gtgtgtccctggaca

SEQ ID NO: 3591017 - DNA, 16 bp, Homo sapiens
gtgtgtccctggacac

SEQ ID NO: 3591018 - DNA, 19 bp, Homo sapiens
gtgtgtgaaaattcaggtg

SEQ ID NO: 3591019 - DNA, 21 bp, Homo sapiens
gtgtgtggtgaggggctttct

SEQ ID NO: 3591020 - DNA, 13 bp, Homo sapiens
gtgtgtgtatgtg

SEQ ID NO: 3591021 - DNA, 20 bp, Homo sapiens
gtgttaattttgctaactgg

SEQ ID NO: 3591022 - DNA, 21 bp, Homo sapiens
gtgttaattttgctaactggg

SEQ ID NO: 3591023 - DNA, 14 bp, Homo sapiens
gtgttcatttcatt

SEQ ID NO: 3591024 - DNA, 15 bp, Homo sapiens
gtgttcctgaagctg

SEQ ID NO: 3591025 - DNA, 18 bp, Homo sapiens
gtgttcctgaagctgctg

SEQ ID NO: 3591026 - DNA, 22 bp, Homo sapiens
gtgttcctgaagctgctgtgtc

SEQ ID NO: 3591027 - DNA, 14 bp, Homo sapiens
gtgttctgctcctg

SEQ ID NO: 3591028 - DNA, 16 bp, Homo sapiens
gtgttctgctcctgct

SEQ ID NO: 3591029 - DNA, 17 bp, Homo sapiens
gtgttctgctcctgctt

SEQ ID NO: 3591030 - DNA, 21 bp, Homo sapiens
gtgttctgctcctgcttttct

SEQ ID NO: 3591031 - DNA, 23 bp, Homo sapiens
gtgttctgctcctgcttttctgt

SEQ ID NO: 3591032 - DNA, 16 bp, Homo sapiens
gtgttgaaaatgttca

SEQ ID NO: 3591033 - DNA, 19 bp, Homo sapiens
gtgttgcagccgcagagaa

SEQ ID NO: 3591034 - DNA, 21 bp, Homo sapiens
gtgttgcagccgcagagaaat

SEQ ID NO: 3591035 - DNA, 13 bp, Homo sapiens
gtgttgctgtggc

SEQ ID NO: 3591036 - DNA, 22 bp, Homo sapiens
gtgttgtaaaaatgtctttcat

SEQ ID NO: 3591037 - DNA, 14 bp, Homo sapiens
gtgttgtcccttct

SEQ ID NO: 3591038 - DNA, 15 bp, Homo sapiens
gtgttgtgtgtggga

SEQ ID NO: 3591039 - DNA, 15 bp, Homo sapiens
gtgtttccctctgtg

SEQ ID NO: 3591040 - DNA, 21 bp, Homo sapiens
gtgtttctctaaggaattatt

SEQ ID NO: 3591041 - DNA, 13 bp, Homo sapiens
gtgtttgattggc

SEQ ID NO: 3591042 - DNA, 14 bp, Homo sapiens
gtgtttgattggct

SEQ ID NO: 3591043 - DNA, 13 bp, Homo sapiens
gtgtttggttcaa

SEQ ID NO: 3591044 - DNA, 17 bp, Homo sapiens
gtgtttggtttcttcat

SEQ ID NO: 3591045 - DNA, 18 bp, Homo sapiens
gtgtttgtcatggtgaaa

SEQ ID NO: 3591046 - DNA, 20 bp, Homo sapiens
gtgttttcatcatttcagcc

SEQ ID NO: 3591047 - DNA, 16 bp, Homo sapiens
gtgttttcattttaga

SEQ ID NO: 3591048 - DNA, 16 bp, Homo sapiens
gtgtttttcatgtttt

SEQ ID NO: 3591049 - DNA, 14 bp, Homo sapiens
gtgtttttgggaag

SEQ ID NO: 3591050 - DNA, 17 bp, Homo sapiens
gttaaaacataaacaca

SEQ ID NO: 3591051 - DNA, 19 bp, Homo sapiens
gttaaaacataaacacatt

SEQ ID NO: 3591052 - DNA, 24 bp, Homo sapiens
gttaaaacataaacacatttccat

SEQ ID NO: 3591053 - DNA, 22 bp, Homo sapiens
gttaaaagcattttaatactaa

SEQ ID NO: 3591054 - DNA, 17 bp, Homo sapiens
gttaaatattttgctaa

SEQ ID NO: 3591055 - DNA, 21 bp, Homo sapiens
gttaaatattttgctaactgg

SEQ ID NO: 3591056 - DNA, 22 bp, Homo sapiens
gttaactatgacagatatattt

SEQ ID NO: 3591057 - DNA, 13 bp, Homo sapiens
gttaagacctggc

SEQ ID NO: 3591058 - DNA, 16 bp, Homo sapiens
gttaagacctggcagc

SEQ ID NO: 3591059 - DNA, 18 bp, Homo sapiens
gttaatattttatgtgta

SEQ ID NO: 3591060 - DNA, 20 bp, Homo sapiens
gttaatctgatgtataatgt

SEQ ID NO: 3591061 - DNA, 22 bp, Homo sapiens
gttaatctgatgtataatgtaa

SEQ ID NO: 3591062 - DNA, 15 bp, Homo sapiens
gttaattatgcagtg

SEQ ID NO: 3591063 - DNA, 17 bp, Homo sapiens
gttaatttataatgtat

SEQ ID NO: 3591064 - DNA, 17 bp, Homo sapiens
gttaattttgaagtgct

SEQ ID NO: 3591065 - DNA, 14 bp, Homo sapiens
gttaattttgctaa

SEQ ID NO: 3591066 - DNA, 17 bp, Homo sapiens
gttaattttgctaactg

SEQ ID NO: 3591067 - DNA, 18 bp, Homo sapiens
gttaattttgctaactgg

SEQ ID NO: 3591068 - DNA, 14 bp, Homo sapiens
gttaatttttccaa

SEQ ID NO: 3591069 - DNA, 19 bp, Homo sapiens
gttacaaaagaaaaaagca

SEQ ID NO: 3591070 - DNA, 15 bp, Homo sapiens
gttacagttctgtgg

SEQ ID NO: 3591071 - DNA, 15 bp, Homo sapiens
gttacatatcaaaac

SEQ ID NO: 3591072 - DNA, 23 bp, Homo sapiens
gttaccattttaacgctgcctaa

SEQ ID NO: 3591073 - DNA, 15 bp, Homo sapiens
gttaccttatagtta

SEQ ID NO: 3591074 - DNA, 18 bp, Homo sapiens
gttaccttatagttactg

SEQ ID NO: 3591075 - DNA, 13 bp, Homo sapiens
gttactgtgtaat

SEQ ID NO: 3591076 - DNA, 19 bp, Homo sapiens
gttagaatgagatctgaat

SEQ ID NO: 3591077 - DNA, 13 bp, Homo sapiens
gttagattaagaa

SEQ ID NO: 3591078 - DNA, 16 bp, Homo sapiens
gttaggccaggcctta

SEQ ID NO: 3591079 - DNA, 16 bp, Homo sapiens
gttaggttttctatgt

SEQ ID NO: 3591080 - DNA, 19 bp, Homo sapiens
gttagtattttaatcctgt

SEQ ID NO: 3591081 - DNA, 21 bp, Homo sapiens
gttagtattttaatcctgtac

SEQ ID NO: 3591082 - DNA, 17 bp, Homo sapiens
gttagttaccttatagt

SEQ ID NO: 3591083 - DNA, 12 bp, Homo sapiens
gttataaataaa

SEQ ID NO: 3591084 - DNA, 13 bp, Homo sapiens
gttatatatatgt

SEQ ID NO: 3591085 - DNA, 12 bp, Homo sapiens
gttatattcatt

SEQ ID NO: 3591086 - DNA, 12 bp, Homo sapiens
gttatgcagtga

SEQ ID NO: 3591087 - DNA, 20 bp, Homo sapiens
gttatgcagtgaactatttt

SEQ ID NO: 3591088 - DNA, 21 bp, Homo sapiens
gttatgcagtgaactattttt

SEQ ID NO: 3591089 - DNA, 13 bp, Homo sapiens
gttatgctgtttc

SEQ ID NO: 3591090 - DNA, 15 bp, Homo sapiens
gttatgctgtttcct

SEQ ID NO: 3591091 - DNA, 22 bp, Homo sapiens
gttatgtaccatatgatctgtt

SEQ ID NO: 3591092 - DNA, 22 bp, Homo sapiens
gttatgtcagaggaacagtcct

SEQ ID NO: 3591093 - DNA, 20 bp, Homo sapiens
gttattaactgtattttctt

SEQ ID NO: 3591094 - DNA, 16 bp, Homo sapiens
gttattaattaaagaa

SEQ ID NO: 3591095 - DNA, 22 bp, Homo sapiens
gttatttcttccctgctttgca

SEQ ID NO: 3591096 - DNA, 13 bp, Homo sapiens
gttattttccttc

SEQ ID NO: 3591097 - DNA, 14 bp, Homo sapiens
gttatttttacagc

SEQ ID NO: 3591098 - DNA, 17 bp, Homo sapiens
gttcaagtattaagcag

SEQ ID NO: 3591099 - DNA, 23 bp, Homo sapiens
gttcaatctggattcatatttaa

SEQ ID NO: 3591100 - DNA, 22 bp, Homo sapiens
gttcaatgcctcacgagatttg

SEQ ID NO: 3591101 - DNA, 18 bp, Homo sapiens
gttcaattggacaattat

SEQ ID NO: 3591102 - DNA, 21 bp, Homo sapiens
gttcacctccaagcatttcat

SEQ ID NO: 3591103 - DNA, 18 bp, Homo sapiens
gttcacctgtgactcctg

SEQ ID NO: 3591104 - DNA, 24 bp, Homo sapiens
gttcactctacttagcatgtccct

SEQ ID NO: 3591105 - DNA, 13 bp, Homo sapiens
gttcagaacaact

SEQ ID NO: 3591106 - DNA, 18 bp, Homo sapiens
gttcagaagaatcttcct

SEQ ID NO: 3591107 - DNA, 19 bp, Homo sapiens
gttcagaatggcagtcctg

SEQ ID NO: 3591108 - DNA, 22 bp, Homo sapiens
gttcagaatggcagtcctggag

SEQ ID NO: 3591109 - DNA, 14 bp, Homo sapiens
gttcagacacagct

SEQ ID NO: 3591110 - DNA, 17 bp, Homo sapiens
gttcagggaccgtccag

SEQ ID NO: 3591111 - DNA, 20 bp, Homo sapiens
gttcagggaccgtccagggg

SEQ ID NO: 3591112 - DNA, 17 bp, Homo sapiens
gttcatcttgcagcatt

SEQ ID NO: 3591113 - DNA, 14 bp, Homo sapiens
gttcatgagaatct

SEQ ID NO: 3591114 - DNA, 15 bp, Homo sapiens
gttcatgcagctgtg

SEQ ID NO: 3591115 - DNA, 17 bp, Homo sapiens
gttcattctaccaagct

SEQ ID NO: 3591116 - DNA, 19 bp, Homo sapiens
gttccaacatgcaatactg

SEQ ID NO: 3591117 - DNA, 17 bp, Homo sapiens
gttccaagtccaataag

SEQ ID NO: 3591118 - DNA, 14 bp, Homo sapiens
gttccacagaggac

SEQ ID NO: 3591119 - DNA, 12 bp, Homo sapiens
gttccactgaga

SEQ ID NO: 3591120 - DNA, 17 bp, Homo sapiens
gttccagtggcggcacg

SEQ ID NO: 3591121 - DNA, 12 bp, Homo sapiens
gttccccagaga

SEQ ID NO: 3591122 - DNA, 13 bp, Homo sapiens
gttccccagagaa

SEQ ID NO: 3591123 - DNA, 12 bp, Homo sapiens
gttcccccagca

SEQ ID NO: 3591124 - DNA, 19 bp, Homo sapiens
gttccctgctgcgctgctt

SEQ ID NO: 3591125 - DNA, 22 bp, Homo sapiens
gttccctgctgcgctgcttggt

SEQ ID NO: 3591126 - DNA, 21 bp, Homo sapiens
gttccgcccgccctcccggag

SEQ ID NO: 3591127 - DNA, 15 bp, Homo sapiens
gttccggggagaaac

SEQ ID NO: 3591128 - DNA, 20 bp, Homo sapiens
gtttctttctctgaggacaa

SEQ ID NO: 3591129 - DNA, 19 bp, Homo sapiens
gtttgaagaccaatcaaat

SEQ ID NO: 3591130 - DNA, 20 bp, Homo sapiens
gtttgaagaccaatcaaata

SEQ ID NO: 3591131 - DNA, 14 bp, Homo sapiens
gtttgaaggagaat

SEQ ID NO: 3591132 - DNA, 14 bp, Homo sapiens
gtttgaatatttgt

SEQ ID NO: 3591133 - DNA, 17 bp, Homo sapiens
gtttgaggaagtggctg

SEQ ID NO: 3591134 - DNA, 12 bp, Homo sapiens
gtttgattggct

SEQ ID NO: 3591135 - DNA, 16 bp, Homo sapiens
gtttgcagatattctc

SEQ ID NO: 3591136 - DNA, 18 bp, Homo sapiens
gtttgcaggagcccccct

SEQ ID NO: 3591137 - DNA, 17 bp, Homo sapiens
gtttgccactgtgtttc

SEQ ID NO: 3591138 - DNA, 15 bp, Homo sapiens
gtttgccttttatgt

SEQ ID NO: 3591139 - DNA, 19 bp, Homo sapiens
gtttgccttttatgtaaat

SEQ ID NO: 3591140 - DNA, 14 bp, Homo sapiens
gtttgcggcagtgt

SEQ ID NO: 3591141 - DNA, 18 bp, Homo sapiens
gtttgctcaaaattgctt

SEQ ID NO: 3591142 - DNA, 21 bp, Homo sapiens
gtttgctcaaaattgcttcta

SEQ ID NO: 3591143 - DNA, 22 bp, Homo sapiens
gtttgctctaccaaatagtgat

SEQ ID NO: 3591144 - DNA, 13 bp, Homo sapiens
gtttggtgcttct

SEQ ID NO: 3591145 - DNA, 17 bp, Homo sapiens
gtttggtgtttttacag

SEQ ID NO: 3591146 - DNA, 13 bp, Homo sapiens
gtttggttcaatt

SEQ ID NO: 3591147 - DNA, 15 bp, Homo sapiens
gtttggtttcttcat

SEQ ID NO: 3591148 - DNA, 15 bp, Homo sapiens
gtttgtcatggtgaa

SEQ ID NO: 3591149 - DNA, 20 bp, Homo sapiens
gtttgtcttggatatatagg

SEQ ID NO: 3591150 - DNA, 19 bp, Homo sapiens
gtttgtggaaaatgaaaat

SEQ ID NO: 3591151 - DNA, 17 bp, Homo sapiens
gtttgtgtttgattggc

SEQ ID NO: 3591152 - DNA, 13 bp, Homo sapiens
gtttgttccctgt

SEQ ID NO: 3591153 - DNA, 22 bp, Homo sapiens
gttttaaagacctgacaccttt

SEQ ID NO: 3591154 - DNA, 20 bp, Homo sapiens
gttttacaatagttctgtgg

SEQ ID NO: 3591155 - DNA, 22 bp, Homo sapiens
gttttacagatttattcctttg

SEQ ID NO: 3591156 - DNA, 20 bp, Homo sapiens
gttttagaagattctatgtt

SEQ ID NO: 3591157 - DNA, 23 bp, Homo sapiens
gttttattattatcgctttatgt

SEQ ID NO: 3591158 - DNA, 22 bp, Homo sapiens
gttttcaaccggaaggaggcca

SEQ ID NO: 3591159 - DNA, 15 bp, Homo sapiens
gttttcagagaatta

SEQ ID NO: 3591160 - DNA, 19 bp, Homo sapiens
gttttcagatgaaaagaaa

SEQ ID NO: 3591161 - DNA, 16 bp, Homo sapiens
gttttcatcatttcag

SEQ ID NO: 3591162 - DNA, 16 bp, Homo sapiens
gttttccagtattgaa

SEQ ID NO: 3591163 - DNA, 23 bp, Homo sapiens
gttttcccccagcaacgcccctc

SEQ ID NO: 3591164 - DNA, 22 bp, Homo sapiens
gttttcctcccttctgctactg

SEQ ID NO: 3591165 - DNA, 18 bp, Homo sapiens
gttttctatttatgcctt

SEQ ID NO: 3591166 - DNA, 16 bp, Homo sapiens
gttttctcctcccagg

SEQ ID NO: 3591167 - DNA, 16 bp, Homo sapiens
gttttctgagaaagac

SEQ ID NO: 3591168 - DNA, 16 bp, Homo sapiens
gtgctcttttctcctc

SEQ ID NO: 3591169 - DNA, 15 bp, Homo sapiens
gtgctgacggccagg

SEQ ID NO: 3591170 - DNA, 12 bp, Homo sapiens
gtgctgcaggag

SEQ ID NO: 3591171 - DNA, 23 bp, Homo sapiens
gtgctgcaggagtgtcctgccca

SEQ ID NO: 3591172 - DNA, 12 bp, Homo sapiens
gtgctgccacac

SEQ ID NO: 3591173 - DNA, 13 bp, Homo sapiens
gtgctgctgtgga

SEQ ID NO: 3591174 - DNA, 18 bp, Homo sapiens
gtgctggcggacgcagct

SEQ ID NO: 3591175 - DNA, 19 bp, Homo sapiens
gtgctggcggacgcagctg

SEQ ID NO: 3591176 - DNA, 19 bp, Homo sapiens
gtgctgtttattaatctta

SEQ ID NO: 3591177 - DNA, 16 bp, Homo sapiens
gtgctgtttcaaagtt

SEQ ID NO: 3591178 - DNA, 15 bp, Homo sapiens
gtgcttagttggctt

SEQ ID NO: 3591179 - DNA, 21 bp, Homo sapiens
gtgctttagagataattgctt

SEQ ID NO: 3591180 - DNA, 12 bp, Homo sapiens
gtgctttggaac

SEQ ID NO: 3591181 - DNA, 18 bp, Homo sapiens
gtgctttgtgttcagttt

SEQ ID NO: 3591182 - DNA, 15 bp, Homo sapiens
gtgcttttaaatgca

SEQ ID NO: 3591183 - DNA, 13 bp, Homo sapiens
gtcacttaaattt

SEQ ID NO: 3591184 - DNA, 15 bp, Homo sapiens
gtcagacgccaggca

SEQ ID NO: 3591185 - DNA, 15 bp, Homo sapiens
gtcagccactgtgat

SEQ ID NO: 3591186 - DNA, 21 bp, Homo sapiens
gtcagcctggaagggacagta

SEQ ID NO: 3591187 - DNA, 16 bp, Homo sapiens
gtcaggctagctgtgc

SEQ ID NO: 3591188 - DNA, 17 bp, Homo sapiens
gtcaggctagctgtgct

SEQ ID NO: 3591189 - DNA, 18 bp, Homo sapiens
gtcagggtccaggagagc

SEQ ID NO: 3591190 - DNA, 15 bp, Homo sapiens
gtcaggtgtcgaggc

SEQ ID NO: 3591191 - DNA, 21 bp, Homo sapiens
gtcagtatgtggaagtgtggg

SEQ ID NO: 3591192 - DNA, 13 bp, Homo sapiens
gtcagttgtatca

SEQ ID NO: 3591193 - DNA, 14 bp, Homo sapiens
gtcagttgttattt

SEQ ID NO: 3591194 - DNA, 15 bp, Homo sapiens
gtcagttgttattta

SEQ ID NO: 3591195 - DNA, 17 bp, Homo sapiens
gtcagttgttatttatt

SEQ ID NO: 3591196 - DNA, 13 bp, Homo sapiens
gtcagtttttcct

SEQ ID NO: 3591197 - DNA, 16 bp, Homo sapiens
gtcagtttttcctccc

SEQ ID NO: 3591198 - DNA, 20 bp, Homo sapiens
gtcatagcaagcttttgctc

SEQ ID NO: 3591199 - DNA, 12 bp, Homo sapiens
gtcatatgttgt

SEQ ID NO: 3591200 - DNA, 19 bp, Homo sapiens
gtcatcctcaaagaaagtg

SEQ ID NO: 3591201 - DNA, 22 bp, Homo sapiens
gtcatcctcaaagaaagtgtat

SEQ ID NO: 3591202 - DNA, 12 bp, Homo sapiens
gtcatcttgcta

SEQ ID NO: 3591203 - DNA, 21 bp, Homo sapiens
gtcatgaagtgcacaggagcc

SEQ ID NO: 3591204 - DNA, 19 bp, Homo sapiens
gtcatgcattttgctttgg

SEQ ID NO: 3591205 - DNA, 13 bp, Homo sapiens
gtcatggtgaaat

SEQ ID NO: 3591206 - DNA, 19 bp, Homo sapiens
gtcattatgttaatatttc

SEQ ID NO: 3591207 - DNA, 14 bp, Homo sapiens
gtcattcagaaaaa

SEQ ID NO: 3591208 - DNA, 15 bp, Homo sapiens
gtcattcagttctag

SEQ ID NO: 3591209 - DNA, 17 bp, Homo sapiens
gtcattcagttctaggc

SEQ ID NO: 3591210 - DNA, 20 bp, Homo sapiens
gtcattcagttctaggcctt

SEQ ID NO: 3591211 - DNA, 21 bp, Homo sapiens
gtcattcagttctaggccttt

SEQ ID NO: 3591212 - DNA, 14 bp, Homo sapiens
gtcattcttcccta

SEQ ID NO: 3591213 - DNA, 18 bp, Homo sapiens
gtcattgcacctatctca

SEQ ID NO: 3591214 - DNA, 22 bp, Homo sapiens
gtcattgcacctatctcagcca

SEQ ID NO: 3591215 - DNA, 13 bp, Homo sapiens
gtcatttaaatgt

SEQ ID NO: 3591216 - DNA, 23 bp, Homo sapiens
gtcattttttttctttgaataaa

SEQ ID NO: 3591217 - DNA, 14 bp, Homo sapiens
gtccaaacccactc

SEQ ID NO: 3591218 - DNA, 16 bp, Homo sapiens
gtccacagctggaaag

SEQ ID NO: 3591219 - DNA, 15 bp, Homo sapiens
gtccactcccagtgc

SEQ ID NO: 3591220 - DNA, 21 bp, Homo sapiens
gtccacttaaaatacatgaat

SEQ ID NO: 3591221 - DNA, 16 bp, Homo sapiens
gtccagctcagccctg

SEQ ID NO: 3591222 - DNA, 17 bp, Homo sapiens
gtccagctcagccctgg

SEQ ID NO: 3591223 - DNA, 22 bp, Homo sapiens
gtccagctcagccctggcctgg

SEQ ID NO: 3591224 - DNA, 22 bp, Homo sapiens
gtccagctctgacatcccttcc

SEQ ID NO: 3591225 - DNA, 16 bp, Homo sapiens
gtccaggagagcctgg

SEQ ID NO: 3591226 - DNA, 17 bp, Homo sapiens
gtccaggagagcctggg

SEQ ID NO: 3591227 - DNA, 19 bp, Homo sapiens
gtccaggagagcctggggg

SEQ ID NO: 3591228 - DNA, 15 bp, Homo sapiens
gtccaggagccccgc

SEQ ID NO: 3591229 - DNA, 22 bp, Homo sapiens
gtccaggagccccgccaggtgc

SEQ ID NO: 3591230 - DNA, 23 bp, Homo sapiens
gtccaggccccaccggccaggcc

SEQ ID NO: 3591231 - DNA, 17 bp, Homo sapiens
gtccagtgagcagtgtt

SEQ ID NO: 3591232 - DNA, 19 bp, Homo sapiens
gtccagtgagcagtgttgc

SEQ ID NO: 3591233 - DNA, 14 bp, Homo sapiens
gtccatgtaaatac

SEQ ID NO: 3591234 - DNA, 15 bp, Homo sapiens
gtccatgtaaatact

SEQ ID NO: 3591235 - DNA, 15 bp, Homo sapiens
gtcccaacttgtaaa

SEQ ID NO: 3591236 - DNA, 15 bp, Homo sapiens
gtcccaattctgccc

SEQ ID NO: 3591237 - DNA, 12 bp, Homo sapiens
gtcccacactgt

SEQ ID NO: 3591238 - DNA, 15 bp, Homo sapiens
gtcccacactgtggc

SEQ ID NO: 3591239 - DNA, 14 bp, Homo sapiens
gtcccacccacaca

SEQ ID NO: 3591240 - DNA, 20 bp, Homo sapiens
gtcccacccacacagctgcc

SEQ ID NO: 3591241 - DNA, 20 bp, Homo sapiens
gtcccagaatgcctcctgca

SEQ ID NO: 3591242 - DNA, 20 bp, Homo sapiens
gtcccagcatccctggagca

SEQ ID NO: 3591243 - DNA, 15 bp, Homo sapiens
gtcccagctccctgg

SEQ ID NO: 3591244 - DNA, 15 bp, Homo sapiens
gtcccatcggaagtt

SEQ ID NO: 3591245 - DNA, 19 bp, Homo sapiens
gtcccatttttctcttgcc

SEQ ID NO: 3591246 - DNA, 19 bp, Homo sapiens
gtccccactgctgagctgg

SEQ ID NO: 3591247 - DNA, 20 bp, Homo sapiens
gtccccactgctgagctggc

SEQ ID NO: 3591248 - DNA, 11 bp, Homo sapiens
gtccccccacc

SEQ ID NO: 3591249 - DNA, 12 bp, Homo sapiens
gtccccccaccc

SEQ ID NO: 3591250 - DNA, 13 bp, Homo sapiens
gtcccggccagct

SEQ ID NO: 3591251 - DNA, 23 bp, Homo sapiens
gtccctaccgagtctcttctcca

SEQ ID NO: 3591252 - DNA, 20 bp, Homo sapiens
gtccctctgccccatcctcc

SEQ ID NO: 3591253 - DNA, 14 bp, Homo sapiens
gtccctgcagggcc

SEQ ID NO: 3591254 - DNA, 18 bp, Homo sapiens
gtccctgcagggccatct

SEQ ID NO: 3591255 - DNA, 22 bp, Homo sapiens
gtccctgctgctgccagggctt

SEQ ID NO: 3591256 - DNA, 16 bp, Homo sapiens
gtccctggacacagct

SEQ ID NO: 3591257 - DNA, 20 bp, Homo sapiens
gtccctggacacagctcttc

SEQ ID NO: 3591258 - DNA, 22 bp, Homo sapiens
gtccctggacacagctcttcat

SEQ ID NO: 3591259 - DNA, 16 bp, Homo sapiens
gtccctgtccctctag

SEQ ID NO: 3591260 - DNA, 19 bp, Homo sapiens
gtcccttcagactggccct

SEQ ID NO: 3591261 - DNA, 13 bp, Homo sapiens
gtcccttgcctct

SEQ ID NO: 3591262 - DNA, 16 bp, Homo sapiens
gtccctttccctacct

SEQ ID NO: 3591263 - DNA, 17 bp, Homo sapiens
gtccctttccctacctt

SEQ ID NO: 3591264 - DNA, 15 bp, Homo sapiens
gtcccttttccctta

SEQ ID NO: 3591265 - DNA, 18 bp, Homo sapiens
gtccgtgccccttccctg

SEQ ID NO: 3591266 - DNA, 19 bp, Homo sapiens
gtccgtgctgacagctgct

SEQ ID NO: 3591267 - DNA, 21 bp, Homo sapiens
gtccgtgctgacagctgctcc

SEQ ID NO: 3591268 - DNA, 18 bp, Homo sapiens
gtcctaacttcctgtgcc

SEQ ID NO: 3591269 - DNA, 18 bp, Homo sapiens
gtcctacagtgactccct

SEQ ID NO: 3591270 - DNA, 22 bp, Homo sapiens
gtcctacagtgactccctggga

SEQ ID NO: 3591271 - DNA, 13 bp, Homo sapiens
gtcctagttgtcc

SEQ ID NO: 3591272 - DNA, 19 bp, Homo sapiens
gtcctattatattcattct

SEQ ID NO: 3591273 - DNA, 20 bp, Homo sapiens
gtcctcagagaatttctacc

SEQ ID NO: 3591274 - DNA, 21 bp, Homo sapiens
gtcctcagccttgccagagat

SEQ ID NO: 3591275 - DNA, 13 bp, Homo sapiens
gtcctcaggaagg

SEQ ID NO: 3591276 - DNA, 18 bp, Homo sapiens
gtcctcaggaagggggcc

SEQ ID NO: 3591277 - DNA, 20 bp, Homo sapiens
gtcctccactcgacccagaa

SEQ ID NO: 3591278 - DNA, 21 bp, Homo sapiens
gtcctcccaatttcagactcc

SEQ ID NO: 3591279 - DNA, 19 bp, Homo sapiens
gtcctccctgatcccaccc

SEQ ID NO: 3591280 - DNA, 20 bp, Homo sapiens
gtcctccctgatcccacccc

SEQ ID NO: 3591281 - DNA, 22 bp, Homo sapiens
gtcctccctgatcccaccccct

SEQ ID NO: 3591282 - DNA, 18 bp, Homo sapiens
gtcctccgccttaccagg

SEQ ID NO: 3591283 - DNA, 22 bp, Homo sapiens
gtcctcctatctccctggctca

SEQ ID NO: 3591284 - DNA, 17 bp, Homo sapiens
gtcctctcggctgccag

SEQ ID NO: 3591285 - DNA, 10 bp, Homo sapiens
gtcctctctg

SEQ ID NO: 3591286 - DNA, 20 bp, Homo sapiens
gtcctctctgagtcaaatcc

SEQ ID NO: 3591287 - DNA, 13 bp, Homo sapiens
gtcctctgaatga

SEQ ID NO: 3591288 - DNA, 15 bp, Homo sapiens
gtcctcttctgctct

SEQ ID NO: 3591289 - DNA, 23 bp, Homo sapiens
gtcctcttctgctcttttcctgg

SEQ ID NO: 3591290 - DNA, 13 bp, Homo sapiens
gtcctcttttcct

SEQ ID NO: 3591291 - DNA, 21 bp, Homo sapiens
gtcctgaagtgacctcactgg

SEQ ID NO: 3591292 - DNA, 11 bp, Homo sapiens
gtcctgcacat

SEQ ID NO: 3591293 - DNA, 12 bp, Homo sapiens
gtcctgcacatg

SEQ ID NO: 3591294 - DNA, 20 bp, Homo sapiens
gtcctgcacatgagtggaaa

SEQ ID NO: 3591295 - DNA, 18 bp, Homo sapiens
gtcctgcagcctgcagga

SEQ ID NO: 3591296 - DNA, 18 bp, Homo sapiens
gtcctgcagtcccacact

SEQ ID NO: 3591297 - DNA, 20 bp, Homo sapiens
gtcctgcagtcccacactgt

SEQ ID NO: 3591298 - DNA, 14 bp, Homo sapiens
gtcctgcccatgcc

SEQ ID NO: 3591299 - DNA, 23 bp, Homo sapiens
gtcctgcctgtctgaagccaatg

SEQ ID NO: 3591300 - DNA, 14 bp, Homo sapiens
gtcctggaggcagg

SEQ ID NO: 3591301 - DNA, 15 bp, Homo sapiens
gtcctggccatccca

SEQ ID NO: 3591302 - DNA, 16 bp, Homo sapiens
gtcctggccatcccac

SEQ ID NO: 3591303 - DNA, 18 bp, Homo sapiens
gtcctggccatcccacaa

SEQ ID NO: 3591304 - DNA, 19 bp, Homo sapiens
gtcctgggcatgggtccag

SEQ ID NO: 3591305 - DNA, 23 bp, Homo sapiens
gtcctgggcatgggtccagggcc

SEQ ID NO: 3591306 - DNA, 14 bp, Homo sapiens
gtcctgggcctgcc

SEQ ID NO: 3591307 - DNA, 15 bp, Homo sapiens
gtcctgggcctgccc

SEQ ID NO: 3591308 - DNA, 12 bp, Homo sapiens
gtcctgggctgg

SEQ ID NO: 3591309 - DNA, 23 bp, Homo sapiens
gtcctggtgccctggatgcccag

SEQ ID NO: 3591310 - DNA, 14 bp, Homo sapiens
gtccttactccccc

SEQ ID NO: 3591311 - DNA, 15 bp, Homo sapiens
ggtgccagttatggc

SEQ ID NO: 3591312 - DNA, 20 bp, Homo sapiens
ggtgccccaggaccagctca

SEQ ID NO: 3591313 - DNA, 21 bp, Homo sapiens
ggtgccccaggaccagctcag

SEQ ID NO: 3591314 - DNA, 22 bp, Homo sapiens
ggtgcccgcgccaggccctcag

SEQ ID NO: 3591315 - DNA, 19 bp, Homo sapiens
ggtgccctggatgcccagg

SEQ ID NO: 3591316 - DNA, 20 bp, Homo sapiens
ggtgccctggatgcccagga

SEQ ID NO: 3591317 - DNA, 20 bp, Homo sapiens
ggtgcctatctgcctggagg

SEQ ID NO: 3591318 - DNA, 12 bp, Homo sapiens
ggtgcggctgtg

SEQ ID NO: 3591319 - DNA, 22 bp, Homo sapiens
ggtgcggctgtgcagcctgtcc

SEQ ID NO: 3591320 - DNA, 19 bp, Homo sapiens
ggtgctacaaaaacacagc

SEQ ID NO: 3591321 - DNA, 18 bp, Homo sapiens
ggtgctcatgctgctccc

SEQ ID NO: 3591322 - DNA, 13 bp, Homo sapiens
ggtgctctctctg

SEQ ID NO: 3591323 - DNA, 15 bp, Homo sapiens
ggtgctgacggccag

SEQ ID NO: 3591324 - DNA, 12 bp, Homo sapiens
ggtgctgctctc

SEQ ID NO: 3591325 - DNA, 14 bp, Homo sapiens
ggtgctgctctctc

SEQ ID NO: 3591326 - DNA, 15 bp, Homo sapiens
ggtggaacaagcaca

SEQ ID NO: 3591327 - DNA, 18 bp, Homo sapiens
ggtggacatctgacccca

SEQ ID NO: 3591328 - DNA, 17 bp, Homo sapiens
ggtggcacacgcctgta

SEQ ID NO: 3591329 - DNA, 22 bp, Homo sapiens
ggtggcacctgtttcccgggca

SEQ ID NO: 3591330 - DNA, 12 bp, Homo sapiens
ggtggcagacta

SEQ ID NO: 3591331 - DNA, 21 bp, Homo sapiens
ggtggccactccagacccctg

SEQ ID NO: 3591332 - DNA, 22 bp, Homo sapiens
ggtggccactccagacccctgg

SEQ ID NO: 3591333 - DNA, 22 bp, Homo sapiens
ggtggctagtcaagctcctcct

SEQ ID NO: 3591334 - DNA, 20 bp, Homo sapiens
ggtggctcccggagggccct

SEQ ID NO: 3591335 - DNA, 20 bp, Homo sapiens
ggtggctgccccggcctcct

SEQ ID NO: 3591336 - DNA, 21 bp, Homo sapiens
ggtggctgccccggcctcctc

SEQ ID NO: 3591337 - DNA, 19 bp, Homo sapiens
gtacctcaagccccatttc

SEQ ID NO: 3591338 - DNA, 21 bp, Homo sapiens
gtacctcagtggatcttcaga

SEQ ID NO: 3591339 - DNA, 15 bp, Homo sapiens
gtacctgattgtatt

SEQ ID NO: 3591340 - DNA, 14 bp, Homo sapiens
gtacctgccctcta

SEQ ID NO: 3591341 - DNA, 14 bp, Homo sapiens
gtactacccagctc

SEQ ID NO: 3591342 - DNA, 14 bp, Homo sapiens
gtactcattaaaaa

SEQ ID NO: 3591343 - DNA, 19 bp, Homo sapiens
gtactccacatatttcagt

SEQ ID NO: 3591344 - DNA, 13 bp, Homo sapiens
gtactcccaaact

SEQ ID NO: 3591345 - DNA, 14 bp, Homo sapiens
gtactgggacattg

SEQ ID NO: 3591346 - DNA, 19 bp, Homo sapiens
gtacttggcccccttcagg

SEQ ID NO: 3591347 - DNA, 22 bp, Homo sapiens
gtacttggcccccttcaggagc

SEQ ID NO: 3591348 - DNA, 13 bp, Homo sapiens
gtacttttccttt

SEQ ID NO: 3591349 - DNA, 15 bp, Homo sapiens
gtagaataggcaggg

SEQ ID NO: 3591350 - DNA, 17 bp, Homo sapiens
gtagactgtgccagagg

SEQ ID NO: 3591351 - DNA, 21 bp, Homo sapiens
gtagactgtgccagaggccag

SEQ ID NO: 3591352 - DNA, 17 bp, Homo sapiens
gtagagcccctactgtg

SEQ ID NO: 3591353 - DNA, 21 bp, Homo sapiens
gtagagcccctactgtgggca

SEQ ID NO: 3591354 - DNA, 17 bp, Homo sapiens
gtagatcaccagaataa

SEQ ID NO: 3591355 - DNA, 16 bp, Homo sapiens
gtagatgctgaggccc

SEQ ID NO: 3591356 - DNA, 12 bp, Homo sapiens
gtagatttaaaa

SEQ ID NO: 3591357 - DNA, 12 bp, Homo sapiens
gtagcagcaggc

SEQ ID NO: 3591358 - DNA, 22 bp, Homo sapiens
gtagcctcaatcgagtgagaca

SEQ ID NO: 3591359 - DNA, 18 bp, Homo sapiens
gtagcgttttttaaatgt

SEQ ID NO: 3591360 - DNA, 22 bp, Homo sapiens
gtagcgttttttaaatgtatac

SEQ ID NO: 3591361 - DNA, 19 bp, Homo sapiens
gtagctatttttatacact

SEQ ID NO: 3591362 - DNA, 19 bp, Homo sapiens
gtagctgcagccttcatca

SEQ ID NO: 3591363 - DNA, 17 bp, Homo sapiens
gtagctggattacaggc

SEQ ID NO: 3591364 - DNA, 16 bp, Homo sapiens
gtagctgtcgtacatt

SEQ ID NO: 3591365 - DNA, 22 bp, Homo sapiens
gtagctgtcgtacattgagcaa

SEQ ID NO: 3591366 - DNA, 12 bp, Homo sapiens
gtagctttgctc

SEQ ID NO: 3591367 - DNA, 16 bp, Homo sapiens
gtaggaccctcgagag

SEQ ID NO: 3591368 - DNA, 19 bp, Homo sapiens
gtaggattttgagggtggg

SEQ ID NO: 3591369 - DNA, 23 bp, Homo sapiens
gtagggatatggcaggactcctg

SEQ ID NO: 3591370 - DNA, 17 bp, Homo sapiens
gtagggtagtggctggg

SEQ ID NO: 3591371 - DNA, 20 bp, Homo sapiens
gtaggtcccggccagctctg

SEQ ID NO: 3591372 - DNA, 21 bp, Homo sapiens
gtaggtcccggccagctctgg

SEQ ID NO: 3591373 - DNA, 20 bp, Homo sapiens
gtaggtggttcgtgctgtgc

SEQ ID NO: 3591374 - DNA, 16 bp, Homo sapiens
gtaggtttttttaaaa

SEQ ID NO: 3591375 - DNA, 22 bp, Homo sapiens
gtagtagcgttttttaaatgta

SEQ ID NO: 3591376 - DNA, 23 bp, Homo sapiens
gtagtattttttgtataattgga

SEQ ID NO: 3591377 - DNA, 22 bp, Homo sapiens
gtagtccgtgctgacagctgct

SEQ ID NO: 3591378 - DNA, 23 bp, Homo sapiens
gtagtccgtgctgacagctgctc

SEQ ID NO: 3591379 - DNA, 14 bp, Homo sapiens
gtagtgtggcctgt

SEQ ID NO: 3591380 - DNA, 14 bp, Homo sapiens
gtagttctcaaagt

SEQ ID NO: 3591381 - DNA, 21 bp, Homo sapiens
gtagttgagttggaacaacat

SEQ ID NO: 3591382 - DNA, 16 bp, Homo sapiens
gtataaagcatgtggt

SEQ ID NO: 3591383 - DNA, 14 bp, Homo sapiens
gtataaatgtacat

SEQ ID NO: 3591384 - DNA, 21 bp, Homo sapiens
gtataactttaacttctgttt

SEQ ID NO: 3591385 - DNA, 17 bp, Homo sapiens
gtataagaaatgcatat

SEQ ID NO: 3591386 - DNA, 16 bp, Homo sapiens
gtataatgtaatgttt

SEQ ID NO: 3591387 - DNA, 18 bp, Homo sapiens
gtataattggatttccta

SEQ ID NO: 3591388 - DNA, 20 bp, Homo sapiens
gtataattggatttcctaat

SEQ ID NO: 3591389 - DNA, 22 bp, Homo sapiens
gtatagaccaaagcaaagaaaa

SEQ ID NO: 3591390 - DNA, 12 bp, Homo sapiens
gtatataagctt

SEQ ID NO: 3591391 - DNA, 13 bp, Homo sapiens
gtatataagcttt

SEQ ID NO: 3591392 - DNA, 12 bp, Homo sapiens
gtatatcatgta

SEQ ID NO: 3591393 - DNA, 21 bp, Homo sapiens
gtatatgtctcaggtccctgc

SEQ ID NO: 3591394 - DNA, 19 bp, Homo sapiens
gtatattaaaaaagagaca

SEQ ID NO: 3591395 - DNA, 18 bp, Homo sapiens
gtatattctattttacaa

SEQ ID NO: 3591396 - DNA, 17 bp, Homo sapiens
gtatatttttgtctgca

SEQ ID NO: 3591397 - DNA, 20 bp, Homo sapiens
gtatatttttgtctgcagct

SEQ ID NO: 3591398 - DNA, 15 bp, Homo sapiens
gtatccaatgaaata

SEQ ID NO: 3591399 - DNA, 23 bp, Homo sapiens
gtatcctccaggtttttcaatta

SEQ ID NO: 3591400 - DNA, 16 bp, Homo sapiens
gtatcctggccctggg

SEQ ID NO: 3591401 - DNA, 17 bp, Homo sapiens
gtatcctggccctgggg

SEQ ID NO: 3591402 - DNA, 18 bp, Homo sapiens
gtatcctggccctggggg

SEQ ID NO: 3591403 - DNA, 13 bp, Homo sapiens
gtatctggcttcc

SEQ ID NO: 3591404 - DNA, 18 bp, Homo sapiens
gtatctggcttccctgga

SEQ ID NO: 3591405 - DNA, 13 bp, Homo sapiens
gtatcttaaattt

SEQ ID NO: 3591406 - DNA, 22 bp, Homo sapiens
gtatgaaagatggctgtgcctc

SEQ ID NO: 3591407 - DNA, 23 bp, Homo sapiens
gtatgaaagatggctgtgcctct

SEQ ID NO: 3591408 - DNA, 18 bp, Homo sapiens
gtatgaataaagacacct

SEQ ID NO: 3591409 - DNA, 19 bp, Homo sapiens
gtatgaataaagacaccta

SEQ ID NO: 3591410 - DNA, 15 bp, Homo sapiens
gtatgaataattgca

SEQ ID NO: 3591411 - DNA, 24 bp, Homo sapiens
gtatgataggttattttgatgtaa

SEQ ID NO: 3591412 - DNA, 17 bp, Homo sapiens
gtatgcagtactaaaat

SEQ ID NO: 3591413 - DNA, 13 bp, Homo sapiens
gtatggaaataaa

SEQ ID NO: 3591414 - DNA, 13 bp, Homo sapiens
gtatgtgagctgt

SEQ ID NO: 3591415 - DNA, 18 bp, Homo sapiens
gtatgtggaagtgtgggt

SEQ ID NO: 3591416 - DNA, 15 bp, Homo sapiens
gtatgtgtgtctatt

SEQ ID NO: 3591417 - DNA, 21 bp, Homo sapiens
gtattaagcagttcattctac

SEQ ID NO: 3591418 - DNA, 23 bp, Homo sapiens
gtattatccacaattattggcaa

SEQ ID NO: 3591419 - DNA, 15 bp, Homo sapiens
gtattatctcctttg

SEQ ID NO: 3591420 - DNA, 18 bp, Homo sapiens
gtattattttttaataaa

SEQ ID NO: 3591421 - DNA, 20 bp, Homo sapiens
gtattcagaccctgggtcag

SEQ ID NO: 3591422 - DNA, 16 bp, Homo sapiens
gtattgaaaacttcaa

SEQ ID NO: 3591423 - DNA, 16 bp, Homo sapiens
gtattgcacattgtaa

SEQ ID NO: 3591424 - DNA, 18 bp, Homo sapiens
gtattggtgttgcagccg

SEQ ID NO: 3591425 - DNA, 22 bp, Homo sapiens
gtatttaaaaaaaagaaacttt

SEQ ID NO: 3591426 - DNA, 14 bp, Homo sapiens
gtatttaagacata

SEQ ID NO: 3591427 - DNA, 17 bp, Homo sapiens
gtatttaagacataaac

SEQ ID NO: 3591428 - DNA, 21 bp, Homo sapiens
gtatttaagatgtacatttaa

SEQ ID NO: 3591429 - DNA, 13 bp, Homo sapiens
gtatttatcttta

SEQ ID NO: 3591430 - DNA, 16 bp, Homo sapiens
gtatttattaatttga

SEQ ID NO: 3591431 - DNA, 18 bp, Homo sapiens
gtatttattaccgtcaca

SEQ ID NO: 3591432 - DNA, 17 bp, Homo sapiens
gtatttctatacagtag

SEQ ID NO: 3591433 - DNA, 21 bp, Homo sapiens
gtatttgaaaattacatgttt

SEQ ID NO: 3591434 - DNA, 12 bp, Homo sapiens
gtattttacatg

SEQ ID NO: 3591435 - DNA, 14 bp, Homo sapiens
gtattttcagagaa

SEQ ID NO: 3591436 - DNA, 17 bp, Homo sapiens
gtatttttttgtaattg

SEQ ID NO: 3591437 - DNA, 12 bp, Homo sapiens
gtcaaaaggaac

SEQ ID NO: 3591438 - DNA, 13 bp, Homo sapiens
gtcaaaaggaaca

SEQ ID NO: 3591439 - DNA, 23 bp, Homo sapiens
gtcaaacattcgtgagctgggga

SEQ ID NO: 3591440 - DNA, 16 bp, Homo sapiens
gtcaaactttggagag

SEQ ID NO: 3591441 - DNA, 22 bp, Homo sapiens
gtcaaagtgttgctgtggctcc

SEQ ID NO: 3591442 - DNA, 12 bp, Homo sapiens
gtcaaatccagt

SEQ ID NO: 3591443 - DNA, 13 bp, Homo sapiens
gtcaaatccagtg

SEQ ID NO: 3591444 - DNA, 18 bp, Homo sapiens
gtcaaatccagtggtggg

SEQ ID NO: 3591445 - DNA, 21 bp, Homo sapiens
gtcaaatccagtggtgggtaa

SEQ ID NO: 3591446 - DNA, 12 bp, Homo sapiens
gtcaacatttct

SEQ ID NO: 3591447 - DNA, 17 bp, Homo sapiens
gtcaacatttctcatgt

SEQ ID NO: 3591448 - DNA, 19 bp, Homo sapiens
gtcaacatttctcatgttg

SEQ ID NO: 3591449 - DNA, 20 bp, Homo sapiens
gtcaacatttctcatgttga

SEQ ID NO: 3591450 - DNA, 19 bp, Homo sapiens
gtcaagagatcgagaccat

SEQ ID NO: 3591451 - DNA, 19 bp, Homo sapiens
gtcacaacccttctctgtt

SEQ ID NO: 3591452 - DNA, 17 bp, Homo sapiens
gtcacaggactctgcct

SEQ ID NO: 3591453 - DNA, 13 bp, Homo sapiens
gtcacatctcagg

SEQ ID NO: 3591454 - DNA, 14 bp, Homo sapiens
gtcacatctcaggg

SEQ ID NO: 3591455 - DNA, 18 bp, Homo sapiens
cttggctttatgcaaata

SEQ ID NO: 3591456 - DNA, 20 bp, Homo sapiens
cttggctttatgcaaataca

SEQ ID NO: 3591457 - DNA, 10 bp, Homo sapiens
cttgggaatg

SEQ ID NO: 3591458 - DNA, 13 bp, Homo sapiens
cttgggaatttta

SEQ ID NO: 3591459 - DNA, 14 bp, Homo sapiens
cttgggaccccaga

SEQ ID NO: 3591460 - DNA, 17 bp, Homo sapiens
cttgggatccaggcccc

SEQ ID NO: 3591461 - DNA, 23 bp, Homo sapiens
cttgggcagatctcccacatgcc

SEQ ID NO: 3591462 - DNA, 20 bp, Homo sapiens
cttgggcctcaggctctgca

SEQ ID NO: 3591463 - DNA, 14 bp, Homo sapiens
cttgggctgaccca

SEQ ID NO: 3591464 - DNA, 16 bp, Homo sapiens
cttgggctgacccagc

SEQ ID NO: 3591465 - DNA, 19 bp, Homo sapiens
cttggggagttaagacctg

SEQ ID NO: 3591466 - DNA, 20 bp, Homo sapiens
cttgggggaggccaccccaa

SEQ ID NO: 3591467 - DNA, 17 bp, Homo sapiens
cttggtgacaaaattca

SEQ ID NO: 3591468 - DNA, 13 bp, Homo sapiens
cttgtaataaata

SEQ ID NO: 3591469 - DNA, 15 bp, Homo sapiens
cttgtacagtctgct

SEQ ID NO: 3591470 - DNA, 17 bp, Homo sapiens
cttgtatattttaagaa

SEQ ID NO: 3591471 - DNA, 22 bp, Homo sapiens
cttgtcaccagttaaaagcatt

SEQ ID NO: 3591472 - DNA, 23 bp, Homo sapiens
cttgtcactggtagaccaaaata

SEQ ID NO: 3591473 - DNA, 21 bp, Homo sapiens
cttgtcccgtctggacctggg

SEQ ID NO: 3591474 - DNA, 16 bp, Homo sapiens
cttgtcctcttctgct

SEQ ID NO: 3591475 - DNA, 22 bp, Homo sapiens
cttgtcctcttctgctcttttc

SEQ ID NO: 3591476 - DNA, 15 bp, Homo sapiens
cttgtcgggggccca

SEQ ID NO: 3591477 - DNA, 14 bp, Homo sapiens
cttgtgattggctg

SEQ ID NO: 3591478 - DNA, 16 bp, Homo sapiens
cttgtgattggctgca

SEQ ID NO: 3591479 - DNA, 18 bp, Homo sapiens
cttgtggaattgggagct

SEQ ID NO: 3591480 - DNA, 10 bp, Homo sapiens
cttgtggcag

SEQ ID NO: 3591481 - DNA, 10 bp, Homo sapiens
cttgtggcct

SEQ ID NO: 3591482 - DNA, 15 bp, Homo sapiens
cttgtggcctatgaa

SEQ ID NO: 3591483 - DNA, 17 bp, Homo sapiens
cttgtgtctctgtgctt

SEQ ID NO: 3591484 - DNA, 23 bp, Homo sapiens
cttgttcctgaaatgtgtttcct

SEQ ID NO: 3591485 - DNA, 15 bp, Homo sapiens
cttgttgaatttatt

SEQ ID NO: 3591486 - DNA, 15 bp, Homo sapiens
cttgtttaatgttaa

SEQ ID NO: 3591487 - DNA, 16 bp, Homo sapiens
cttgtttaatgttaat

SEQ ID NO: 3591488 - DNA, 17 bp, Homo sapiens
cttgtttgaatatttgt

SEQ ID NO: 3591489 - DNA, 19 bp, Homo sapiens
cttgttttttttttccact

SEQ ID NO: 3591490 - DNA, 17 bp, Homo sapiens
ctttaaaacgcgtctgc

SEQ ID NO: 3591491 - DNA, 20 bp, Homo sapiens
gggaccaggtttgcaggagc

SEQ ID NO: 3591492 - DNA, 16 bp, Homo sapiens
gggacccacagaactt

SEQ ID NO: 3591493 - DNA, 13 bp, Homo sapiens
gggaccccagaga

SEQ ID NO: 3591494 - DNA, 22 bp, Homo sapiens
gggaccccgagaaccctgagca

SEQ ID NO: 3591495 - DNA, 19 bp, Homo sapiens
gggaccgggcgcagccctc

SEQ ID NO: 3591496 - DNA, 20 bp, Homo sapiens
gggaccggtgctgcaggagt

SEQ ID NO: 3591497 - DNA, 18 bp, Homo sapiens
gggaccgtccaggggaga

SEQ ID NO: 3591498 - DNA, 13 bp, Homo sapiens
gggactcagggac

SEQ ID NO: 3591499 - DNA, 24 bp, Homo sapiens
gggactgactttccgagcctccag

SEQ ID NO: 3591500 - DNA, 12 bp, Homo sapiens
gggagaagctcc

SEQ ID NO: 3591501 - DNA, 18 bp, Homo sapiens
gggagacaggagcctagc

SEQ ID NO: 3591502 - DNA, 21 bp, Homo sapiens
gggagagatccctgcagaacc

SEQ ID NO: 3591503 - DNA, 14 bp, Homo sapiens
gggagagcggctgg

SEQ ID NO: 3591504 - DNA, 12 bp, Homo sapiens
gggagcacccag

SEQ ID NO: 3591505 - DNA, 14 bp, Homo sapiens
gggagcactgcgtt

SEQ ID NO: 3591506 - DNA, 15 bp, Homo sapiens
gggagcagggaggtc

SEQ ID NO: 3591507 - DNA, 23 bp, Homo sapiens
gggagcaggttccccaagggccc

SEQ ID NO: 3591508 - DNA, 22 bp, Homo sapiens
gggagcatttaatggcagctag

SEQ ID NO: 3591509 - DNA, 10 bp, Homo sapiens
gggagccagg

SEQ ID NO: 3591510 - DNA, 20 bp, Homo sapiens
gggagccgggcaaactggcc

SEQ ID NO: 3591511 - DNA, 17 bp, Homo sapiens
gggagcctagctcctgc

SEQ ID NO: 3591512 - DNA, 15 bp, Homo sapiens
gggagctctggggac

SEQ ID NO: 3591513 - DNA, 20 bp, Homo sapiens
gggagctgctgggtggcagg

SEQ ID NO: 3591514 - DNA, 21 bp, Homo sapiens
gggagctgctgggtggcaggg

SEQ ID NO: 3591515 - DNA, 17 bp, Homo sapiens
gggagcttccgctttga

SEQ ID NO: 3591516 - DNA, 15 bp, Homo sapiens
gggaggagcctgtgc

SEQ ID NO: 3591517 - DNA, 13 bp, Homo sapiens
gggaggagcttct

SEQ ID NO: 3591518 - DNA, 12 bp, Homo sapiens
gggaggcacact

SEQ ID NO: 3591519 - DNA, 20 bp, Homo sapiens
gggaggcagaggttgcagtg

SEQ ID NO: 3591520 - DNA, 18 bp, Homo sapiens
gggaggctgaggcagaag

SEQ ID NO: 3591521 - DNA, 13 bp, Homo sapiens
gggagggaggtgg

SEQ ID NO: 3591522 - DNA, 16 bp, Homo sapiens
gggaggtccaagcaga

SEQ ID NO: 3591523 - DNA, 16 bp, Homo sapiens
gggagttaagacctgg

SEQ ID NO: 3591524 - DNA, 20 bp, Homo sapiens
gggagttaagacctggcagc

SEQ ID NO: 3591525 - DNA, 23 bp, Homo sapiens
gggagttaagacctggcagctct

SEQ ID NO: 3591526 - DNA, 23 bp, Homo sapiens
gggatagtgttctgctcctgctt

SEQ ID NO: 3591527 - DNA, 14 bp, Homo sapiens
gggatatggctgcc

SEQ ID NO: 3591528 - DNA, 14 bp, Homo sapiens
gggatccagccact

SEQ ID NO: 3591529 - DNA, 20 bp, Homo sapiens
gggatccctcccccccatgc

SEQ ID NO: 3591530 - DNA, 19 bp, Homo sapiens
gggatcctccacagagagg

SEQ ID NO: 3591531 - DNA, 16 bp, Homo sapiens
gggatcttcccacagg

SEQ ID NO: 3591532 - DNA, 14 bp, Homo sapiens
gggatgacctccag

SEQ ID NO: 3591533 - DNA, 22 bp, Homo sapiens
gggatgaggtcaccaggggagg

SEQ ID NO: 3591534 - DNA, 22 bp, Homo sapiens
gggatgatggcagagccaggct

SEQ ID NO: 3591535 - DNA, 16 bp, Homo sapiens
gggatgctgggctggg

SEQ ID NO: 3591536 - DNA, 17 bp, Homo sapiens
gggatgctgggctgggc

SEQ ID NO: 3591537 - DNA, 22 bp, Homo sapiens
gggatggacttgtgattggctg

SEQ ID NO: 3591538 - DNA, 13 bp, Homo sapiens
gggatggagggaa

SEQ ID NO: 3591539 - DNA, 18 bp, Homo sapiens
gggattgaggggccctgg

SEQ ID NO: 3591540 - DNA, 22 bp, Homo sapiens
gggattgcccctggctttgcct

SEQ ID NO: 3591541 - DNA, 14 bp, Homo sapiens
gggattgctgaggc

SEQ ID NO: 3591542 - DNA, 23 bp, Homo sapiens
gggcaagctaggccccagaggcc

SEQ ID NO: 3591543 - DNA, 15 bp, Homo sapiens
gggcacacctcctcc

SEQ ID NO: 3591544 - DNA, 17 bp, Homo sapiens
gggcacacctcctccca

SEQ ID NO: 3591545 - DNA, 16 bp, Homo sapiens
gggcacacgctgctct

SEQ ID NO: 3591546 - DNA, 23 bp, Homo sapiens
gggcacacgctgctctgccccag

SEQ ID NO: 3591547 - DNA, 17 bp, Homo sapiens
gggcacagtggtgaccc

SEQ ID NO: 3591548 - DNA, 14 bp, Homo sapiens
gggcagactgtgaa

SEQ ID NO: 3591549 - DNA, 15 bp, Homo sapiens
gggcagaggagaact

SEQ ID NO: 3591550 - DNA, 16 bp, Homo sapiens
gggcagatctcccaca

SEQ ID NO: 3591551 - DNA, 16 bp, Homo sapiens
gggcagcaatttaaat

SEQ ID NO: 3591552 - DNA, 11 bp, Homo sapiens
gggcagcactc

SEQ ID NO: 3591553 - DNA, 14 bp, Homo sapiens
gggcagcactcccc

SEQ ID NO: 3591554 - DNA, 21 bp, Homo sapiens
gggcagcactccccagagctg

SEQ ID NO: 3591555 - DNA, 14 bp, Homo sapiens
gggcagcaggccag

SEQ ID NO: 3591556 - DNA, 20 bp, Homo sapiens
gggcagcaggccagagaaag

SEQ ID NO: 3591557 - DNA, 21 bp, Homo sapiens
gggcagcctctccgactctgc

SEQ ID NO: 3591558 - DNA, 17 bp, Homo sapiens
gggcagcggctccactt

SEQ ID NO: 3591559 - DNA, 22 bp, Homo sapiens
gggcagctggcccccagccctg

SEQ ID NO: 3591560 - DNA, 20 bp, Homo sapiens
gggcaggaaagccacatctt

SEQ ID NO: 3591561 - DNA, 14 bp, Homo sapiens
gggcagggaaggac

SEQ ID NO: 3591562 - DNA, 19 bp, Homo sapiens
gggcagggatgatggcaga

SEQ ID NO: 3591563 - DNA, 16 bp, Homo sapiens
gggcagggcccacgtg

SEQ ID NO: 3591564 - DNA, 16 bp, Homo sapiens
gggcagggggacagca

SEQ ID NO: 3591565 - DNA, 13 bp, Homo sapiens
gggcatcctcagg

SEQ ID NO: 3591566 - DNA, 15 bp, Homo sapiens
gggcatggccaggtg

SEQ ID NO: 3591567 - DNA, 20 bp, Homo sapiens
gggcattagcaaggcagagc

SEQ ID NO: 3591568 - DNA, 23 bp, Homo sapiens
gggccaagagatctgtgtggctc

SEQ ID NO: 3591569 - DNA, 15 bp, Homo sapiens
gggccacctgcagga

SEQ ID NO: 3591570 - DNA, 11 bp, Homo sapiens
gggccagagcc

SEQ ID NO: 3591571 - DNA, 12 bp, Homo sapiens
gggccagagcca

SEQ ID NO: 3591572 - DNA, 13 bp, Homo sapiens
gggccagagccag

SEQ ID NO: 3591573 - DNA, 14 bp, Homo sapiens
gggccagagccagg

SEQ ID NO: 3591574 - DNA, 16 bp, Homo sapiens
gggccagatccagcct

SEQ ID NO: 3591575 - DNA, 13 bp, Homo sapiens
ctgtatgtgagct

SEQ ID NO: 3591576 - DNA, 23 bp, Homo sapiens
ctgtatgtgagctgtaaaaatgt

SEQ ID NO: 3591577 - DNA, 23 bp, Homo sapiens
tcataaaatcaaaacaagtgaaa

SEQ ID NO: 3591578 - DNA, 19 bp, Homo sapiens
tcataaatcatgttgttgt

SEQ ID NO: 3591579 - DNA, 17 bp, Homo sapiens
tcataaggagttggtgt

SEQ ID NO: 3591580 - DNA, 14 bp, Homo sapiens
tcataatctttgct

SEQ ID NO: 3591581 - DNA, 14 bp, Homo sapiens
tattgactttgtct

SEQ ID NO: 3591582 - DNA, 14 bp, Homo sapiens
tattgatacaatat

SEQ ID NO: 3591583 - DNA, 20 bp, Homo sapiens
tattgatatgcttatacact

SEQ ID NO: 3591584 - DNA, 16 bp, Homo sapiens
tattgatattcaataa

SEQ ID NO: 3591585 - DNA, 14 bp, Homo sapiens
tattgattaagcct

SEQ ID NO: 3591586 - DNA, 13 bp, Homo sapiens
tattgcatttata

SEQ ID NO: 3591587 - DNA, 17 bp, Homo sapiens
tattgcatttatatgta

SEQ ID NO: 3591588 - DNA, 19 bp, Homo sapiens
tattgccaaaacccagctg

SEQ ID NO: 3591589 - DNA, 21 bp, Homo sapiens
tattgccaaaacccagctgca

SEQ ID NO: 3591590 - DNA, 21 bp, Homo sapiens
tattgccctaattaaaaactg

SEQ ID NO: 3591591 - DNA, 20 bp, Homo sapiens
tattggcaaagtttaaatgt

SEQ ID NO: 3591592 - DNA, 20 bp, Homo sapiens
tattggtttaaagaaagtgt

SEQ ID NO: 3591593 - DNA, 17 bp, Homo sapiens
tattgtatattacaatg

SEQ ID NO: 3591594 - DNA, 12 bp, Homo sapiens
tattgtattttg

SEQ ID NO: 3591595 - DNA, 17 bp, Homo sapiens
tattgtattttgatgag

SEQ ID NO: 3591596 - DNA, 22 bp, Homo sapiens
tattgtgccaactgccaggctg

SEQ ID NO: 3591597 - DNA, 22 bp, Homo sapiens
tattgtgtggtctggttcctgt

SEQ ID NO: 3591598 - DNA, 15 bp, Homo sapiens
tattgttagaaaatg

SEQ ID NO: 3591599 - DNA, 22 bp, Homo sapiens
tattgttagaaaatgacttatt

SEQ ID NO: 3591600 - DNA, 20 bp, Homo sapiens
tattgtttaaaatcatttct

SEQ ID NO: 3591601 - DNA, 16 bp, Homo sapiens
tatttaaaaaaaagaa

SEQ ID NO: 3591602 - DNA, 23 bp, Homo sapiens
tatttaaaatggtgaatgacact

SEQ ID NO: 3591603 - DNA, 18 bp, Homo sapiens
tatttaaatgttctaaca

SEQ ID NO: 3591604 - DNA, 14 bp, Homo sapiens
tatttaactgatta

SEQ ID NO: 3591605 - DNA, 21 bp, Homo sapiens
tatttaactgattaaaaatac

SEQ ID NO: 3591606 - DNA, 14 bp, Homo sapiens
tatttaacttctga

SEQ ID NO: 3591607 - DNA, 12 bp, Homo sapiens
tatttaagatgt

SEQ ID NO: 3591608 - DNA, 22 bp, Homo sapiens
tatttaagatgtacatttaata

SEQ ID NO: 3591609 - DNA, 20 bp, Homo sapiens
tatttaagcagcttgaatgg

SEQ ID NO: 3591610 - DNA, 18 bp, Homo sapiens
tatttaatgatgattatg

SEQ ID NO: 3591611 - DNA, 18 bp, Homo sapiens
tatttacactattatttc

SEQ ID NO: 3591612 - DNA, 14 bp, Homo sapiens
tatttacagctgtg

SEQ ID NO: 3591613 - DNA, 22 bp, Homo sapiens
tatttacagctgtgctccacac

SEQ ID NO: 3591614 - DNA, 15 bp, Homo sapiens
tatttacccttttcc

SEQ ID NO: 3591615 - DNA, 15 bp, Homo sapiens
tatttagtcaacata

SEQ ID NO: 3591616 - DNA, 17 bp, Homo sapiens
tatttagtcaacatata

SEQ ID NO: 3591617 - DNA, 22 bp, Homo sapiens
tatttatatcatccagaaaaga

SEQ ID NO: 3591618 - DNA, 22 bp, Homo sapiens
tatttatgccttgatgatttaa

SEQ ID NO: 3591619 - DNA, 12 bp, Homo sapiens
tatttattaaac

SEQ ID NO: 3591620 - DNA, 16 bp, Homo sapiens
tatttattaaacttca

SEQ ID NO: 3591621 - DNA, 17 bp, Homo sapiens
tatttattagccaactg

SEQ ID NO: 3591622 - DNA, 14 bp, Homo sapiens
tatttattccccag

SEQ ID NO: 3591623 - DNA, 22 bp, Homo sapiens
tatttattccccagtgactcca

SEQ ID NO: 3591624 - DNA, 17 bp, Homo sapiens
tatttattgatgttttc

SEQ ID NO: 3591625 - DNA, 16 bp, Homo sapiens
tatttattgttagaaa

SEQ ID NO: 3591626 - DNA, 20 bp, Homo sapiens
tatttattgttagaaaatga

SEQ ID NO: 3591627 - DNA, 24 bp, Homo sapiens
tatttattgttagaaaatgactta

SEQ ID NO: 3591628 - DNA, 13 bp, Homo sapiens
tatttattttctt

SEQ ID NO: 3591629 - DNA, 20 bp, Homo sapiens
tatttattttttttaagtat

SEQ ID NO: 3591630 - DNA, 17 bp, Homo sapiens
tatttcaataaatcttt

SEQ ID NO: 3591631 - DNA, 18 bp, Homo sapiens
tatttcaatcttttaaat

SEQ ID NO: 3591632 - DNA, 16 bp, Homo sapiens
tatttcagcaaacttg

SEQ ID NO: 3591633 - DNA, 17 bp, Homo sapiens
tatttcagtgttttcat

SEQ ID NO: 3591634 - DNA, 23 bp, Homo sapiens
tatttcatcatgataattcagca

SEQ ID NO: 3591635 - DNA, 18 bp, Homo sapiens
tatttccacccatttgtt

SEQ ID NO: 3591636 - DNA, 15 bp, Homo sapiens
tatttctaagtattt

SEQ ID NO: 3591637 - DNA, 19 bp, Homo sapiens
tatttctaatccttttcct

SEQ ID NO: 3591638 - DNA, 17 bp, Homo sapiens
tatttctacattacagc

SEQ ID NO: 3591639 - DNA, 16 bp, Homo sapiens
tatttctatacagtag

SEQ ID NO: 3591640 - DNA, 17 bp, Homo sapiens
tatttctcagctgtgcc

SEQ ID NO: 3591641 - DNA, 17 bp, Homo sapiens
tatttctccatcccctc

SEQ ID NO: 3591642 - DNA, 12 bp, Homo sapiens
tatttctgactc

SEQ ID NO: 3591643 - DNA, 12 bp, Homo sapiens
tatttcttccct

SEQ ID NO: 3591644 - DNA, 23 bp, Homo sapiens
tatttcttgaagaataaattcta

SEQ ID NO: 3591645 - DNA, 16 bp, Homo sapiens
tatttgaaaaaaactt

SEQ ID NO: 3591646 - DNA, 13 bp, Homo sapiens
tatttgacttgaa

SEQ ID NO: 3591647 - DNA, 14 bp, Homo sapiens
tatttgcattgagg

SEQ ID NO: 3591648 - DNA, 23 bp, Homo sapiens
tatttgggcctgctccagacctg

SEQ ID NO: 3591649 - DNA, 22 bp, Homo sapiens
tatttgtaaatttatgtgatgg

SEQ ID NO: 3591650 - DNA, 16 bp, Homo sapiens
tatttgtcaacagatt

SEQ ID NO: 3591651 - DNA, 12 bp, Homo sapiens
tattttaatcct

SEQ ID NO: 3591652 - DNA, 14 bp, Homo sapiens
tattttaattaaaa

SEQ ID NO: 3591653 - DNA, 14 bp, Homo sapiens
tattttaattactg

SEQ ID NO: 3591654 - DNA, 17 bp, Homo sapiens
tattttatattgttata

SEQ ID NO: 3591655 - DNA, 15 bp, Homo sapiens
tattttatgtgtaaa

SEQ ID NO: 3591656 - DNA, 19 bp, Homo sapiens
tattttcaacgcagccctg

SEQ ID NO: 3591657 - DNA, 13 bp, Homo sapiens
tattttcaagaaa

SEQ ID NO: 3591658 - DNA, 14 bp, Homo sapiens
tattttcagagaac

SEQ ID NO: 3591659 - DNA, 14 bp, Homo sapiens
tattttccttctga

SEQ ID NO: 3591660 - DNA, 15 bp, Homo sapiens
tattttctaaagact

SEQ ID NO: 3591661 - DNA, 21 bp, Homo sapiens
tattttgagaaactgctgcag

SEQ ID NO: 3591662 - DNA, 13 bp, Homo sapiens
tattttgctaact

SEQ ID NO: 3591663 - DNA, 17 bp, Homo sapiens
tattttgctaactggtt

SEQ ID NO: 3591664 - DNA, 12 bp, Homo sapiens
tattttgtaata

SEQ ID NO: 3591665 - DNA, 19 bp, Homo sapiens
tattttgtaataaactctc

SEQ ID NO: 3591666 - DNA, 17 bp, Homo sapiens
tattttgtttcttttaa

SEQ ID NO: 3591667 - DNA, 23 bp, Homo sapiens
tatttttaaaaaatgaaatcctt

SEQ ID NO: 3591668 - DNA, 17 bp, Homo sapiens
tatttttaaagaaatgc

SEQ ID NO: 3591669 - DNA, 22 bp, Homo sapiens
tatttttatacactgtaagctt

SEQ ID NO: 3591670 - DNA, 11 bp, Homo sapiens
tatttttcctt

SEQ ID NO: 3591671 - DNA, 18 bp, Homo sapiens
tattttttaaatcttgac

SEQ ID NO: 3591672 - DNA, 20 bp, Homo sapiens
tattttttaaatcttgacca

SEQ ID NO: 3591673 - DNA, 12 bp, Homo sapiens
tattttttcaga

SEQ ID NO: 3591674 - DNA, 13 bp, Homo sapiens
tattttttcagac

SEQ ID NO: 3591675 - DNA, 15 bp, Homo sapiens
tattttttcagaccg

SEQ ID NO: 3591676 - DNA, 19 bp, Homo sapiens
tatttttttgtaattgctt

SEQ ID NO: 3591677 - DNA, 17 bp, Homo sapiens
tcaaaaagccacagcag

SEQ ID NO: 3591678 - DNA, 14 bp, Homo sapiens
tcaaaacaaaacaa

SEQ ID NO: 3591679 - DNA, 16 bp, Homo sapiens
tcaaaactgaagcttt

SEQ ID NO: 3591680 - DNA, 13 bp, Homo sapiens
tcaaaagtttgtt

SEQ ID NO: 3591681 - DNA, 23 bp, Homo sapiens
tcaaacccagagggttgctggtc

SEQ ID NO: 3591682 - DNA, 15 bp, Homo sapiens
tcaaactgcacatct

SEQ ID NO: 3591683 - DNA, 15 bp, Homo sapiens
tcaaacttaaacaaa

SEQ ID NO: 3591684 - DNA, 23 bp, Homo sapiens
tcaaagagaagatgcctgttaat

SEQ ID NO: 3591685 - DNA, 17 bp, Homo sapiens
tcaaagctgaatatttt

SEQ ID NO: 3591686 - DNA, 16 bp, Homo sapiens
tcaaagtaaggctggt

SEQ ID NO: 3591687 - DNA, 13 bp, Homo sapiens
tcaaagtcattaa

SEQ ID NO: 3591688 - DNA, 13 bp, Homo sapiens
tcaaagtgcctgg

SEQ ID NO: 3591689 - DNA, 17 bp, Homo sapiens
tcaaagtgcctgggctc

SEQ ID NO: 3591690 - DNA, 15 bp, Homo sapiens
tcaaagtgttgctgt

SEQ ID NO: 3591691 - DNA, 14 bp, Homo sapiens
tcaaataaaaataa

SEQ ID NO: 3591692 - DNA, 22 bp, Homo sapiens
tcaaatacatttaaaacattaa

SEQ ID NO: 3591693 - DNA, 14 bp, Homo sapiens
tcaaatatgcaaag

SEQ ID NO: 3591694 - DNA, 11 bp, Homo sapiens
tcaaatatttc

SEQ ID NO: 3591695 - DNA, 23 bp, Homo sapiens
tcaaatcaggctactagaattct

SEQ ID NO: 3591696 - DNA, 20 bp, Homo sapiens
tcaaatgctggcaaatccag

SEQ ID NO: 3591697 - DNA, 20 bp, Homo sapiens
tcaaatggggccagatccag

SEQ ID NO: 3591698 - DNA, 14 bp, Homo sapiens
tcaaattaccgtgt

SEQ ID NO: 3591699 - DNA, 17 bp, Homo sapiens
tcaacagagaggggcag

SEQ ID NO: 3591700 - DNA, 15 bp, Homo sapiens
gtgaactccaggcat

SEQ ID NO: 3591701 - DNA, 14 bp, Homo sapiens
gtgaactctggtgc

SEQ ID NO: 3591702 - DNA, 16 bp, Homo sapiens
gtgaacttgactgggt

SEQ ID NO: 3591703 - DNA, 12 bp, Homo sapiens
gtgaagaaataa

SEQ ID NO: 3591704 - DNA, 16 bp, Homo sapiens
gtgaagaaataaatga

SEQ ID NO: 3591705 - DNA, 20 bp, Homo sapiens
gtgaagaaataaatgaaact

SEQ ID NO: 3591706 - DNA, 18 bp, Homo sapiens
ttctatataaaatgtatt

SEQ ID NO: 3591707 - DNA, 19 bp, Homo sapiens
ttctatataaaatgtattc

SEQ ID NO: 3591708 - DNA, 21 bp, Homo sapiens
ttctatataaaatgtattcaa

SEQ ID NO: 3591709 - DNA, 22 bp, Homo sapiens
ttctatataaaatgtattcaag

SEQ ID NO: 3591710 - DNA, 13 bp, Homo sapiens
ttctatattcctc

SEQ ID NO: 3591711 - DNA, 18 bp, Homo sapiens
ttctatctcatctgtctc

SEQ ID NO: 3591712 - DNA, 12 bp, Homo sapiens
ttctatgtgact

SEQ ID NO: 3591713 - DNA, 12 bp, Homo sapiens
ttctatgttaat

SEQ ID NO: 3591714 - DNA, 17 bp, Homo sapiens
ttctattaatcaagaga

SEQ ID NO: 3591715 - DNA, 14 bp, Homo sapiens
ttctattctccaga

SEQ ID NO: 3591716 - DNA, 11 bp, Homo sapiens
ttctatttaaa

SEQ ID NO: 3591717 - DNA, 13 bp, Homo sapiens
ttctattttacaa

SEQ ID NO: 3591718 - DNA, 14 bp, Homo sapiens
ttctcaaagtttta

SEQ ID NO: 3591719 - DNA, 23 bp, Homo sapiens
ttctcaaagttttattataaatt

SEQ ID NO: 3591720 - DNA, 22 bp, Homo sapiens
ttccctgcgagacgcacacagc

SEQ ID NO: 3591721 - DNA, 17 bp, Homo sapiens
ttccctgctttgcatct

SEQ ID NO: 3591722 - DNA, 21 bp, Homo sapiens
ttccctgctttgcatctttgt

SEQ ID NO: 3591723 - DNA, 20 bp, Homo sapiens
ttccctggaactcctggcct

SEQ ID NO: 3591724 - DNA, 23 bp, Homo sapiens
ttccctggaagctctccgagctc

SEQ ID NO: 3591725 - DNA, 12 bp, Homo sapiens
ttccctgggagg

SEQ ID NO: 3591726 - DNA, 20 bp, Homo sapiens
ttccctgggtttgggagcca

SEQ ID NO: 3591727 - DNA, 22 bp, Homo sapiens
ttccctgggtttgggagccagg

SEQ ID NO: 3591728 - DNA, 16 bp, Homo sapiens
ttccctgttctccctt

SEQ ID NO: 3591729 - DNA, 15 bp, Homo sapiens
ttcccttattcctaa

SEQ ID NO: 3591730 - DNA, 18 bp, Homo sapiens
ttccgcattctttgtaca

SEQ ID NO: 3591731 - DNA, 21 bp, Homo sapiens
ttccggggagaaacccagaga

SEQ ID NO: 3591732 - DNA, 17 bp, Homo sapiens
ttccgtaaatgtctgca

SEQ ID NO: 3591733 - DNA, 21 bp, Homo sapiens
ttcctaatggctatttttgaa

SEQ ID NO: 3591734 - DNA, 15 bp, Homo sapiens
ttcctagttttctcc

SEQ ID NO: 3591735 - DNA, 20 bp, Homo sapiens
ttcctatagctacatgttct

SEQ ID NO: 3591736 - DNA, 13 bp, Homo sapiens
ttcctatgatgga

SEQ ID NO: 3591737 - DNA, 18 bp, Homo sapiens
ttcctatgatggatggca

SEQ ID NO: 3591738 - DNA, 22 bp, Homo sapiens
ttcctcacacccctgtcccacc

SEQ ID NO: 3591739 - DNA, 23 bp, Homo sapiens
ttcctcacacccctgtcccaccc

SEQ ID NO: 3591740 - DNA, 13 bp, Homo sapiens
ttcctcacatttg

SEQ ID NO: 3591741 - DNA, 22 bp, Homo sapiens
ttcctcagttgatataaaactc

SEQ ID NO: 3591742 - DNA, 12 bp, Homo sapiens
ttcctccagcct

SEQ ID NO: 3591743 - DNA, 14 bp, Homo sapiens
ttcctccagcctcc

SEQ ID NO: 3591744 - DNA, 17 bp, Homo sapiens
ttcctccagcctcccct

SEQ ID NO: 3591745 - DNA, 19 bp, Homo sapiens
ttcctccagcctcccctcc

SEQ ID NO: 3591746 - DNA, 15 bp, Homo sapiens
ttcctccccctgcaa

SEQ ID NO: 3591747 - DNA, 14 bp, Homo sapiens
ttcctcccttctgc

SEQ ID NO: 3591748 - DNA, 16 bp, Homo sapiens
ttcctcccttctgcta

SEQ ID NO: 3591749 - DNA, 14 bp, Homo sapiens
ttcctcctcccaag

SEQ ID NO: 3591750 - DNA, 12 bp, Homo sapiens
ttcctctccact

SEQ ID NO: 3591751 - DNA, 15 bp, Homo sapiens
ttcctctccactgcc

SEQ ID NO: 3591752 - DNA, 13 bp, Homo sapiens
ttcctctgcacgc

SEQ ID NO: 3591753 - DNA, 19 bp, Homo sapiens
ttcctctgcacgctcaatg

SEQ ID NO: 3591754 - DNA, 21 bp, Homo sapiens
ttcctctgcacgctcaatgcc

SEQ ID NO: 3591755 - DNA, 17 bp, Homo sapiens
ttcctctgcagttttga

SEQ ID NO: 3591756 - DNA, 19 bp, Homo sapiens
ttcctcttccgggcagaaa

SEQ ID NO: 3591757 - DNA, 13 bp, Homo sapiens
ttcctctttgctt

SEQ ID NO: 3591758 - DNA, 18 bp, Homo sapiens
ttcctgaaatatccagga

SEQ ID NO: 3591759 - DNA, 15 bp, Homo sapiens
ttcctgaagaaccag

SEQ ID NO: 3591760 - DNA, 19 bp, Homo sapiens
ttcctgaagaaccagtccc

SEQ ID NO: 3591761 - DNA, 13 bp, Homo sapiens
ttcctgaagctgc

SEQ ID NO: 3591762 - DNA, 18 bp, Homo sapiens
ttcctgcatttgtgaaat

SEQ ID NO: 3591763 - DNA, 11 bp, Homo sapiens
ttcctgccttt

SEQ ID NO: 3591764 - DNA, 15 bp, Homo sapiens
ttcctgcctttaagc

SEQ ID NO: 3591765 - DNA, 14 bp, Homo sapiens
ttcctgctgcaccc

SEQ ID NO: 3591766 - DNA, 18 bp, Homo sapiens
ttcctgctgctgctactg

SEQ ID NO: 3591767 - DNA, 14 bp, Homo sapiens
ttcctggaaacagc

SEQ ID NO: 3591768 - DNA, 16 bp, Homo sapiens
ttcctggaaacagcat

SEQ ID NO: 3591769 - DNA, 20 bp, Homo sapiens
ttcctggaaacagcatgaat

SEQ ID NO: 3591770 - DNA, 14 bp, Homo sapiens
ttcctggcacaatg

SEQ ID NO: 3591771 - DNA, 13 bp, Homo sapiens
ttcctggcagctg

SEQ ID NO: 3591772 - DNA, 17 bp, Homo sapiens
ttcctggcagctgctgt

SEQ ID NO: 3591773 - DNA, 14 bp, Homo sapiens
ttcctggctgtaaa

SEQ ID NO: 3591774 - DNA, 20 bp, Homo sapiens
ttcctgggcacacgctgctc

SEQ ID NO: 3591775 - DNA, 17 bp, Homo sapiens
ttcctgggcctttgcaa

SEQ ID NO: 3591776 - DNA, 15 bp, Homo sapiens
ttcctggtgctcttt

SEQ ID NO: 3591777 - DNA, 16 bp, Homo sapiens
ttcctgtccagctcca

SEQ ID NO: 3591778 - DNA, 13 bp, Homo sapiens
ttcctgtctcctt

SEQ ID NO: 3591779 - DNA, 21 bp, Homo sapiens
ttcctgtgtgtccaaaactgc

SEQ ID NO: 3591780 - DNA, 22 bp, Homo sapiens
ttcctgtgtgtccaaaactgcc

SEQ ID NO: 3591781 - DNA, 17 bp, Homo sapiens
ttcctgttgtcaagaat

SEQ ID NO: 3591782 - DNA, 12 bp, Homo sapiens
ttccttaagtat

SEQ ID NO: 3591783 - DNA, 20 bp, Homo sapiens
ttccttaagtatatcatgta

SEQ ID NO: 3591784 - DNA, 18 bp, Homo sapiens
ttccttatccctctcttc

SEQ ID NO: 3591785 - DNA, 19 bp, Homo sapiens
ttccttatccctctcttcc

SEQ ID NO: 3591786 - DNA, 21 bp, Homo sapiens
ttccttatccctctcttcccc

SEQ ID NO: 3591787 - DNA, 23 bp, Homo sapiens
ttccttatccctctcttcccctt

SEQ ID NO: 3591788 - DNA, 21 bp, Homo sapiens
ttccttatgtatcagtgtcct

SEQ ID NO: 3591789 - DNA, 22 bp, Homo sapiens
ttccttatgtatcagtgtcctt

SEQ ID NO: 3591790 - DNA, 23 bp, Homo sapiens
ttccttatgtatcagtgtccttt

SEQ ID NO: 3591791 - DNA, 14 bp, Homo sapiens
ttccttcaggcagc

SEQ ID NO: 3591792 - DNA, 13 bp, Homo sapiens
ttccttgtcccgt

SEQ ID NO: 3591793 - DNA, 18 bp, Homo sapiens
ttcctttacaactaaata

SEQ ID NO: 3591794 - DNA, 20 bp, Homo sapiens
ttcctttacaactaaataac

SEQ ID NO: 3591795 - DNA, 21 bp, Homo sapiens
ttccttttaaaacacttccat

SEQ ID NO: 3591796 - DNA, 13 bp, Homo sapiens
ttccttttcactg

SEQ ID NO: 3591797 - DNA, 16 bp, Homo sapiens
ttccttttcaggagat

SEQ ID NO: 3591798 - DNA, 23 bp, Homo sapiens
ttccttttgaacgccccccccca

SEQ ID NO: 3591799 - DNA, 17 bp, Homo sapiens
ttcctttttcttcgctg

SEQ ID NO: 3591800 - DNA, 15 bp, Homo sapiens
ttccttttttcaata

SEQ ID NO: 3591801 - DNA, 20 bp, Homo sapiens
ttcgactggtccagctctga

SEQ ID NO: 3591802 - DNA, 16 bp, Homo sapiens
ttcgagaccagcctgg

SEQ ID NO: 3591803 - DNA, 23 bp, Homo sapiens
ttcgcgctggaatccagaaggaa

SEQ ID NO: 3591804 - DNA, 16 bp, Homo sapiens
ttcgctggactattgt

SEQ ID NO: 3591805 - DNA, 20 bp, Homo sapiens
ttcgctggactattgtgcca

SEQ ID NO: 3591806 - DNA, 11 bp, Homo sapiens
ttcggcagcct

SEQ ID NO: 3591807 - DNA, 12 bp, Homo sapiens
ttcggcagcctt

SEQ ID NO: 3591808 - DNA, 17 bp, Homo sapiens
ttcggccccatgtatct

SEQ ID NO: 3591809 - DNA, 18 bp, Homo sapiens
ttcggccccatgtatctc

SEQ ID NO: 3591810 - DNA, 12 bp, Homo sapiens
ttcgggctgtgc

SEQ ID NO: 3591811 - DNA, 19 bp, Homo sapiens
ttcggggtgatcctgttct

SEQ ID NO: 3591812 - DNA, 19 bp, Homo sapiens
ttcgtacataataagtttc

SEQ ID NO: 3591813 - DNA, 13 bp, Homo sapiens
ttcgtgagctggg

SEQ ID NO: 3591814 - DNA, 18 bp, Homo sapiens
ttcgtgagctggggactc

SEQ ID NO: 3591815 - DNA, 23 bp, Homo sapiens
ttcgtgatgacatatcacatgtc

SEQ ID NO: 3591816 - DNA, 23 bp, Homo sapiens
ttcgttaagaatttggggcagga

SEQ ID NO: 3591817 - DNA, 16 bp, Homo sapiens
ttctaaaacaataaag

SEQ ID NO: 3591818 - DNA, 18 bp, Homo sapiens
ttctaacatgaaatatat

SEQ ID NO: 3591819 - DNA, 20 bp, Homo sapiens
ttctaagcaaccacactgct

SEQ ID NO: 3591820 - DNA, 17 bp, Homo sapiens
ttctaatacaagcatat

SEQ ID NO: 3591821 - DNA, 20 bp, Homo sapiens
ttctaatgttattttccttc

SEQ ID NO: 3591822 - DNA, 23 bp, Homo sapiens
ttctaatgttattttccttctga

SEQ ID NO: 3591823 - DNA, 20 bp, Homo sapiens
ttctaattggctttactatt

SEQ ID NO: 3591824 - DNA, 20 bp, Homo sapiens
ttctacattcagattatatg

SEQ ID NO: 3591825 - DNA, 18 bp, Homo sapiens
ttctaccatttcagagag

SEQ ID NO: 3591826 - DNA, 13 bp, Homo sapiens
ttctactgctctc

SEQ ID NO: 3591827 - DNA, 19 bp, Homo sapiens
ttctagaaagagaaacagt

SEQ ID NO: 3591828 - DNA, 19 bp, Homo sapiens
ttctaggcatacttttcaa

SEQ ID NO: 3591829 - DNA, 13 bp, Homo sapiens
ttctaggcctttc

SEQ ID NO: 3591830 - DNA, 15 bp, Homo sapiens
ttctagggtccctga

SEQ ID NO: 3591831 - DNA, 23 bp, Homo sapiens
ttctagggtccctgaacgccctg

SEQ ID NO: 3591832 - DNA, 18 bp, Homo sapiens
ttctagtacctgtgactc

SEQ ID NO: 3591833 - DNA, 11 bp, Homo sapiens
ttctagttcaa

SEQ ID NO: 3591834 - DNA, 20 bp, Homo sapiens
ttctagttgcccccattccc

SEQ ID NO: 3591835 - DNA, 14 bp, Homo sapiens
aattacacccaaag

SEQ ID NO: 3591836 - DNA, 12 bp, Homo sapiens
aattacatgttt

SEQ ID NO: 3591837 - DNA, 12 bp, Homo sapiens
aattagcaattg

SEQ ID NO: 3591838 - DNA, 14 bp, Homo sapiens
aattagctgggcgt

SEQ ID NO: 3591839 - DNA, 21 bp, Homo sapiens
aattaggcagtgctaaagcct

SEQ ID NO: 3591840 - DNA, 16 bp, Homo sapiens
aattaggctgtaacta

SEQ ID NO: 3591841 - DNA, 13 bp, Homo sapiens
aattagtatttca

SEQ ID NO: 3591842 - DNA, 16 bp, Homo sapiens
aattataactattaca

SEQ ID NO: 3591843 - DNA, 18 bp, Homo sapiens
aattataactattacagt

SEQ ID NO: 3591844 - DNA, 13 bp, Homo sapiens
aattatatgatat

SEQ ID NO: 3591845 - DNA, 18 bp, Homo sapiens
aattatatgatatgcatg

SEQ ID NO: 3591846 - DNA, 23 bp, Homo sapiens
aattatattttgttgctttctta

SEQ ID NO: 3591847 - DNA, 15 bp, Homo sapiens
aattatctatagcta

SEQ ID NO: 3591848 - DNA, 22 bp, Homo sapiens
aattatctatagctaagtacac

SEQ ID NO: 3591849 - DNA, 23 bp, Homo sapiens
aattatctatagctaagtacaca

SEQ ID NO: 3591850 - DNA, 19 bp, Homo sapiens
aattatctcaagtaaaaca

SEQ ID NO: 3591851 - DNA, 21 bp, Homo sapiens
aattatctcaagtaaaacaaa

SEQ ID NO: 3591852 - DNA, 19 bp, Homo sapiens
aattatgagttatttttat

SEQ ID NO: 3591853 - DNA, 15 bp, Homo sapiens
aattatgtgacattt

SEQ ID NO: 3591854 - DNA, 12 bp, Homo sapiens
aattatgtgcaa

SEQ ID NO: 3591855 - DNA, 16 bp, Homo sapiens
aattattactttaaat

SEQ ID NO: 3591856 - DNA, 20 bp, Homo sapiens
aattattatttatttttgcc

SEQ ID NO: 3591857 - DNA, 17 bp, Homo sapiens
aattattgatgttttca

SEQ ID NO: 3591858 - DNA, 14 bp, Homo sapiens
aattatttgattat

SEQ ID NO: 3591859 - DNA, 17 bp, Homo sapiens
aattcaccacagacttt

SEQ ID NO: 3591860 - DNA, 23 bp, Homo sapiens
aattcaccagtgttcctgaagct

SEQ ID NO: 3591861 - DNA, 13 bp, Homo sapiens
aattcaccttccc

SEQ ID NO: 3591862 - DNA, 15 bp, Homo sapiens
aattcaggtctgtat

SEQ ID NO: 3591863 - DNA, 22 bp, Homo sapiens
aattcaggtctgtatgtcatgg

SEQ ID NO: 3591864 - DNA, 21 bp, Homo sapiens
aattcaggtgctagaagccta

SEQ ID NO: 3591865 - DNA, 22 bp, Homo sapiens
aattcatttgcttgcaatctaa

SEQ ID NO: 3591866 - DNA, 15 bp, Homo sapiens
aattccaaaatccaa

SEQ ID NO: 3591867 - DNA, 17 bp, Homo sapiens
aattcctttacaactaa

SEQ ID NO: 3591868 - DNA, 21 bp, Homo sapiens
aattctacctccttgtgttgc

SEQ ID NO: 3591869 - DNA, 17 bp, Homo sapiens
aattctactaagttatt

SEQ ID NO: 3591870 - DNA, 18 bp, Homo sapiens
aattctactaagttattt

SEQ ID NO: 3591871 - DNA, 16 bp, Homo sapiens
aattctcaaagtttta

SEQ ID NO: 3591872 - DNA, 15 bp, Homo sapiens
aattctgtttaattt

SEQ ID NO: 3591873 - DNA, 18 bp, Homo sapiens
aattcttaccctgtacat

SEQ ID NO: 3591874 - DNA, 13 bp, Homo sapiens
aattctttcaagt

SEQ ID NO: 3591875 - DNA, 23 bp, Homo sapiens
aattcttttatctttattttagt

SEQ ID NO: 3591876 - DNA, 17 bp, Homo sapiens
aattgaagcatgaacgt

SEQ ID NO: 3591877 - DNA, 17 bp, Homo sapiens
aattgaattggaaagac

SEQ ID NO: 3591878 - DNA, 21 bp, Homo sapiens
aattgaccctagccagagaat

SEQ ID NO: 3591879 - DNA, 19 bp, Homo sapiens
aattgacctgatttccatt

SEQ ID NO: 3591880 - DNA, 21 bp, Homo sapiens
aattgactgatgattttcctt

SEQ ID NO: 3591881 - DNA, 23 bp, Homo sapiens
aattgagaaaaatatatactaaa

SEQ ID NO: 3591882 - DNA, 19 bp, Homo sapiens
aattgaggaaaaactgaca

SEQ ID NO: 3591883 - DNA, 16 bp, Homo sapiens
aattgatctgttttgg

SEQ ID NO: 3591884 - DNA, 21 bp, Homo sapiens
aattgatctgttttggatgtt

SEQ ID NO: 3591885 - DNA, 21 bp, Homo sapiens
aattgattaacttatactgta

SEQ ID NO: 3591886 - DNA, 14 bp, Homo sapiens
aattgcaatatata

SEQ ID NO: 3591887 - DNA, 15 bp, Homo sapiens
aattgcactgaagtt

SEQ ID NO: 3591888 - DNA, 20 bp, Homo sapiens
aattggaagctgccctgccc

SEQ ID NO: 3591889 - DNA, 11 bp, Homo sapiens
aattggatttc

SEQ ID NO: 3591890 - DNA, 15 bp, Homo sapiens
aattggatttcctaa

SEQ ID NO: 3591891 - DNA, 17 bp, Homo sapiens
aattggatttcctaata

SEQ ID NO: 3591892 - DNA, 12 bp, Homo sapiens
aattgtacaata

SEQ ID NO: 3591893 - DNA, 14 bp, Homo sapiens
aattgtacaataaa

SEQ ID NO: 3591894 - DNA, 15 bp, Homo sapiens
aattgtacaataaat

SEQ ID NO: 3591895 - DNA, 15 bp, Homo sapiens
aattgtgatgtgtcc

SEQ ID NO: 3591896 - DNA, 18 bp, Homo sapiens
aattgtttatatggataa

SEQ ID NO: 3591897 - DNA, 20 bp, Homo sapiens
aattgtttttattgttttct

SEQ ID NO: 3591898 - DNA, 14 bp, Homo sapiens
aatttaaaaatata

SEQ ID NO: 3591899 - DNA, 15 bp, Homo sapiens
aatttaaaaatatat

SEQ ID NO: 3591900 - DNA, 17 bp, Homo sapiens
aatttaaaaatatattt

SEQ ID NO: 3591901 - DNA, 12 bp, Homo sapiens
aatttaaactgt

SEQ ID NO: 3591902 - DNA, 24 bp, Homo sapiens
aatttaaatagcattatcttatca

SEQ ID NO: 3591903 - DNA, 13 bp, Homo sapiens
aatttaaatgtta

SEQ ID NO: 3591904 - DNA, 13 bp, Homo sapiens
aatttaacagtat

SEQ ID NO: 3591905 - DNA, 21 bp, Homo sapiens
aatttaatccttctttgtaat

SEQ ID NO: 3591906 - DNA, 14 bp, Homo sapiens
aatttaattacaaa

SEQ ID NO: 3591907 - DNA, 12 bp, Homo sapiens
aatttaattttt

SEQ ID NO: 3591908 - DNA, 17 bp, Homo sapiens
aatttaatttttccttt

SEQ ID NO: 3591909 - DNA, 16 bp, Homo sapiens
aatttaccatcatctc

SEQ ID NO: 3591910 - DNA, 20 bp, Homo sapiens
aatttacctttttttagtta

SEQ ID NO: 3591911 - DNA, 13 bp, Homo sapiens
aatttataatgta

SEQ ID NO: 3591912 - DNA, 14 bp, Homo sapiens
aatttataatgtat

SEQ ID NO: 3591913 - DNA, 16 bp, Homo sapiens
aatttataatgtattt

SEQ ID NO: 3591914 - DNA, 19 bp, Homo sapiens
aatttatacaccagcaatt

SEQ ID NO: 3591915 - DNA, 14 bp, Homo sapiens
aatttatttcaata

SEQ ID NO: 3591916 - DNA, 20 bp, Homo sapiens
aatttatttcaataaatctt

SEQ ID NO: 3591917 - DNA, 20 bp, Homo sapiens
aatttatttttaagaaagaa

SEQ ID NO: 3591918 - DNA, 18 bp, Homo sapiens
aatttcagctttggctct

SEQ ID NO: 3591919 - DNA, 22 bp, Homo sapiens
aatttcaggattaactaaagaa

SEQ ID NO: 3591920 - DNA, 16 bp, Homo sapiens
aatttcccaggaccct

SEQ ID NO: 3591921 - DNA, 17 bp, Homo sapiens
aatttctgggatattta

SEQ ID NO: 3591922 - DNA, 20 bp, Homo sapiens
aatttcttaacttcttgctt

SEQ ID NO: 3591923 - DNA, 12 bp, Homo sapiens
aatttgataaac

SEQ ID NO: 3591924 - DNA, 17 bp, Homo sapiens
aatttgccagaggacca

SEQ ID NO: 3591925 - DNA, 14 bp, Homo sapiens
aatttgcgcctcgg

SEQ ID NO: 3591926 - DNA, 15 bp, Homo sapiens
aatttggctttcaca

SEQ ID NO: 3591927 - DNA, 18 bp, Homo sapiens
aatttgggggaaaattta

SEQ ID NO: 3591928 - DNA, 20 bp, Homo sapiens
aatttgtcttaaaaatttat

SEQ ID NO: 3591929 - DNA, 18 bp, Homo sapiens
aatttgttatacttcaaa

SEQ ID NO: 3591930 - DNA, 12 bp, Homo sapiens
aatttgttcttt

SEQ ID NO: 3591931 - DNA, 22 bp, Homo sapiens
aatttgttttgctgagagcata

SEQ ID NO: 3591932 - DNA, 15 bp, Homo sapiens
aattttaaaaagcag

SEQ ID NO: 3591933 - DNA, 13 bp, Homo sapiens
aattttaactgta

SEQ ID NO: 3591934 - DNA, 21 bp, Homo sapiens
aattttacactctgtattgaa

SEQ ID NO: 3591935 - DNA, 19 bp, Homo sapiens
aattttatgagggccacgg

SEQ ID NO: 3591936 - DNA, 20 bp, Homo sapiens
aattttcctttaatatgaaa

SEQ ID NO: 3591937 - DNA, 20 bp, Homo sapiens
aattttgaagtgctgtttat

SEQ ID NO: 3591938 - DNA, 11 bp, Homo sapiens
aattttgcaaa

SEQ ID NO: 3591939 - DNA, 14 bp, Homo sapiens
aattttgcaaatta

SEQ ID NO: 3591940 - DNA, 21 bp, Homo sapiens
aattttgccaaaatcctgaac

SEQ ID NO: 3591941 - DNA, 12 bp, Homo sapiens
aattttgctaac

SEQ ID NO: 3591942 - DNA, 15 bp, Homo sapiens
aattttgctaactgg

SEQ ID NO: 3591943 - DNA, 16 bp, Homo sapiens
aattttgctaactggg

SEQ ID NO: 3591944 - DNA, 15 bp, Homo sapiens
aattttgtaacgaag

SEQ ID NO: 3591945 - DNA, 18 bp, Homo sapiens
aattttgtaatgtatcaa

SEQ ID NO: 3591946 - DNA, 22 bp, Homo sapiens
aattttgtgtaagaaatacaga

SEQ ID NO: 3591947 - DNA, 19 bp, Homo sapiens
aatttttaaaaatacactt

SEQ ID NO: 3591948 - DNA, 17 bp, Homo sapiens
aatttttacctttatct

SEQ ID NO: 3591949 - DNA, 16 bp, Homo sapiens
aatttttaggcaaaga

SEQ ID NO: 3591950 - DNA, 14 bp, Homo sapiens
aatttttccaacta

SEQ ID NO: 3591951 - DNA, 13 bp, Homo sapiens
aatttttgctgaa

SEQ ID NO: 3591952 - DNA, 21 bp, Homo sapiens
aattttttaagtgaaaatata

SEQ ID NO: 3591953 - DNA, 22 bp, Homo sapiens
aattttttgaaacacaatacct

SEQ ID NO: 3591954 - DNA, 12 bp, Homo sapiens
aattttttttac

SEQ ID NO: 3591955 - DNA, 16 bp, Homo sapiens
aattttttttacattt

SEQ ID NO: 3591956 - DNA, 20 bp, Homo sapiens
aattttttttcatgctttat

SEQ ID NO: 3591957 - DNA, 16 bp, Homo sapiens
aattttttttccgtaa

SEQ ID NO: 3591958 - DNA, 16 bp, Homo sapiens
acaaaaaaaattttag

SEQ ID NO: 3591959 - DNA, 14 bp, Homo sapiens
acaaaaacacagca

SEQ ID NO: 3591960 - DNA, 18 bp, Homo sapiens
acaaaaagaaaagaaaat

SEQ ID NO: 3591961 - DNA, 15 bp, Homo sapiens
acaaaacaaaacaaa

SEQ ID NO: 3591962 - DNA, 15 bp, Homo sapiens
acaaaacaaacaaac

SEQ ID NO: 3591963 - DNA, 12 bp, Homo sapiens
acaaaagaaaaa

SEQ ID NO: 3591964 - DNA, 20 bp, Homo sapiens
acaaaagaaaagacttgtaa

SEQ ID NO: 3591965 - DNA, 13 bp, Homo sapiens
acaaaagagcagt

SEQ ID NO: 3591966 - DNA, 11 bp, Homo sapiens
acaaaagcaat

SEQ ID NO: 3591967 - DNA, 17 bp, Homo sapiens
acaaaagctttttaaaa

SEQ ID NO: 3591968 - DNA, 20 bp, Homo sapiens
accctgccccccctaagaga

SEQ ID NO: 3591969 - DNA, 17 bp, Homo sapiens
accctgcgcctccagag

SEQ ID NO: 3591970 - DNA, 19 bp, Homo sapiens
accctgcgcctccagaggt

SEQ ID NO: 3591971 - DNA, 14 bp, Homo sapiens
accctggcagggac

SEQ ID NO: 3591972 - DNA, 20 bp, Homo sapiens
accctggcagggacctgaga

SEQ ID NO: 3591973 - DNA, 15 bp, Homo sapiens
accctggtctgtgga

SEQ ID NO: 3591974 - DNA, 15 bp, Homo sapiens
accctggtgggccaa

SEQ ID NO: 3591975 - DNA, 19 bp, Homo sapiens
accctgtacatatgtaaac

SEQ ID NO: 3591976 - DNA, 15 bp, Homo sapiens
accctgtcctgcagt

SEQ ID NO: 3591977 - DNA, 19 bp, Homo sapiens
accctgtcctgcagtccca

SEQ ID NO: 3591978 - DNA, 14 bp, Homo sapiens
acccttaactgaca

SEQ ID NO: 3591979 - DNA, 18 bp, Homo sapiens
acccttacagcctctgac

SEQ ID NO: 3591980 - DNA, 11 bp, Homo sapiens
acccttgacac

SEQ ID NO: 3591981 - DNA, 15 bp, Homo sapiens
acccttttccatttt

SEQ ID NO: 3591982 - DNA, 17 bp, Homo sapiens
acccttttcccccttcc

SEQ ID NO: 3591983 - DNA, 19 bp, Homo sapiens
acccttttcccccttccca

SEQ ID NO: 3591984 - DNA, 21 bp, Homo sapiens
accgaactgggcatatttcta

SEQ ID NO: 3591985 - DNA, 21 bp, Homo sapiens
accgagtctcttctccactgg

SEQ ID NO: 3591986 - DNA, 19 bp, Homo sapiens
accgcaggtgctcatgctg

SEQ ID NO: 3591987 - DNA, 17 bp, Homo sapiens
accgccacgtcccagca

SEQ ID NO: 3591988 - DNA, 17 bp, Homo sapiens
accgcttctgccttttc

SEQ ID NO: 3591989 - DNA, 23 bp, Homo sapiens
accggaaggaggccaaccagccc

SEQ ID NO: 3591990 - DNA, 21 bp, Homo sapiens
accgggctgggagctctgcag

SEQ ID NO: 3591991 - DNA, 13 bp, Homo sapiens
accggtgggcagt

SEQ ID NO: 3591992 - DNA, 16 bp, Homo sapiens
accggtgggcagtggg

SEQ ID NO: 3591993 - DNA, 12 bp, Homo sapiens
accgtccagggg

SEQ ID NO: 3591994 - DNA, 15 bp, Homo sapiens
accgtgcccacgagg

SEQ ID NO: 3591995 - DNA, 21 bp, Homo sapiens
accgtggcagcttgctgggct

SEQ ID NO: 3591996 - DNA, 21 bp, Homo sapiens
acctaacacattaaatgtgga

SEQ ID NO: 3591997 - DNA, 21 bp, Homo sapiens
acctaagattacaaatcagaa

SEQ ID NO: 3591998 - DNA, 21 bp, Homo sapiens
acctaatccaggcagatccag

SEQ ID NO: 3591999 - DNA, 15 bp, Homo sapiens
acctacaataaactg

SEQ ID NO: 3592000 - DNA, 16 bp, Homo sapiens
acctacaataaactgg

SEQ ID NO: 3592001 - DNA, 19 bp, Homo sapiens
acctacagactccatctct

SEQ ID NO: 3592002 - DNA, 15 bp, Homo sapiens
acctaccccagccag

SEQ ID NO: 3592003 - DNA, 16 bp, Homo sapiens
acctacctgccttgga

SEQ ID NO: 3592004 - DNA, 23 bp, Homo sapiens
acctagcacacctgaatcagctg

SEQ ID NO: 3592005 - DNA, 14 bp, Homo sapiens
acctagcagcctca

SEQ ID NO: 3592006 - DNA, 16 bp, Homo sapiens
acctagctaattattt

SEQ ID NO: 3592007 - DNA, 19 bp, Homo sapiens
acctatccttacatttcac

SEQ ID NO: 3592008 - DNA, 20 bp, Homo sapiens
acctcaaactatctggccat

SEQ ID NO: 3592009 - DNA, 16 bp, Homo sapiens
acctcaaccaatgcca

SEQ ID NO: 3592010 - DNA, 14 bp, Homo sapiens
acctcaagccccat

SEQ ID NO: 3592011 - DNA, 19 bp, Homo sapiens
acctcaagccccatttcct

SEQ ID NO: 3592012 - DNA, 12 bp, Homo sapiens
acctcacagcta

SEQ ID NO: 3592013 - DNA, 17 bp, Homo sapiens
acctcactggcctgcca

SEQ ID NO: 3592014 - DNA, 20 bp, Homo sapiens
acctcactggcctgccatgc

SEQ ID NO: 3592015 - DNA, 13 bp, Homo sapiens
acctcagcctggc

SEQ ID NO: 3592016 - DNA, 14 bp, Homo sapiens
acctcagcctggcc

SEQ ID NO: 3592017 - DNA, 12 bp, Homo sapiens
acctcaggctcc

SEQ ID NO: 3592018 - DNA, 13 bp, Homo sapiens
acctcaggctcct

SEQ ID NO: 3592019 - DNA, 14 bp, Homo sapiens
acctcaggctccta

SEQ ID NO: 3592020 - DNA, 13 bp, Homo sapiens
acctcagttttat

SEQ ID NO: 3592021 - DNA, 18 bp, Homo sapiens
acctcagttttatgcccc

SEQ ID NO: 3592022 - DNA, 17 bp, Homo sapiens
acctccaagcatttcat

SEQ ID NO: 3592023 - DNA, 18 bp, Homo sapiens
acctccaagcatttcatg

SEQ ID NO: 3592024 - DNA, 14 bp, Homo sapiens
acctccacacccac

SEQ ID NO: 3592025 - DNA, 13 bp, Homo sapiens
acctccagaagtc

SEQ ID NO: 3592026 - DNA, 16 bp, Homo sapiens
acctccagaagtccct

SEQ ID NO: 3592027 - DNA, 17 bp, Homo sapiens
acctccagaagtccctt

SEQ ID NO: 3592028 - DNA, 11 bp, Homo sapiens
acctccagact

SEQ ID NO: 3592029 - DNA, 15 bp, Homo sapiens
acctccagcctccct

SEQ ID NO: 3592030 - DNA, 21 bp, Homo sapiens
acctccattctattttagaat

SEQ ID NO: 3592031 - DNA, 11 bp, Homo sapiens
acctccccctt

SEQ ID NO: 3592032 - DNA, 15 bp, Homo sapiens
acctcccccttcccc

SEQ ID NO: 3592033 - DNA, 14 bp, Homo sapiens
acctccctgcctcc

SEQ ID NO: 3592034 - DNA, 14 bp, Homo sapiens
acctccgcccctgc

SEQ ID NO: 3592035 - DNA, 14 bp, Homo sapiens
acctcctaccctcc

SEQ ID NO: 3592036 - DNA, 21 bp, Homo sapiens
acctcctctgtgatttctttc

SEQ ID NO: 3592037 - DNA, 21 bp, Homo sapiens
acctcgctgttgtcacatctc

SEQ ID NO: 3592038 - DNA, 23 bp, Homo sapiens
acctcggagggatggagaaagaa

SEQ ID NO: 3592039 - DNA, 16 bp, Homo sapiens
acctcggcacacactg

SEQ ID NO: 3592040 - DNA, 17 bp, Homo sapiens
acctcggcacacactgt

SEQ ID NO: 3592041 - DNA, 14 bp, Homo sapiens
acctcgtcaagagc

SEQ ID NO: 3592042 - DNA, 17 bp, Homo sapiens
acctctaagtgctgctg

SEQ ID NO: 3592043 - DNA, 13 bp, Homo sapiens
acctctcccaggg

SEQ ID NO: 3592044 - DNA, 22 bp, Homo sapiens
acctctcccccaaggccactgc

SEQ ID NO: 3592045 - DNA, 15 bp, Homo sapiens
acctctcctgacccc

SEQ ID NO: 3592046 - DNA, 16 bp, Homo sapiens
acctctcctgccctgt

SEQ ID NO: 3592047 - DNA, 15 bp, Homo sapiens
acctctgacaactgt

SEQ ID NO: 3592048 - DNA, 18 bp, Homo sapiens
acctctgtctgagacagg

SEQ ID NO: 3592049 - DNA, 19 bp, Homo sapiens
acctctgtctgagacaggt

SEQ ID NO: 3592050 - DNA, 11 bp, Homo sapiens
acctctgtgcc

SEQ ID NO: 3592051 - DNA, 21 bp, Homo sapiens
acctcttaaagaaaacccacc

SEQ ID NO: 3592052 - DNA, 19 bp, Homo sapiens
acctgaatcagctggacat

SEQ ID NO: 3592053 - DNA, 19 bp, Homo sapiens
acctgacacaccaggcgct

SEQ ID NO: 3592054 - DNA, 22 bp, Homo sapiens
acctgactcaattatttgcata

SEQ ID NO: 3592055 - DNA, 18 bp, Homo sapiens
acctgagcggcaccctgg

SEQ ID NO: 3592056 - DNA, 21 bp, Homo sapiens
acctgagcggcaccctggtct

SEQ ID NO: 3592057 - DNA, 13 bp, Homo sapiens
acctgatcctgga

SEQ ID NO: 3592058 - DNA, 14 bp, Homo sapiens
acctgattgtattt

SEQ ID NO: 3592059 - DNA, 22 bp, Homo sapiens
acctgcaaagatctgtcctcag

SEQ ID NO: 3592060 - DNA, 14 bp, Homo sapiens
acctgcaggaccct

SEQ ID NO: 3592061 - DNA, 16 bp, Homo sapiens
acctgccaaggagcat

SEQ ID NO: 3592062 - DNA, 11 bp, Homo sapiens
acctgcccctg

SEQ ID NO: 3592063 - DNA, 16 bp, Homo sapiens
acctgctcagccctgc

SEQ ID NO: 3592064 - DNA, 14 bp, Homo sapiens
acctgctccagaag

SEQ ID NO: 3592065 - DNA, 18 bp, Homo sapiens
acctgctctcctcttgcc

SEQ ID NO: 3592066 - DNA, 15 bp, Homo sapiens
acctgcttttcaatg

SEQ ID NO: 3592067 - DNA, 18 bp, Homo sapiens
acctggaacttggggagt

SEQ ID NO: 3592068 - DNA, 22 bp, Homo sapiens
acctggacttaagcatctggct

SEQ ID NO: 3592069 - DNA, 14 bp, Homo sapiens
acctggagaagtag

SEQ ID NO: 3592070 - DNA, 18 bp, Homo sapiens
acctggagcttcagccag

SEQ ID NO: 3592071 - DNA, 23 bp, Homo sapiens
acctggagcttcagccaggtctg

SEQ ID NO: 3592072 - DNA, 17 bp, Homo sapiens
acctggatccagcactg

SEQ ID NO: 3592073 - DNA, 13 bp, Homo sapiens
acctggatgtact

SEQ ID NO: 3592074 - DNA, 21 bp, Homo sapiens
acctggattgcgcctaatgtg

SEQ ID NO: 3592075 - DNA, 22 bp, Homo sapiens
acctggattgtgcctaatgtgt

SEQ ID NO: 3592076 - DNA, 15 bp, Homo sapiens
acctggcaaaggacc

SEQ ID NO: 3592077 - DNA, 13 bp, Homo sapiens
acctggcctagaa

SEQ ID NO: 3592078 - DNA, 17 bp, Homo sapiens
acctggcctagaaaggg

SEQ ID NO: 3592079 - DNA, 15 bp, Homo sapiens
acctggctgccaaca

SEQ ID NO: 3592080 - DNA, 14 bp, Homo sapiens
acctgggaacacag

SEQ ID NO: 3592081 - DNA, 19 bp, Homo sapiens
acctgggaaggccagcctt

SEQ ID NO: 3592082 - DNA, 18 bp, Homo sapiens
acctggggtgaatactta

SEQ ID NO: 3592083 - DNA, 21 bp, Homo sapiens
acctggtcacaggactctgcc

SEQ ID NO: 3592084 - DNA, 23 bp, Homo sapiens
acctggtccccactgctgagctg

SEQ ID NO: 3592085 - DNA, 21 bp, Homo sapiens
acctggtcgccaatccatgct

SEQ ID NO: 3592086 - DNA, 15 bp, Homo sapiens
acctgtcctctttgt

SEQ ID NO: 3592087 - DNA, 14 bp, Homo sapiens
acctgtcctgtctt

SEQ ID NO: 3592088 - DNA, 17 bp, Homo sapiens
acctgtcctgtctttga

SEQ ID NO: 3592089 - DNA, 14 bp, Homo sapiens
acctgtctgctgcc

SEQ ID NO: 3592090 - DNA, 21 bp, Homo sapiens
acctgtctgctgccagcacag

SEQ ID NO: 3592091 - DNA, 23 bp, Homo sapiens
acctgtggaacataaaaaggaca

SEQ ID NO: 3592092 - DNA, 16 bp, Homo sapiens
acctgtgtgagagaat

SEQ ID NO: 3592093 - DNA, 19 bp, Homo sapiens
acctgtgtgagagaattta

SEQ ID NO: 3592094 - DNA, 17 bp, Homo sapiens
acctgttcttagagtgt

SEQ ID NO: 3592095 - DNA, 22 bp, Homo sapiens
acctgtttcccgggcaatttaa

SEQ ID NO: 3592096 - DNA, 13 bp, Homo sapiens
accttaaaagtaa

SEQ ID NO: 3592097 - DNA, 19 bp, Homo sapiens
accttaaaagtaataaaga

SEQ ID NO: 3592098 - DNA, 21 bp, Homo sapiens
accttaaaagtaataaagaga

SEQ ID NO: 3592099 - DNA, 18 bp, Homo sapiens
accttaatgacaacactt

SEQ ID NO: 3592100 - DNA, 22 bp, Homo sapiens
accttagctggcattacagctg

SEQ ID NO: 3592101 - DNA, 16 bp, Homo sapiens
agaaaatttttgtagt

SEQ ID NO: 3592102 - DNA, 14 bp, Homo sapiens
agaaacaagctgtg

SEQ ID NO: 3592103 - DNA, 17 bp, Homo sapiens
agaaacagagtggcctc

SEQ ID NO: 3592104 - DNA, 17 bp, Homo sapiens
agaaacagctcagccag

SEQ ID NO: 3592105 - DNA, 19 bp, Homo sapiens
agaaacagtttcttgcttg

SEQ ID NO: 3592106 - DNA, 15 bp, Homo sapiens
agaaaccaacaagaa

SEQ ID NO: 3592107 - DNA, 21 bp, Homo sapiens
agaaacccagagatgcctgat

SEQ ID NO: 3592108 - DNA, 17 bp, Homo sapiens
agaaactacaaatatag

SEQ ID NO: 3592109 - DNA, 13 bp, Homo sapiens
agaaactgaggaa

SEQ ID NO: 3592110 - DNA, 18 bp, Homo sapiens
agaaactgaggaattttc

SEQ ID NO: 3592111 - DNA, 17 bp, Homo sapiens
agaaactgaggcccaga

SEQ ID NO: 3592112 - DNA, 14 bp, Homo sapiens
agaaactgatgcca

SEQ ID NO: 3592113 - DNA, 15 bp, Homo sapiens
agaaactgttcccac

SEQ ID NO: 3592114 - DNA, 12 bp, Homo sapiens
agaaacttttct

SEQ ID NO: 3592115 - DNA, 15 bp, Homo sapiens
agaaacttttttatt

SEQ ID NO: 3592116 - DNA, 19 bp, Homo sapiens
agaaagactattcaaacag

SEQ ID NO: 3592117 - DNA, 17 bp, Homo sapiens
agaaagagaaacagttg

SEQ ID NO: 3592118 - DNA, 17 bp, Homo sapiens
agaaagagctgcctgga

SEQ ID NO: 3592119 - DNA, 14 bp, Homo sapiens
agaaagaggcaggg

SEQ ID NO: 3592120 - DNA, 15 bp, Homo sapiens
agaaagcaaaataca

SEQ ID NO: 3592121 - DNA, 15 bp, Homo sapiens
agaaagcaaaggtgc

SEQ ID NO: 3592122 - DNA, 23 bp, Homo sapiens
agaaagcaaaggtgcactccaga

SEQ ID NO: 3592123 - DNA, 18 bp, Homo sapiens
agaaagcatatcccacca

SEQ ID NO: 3592124 - DNA, 16 bp, Homo sapiens
agaaagcctcctgccc

SEQ ID NO: 3592125 - DNA, 23 bp, Homo sapiens
agaaagcctcctgccccctgcca

SEQ ID NO: 3592126 - DNA, 18 bp, Homo sapiens
agaaagcctgggtgacat

SEQ ID NO: 3592127 - DNA, 15 bp, Homo sapiens
agaaagcttcatcca

SEQ ID NO: 3592128 - DNA, 21 bp, Homo sapiens
agaaagcttcatccacagcct

SEQ ID NO: 3592129 - DNA, 16 bp, Homo sapiens
agaaagggattgctga

SEQ ID NO: 3592130 - DNA, 13 bp, Homo sapiens
agaaagggcaagg

SEQ ID NO: 3592131 - DNA, 14 bp, Homo sapiens
agaaaggggagccc

SEQ ID NO: 3592132 - DNA, 15 bp, Homo sapiens
agaaaggggagccca

SEQ ID NO: 3592133 - DNA, 17 bp, Homo sapiens
agaaaggggagcccact

SEQ ID NO: 3592134 - DNA, 22 bp, Homo sapiens
agaaaggtgtgaggagagagga

SEQ ID NO: 3592135 - DNA, 22 bp, Homo sapiens
agaaagtaagcatttccagcct

SEQ ID NO: 3592136 - DNA, 21 bp, Homo sapiens
agaaagtaatttaatttgtaa

SEQ ID NO: 3592137 - DNA, 18 bp, Homo sapiens
agaaagtgggaggtcagg

SEQ ID NO: 3592138 - DNA, 16 bp, Homo sapiens
agaaagtgtatttgga

SEQ ID NO: 3592139 - DNA, 15 bp, Homo sapiens
agaaataatggtctt

SEQ ID NO: 3592140 - DNA, 18 bp, Homo sapiens
agaaatatatttgtcact

SEQ ID NO: 3592141 - DNA, 12 bp, Homo sapiens
agaaatgcagaa

SEQ ID NO: 3592142 - DNA, 13 bp, Homo sapiens
agaaatgccccag

SEQ ID NO: 3592143 - DNA, 17 bp, Homo sapiens
agaaatgccccagtgtt

SEQ ID NO: 3592144 - DNA, 22 bp, Homo sapiens
agaaatggctaataaactttgt

SEQ ID NO: 3592145 - DNA, 21 bp, Homo sapiens
agaaatgtcttaatttttgaa

SEQ ID NO: 3592146 - DNA, 16 bp, Homo sapiens
agaaatttagagctaa

SEQ ID NO: 3592147 - DNA, 14 bp, Homo sapiens
agaacaaaacttct

SEQ ID NO: 3592148 - DNA, 12 bp, Homo sapiens
agaacaaacaaa

SEQ ID NO: 3592149 - DNA, 22 bp, Homo sapiens
agaacaacaaatatgttctctg

SEQ ID NO: 3592150 - DNA, 22 bp, Homo sapiens
agaacagcgggtacttatttct

SEQ ID NO: 3592151 - DNA, 14 bp, Homo sapiens
agaacatgaaatgc

SEQ ID NO: 3592152 - DNA, 18 bp, Homo sapiens
agaacattcagctctgga

SEQ ID NO: 3592153 - DNA, 18 bp, Homo sapiens
agaacattccatttgctt

SEQ ID NO: 3592154 - DNA, 21 bp, Homo sapiens
agaaccaaccagggaagctgt

SEQ ID NO: 3592155 - DNA, 17 bp, Homo sapiens
agaaccaataaaagtgg

SEQ ID NO: 3592156 - DNA, 14 bp, Homo sapiens
agaaccatgcagga

SEQ ID NO: 3592157 - DNA, 17 bp, Homo sapiens
agaacccctacatgaaa

SEQ ID NO: 3592158 - DNA, 19 bp, Homo sapiens
agaacccctacatgaaaca

SEQ ID NO: 3592159 - DNA, 19 bp, Homo sapiens
agaaccctgagcagggtcc

SEQ ID NO: 3592160 - DNA, 20 bp, Homo sapiens
agaacctctaagtgctgctg

SEQ ID NO: 3592161 - DNA, 22 bp, Homo sapiens
agaacctctaagtgctgctgtg

SEQ ID NO: 3592162 - DNA, 13 bp, Homo sapiens
agaacctggaact

SEQ ID NO: 3592163 - DNA, 18 bp, Homo sapiens
agaacgtggctctgctgg

SEQ ID NO: 3592164 - DNA, 19 bp, Homo sapiens
agaacgtggctctgctggc

SEQ ID NO: 3592165 - DNA, 23 bp, Homo sapiens
agaactattgtgctcagagacac

SEQ ID NO: 3592166 - DNA, 20 bp, Homo sapiens
agaactcaaatggggccaga

SEQ ID NO: 3592167 - DNA, 17 bp, Homo sapiens
agaactcctgtcttctt

SEQ ID NO: 3592168 - DNA, 19 bp, Homo sapiens
agaactcctgtcttctttc

SEQ ID NO: 3592169 - DNA, 18 bp, Homo sapiens
agaactgcccttgctgcc

SEQ ID NO: 3592170 - DNA, 21 bp, Homo sapiens
agaactgcccttgctgcccgc

SEQ ID NO: 3592171 - DNA, 15 bp, Homo sapiens
agaacttgctgcctc

SEQ ID NO: 3592172 - DNA, 22 bp, Homo sapiens
agaacttgctgctgccttcaca

SEQ ID NO: 3592173 - DNA, 14 bp, Homo sapiens
agaagaaaggactg

SEQ ID NO: 3592174 - DNA, 14 bp, Homo sapiens
agaagaagagaggc

SEQ ID NO: 3592175 - DNA, 17 bp, Homo sapiens
agaagaaggccagagag

SEQ ID NO: 3592176 - DNA, 18 bp, Homo sapiens
agaagaaggccagagagg

SEQ ID NO: 3592177 - DNA, 15 bp, Homo sapiens
agaagaatcttcctg

SEQ ID NO: 3592178 - DNA, 23 bp, Homo sapiens
agaagaatcttcctggcacaatg

SEQ ID NO: 3592179 - DNA, 14 bp, Homo sapiens
agaagaggagaaaa

SEQ ID NO: 3592180 - DNA, 20 bp, Homo sapiens
agaagaggagaaaaagaaga

SEQ ID NO: 3592181 - DNA, 18 bp, Homo sapiens
agaagagggcccagccca

SEQ ID NO: 3592182 - DNA, 19 bp, Homo sapiens
agaagagggcccagcccag

SEQ ID NO: 3592183 - DNA, 19 bp, Homo sapiens
agaagagttttagagaaaa
